United States Patent 10,988,754 (NUCLEIC ACID MOLECULES) - sequence listing, part 2

SEQ ID NO: 16171 - protein, 9 aa, Artificial Sequence
  Transmembrane emp24 domain-containing protein 9 (130-138)
SLFAGGMLR

SEQ ID NO: 16172 - protein, 10 aa, Artificial Sequence
  Splicing factor 3A subunit 3 (299-308)
SLFAKNPKSK

SEQ ID NO: 16173 - protein, 9 aa, Artificial Sequence
  Probable E3 ubiquitin-protein ligase HECTD4 (550-558)
SLFGGTSGL

SEQ ID NO: 16174 - protein, 9 aa, Artificial Sequence
  ADP-ribosylation factor 4 (7-15)
SLFSRLFGK

SEQ ID NO: 16175 - protein, 10 aa, Artificial Sequence
  Leukocyte tyrosine kinase receptor (149-158)
SLGLGESLYI

SEQ ID NO: 16176 - protein, 10 aa, Artificial Sequence
  PRELI domain containing protein 3A (115-124)
SLGSYLESLM

SEQ ID NO: 16177 - protein, 11 aa, Artificial Sequence
  Epidermal growth factor receptor kinase substrate 8 (115-125)
SLIDLESKNEL

SEQ ID NO: 16178 - protein, 10 aa, Artificial Sequence
  Sugar phosphate exchanger 3 (370-379)
SLIGYSLFSV

SEQ ID NO: 16179 - protein, 9 aa, Artificial Sequence
  Type I inositol 3,4-bisphosphate 4-phosphatase (107-115)
SLINQMTQV

SEQ ID NO: 16180 - protein, 9 aa, Artificial Sequence
  Kinectin (369-377)
SLKAHVQEV

SEQ ID NO: 16181 - protein, 9 aa, Artificial Sequence
  Dolichyl-diphosphooligosaccharide-proteinosyltransferase 48 kDa subunit (66-74)
SLKDRGFEL

SEQ ID NO: 16182 - protein, 9 aa, Artificial Sequence
  Gamma-interferon-inducible protein 16 (248-256)
SLKEKFNGK

SEQ ID NO: 16183 - protein, 9 aa, Artificial Sequence
  KN motif and ankyrin repeat domain-containing protein 1 (464-472)
SLKEKIYRL

SEQ ID NO: 16184 - protein, 10 aa, Artificial Sequence
  Histone-lysine N-methyltransferase NSD2 (177-186)
SLLEQGLVEA

SEQ ID NO: 16185 - protein, 12 aa, Artificial Sequence
  TSC22 domain family protein 1 (28-39)
SLLGTENASVRL

SEQ ID NO: 16186 - protein, 12 aa, Artificial Sequence
  Homocysteine-responsive endoplasmic reticulum-resident ubiquitin-like domain member 1 protein (221-232)
SLLPEGPPAIAN

SEQ ID NO: 16187 - protein, 9 aa, Artificial Sequence
  Ankyrin repeat and KH domain-containing protein 1 (2544-2552)
SLLPSVPAL

SEQ ID NO: 16188 - protein, 9 aa, Artificial Sequence
  E3 ubiquitin-protein ligase TRIM38 (21-29)
SLMTNPVSI

SEQ ID NO: 16189 - protein, 9 aa, Artificial Sequence
  Coiled-coil domain-containing protein 93 (321-329)
SLNKQIAQK

SEQ ID NO: 16190 - protein, 9 aa, Artificial Sequence
  Deubiquitinating protein VCIP135 (181-189)
SLNSNVYDV

SEQ ID NO: 16191 - protein, 9 aa, Artificial Sequence
  Disintegrin and metalloproteinase domain-containing protein 10 (100-108)
SLNTGIITV

SEQ ID NO: 16192 - protein, 9 aa, Artificial Sequence
  E3 ubiquitin-protein ligase BRE1B (149-157)
SLQNHNHQL

SEQ ID NO: 16193 - protein, 9 aa, Artificial Sequence
  DNA primase small subunit (265-273)
SLQRWEHLK

SEQ ID NO: 16194 - protein, 9 aa, Artificial Sequence
  Integrin alpha-3 (452-460)
SLSDHIVLL

SEQ ID NO: 16195 - protein, 9 aa, Artificial Sequence
  Pleckstrin homology-like domain family B member 2 (117-125)
SLSGYPLGR

SEQ ID NO: 16196 - protein, 9 aa, Artificial Sequence
  GDH/6PGL endoplasmic bifunctional protein (741-749)
SLSLPLINR

SEQ ID NO: 16197 - protein, 12 aa, Artificial Sequence
  26S proteasome non-ATPase regulatory subunit 3 (262-273)
SLYDQAEKLVSK

SEQ ID NO: 16198 - protein, 9 aa, Artificial Sequence
  Delta(24)-sterol reductase (399-407)
SLYHKLREK

SEQ ID NO: 16199 - protein, 13 aa, Artificial Sequence
  D-beta-hydroxybutyrate dehydrogenase, mitochondrial (246-258)
SLYSPESIQAIAK

SEQ ID NO: 16200 - protein, 9 aa, Artificial Sequence
  TATA box-binding protein-associated factor RNA polymerase I subunit B (255-263)
SLYWLSTQK

SEQ ID NO: 16201 - protein, 9 aa, Artificial Sequence
  Bifunctional 3'-phosphoadenosine 5'-phosphosulfate synthase 2 (537-545)
SMAPGLTSV

SEQ ID NO: 16202 - protein, 9 aa, Artificial Sequence
  Protein SON (1023-1031)
SMMSPMAER

SEQ ID NO: 16203 - protein, 9 aa, Artificial Sequence
  Small nuclear ribonucleoprotein Sm D1 (35-43)
SMNTHLKAV

SEQ ID NO: 16204 - protein, 9 aa, Artificial Sequence
  Ubiquitin carboxyl-terminal hydrolase isozyme L5 (131-139)
SNSDVIRQV

SEQ ID NO: 16205 - protein, 9 aa, Artificial Sequence
  Chloride channel CLIC-like protein 1 (324-332)
SPAAEKAQL

SEQ ID NO: 16206 - protein, 9 aa, Artificial Sequence
  Eukaryotic translation initiation factor 2A (347-355)
SPHGHILVL

SEQ ID NO: 16207 - protein, 11 aa, Artificial Sequence
  Zinc finger SWIM domain-containing protein 7 (59-69)
SPSGRRVYQVL

SEQ ID NO: 16208 - protein, 9 aa, Artificial Sequence
  Spermatogenesis-associated protein 20 (30-38)
SPTSRLNSL

SEQ ID NO: 16209 - protein, 9 aa, Artificial Sequence
  mRNA-decapping enzyme 1A (62-70)
SPYHGFTIV

SEQ ID NO: 16210 - protein, 9 aa, Artificial Sequence
  Complex I assembly factor TIMMDC1, mitochondrial (108-116)
SQAEIYHNR

SEQ ID NO: 16211 - protein, 11 aa, Artificial Sequence
  Centromere protein J (1081-1091)
SQISSGTQVEK

SEQ ID NO: 16212 - protein, 9 aa, Artificial Sequence
  G protein pathway suppressor 2 (319-327)
SQNPRFYHK

SEQ ID NO: 16213 - protein, 9 aa, Artificial Sequence
  T-complex protein 1 subunit eta (157-165)
SQQKAFFAK

SEQ ID NO: 16214 - protein, 10 aa, Artificial Sequence
  3-hydroxy-3-methylglutaryl-coenzyme A reductase (226-235)
SREGRPIWQL

SEQ ID NO: 16215 - protein, 9 aa, Artificial Sequence
  Protein CYR61 (3-11)
SRIARALAL

SEQ ID NO: 16216 - protein, 9 aa, Artificial Sequence
  Polyadenylate-binding protein 4 (289-297)
SRYQGVNLY

SEQ ID NO: 16217 - protein, 10 aa, Artificial Sequence
  NUMB protein (52-61)
SSATTSPFFK

SEQ ID NO: 16218 - protein, 9 aa, Artificial Sequence
  Nucleoporin GLE1 (16-24)
SSDKGRLCY

SEQ ID NO: 16219 - protein, 10 aa, Artificial Sequence
  Rho guanine nucleotide exchange factor 35 (173-182)
SSDNSGQTRY

SEQ ID NO: 16220 - protein, 9 aa, Artificial Sequence
  Integrin alpha-7 (233-241)
SSDPDQLVY

SEQ ID NO: 16221 - protein, 11 aa, Artificial Sequence
  Transcriptional coactivator YAP1 (331-341)
SSDPFLNSGTY

SEQ ID NO: 16222 - protein, 9 aa, Artificial Sequence
  Plastin-3 (113-121)
SSEGTQHSY

SEQ ID NO: 16223 - protein, 10 aa, Artificial Sequence
  Spermatogenesis-associated serine-rich protein 2 (123-132)
SSEKGGMNGY

SEQ ID NO: 16224 - protein, 11 aa, Artificial Sequence
  Myotubularin-related protein 14 (229-239)
SSEKVDKAQRY

SEQ ID NO: 16225 - protein, 9 aa, Artificial Sequence
  Liprin-beta-1 (506-514)
SSFGRGFFK

SEQ ID NO: 16226 - protein, 9 aa, Artificial Sequence
  Breast cancer type 2 susceptibility protein (661-669)
SSFGTILRK

SEQ ID NO: 16227 - protein, 9 aa, Artificial Sequence
  60S ribosomal protein L28 (14-22)
SSFLIKRNK

SEQ ID NO: 16228 - protein, 9 aa, Artificial Sequence
  AP-3 complex subunit mu-2 (10-18)
SSGDIFLEK

SEQ ID NO: 16229 - protein, 9 aa, Artificial Sequence
  Deoxynucleotidyltransferase terminal-interacting protein 2 (562-570)
SSIDPGLSI

SEQ ID NO: 16230 - protein, 9 aa, Artificial Sequence
  60S ribosomal protein L28 (91-99)
SSIRHMIRK

SEQ ID NO: 16231 - protein, 12 aa, Artificial Sequence
  Dermcidin (63-74)
SSLLEKGLDGAK

SEQ ID NO: 16232 - protein, 9 aa, Artificial Sequence
  Integrator complex subunit 3 (459-467)
SSLNHIVEK

SEQ ID NO: 16233 - protein, 9 aa, Artificial Sequence
  Retinoblastoma-like protein 2 (834-842)
SSLSLFFRK

SEQ ID NO: 16234 - protein, 10 aa, Artificial Sequence
  GATS-like protein 2 (89-98)
SSSQPIGVTK

SEQ ID NO: 16235 - protein, 11 aa, Artificial Sequence
  Synaptotagmin-like protein 2 (280-290)
SSSTDSETLRY

SEQ ID NO: 16236 - protein, 11 aa, Artificial Sequence
  WD repeat-containing protein 62 (49-59)
STASEETVQNR

SEQ ID NO: 16237 - protein, 9 aa, Artificial Sequence
  Cyclic AMP-responsive element-binding protein 3-like protein 2 (116-124)
STDFPSTSI

SEQ ID NO: 16238 - protein, 12 aa, Artificial Sequence
  ETS-related transcription factor Elf-1 (430-441)
STDPSAGTGSQK

SEQ ID NO: 16239 - protein, 10 aa, Artificial Sequence
  Epidermal growth factor receptor kinase substrate 8 (476-485)
STEHSSVSEY

SEQ ID NO: 16240 - protein, 9 aa, Artificial Sequence
  Nuclear receptor subfamily 2 group C member 2 (226-234)
STEKIYIRK

SEQ ID NO: 16241 - protein, 10 aa, Artificial Sequence
  V-type proton ATPase subunit H (296-305)
STERETRQEY

SEQ ID NO: 16242 - protein, 10 aa, Artificial Sequence
  Nucleolar protein 56 (354-363)
STFIGRAAAK

SEQ ID NO: 16243 - protein, 11 aa, Artificial Sequence
  Ankyrin repeat and KH domain-containing protein 1 (1842-1852)
STFQPANKLNK

SEQ ID NO: 16244 - protein, 11 aa, Artificial Sequence
  5-aminolevulinate synthase, nonspecific, mitochondrial (212-222)
STFQYDRFFEK

SEQ ID NO: 16245 - protein, 9 aa, Artificial Sequence
  Nuclear autoantigen Sp-100 (389-397)
STFRESFKK

SEQ ID NO: 16246 - protein, 10 aa, Artificial Sequence
  Zinc finger protein SNAI2 (138-147)
STFSGLAKHK

SEQ ID NO: 16247 - protein, 12 aa, Artificial Sequence
  Oxidative stress-responsive serine-rich protein 1 (96-107)
STIASSSSSQLK

SEQ ID NO: 16248 - protein, 9 aa, Artificial Sequence
  Clathrin interactor 1 (210-218)
STIDDTISK

SEQ ID NO: 16249 - protein, 11 aa, Artificial Sequence
  Ligand-dependent nuclear receptor-interacting factor 1 (338-348)
STIDPSGTRSK

SEQ ID NO: 16250 - protein, 10 aa, Artificial Sequence
  Regulation of nuclear pre-mRNA domain-containing protein 2 (942-951)
STIEFKNMLK

SEQ ID NO: 16251 - protein, 9 aa, Artificial Sequence
  Probable RNA-binding protein 23 (53-61)
STIGETSNR

SEQ ID NO: 16252 - protein, 12 aa, Artificial Sequence
  Hexokinase-2 (408-419)
STIGVDGSVYKK

SEQ ID NO: 16253 - protein, 11 aa, Artificial Sequence
  Transcription intermediary factor 1-alpha (597-607)
STIMLDNIVRK

SEQ ID NO: 16254 - protein, 9 aa, Artificial Sequence
  Tigger transposable element-derived protein 2 (379-387)
STITKAWKK

SEQ ID NO: 16255 - protein, 11 aa, Artificial Sequence
  Mediator of RNA polymerase II transcription subunit 20 (51-61)
STLGSQGQTGK

SEQ ID NO: 16256 - protein, 9 aa, Artificial Sequence
  KN motif and ankyrin repeat domain-containing protein 1 (972-980)
STLKSIMKK

SEQ ID NO: 16257 - protein, 11 aa, Artificial Sequence
  Alanine-tRNA ligase, cytoplasmic (3-13)
STLTASEIRQR

SEQ ID NO: 16258 - protein, 9 aa, Artificial Sequence
  Guanine nucleotide-binding protein G(I)/G(S)/G(O) subunit gamma-12 (7-15)
STNNIAQAR

SEQ ID NO: 16259 - protein, 9 aa, Artificial Sequence
  AP-3 complex subunit delta-1 (232-240)
STNNWVLIK

SEQ ID NO: 16260 - protein, 9 aa, Artificial Sequence
  Guanine nucleotide-binding protein G(I)/G(S)/G(O) subunit gamma-5 (55-63)
STNPFRPQK

SEQ ID NO: 16261 - protein, 11 aa, Artificial Sequence
  ATP synthase F(0) complex subunit B1, mitochondrial (228-238)
STQQEKETIAK

SEQ ID NO: 16262 - protein, 10 aa, Artificial Sequence
  Band 4.1-like protein 2 (78-87)
STTTTTHITK

SEQ ID NO: 16263 - protein, 9 aa, Artificial Sequence
  Mediator of RNA polymerase II transcription subunit 25 (129-137)
STVAPGSGL

SEQ ID NO: 16264 - protein, 9 aa, Artificial Sequence
  SEC14-like protein 1 (142-150)
STVEKIAMK

SEQ ID NO: 16265 - protein, 11 aa, Artificial Sequence
  Signal recognition particle 14 kDa protein (68-78)
STVVSSKEVNK

SEQ ID NO: 16266 - protein, 10 aa, Artificial Sequence
  Cleavage and polyadenylation specificity factor subunit 3 (66-75)
STYGTHIHEK

SEQ ID NO: 16267 - protein, 10 aa, Artificial Sequence
  DmX-like protein 2 (1766-1775)
STYISILNQK

SEQ ID NO: 16268 - protein, 11 aa, Artificial Sequence
  Lysosomal protective protein (339-349)
STYLNNPYVRK

SEQ ID NO: 16269 - protein, 10 aa, Artificial Sequence
  E3 ubiquitin-protein ligase HECTD1 (546-555)
STYNLQILTR

SEQ ID NO: 16270 - protein, 11 aa, Artificial Sequence
  Protein FAM84B (105-115)
STYTPENLLNK

SEQ ID NO: 16271 - protein, 10 aa, Artificial Sequence
  Lysine-specific demethylase 5B (847-856)
SVAQQLLNGK

SEQ ID NO: 16272 - protein, 9 aa, Artificial Sequence
  Perilipin-2 (129-137)
SVASTITGV

SEQ ID NO: 16273 - protein, 11 aa, Artificial Sequence
  Oral-facial-digital syndrome 1 protein (92-102)
SVFFPESGLAK

SEQ ID NO: 16274 - protein, 11 aa, Artificial Sequence
  Short coiled-coil protein (42-52)
SVFQTTDTKSK

SEQ ID NO: 16275 - protein, 9 aa, Artificial Sequence
  Centromere protein F (215-223)
SVFSWQQEK

SEQ ID NO: 16276 - protein, 11 aa, Artificial Sequence
  Probable 18S rRNA (guanine-N(7))-methyltransferase (228-238)
SVFTNERFPLR

SEQ ID NO: 16277 - protein, 12 aa, Artificial Sequence
  Protein FAN (644-655)
SVFTTSQDSTLK

SEQ ID NO: 16278 - protein, 9 aa, Artificial Sequence
  Acyl-CoA desaturase (245-253)
SVFVATFLR

SEQ ID NO: 16279 - protein, 9 aa, Artificial Sequence
  Nitric oxide synthase-interacting protein (147-155)
SVGPPSKDK

SEQ ID NO: 16280 - protein, 10 aa, Artificial Sequence
  V-type proton ATPase subunit d 1 (68-77)
SVIDDRLKEK

SEQ ID NO: 16281 - protein, 11 aa, Artificial Sequence
  Striatin (234-244)
SVIDTSTIVRK

SEQ ID NO: 16282 - protein, 11 aa, Artificial Sequence
  Phosducin-like protein (220-230)
SVIGASSQFTR

SEQ ID NO: 16283 - protein, 9 aa, Artificial Sequence
  Protein fuzzy homolog (41-49)
SVIGSLNGV

SEQ ID NO: 16284 - protein, 9 aa, Artificial Sequence
  MAP kinase-activating death domain protein (1140-1148)
SVIGVSPAV

SEQ ID NO: 16285 - protein, 9 aa, Artificial Sequence
  Tubby-related protein 3 (322-330)
SVIIPGMTL

SEQ ID NO: 16286 - protein, 9 aa, Artificial Sequence
  ETS-related transcription factor Elf-1 (531-539)
SVIKTQETK

SEQ ID NO: 16287 - protein, 9 aa, Artificial Sequence
  SEC14 domain and spectrin repeat-containing protein 1 (4-12)
SVILPILKK

SEQ ID NO: 16288 - protein, 9 aa, Artificial Sequence
  Serine/threonine-protein kinase RIO1 (130-138)
SVINKVTEK

SEQ ID NO: 16289 - protein, 9 aa, Artificial Sequence
  NHS-like protein 1 (635-643)
SVINVFVGR

SEQ ID NO: 16290 - protein, 11 aa, Artificial Sequence
  E3 ubiquitin-protein ligase Topors (307-317)
SVLGKDEQINK

SEQ ID NO: 16291 - protein, 9 aa, Artificial Sequence
  Nuclear pore complex protein Nup50 (280-288)
SVLGSLSSV

SEQ ID NO: 16292 - protein, 9 aa, Artificial Sequence
  Superkiller viralicidic activity 2-like 2 (759-767)
SVLKSIQEV

SEQ ID NO: 16293 - protein, 9 aa, Artificial Sequence
  Nuclear pore membraneoprotein 210 (659-667)
SVLNFATNR

SEQ ID NO: 16294 - protein, 12 aa, Artificial Sequence
  Little elongation complex subunit 1 (852-863)
SVLPNQVSVITK

SEQ ID NO: 16295 - protein, 11 aa, Artificial Sequence
  Lysine-specific demethylase 3A (512-522)
SVLTDPAKLKK

SEQ ID NO: 16296 - protein, 9 aa, Artificial Sequence
  Enhancer of mRNA-decapping protein 4 (927-935)
SVMAQVRQK

SEQ ID NO: 16297 - protein, 10 aa, Artificial Sequence
  Poly(U)-binding-splicing factor PUF60 (174-183)
SVMLGGRNIK

SEQ ID NO: 16298 - protein, 9 aa, Artificial Sequence
  TGF-beta-activated kinase 1 and MAP3K7-binding protein 2 (354-362)
SVNSQTLNR

SEQ ID NO: 16299 - protein, 10 aa, Artificial Sequence
  Rho GDP-dissociation inhibitor 1 (24-33)
SVNYKPPAQK

SEQ ID NO: 16300 - protein, 10 aa, Artificial Sequence
  LON peptidase N-terminal domain and RING finger protein 1 (418-427)
SVQEKGVLLK

SEQ ID NO: 16301 - protein, 9 aa, Artificial Sequence
  Kinesin-like protein KIF11 (750-758)
SVQENIQQK

SEQ ID NO: 16302 - protein, 9 aa, Artificial Sequence
  DNA topoisomerase 2-binding protein 1 (587-595)
SVQEYFVRK

SEQ ID NO: 16303 - protein, 9 aa, Artificial Sequence
  Zinc-binding alcohol dehydrogenase domain-containing protein 2 (299-307)
SVQGFFLNH

SEQ ID NO: 16304 - protein, 11 aa, Artificial Sequence
  E3 ubiquitin-protein ligase MARCH7 (13-23)
SVQPSSSLSAR

SEQ ID NO: 16305 - protein, 11 aa, Artificial Sequence
  MAP7 domain-containing protein 3 (532-542)
SVQSASSTVKK

SEQ ID NO: 16306 - protein, 10 aa, Artificial Sequence
  BRCA1-associated RING domain protein 1 (162-171)
SVQTQPAIKK

SEQ ID NO: 16307 - protein, 9 aa, Artificial Sequence
  DNA-directed RNA polymerase, mitochondrial (77-85)
SVSEVVVNR

SEQ ID NO: 16308 - protein, 10 aa, Artificial Sequence
  GAS2-like protein 3 (568-577)
SVSPVKATQK

SEQ ID NO: 16309 - protein, 9 aa, Artificial Sequence
  Lipoma-preferred partner (35-43)
SVSTQQPPK

SEQ ID NO: 16310 - protein, 9 aa, Artificial Sequence
  Probable 8-oxo-dGTP diphosphatase NUDT15 (78-86)
SVVNSFIEK

SEQ ID NO: 16311 - protein, 9 aa, Artificial Sequence
  Transmembrane and TPR repeat-containing protein 2 (627-635)
SVYKEAIQK

SEQ ID NO: 16312 - protein, 9 aa, Artificial Sequence
  Cytoplasmic dynein 1 heavy chain 1 (2957-2965)
SVYQIKVHR

SEQ ID NO: 16313 - protein, 9 aa, Artificial Sequence
  Tetratricopeptide repeat protein 28 (60-68)
SYHNYVLEL

SEQ ID NO: 16314 - protein, 9 aa, Artificial Sequence
  Long-chain-fatty-acid-CoA ligase 3 (616-624)
SYHSYVIGF

SEQ ID NO: 16315 - protein, 9 aa, Artificial Sequence
  14-3-3 protein beta/alpha (212-220)
SYKDSTLIM

SEQ ID NO: 16316 - protein, 9 aa, Artificial Sequence
  Serine/threonine-protein kinase 24 (88-96)
SYLKDTKLW

SEQ ID NO: 16317 - protein, 9 aa, Artificial Sequence
  Selenoprotein N (310-318)
SYLPFTEAF

SEQ ID NO: 16318 - protein, 9 aa, Artificial Sequence
  Zinc finger protein 383 (239-247)
SYLSQHQRI

SEQ ID NO: 16319 - protein, 9 aa, Artificial Sequence
  Tumor necrosis factor receptor superfamily member 3 (87-95)
SYNEHWNYL

SEQ ID NO: 16320 - protein, 9 aa, Artificial Sequence
  Transmembrane protein 39A (477-485)
SYPLNSYEL

SEQ ID NO: 16321 - protein, 9 aa, Artificial Sequence
  Tetraspanin-10 (217-225)
SYQDWQQNL

SEQ ID NO: 16322 - protein, 9 aa, Artificial Sequence
  Calcyclin-binding protein (124-132)
SYSMIVNNL

SEQ ID NO: 16323 - protein, 9 aa, Artificial Sequence
  Transmembrane protein 39A (363-371)
SYSNAPQHI

SEQ ID NO: 16324 - protein, 9 aa, Artificial Sequence
  Serine/threonine-protein kinase LATS2 (554-562)
SYSPYAFKF

SEQ ID NO: 16325 - protein, 9 aa, Artificial Sequence
  AF4/FMR2 family member 4 (1095-1103)
SYVQVTSNF

SEQ ID NO: 16326 - protein, 11 aa, Artificial Sequence
  Basement membrane-specific heparan sulfate proteoglycan core protein (176-186)
SYVTSPQGFQF

SEQ ID NO: 16327 - protein, 9 aa, Artificial Sequence
  Transcription factor BTF3 (82-90)
TADDKKLQF

SEQ ID NO: 16328 - protein, 9 aa, Artificial Sequence
  Dolichyl-diphosphooligosaccharide-proteinosyltransferase 48 kDa subunit (78-86)
TADDPSLSL

SEQ ID NO: 16329 - protein, 10 aa, Artificial Sequence
  Transducin beta-like protein 3 (197-206)
TADHNLLLYE

SEQ ID NO: 16330 - protein, 9 aa, Artificial Sequence
  Lymphocyte cytosolic protein 2 (227-235)
TAKLPAPSI

SEQ ID NO: 16331 - protein, 9 aa, Artificial Sequence
  Pyridine nucleotide-disulfide oxidoreductase domain-containing protein 1 (42-50)
TASPVIKAV

SEQ ID NO: 16332 - protein, 9 aa, Artificial Sequence
  Programmed cell death 6-interacting protein (658-666)
TAYDNFVEL

SEQ ID NO: 16333 - protein, 14 aa, Artificial Sequence
  Cullin-4B (24-37)
TDGNTSTTPPTSAK

SEQ ID NO: 16334 - protein, 9 aa, Artificial Sequence
  Putative sodium-coupled neutral amino acid transporter 10 (253-261)
TEATAGNVL

SEQ ID NO: 16335 - protein, 11 aa, Artificial Sequence
  Optineurin (373-383)
TEDEKSKLTVL

SEQ ID NO: 16336 - protein, 12 aa, Artificial Sequence
  Nuclear factor erythroid 2-related factor 2 (160-171)
TEDPNQLTVNSL

SEQ ID NO: 16337 - protein, 11 aa, Artificial Sequence
  Actin-related protein 2/3 complex subunit 1A (312-322)
TEDRNTALETL

SEQ ID NO: 16338 - protein, 9 aa, Artificial Sequence
  Dynactin subunit 2 (131-139)
TEEKLTPVL

SEQ ID NO: 16339 - protein, 10 aa, Artificial Sequence
  Dynactin subunit 2 (131-140)
TEEKLTPVLL

SEQ ID NO: 16340 - protein, 10 aa, Artificial Sequence
  Protein fuzzy homolog (371-380)
TEEPGTGVRL

SEQ ID NO: 16341 - protein, 11 aa, Artificial Sequence
  BRF1 protein (61-71)
TEFEDTPTSQL

SEQ ID NO: 16342 - protein, 10 aa, Artificial Sequence
  Dystonin (2514-2523)
TEIDSKWQEL

SEQ ID NO: 16343 - protein, 9 aa, Artificial Sequence
  Protein TBRG4 (216-224)
TEIEDSHTL

SEQ ID NO: 16344 - protein, 9 aa, Artificial Sequence
  RuvB-like 1 (44-52)
TEIKKTEVL

SEQ ID NO: 16345 - protein, 9 aa, Artificial Sequence
  MIF2 suppressor (12-20)
TENNDHINL

SEQ ID NO: 16346 - protein, 9 aa, Artificial Sequence
  Sodium/potassium-transporting ATPase subunit alpha-1 (206-214)
TENQSGVSF

SEQ ID NO: 16347 - protein, 9 aa, Artificial Sequence
  Eukaryotic translation initiation factor 3 subunit L (482-490)
TEQEFRIQL

SEQ ID NO: 16348 - protein, 10 aa, Artificial Sequence
  Golgi-associated PDZ and coiled-coil motif-containing protein (106-115)
TETQAEKVVL

SEQ ID NO: 16349 - protein, 10 aa, Artificial Sequence
  Dolichyl-diphosphooligosaccharide-proteinosyltransferase subunit 2 (371-380)
TEVGITNVDL

SEQ ID NO: 16350 - protein, 10 aa, Artificial Sequence
  Apoptosis-inducing factor 2 (163-172)
TEYPEKEVTL

SEQ ID NO: 16351 - protein, 9 aa, Artificial Sequence
  Fibronectin type III domain-containing protein 3B (635-643)
THLKPGTLY

SEQ ID NO: 16352 - protein, 9 aa, Artificial Sequence
  Transcription factor 12 (468-476)
THREDSVSL

SEQ ID NO: 16353 - protein, 9 aa, Artificial Sequence
  N-alpha-acetyltransferase 25, NatB auxiliary subunit (500-508)
THSPSNAQF

SEQ ID NO: 16354 - protein, 9 aa, Artificial Sequence
  Minor histocompatibility antigen H13 (287-295)
THTYFYTSF

SEQ ID NO: 16355 - protein, 9 aa, Artificial Sequence
  GLTSCR1-like protein (169-177)
THVPVGASF

SEQ ID NO: 16356 - protein, 9 aa, Artificial Sequence
  Asparagine synthetase (glutamine-hydrolyzing) (553-561)
THYKSAVKA

SEQ ID NO: 16357 - protein, 11 aa, Artificial Sequence
  Sorting nexin-18 (279-289)
TIDDPTKQTKF

SEQ ID NO: 16358 - protein, 9 aa, Artificial Sequence
  Clathrin interactor 1 (211-219)
TIDDTISKF

SEQ ID NO: 16359 - protein, 9 aa, Artificial Sequence
  Nucleolar GTP-binding protein 1 (163-171)
TIDPNTRTL

SEQ ID NO: 16360 - protein, 13 aa, Artificial Sequence
  Signal transducer and activator of transcription 5B (372-384)
TIISEQQAKSLLK

SEQ ID NO: 16361 - protein, 9 aa, Artificial Sequence
  Sorting nexin-14 (74-82)
TIKYKPKQL

SEQ ID NO: 16362 - protein, 11 aa, Artificial Sequence
  Heterogeneous nuclear ribonucleoproteins A2/B1 (164-174)
TINGHNAEVRK

SEQ ID NO: 16363 - protein, 10 aa, Artificial Sequence
  Similar to calcium-independent phospholipase A2 (165-174)
TIVNRGITPK

SEQ ID NO: 16364 - protein, 11 aa, Artificial Sequence
  Cytoplasmic dynein 1 heavy chain 1 (1281-1291)
TIYEGKFGRLK

SEQ ID NO: 16365 - protein, 9 aa, Artificial Sequence
  Melanoma-associated antigen D1 (153-161)
TKVGPNATY

SEQ ID NO: 16366 - protein, 9 aa, Artificial Sequence
  Calmodulin-binding transcription activator 1 (1179-1187)
TLAEHIIEA

SEQ ID NO: 16367 - protein, 12 aa, Artificial Sequence
  Syndecan-3 (348-359)
TLEEPKQASVTY

SEQ ID NO: 16368 - protein, 12 aa, Artificial Sequence
  Septin-7 (426-437)
TLEKNKKKGKIF

SEQ ID NO: 16369 - protein, 11 aa, Artificial Sequence
  Histone-lysine N-methyltransferase ASH1L (2959-2969)
TLFIPENSFRK

SEQ ID NO: 16370 - protein, 11 aa, Artificial Sequence
  Uncharacterized protein C1orf198 (300-310)
TLFSEPKFAQV

SEQ ID NO: 16371 - protein, 11 aa, Artificial Sequence
  Signal recognition particle receptor subunit beta (114-124)
TLIDLPGHESL

SEQ ID NO: 16372 - protein, 9 aa, Artificial Sequence
  Conserved oligomeric Golgi complex subunit 5 (271-279)
TLKDTITSV

SEQ ID NO: 16373 - protein, 9 aa, Artificial Sequence
  Transcription intermediary factor 1-beta (187-195)
TLQKSTKEV

SEQ ID NO: 16374 - protein, 9 aa, Artificial Sequence
  Cell division cycle protein 20 homolog (304-312)
TLSGHSQEV

SEQ ID NO: 16375 - protein, 9 aa, Artificial Sequence
  Zinc finger BED domain-containing protein 4 (953-961)
TLSQVIPMV

SEQ ID NO: 16376 - protein, 9 aa, Artificial Sequence
  Ubiquitin-60S ribosomal protein L40 (12-20)
TLTGKTITL

SEQ ID NO: 16377 - protein, 9 aa, Artificial Sequence
  Sodium/potassium-transporting ATPase subunit alpha-3 (782-790)
TLTSNIPEI

SEQ ID NO: 16378 - protein, 11 aa, Artificial Sequence
  Putative heat shock protein HSP 90-beta 2 (85-95)
TLVDTGIGMTK

SEQ ID NO: 16379 - protein, 11 aa, Artificial Sequence
  Lathosterol oxidase (245-255)
TLWDRIGGSFK

SEQ ID NO: 16380 - protein, 9 aa, Artificial Sequence
  Nicotinamide phosphoribosyltransferase (435-443)
TPAGNFVTL

SEQ ID NO: 16381 - protein, 9 aa, Artificial Sequence
  SH3 domain-containing protein 19 (137-145)
TPAPRPLLL

SEQ ID NO: 16382 - protein, 9 aa, Artificial Sequence
  Ephrin-A5 (207-215)
TPRIPSRLL

SEQ ID NO: 16383 - protein, 9 aa, Artificial Sequence
  40S ribosomal protein S2 (285-293)
TQAPAVATT

SEQ ID NO: 16384 - protein, 9 aa, Artificial Sequence
  RNA-binding protein EWS (33-41)
TQAYGQQSY

SEQ ID NO: 16385 - protein, 9 aa, Artificial Sequence
  28S ribosomal protein S12, mitochondrial (115-123)
TQDLPGVKL

SEQ ID NO: 16386 - protein, 11 aa, Artificial Sequence
  Synphilin-1 (60-70)
TQKPTGIADVY

SEQ ID NO: 16387 - protein, 9 aa, Artificial Sequence
  U5 small nuclear ribonucleoprotein 200 kDa helicase (1765-1773)
TQNPNYYNL

SEQ ID NO: 16388 - protein, 9 aa, Artificial Sequence
  SWI/SNF-related matrix-associated actin-dependent regulator of chromatin subfamily D member 1 (436-444)
TQREFMLSF

SEQ ID NO: 16389 - protein, 9 aa, Artificial Sequence
  Protein FAM204A (125-133)
TQWKELTQY

SEQ ID NO: 16390 - protein, 9 aa, Artificial Sequence
  Cytoskeleton-associated protein 2 (274-282)
TSANVTIRK

SEQ ID NO: 16391 - protein, 9 aa, Artificial Sequence
  Uncharacterized protein KIAA2013 (598-606)
TSAPTGHTF

SEQ ID NO: 16392 - protein, 9 aa, Artificial Sequence
  Long-chain-fatty-acid-CoA ligase 4 (10-18)
TSDKPGSPY

SEQ ID NO: 16393 - protein, 9 aa, Artificial Sequence
  Zinc finger MYM-type protein 1 (293-301)
TSDLGKTEL

SEQ ID NO: 16394 - protein, 9 aa, Artificial Sequence
  Importin subunit alpha-4 (81-89)
TSDNPVVQL

SEQ ID NO: 16395 - protein, 9 aa, Artificial Sequence
  Dual specificity mitogen-activated protein kinase kinase 3 (150-158)
TSLDKFYRK

SEQ ID NO: 16396 - protein, 11 aa, Artificial Sequence
  Prothymosin alpha (8-18)
TSSEITTKDLK

SEQ ID NO: 16397 - protein, 9 aa, Artificial Sequence
  Histone-lysine N-methyltransferase SETD2 (1436-1444)
TSVPPGSAL

SEQ ID NO: 16398 - protein, 9 aa, Artificial Sequence
  Metastasis-associated protein MTA2 (312-320)
TTDRYIQQK

SEQ ID NO: 16399 - protein, 9 aa, Artificial Sequence
  Cyclin-dependent kinase 1 (25-33)
TTGQVVAMK

SEQ ID NO: 16400 - protein, 11 aa, Artificial Sequence
  ATP-dependent RNA helicase DHX8 (1166-1176)
TTIDPRWLVEF

SEQ ID NO: 16401 - protein, 9 aa, Artificial Sequence
  Splicing factor 3A subunit 1 (123-131)
TTQQQLPQK

SEQ ID NO: 16402 - protein, 9 aa, Artificial Sequence
  Germinal-center associated nuclear protein (203-211)
TTSNFTFSK

SEQ ID NO: 16403 - protein, 9 aa, Artificial Sequence
  Vacuolar protein sorting-associated protein 35 (375-383)
TTVEIFNKL

SEQ ID NO: 16404 - protein, 10 aa, Artificial Sequence
  Eukaryotic translation initiation factor 3 subunit L (353-362)
TTYKYEMINK

SEQ ID NO: 16405 - protein, 9 aa, Artificial Sequence
  Cofilin-1 (12-20)
TVDDPYATF

SEQ ID NO: 16406 - protein, 9 aa, Artificial Sequence
  CCAAT/enhancer-binding protein beta (266-274)
TVDKHSDEY

SEQ ID NO: 16407 - protein, 11 aa, Artificial Sequence
  WD repeat-containing protein 48 (379-389)
TVDKNMPKFNK

SEQ ID NO: 16408 - protein, 9 aa, Artificial Sequence
  TRAF2 and NCK-interacting protein kinase (352-360)
TVEEGQRLK

SEQ ID NO: 16409 - protein, 10 aa, Artificial Sequence
  Nicotinamide phosphoribosyltransferase (460-469)
TVFKNGKVTK

SEQ ID NO: 16410 - protein, 9 aa, Artificial Sequence
  E3 ubiquitin-protein ligase RNF213 (4830-4838)
TVFLSTWNK

SEQ ID NO: 16411 - protein, 9 aa, Artificial Sequence
  Chromatin assembly factor 1 subunit B (444-452)
TVIRDPPSI

SEQ ID NO: 16412 - protein, 9 aa, Artificial Sequence
  Glycine-tRNA ligase (350-358)
TVLGYFIGR

SEQ ID NO: 16413 - protein, 11 aa, Artificial Sequence
  Beta-lactamase-like protein 2 (237-247)
TVMELVKIIYK

SEQ ID NO: 16414 - protein, 9 aa, Artificial Sequence
  Probable U3 small nucleolar RNA-associated protein 11 (238-246)
TVNSPAIYK

SEQ ID NO: 16415 - protein, 10 aa, Artificial Sequence
  Complex I assembly factor TIMMDC1, mitochondrial (151-160)
TVNTSLNVYR

SEQ ID NO: 16416 - protein, 9 aa, Artificial Sequence
  Coiled-coil domain-containing protein 66 (124-132)
TVNTSLVGK

SEQ ID NO: 16417 - protein, 9 aa, Artificial Sequence
  Exportin-1 (648-656)
TVQEHLIEK

SEQ ID NO: 16418 - protein, 9 aa, Artificial Sequence
  SWI/SNF-related matrix-associated actin-dependent regulator of chromatin subfamily A containing DEAD/H box 1 (109-117)
TVQEKTFNK

SEQ ID NO: 16419 - protein, 9 aa, Artificial Sequence
  Collagen alpha-3(VI) chain (2723-2731)
TVRPPVAVK

SEQ ID NO: 16420 - protein, 9 aa, Artificial Sequence
  Cleavage and polyadenylation specificity factor subunit 3 (440-448)
TVTTVILEV

SEQ ID NO: 16421 - protein, 11 aa, Artificial Sequence
  Transformation/transcription domain-associated protein (10-20)
TVVDQTTLMKK

SEQ ID NO: 16422 - protein, 12 aa, Artificial Sequence
  Endoplasmic reticulum-Golgi intermediate compartment protein 1 (103-114)
TVYEDKSGKQRY

SEQ ID NO: 16423 - protein, 12 aa, Artificial Sequence
  HIG1 domain family member 2A, mitochondrial (27-38)
TVYRNPESFKEK

SEQ ID NO: 16424 - protein, 9 aa, Artificial Sequence
  Neuroblastoma-amplified sequence (1950-1958)
TYADTLNHL

SEQ ID NO: 16425 - protein, 9 aa, Artificial Sequence
  Dystonin (672-680)
TYAEKLHRL

SEQ ID NO: 16426 - protein, 9 aa, Artificial Sequence
  Unconventional myosin-Va (386-394)
TYIKPISKL

SEQ ID NO: 16427 - protein, 9 aa, Artificial Sequence
  Protein transport protein Sec24B (640-648)
TYINPFVSF

SEQ ID NO: 16428 - protein, 11 aa, Artificial Sequence
  MORN repeat-containing protein 1 (177-187)
TYKGQWHSDVF

SEQ ID NO: 16429 - protein, 9 aa, Artificial Sequence
  Nesprin-2 (2589-2597)
TYLDKIKKF

SEQ ID NO: 16430 - protein, 9 aa, Artificial Sequence
  Interferon-induced protein with tetratricopeptide repeats 1 (116-124)
TYLDKVENI

SEQ ID NO: 16431 - protein, 9 aa, Artificial Sequence
  Putative UDP-GlcNAc:betaGal beta-1,3-N-acetylglucosaminyltransferase LOC100288842 (347-355)
TYLDSFKRF

SEQ ID NO: 16432 - protein, 11 aa, Artificial Sequence
  Tenascin (710-720)
TYLPAPEGLKF

SEQ ID NO: 16433 - protein, 9 aa, Artificial Sequence
  Mid1-interacting protein 1 (6-14)
TYNQKHSLF

SEQ ID NO: 16434 - protein, 9 aa, Artificial Sequence
  Glycogenin-2 (121-129)
TYSPAFKQF

SEQ ID NO: 16435 - protein, 9 aa, Artificial Sequence
  60S ribosomal protein L28 (24-32)
TYSTEPNNL

SEQ ID NO: 16436 - protein, 11 aa, Artificial Sequence
  Vacuolar protein sorting-associated protein 13B (523-533)
TYTEIAGMQRF

SEQ ID NO: 16437 - protein, 9 aa, Artificial Sequence
  5'-3' exoribonuclease 1 (313-321)
TYVTILPEL

SEQ ID NO: 16438 - protein, 9 aa, Artificial Sequence
  EF-hand calcium-binding domain-containing protein 11 (105-113)
TYYRGFLTL

SEQ ID NO: 16439 - protein, 9 aa, Artificial Sequence
  Exocyst complex component 4 (15-23)
VAAAHSVVL

SEQ ID NO: 16440 - protein, 9 aa, Artificial Sequence
  Pre-mRNA-splicing factor RBM22 (282-290)
VAAEKSFNK

SEQ ID NO: 16441 - protein, 9 aa, Artificial Sequence
  Protein disulfide-isomerase A4 (76-84)
VADKDTVLL

SEQ ID NO: 16442 - protein, 10 aa, Artificial Sequence
  Dolichyl-diphosphooligosaccharide-proteinosyltransferase 48 kDa subunit (203-212)
VADPDNPLVL

SEQ ID NO: 16443 - protein, 11 aa, Artificial Sequence
  KN motif and ankyrin repeat domain-containing protein 2 (489-499)
VADPTAHRRSL

SEQ ID NO: 16444 - protein, 9 aa, Artificial Sequence
  40S ribosomal protein S5 (11-19)
VAETPDIKL

SEQ ID NO: 16445 - protein, 9 aa, Artificial Sequence
  ATP-dependent 6-phosphofructokinase, liver type (717-725)
VAFSPVTEL

SEQ ID NO: 16446 - protein, 9 aa, Artificial Sequence
  Inosine-5'-monophosphate dehydrogenase 2 (219-227)
VAIIARTDL

SEQ ID NO: 16447 - protein, 9 aa, Artificial Sequence
  Transmembrane protein 41B (243-251)
VAIKAGTTL

SEQ ID NO: 16448 - protein, 11 aa, Artificial Sequence
  Importin-9 (102-112)
VAMSPELIQQF

SEQ ID NO: 16449 - protein, 9 aa, Artificial Sequence
  Cytochrome c oxidase subunit 7A2, mitochondrial (75-83)
VASFPKKQE

SEQ ID NO: 16450 - protein, 9 aa, Artificial Sequence
  Transketolase (365-373)
VATEKAVEL

SEQ ID NO: 16451 - protein, 9 aa, Artificial Sequence
  Hydroxyacylglutathione hydrolase-like protein (26-34)
VAVDVAVPK

SEQ ID NO: 16452 - protein, 14 aa, Artificial Sequence
  Myosin-9 (1950-1963)
VDGKADGAEAKPAE

SEQ ID NO: 16453 - protein, 9 aa, Artificial Sequence
  StAR-related lipid transfer protein 13 (841-849)
VEAPPSVVL

SEQ ID NO: 16454 - protein, 10 aa, Artificial Sequence
  Cytoplasmic dynein 1 heavy chain 1 (236-245)
VEDPTFLNQL

SEQ ID NO: 16455 - protein, 10 aa, Artificial Sequence
  Protein strawberry notch homolog 1 (1087-1096)
VEDRSGILTL

SEQ ID NO: 16456 - protein, 11 aa, Artificial Sequence
  Condensin complex subunit 3 (683-693)
VEETATAKNVL

SEQ ID NO: 16457 - protein, 10 aa, Artificial Sequence
  Serine/threonine-protein phosphatase 2A 55 kDa regulatory subunit B alpha isoform (34-43)
VEFNHSGELL

SEQ ID NO: 16458 - protein, 11 aa, Artificial Sequence
  Dynactin subunit 3 (113-123)
VEITEESKALL

SEQ ID NO: 16459 - protein, 11 aa, Artificial Sequence
  Coatomer subunit delta (229-239)
VENEDKKGVQL

SEQ ID NO: 16460 - protein, 12 aa, Artificial Sequence
  Transmembrane emp24 domain-containing protein 4 (79-90)
VEVKDPDGKVVL

SEQ ID NO: 16461 - protein, 10 aa, Artificial Sequence
  Neuroblast differentiation-associated protein AHNAK (866-875)
VEVQGPDWHL

SEQ ID NO: 16462 - protein, 9 aa, Artificial Sequence
  Coatomer subunit alpha (256-264)
VFHPRQELI

SEQ ID NO: 16463 - protein, 9 aa, Artificial Sequence
  Alpha-internexin (107-115)
VFIEKVHQL

SEQ ID NO: 16464 - protein, 9 aa, Artificial Sequence
  Protein unc-119 homolog B (162-170)
VGDKPVSNF

SEQ ID NO: 16465 - protein, 9 aa, Artificial Sequence
  Dehydrogenase/reductase SDR family member on chromosome X (20-28)
VILAQLLRR

SEQ ID NO: 16466 - protein, 10 aa, Artificial Sequence
  Transcription initiation factor IIA subunit 1 (21-30)
VINDVRDIFL

SEQ ID NO: 16467 - protein, 9 aa, Artificial Sequence
  Protein FAM208B (1046-1054)
VINPEPITL

SEQ ID NO: 16468 - protein, 9 aa, Artificial Sequence
  Copine-2 (523-531)
VLAELPQQV

SEQ ID NO: 16469 - protein, 11 aa, Artificial Sequence
  High affinity cationic amino acid transporter 1 (147-157)
VLAENPDIFAV

SEQ ID NO: 16470 - protein, 13 aa, Artificial Sequence
  Neudesin (19-31)
VLALAPGLPTARA

SEQ ID NO: 16471 - protein, 13 aa, Artificial Sequence
  Activating signal cointegrator 1 complex subunit 2 (166-178)
VLFGKGNSPLLQK

SEQ ID NO: 16472 - protein, 11 aa, Artificial Sequence
  Acyl-CoA:lysophosphatidylglycerol acyltransferase 1 (180-190)
VLFPEGGFLRK

SEQ ID NO: 16473 - protein, 9 aa, Artificial Sequence
  Importin-7 (169-177)
VLIQKQIFK

SEQ ID NO: 16474 - protein, 9 aa, Artificial Sequence
  Tight junction protein ZO-1 (1634-1642)
VLSSIETGV

SEQ ID NO: 16475 - protein, 9 aa, Artificial Sequence
  Interleukin-4 receptor subunit alpha (335-343)
VLWPESISV

SEQ ID NO: 16476 - protein, 12 aa, Artificial Sequence
  Dolichyl-diphosphooligosaccharide-proteinosyltransferase subunit 4 (23-34)
VLYHYVAVNNPK

SEQ ID NO: 16477 - protein, 11 aa, Artificial Sequence
  Clathrin heavy chain 1 (788-798)
VLYLYRNNLQK

SEQ ID NO: 16478 - protein, 9 aa, Artificial Sequence
  ADNP homeobox protein 2 (968-976)
VMHDSSFSV

SEQ ID NO: 16479 - protein, 10 aa, Artificial Sequence
  Myosin-10 (1967-1976)
VNETQPPQSE

SEQ ID NO: 16480 - protein, 9 aa, Artificial Sequence
  Fas-activated serine/threonine kinase (383-391)
VPIFPQPLI

SEQ ID NO: 16481 - protein, 11 aa, Artificial Sequence
  DNA-(apurinic or apyrimidinic site) lyase (172-182)
VPNAGRGLVRL

SEQ ID NO: 16482 - protein, 9 aa, Artificial Sequence
  Eukaryotic translation initiation factor 3 subunit A (428-436)
VPQLQNNTI

SEQ ID NO: 16483 - protein, 9 aa, Artificial Sequence
  Zinc finger CCCH domain-containing protein 7A (237-245)
VPVMPLTSI

SEQ ID NO: 16484 - protein, 8 aa, Artificial Sequence
  Cellular tumor antigen p53 (218-225)
VPYEPPEV

SEQ ID NO: 16485 - protein, 9 aa, Artificial Sequence
  40S ribosomal protein S11 (120-128)
VQIGDIVTV

SEQ ID NO: 16486 - protein, 9 aa, Artificial Sequence
  Golgin-45 (153-161)
VQTEVNREL

SEQ ID NO: 16487 - protein, 9 aa, Artificial Sequence
  Centrosomal protein of 192 kDa (314-322)
VRNPRITSL

SEQ ID NO: 16488 - protein, 9 aa, Artificial Sequence
  Oxidoreductase HTATIP2 (105-113)
VRVDRDYVL

SEQ ID NO: 16489 - protein, 9 aa, Artificial Sequence
  Serine/threonine-protein phosphatase 4 catalytic subunit (102-110)
VRYPDRITL

SEQ ID NO: 16490 - protein, 9 aa, Artificial Sequence
  Phosphorylated CTD-interacting factor 1 (411-419)
VSAPPMPSV

SEQ ID NO: 16491 - protein, 9 aa, Artificial Sequence
  Protein prenyltransferase alpha subunit repeat-containing protein 1 (214-222)
VSDHSGFHY

SEQ ID NO: 16492 - protein, 12 aa, Artificial Sequence
  Nuclear protein localization protein 4 homolog (316-327)
VSEDTRKGTVRY

SEQ ID NO: 16493 - protein, 9 aa, Artificial Sequence
  Neuronal regeneration-related protein (79-87)
VSQEPFPNK

SEQ ID NO: 16494 - protein, 9 aa, Artificial Sequence
  Mannosyl-oligosaccharide glucosidase (210-218)
VTDGKEVLL

SEQ ID NO: 16495 - protein, 9 aa, Artificial Sequence
  Attractin (8-16)
VTDGPGNYK

SEQ ID NO: 16496 - protein, 9 aa, Artificial Sequence
  U3 small nucleolar ribonucleoprotein protein IMP3 (23-31)
VTDHNLHEL

SEQ ID NO: 16497 - protein, 9 aa, Artificial Sequence
  Protocadherin Fat 1 (1217-1225)
VTDNGSPPK

SEQ ID NO: 16498 - protein, 10 aa, Artificial Sequence
  Death-inducer obliterator 1 (716-725)
VTDNRYKSKY

SEQ ID NO: 16499 - protein, 11 aa, Artificial Sequence
  Fructose-bisphosphate aldolase A (87-97)
VTEKVLAAVYK

SEQ ID NO: 16500 - protein, 11 aa, Artificial Sequence
  Prefoldin subunit 4 (11-21)
VTFEDQQKINK

SEQ ID NO: 16501 - protein, 11 aa, Artificial Sequence
  Phosphoserine aminotransferase (349-359)
VTIEDVQKLAA

SEQ ID NO: 16502 - protein, 13 aa, Artificial Sequence
  Phosphate carrier protein, mitochondrial (107-119)
VTLKEDGVRGLAK

SEQ ID NO: 16503 - protein, 10 aa, Artificial Sequence
  Apoptosis inhibitor 5 (368-377)
VTLSWKPVQK

SEQ ID NO: 16504 - protein, 10 aa, Artificial Sequence
  Small subunit processome component 20 homolog (830-839)
VTNPDIAAKK

SEQ ID NO: 16505 - protein, 9 aa, Artificial Sequence
  Putative PIP5K1A and PSMD4-like protein (656-664)
VTVPPGPSL

SEQ ID NO: 16506 - protein, 10 aa, Artificial Sequence
  Something about silencing protein 10 (302-311)
VTYRNLINKL

SEQ ID NO: 16507 - protein, 9 aa, Artificial Sequence
  116 kDa U5 small nuclear ribonucleoprotein component (795-803)
VVAQEPLHR

SEQ ID NO: 16508 - protein, 9 aa, Artificial Sequence
  E3 ubiquitin-protein ligase TRIM23 (309-317)
VVDAHVREK

SEQ ID NO: 16509 - protein, 9 aa, Artificial Sequence
  X-ray repair cross-complementing protein 5 (174-182)
VVDAKTLKK

SEQ ID NO: 16510 - protein, 12 aa, Artificial Sequence
  DNA damage-binding protein 1 (364-375)
VVDLERQGQGQL

SEQ ID NO: 16511 - protein, 11 aa, Artificial Sequence
  Vacuolar protein sorting-associated protein 45 (3-13)
VVFAVKQYISK

SEQ ID NO: 16512 - protein, 11 aa, Artificial Sequence
  60S ribosomal protein L8 (15-25)
VVFRDPYRFKK

SEQ ID NO: 16513 - protein, 10 aa, Artificial Sequence
  Rho-related BTB domain-containing protein 3 (256-265)
VVFYNPNLKK

SEQ ID NO: 16514 - protein, 11 aa, Artificial Sequence
  Protein FAM171B (18-28)
VVLLKARLVPA

SEQ ID NO: 16515 - protein, 11 aa, Artificial Sequence
  Clathrin interactor 1 (17-27)
VVMNYSEIESK

SEQ ID NO: 16516 - protein, 11 aa, Artificial Sequence
  Protein disulfide-isomerase A4 (356-366)
VVMQPEKFQSK

SEQ ID NO: 16517 - protein, 10 aa, Artificial Sequence
  Sulfate anion transporter 1 (417-426)
VVSATVVLLV

SEQ ID NO: 16518 - protein, 9 aa, Artificial Sequence
  26S proteasome non-ATPase regulatory subunit 14 (143-151)
VVVDPIQSV

SEQ ID NO: 16519 - protein, 9 aa, Artificial Sequence
  Sodium/potassium-transporting ATPase subunit alpha-1 (185-193)
VVVGDLVEV

SEQ ID NO: 16520 - protein, 9 aa, Artificial Sequence
  Receptor tyrosine-protein kinase erbB-3 (147-155)
VYIEKNDKL

SEQ ID NO: 16521 - protein, 9 aa, Artificial Sequence
  Uncharacterized protein C5orf42 (702-710)
VYILQPEVI

SEQ ID NO: 16522 - protein, 10 aa, Artificial Sequence
  Small nuclear ribonucleoprotein Sm D3 (61-70)
VYIRGSKIRF

SEQ ID NO: 16523 - protein, 9 aa, Artificial Sequence
  Selenoprotein K (56-64)
VYISNGQVL

SEQ ID NO: 16524 - protein, 9 aa, Artificial Sequence
  Fibronectin type III domain-containing protein 3B (651-659)
VYKGEEATF

SEQ ID NO: 16525 - protein, 8 aa, Artificial Sequence
  Transmembrane protein 41B (71-78)
VYKNFPQL

SEQ ID NO: 16526 - protein, 9 aa, Artificial Sequence
  Surfeit locus protein 4 (220-228)
VYKPMHDFL

SEQ ID NO: 16527 - protein, 10 aa, Artificial Sequence
  Mitogen-activated protein kinase-binding protein 1 (356-365)
VYNDHSIYVW

SEQ ID NO: 16528 - protein, 9 aa, Artificial Sequence
  CMP-N-acetylneuraminate-beta-galactosamide-alpha-2,3-sialyltransf erase 1 (190-198)
VYPESFREL

SEQ ID NO: 16529 - protein, 9 aa, Artificial Sequence
  Inactive tyrosine-protein kinase 7 (603-611)
VYQGHTALL

SEQ ID NO: 16530 - protein, 9 aa, Artificial Sequence
  Bcl-2 homologous antagonist/killer (142-150)
VYQHGLTGF

SEQ ID NO: 16531 - protein, 9 aa, Artificial Sequence
  Rho GTPase-activating protein 5 (413-421)
VYQNHVQHL

SEQ ID NO: 16532 - protein, 9 aa, Artificial Sequence
  Mitochondrial peptide methionine sulfoxide reductase (82-90)
VYQPEHMSF

SEQ ID NO: 16533 - protein, 11 aa, Artificial Sequence
  Complex I assembly factor TIMMDC1, mitochondrial (158-168)
VYRNKDALSHF

SEQ ID NO: 16534 - protein, 10 aa, Artificial Sequence
  Unconventional myosin-XVIIIa (453-462)
VYSEKVMHMF

SEQ ID NO: 16535 - protein, 10 aa, Artificial Sequence
  Latent-transforming growth factor beta-binding protein 3 (448-457)
VYSSAEFHSL

SEQ ID NO: 16536 - protein, 9 aa, Artificial Sequence
  Uncharacterized protein C11orf80 (292-300)
VYTLLTTHL

SEQ ID NO: 16537 - protein, 9 aa, Artificial Sequence
  Integrin alpha-11 (440-448)
VYVAGAPRF

SEQ ID NO: 16538 - protein, 9 aa, Artificial Sequence
  Angiomotin (598-606)
VYVDKVEKM

SEQ ID NO: 16539 - protein, 9 aa, Artificial Sequence
  Early endosome antigen 1 (285-293)
VYVQELQKL

SEQ ID NO: 16540 - protein, 9 aa, Artificial Sequence
  Transformation/transcription domain-associated protein (1973-1981)
VYYPVRHHL

SEQ ID NO: 16541 - protein, 9 aa, Artificial Sequence
  Actin-binding protein anillin (212-220)
WEDDVNHSF

SEQ ID NO: 16542 - protein, 9 aa, Artificial Sequence
  AP-5 complex subunit zeta-1 (1307-1315)
YAAGVHSVL

SEQ ID NO: 16543 - protein, 10 aa, Artificial Sequence
  Proline-rich protein 12 (50-59)
YAAPHPLQSY

SEQ ID NO: 16544 - protein, 9 aa, Artificial Sequence
  A-kinase anchor protein 12 (1228-1236)
YADEKTKDV

SEQ ID NO: 16545 - protein, 9 aa, Artificial Sequence
  Maturin (34-42)
YADPGVSFY

SEQ ID NO: 16546 - protein, 9 aa, Artificial Sequence
  Integrin alpha-V (110-118)
YAKDDPLEF

SEQ ID NO: 16547 - protein, 9 aa, Artificial Sequence
  Ras-related protein Rab-1B (43-51)
YASENVNKL

SEQ ID NO: 16548 - protein, 9 aa, Artificial Sequence
  Acetyl-CoA carboxylase 2 (1068-1076)
YASNITSVL

SEQ ID NO: 16549 - protein, 10 aa, Artificial Sequence
  Translocon-associated protein subunit beta (33-42)
YAVEGRDLTL

SEQ ID NO: 16550 - protein, 8 aa, Artificial Sequence
  Melanoma-associated antigen B2 (233-240)
YDGEEHSV

SEQ ID NO: 16551 - protein, 11 aa, Artificial Sequence
  Protein phosphatase 1A (59-69)
YDGHAGSQVAK

SEQ ID NO: 16552 - protein, 9 aa, Artificial Sequence
  NAD(P)H dehydrogenase (quinone) 1 (130-138)
YDKGPFRSK

SEQ ID NO: 16553 - protein, 10 aa, Artificial Sequence
  Proteasome subunit beta type-4 (177-186)
YEAPSLATGY

SEQ ID NO: 16554 - protein, 9 aa, Artificial Sequence
  RNA-binding motif protein, X-linked 2 (84-92)
YEDQRSTIL

SEQ ID NO: 16555 - protein, 9 aa, Artificial Sequence
  SAP30-binding protein (41-49)
YGEDDFSRL

SEQ ID NO: 16556 - protein, 9 aa, Artificial Sequence
  Tubulin-specific chaperone C (219-227)
YGNPNTLRL

SEQ ID NO: 16557 - protein, 9 aa, Artificial Sequence
  Regulator of microtubule dynamics protein 1 (188-196)
YIIKEHFEK

SEQ ID NO: 16558 - protein, 9 aa, Artificial Sequence
  Tensin-3 (11-19)
YITERIIAV

SEQ ID NO: 16559 - protein, 9 aa, Artificial Sequence
  Uncharacterized protein CXorf57 (109-117)
YLDPSLNSL

SEQ ID NO: 16560 - protein, 9 aa, Artificial Sequence
  Ragulator complex protein LAMTOR2 (114-122)
YLEEPLTQV

SEQ ID NO: 16561 - protein, 9 aa, Artificial Sequence
  HLA class I histocompatibility antigen, B-15 alpha chain (195-203)
YLENGKETL

SEQ ID NO: 16562 - protein, 9 aa, Artificial Sequence
  Proteasome activator complex subunit 4 (1375-1383)
YLEPKLTQV

SEQ ID NO: 16563 - protein, 9 aa, Artificial Sequence
  Inhibitor of nuclear factor kappa-B kinase subunit alpha (354-362)
YLFDKSKTV

SEQ ID NO: 16564 - protein, 9 aa, Artificial Sequence
  Unconventional myosin-X (243-251)
YLLEKNRVV

SEQ ID NO: 16565 - protein, 11 aa, Artificial Sequence
  Protein-lysine N-methyltransferase EEF2KMT (112-122)
YLLPSGGSVTL

SEQ ID NO: 16566 - protein, 9 aa, Artificial Sequence
  ER lumen protein-retaining receptor 3 (196-204)
YLYVTKVLK

SEQ ID NO: 16567 - protein, 10 aa, Artificial Sequence
  Zinc-binding alcohol dehydrogenase domain-containing protein 2 (355-364)
YMYMGKNTGK

SEQ ID NO: 16568 - protein, 9 aa, Artificial Sequence
  Ubiquitin-60S ribosomal protein L40 (64-72)
YNIQKESTL

SEQ ID NO: 16569 - protein, 10 aa, Artificial Sequence
  Disabled homolog 2-interacting protein (418-427)
YPDDRTARTL

SEQ ID NO: 16570 - protein, 11 aa, Artificial Sequence
  7-methylguanosine phosphate-specific 5'-nucleotidase (85-95)
YPIEIDPHRTV

SEQ ID NO: 16571 - protein, 9 aa, Artificial Sequence
  RNA polymerase II-associated protein 3 (96-104)
YPKEADIVI

SEQ ID NO: 16572 - protein, 9 aa, Artificial Sequence
  Rabankyrin-5 (262-270)
YPLHKAIKV

SEQ ID NO: 16573 - protein, 9 aa, Artificial Sequence
  AP-1 complex subunit beta-1 (421-429)
YPNKYESVI

SEQ ID NO: 16574 - protein, 9 aa, Artificial Sequence
  Ataxin-2 (759-767)
YPVPVSPGV

SEQ ID NO: 16575 - protein, 9 aa, Artificial Sequence
  Ataxin-2-like protein (752-760)
YPYPVSNSV

SEQ ID NO: 16576 - protein, 9 aa, Artificial Sequence
  Long-chain-fatty-acid-CoA ligase 3 (709-717)
YQADIERMY

SEQ ID NO: 16577 - protein, 9 aa, Artificial Sequence
  RNA-binding motif protein 22 (253-261)
YQFGEIRTI

SEQ ID NO: 16578 - protein, 9 aa, Artificial Sequence
  Copine-1 (66-74)
YRFETVQKL

SEQ ID NO: 16579 - protein, 8 aa, Artificial Sequence
  Fibronectin type III domain-containing protein 3B (557-564)
YRGPSHTY

SEQ ID NO: 16580 - protein, 9 aa, Artificial Sequence
  Myosin-9 (40-48)
YRIGQSKVF

SEQ ID NO: 16581 - protein, 9 aa, Artificial Sequence
  Fatty acid desaturase 2 (166-174)
YRKPKWNHL

SEQ ID NO: 16582 - protein, 9 aa, Artificial Sequence
  Breast cancer anti-estrogen resistance protein 3 (757-765)
YRMNAERIL

SEQ ID NO: 16583 - protein, 9 aa, Artificial Sequence
  Unconventional myosin-Ib (72-80)
YRNRNFYEL

SEQ ID NO: 16584 - protein, 9 aa, Artificial Sequence
  Constitutive coactivator of PPAR-gamma-like protein 1 (602-610)
YRPVRQYVY

SEQ ID NO: 16585 - protein, 9 aa, Artificial Sequence
  E3 ubiquitin-protein ligase MARCH6 (469-477)
YSDAPVSEL

SEQ ID NO: 16586 - protein, 11 aa, Artificial Sequence
  Discoidin, CUB and LCCL domain-containing protein 2 (339-349)
YSDDGQKWTVY

SEQ ID NO: 16587 - protein, 9 aa, Artificial Sequence
  TM2 domain-containing protein 2 (68-76)
YSDVEHTSV

SEQ ID NO: 16588 - protein, 9 aa, Artificial Sequence
  Caveolin-2 (19-27)
YSHHSGLEY

SEQ ID NO: 16589 - protein, 11 aa, Artificial Sequence
  Calcium-responsive transactivator (198-208)
YSSAQGGSQHY

SEQ ID NO: 16590 - protein, 10 aa, Artificial Sequence
  Paxillin (31-40)
YSYPTGNHTY

SEQ ID NO: 16591 - protein, 9 aa, Artificial Sequence
  Uridine phosphorylase 1 (20-28)
YTEKDKQAY

SEQ ID NO: 16592 - protein, 11 aa, Artificial Sequence
  Nucleolin (463-473)
YTGEKGQNQDY

SEQ ID NO: 16593 - protein, 9 aa, Artificial Sequence
  Melanophilin (121-129)
YYEHVKARF

SEQ ID NO: 16594 - protein, 9 aa, Artificial Sequence
  26S proteasome non-ATPase regulatory subunit 3 (212-220)
YYHARVYEF

SEQ ID NO: 16595 - protein, 9 aa, Artificial Sequence
  Neuroepithelial cell-transforming gene 1 protein (222-230)
YYIDKLEYL

SEQ ID NO: 16596 - protein, 9 aa, Artificial Sequence
  Disheveled-associated activator of morphogenesis 2 (101-109)
YYIDRINSM

SEQ ID NO: 16597 - protein, 10 aa, Artificial Sequence
  DNA-dependent protein kinase catalytic subunit (3101-3110)
YYIQNGIQSF

SEQ ID NO: 16598 - protein, 9 aa, Artificial Sequence
  Coiled-coil domain-containing protein 130 (79-87)
YYTTPIYRF

SEQ ID NO: 16599 - protein, 9 aa, Artificial Sequence
  RING finger protein 145 (469-477)
YYVNGTYRL

SEQ ID NO: 16600 - protein, 9 aa, Artificial Sequence
  EH domain-containing protein 4 (505-513)
ALAKHLIKI

SEQ ID NO: 16601 - protein, 8 aa, Artificial Sequence
  Ubiquitin carboxyl-terminal hydrolase 10 (606-613)
FGGHIRSV

SEQ ID NO: 16602 - protein, 7 aa, Artificial Sequence
  Guanine nucleotide-binding protein subunit beta-5 (322-328)
FGHENRV

SEQ ID NO: 16603 - protein, 10 aa, Artificial Sequence
  Alpha-actinin-3 (113-122)
FIASKGVKLV

SEQ ID NO: 16604 - protein, 9 aa, Artificial Sequence
  Transcriptional regulator Kaiso (564-572)
FMSSHIKSV

SEQ ID NO: 16605 - protein, 11 aa, Artificial Sequence
  DNA fragmentation factor subunit alpha (139-149)
ILLSEEDLQML

SEQ ID NO: 16606 - protein, 9 aa, Artificial Sequence
  Serine/threonine-protein kinase ULK3 (108-116)
ILPEKVARV

SEQ ID NO: 16607 - protein, 9 aa, Artificial Sequence
  Protein-lysine N-methyltransferase EEF2KMT (154-162)
KLDSPRVTV

SEQ ID NO: 16608 - protein, 9 aa, Artificial Sequence
  WASH complex subunit 7 (85-93)
KVLNKVITV

SEQ ID NO: 16609 - protein, 8 aa, Artificial Sequence
  Myelin expression factor 2 (298-305)
LFDRPMHV

SEQ ID NO: 16610 - protein, 9 aa, Artificial Sequence
  cAMP-specific 3',5'-cyclic phosphodiesterase 4B (450-458)
LLADLKTMV

SEQ ID NO: 16611 - protein, 9 aa, Artificial Sequence
  Multifunctional methyltransferase subunit TRM112-like protein (8-16)
LLSSHVRGV

SEQ ID NO: 16612 - protein, 7 aa, Artificial Sequence
  60S ribosomal protein L19 (120-126)
MEHIHKL

SEQ ID NO: 16613 - protein, 9 aa, Artificial Sequence
  Melanoma antigen preferentially expressed in tumors (394-402)
QLLALLPSL

SEQ ID NO: 16614 - protein, 9 aa, Artificial Sequence
  Proteasome activator complex subunit 4 (564-572)
QLLSEITRV

SEQ ID NO: 16615 - protein, 9 aa, Artificial Sequence
  Eukaryotic translation initiation factor 3 subunit C (478-486)
QVCAIIERV

SEQ ID NO: 16616 - protein, 9 aa, Artificial Sequence
  Methylsterol monooxygenase 1 (33-41)
RIYKYIHKV

SEQ ID NO: 16617 - protein, 9 aa, Artificial Sequence
  Spectrin beta chain, erythrocytic (86-94)
RMLIKLLEV

SEQ ID NO: 16618 - protein, 11 aa, Artificial Sequence
  NHP2-like protein 1 (118-128)
SIQQSIERLLV

SEQ ID NO: 16619 - protein, 9 aa, Artificial Sequence
  Erlin-2 (41-49)
SLFSAVHKI

SEQ ID NO: 16620 - protein, 9 aa, Artificial Sequence
  Protein FAM214A (403-411)
SLHSKLFRV

SEQ ID NO: 16621 - protein, 9 aa, Artificial Sequence
  Vacuole membrane protein 1 (82-90)
SLWSIISKV

SEQ ID NO: 16622 - protein, 9 aa, Artificial Sequence
  Potassium voltage-gated channel subfamily KQT member 5 (530-538)
SMLGRVVKV

SEQ ID NO: 16623 - protein, 9 aa, Artificial Sequence
  Sialate O-acetylesterase (32-40)
TIMKKVTSV

SEQ ID NO: 16624 - protein, 11 aa, Artificial Sequence
  Protein ELFN1 (17-27)
TLLHAGGLARA

SEQ ID NO: 16625 - protein, 9 aa, Artificial Sequence
  Reticulocalbin-1 (21-29)
VLAPRVLRA

SEQ ID NO: 16626 - protein, 9 aa, Artificial Sequence
  Eukaryotic translation initiation factor 3 subunit A (379-387)
VLQYVVPEV

SEQ ID NO: 16627 - protein, 9 aa, Artificial Sequence
  Intraflagellar transport protein 81 homolog (117-125)
YLARFLIKL

SEQ ID NO: 16628 - protein, 9 aa, Artificial Sequence
  Small subunit processome component 20 homolog (154-162)
YLYKYLWRL

SEQ ID NO: 16629 - protein, 15 aa, Artificial Sequence
  Serum albumin (438-452)
KVPQVSTPTLVEVSR

SEQ ID NO: 16630 - protein, 9 aa, Artificial Sequence
  Beta-secretase 2 (5-13)
ARALLLPLL

SEQ ID NO: 16631 - protein, 9 aa, Artificial Sequence
  Proteasome subunit beta type-4 (79-87)
ARFRNISRI

SEQ ID NO: 16632 - protein, 10 aa, Artificial Sequence
  Protein sel-1 homolog 1 (629-638)
ARIKLGDYHF

SEQ ID NO: 16633 - protein, 10 aa, Artificial Sequence
  Lon protease homolog 2, peroxisomal (291-300)
ARILLDNDHY

SEQ ID NO: 16634 - protein, 11 aa, Artificial Sequence
  NAD(P)H dehydrogenase (quinone) 1 (128-138)
ARIQILEGWKK

SEQ ID NO: 16635 - protein, 9 aa, Artificial Sequence
  Zinc finger protein 721 (73-81)
ARVKVFSKF

SEQ ID NO: 16636 - protein, 9 aa, Artificial Sequence
  TATA-box-binding protein (218-226)
ARVVQKLGF

SEQ ID NO: 16637 - protein, 22 aa, Artificial Sequence
  Plectin (3368-3389)
ATTAALLLEAQAATGFLVDPVR

SEQ ID NO: 16638 - protein, 9 aa, Artificial Sequence
  Coatomer subunit alpha (338-346)
DRFLRQLDF

SEQ ID NO: 16639 - protein, 9 aa, Artificial Sequence
  Mannosyl-oligosaccharide glucosidase (370-378)
ERFEKTFQL

SEQ ID NO: 16640 - protein, 9 aa, Artificial Sequence
  General transcription factor II-I (386-394)
ERIRFVIKK

SEQ ID NO: 16641 - protein, 9 aa, Artificial Sequence
  NADH dehydrogenase (ubiquinone) 1 beta subcomplex subunit 4 (35-43)
ERLAIRAQL

SEQ ID NO: 16642 - protein, 9 aa, Artificial Sequence
  Cytoplasmic dynein 1 heavy chain 1 (2441-2449)
FQLEHIMDL

SEQ ID NO: 16643 - protein, 9 aa, Artificial Sequence
  AP-2 complex subunit sigma (52-60)
FRNFKIIYR

SEQ ID NO: 16644 - protein, 10 aa, Artificial Sequence
  Protein scribble homolog (1146-1155)
GRDGRLRVGL

SEQ ID NO: 16645 - protein, 10 aa, Artificial Sequence
  Disintegrin and metalloproteinase domain-containing protein 10 (14-23)
GRFEGFIQTR

SEQ ID NO: 16646 - protein, 11 aa, Artificial Sequence
  Mitogen-activated protein kinase kinase kinase 12 (175-185)
GRFHGEEVAVK

SEQ ID NO: 16647 - protein, 10 aa, Artificial Sequence
  Rho guanine nucleotide exchange factor 2 (459-468)
GRFKDVLVLL

SEQ ID NO: 16648 - protein, 9 aa, Artificial Sequence
  Dolichyl-diphosphooligosaccharide-proteinosyltransferase subunit STT3A (230-238)
GRFSHRIYV

SEQ ID NO: 16649 - protein, 9 aa, Artificial Sequence
  Small nuclear ribonucleoprotein-associated proteins B and B' (17-25)
GRIFIGTFK

SEQ ID NO: 16650 - protein, 9 aa, Artificial Sequence
  Sorbitol dehydrogenase (55-63)
GRIGNFIVK

SEQ ID NO: 16651 - protein, 10 aa, Artificial Sequence
  Sorbitol dehydrogenase (55-64)
GRIGNFIVKK

SEQ ID NO: 16652 - protein, 9 aa, Artificial Sequence
  Dystonin (345-353)
GRIKLLQGY

SEQ ID NO: 16653 - protein, 9 aa, Artificial Sequence
  26S protease regulatory subunit 6B (325-333)
GRLDRKIEF

SEQ ID NO: 16654 - protein, 9 aa, Artificial Sequence
  Serine/threonine-protein phosphatase 6 regulatory subunit 3 (311-319)
GRLGSFHEL

SEQ ID NO: 16655 - protein, 10 aa, Artificial Sequence
  H(+)/Cl(-) exchange transporter 3 (772-781)
GRLLGIITKK

SEQ ID NO: 16656 - protein, 9 aa, Artificial Sequence
  Thioredoxin reductase 1, cytoplasmic (45-53)
GRLQKLLKM

SEQ ID NO: 16657 - protein, 9 aa, Artificial Sequence
  Aurora kinase A-interacting protein (40-48)
GRLTSQLLR

SEQ ID NO: 16658 - protein, 10 aa, Artificial Sequence
  Lon protease homolog 2, peroxisomal (714-723)
GRLVRSDVAM

SEQ ID NO: 16659 - protein, 10 aa, Artificial Sequence
  Up-regulated during skeletal muscle growth protein 5 (26-35)
GRMNCVLATY

SEQ ID NO: 16660 - protein, 9 aa, Artificial Sequence
  Tetratricopeptide repeat protein 12 (373-381)
GRSLIINHL

SEQ ID NO: 16661 - protein, 10 aa, Artificial Sequence
  Plectin (2680-2689)
GRSSIAGLLL

SEQ ID NO: 16662 - protein, 9 aa, Artificial Sequence
  Nucleolar protein 11 (40-48)
GRTVILYKV

SEQ ID NO: 16663 - protein, 16 aa, Artificial Sequence
  HLA class I histocompatibility antigen, A-1 alpha chain (25-40)
GSHSMRYFFTSVSRPG

SEQ ID NO: 16664 - protein, 9 aa, Artificial Sequence
  Transcription factor E2F4 (157-165)
IRAPSGTSL

SEQ ID NO: 16665 - protein, 9 aa, Artificial Sequence
  CAP-Gly domain-containing linker protein 4 (454-462)
IRFFGTTNF

SEQ ID NO: 16666 - protein, 11 aa, Artificial Sequence
  Glutamine synthetase (323-333)
IRIPRTVGQEK

SEQ ID NO: 16667 - protein, 11 aa, Artificial Sequence
  NADH dehydrogenase (ubiquinone) iron-sulfur protein 5 (8-18)
KRFGLNIDRWL

SEQ ID NO: 16668 - protein, 10 aa, Artificial Sequence
  Cytoplasmic dynein 2 heavy chain 1 (804-813)
KRFIGIPNQF

SEQ ID NO: 16669 - protein, 9 aa, Artificial Sequence
  DNA-dependent protein kinase catalytic subunit (1074-1082)
KRLGASLAF

SEQ ID NO: 16670 - protein, 9 aa, Artificial Sequence
  Fatty acyl-CoA reductase 1 (327-335)
KRNPLEQAF

SEQ ID NO: 16671 - protein, 9 aa, Artificial Sequence
  ATP-dependent RNA helicase DDX18 (403-411)
KRTTTFFQF

SEQ ID NO: 16672 - protein, 10 aa, Artificial Sequence
  Talin-1 (357-366)
KRWAASPKSF

SEQ ID NO: 16673 - protein, 9 aa, Artificial Sequence
  ATP-dependent RNA helicase DHX8 (289-297)
KRWEGLVHI

SEQ ID NO: 16674 - protein, 9 aa, Artificial Sequence
  Eukaryotic translation initiation factor 4 gamma 1 (570-578)
KRYDREFLL

SEQ ID NO: 16675 - protein, 9 aa, Artificial Sequence
  E3 ubiquitin-protein ligase RNF213 (1227-1235)
LRDSHIFQL

SEQ ID NO: 16676 - protein, 9 aa, Artificial Sequence
  Eukaryotic initiation factor 4A-II (229-237)
MRDPIRILV

SEQ ID NO: 16677 - protein, 9 aa, Artificial Sequence
  Abhydrolase domain-containing protein 2 (327-335)
MRYLHRIYV

SEQ ID NO: 16678 - protein, 9 aa, Artificial Sequence
  Uncharacterized protein C15orf41 (140-148)
NRFGPGLVI

SEQ ID NO: 16679 - protein, 9 aa, Artificial Sequence
  Heat shock protein HSP 90-alpha (808-816)
NRIYRMIKL

SEQ ID NO: 16680 - protein, 9 aa, Artificial Sequence
  Guanine nucleotide-binding protein G(s) subunit alpha isoforms short (265-273)
NRWLRTISV

SEQ ID NO: 16681 - protein, 14 aa, Artificial Sequence
  Zinc finger protein 608 (42-55)
PASPGAGNPPGTPK

SEQ ID NO: 16682 - protein, 9 aa, Artificial Sequence
  Eukaryotic translation initiation factor 3 subunit L (152-160)
QRFESYYNY

SEQ ID NO: 16683 - protein, 9 aa, Artificial Sequence
  Eukaryotic translation initiation factor 3 subunit A (316-324)
QRMSTRVLL

SEQ ID NO: 16684 - protein, 9 aa, Artificial Sequence
  Transmembrane protein 141 (54-62)
RKFPYPLQW

SEQ ID NO: 16685 - protein, 11 aa, Artificial Sequence
  Nuclear envelope integral membrane protein 1 (157-167)
RRFDPKLFLVF

SEQ ID NO: 16686 - protein, 11 aa, Artificial Sequence
  Unconventional myosin-Id (770-780)
RRFEEALQTIF

SEQ ID NO: 16687 - protein, 13 aa, Artificial Sequence
  Pre-mRNA-processing-splicing factor 8 (820-832)
RRFSPIPFPPLSY

SEQ ID NO: 16688 - protein, 9 aa, Artificial Sequence
  Exportin-1 (596-604)
RRHFVQVQV

SEQ ID NO: 16689 - protein, 10 aa, Artificial Sequence
  Negative elongation factor C/D (83-92)
RRIAQEVQRF

SEQ ID NO: 16690 - protein, 10 aa, Artificial Sequence
  cAMP-dependent protein kinase type I-beta regulatory subunit (232-241)
RRILMGSTLR

SEQ ID NO: 16691 - protein, 10 aa, Artificial Sequence
  Cytoplasmic FMR1-interacting protein 2 (148-157)
RRKDFVSEAY

SEQ ID NO: 16692 - protein, 9 aa, Artificial Sequence
  Nuclear pore complex protein Nup98-Nup96 (778-786)
RRKEVVVYL

SEQ ID NO: 16693 - protein, 10 aa, Artificial Sequence
  NADH dehydrogenase (ubiquinone) 1 alpha subcomplex subunit 13 (49-58)
RRLQIEDFEA

SEQ ID NO: 16694 - protein, 10 aa, Artificial Sequence
  Signal peptide peptidase-like 2A (5-14)
RRLSPAGAAL

SEQ ID NO: 16695 - protein, 13 aa, Artificial Sequence
  Splicing factor, proline- and glutamine-rich (547-559)
RRMEELHNQEMQK

SEQ ID NO: 16696 - protein, 9 aa, Artificial Sequence
  Probable ATP-dependent RNA helicase DDX10 (353-361)
RRMEVYNEF

SEQ ID NO: 16697 - protein, 12 aa, Artificial Sequence
  40S ribosomal protein S21 (60-71)
RRMGESDDSILR

SEQ ID NO: 16698 - protein, 9 aa, Artificial Sequence
  HLA class II histocompatibility antigen, DQ beta 1 chain (88-96)
RRVEPTVTI

SEQ ID NO: 16699 - protein, 12 aa, Artificial Sequence
  HLA class I histocompatibility antigen, B-15 alpha chain (193-204)
RRYLENGKETLQ

SEQ ID NO: 16700 - protein, 9 aa, Artificial Sequence
  Glucoside xylosyltransferase 1 (2-10)
RRYLRVVVL

SEQ ID NO: 16701 - protein, 11 aa, Artificial Sequence
  Eukaryotic initiation factor 4A-I (168-178)
RRYLSPKYIKM

SEQ ID NO: 16702 - protein, 15 aa, Artificial Sequence
  HLA class II histocompatibility antigen, DR alpha chain (48-62)
SFEAQGALANIAVDK

SEQ ID NO: 16703 - protein, 10 aa, Artificial Sequence
  EH domain-containing protein 4 (129-138)
SRFGNAFLNR

SEQ ID NO: 16704 - protein, 10 aa, Artificial Sequence
  Cohesin subunit SA-2 (369-378)
SRFKDRIVSM

SEQ ID NO: 16705 - protein, 9 aa, Artificial Sequence
  Nucleolar pre-ribosomal-associated protein 1 (628-636)
SRFNRYYSL

SEQ ID NO: 16706 - protein, 9 aa, Artificial Sequence
  26S proteasome non-ATPase regulatory subunit 13 (153-161)
SRFYDLSSK

SEQ ID NO: 16707 - protein, 9 aa, Artificial Sequence
  Lysine-specific demethylase 3A (1085-1093)
SRLPNYFVR

SEQ ID NO: 16708 - protein, 9 aa, Artificial Sequence
  RRP12-like protein (519-527)
TRLGFFTTY

SEQ ID NO: 16709 - protein, 9 aa, Artificial Sequence
  Voltage-dependent anion-selective channel protein 2 (165-173)
TRNNFAVGY

SEQ ID NO: 16710 - protein, 11 aa, Artificial Sequence
  Dolichyl-diphosphooligosaccharide-proteinosyltransferase 48 kDa subunit (358-368)
VRIDPFVRTFL

SEQ ID NO: 16711 - protein, 9 aa, Artificial Sequence
  Phosphatidylinositol 4-phosphate 5-kinase type-1 alpha (54-62)
YRFVKKLEH

SEQ ID NO: 16712 - protein, 9 aa, Artificial Sequence
  PERQ amino acid-rich with GYF domain-containing protein 2 (41-49)
YRYGREEML

SEQ ID NO: 16713 - protein, 9 aa, Artificial Sequence
  Alpha-actinin-1 (567-575)
AILGIHNEV

SEQ ID NO: 16714 - protein, 9 aa, Artificial Sequence
  CCR4-NOT transcription complex subunit 1 (2294-2302)
AIQEQITRV

SEQ ID NO: 16715 - protein, 10 aa, Artificial Sequence
  GEM-interacting protein (553-562)
ALDVQGIYRV

SEQ ID NO: 16716 - protein, 10 aa, Artificial Sequence
  Glycogen phosphorylase, brain form (417-426)
ALFPGDVDRL

SEQ ID NO: 16717 - protein, 13 aa, Artificial Sequence
  T-complex protein 1 subunit gamma (186-198)
EENGRKEIDIKKY

SEQ ID NO: 16718 - protein, 9 aa, Artificial Sequence
  Glycerol-3-phosphate dehydrogenase, mitochondrial (467-475)
ETARKFLYY

SEQ ID NO: 16719 - protein, 9 aa, Artificial Sequence
  Hexokinase-2 (850-858)
GLDALKVTV

SEQ ID NO: 16720 - protein, 9 aa, Artificial Sequence
  NF-kappa-B-repressing factor (193-201)
GSDKINYTY

SEQ ID NO: 16721 - protein, 9 aa, Artificial Sequence
  Galectin-3 (217-225)
HLLQYNHRV

SEQ ID NO: 16722 - protein, 9 aa, Artificial Sequence
  Serine-protein kinase ATM (2898-2906)
KILPTPETV

SEQ ID NO: 16723 - protein, 9 aa, Artificial Sequence
  F-box only protein 7 (226-234)
KINNEIRSV

SEQ ID NO: 16724 - protein, 9 aa, Artificial Sequence
  DNA topoisomerase 2-beta (151-159)
KLDETGVAL

SEQ ID NO: 16725 - protein, 10 aa, Artificial Sequence
  Coatomer subunit gamma-1 (75-84)
KLFQSNDPTL

SEQ ID NO: 16726 - protein, 10 aa, Artificial Sequence
  Protein S100-A6 (47-56)
KLQDAEIARL

SEQ ID NO: 16727 - protein, 9 aa, Artificial Sequence
  Nucleoprotein TPR (699-707)
KLQEQVTDL

SEQ ID NO: 16728 - protein, 9 aa, Artificial Sequence
  Unconventional myosin-Ic (409-417)
KLQQLFIEL

SEQ ID NO: 16729 - protein, 9 aa, Artificial Sequence
  26S proteasome non-ATPase regulatory subunit 11 (159-167)
KMDDKALLV

SEQ ID NO: 16730 - protein, 9 aa, Artificial Sequence
  Serine/threonine-protein kinase/endoribonuclease IRE1 (690-698)
KPHNILISM

SEQ ID NO: 16731 - protein, 9 aa, Artificial Sequence
  Zinc finger protein 277 (158-166)
KSELGLNFY

SEQ ID NO: 16732 - protein, 9 aa, Artificial Sequence
  Profilin-1 (105-113)
KTDKTLVLL

SEQ ID NO: 16733 - protein, 9 aa, Artificial Sequence
  RHO/RAC effector protein (462-470)
KTERSDLEY

SEQ ID NO: 16734 - protein, 9 aa, Artificial Sequence
  Replication protein A 70 kDa DNA-binding subunit (489-497)
KVIDQQNGL

SEQ ID NO: 16735 - protein, 9 aa, Artificial Sequence
  Plectin (2572-2580)
LLAEENQRL

SEQ ID NO: 16736 - protein, 9 aa, Artificial Sequence
  Clathrin heavy chain 1 (333-341)
NIIPYITNV

SEQ ID NO: 16737 - protein, 9 aa, Artificial Sequence
  Cell division cycle protein 27 homolog (216-224)
NLESSNSKY

SEQ ID NO: 16738 - protein, 10 aa, Artificial Sequence
  Band 4.1-like protein 2 (252-261)
NLLEKDYFGL

SEQ ID NO: 16739 - protein, 9 aa, Artificial Sequence
  Keratin, type I cytoskeletal 18 (100-108)
RLAADDFRV

SEQ ID NO: 16740 - protein, 10 aa, Artificial Sequence
  Vacuolar protein sorting-associated protein 35 (226-235)
RLSQLEGVNV

SEQ ID NO: 16741 - protein, 9 aa, Artificial Sequence
  DNA topoisomerase 2-alpha (230-238)
SLDKDIVAL

SEQ ID NO: 16742 - protein, 9 aa, Artificial Sequence
  Ubiquitin carboxyl-terminal hydrolase 14 (241-249)
SLIDQFFGV

SEQ ID NO: 16743 - protein, 9 aa, Artificial Sequence
  Calcium-binding mitochondrial carrier protein Aralar1 (25-33)
STEVDGERY

SEQ ID NO: 16744 - protein, 9 aa, Artificial Sequence
  Thymosin beta-10 (26-34)
TETQEKNTL

SEQ ID NO: 16745 - protein, 9 aa, Artificial Sequence
  L-lactate dehydrogenase B chain (323-331)
TLWDIQKDL

SEQ ID NO: 16746 - protein, 9 aa, Artificial Sequence
  SAM and SH3 domain-containing protein 1 (299-307)
VLDERSALY

SEQ ID NO: 16747 - protein, 9 aa, Artificial Sequence
  Centromere protein F (684-692)
VLDSKSVEV

SEQ ID NO: 16748 - protein, 10 aa, Artificial Sequence
  N(G),N(G)-dimethylarginine dimethylaminohydrolase 1 (92-101)
VLFTGREFFV

SEQ ID NO: 16749 - protein, 20 aa, Artificial Sequence
  Cytochrome c oxidase subunit 7C, mitochondrial (44-63)
YFGSAFATPFLVVRHQLLKT

SEQ ID NO: 16750 - protein, 9 aa, Artificial Sequence
  GTP-binding protein Rit1 (134-142)
YIDDVFHAL

SEQ ID NO: 16751 - protein, 9 aa, Artificial Sequence
  WASH complex subunit 7 (733-741)
YLDKTFYNL

SEQ ID NO: 16752 - protein, 10 aa, Artificial Sequence
  Coatomer subunit alpha (707-716)
YLITGNLEKL

SEQ ID NO: 16753 - protein, 9 aa, Artificial Sequence
  cAMP-dependent protein kinase type I-alpha regulatory subunit (126-134)
AALAKAIEK

SEQ ID NO: 16754 - protein, 8 aa, Artificial Sequence
  Fatty acid synthase (1645-1652)
AASVPVVY

SEQ ID NO: 16755 - protein, 9 aa, Artificial Sequence
  Matrix Gla protein (90-98)
AAYNRYFRK

SEQ ID NO: 16756 - protein, 8 aa, Artificial Sequence
  60S ribosomal protein L10 (29-36)
AKIRIFDL

SEQ ID NO: 16757 - protein, 9 aa, Artificial Sequence
  Sushi repeat-containing protein SRPX isoform 4 (328-336)
ALLDQFYEK

SEQ ID NO: 16758 - protein, 10 aa, Artificial Sequence
  Zinc finger MYM-type protein 4 (757-766)
ASAGPPSLRK

SEQ ID NO: 16759 - protein, 10 aa, Artificial Sequence
  Thymosin beta-10 (16-25)
ASFDKAKLKK

SEQ ID NO: 16760 - protein, 9 aa, Artificial Sequence
  Glycogen phosphorylase, muscle form (303-311)
ATLQDIIRR

SEQ ID NO: 16761 - protein, 9 aa, Artificial Sequence
  Cell surfaceoprotein MUC18 (577-585)
AVLYFLYKK

SEQ ID NO: 16762 - protein, 8 aa, Artificial Sequence
  Torsin-1A-interacting protein 1 (433-440)
AYSSFRSV

SEQ ID NO: 16763 - protein, 8 aa, Artificial Sequence
  Nucleolin (415-422)
DAAEIRLV

SEQ ID NO: 16764 - protein, 8 aa, Artificial Sequence
  Prohibitin (233-240)
DGLIELRK

SEQ ID NO: 16765 - protein, 7 aa, Artificial Sequence
  Lysine-specific demethylase 5B (46-52)
FAFIHKI

SEQ ID NO: 16766 - protein, 9 aa, Artificial Sequence
  Polypeptide N-acetylgalactosaminyltransferase 5 (282-290)
FPKVRILRL

SEQ ID NO: 16767 - protein, 10 aa, Artificial Sequence
  Dual specificity protein phosphatase 6 (130-139)
FYLEGGFSKF

SEQ ID NO: 16768 - protein, 9 aa, Artificial Sequence
  Multiple PDZ domain protein (777-785)
GTVRIGVAK

SEQ ID NO: 16769 - protein, 10 aa, Artificial Sequence
  Calcyphosin (120-129)
GVYSGRAHPK

SEQ ID NO: 16770 - protein, 10 aa, Artificial Sequence
  PEST proteolytic signal-containing nuclear protein (144-153)
HLGNVHDQDN

SEQ ID NO: 16771 - protein, 10 aa, Artificial Sequence
  DAZ-associated protein 1 (397-406)
HNVQGFHPYR

SEQ ID NO: 16772 - protein, 15 aa, Artificial Sequence
  Ribonucleoprotein PTB-binding 1 (737-751)
HSQGLGGHYADSYLK

SEQ ID NO: 16773 - protein, 9 aa, Artificial Sequence
  Melanocyte protein PMEL (189-197)
HTMEVTVYH

SEQ ID NO: 16774 - protein, 11 aa, Artificial Sequence
  Neurosecretory protein VGF (2-12)
KALRLSASALF

SEQ ID NO: 16775 - protein, 9 aa, Artificial Sequence
  Serine/threonine-protein kinase Nek7 (81-89)
KEIDLLKQL

SEQ ID NO: 16776 - protein, 9 aa, Artificial Sequence
  Calpain-3 (10-18)
KVLNTVVNK

SEQ ID NO: 16777 - protein, 9 aa, Artificial Sequence
  (Pyruvate dehydrogenase (acetyl-transferring))-phosphatase 1, mitochondrial (542-550)
LPEELARMY

SEQ ID NO: 16778 - protein, 7 aa, Artificial Sequence
  Vimentin (116-122)
NYIDKVR

SEQ ID NO: 16779 - protein, 8 aa, Artificial Sequence
  Vimentin (116-123)
NYIDKVRF

SEQ ID NO: 16780 - protein, 8 aa, Artificial Sequence
  Lysine-specific demethylase 5B (45-52)
PFAFIHKI

SEQ ID NO: 16781 - protein, 8 aa, Artificial Sequence
  Isoleucine-tRNA ligase, cytoplasmic (611-618)
PVSIIQKY

SEQ ID NO: 16782 - protein, 9 aa, Artificial Sequence
  Ankyrin-2 (1316-1324)
PYMAKFVVF

SEQ ID NO: 16783 - protein, 7 aa, Artificial Sequence
  Plectin (3425-3431)
PYSGSTI

SEQ ID NO: 16784 - protein, 9 aa, Artificial Sequence
  Crooked neck-like protein 1 (372-380)
RFEEKHAYF

SEQ ID NO: 16785 - protein, 9 aa, Artificial Sequence
  Vimentin (122-130)
RFLEQQNKI

SEQ ID NO: 16786 - protein, 9 aa, Artificial Sequence
  Membrane-associated transporter protein (209-217)
RLLGTEFQV

SEQ ID NO: 16787 - protein, 8 aa, Artificial Sequence
  V-type proton ATPase subunit B, kidney isoform (40-47)
RSGQVLEV

SEQ ID NO: 16788 - protein, 9 aa, Artificial Sequence
  Sialidase-4 (192-200)
RTSPHSFAF

SEQ ID NO: 16789 - protein, 9 aa, Artificial Sequence
  Tubulin beta-6 chain (244-252)
RYLTVATVF

SEQ ID NO: 16790 - protein, 9 aa, Artificial Sequence
  Transcription elongation factor SPT5 (361-369)
RYSRKGFLF

SEQ ID NO: 16791 - protein, 9 aa, Artificial Sequence
  Zinc finger MYM-type protein 4 (758-766)
SAGPPSLRK

SEQ ID NO: 16792 - protein, 9 aa, Artificial Sequence
  Melanoma-associated antigen 1 (230-238)
SAYGEPRKL

SEQ ID NO: 16793 - protein, 13 aa, Artificial Sequence
  Heterogeneous nuclear ribonucleoproteins A2/B1 (289-301)
SGGSGGYGGRSRY

SEQ ID NO: 16794 - protein, 13 aa, Artificial Sequence
  Elongation factor 1-alpha 1 (18-30)
SGKSTTTGHLIYK

SEQ ID NO: 16795 - protein, 9 aa, Artificial Sequence
  G protein pathway suppressor 2 (319-327)
SQNPRFYHK

SEQ ID NO: 16796 - protein, 9 aa, Artificial Sequence
  Nuclear pore complex protein Nup205 (214-222)
SSLYIILKK

SEQ ID NO: 16797 - protein, 9 aa, Artificial Sequence
  RNA binding motif protein, X-linked-like-1 (142-150)
SSRGPLPVK

SEQ ID NO: 16798 - protein, 10 aa, Artificial Sequence
  Mitochondrial fission factor (79-88)
STPFKPLALK

SEQ ID NO: 16799 - protein, 17 aa, Artificial Sequence
  Prelamin-A/C (479-495)
SVGGSGGGSFGDNLVTR

SEQ ID NO: 16800 - protein, 9 aa, Artificial Sequence
  Zinc finger MIZ domain-containing protein 1 (594-602)
SVLQGLLKK

SEQ ID NO: 16801 - protein, 9 aa, Artificial Sequence
  Anaphase-promoting complex subunit 5 (50-58)
SVVGLFLRH

SEQ ID NO: 16802 - protein, 11 aa, Artificial Sequence
  Prohibitin (230-240)
TAGDGLIELRK

SEQ ID NO: 16803 - protein, 15 aa, Artificial Sequence
  RNA polymerase II-associated factor 1 homolog (4-18)
TIQTQAQREDGHRPN

SEQ ID NO: 16804 - protein, 15 aa, Artificial Sequence
  Thymosin beta-10 (33-47)
TLPTKETIEQEKRSE

SEQ ID NO: 16805 - protein, 17 aa, Artificial Sequence
  Thymosin beta-10 (33-49)
TLPTKETIEQEKRSEIS

SEQ ID NO: 16806 - protein, 14 aa, Artificial Sequence
  Golgi-specific brefeldin A-resistance guanine nucleotide exchange factor 1 (535-548)
TPRPTDPIPTSEVN

SEQ ID NO: 16807 - protein, 11 aa, Artificial Sequence
  KH domain-containing, RNA-binding, signal transduction-associated protein 1 (33-43)
TPSRQPPLPHR

SEQ ID NO: 16808 - protein, 15 aa, Artificial Sequence
  Probable ATP-dependent RNA helicase DDX5 (556-570)
TSFRTGNPTGTYQNG

SEQ ID NO: 16809 - protein, 8 aa, Artificial Sequence
  Elongation factor 1-alpha 1 (23-30)
TTGHLIYK

SEQ ID NO: 16810 - protein, 15 aa, Artificial Sequence
  Vimentin (446-460)
TVETRDGQVINETSQ

SEQ ID NO: 16811 - protein, 14 aa, Artificial Sequence
  Serum albumin (439-452)
VPQVSTPTLVEVSR

SEQ ID NO: 16812 - protein, 9 aa, Artificial Sequence
  Melanoma-associated antigen F1 (199-207)
VQPSKYHFL

SEQ ID NO: 16813 - protein, 8 aa, Artificial Sequence
  Vimentin (117-124)
YIDKVRFL

SEQ ID NO: 16814 - protein, 9 aa, Artificial Sequence
  Fatty acid synthase (2288-2296)
YYIDCIRQV

SEQ ID NO: 16815 - protein, 9 aa, Artificial Sequence
  Zinc finger protein 552 (2-10)
AAAALRFPV

SEQ ID NO: 16816 - protein, 10 aa, Artificial Sequence
  Colipase-like protein 2 (3-12)
AALALVAGVL

SEQ ID NO: 16817 - protein, 9 aa, Artificial Sequence
  ATP-binding cassette sub-family G member 1 (538-546)
AALGTMTSL

SEQ ID NO: 16818 - protein, 9 aa, Artificial Sequence
  Integrin beta-7 (351-359)
AALPVYQEL

SEQ ID NO: 16819 - protein, 9 aa, Artificial Sequence
  Translocon-associated protein subunit delta (2-10)
AAMASLGAL

SEQ ID NO: 16820 - protein, 9 aa, Artificial Sequence
  Fumarate hydratase, mitochondrial (264-272)
AAMPRIYEL

SEQ ID NO: 16821 - protein, 8 aa, Artificial Sequence
  Interferon-induced GTP-binding protein Mx1 (15-22)
AASHPLLL

SEQ ID NO: 16822 - protein, 9 aa, Artificial Sequence
  Basement membrane-specific heparan sulfate proteoglycan core protein (1503-1511)
AASISAVSL

SEQ ID NO: 16823 - protein, 9 aa, Artificial Sequence
  Zinc finger and BTB domain-containing protein 7B (478-486)
AASPAGLDL

SEQ ID NO: 16824 - protein, 9 aa, Artificial Sequence
  Poly(rC)-binding protein 2 (92-100)
AASRPPVTL

SEQ ID NO: 16825 - protein, 11 aa, Artificial Sequence
  Protein phosphatase inhibitor 2 (2-12)
AASTASHRPIK

SEQ ID NO: 16826 - protein, 9 aa, Artificial Sequence
  Transcription factor jun-B (200-208)
AAVGTGSSY

SEQ ID NO: 16827 - protein, 9 aa, Artificial Sequence
  Carnitine O-palmitoyltransferase 1, liver isoform (476-484)
ADAPIVAHL

SEQ ID NO: 16828 - protein, 10 aa, Artificial Sequence
  Protein CDV3 homolog (2-11)
AETEERSLDN

SEQ ID NO: 16829 - protein, 9 aa, Artificial Sequence
  Cirhin (640-648)
AFKISKIYK

SEQ ID NO: 16830 - protein, 9 aa, Artificial Sequence
  Tyrosine-protein kinase HCK (301-309)
AFLAEANVM

SEQ ID NO: 16831 - protein, 9 aa, Artificial Sequence
  2-oxoglutarate dehydrogenase, mitochondrial (85-93)
AGAPPGTAY

SEQ ID NO: 16832 - protein, 8 aa, Artificial Sequence
  Fc receptor-like A (58-65)
AGFQVKAY

SEQ ID NO: 16833 - protein, 9 aa, Artificial Sequence
  Piezo-type mechanosensitive ion channel component 1 (211-219)
AGIAHPSAL

SEQ ID NO: 16834 - protein, 10 aa, Artificial Sequence
  Uncharacterized protein ENSP00000382042 (147-156)
AGTGGSPALL

SEQ ID NO: 16835 - protein, 9 aa, Artificial Sequence
  Glycogen debranching enzyme (1193-1201)
AGTLDQPLF

SEQ ID NO: 16836 - protein, 10 aa, Artificial Sequence
  Abelson tyrosine-protein kinase 2 (1157-1166)
AGVPGTNPVL

SEQ ID NO: 16837 - protein, 9 aa, Artificial Sequence
  Heterogeneous nuclear ribonucleoprotein F (403-411)
AGYSGQNSM

SEQ ID NO: 16838 - protein, 9 aa, Artificial Sequence
  Spectrin alpha chain, non-erythrocytic 1 (2132-2140)
AHDAFRSSL

SEQ ID NO: 16839 - protein, 9 aa, Artificial Sequence
  ER degradation-enhancing alpha-mannosidase-like protein 1 (264-272)
AHDLAVRLL

SEQ ID NO: 16840 - protein, 9 aa, Artificial Sequence
  DmX-like protein 2 (2940-2948)
AHDSAIKAL

SEQ ID NO: 16841 - protein, 9 aa, Artificial Sequence
  Testicular acid phosphatase (287-295)
AHDSTLLAL

SEQ ID NO: 16842 - protein, 9 aa, Artificial Sequence
  Lysosomal acid phosphatase (285-293)
AHDTTLVAL

SEQ ID NO: 16843 - protein, 11 aa, Artificial Sequence
  U4/U6 small nuclear ribonucleoprotein Prp3 (510-520)
AHEEANAARKL

SEQ ID NO: 16844 - protein, 9 aa, Artificial Sequence
  Protein FAM195A (93-101)
AHEENVRFV

SEQ ID NO: 16845 - protein, 9 aa, Artificial Sequence
  Synemin (147-155)
AHERDVREL

SEQ ID NO: 16846 - protein, 9 aa, Artificial Sequence
  NADH dehydrogenase (ubiquinone) 1 alpha subcomplex subunit 1 (39-47)
AHFGYHWSL

SEQ ID NO: 16847 - protein, 9 aa, Artificial Sequence
  GDP-mannose 4,6 dehydratase (74-82)
AHIEGNMKL

SEQ ID NO: 16848 - protein, 9 aa, Artificial Sequence
  Striatin-3 (531-539)
AHIGPVLSL

SEQ ID NO: 16849 - protein, 9 aa, Artificial Sequence
  Nuclear factor erythroid 2-related factor 2 (106-114)
AHIPKSDAL

SEQ ID NO: 16850 - protein, 9 aa, Artificial Sequence
  Nucleolar RNA helicase 2 (616-624)
AHISGATSV

SEQ ID NO: 16851 - protein, 9 aa, Artificial Sequence
  Coatomer subunit beta' (555-563)
AHLDRTMYL

SEQ ID NO: 16852 - protein, 9 aa, Artificial Sequence
  Nuclear inhibitor of protein phosphatase 1 (172-180)
AHNKRISTL

SEQ ID NO: 16853 - protein, 8 aa, Artificial Sequence
  Suppressor of SWI4 1 homolog (136-143)
AHPPLLVL

SEQ ID NO: 16854 - protein, 9 aa, Artificial Sequence
  Exosome complex component CSL4 (156-164)
AHSESGIQM

SEQ ID NO: 16855 - protein, 10 aa, Artificial Sequence
  DNA mismatch repair protein Msh6 (457-466)
AHSGFPEIAF

SEQ ID NO: 16856 - protein, 9 aa, Artificial Sequence
  60S ribosomal protein L18a (121-129)
AHSIQIMKV

SEQ ID NO: 16857 - protein, 9 aa, Artificial Sequence
  Sodium-coupled neutral amino acid transporter 5 (74-82)
AHTGVIFFL

SEQ ID NO: 16858 - protein, 9 aa, Artificial Sequence
  AP-2 complex subunit mu (194-202)
AHVSGRVVM

SEQ ID NO: 16859 - protein, 9 aa, Artificial Sequence
  Trafficking protein particle complex subunit 5 (162-170)
AHWHKGTTL

SEQ ID NO: 16860 - protein, 9 aa, Artificial Sequence
  LIM and SH3 domain protein 1 (55-63)
AHYPKQSFT

SEQ ID NO: 16861 - protein, 9 aa, Artificial Sequence
  Endoplasmic reticulum-Golgi intermediate compartment protein 3 (313-321)
AIIGGMFTV

SEQ ID NO: 16862 - protein, 9 aa, Artificial Sequence
  Parafibromin (184-192)
AIKAKIMAK

SEQ ID NO: 16863 - protein, 9 aa, Artificial Sequence
  Exportin-4 (825-833)
AILFNFLMD

SEQ ID NO: 16864 - protein, 9 aa, Artificial Sequence
  Protein arginine N-methyltransferase 5 (168-176)
AILPTSIFL

SEQ ID NO: 16865 - protein, 10 aa, Artificial Sequence
  Bifunctional glutamate/proline-tRNA ligase (215-224)
AKAALLNQHY

SEQ ID NO: 16866 - protein, 10 aa, Artificial Sequence
  Exportin-5 (744-753)
AKAGGFVVGY

SEQ ID NO: 16867 - protein, 9 aa, Artificial Sequence
  DNA replication licensing factor MCM7 (470-478)
AKAGILTTL

SEQ ID NO: 16868 - protein, 9 aa, Artificial Sequence
  DNA replication licensing factor MCM5 (470-478)
AKAGITTTL

SEQ ID NO: 16869 - protein, 9 aa, Artificial Sequence
  Peptidase M20 domain-containing protein 2 (398-406)
AKALAMTAL

SEQ ID NO: 16870 - protein, 10 aa, Artificial Sequence
  Proteasome subunit beta type-2 (125-134)
AKAPFAAHGY

SEQ ID NO: 16871 - protein, 9 aa, Artificial Sequence
  Drebrin (614-622)
AKAPPPVFY

SEQ ID NO: 16872 - protein, 9 aa, Artificial Sequence
  CCAAT/enhancer-binding protein beta (241-249)
AKAPPTACY

SEQ ID NO: 16873 - protein, 9 aa, Artificial Sequence
  Ragulator complex protein LAMTOR2 (106-114)
AKAQALVQY

SEQ ID NO: 16874 - protein, 9 aa, Artificial Sequence
  Protein PRRC2C (2502-2510)
AKAQSGLAF

SEQ ID NO: 16875 - protein, 9 aa, Artificial Sequence
  ATP-dependent RNA helicase A (181-189)
AKARLNQYF

SEQ ID NO: 16876 - protein, 11 aa, Artificial Sequence
  Heterogeneous nuclear ribonucleoprotein L (247-257)
AKASLNGADIY

SEQ ID NO: 16877 - protein, 9 aa, Artificial Sequence
  NAD(P)H-hydrate epimerase (96-104)
AKAYPPTSM

SEQ ID NO: 16878 - protein, 9 aa, Artificial Sequence
  1-phosphatidylinositol 4,5-bisphosphate phosphodiesterase beta-1 (127-135)
AKEWTNEVF

SEQ ID NO: 16879 - protein, 10 aa, Artificial Sequence
  Cell division cycle-associated 7-like protein (291-300)
AKFAEEFYSF

SEQ ID NO: 16880 - protein, 9 aa, Artificial Sequence
  Cathepsin D (193-201)
AKFDGILGM

SEQ ID NO: 16881 - protein, 10 aa, Artificial Sequence
  Crooked neck-like protein 1 (420-429)
AKFEENQKEF

SEQ ID NO: 16882 - protein, 9 aa, Artificial Sequence
  Staphylococcal nuclease domain-containing protein 1 (248-256)
AKFFTESRL

SEQ ID NO: 16883 - protein, 9 aa, Artificial Sequence
  Pre-mRNA-processing factor 19 (487-495)
AKFIASTGM

SEQ ID NO: 16884 - protein, 9 aa, Artificial Sequence
  Squalene monooxygenase (243-251)
AKFIEGVVL

SEQ ID NO: 16885 - protein, 9 aa, Artificial Sequence
  DCN1-like protein 2 (152-160)
AKFKDFYQF

SEQ ID NO: 16886 - protein, 10 aa, Artificial Sequence
  DnaJ homolog subfamily B member 9 (65-74)
AKFREIAEAY

SEQ ID NO: 16887 - protein, 9 aa, Artificial Sequence
  Nitrogen permease regulator 3-like protein (366-374)
AKFSLPVSL

SEQ ID NO: 16888 - protein, 11 aa, Artificial Sequence
  DNA-directed RNA polymerases I and III subunit RPAC1 (223-233)
AKFSPVATASY

SEQ ID NO: 16889 - protein, 9 aa, Artificial Sequence
  Ubiquitin-like modifier-activating enzyme 1 (321-329)
AKFSRPAQL

SEQ ID NO: 16890 - protein, 9 aa, Artificial Sequence
  Staphylococcal nuclease domain-containing protein 1 (738-746)
AKFVDGEWY

SEQ ID NO: 16891 - protein, 9 aa, Artificial Sequence
  60S ribosomal protein L31 (74-82)
AKGIRNVPY

SEQ ID NO: 16892 - protein, 9 aa, Artificial Sequence
  Cullin-1 (220-228)
AKGPTLTVY

SEQ ID NO: 16893 - protein, 9 aa, Artificial Sequence
  NACHT, LRR and PYD domains-containing protein 7 (625-633)
AKGVFLENY

SEQ ID NO: 16894 - protein, 9 aa, Artificial Sequence
  Cystatin-B (90-98)
AKHDELTYF

SEQ ID NO: 16895 - protein, 12 aa, Artificial Sequence
  T-complex protein 1 subunit theta (19-30)
AKHFSGLEEAVY

SEQ ID NO: 16896 - protein, 9 aa, Artificial Sequence
  Unconventional myosin-Va (1821-1829)
AKHIFPVTF

SEQ ID NO: 16897 - protein, 9 aa, Artificial Sequence
  Fatty aldehyde dehydrogenase (198-206)
AKHLTPVTL

SEQ ID NO: 16898 - protein, 9 aa, Artificial Sequence
  AP-2 complex subunit sigma (44-52)
AKHTNFVEF

SEQ ID NO: 16899 - protein, 9 aa, Artificial Sequence
  F-box DNA helicase 1 (835-843)
AKIAVVEKY

SEQ ID NO: 16900 - protein, 11 aa, Artificial Sequence
  Carnitine O-palmitoyltransferase 1, liver isoform (75-85)
AKIDPSLGIIA

SEQ ID NO: 16901 - protein, 9 aa, Artificial Sequence
  D(2) dopamine receptor (338-346)
AKIFEIQTM

SEQ ID NO: 16902 - protein, 9 aa, Artificial Sequence
  Poly(rC)-binding protein 2 (308-316)
AKINEIRQM

SEQ ID NO: 16903 - protein, 9 aa, Artificial Sequence
  Reticulon-2 (522-530)
AKIPGTGAL

SEQ ID NO: 16904 - protein, 11 aa, Artificial Sequence
  Protein SET (89-99)
AKIPNFWVTTF

SEQ ID NO: 16905 - protein, 11 aa, Artificial Sequence
  COBW domain-containing protein 6 (40-50)
AKIPVTIITGY

SEQ ID NO: 16906 - protein, 11 aa, Artificial Sequence
  Dolichyl-diphosphooligosaccharide-proteinosyltransferase subunit 1 (125-135)
AKISVIVETVY

SEQ ID NO: 16907 - protein, 9 aa, Artificial Sequence
  Nuclear fragile X mental retardation-interacting protein 2 (350-358)
AKIVPKISY

SEQ ID NO: 16908 - protein, 9 aa, Artificial Sequence
  Poly (ADP-ribose) polymerase 3 (121-129)
AKKDFEKKF

SEQ ID NO: 16909 - protein, 9 aa, Artificial Sequence
  DnaJ homolog subfamily C member 7 (40-48)
AKKDYNEAY

SEQ ID NO: 16910 - protein, 9 aa, Artificial Sequence
  Double-stranded RNA-binding protein Staufen homolog 1 (297-305)
AKKEKEPEY

SEQ ID NO: 16911 - protein, 9 aa, Artificial Sequence
  Translocation protein SEC62 (64-72)
AKKGEEALF

SEQ ID NO: 16912 - protein, 9 aa, Artificial Sequence
  SWI/SNF complex subunit SMARCC2 (316-324)
AKKGPSTPY

SEQ ID NO: 16913 - protein, 9 aa, Artificial Sequence
  Myosin light chain 1/3, skeletal muscle isoform (105-113)
AKKIEFEQF

SEQ ID NO: 16914 - protein, 9 aa, Artificial Sequence
  Probable ATP-dependent RNA helicase DDX6 (351-359)
AKKISQLGY

SEQ ID NO: 16915 - protein, 9 aa, Artificial Sequence
  Poly (ADP-ribose) polymerase 8 (686-694)
AKKLFGSTF

SEQ ID NO: 16916 - protein, 9 aa, Artificial Sequence
  Serine/threonine-protein phosphatase 2A 56 kDa regulatory subunit delta isoform (231-239)
AKKYIDQKF

SEQ ID NO: 16917 - protein, 9 aa, Artificial Sequence
  Nucleolar RNA helicase 2 (386-394)
AKKYMKSTY

SEQ ID NO: 16918 - protein, 11 aa, Artificial Sequence
  Interferon-induced, double-stranded RNA-activated protein kinase (313-323)
AKLDHVNIVHY

SEQ ID NO: 16919 - protein, 9 aa, Artificial Sequence
  Golgin subfamily A member 4 (798-806)
AKLDVFQSY

SEQ ID NO: 16920 - protein, 9 aa, Artificial Sequence
  Zinc finger Ran-binding domain-containing protein 2 (94-102)
AKLEERTGY

SEQ ID NO: 16921 - protein, 9 aa, Artificial Sequence
  Pre-mRNA-splicing factor ATP-dependent RNA helicase PRP16 (1082-1090)
AKLKGIGEY

SEQ ID NO: 16922 - protein, 9 aa, Artificial Sequence
  DNA replication licensing factor MCM5 (557-565)
AKLKKFIAY

SEQ ID NO: 16923 - protein, 10 aa, Artificial Sequence
  Transmembrane and coiled-coil domain-containing protein 1 (115-124)
AKLPFTPLSY

SEQ ID NO: 16924 - protein, 9 aa, Artificial Sequence
  ATP-dependent RNA helicase A (856-864)
AKLPIEPRF

SEQ ID NO: 16925 - protein, 9 aa, Artificial Sequence
  Peptidyl-prolyl cis-trans isomerase FKBP1A (73-81)
AKLTISPDY

SEQ ID NO: 16926 - protein, 11 aa, Artificial Sequence
  Heterogeneous nuclear ribonucleoprotein U (422-432)
AKNGQDLGVAF

SEQ ID NO: 16927 - protein, 9 aa, Artificial Sequence
  Pre-mRNA-processing-splicing factor 8 (1011-1019)
AKNNVVINY

SEQ ID NO: 16928 - protein, 9 aa, Artificial Sequence
  Immunoglobulin superfamily member 10 (2607-2615)
AKNPLGSDY

SEQ ID NO: 16929 - protein, 11 aa, Artificial Sequence
  ADP-ribosylation factor GTPase-activating protein 3 (30-40)
AKNPSWASITY

SEQ ID NO: 16930 - protein, 10 aa, Artificial Sequence
  Transmembrane protein 214 (356-365)
AKPDSTLHTY

SEQ ID NO: 16931 - protein, 10 aa, Artificial Sequence
  Nucleolar GTP-binding protein 2 (401-410)
AKPEYISKTY

SEQ ID NO: 16932 - protein, 9 aa, Artificial Sequence
  Vacuolar protein sorting-associated protein 41 homolog (804-812)
AKPFSVVVF

SEQ ID NO: 16933 - protein, 9 aa, Artificial Sequence
  116 kDa U5 small nuclear ribonucleoprotein component (445-453)
AKPKIEHTY

SEQ ID NO: 16934 - protein, 9 aa, Artificial Sequence
  Olfactomedin-like protein 2B (2-10)
AKPRLLVLY

SEQ ID NO: 16935 - protein, 10 aa, Artificial Sequence
  RNA-binding protein 38 (113-122)
AKPRSLQTGF

SEQ ID NO: 16936 - protein, 9 aa, Artificial Sequence
  116 kDa U5 small nuclear ribonucleoprotein component (962-970)
AKQDVVLNY

SEQ ID NO: 16937 - protein, 9 aa, Artificial Sequence
  Nuclear pore complex protein Nup153 (293-301)
AKQLSAQSY

SEQ ID NO: 16938 - protein, 9 aa, Artificial Sequence
  Proteasome activator complex subunit 1 (189-197)
AKQPHVGDY

SEQ ID NO: 16939 - protein, 9 aa, Artificial Sequence
  Mitochondrial import receptor subunit TOM7 homolog (8-16)
AKQRLQQLF

SEQ ID NO: 16940 - protein, 9 aa, Artificial Sequence
  Protein disulfide-isomerase A4 (244-252)
AKRFDVSGY

SEQ ID NO: 16941 - protein, 9 aa, Artificial Sequence
  Serine/threonine-protein phosphatase PP1-beta catalytic subunit (258-266)
AKRQLVTLF

SEQ ID NO: 16942 - protein, 8 aa, Artificial Sequence
  Putative uncharacterized protein C10orf113 (2-9)
AKSERRIY

SEQ ID NO: 16943 - protein, 9 aa, Artificial Sequence
  Serine/threonine-protein kinase/endoribonuclease IRE1 (276-284)
AKSKLTPTL

SEQ ID NO: 16944 - protein, 10 aa, Artificial Sequence
  Gamma-taxilin (369-378)
AKSNELFTTF

SEQ ID NO: 16945 - protein, 9 aa, Artificial Sequence
  Cullin-1 (38-46)
AKSRYMELY

SEQ ID NO: 16946 - protein, 9 aa, Artificial Sequence
  Protein disulfide-isomerase TMX3 (363-371)
AKSTIVSIF

SEQ ID NO: 16947 - protein, 9 aa, Artificial Sequence
  Coiled-coil domain-containing protein 115 (51-59)
AKSVGPLQY

SEQ ID NO: 16948 - protein, 9 aa, Artificial Sequence
  Cyclin-dependent kinase 14 (280-288)
AKSVPSHTY

SEQ ID NO: 16949 - protein, 9 aa, Artificial Sequence
  Nuclear nucleic acid-binding protein C1D (53-61)
AKVDLVSAY

SEQ ID NO: 16950 - protein, 10 aa, Artificial Sequence
  Plastin-2 (19-28)
AKVDTDGNGY

SEQ ID NO: 16951 - protein, 9 aa, Artificial Sequence
  Transmembrane protein 14D (103-111)
AKVGVRMLM

SEQ ID NO: 16952 - protein, 9 aa, Artificial Sequence
  60S ribosomal protein L27 (114-122)
AKVKFEERY

SEQ ID NO: 16953 - protein, 8 aa, Artificial Sequence
  Neuroblast differentiation-associated protein AHNAK (5180-5187)
AKVKTPSF

SEQ ID NO: 16954 - protein, 9 aa, Artificial Sequence
  Nck-associated protein 1-like (512-520)
AKVMNLIVF

SEQ ID NO: 16955 - protein, 9 aa, Artificial Sequence
  Dolichyl-diphosphooligosaccharide-proteinosyltransferase subunit STT3A (520-528)
AKVMSWWDY

SEQ ID NO: 16956 - protein, 9 aa, Artificial Sequence
  Eukaryotic translation initiation factor 3 subunit L (142-150)
AKVSGGPSL

SEQ ID NO: 16957 - protein, 9 aa, Artificial Sequence
  Condensin-2 complex subunit D3 (362-370)
AKVVDKSEY

SEQ ID NO: 16958 - protein, 9 aa, Artificial Sequence
  Cytoskeleton-associated protein 5 (1205-1213)
AKWLQDEMF

SEQ ID NO: 16959 - protein, 11 aa, Artificial Sequence
  DNA-directed RNA polymerase II subunit RPB3 (174-184)
AKWNPTAGVAF

SEQ ID NO: 16960 - protein, 9 aa, Artificial Sequence
  Enhancer of mRNA-decapping protein 4 (124-132)
AKYDWEQKY

SEQ ID NO: 16961 - protein, 9 aa, Artificial Sequence
  Myotubularin-related protein 6 (102-110)
AKYEDLYAF

SEQ ID NO: 16962 - protein, 9 aa, Artificial Sequence
  CXXC-type zinc finger protein 1 (507-515)
AKYESQTSF

SEQ ID NO: 16963 - protein, 9 aa, Artificial Sequence
  Guanine nucleotide-binding protein G(s) subunit alpha isoforms XLas (980-988)
AKYFIRDEF

SEQ ID NO: 16964 - protein, 9 aa, Artificial Sequence
  Integrator complex subunit 10 (304-312)
AKYKNQVVY

SEQ ID NO: 16965 - protein, 11 aa, Artificial Sequence
  40S ribosomal protein S5 (46-56)
AKYLPHSAGRY

SEQ ID NO: 16966 - protein, 11 aa, Artificial Sequence
  Nucleolar protein 56 (319-329)
AKYPASTVQIL

SEQ ID NO: 16967 - protein, 9 aa, Artificial Sequence
  Proteasome activator complex subunit 3 (194-202)
AKYPHVEDY

SEQ ID NO: 16968 - protein, 9 aa, Artificial Sequence
  V-type proton ATPase subunit C 1 (110-118)
AKYPIKQSL

SEQ ID NO: 16969 - protein, 9 aa, Artificial Sequence
  Probable ATP-dependent RNA helicase DDX10 (280-288)
AKYSTPATL

SEQ ID NO: 16970 - protein, 9 aa, Artificial Sequence
  26S proteasome non-ATPase regulatory subunit 12 (367-375)
AKYYTRITM

SEQ ID NO: 16971 - protein, 10 aa, Artificial Sequence
  Serine/arginine repetitive matrix protein 2 (2360-2369)
ALAPASLTSA

SEQ ID NO: 16972 - protein, 9 aa, Artificial Sequence
  Protein FAM217A (258-266)
ALDLHNLAL

SEQ ID NO: 16973 - protein, 9 aa, Artificial Sequence
  HAUS augmin-like complex subunit 8 (77-85)
ALDTTRHEL

SEQ ID NO: 16974 - protein, 10 aa, Artificial Sequence
  Mesoderm development candidate 1 (248-257)
ALFSGPLVQA

SEQ ID NO: 16975 - protein, 9 aa, Artificial Sequence
  Zinc finger protein 827 (563-571)
ALFSQDISV

SEQ ID NO: 16976 - protein, 9 aa, Artificial Sequence
  DNA-directed RNA polymerase I subunit RPA49 (297-305)
ALGPGVPHI

SEQ ID NO: 16977 - protein, 10 aa, Artificial Sequence
  Fatty acid desaturase 2 (422-431)
ALLDIIRSLK

SEQ ID NO: 16978 - protein, 9 aa, Artificial Sequence
  Symplekin (780-788)
ALLPQNHKL

SEQ ID NO: 16979 - protein, 9 aa, Artificial Sequence
  Transmembrane protein 147 (135-143)
ALSTLALYV

SEQ ID NO: 16980 - protein, 10 aa, Artificial Sequence
  Protein HIRA (789-798)
ALTAAATLSV

SEQ ID NO: 16981 - protein, 9 aa, Artificial Sequence
  ATP-binding cassette sub-family B member 8, mitochondrial (142-150)
ALVNVQIPL

SEQ ID NO: 16982 - protein, 9 aa, Artificial Sequence
  Serine/threonine-protein phosphatase 6 regulatory ankyrin repeat subunit A (155-163)
ALVPLLSNV

SEQ ID NO: 16983 - protein, 9 aa, Artificial Sequence
  Protein transport protein Sec61 subunit alpha isoform 2 (274-282)
ALVSNLYVI

SEQ ID NO: 16984 - protein, 9 aa, Artificial Sequence
  E3 ubiquitin-protein ligase UBR4 (709-717)
ALYHFNHSL

SEQ ID NO: 16985 - protein, 9 aa, Artificial Sequence
  Tetratricopeptide repeat protein 13 (724-732)
ALYKDLTAK

SEQ ID NO: 16986 - protein, 9 aa, Artificial Sequence
  E3 ubiquitin-protein ligase UBR5 (376-384)
ALYSELLAV

SEQ ID NO: 16987 - protein, 9 aa, Artificial Sequence
  Protein spinster homolog 3 (269-277)
AMAFVTGAL

SEQ ID NO: 16988 - protein, 9 aa, Artificial Sequence
  28S ribosomal protein S9, mitochondrial (347-355)
AMAKALCSF

SEQ ID NO: 16989 - protein, 11 aa, Artificial Sequence
  Probable ribosome biogenesis protein RLP24 (92-102)
AMKRVEEIKQK

SEQ ID NO: 16990 - protein, 9 aa, Artificial Sequence
  Melanocyte-stimulating hormone receptor (198-206)
AMLVLMAVL

SEQ ID NO: 16991 - protein, 9 aa, Artificial Sequence
  Enteropeptidase (878-886)
AMMHLEFKV

SEQ ID NO: 16992 - protein, 9 aa, Artificial Sequence
  60S ribosomal protein L11 (162-170)
AMRWFQQKY

SEQ ID NO: 16993 - protein, 9 aa, Artificial Sequence
  Multivesicular body subunit 12A (38-46)
APASFGKSF

SEQ ID NO: 16994 - protein, 9 aa, Artificial Sequence
  Hypoxia-inducible factor 1-alpha (828-836)
APIQGSRNL

SEQ ID NO: 16995 - protein, 9 aa, Artificial Sequence
  Transcriptional activator Myb (224-232)
AQAPPTAQL

SEQ ID NO: 16996 - protein, 9 aa, Artificial Sequence
  Serine/threonine-protein phosphatase 2B catalytic subunit beta isoform (292-300)
AQDAGYRMY

SEQ ID NO: 16997 - protein, 8 aa, Artificial Sequence
  Transcription intermediary factor 1-beta (762-769)
AQDVGRMF

SEQ ID NO: 16998 - protein, 9 aa, Artificial Sequence
  Poly(A) polymerase gamma (579-587)
AQGLSIPVI

SEQ ID NO: 16999 - protein, 9 aa, Artificial Sequence
  Ribosomal RNA processing protein 1 homolog A (91-99)
AQHLFLQAF

SEQ ID NO: 17000 - protein, 9 aa, Artificial Sequence
  Very-long-chain enoyl-CoA reductase (83-91)
AQISWVTVF

SEQ ID NO: 17001 - protein, 9 aa, Artificial Sequence
  Disintegrin and metalloproteinase domain-containing protein 15 (301-309)
AQLVTGTSF

SEQ ID NO: 17002 - protein, 10 aa, Artificial Sequence
  Protein YIF1B (52-61)
AQRAPGGLSY

SEQ ID NO: 17003 - protein, 9 aa, Artificial Sequence
  Activator of basal transcription 1 (212-220)
AQRPTEQEL

SEQ ID NO: 17004 - protein, 8 aa, Artificial Sequence
  UBX domain-containing protein 4 (350-357)
AQTVGNTY

SEQ ID NO: 17005 - protein, 9 aa, Artificial Sequence
  Uncharacterized protein C11orf24 (193-201)
AQVPKSSAL

SEQ ID NO: 17006 - protein, 10 aa, Artificial Sequence
  Asparagine synthetase (glutamine-hydrolyzing) (277-286)
AQVQYPLQTF

SEQ ID NO: 17007 - protein, 9 aa, Artificial Sequence
  Elongation factor 1-gamma (93-101)
AQVVQWVSF

SEQ ID NO: 17008 - protein, 9 aa, Artificial Sequence
  Transmembrane protein 147 (151-159)
AQVWMITRY

SEQ ID NO: 17009 - protein, 9 aa, Artificial Sequence
  Replication initiator 1 (187-195)
AQWDQLVAH

SEQ ID NO: 17010 - protein, 9 aa, Artificial Sequence
  Probable helicase with zinc finger domain (470-478)
AQYKEISKF

SEQ ID NO: 17011 - protein, 9 aa, Artificial Sequence
  Ribonuclease K6 (120-128)
AQYKFFIVA

SEQ ID NO: 17012 - protein, 9 aa, Artificial Sequence
  Centromere protein N (267-275)
AQYKLETKF

SEQ ID NO: 17013 - protein, 10 aa, Artificial Sequence
  Periodic tryptophan protein 1 homolog (372-381)
ARSDKPIFTL

SEQ ID NO: 17014 - protein, 9 aa, Artificial Sequence
  Olfactory receptor 5K3 (240-248)
ASHFLSVSI

SEQ ID NO: 17015 - protein, 9 aa, Artificial Sequence
  N-acetyllactosaminide beta-1,6-N-acetylglucosaminyl-transferase, isoform A (153-161)
ASKKESVVY

SEQ ID NO: 17016 - protein, 9 aa, Artificial Sequence
  Cytoplasmic FMR1-interacting protein 1 (658-666)
ASMMEYVLY

SEQ ID NO: 17017 - protein, 10 aa, Artificial Sequence
  Utrophin (3369-3378)
ASPQHSALSY

SEQ ID NO: 17018 - protein, 9 aa, Artificial Sequence
  RNA-binding protein NOB1 (403-411)
ASRKKFVKK

SEQ ID NO: 17019 - protein, 9 aa, Artificial Sequence
  Nodal modulator 2 (823-831)
ASSPLITVF

SEQ ID NO: 17020 - protein, 9 aa, Artificial Sequence
  Asparagine synthetase (glutamine-hydrolyzing) (544-552)
ATDPSARTL

SEQ ID NO: 17021 - protein, 9 aa, Artificial Sequence
  Ribosomal RNA processing protein 1 homolog B (664-672)
ATHPPGPAV

SEQ ID NO: 17022 - protein, 9 aa, Artificial Sequence
  Polyadenylate-binding protein 1 (359-367)
ATKPLYVAL

SEQ ID NO: 17023 - protein, 9 aa, Artificial Sequence
  ATP-dependent 6-phosphofructokinase, muscle type (150-158)
ATKSSYLNI

SEQ ID NO: 17024 - protein, 9 aa, Artificial Sequence
  Transmembrane protein 9B (2-10)
ATLWGGLLR

SEQ ID NO: 17025 - protein, 9 aa, Artificial Sequence
  Serine/threonine-protein phosphatase 6 regulatory subunit 1 (821-829)
ATRDPSTSV

SEQ ID NO: 17026 - protein, 9 aa, Artificial Sequence
  Leukocyte-associated immunoglobulin-like receptor 1 (224-232)
ATVNGLPEK

SEQ ID NO: 17027 - protein, 9 aa, Artificial Sequence
  40S ribosomal protein S5 (40-48)
AVKEKYAKY

SEQ ID NO: 17028 - protein, 9 aa, Artificial Sequence
  Oligoribonuclease, mitochondrial (109-117)
AVKESTITL

SEQ ID NO: 17029 - protein, 9 aa, Artificial Sequence
  39S ribosomal protein L44, mitochondrial (114-122)
AVLLNLKSN

SEQ ID NO: 17030 - protein, 10 aa, Artificial Sequence
  Ig lambda-2 chain C regions (41-50)
AWKADSSPVK

SEQ ID NO: 17031 - protein, 9 aa, Artificial Sequence
  Nucleolar transcription factor 1 (644-652)
AYKEYISNK

SEQ ID NO: 17032 - protein, 10 aa, Artificial Sequence
  Translocon-associated protein subunit gamma (76-85)
AYKNVKFVLK

SEQ ID NO: 17033 - protein, 9 aa, Artificial Sequence
  Serine-protein kinase ATM (740-748)
AYKSELFQK

SEQ ID NO: 17034 - protein, 9 aa, Artificial Sequence
  Poly (ADP-ribose) polymerase (365-373)
AYPEYLITF

SEQ ID NO: 17035 - protein, 12 aa, Artificial Sequence
  Sialoadhesin (1671-1682)
CKQSMGENSVEM

SEQ ID NO: 17036 - protein, 9 aa, Artificial Sequence
  Transmembrane inner ear expressed protein (21-29)
CLAGVAGQL

SEQ ID NO: 17037 - protein, 9 aa, Artificial Sequence
  Tetraspanin-18 (82-90)
CLLLFFFLF

SEQ ID NO: 17038 - protein, 9 aa, Artificial Sequence
  Asparagine-tRNA ligase, cytoplasmic (537-545)
CLYPRFVQR

SEQ ID NO: 17039 - protein, 11 aa, Artificial Sequence
  Protein-glutamine gamma-glutamyltransferase 4 (213-223)
CRAMCAMMSFE

SEQ ID NO: 17040 - protein, 10 aa, Artificial Sequence
  Pentatricopeptide repeat domain-containing protein 3, mitochondrial (34-43)
CRFYSGSATL

SEQ ID NO: 17041 - protein, 9 aa, Artificial Sequence
  Endothelin-1 receptor (88-96)
CTIFIVGMV

SEQ ID NO: 17042 - protein, 9 aa, Artificial Sequence
  cAMP-dependent protein kinase type I-alpha regulatory subunit (109-117)
DAASYVRKV

SEQ ID NO: 17043 - protein, 9 aa, Artificial Sequence
  DnaJ homolog subfamily B member 9 (12-20)
DAEAKFREI

SEQ ID NO: 17044 - protein, 9 aa, Artificial Sequence
  Catenin beta-1 (145-153)
DAELATRAI

SEQ ID NO: 17045 - protein, 9 aa, Artificial Sequence
  Protein disulfide-isomerase A5 (441-449)
DAFKDDRKI

SEQ ID NO: 17046 - protein, 8 aa, Artificial Sequence
  Asparagine synthetase (glutamine-hydrolyzing) (9-16)
DAFRFENV

SEQ ID NO: 17047 - protein, 9 aa, Artificial Sequence
  Protein FAM127A (61-69)
DALKVTFLI

SEQ ID NO: 17048 - protein, 9 aa, Artificial Sequence
  Importin subunit beta-1 (627-635)
DALMAVSTL

SEQ ID NO: 17049 - protein, 8 aa, Artificial Sequence
  Eukaryotic translation initiation factor 3 subunit A (504-511)
DAPIGPHL

SEQ ID NO: 17050 - protein, 11 aa, Artificial Sequence
  Dermcidin (86-96)
DAVEDLESVGK

SEQ ID NO: 17051 - protein, 8 aa, Artificial Sequence
  DNA polymerase delta catalytic subunit (515-522)
DAYLPLRL

SEQ ID NO: 17052 - protein, 9 aa, Artificial Sequence
  Oral-facial-digital syndrome 1 protein (185-193)
DAYPQRIKF

SEQ ID NO: 17053 - protein, 9 aa, Artificial Sequence
  Splicing factor, arginine/serine-rich 15 (540-548)
DAYRALQKL

SEQ ID NO: 17054 - protein, 8 aa, Artificial Sequence
  Period circadian protein homolog 1 (771-778)
DAYRPVGL

SEQ ID NO: 17055 - protein, 9 aa, Artificial Sequence
  Torsin-1A-interacting protein 2 (317-325)
DAYTSSQKV

SEQ ID NO: 17056 - protein, 12 aa, Artificial Sequence
  Autism susceptibility gene 2 protein (283-294)
DCCKEPIFEPVV

SEQ ID NO: 17057 - protein, 10 aa, Artificial Sequence
  Voltage-dependent T-type calcium channel subunit alpha-1G (1640-1649)
DEALKICNYI

SEQ ID NO: 17058 - protein, 9 aa, Artificial Sequence
  Signal peptidase complex subunit 2 (82-90)
DGRLTICTI

SEQ ID NO: 17059 - protein, 10 aa, Artificial Sequence
  Alanine-tRNA ligase, cytoplasmic (300-309)
DHARTITVAL

SEQ ID NO: 17060 - protein, 9 aa, Artificial Sequence
  SRSF protein kinase 2 (597-605)
DHIAHIIEL

SEQ ID NO: 17061 - protein, 8 aa, Artificial Sequence
  Laminin subunit beta-3 (1159-1166)
DHINGRVL

SEQ ID NO: 17062 - protein, 9 aa, Artificial Sequence
  Coatomer subunit gamma-1 (762-770)
DHIQKVMKL

SEQ ID NO: 17063 - protein, 9 aa, Artificial Sequence
  Protein Hook homolog 2 (130-138)
DHIQRIMTL

SEQ ID NO: 17064 - protein, 9 aa, Artificial Sequence
  V-type proton ATPase subunit S1 (458-466)
DHKGPTISL

SEQ ID NO: 17065 - protein, 9 aa, Artificial Sequence
  Cyclin-Y-like protein 2 (84-92)
DHPKASTIF

SEQ ID NO: 17066 - protein, 9 aa, Artificial Sequence
  Calponin-2 (202-210)
DHSTISLQM

SEQ ID NO: 17067 - protein, 8 aa, Artificial Sequence
  Integrin beta-7 (722-729)
DHTQAIVL

SEQ ID NO: 17068 - protein, 8 aa, Artificial Sequence
  Lipopolysaccharide-responsive and beige-like anchor protein (1946-1953)
DHVTATQL

SEQ ID NO: 17069 - protein, 9 aa, Artificial Sequence
  BPI fold-containing family A member 2 (98-106)
DIFGLKISN

SEQ ID NO: 17070 - protein, 11 aa, Artificial Sequence
  BPI fold-containing family A member 2 (98-108)
DIFGLKISNSL

SEQ ID NO: 17071 - protein, 10 aa, Artificial Sequence
  60S ribosomal protein L4 (35-44)
DIVNFVHTNL

SEQ ID NO: 17072 - protein, 9 aa, Artificial Sequence
  Solute carrier family 2, facilitated glucose transporter member 2 (4-12)
DKVTGTLVF

SEQ ID NO: 17073 - protein, 9 aa, Artificial Sequence
  1,2-dihydroxy-3-keto-5-methylthiopentene dioxygenase (44-52)
DKYENDPEL

SEQ ID NO: 17074 - protein, 9 aa, Artificial Sequence
  Peroxidasin-like protein (813-821)
DLDHTVPAL

SEQ ID NO: 17075 - protein, 9 aa, Artificial Sequence
  Mitochondrial import receptor subunit TOM6 homolog (66-74)
DLMAPQPGV

SEQ ID NO: 17076 - protein, 9 aa, Artificial Sequence
  Phosphorylase b kinase gamma catalytic chain, skeletal muscle/heart isoform (105-113)
DLMKRGELF

SEQ ID NO: 17077 - protein, 9 aa, Artificial Sequence
  Inosine-5'-monophosphate dehydrogenase 1 (77-85)
DMAIAMALM

SEQ ID NO: 17078 - protein, 12 aa, Artificial Sequence
  Type II inositol 1,4,5-trisphosphate 5-phosphatase (2-13)
DQSVAIQETLAE

SEQ ID NO: 17079 - protein, 9 aa, Artificial Sequence
  Proline and serine-rich protein 3 (2-10)
DRSLPVFSI

SEQ ID NO: 17080 - protein, 9 aa, Artificial Sequence
  Nucleotide exchange factor SIL1 (410-418)
DRYRQDPQL

SEQ ID NO: 17081 - protein, 9 aa, Artificial Sequence
  Cyclin-Y-like protein 2 (130-138)
DSIASQPHL

SEQ ID NO: 17082 - protein, 8 aa, Artificial Sequence
  Hexokinase-2 (815-822)
DSIIVKEV

SEQ ID NO: 17083 - protein, 8 aa, Artificial Sequence
  60S ribosomal protein L6 (255-262)
DSQILPKI

SEQ ID NO: 17084 - protein, 9 aa, Artificial Sequence
  Small ubiquitin-related modifier 1 (30-38)
DSSEIHFKV

SEQ ID NO: 17085 - protein, 9 aa, Artificial Sequence
  Integrin beta-7 (374-382)
DSSNVVQLI

SEQ ID NO: 17086 - protein, 9 aa, Artificial Sequence
  Ig lambda-2 chain C regions (45-53)
DSSPVKAGV

SEQ ID NO: 17087 - protein, 9 aa, Artificial Sequence
  Sterol O-acyltransferase 1 (310-318)
DSYPRNPTV

SEQ ID NO: 17088 - protein, 8 aa, Artificial Sequence
  Store-operated calcium entry-associated regulatory factor (74-81)
DSYTPKVI

SEQ ID NO: 17089 - protein, 9 aa, Artificial Sequence
  Disintegrin and metalloproteinase domain-containing protein 15 (247-255)
DTFFRPLNV

SEQ ID NO: 17090 - protein, 8 aa, Artificial Sequence
  Sialidase-1 (75-82)
DTFRIPLI

SEQ ID NO: 17091 - protein, 9 aa, Artificial Sequence
  WD repeat-containing protein 54 (273-281)
DTFVHIWKL

SEQ ID NO: 17092 - protein, 9 aa, Artificial Sequence
  Protein FAM117A (93-101)
DTILSSYLL

SEQ ID NO: 17093 - protein, 10 aa, Artificial Sequence
  Ankyrin repeat and SOCS box protein 3 (420-429)
DTLIFTLEFT

SEQ ID NO: 17094 - protein, 9 aa, Artificial Sequence
  WD repeat-containing protein 26 (376-384)
DTTVIIWQV

SEQ ID NO: 17095 - protein, 9 aa, Artificial Sequence
  Signal recognition particle receptor subunit beta (154-162)
DVAEFLYQV

SEQ ID NO: 17096 - protein, 9 aa, Artificial Sequence
  60S ribosomal protein L23a (120-128)
DVAKVNTLI

SEQ ID NO: 17097 - protein, 9 aa, Artificial Sequence
  G2/M phase-specific E3 ubiquitin-protein ligase (493-501)
DVAQIIIRI

SEQ ID NO: 17098 - protein, 9 aa, Artificial Sequence
  Inorganic pyrophosphatase (42-50)
DVFHMVVEV

SEQ ID NO: 17099 - protein, 9 aa, Artificial Sequence
  Carboxylesterase 3 (415-423)
DVFINVPTV

SEQ ID NO: 17100 - protein, 9 aa, Artificial Sequence
  Bardet-Biedl syndrome 7 protein (53-61)
EAAAVFKTL

SEQ ID NO: 17101 - protein, 9 aa, Artificial Sequence
  Exocyst complex component 5 (158-166)
EAADIIQKL

SEQ ID NO: 17102 - protein, 9 aa, Artificial Sequence
  Lysine-specific histone demethylase 1A (710-718)
EAAGIMENI

SEQ ID NO: 17103 - protein, 11 aa, Artificial Sequence
  Probable phospholipid-transporting ATPase VA (700-710)
EAALVYAARAY

SEQ ID NO: 17104 - protein, 9 aa, Artificial Sequence
  Kelch-like protein 6 (450-458)
EAAPLLVHV

SEQ ID NO: 17105 - protein, 9 aa, Artificial Sequence
  Coatomer subunit gamma-1 (269-277)
EAASAIVNL

SEQ ID NO: 17106 - protein, 9 aa, Artificial Sequence
  Nesprin-3 (176-184)
EAASLFNRI

SEQ ID NO: 17107 - protein, 10 aa, Artificial Sequence
  snRNA-activating protein complex subunit 4 (237-246)
EAEKEIQDIN

SEQ ID NO: 17108 - protein, 9 aa, Artificial Sequence
  L-xylulose reductase (98-106)
EAFDRSFEV

SEQ ID NO: 17109 - protein, 10 aa, Artificial Sequence
  Protein flightless-1 homolog (516-525)
EAFHGKFYEA

SEQ ID NO: 17110 - protein, 9 aa, Artificial Sequence
  Mortality factor 4-like protein 2 (113-121)
EAFKNRMEV

SEQ ID NO: 17111 - protein, 9 aa, Artificial Sequence
  Pre-B-cell leukemia transcription factor-interacting protein 1 (166-174)
EAGPPQPMV

SEQ ID NO: 17112 - protein, 9 aa, Artificial Sequence
  E3 ubiquitin-protein ligase UBR2 (256-264)
EAIGFATTV

SEQ ID NO: 17113 - protein, 8 aa, Artificial Sequence
  60S ribosomal protein L10 (63-70)
EALEAARI

SEQ ID NO: 17114 - protein, 8 aa, Artificial Sequence
  Steroid hormone receptor ERR1 (353-360)
EALHEALL

SEQ ID NO: 17115 - protein, 9 aa, Artificial Sequence
  Very-long-chain (3R)-3-hydroxyacyl-CoA dehydratase 3 (293-301)
EAVSVIQSI

SEQ ID NO: 17116 - protein, 9 aa, Artificial Sequence
  Paired amphipathic helix protein Sin3a (1166-1174)
ECRFKLNSY

SEQ ID NO: 17117 - protein, 12 aa, Artificial Sequence
  RNA polymerase I-specific transcription initiation factor RRN3 (604-615)
EDDDFLKGEVPQ

SEQ ID NO: 17118 - protein, 9 aa, Artificial Sequence
  MICAL C-terminal-like protein (368-376)
EDVPTLLEK

SEQ ID NO: 17119 - protein, 9 aa, Artificial Sequence
  Protein transport protein Sec24C (408-416)
EEASPYVVD

SEQ ID NO: 17120 - protein, 11 aa, Artificial Sequence
  PHD finger protein 10 (446-456)
EEMMFCDMCDR

SEQ ID NO: 17121 - protein, 9 aa, Artificial Sequence
  FERM domain-containing protein 6 (338-346)
EENEEKKQY

SEQ ID NO: 17122 - protein, 9 aa, Artificial Sequence
  Epiplakin (2700-2708)
EERLSKVSF

SEQ ID NO: 17123 - protein, 12 aa, Artificial Sequence
  Salivary acidic proline-rich phosphoprotein 1/2 (44-55)
EERQGPPLGGQQ

SEQ ID NO: 17124 - protein, 9 aa, Artificial Sequence
  Inactive ubiquitin carboxyl-terminal hydrolase 17-like protein 4 (449-457)
EFNVRKVEG

SEQ ID NO: 17125 - protein, 9 aa, Artificial Sequence
  Kinesin heavy chain isoform 5A (583-591)
EFTVARLYI

SEQ ID NO: 17126 - protein, 9 aa, Artificial Sequence
  Hyaluronan and proteoglycan link protein 2 (201-209)
EGSVRYPVL

SEQ ID NO: 17127 - protein, 8 aa, Artificial Sequence
  Gem-associated protein 5 (589-596)
EHGSQPEL

SEQ ID NO: 17128 - protein, 9 aa, Artificial Sequence
  Filamin-B (2269-2277)
EHIPESPYL

SEQ ID NO: 17129 - protein, 9 aa, Artificial Sequence
  Protein Hook homolog 1 (136-144)
EHIQNIMTL

SEQ ID NO: 17130 - protein, 9 aa, Artificial Sequence
  26S proteasome non-ATPase regulatory subunit 11 (348-356)
EHISSLIKL

SEQ ID NO: 17131 - protein, 9 aa, Artificial Sequence
  Intraflagellar transport protein 46 homolog (70-78)
EHLPVSAEI

SEQ ID NO: 17132 - protein, 9 aa, Artificial Sequence
  Kinesin-like protein KIF21B (1412-1420)
EHQINQIAL

SEQ ID NO: 17133 - protein, 9 aa, Artificial Sequence
  Zinc finger and BTB domain-containing protein 38 (220-228)
EHSYAVSSV

SEQ ID NO: 17134 - protein, 9 aa, Artificial Sequence
  Fructose-bisphosphate aldolase A (156-164)
EHTPSALAI

SEQ ID NO: 17135 - protein, 9 aa, Artificial Sequence
  Ribosome-binding protein 1 (768-776)
EHVKEVQQL

SEQ ID NO: 17136 - protein, 9 aa, Artificial Sequence
  OTU domain-containing protein 6B (276-284)
EHYNSVTRL

SEQ ID NO: 17137 - protein, 9 aa, Artificial Sequence
  E3 ubiquitin-protein ligase UBR4 (401-409)
EHYQNFQLL

SEQ ID NO: 17138 - protein, 9 aa, Artificial Sequence
  26S protease regulatory subunit 4 (130-138)
EHYVSILSF

SEQ ID NO: 17139 - protein, 9 aa, Artificial Sequence
  Epsin-2 (42-50)
EIADLTYNV

SEQ ID NO: 17140 - protein, 9 aa, Artificial Sequence
  Telomere-associated protein RIF1 (220-228)
EIASITEQL

SEQ ID NO: 17141 - protein, 10 aa, Artificial Sequence
  General transcription factor II-I (577-586)
EIFNLKFAQA

SEQ ID NO: 17142 - protein, 10 aa, Artificial Sequence
  Atlastin-3 (199-208)
EIFQKPFQTL

SEQ ID NO: 17143 - protein, 9 aa, Artificial Sequence
  DNA-directed RNA polymerase III subunit RPC5 (655-663)
EIFSKNYRV

SEQ ID NO: 17144 - protein, 10 aa, Artificial Sequence
  C-X-C motif chemokine 9 (62-71)
EIIATLKNGV

SEQ ID NO: 17145 - protein, 9 aa, Artificial Sequence
  Uncharacterized protein CXorf23 (474-482)
EIITIIHQV

SEQ ID NO: 17146 - protein, 9 aa, Artificial Sequence
  Serine/threonine-protein kinase TBK1 (497-505)
EISDIHTKL

SEQ ID NO: 17147 - protein, 9 aa, Artificial Sequence
  Constitutive coactivator of peroxisome proliferator-activated receptor gamma (111-119)
EISRIFHYI

SEQ ID NO: 17148 - protein, 9 aa, Artificial Sequence
  Centrosomal protein of 170 kDa protein B (1491-1499)
EISSILKEL

SEQ ID NO: 17149 - protein, 9 aa, Artificial Sequence
  Testis-specific Y-encoded-like protein 2 (468-476)
EITDINENI

SEQ ID NO: 17150 - protein, 9 aa, Artificial Sequence
  Oxysterols receptor LXR-beta (280-288)
EIVDFAKQV

SEQ ID NO: 17151 - protein, 10 aa, Artificial Sequence
  Tubulin beta-4B chain (3-12)
EIVHLQAGQC

SEQ ID NO: 17152 - protein, 9 aa, Artificial Sequence
  Activating transcription factor 7-interacting protein 2 (101-109)
EIVHSETKL

SEQ ID NO: 17153 - protein, 9 aa, Artificial Sequence
  Ras GTPase-activating-like protein IQGAP2 (753-761)
EIVKIQSLL

SEQ ID NO: 17154 - protein, 9 aa, Artificial Sequence
  Williams-Beuren syndrome chromosomal region 16 protein (214-222)
EIYSESHRV

SEQ ID NO: 17155 - protein, 10 aa, Artificial Sequence
  Protein S100-A8 (6-15)
EKALNSIIDV

SEQ ID NO: 17156 - protein, 10 aa, Artificial Sequence
  Zinc finger protein 559 (97-106)
EKALSEHSCL

SEQ ID NO: 17157 - protein, 9 aa, Artificial Sequence
  Replication protein A 32 kDa subunit (84-92)
EKAPTNIVY

SEQ ID NO: 17158 - protein, 9 aa, Artificial Sequence
  Pre-mRNA-processing factor 40 homolog A (475-483)
EKMTSTTRY

SEQ ID NO: 17159 - protein, 10 aa, Artificial Sequence
  Transcriptional repressor p66-beta (434-443)
EKNGKILCEQ

SEQ ID NO: 17160 - protein, 10 aa, Artificial Sequence
  Valine-tRNA ligase (271-280)
EKRDPGVITY

SEQ ID NO: 17161 - protein, 9 aa, Artificial Sequence
  Transcriptional regulator Kaiso (528-536)
EKVFPLAEY

SEQ ID NO: 17162 - protein, 9 aa, Artificial Sequence
  Tyrosine-tRNA ligase, cytoplasmic (281-289)
EKWGGNKTY

SEQ ID NO: 17163 - protein, 9 aa, Artificial Sequence
  E3 ubiquitin-protein ligase synoviolin (216-224)
ELFTGFIKV

SEQ ID NO: 17164 - protein, 10 aa, Artificial Sequence
  Cohesin subunit SA-2 (1209-1218)
ELKPDFFDPA

SEQ ID NO: 17165 - protein, 9 aa, Artificial Sequence
  Cytospin-A (413-421)
ELQATLQEL

SEQ ID NO: 17166 - protein, 9 aa, Artificial Sequence
  E3 ubiquitin-protein ligase UBR4 (3813-3821)
ELSKIIQKV

SEQ ID NO: 17167 - protein, 9 aa, Artificial Sequence
  60S ribosomal protein L36 (89-97)
ELSNVLAAM

SEQ ID NO: 17168 - protein, 10 aa, Artificial Sequence
  Glutamate-rich protein 3 (1485-1494)
ELSPESLQAM

SEQ ID NO: 17169 - protein, 9 aa, Artificial Sequence
  Mini-chromosome maintenance complex-binding protein (343-351)
ELSPVRAEL

SEQ ID NO: 17170 - protein, 12 aa, Artificial Sequence
  Dynamin-binding protein (804-815)
EMCIERIMVPMQ

SEQ ID NO: 17171 - protein, 10 aa, Artificial Sequence
  GLIPR1-like protein 2 (312-321)
EMEMEIMEME

SEQ ID NO: 17172 - protein, 12 aa, Artificial Sequence
  Pleckstrin homology domain-containing family G member 3 (582-593)
EMGGAAQEPESL

SEQ ID NO: 17173 - protein, 9 aa, Artificial Sequence
  Contactin-1 (416-424)
EMNPMKKKI

SEQ ID NO: 17174 - protein, 8 aa, Artificial Sequence
  Putative vomeronasal receptor-like protein 4 (2-9)
EMTKLFSY

SEQ ID NO: 17175 - protein, 10 aa, Artificial Sequence
  Putative vomeronasal receptor-like protein 4 (2-11)
EMTKLFSYIV

SEQ ID NO: 17176 - protein, 9 aa, Artificial Sequence
  Cyclin-H (240-248)
ENRTCLSQL

SEQ ID NO: 17177 - protein, 9 aa, Artificial Sequence
  3-phosphoinositide-dependent protein kinase 1 (57-65)
EPRPGAGSL

SEQ ID NO: 17178 - protein, 9 aa, Artificial Sequence
  Gamma-glutamyltransferase 6 (2-10)
ERAEEPVVY

SEQ ID NO: 17179 - protein, 9 aa, Artificial Sequence
  Integrin beta-7 (243-251)
EREVGRQSV

SEQ ID NO: 17180 - protein, 9 aa, Artificial Sequence
  Serine/threonine-protein kinase pim-3 (34-42)
ESFEKAYQV

SEQ ID NO: 17181 - protein, 9 aa, Artificial Sequence
  Endoplasmin (550-558)
ESSPFVERL

SEQ ID NO: 17182 - protein, 9 aa, Artificial Sequence
  Lamina-associated polypeptide 2, isoforms beta/gamma (277-285)
ESTPIAETI

SEQ ID NO: 17183 - protein, 12 aa, Artificial Sequence
  Dermcidin (92-103)
ESVGKGAVHDVK

SEQ ID NO: 17184 - protein, 9 aa, Artificial Sequence
  Elongation factor 2 (311-319)
ETAKLIEKL

SEQ ID NO: 17185 - protein, 10 aa, Artificial Sequence
  Dolichyl-diphosphooligosaccharide-proteinosyltransferase 48 kDa subunit (318-327)
ETAPPNAYTV

SEQ ID NO: 17186 - protein, 9 aa, Artificial Sequence
  Heat shock protein HSP 90-beta (13-21)
ETFAFQAEI

SEQ ID NO: 17187 - protein, 9 aa, Artificial Sequence
  Cyclin-dependent kinase 6 (69-77)
ETFEHPNVV

SEQ ID NO: 17188 - protein, 9 aa, Artificial Sequence
  Serine/threonine-protein phosphatase 2A catalytic subunit beta isoform (226-234)
ETFNHANGL

SEQ ID NO: 17189 - protein, 12 aa, Artificial Sequence
  Protein diaphanous homolog 1 (1255-1266)
ETFPTILEEAKE

SEQ ID NO: 17190 - protein, 9 aa, Artificial Sequence
  Serine/threonine-protein kinase 17B (257-265)
ETFSSVSQL

SEQ ID NO: 17191 - protein, 9 aa, Artificial Sequence
  Transcription elongation factor SPT6 (1159-1167)
ETFYIGKLI

SEQ ID NO: 17192 - protein, 9 aa, Artificial Sequence
  SWI/SNF-related matrix-associated actin-dependent regulator of chromatin subfamily D member 2 (442-450)
ETIESINQL

SEQ ID NO: 17193 - protein, 10 aa, Artificial Sequence
  Ribonuclease H2 subunit C (135-144)
ETIPGPDAKV

SEQ ID NO: 17194 - protein, 10 aa, Artificial Sequence
  MOB kinase activator 1A (129-138)
ETLFPSKIGV

SEQ ID NO: 17195 - protein, 9 aa, Artificial Sequence
  Cystatin-B (15-23)
ETQHIADQV

SEQ ID NO: 17196 - protein, 9 aa, Artificial Sequence
  Heat shock protein HSP 90-beta (478-486)
ETQKSIYYI

SEQ ID NO: 17197 - protein, 10 aa, Artificial Sequence
  Wiskott-Aldrich syndrome protein (285-294)
ETSKLIYDFI

SEQ ID NO: 17198 - protein, 9 aa, Artificial Sequence
  Elongation factor 1-alpha 1 (81-89)
ETSKYYVTI

SEQ ID NO: 17199 - protein, 9 aa, Artificial Sequence
  Protein virilizer homolog (61-69)
ETSPHTFQL

SEQ ID NO: 17200 - protein, 9 aa, Artificial Sequence
  Splicing factor 3B subunit 1 (1221-1229)
ETSPHVIQA

SEQ ID NO: 17201 - protein, 10 aa, Artificial Sequence
  G1/S-specific cyclin-D2 (114-123)
ETSPLTAEKL

SEQ ID NO: 17202 - protein, 9 aa, Artificial Sequence
  Neurexin-3 (1375-1383)
ETTKDSLSM

SEQ ID NO: 17203 - protein, 9 aa, Artificial Sequence
  Mucin-16 (2346-2354)
ETTVKTSDI

SEQ ID NO: 17204 - protein, 9 aa, Artificial Sequence
  Non-structural maintenance of chromosomes element 1 homolog (182-190)
ETYPDAVKI

SEQ ID NO: 17205 - protein, 9 aa, Artificial Sequence
  Alanine-tRNA ligase, cytoplasmic (688-696)
ETYPDPVRV

SEQ ID NO: 17206 - protein, 10 aa, Artificial Sequence
  Actin-related protein 2 (129-138)
ETYQFSGVYV

SEQ ID NO: 17207 - protein, 9 aa, Artificial Sequence
  Pre-mRNA-processing-splicing factor 8 (1844-1852)
EVAALIRSL

SEQ ID NO: 17208 - protein, 9 aa, Artificial Sequence
  Ankyrin repeat and KH domain-containing protein 1 (519-527)
EVADFLIKA

SEQ ID NO: 17209 - protein, 9 aa, Artificial Sequence
  PRKCA-binding protein (85-93)
EVAKMIQEV

SEQ ID NO: 17210 - protein, 9 aa, Artificial Sequence
  A-kinase anchor protein 9 (1455-1463)
EVAKVIVSM

SEQ ID NO: 17211 - protein, 9 aa, Artificial Sequence
  Histone acetyltransferase KAT8 (250-258)
EVDGKDHKI

SEQ ID NO: 17212 - protein, 11 aa, Artificial Sequence
  Nucleolin (411-421)
EVFEDAAEIRL

SEQ ID NO: 17213 - protein, 9 aa, Artificial Sequence
  Nucleolin (504-512)
EVFEKATFI

SEQ ID NO: 17214 - protein, 9 aa, Artificial Sequence
  Desmoplakin (745-753)
EVFGLFQKL

SEQ ID NO: 17215 - protein, 9 aa, Artificial Sequence
  Splicing factor 3B subunit 3 (57-65)
EVFGVIRSL

SEQ ID NO: 17216 - protein, 9 aa, Artificial Sequence
  E2F-associated phosphoprotein (273-281)
EVFHFFNVL

SEQ ID NO: 17217 - protein, 9 aa, Artificial Sequence
  Vacuolar protein sorting-associated protein 8 homolog (935-943)
EVFNYIHNI

SEQ ID NO: 17218 - protein, 9 aa, Artificial Sequence
  Actin-binding LIM protein 1 (747-755)
EVFREIFGM

SEQ ID NO: 17219 - protein, 10 aa, Artificial Sequence
  Replication protein A 32 kDa subunit (62-71)
EVFRIGNVEI

SEQ ID NO: 17220 - protein, 9 aa, Artificial Sequence
  Phenylalanine-tRNA ligase alpha subunit (418-426)
EVFSYHQGL

SEQ ID NO: 17221 - protein, 9 aa, Artificial Sequence
  Non-canonical poly(A) RNA polymerase PAPD7 (185-193)
EVFTGGISS

SEQ ID NO: 17222 - protein, 9 aa, Artificial Sequence
  Cytochrome b-245 heavy chain (203-211)
EVFWYTHHL

SEQ ID NO: 17223 - protein, 10 aa, Artificial Sequence
  Sigma non-opioid intracellular receptor 1 (144-153)
EVFYPGETVV

SEQ ID NO: 17224 - protein, 9 aa, Artificial Sequence
  Phosphomannomutase 1 (68-76)
EVIEKFDYV

SEQ ID NO: 17225 - protein, 9 aa, Artificial Sequence
  Centromere/kinetochore protein zw10 homolog (663-671)
EVIGKITAL

SEQ ID NO: 17226 - protein, 9 aa, Artificial Sequence
  Protein phosphatase 1G (109-117)
EVIKELAQI

SEQ ID NO: 17227 - protein, 9 aa, Artificial Sequence
  Importin-9 (267-275)
EVLKAVTAL

SEQ ID NO: 17228 - protein, 9 aa, Artificial Sequence
  Nuclear receptor-binding factor 2 (2-10)
EVMEGPLNL

SEQ ID NO: 17229 - protein, 9 aa, Artificial Sequence
  Uncharacterized protein KIAA1143 (71-79)
EVMKIKAEI

SEQ ID NO: 17230 - protein, 9 aa, Artificial Sequence
  C-1-tetrahydrofolate synthase, cytoplasmic (80-88)
EVMKYITSL

SEQ ID NO: 17231 - protein, 9 aa, Artificial Sequence
  Probable ubiquitin carboxyl-terminal hydrolase FAF-X (357-365)
EVNKVISSV

SEQ ID NO: 17232 - protein, 9 aa, Artificial Sequence
  Programmed cell death protein 4 (355-363)
EVPHFHHEL

SEQ ID NO: 17233 - protein, 9 aa, Artificial Sequence
  InaD-like protein (626-634)
EVPPPFTLV

SEQ ID NO: 17234 - protein, 9 aa, Artificial Sequence
  Gypsy retrotransposon integrase-like protein 1 (184-192)
EVSKAIINI

SEQ ID NO: 17235 - protein, 9 aa, Artificial Sequence
  DNA-directed RNA polymerase III subunit RPC3 (143-151)
EVSNTFVRL

SEQ ID NO: 17236 - protein, 9 aa, Artificial Sequence
  CAP-Gly domain-containing linker protein 1 (841-849)
EVSQVKETL

SEQ ID NO: 17237 - protein, 10 aa, Artificial Sequence
  Double-stranded RNA-specific adenosine deaminase (806-815)
EVTPVTGASL

SEQ ID NO: 17238 - protein, 9 aa, Artificial Sequence
  Multiple C2 and transmembrane domain-containing protein 1 (410-418)
EVVGSYFSV

SEQ ID NO: 17239 - protein, 10 aa, Artificial Sequence
  Monocarboxylate transporter 4 (456-465)
EVVHTPETSV

SEQ ID NO: 17240 - protein, 9 aa, Artificial Sequence
  E3 ubiquitin-protein ligase RNF114 (34-42)
EVYEKPVQV

SEQ ID NO: 17241 - protein, 11 aa, Artificial Sequence
  Sorting nexin-17 (460-470)
FAFEGIGDEDL

SEQ ID NO: 17242 - protein, 10 aa, Artificial Sequence
  Coiled-coil domain-containing protein 60 (70-79)
FAILREETAK

SEQ ID NO: 17243 - protein, 9 aa, Artificial Sequence
  Serpin B6 (11-19)
FALNLLKTL

SEQ ID NO: 17244 - protein, 9 aa, Artificial Sequence
  Inactive phospholipase D5 (72-80)
FALVCCFAI

SEQ ID NO: 17245 - protein, 9 aa, Artificial Sequence
  Actin-like protein 6A (118-126)
FANGRSTGL

SEQ ID NO: 17246 - protein, 9 aa, Artificial Sequence
  Fatty acid synthase (1720-1728)
FANSRDTSF

SEQ ID NO: 17247 - protein, 9 aa, Artificial Sequence
  DNA polymerase delta subunit 2 (24-32)
FARVPVATY

SEQ ID NO: 17248 - protein, 10 aa, Artificial Sequence
  Microtubule cross-linking factor 1 (1586-1595)
FASPLHSLEM

SEQ ID NO: 17249 - protein, 9 aa, Artificial Sequence
  ATP synthase subunit delta, mitochondrial (42-50)
FASPTQVFF

SEQ ID NO: 17250 - protein, 9 aa, Artificial Sequence
  Alanine-tRNA ligase, cytoplasmic (346-354)
FATLVDVVV

SEQ ID NO: 17251 - protein, 11 aa, Artificial Sequence
  G patch domain-containing protein 2 (148-158)
FAVDNVGNRTL

SEQ ID NO: 17252 - protein, 9 aa, Artificial Sequence
  Protein disulfide-isomerase A2 (456-464)
FAVHGFPTL

SEQ ID NO: 17253 - protein, 9 aa, Artificial Sequence
  Translocon-associated protein subunit gamma (75-83)
FAYKNVKFV

SEQ ID NO: 17254 - protein, 9 aa, Artificial Sequence
  Transmembrane protein 214 (326-334)
FAYMPNNSL

SEQ ID NO: 17255 - protein, 9 aa, Artificial Sequence
  28S ribosomal protein S29, mitochondrial (117-125)
FAYPAIRYL

SEQ ID NO: 17256 - protein, 9 aa, Artificial Sequence
  Protein furry homolog-like (828-836)
FAYTRLQLL

SEQ ID NO: 17257 - protein, 8 aa, Artificial Sequence
  Transmembrane and coiled-coil domain-containing protein 1 (109-116)
FDGRVVAK

SEQ ID NO: 17258 - protein, 9 aa, Artificial Sequence
  ATP-binding cassette sub-family A member 9 (420-428)
FDKILPAEY

SEQ ID NO: 17259 - protein, 8 aa, Artificial Sequence
  Peroxidasin-like protein (1168-1175)
FEDLQNEI

SEQ ID NO: 17260 - protein, 10 aa, Artificial Sequence
  Unconventional myosin-Ih (75-84)
FELPPHVYAI

SEQ ID NO: 17261 - protein, 9 aa, Artificial Sequence
  Band 4.1-like protein 1 (692-700)
FEPVKTETM

SEQ ID NO: 17262 - protein, 12 aa, Artificial Sequence
  Gigaxonin (459-470)
FGAVACGVAMEL

SEQ ID NO: 17263 - protein, 10 aa, Artificial Sequence
  Cysteine andine-rich protein 1 (180-189)
FGFGQGAGAL

SEQ ID NO: 17264 - protein, 9 aa, Artificial Sequence
  Protein FAM60A (2-10)
FGFHKPKMY

SEQ ID NO: 17265 - protein, 9 aa, Artificial Sequence
  Acyl-CoA-binding domain-containing protein 6 (141-149)
FGGPVISSL

SEQ ID NO: 17266 - protein, 9 aa, Artificial Sequence
  Hydroxyacyl-coenzyme A dehydrogenase, mitochondrial (302-310)
FGKKTGEGF

SEQ ID NO: 17267 - protein, 9 aa, Artificial Sequence
  EH domain-containing protein 1 (42-50)
FHEFHSPAL

SEQ ID NO: 17268 - protein, 9 aa, Artificial Sequence
  Forkhead box protein N2 (278-286)
FHHPSAVRL

SEQ ID NO: 17269 - protein, 9 aa, Artificial Sequence
  B-lymphocyte antigen CD20 (62-70)
FHIALGGLL

SEQ ID NO: 17270 - protein, 9 aa, Artificial Sequence
  Endoplasmic reticulum-Golgi intermediate compartment protein 2 (185-193)
FHITVGKAI

SEQ ID NO: 17271 - protein, 9 aa, Artificial Sequence
  Complement receptor type 2 (1016-1024)
FHLEAREVY

SEQ ID NO: 17272 - protein, 9 aa, Artificial Sequence
  Eukaryotic elongation factor 2 kinase (553-561)
FHLEHAANL

SEQ ID NO: 17273 - protein, 9 aa, Artificial Sequence
  Dolichyl-diphosphooligosaccharide-proteinosyltransferase subunit 2 (579-587)
FHLGHAAML

SEQ ID NO: 17274 - protein, 9 aa, Artificial Sequence
  Brain-specific angiogenesis inhibitor 1-associated protein 2 (97-105)
FHNELLTQL

SEQ ID NO: 17275 - protein, 9 aa, Artificial Sequence
  Large subunit GTPase 1 homolog (597-605)
FHQENVRAL

SEQ ID NO: 17276 - protein, 9 aa, Artificial Sequence
  tRNA (uracil(54)-C(5))-methyltransferase homolog (396-404)
FHTGQAEKI

SEQ ID NO: 17277 - protein, 10 aa, Artificial Sequence
  E3 ubiquitin-protein ligase UHRF1 (36-45)
FHVEPGLQRL

SEQ ID NO: 17278 - protein, 9 aa, Artificial Sequence
  Minor histocompatibility protein HA-1 (190-198)
FHYESNNDL

SEQ ID NO: 17279 - protein, 9 aa, Artificial Sequence
  Gamma-adducin (307-315)
FHYIFNVQL

SEQ ID NO: 17280 - protein, 9 aa, Artificial Sequence
  Protein RER1 (79-87)
FIAFLSPKV

SEQ ID NO: 17281 - protein, 9 aa, Artificial Sequence
  Mitochondrial import receptor subunit TOM5 homolog (43-51)
FILKKLDSI

SEQ ID NO: 17282 - protein, 9 aa, Artificial Sequence
  Neutral amino acid transporter B(0) (175-183)
FILPIGATV

SEQ ID NO: 17283 - protein, 9 aa, Artificial Sequence
  Nectin-1 (509-517)
FISKKEWYV

SEQ ID NO: 17284 - protein, 9 aa, Artificial Sequence
  Desmoplakin (2300-2308)
FIVDPVSNL

SEQ ID NO: 17285 - protein, 9 aa, Artificial Sequence
  Zinc finger protein 460 (554-562)
FIVEETLPL

SEQ ID NO: 17286 - protein, 9 aa, Artificial Sequence
  Elongation factor 1-gamma (16-24)
FKALIAAQY

SEQ ID NO: 17287 - protein, 9 aa, Artificial Sequence
  Ubiquilin-1 (61-69)
FKEEISKRF

SEQ ID NO: 17288 - protein, 9 aa, Artificial Sequence
  Nuclear pore complex protein Nup153 (924-932)
FKFGDQGGF

SEQ ID NO: 17289 - protein, 9 aa, Artificial Sequence
  Thioredoxin-interacting protein (370-378)
FKFMPPPTY

SEQ ID NO: 17290 - protein, 9 aa, Artificial Sequence
  Protein SCAF11 (1115-1123)
FKFVEQQSY

SEQ ID NO: 17291 - protein, 10 aa, Artificial Sequence
  Casein kinase II subunit alpha (197-206)
FKGPELLVDY

SEQ ID NO: 17292 - protein, 10 aa, Artificial Sequence
  Ras association domain-containing protein 2 (212-221)
FKIENSAEEF

SEQ ID NO: 17293 - protein, 9 aa, Artificial Sequence
  Septin-6 (197-205)
FKIKITSEL

SEQ ID NO: 17294 - protein, 9 aa, Artificial Sequence
  Ubiquitin carboxyl-terminal hydrolase 33 (150-158)
FKIPSNTTL

SEQ ID NO: 17295 - protein, 10 aa, Artificial Sequence
  SLIT-ROBO Rho GTPase-activating protein 3 (765-774)
FKKGASLLLY

SEQ ID NO: 17296 - protein, 10 aa, Artificial Sequence
  ETS domain-containing protein Elk-4 (163-172)
FKLIKTENPA

SEQ ID NO: 17297 - protein, 9 aa, Artificial Sequence
  Nucleoporin-like protein 2 (303-311)
FKSPAASSF

SEQ ID NO: 17298 - protein, 10 aa, Artificial Sequence
  Mini-chromosome maintenance complex-binding protein (250-259)
FKVNDILELY

SEQ ID NO: 17299 - protein, 9 aa, Artificial Sequence
  U2 small nuclear ribonucleoprotein auxiliary factor 35 kDa subunit-related protein 2 (256-264)
FKVSCNLEP

SEQ ID NO: 17300 - protein, 9 aa, Artificial Sequence
  Ubiquitin-conjugating enzyme E2 T (132-140)
FKYNKPAFL

SEQ ID NO: 17301 - protein, 9 aa, Artificial Sequence
  Bestrophin-3 (595-603)
FLGSSHTSL

SEQ ID NO: 17302 - protein, 10 aa, Artificial Sequence
  Heparan-alpha-glucosaminide N-acetyltransferase (512-521)
FLGVQAGKIL

SEQ ID NO: 17303 - protein, 9 aa, Artificial Sequence
  Acetyl-CoA carboxylase 1 (2174-2182)
FLIPIYHQV

SEQ ID NO: 17304 - protein, 9 aa, Artificial Sequence
  Rho-associated protein kinase 1 (316-324)
FLTDREVRL

SEQ ID NO: 17305 - protein, 9 aa, Artificial Sequence
  AP-2 complex subunit alpha-1 (812-820)
FLTPPLLSV

SEQ ID NO: 17306 - protein, 10 aa, Artificial Sequence
  Bardet-Biedl syndrome 1 protein (409-418)
FLYNEALYSL

SEQ ID NO: 17307 - protein, 9 aa, Artificial Sequence
  Adiponectin receptor protein 1 (163-171)
FMAPLQEKV

SEQ ID NO: 17308 - protein, 9 aa, Artificial Sequence
  Protein SGT1 homolog (332-340)
FMESGGTVL

SEQ ID NO: 17309 - protein, 9 aa, Artificial Sequence
  Cyclin-dependent kinase 13 (131-139)
FPITAIREI

SEQ ID NO: 17310 - protein, 9 aa, Artificial Sequence
  Actin-like protein 6A (99-107)
FQAILDHTY

SEQ ID NO: 17311 - protein, 10 aa, Artificial Sequence
  Nuclear pore complex protein Nup153 (1395-1404)
FQFGSSTTNF

SEQ ID NO: 17312 - protein, 9 aa, Artificial Sequence
  Choline-phosphate cytidylyltransferase B (242-250)
FQNQVDKMK

SEQ ID NO: 17313 - protein, 9 aa, Artificial Sequence
  Fibrillin-3 (594-602)
FRCQCLGGL

SEQ ID NO: 17314 - protein, 9 aa, Artificial Sequence
  Polycystin-1 (3465-3473)
FSASDEDLI

SEQ ID NO: 17315 - protein, 9 aa, Artificial Sequence
  Chromodomain-helicase-DNA-binding protein 4 (167-175)
FSEEDYRTL

SEQ ID NO: 17316 - protein, 9 aa, Artificial Sequence
  Integrin beta-7 (227-235)
FSFHHVLSL

SEQ ID NO: 17317 - protein, 10 aa, Artificial Sequence
  GPALPP motifs-containing protein 1 (331-340)
FSHGKGNMFL

SEQ ID NO: 17318 - protein, 9 aa, Artificial Sequence
  Transcription intermediary factor 1-beta (125-133)
FSKDIVENY

SEQ ID NO: 17319 - protein, 9 aa, Artificial Sequence
  Meiosis arrest female protein 1 (1734-1742)
FSLAPITKL

SEQ ID NO: 17320 - protein, 8 aa, Artificial Sequence
  Chromosome transmission fidelity protein 8 homolog isoform 2 (371-378)
FSQSSGTL

SEQ ID NO: 17321 - protein, 9 aa, Artificial Sequence
  Protein PRRC2A (165-173)
FSREEFPTL

SEQ ID NO: 17322 - protein, 9 aa, Artificial Sequence
  V-type proton ATPase subunit D (79-87)
FSTTVIQNV

SEQ ID NO: 17323 - protein, 8 aa, Artificial Sequence
  Nodal modulator 2 (329-336)
FSVTGRVL

SEQ ID NO: 17324 - protein, 9 aa, Artificial Sequence
  ETS domain-containing protein Elk-3 (331-339)
FTAQTPNGL

SEQ ID NO: 17325 - protein, 10 aa, Artificial Sequence
  ATP synthase subunit delta, mitochondrial (40-49)
FTFASPTQVF

SEQ ID NO: 17326 - protein, 11 aa, Artificial Sequence
  E3 SUMO-protein ligase RanBP2 (1132-1142)
FTFHGPGKSVF

SEQ ID NO: 17327 - protein, 9 aa, Artificial Sequence
  Embigin (129-137)
FTIINSKQM

SEQ ID NO: 17328 - protein, 9 aa, Artificial Sequence
  Protein transport protein Sec23B (392-400)
FTKDFNGDF

SEQ ID NO: 17329 - protein, 9 aa, Artificial Sequence
  Protein TFG (363-371)
FTSLPGSTM

SEQ ID NO: 17330 - protein, 9 aa, Artificial Sequence
  Nuclear factor of activated T-cells, cytoplasmic 2 (454-462)
FTYHPVPAI

SEQ ID NO: 17331 - protein, 9 aa, Artificial Sequence
  Phosphomannomutase 2 (157-165)
FVADLRKEF

SEQ ID NO: 17332 - protein, 9 aa, Artificial Sequence
  V-type proton ATPase subunit G 1 (102-110)
FVCDIRPEI

SEQ ID NO: 17333 - protein, 9 aa, Artificial Sequence
  T-box transcription factor TBX20 (45-53)
FVEKSSCAQ

SEQ ID NO: 17334 - protein, 9 aa, Artificial Sequence
  Dual specificity protein phosphatase 4 (364-372)
FVFSFPVSV

SEQ ID NO: 17335 - protein, 9 aa, Artificial Sequence
  RNA-binding protein PNO1 (136-144)
FVKAFILGF

SEQ ID NO: 17336 - protein, 9 aa, Artificial Sequence
  Serine/threonine-protein kinase mTOR (725-733)
FVMPFLRKM

SEQ ID NO: 17337 - protein, 9 aa, Artificial Sequence
  60S ribosomal protein L36 (39-47)
FVRDMIREV

SEQ ID NO: 17338 - protein, 9 aa, Artificial Sequence
  Melanoma-associated antigen C2 (265-273)
FVYGEPREL

SEQ ID NO: 17339 - protein, 9 aa, Artificial Sequence
  Beta-1,3-galactosyltransferase 5 (36-44)
FVYKKDGNF

SEQ ID NO: 17340 - protein, 9 aa, Artificial Sequence
  Olfactory receptor 12D2 (250-258)
FYAPVLFTY

SEQ ID NO: 17341 - protein, 9 aa, Artificial Sequence
  Laminin subunit alpha-5 (1849-1857)
FYRDVKGLF

SEQ ID NO: 17342 - protein, 9 aa, Artificial Sequence
  Erythrocyte band 7 integral membrane protein (75-83)
GAKGPGLFF

SEQ ID NO: 17343 - protein, 9 aa, Artificial Sequence
  Forkhead box protein O3 (542-550)
GALGGSRAL

SEQ ID NO: 17344 - protein, 9 aa, Artificial Sequence
  Tumor necrosis factor receptor superfamily member 18 (5-13)
GAMGAFRAL

SEQ ID NO: 17345 - protein, 9 aa, Artificial Sequence
  Leukocyte elastase inhibitor (309-317)
GARDIFISK

SEQ ID NO: 17346 - protein, 9 aa, Artificial Sequence
  Solute carrier family 22 member 9 (444-452)
GASALANTL

SEQ ID NO: 17347 - protein, 9 aa, Artificial Sequence
  Alpha-enolase (122-130)
GAVEKGVPL

SEQ ID NO: 17348 - protein, 9 aa, Artificial Sequence
  Importin subunit alpha-5 (169-177)
GAVPIFIEL

SEQ ID NO: 17349 - protein, 9 aa, Artificial Sequence
  60S ribosomal protein L15 (2-10)
GAYKYIQEL

SEQ ID NO: 17350 - protein, 10 aa, Artificial Sequence
  Nuclease EXOG, mitochondrial (105-114)
GDADRKHCKF

SEQ ID NO: 17351 - protein, 9 aa, Artificial Sequence
  Lariat debranching enzyme (502-510)
GEDLTKVPL

SEQ ID NO: 17352 - protein, 8 aa, Artificial Sequence
  Leucine-rich repeat LGI family member 4 (2-9)
GGAGILLL

SEQ ID NO: 17353 - protein, 9 aa, Artificial Sequence
  Anosmin-1 (412-420)
GGIQTQLPF

SEQ ID NO: 17354 - protein, 9 aa, Artificial Sequence
  Cold-inducible RNA-binding protein (133-141)
GGYGGSRDY

SEQ ID NO: 17355 - protein, 9 aa, Artificial Sequence
  Acetyl-CoA carboxylase 2 (352-360)
GHASENPKL

SEQ ID NO: 17356 - protein, 9 aa, Artificial Sequence
  Guanine nucleotide-binding protein subunit beta-5 (365-373)
GHENRVSTL

SEQ ID NO: 17357 - protein, 11 aa, Artificial Sequence
  Rho guanine nucleotide exchange factor 2 (157-167)
GHFNDESPLGL

SEQ ID NO: 17358 - protein, 9 aa, Artificial Sequence
  DNA polymerase delta catalytic subunit (784-792)
GHFPSPIRL

SEQ ID NO: 17359 - protein, 9 aa, Artificial Sequence
  Factor VIII intron 22 protein (163-171)
GHFQRAAQL

SEQ ID NO: 17360 - protein, 9 aa, Artificial Sequence
  Centrosomal protein of 152 kDa (1140-1148)
GHHAQPLAL

SEQ ID NO: 17361 - protein, 9 aa, Artificial Sequence
  Inosine-5'-monophosphate dehydrogenase 2 (371-379)
GHIAKALAL

SEQ ID NO: 17362 - protein, 10 aa, Artificial Sequence
  Selenocysteine-specific elongation factor (14-23)
GHIDSGKTAL

SEQ ID NO: 17363 - protein, 9 aa, Artificial Sequence
  Hairy/enhancer-of-split related with YRPW motif protein 1 (176-184)
GHIPWGTVF

SEQ ID NO: 17364 - protein, 12 aa, Artificial Sequence
  Transcription factor AP-1 (86-97)
GHITTTPTPTQF

SEQ ID NO: 17365 - protein, 9 aa, Artificial Sequence
  U5 small nuclear ribonucleoprotein 40 kDa protein (107-115)
GHSGAVMEL

SEQ ID NO: 17366 - protein, 9 aa, Artificial Sequence
  Scaffold attachment factor B1 (858-866)
GHSGPGHMM

SEQ ID NO: 17367 - protein, 9 aa, Artificial Sequence
  Proteasome subunit beta type-4 (125-133)
GHSYSPRAI

SEQ ID NO: 17368 - protein, 11 aa, Artificial Sequence
  Inactive tyrosine-protein kinase transmembrane receptor ROR1 (927-937)
GHTESMISAEL

SEQ ID NO: 17369 - protein, 9 aa, Artificial Sequence
  Cytochrome b-c1 complex subunit 2, mitochondrial (445-453)
GHTPFVDEL

SEQ ID NO: 17370 - protein, 9 aa, Artificial Sequence
  Tetratricopeptide repeat protein 8 (471-479)
GHVEQARAL

SEQ ID NO: 17371 - protein, 9 aa, Artificial Sequence
  Centromere protein M (155-163)
GHVPGVSAL

SEQ ID NO: 17372 - protein, 9 aa, Artificial Sequence
  Inosine-5'-monophosphate dehydrogenase 1 (371-379)
GHVVKALAL

SEQ ID NO: 17373 - protein, 9 aa, Artificial Sequence
  Ubiquitin carboxyl-terminal hydrolase 1 (592-600)
GHYTASVKV

SEQ ID NO: 17374 - protein, 9 aa, Artificial Sequence
  Tubulin beta-4B chain (104-112)
GHYTEGAEL

SEQ ID NO: 17375 - protein, 9 aa, Artificial Sequence
  Ubiquitin-like-conjugating enzyme ATG3 (118-126)
GITEAVKEI

SEQ ID NO: 17376 - protein, 9 aa, Artificial Sequence
  Phospholipid phosphatase 5 (2-10)
GKAAAAVAF

SEQ ID NO: 17377 - protein, 10 aa, Artificial Sequence
  Sterol regulatory element-binding protein 2 (933-942)
GKADGQQSSF

SEQ ID NO: 17378 - protein, 9 aa, Artificial Sequence
  Zinc finger protein 623 (381-389)
GKAFFLSSY

SEQ ID NO: 17379 - protein, 9 aa, Artificial Sequence
  Zinc finger protein 791 (278-286)
GKAFIFPSF

SEQ ID NO: 17380 - protein, 9 aa, Artificial Sequence
  Zinc finger protein with KRAB and SCAN domains 1 (495-503)
GKAFNRNSY

SEQ ID NO: 17381 - protein, 9 aa, Artificial Sequence
  Zinc finger protein 397 (375-383)
GKAFSQSSY

SEQ ID NO: 17382 - protein, 9 aa, Artificial Sequence
  Zinc finger protein 791 (362-370)
GKAFSRISY

SEQ ID NO: 17383 - protein, 10 aa, Artificial Sequence
  Zinc finger protein 460 (370-379)
GKAFTHYSTY

SEQ ID NO: 17384 - protein, 9 aa, Artificial Sequence
  Coatomer subunit delta (13-21)
GKAIVSRQF

SEQ ID NO: 17385 - protein, 9 aa, Artificial Sequence
  O-acetyl-ADP-ribose deacetylase MACROD1 (208-216)
GKAKITGGY

SEQ ID NO: 17386 - protein, 9 aa, Artificial Sequence
  2',3'-cyclic-nucleotide 3'-phosphodiesterase (260-268)
GKAPGAEEY

SEQ ID NO: 17387 - protein, 9 aa, Artificial Sequence
  Ig lambda chain V-II region BOH (43-51)
GKAPKLIIY

SEQ ID NO: 17388 - protein, 9 aa, Artificial Sequence
  Ig kappa chain V-I region Walker (63-71)
GKAPKLLIY

SEQ ID NO: 17389 - protein, 9 aa, Artificial Sequence
  Filamin-B (876-884)
GKAPLNVQF

SEQ ID NO: 17390 - protein, 9 aa, Artificial Sequence
  SH2 domain-containing protein 3C (476-484)
GKASPSPSL

SEQ ID NO: 17391 - protein, 9 aa, Artificial Sequence
  Parafibromin (46-54)
GKEGQPREY

SEQ ID NO: 17392 - protein, 9 aa, Artificial Sequence
  40S ribosomal protein S11 (29-37)
GKEKLPRYY

SEQ ID NO: 17393 - protein, 10 aa, Artificial Sequence
  Transmembrane emp24 domain-containing protein 10 (93-102)
GKFAFTTEDY

SEQ ID NO: 17394 - protein, 9 aa, Artificial Sequence
  ER membrane protein complex subunit 1 (28-36)
GKFDWRQQY

SEQ ID NO: 17395 - protein, 9 aa, Artificial Sequence
  Nucleolar protein 56 (40-48)
GKFHSIVRL

SEQ ID NO: 17396 - protein, 10 aa, Artificial Sequence
  Putative ATP-dependent RNA helicase DHX30 (1039-1048)
GKFKPNSVTY

SEQ ID NO: 17397 - protein, 10 aa, Artificial Sequence
  Kinesin light chain 1 (395-404)
GKFKQAETLY

SEQ ID NO: 17398 - protein, 10 aa, Artificial Sequence
  Transcription activator BRG1 (851-860)
GKFNVLLTTY

SEQ ID NO: 17399 - protein, 9 aa, Artificial Sequence
  60S ribosomal protein L10a (132-140)
GKFPSLLTH

SEQ ID NO: 17400 - protein, 9 aa, Artificial Sequence
  Microtubule-associated protein RP/EB family member 1 (99-107)
GKFQDNFEF

SEQ ID NO: 17401 - protein, 12 aa, Artificial Sequence
  Glycogen phosphorylase, brain form (810-821)
GKFSSDRTITEY

SEQ ID NO: 17402 - protein, 9 aa, Artificial Sequence
  60S ribosome subunit biogenesis protein NIP7 homolog (71-79)
GKFTKTHKF

SEQ ID NO: 17403 - protein, 11 aa, Artificial Sequence
  ATP-dependent RNA helicase DDX19B (186-196)
GKFYPELKLAY

SEQ ID NO: 17404 - protein, 9 aa, Artificial Sequence
  Serine/threonine-protein kinase pim-2 (39-47)
GKGGFGTVF

SEQ ID NO: 17405 - protein, 9 aa, Artificial Sequence
  Tyrosine-protein kinase Fer (570-578)
GKGNFGEVY

SEQ ID NO: 17406 - protein, 9 aa, Artificial Sequence
  YTH domain-containing family protein 2 (451-459)
GKGPVYLLF

SEQ ID NO: 17407 - protein, 10 aa, Artificial Sequence
  MYCBP-associated protein (359-368)
GKGWPFSAVT

SEQ ID NO: 17408 - protein, 11 aa, Artificial Sequence
  60S ribosomal protein L36a (16-26)
GKHQPHKVTQY

SEQ ID NO: 17409 - protein, 9 aa, Artificial Sequence
  SWI/SNF complex subunit SMARCC1 (93-101)
GKHVTNPAF

SEQ ID NO: 17410 - protein, 9 aa, Artificial Sequence
  DNA damage-binding protein 1 (59-67)
GKIAVMELF

SEQ ID NO: 17411 - protein, 10 aa, Artificial Sequence
  Acidic leucine-rich nuclear phosphoprotein 32 family member B (32-41)
GKIEGLTAEF

SEQ ID NO: 17412 - protein, 9 aa, Artificial Sequence
  Endothelial differentiation-related factor 1 (122-130)
GKIERAIGL

SEQ ID NO: 17413 - protein, 9 aa, Artificial Sequence
  Heterogeneous nuclear ribonucleoprotein A3 (150-158)
GKIETIEVM

SEQ ID NO: 17414 - protein, 9 aa, Artificial Sequence
  Peptidyl-prolyl cis-trans isomerase B (203-211)
GKIEVEKPF

SEQ ID NO: 17415 - protein, 11 aa, Artificial Sequence
  Macrophage migration inhibitory factor (66-76)
GKIGGAQNRSY

SEQ ID NO: 17416 - protein, 9 aa, Artificial Sequence
  Phospholipase ABHD3 (231-239)
GKIGSKTPL

SEQ ID NO: 17417 - protein, 9 aa, Artificial Sequence
  D-dopachrome decarboxylase (109-117)
GKIGTVMTF

SEQ ID NO: 17418 - protein, 9 aa, Artificial Sequence
  Protein YIF1B (244-252)
GKIGYYLVL

SEQ ID NO: 17419 - protein, 9 aa, Artificial Sequence
  Nucleolar GTP-binding protein 2 (54-62)
GKIIKPLQY

SEQ ID NO: 17420 - protein, 10 aa, Artificial Sequence
  Nucleolar protein 58 (195-204)
GKIISDNLTY

SEQ ID NO: 17421 - protein, 9 aa, Artificial Sequence
  Nucleolar GTP-binding protein 2 (534-542)
GKINVVPQF

SEQ ID NO: 17422 - protein, 9 aa, Artificial Sequence
  Protein YIPF5 (145-153)
GKIQFGYVY

SEQ ID NO: 17423 - protein, 10 aa, Artificial Sequence
  TBC1 domain family member 9 (117-126)
GKIQGIIAEY

SEQ ID NO: 17424 - protein, 9 aa, Artificial Sequence
  Nucleolysin TIAR (121-129)
GKISDARVV

SEQ ID NO: 17425 - protein, 9 aa, Artificial Sequence
  Ras GTPase-activating protein 1 (354-362)
GKISKQEAY

SEQ ID NO: 17426 - protein, 8 aa, Artificial Sequence
  Solute carrier family 35 member E2B (319-326)
GKISPVTF

SEQ ID NO: 17427 - protein, 9 aa, Artificial Sequence
  40S ribosomal protein S4, X isoform (167-175)
GKITDFIKF

SEQ ID NO: 17428 - protein, 9 aa, Artificial Sequence
  Calcium channel flower homolog (141-149)
GKKGDAISY

SEQ ID NO: 17429 - protein, 9 aa, Artificial Sequence
  Signal recognition particle receptor subunit beta (226-234)
GKKGKEFEF

SEQ ID NO: 17430 - protein, 9 aa, Artificial Sequence
  Sodium-coupled neutral amino acid transporter 2 (58-66)
GKKKYETEF

SEQ ID NO: 17431 - protein, 9 aa, Artificial Sequence
  Barrier-to-autointegration factor (31-39)
GKKLEERGF

SEQ ID NO: 17432 - protein, 9 aa, Artificial Sequence
  Amyloid protein-binding protein 2 (502-510)
GKKLFGEGY

SEQ ID NO: 17433 - protein, 9 aa, Artificial Sequence
  C-1-tetrahydrofolate synthase, cytoplasmic (332-340)
GKLAREIGL

SEQ ID NO: 17434 - protein, 9 aa, Artificial Sequence
  Sterol regulatory element-binding protein 2 (730-738)
GKLGFLASY

SEQ ID NO: 17435 - protein, 10 aa, Artificial Sequence
  T-cell-specific surfaceoprotein CD28 (88-97)
GKLGNESVTF

SEQ ID NO: 17436 - protein, 11 aa, Artificial Sequence
  T-cell-specific surfaceoprotein CD28 (88-98)
GKLGNESVTFY

SEQ ID NO: 17437 - protein, 9 aa, Artificial Sequence
  Guanine nucleotide-binding protein G(I)/G(S)/G(T) subunit beta-1 (77-85)
GKLIIWDSY

SEQ ID NO: 17438 - protein, 8 aa, Artificial Sequence
  Sterile alpha motif domain-containing protein 9-like (1531-1538)
GKLISVEY

SEQ ID NO: 17439 - protein, 9 aa, Artificial Sequence
  RNA-binding protein FUS (331-339)
GKLKGEATV

SEQ ID NO: 17440 - protein, 9 aa, Artificial Sequence
  Hydroxysteroid dehydrogenase-like protein 2 (382-390)
GKLKPTMAF

SEQ ID NO: 17441 - protein, 9 aa, Artificial Sequence
  Endoplasmic reticulum-Golgi intermediate compartment protein 3 (5-13)
GKLKQFDAY

SEQ ID NO: 17442 - protein, 9 aa, Artificial Sequence
  Tripartite motif-containing protein 26 (302-310)
GKLLRDLEY

SEQ ID NO: 17443 - protein, 10 aa, Artificial Sequence
  Protein PRRC2A (1913-1922)
GKLPAGGVLY

SEQ ID NO: 17444 - protein, 9 aa, Artificial Sequence
  RRP12-like protein (5-13)
GKLPSGVSA

SEQ ID NO: 17445 - protein, 8 aa, Artificial Sequence
  Proteasome subunit alpha type-2 (17-24)
GKLVQIEY

SEQ ID NO: 17446 - protein, 9 aa, Artificial Sequence
  Pre-mRNA-processing-splicing factor 8 (1462-1470)
GKLWNLNNY

SEQ ID NO: 17447 - protein, 9 aa, Artificial Sequence
  Non-specific lipid-transfer protein (510-518)
GKMNPQSAF

SEQ ID NO: 17448 - protein, 9 aa, Artificial Sequence
  Vitamin D 25-hydroxylase (287-295)
GKNDPSSTF

SEQ ID NO: 17449 - protein, 9 aa, Artificial Sequence
  FACT complex subunit SSRP1 (142-150)
GKNEVTLEF

SEQ ID NO: 17450 - protein, 9 aa, Artificial Sequence
  Protein disulfide-isomerase A2 (395-403)
GKNFEQVAF

SEQ ID NO: 17451 - protein, 9 aa, Artificial Sequence
  Embigin (163-171)
GKNKPLISY

SEQ ID NO: 17452 - protein, 9 aa, Artificial Sequence
  Pre-mRNA-splicing factor SLU7 (301-309)
GKNPDEVSY

SEQ ID NO: 17453 - protein, 10 aa, Artificial Sequence
  Cell cycle control protein 50A (320-329)
GKNPFLGIAY

SEQ ID NO: 17454 - protein, 9 aa, Artificial Sequence
  WD repeat-containing protein 75 (353-361)
GKPGHLQFY

SEQ ID NO: 17455 - protein, 10 aa, Artificial Sequence
  Aurora kinase A (325-334)
GKPPFEANTY

SEQ ID NO: 17456 - protein, 9 aa, Artificial Sequence
  Filamin-B (863-871)
GKPTHFTVY

SEQ ID NO: 17457 - protein, 9 aa, Artificial Sequence
  Dual specificity protein phosphatase 5 (162-170)
GKPVVNVSY

SEQ ID NO: 17458 - protein, 9 aa, Artificial Sequence
  Actin-like protein 6A (61-69)
GKQGGPTYY

SEQ ID NO: 17459 - protein, 10 aa, Artificial Sequence
  F-box only protein 21 (396-405)
GKREGIDQSY

SEQ ID NO: 17460 - protein, 9 aa, Artificial Sequence
  Probable ATP-dependent RNA helicase DDX5 (500-508)
GKRGGFNTF

SEQ ID NO: 17461 - protein, 9 aa, Artificial Sequence
  Hydroxymethylglutaryl-CoA synthase, cytoplasmic (367-375)
GKRIGVFSY

SEQ ID NO: 17462 - protein, 9 aa, Artificial Sequence
  Protein S100-A4 (47-55)
GKRTDEAAF

SEQ ID NO: 17463 - protein, 9 aa, Artificial Sequence
  Cell cycle progression protein 1 (410-418)
GKSDSPNVY

SEQ ID NO: 17464 - protein, 9 aa, Artificial Sequence
  C-myc promoter-binding protein (1422-1430)
GKSEVTSSF

SEQ ID NO: 17465 - protein, 9 aa, Artificial Sequence
  Zinc finger protein 213 (379-387)
GKSFSRSAY

SEQ ID NO: 17466 - protein, 9 aa, Artificial Sequence
  Zinc finger protein 557 (403-411)
GKSFTSNSY

SEQ ID NO: 17467 - protein, 9 aa, Artificial Sequence
  Nuclear receptor corepressor 1 (1214-1222)
GKSGHILSY

SEQ ID NO: 17468 - protein, 11 aa, Artificial Sequence
  Polyadenylate-binding protein 1 (228-238)
GKSKGFGFVSF

SEQ ID NO: 17469 - protein, 9 aa, Artificial Sequence
  Constitutive coactivator of PPAR-gamma-like protein 1 (209-217)
GKSLTTSQY

SEQ ID NO: 17470 - protein, 10 aa, Artificial Sequence
  Heterogeneous nuclear ribonucleoprotein U (185-194)
GKSSGPTSLF

SEQ ID NO: 17471 - protein, 11 aa, Artificial Sequence
  Elongation factor 1-alpha 1 (19-29)
GKSTTTGHLIY

SEQ ID NO: 17472 - protein, 9 aa, Artificial Sequence
  Zinc finger protein 845 (333-341)
GKTFSQTSY

SEQ ID NO: 17473 - protein, 10 aa, Artificial Sequence
  Sodium-coupled neutral amino acid transporter 5 (46-55)
GKTSFGMSVF

SEQ ID NO: 17474 - protein, 9 aa, Artificial Sequence
  Ras-related protein Rab-6A (25-33)
GKTSLITRF

SEQ ID NO: 17475 - protein, 9 aa, Artificial Sequence
  ATP-dependent RNA helicase DHX8 (593-601)
GKTTQITQY

SEQ ID NO: 17476 - protein, 9 aa, Artificial Sequence
  Pre-mRNA-splicing factor ATP-dependent RNA helicase PRP16 (560-568)
GKTTQLTQY

SEQ ID NO: 17477 - protein, 9 aa, Artificial Sequence
  ATP-dependent RNA helicase DHX36 (235-243)
GKTTQVTQF

SEQ ID NO: 17478 - protein, 9 aa, Artificial Sequence
  Adenosylhomocysteinase (213-221)
GKVAVVAGY

SEQ ID NO: 17479 - protein, 9 aa, Artificial Sequence
  Major facilitator superfamily domain-containing protein 1 (287-295)
GKVFFTEKF

SEQ ID NO: 17480 - protein, 9 aa, Artificial Sequence
  Zinc finger protein 264 (349-357)
GKVFKHRSY

SEQ ID NO: 17481 - protein, 9 aa, Artificial Sequence
  DNA polymerase delta catalytic subunit (997-1005)
GKVGGLLAF

SEQ ID NO: 17482 - protein, 11 aa, Artificial Sequence
  Estradiol 17-beta-dehydrogenase 8 (159-169)
GKVGNVGQTNY

SEQ ID NO: 17483 - protein, 10 aa, Artificial Sequence
  WD repeat domain phosphoinositide-interacting protein 4 (281-290)
GKVGPMIGQY

SEQ ID NO: 17484 - protein, 9 aa, Artificial Sequence
  Dual specificity protein phosphatase 16 (647-655)
GKVGSQSSF

SEQ ID NO: 17485 - protein, 9 aa, Artificial Sequence
  Protein lin-7 homolog C (165-173)
GKVKLVVRY

SEQ ID NO: 17486 - protein, 9 aa, Artificial Sequence
  Apoptosis-associated speck-like protein containing a CARD (138-146)
GKVLTDEQY

SEQ ID NO: 17487 - protein, 9 aa, Artificial Sequence
  E3 ubiquitin-protein ligase synoviolin (58-66)
GKVMGKVFF

SEQ ID NO: 17488 - protein, 9 aa, Artificial Sequence
  Poly (ADP-ribose) polymerase 1 (46-54)
GKVPHWYHF

SEQ ID NO: 17489 - protein, 9 aa, Artificial Sequence
  DNA-directed RNA polymerase II subunit RPB1 (572-580)
GKVPQPAIL

SEQ ID NO: 17490 - protein, 9 aa, Artificial Sequence
  Nucleolar complex protein 2 homolog (575-583)
GKVQENSAY

SEQ ID NO: 17491 - protein, 11 aa, Artificial Sequence
  Major vault protein (396-406)
GKVRAVIGSTY

SEQ ID NO: 17492 - protein, 9 aa, Artificial Sequence
  40S ribosomal protein S4, X isoform (74-82)
GKVRTDITY

SEQ ID NO: 17493 - protein, 9 aa, Artificial Sequence
  40S ribosomal protein S4, Y isoform 1 (74-82)
GKVRVDVTY

SEQ ID NO: 17494 - protein, 9 aa, Artificial Sequence
  ATP-dependent RNA helicase DHX8 (270-278)
GKVTSIMQF

SEQ ID NO: 17495 - protein, 9 aa, Artificial Sequence
  G2/mitotic-specific cyclin-B2 (323-331)
GKWNLKQQY

SEQ ID NO: 17496 - protein, 9 aa, Artificial Sequence
  Transcription initiation factor IIE subunit beta (135-143)
GKYAFKPKY

SEQ ID NO: 17497 - protein, 9 aa, Artificial Sequence
  Interferon-induced protein 44 (72-80)
GKYASIILF

SEQ ID NO: 17498 - protein, 9 aa, Artificial Sequence
  WD repeat-containing protein 44 (704-712)
GKYAVIGTY

SEQ ID NO: 17499 - protein, 9 aa, Artificial Sequence
  Kinesin light chain 1 (353-361)
GKYEEVEYY

SEQ ID NO: 17500 - protein, 9 aa, Artificial Sequence
  Transketolase (139-147)
GKYFDKASY

SEQ ID NO: 17501 - protein, 9 aa, Artificial Sequence
  Golgi pH regulator A (283-291)
GKYFNFLGY

SEQ ID NO: 17502 - protein, 11 aa, Artificial Sequence
  Ethanolamine kinase 1 (257-267)
GKYFSLIPTGF

SEQ ID NO: 17503 - protein, 12 aa, Artificial Sequence
  Solute carrier family 35 member B1 (38-49)
GKYGEGAKQETF

SEQ ID NO: 17504 - protein, 11 aa, Artificial Sequence
  Phosphatidylinositol 3-kinase regulatory subunit alpha (388-398)
GKYGFSDPLTF

SEQ ID NO: 17505 - protein, 9 aa, Artificial Sequence
  DNA-directed RNA polymerase II subunit RPB7 (40-48)
GKYGFVIAV

SEQ ID NO: 17506 - protein, 9 aa, Artificial Sequence
  Neutral amino acid transporter A (295-303)
GKYIFASIL

SEQ ID NO: 17507 - protein, 9 aa, Artificial Sequence
  ER membrane protein complex subunit 3 (65-73)
GKYIPKQSF

SEQ ID NO: 17508 - protein, 10 aa, Artificial Sequence
  Protein phosphatase 1K, mitochondrial (350-359)
GKYKNSEINF

SEQ ID NO: 17509 - protein, 10 aa, Artificial Sequence
  Peptidyl-prolyl cis-trans isomerase FKBP4 (284-293)
GKYKQALLQY

SEQ ID NO: 17510 - protein, 9 aa, Artificial Sequence
  Protein transport protein Sec31A (487-495)
GKYLELLGY

SEQ ID NO: 17511 - protein, 9 aa, Artificial Sequence
  Catalase (272-280)
GKYPSWTFY

SEQ ID NO: 17512 - protein, 9 aa, Artificial Sequence
  Transmembrane protein 222 (176-184)
GKYVSVGAF

SEQ ID NO: 17513 - protein, 9 aa, Artificial Sequence
  5'-nucleotidase domain-containing protein 1 (122-130)
GKYYFYDNY

SEQ ID NO: 17514 - protein, 8 aa, Artificial Sequence
  Plasmalemma vesicle-associated protein (2-9)
GLAMEHGG

SEQ ID NO: 17515 - protein, 9 aa, Artificial Sequence
  DC-STAMP domain-containing protein 2 (243-251)
GLASLVQVF

SEQ ID NO: 17516 - protein, 8 aa, Artificial Sequence
  Protein sel-1 homolog 3 (550-557)
GLHQISSI

SEQ ID NO: 17517 - protein, 9 aa, Artificial Sequence
  40S ribosomal protein S3a (61-69)
GLKGRVFEV

SEQ ID NO: 17518 - protein, 9 aa, Artificial Sequence
  Integrin beta-7 (317-325)
GLYSRSTEF

SEQ ID NO: 17519 - protein, 11 aa, Artificial Sequence
  Solute carrier family 25 member 46 (162-172)
GMGSTFIVQGV

SEQ ID NO: 17520 - protein, 9 aa, Artificial Sequence
  DNA damage-binding protein 1 (56-64)
GMYGKIAVM

SEQ ID NO: 17521 - protein, 9 aa, Artificial Sequence
  60S ribosomal protein L8 (131-139)
GNYATVISH

SEQ ID NO: 17522 - protein, 9 aa, Artificial Sequence
  Huntingtin (77-85)
GPAVAEEPL

SEQ ID NO: 17523 - protein, 9 aa, Artificial Sequence
  Salivary acidic proline-rich phosphoprotein 1/2 (83-91)
GPPPPQGKP

SEQ ID NO: 17524 - protein, 11 aa, Artificial Sequence
  Basic salivary proline-rich protein 2 (59-69)
GPPPQGGNQPQ

SEQ ID NO: 17525 - protein, 11 aa, Artificial Sequence
  Basic salivary proline-rich protein 4 (248-258)
GPPQQEGNKPQ

SEQ ID NO: 17526 - protein, 11 aa, Artificial Sequence
  Basic salivary proline-rich protein 2 (368-378)
GPPQQEGNNPQ

SEQ ID NO: 17527 - protein, 9 aa, Artificial Sequence
  Ig kappa chain V-I region WAT (41-49)
GQAPKVLIY

SEQ ID NO: 17528 - protein, 10 aa, Artificial Sequence
  Thioredoxin domain-containing protein 5 (57-66)
GQDPHSKHLY

SEQ ID NO: 17529 - protein, 9 aa, Artificial Sequence
  Protein FAM179B (288-296)
GQDRFQSYI

SEQ ID NO: 17530 - protein, 9 aa, Artificial Sequence
  Nucleosome-remodeling factor subunit BPTF (843-851)
GQEGKYRVY

SEQ ID NO: 17531 - protein, 9 aa, Artificial Sequence
  Rho GTPase-activating protein 1 (183-191)
GQKIFYVNY

SEQ ID NO: 17532 - protein, 9 aa, Artificial Sequence
  Endoplasmic reticulum lectin 1 (141-149)
GQKINIHEY

SEQ ID NO: 17533 - protein, 9 aa, Artificial Sequence
  Chromodomain-helicase-DNA-binding protein 2 (905-913)
GQKKQVNIY

SEQ ID NO: 17534 - protein, 9 aa, Artificial Sequence
  Immunoglobulin superfamily member 10 (2429-2437)
GQKPVILTY

SEQ ID NO: 17535 - protein, 9 aa, Artificial Sequence
  Fibronectin (679-687)
GQLISIQQY

SEQ ID NO: 17536 - protein, 9 aa, Artificial Sequence
  Lysine-specific demethylase 4B (78-86)
GQSGLFTQY

SEQ ID NO: 17537 - protein, 9 aa, Artificial Sequence
  FERM domain-containing protein 3 (200-208)
GQSPPVAEF

SEQ ID NO: 17538 - protein, 9 aa, Artificial Sequence
  RNA-binding protein EWS (62-70)
GQTAYATSY

SEQ ID NO: 17539 - protein, 8 aa, Artificial Sequence
  Guanine nucleotide-binding protein subunit beta-2-like 1 (295-302)
GQTLFAGY

SEQ ID NO: 17540 - protein, 9 aa, Artificial Sequence
  Protein ELYS (807-815)
GQVKLIQGF

SEQ ID NO: 17541 - protein, 9 aa, Artificial Sequence
  Zinc finger protein 507 (577-585)
GQVKTGISM

SEQ ID NO: 17542 - protein, 10 aa, Artificial Sequence
  Probable ATP-dependent RNA helicase DDX17 (631-640)
GQYTYGQGTY

SEQ ID NO: 17543 - protein, 9 aa, Artificial Sequence
  LanC-like protein 1 (154-162)
GRIGYIYAL

SEQ ID NO: 17544 - protein, 9 aa, Artificial Sequence
  Gamma-interferon-inducible protein 16 (464-472)
GSHFPGPFM

SEQ ID NO: 17545 - protein, 9 aa, Artificial Sequence
  NADH dehydrogenase (ubiquinone) 1 alpha subcomplex subunit 8 (164-172)
GSRFYFWTK

SEQ ID NO: 17546 - protein, 9 aa, Artificial Sequence
  Proteasome subunit beta type-4 (73-81)
GSYGSLARF

SEQ ID NO: 17547 - protein, 10 aa, Artificial Sequence
  Egl nine homolog 2 (272-281)
GSYVINGRTK

SEQ ID NO: 17548 - protein, 9 aa, Artificial Sequence
  Olfactory receptor 8I2 (193-201)
GTEMVSFVL

SEQ ID NO: 17549 - protein, 9 aa, Artificial Sequence
  Dual adapter for phosphotyrosine and 3-phosphotyrosine and 3-phosphoinositide (165-173)
GTKEGYLTK

SEQ ID NO: 17550 - protein, 9 aa, Artificial Sequence
  Large proline-rich protein BAG6 (391-399)
GTRPPPTPN

SEQ ID NO: 17551 - protein, 9 aa, Artificial Sequence
  Splicing factor 3A subunit 2 (300-308)
GVHPPAPGV

SEQ ID NO: 17552 - protein, 9 aa, Artificial Sequence
  Centrosomal protein of 76 kDa (224-232)
GVTSLTVEL

SEQ ID NO: 17553 - protein, 9 aa, Artificial Sequence
  Programmed cell death 6-interacting protein (279-287)
HAAELIKTV

SEQ ID NO: 17554 - protein, 9 aa, Artificial Sequence
  UDP-glucose:glycoprotein glucosyltransferase 1 (566-574)
HAFQTLTHI

SEQ ID NO: 17555 - protein, 9 aa, Artificial Sequence
  Methionine synthase (601-609)
HAIKSGMDM

SEQ ID NO: 17556 - protein, 9 aa, Artificial Sequence
  KH domain-containing, RNA-binding, signal transduction-associated protein 1 (246-254)
HAMEEVKKF

SEQ ID NO: 17557 - protein, 9 aa, Artificial Sequence
  Dynein heavy chain 6, axonemal (1387-1395)
HARDIVTEL

SEQ ID NO: 17558 - protein, 8 aa, Artificial Sequence
  Putative sodium-coupled neutral amino acid transporter 10 (698-705)
HAVLLQVI

SEQ ID NO: 17559 - protein, 11 aa, Artificial Sequence
  HLA class I histocompatibility antigen, A-30 alpha chain (140-150)
HAYDGKDYIAL

SEQ ID NO: 17560 - protein, 8 aa, Artificial Sequence
  Tryptophan 2,3-dioxygenase (67-74)
HDEHLFII

SEQ ID NO: 17561 - protein, 8 aa, Artificial Sequence
  G1/S-specific cyclin-D2 (157-164)
HDFIEHIL

SEQ ID NO: 17562 - protein, 9 aa, Artificial Sequence
  Splicing factor, proline- and glutamine-rich (29-37)
HDFRSPPPG

SEQ ID NO: 17563 - protein, 9 aa, Artificial Sequence
  MKL/myocardin-like protein 1 (831-839)
HDGPEPLSL

SEQ ID NO: 17564 - protein, 9 aa, Artificial Sequence
  Rho guanine nucleotide exchange factor 5 (1170-1178)
HEDQKLQEV

SEQ ID NO: 17565 - protein, 11 aa, Artificial Sequence
  Dedicator of cytokinesis protein 9 (933-943)
HEELTKSMTTI

SEQ ID NO: 17566 - protein, 9 aa, Artificial Sequence
  Protein phosphatase 2C-like domain-containing protein 1 (71-79)
HEIDLTGIF

SEQ ID NO: 17567 - protein, 10 aa, Artificial Sequence
  Histatin-3 (34-43)
HEKHHSHRGY

SEQ ID NO: 17568 - protein, 9 aa, Artificial Sequence
  Protocadherin-9 (1071-1079)
HEPVGSGTL

SEQ ID NO: 17569 - protein, 9 aa, Artificial Sequence
  60S ribosomal protein L36a-like (90-98)
HFELGGDKK

SEQ ID NO: 17570 - protein, 11 aa, Artificial Sequence
  Cancer/testis antigen 47A (120-130)
HFVLLDMVHSL

SEQ ID NO: 17571 - protein, 10 aa, Artificial Sequence
  Neuroblast differentiation-associated protein AHNAK (5535-5544)
HGAAPDISVK

SEQ ID NO: 17572 - protein, 8 aa, Artificial Sequence
  Centrosomal protein of 97 kDa (154-161)
HGNIITSL

SEQ ID NO: 17573 - protein, 9 aa, Artificial Sequence
  Ubiquitin carboxyl-terminal hydrolase 19 (562-570)
HHAFQPSKL

SEQ ID NO: 17574 - protein, 8 aa, Artificial Sequence
  E3 SUMO-protein ligase CBX4 (399-406)
HHAVGLNL

SEQ ID NO: 17575 - protein, 10 aa, Artificial Sequence
  Thyroid hormone receptor-associated protein 3 (641-650)
HHFGSSGMTL

SEQ ID NO: 17576 - protein, 9 aa, Artificial Sequence
  Beta-galactoside alpha-2,6-sialyltransferase 2 (354-362)
HHFIDSSLY

SEQ ID NO: 17577 - protein, 9 aa, Artificial Sequence
  Protein virilizer homolog (679-687)
HHFLELVTL

SEQ ID NO: 17578 - protein, 8 aa, Artificial Sequence
  L-aminoadipate-semialdehyde dehydrogenase-phosphopantetheinyl transferase (238-245)
HHFVAVAL

SEQ ID NO: 17579 - protein, 9 aa, Artificial Sequence
  PCNA-interacting partner (385-393)
HHGTSILTL

SEQ ID NO: 17580 - protein, 9 aa, Artificial Sequence
  E3 SUMO-protein ligase CBX4 (398-406)
HHHAVGLNL

SEQ ID NO: 17581 - protein, 9 aa, Artificial Sequence
  Transcriptional repressor protein YY1 (76-84)
HHHHHPPMI

SEQ ID NO: 17582 - protein, 10 aa, Artificial Sequence
  Histone deacetylase complex subunit SAP130 (202-211)
HHIMTTNVQM

SEQ ID NO: 17583 - protein, 10 aa, Artificial Sequence
  Vacuolar protein sorting-associated protein 11 homolog (554-563)
HHIPEQTTQL

SEQ ID NO: 17584 - protein, 8 aa, Artificial Sequence
  Drebrin-like protein (362-369)
HHIQGQGL

SEQ ID NO: 17585 - protein, 9 aa, Artificial Sequence
  Protein PRRC2B (1834-1842)
HHIQRAIGL

SEQ ID NO: 17586 - protein, 9 aa, Artificial Sequence
  Fructose-bisphosphate aldolase A (220-228)
HHIYLEGTL

SEQ ID NO: 17587 - protein, 9 aa, Artificial Sequence
  Queuine tRNA-ribosyltransferase subunit QTRTD1 (365-373)
HHLLVTNEL

SEQ ID NO: 17588 - protein, 9 aa, Artificial Sequence
  MMS19 nucleotide excision repair protein homolog (102-110)
HHLVIPSVL

SEQ ID NO: 17589 - protein, 9 aa, Artificial Sequence
  Transcription factor ETV6 (170-178)
HHNPPTIEL

SEQ ID NO: 17590 - protein, 9 aa, Artificial Sequence
  Eukaryotic translation initiation factor 2-alpha kinase 1 (119-127)
HHNRAITHL

SEQ ID NO: 17591 - protein, 9 aa, Artificial Sequence
  Fas apoptotic inhibitory molecule 3 (176-184)
HHSSPTTQI

SEQ ID NO: 17592 - protein, 9 aa, Artificial Sequence
  Gamma-glutamyltranspeptidase 1 (532-540)
HHTQIASTF

SEQ ID NO: 17593 - protein, 9 aa, Artificial Sequence
  Zinc transporter 6 (356-364)
HHVIPMPLL

SEQ ID NO: 17594 - protein, 11 aa, Artificial Sequence
  GLTSCR1-like protein (415-425)
HHVQTINGQLL

SEQ ID NO: 17595 - protein, 9 aa, Artificial Sequence
  Nucleolar RNA helicase 2 (218-226)
HHVYSGKDL

SEQ ID NO: 17596 - protein, 9 aa, Artificial Sequence
  GMP synthase (glutamine-hydrolyzing) (22-30)
HHYEGAVVI

SEQ ID NO: 17597 - protein, 10 aa, Artificial Sequence
  GMP synthase (glutamine-hydrolyzing) (22-31)
HHYEGAVVIL

SEQ ID NO: 17598 - protein, 9 aa, Artificial Sequence
  Membralin (447-455)
HHYELPAIL

SEQ ID NO: 17599 - protein, 10 aa, Artificial Sequence
  G/T mismatch-specific thymine DNAosylase (150-159)
HHYPGPGNHF

SEQ ID NO: 17600 - protein, 9 aa, Artificial Sequence
  Suppression of tumorigenicity 18 protein (571-579)
HIAAAAAIL

SEQ ID NO: 17601 - protein, 9 aa, Artificial Sequence
  Cytochrome b-c1 complex subunit 9 (55-63)
HIKHKYENK

SEQ ID NO: 17602 - protein, 9 aa, Artificial Sequence
  Phosphofurin acidic cluster sorting protein 1 (734-742)
HKFPDEDSY

SEQ ID NO: 17603 - protein, 9 aa, Artificial Sequence
  Heterogeneous nuclear ribonucleoproteins C1/C2 (49-57)
HKGFAFVQY

SEQ ID NO: 17604 - protein, 9 aa, Artificial Sequence
  60S ribosomal protein L31 (30-38)
HKRIHGVGF

SEQ ID NO: 17605 - protein, 9 aa, Artificial Sequence
  Mitotic checkpoint serine/threonine-protein kinase BUB1 (430-438)
HKVANTSSF

SEQ ID NO: 17606 - protein, 10 aa, Artificial Sequence
  JmjC domain-containing protein 8 (176-185)
HKVDLPFQEY

SEQ ID NO: 17607 - protein, 10 aa, Artificial Sequence
  40S ribosomal protein S7 (168-177)
HKVETFSGVY

SEQ ID NO: 17608 - protein, 10 aa, Artificial Sequence
  Histone-lysine N-methyltransferase SETD2 (1284-1293)
HKYQQNAEQY

SEQ ID NO: 17609 - protein, 11 aa, Artificial Sequence
  Protein S100-A4 (17-27)
HKYSGKEGDKF

SEQ ID NO: 17610 - protein, 9 aa, Artificial Sequence
  Calpain-12 (697-705)
HLDGGEGVI

SEQ ID NO: 17611 - protein, 12 aa, Artificial Sequence
  Tyrosine-protein kinase BAZ1B (365-376)
HLEEMMKMMSPN

SEQ ID NO: 17612 - protein, 11 aa, Artificial Sequence
  Catalase (466-476)
HLKDAQIFIQK

SEQ ID NO: 17613 - protein, 9 aa, Artificial Sequence
  Neuropeptide FF receptor 1 (270-278)
HMLVMVALF

SEQ ID NO: 17614 - protein, 10 aa, Artificial Sequence
  AP-1 complex subunit gamma-like 2 (576-585)
HMRAAILEKM

SEQ ID NO: 17615 - protein, 9 aa, Artificial Sequence
  Uncharacterized protein C2orf16 (1260-1268)
HNLPESDSE

SEQ ID NO: 17616 - protein, 9 aa, Artificial Sequence
  E3 ubiquitin-protein ligase CBL (213-221)
HPISSGLEA

SEQ ID NO: 17617 - protein, 9 aa, Artificial Sequence
  Ubiquitin-conjugating enzyme E2 variant 3 (119-127)
HPKSVIVGL

SEQ ID NO: 17618 - protein, 10 aa, Artificial Sequence
  Microtubule-associated protein 4 (1128-1137)
HPTLSGGGDQ

SEQ ID NO: 17619 - protein, 9 aa, Artificial Sequence
  Ataxin-2-like protein (896-904)
HQAGQAPHL

SEQ ID NO: 17620 - protein, 9 aa, Artificial Sequence
  Programmed cell death protein 10 (162-170)
HQKKEFVKY

SEQ ID NO: 17621 - protein, 10 aa, Artificial Sequence
  Transcription activator BRG1 (178-187)
HQLRAQIMAY

SEQ ID NO: 17622 - protein, 9 aa, Artificial Sequence
  RNA polymerase-associated protein CTR9 homolog (714-722)
HQNTEVVLY

SEQ ID NO: 17623 - protein, 10 aa, Artificial Sequence
  Ubiquitin-conjugating enzyme E2 J1 (238-247)
HQPTQPVAKN

SEQ ID NO: 17624 - protein, 11 aa, Artificial Sequence
  40S ribosomal protein S29 (3-13)
HQQLYWSHPRK

SEQ ID NO: 17625 - protein, 12 aa, Artificial Sequence
  MORC family CW-type zinc finger protein 3 (528-539)
HQVPPQSEPESN

SEQ ID NO: 17626 - protein, 9 aa, Artificial Sequence
  TBC1 domain family member 2B (111-119)
HSAGAVTVL

SEQ ID NO: 17627 - protein, 9 aa, Artificial Sequence
  Serine palmitoyltransferase 2 (403-411)
HSAVYATSL

SEQ ID NO: 17628 - protein, 9 aa, Artificial Sequence
  Protein virilizer homolog (1566-1574)
HSELERSFL

SEQ ID NO: 17629 - protein, 8 aa, Artificial Sequence
  Hematopoietic SH2 domain-containing protein (62-69)
HSHVGYTL

SEQ ID NO: 17630 - protein, 9 aa, Artificial Sequence
  Thrombospondin type-1 domain-containing protein 7B (289-297)
HSKSWAIEI

SEQ ID NO: 17631 - protein, 9 aa, Artificial Sequence
  Paired box protein Pax-9 (196-204)
HSVTDILGI

SEQ ID NO: 17632 - protein, 9 aa, Artificial Sequence
  Proteasome subunit beta type-4 (134-142)
HSWLTRAMY

SEQ ID NO: 17633 - protein, 9 aa, Artificial Sequence
  E3 SUMO-protein ligase RanBP2 (3152-3160)
HTGPGLLSM

SEQ ID NO: 17634 - protein, 9 aa, Artificial Sequence
  Cytochrome b-245 heavy chain (115-123)
HTIAHLFNV

SEQ ID NO: 17635 - protein, 10 aa, Artificial Sequence
  Heterogeneous nuclear ribonucleoproteins A2/B1 (163-172)
HTINGHNAEV

SEQ ID NO: 17636 - protein, 10 aa, Artificial Sequence
  Heterogeneous nuclear ribonucleoprotein A3 (189-198)
HTINGHNCEV

SEQ ID NO: 17637 - protein, 9 aa, Artificial Sequence
  Mucin-3A (1830-1838)
HTLTPSTAL

SEQ ID NO: 17638 - protein, 9 aa, Artificial Sequence
  Eukaryotic translation initiation factor 4 gamma 1 (354-362)
HTVEIHEPN

SEQ ID NO: 17639 - protein, 9 aa, Artificial Sequence
  Nucleoporin NUP188 homolog (1451-1459)
HTVGFILQL

SEQ ID NO: 17640 - protein, 9 aa, Artificial Sequence
  5-phosphohydroxy-L-lysine phospho-lyase (166-174)
HVAPLPDTY

SEQ ID NO: 17641 - protein, 10 aa, Artificial Sequence
  Extracellular matrix protein FRAS1 (3372-3381)
HVCSNLVTTY

SEQ ID NO: 17642 - protein, 10 aa, Artificial Sequence
  Cystatin-B (58-67)
HVGDEDFVHL

SEQ ID NO: 17643 - protein, 12 aa, Artificial Sequence
  Microtubule-associated protein 4 (1016-1027)
HVPGGGNVQIQN

SEQ ID NO: 17644 - protein, 9 aa, Artificial Sequence
  Transmembrane protein 201 (96-104)
HVVSSAPSL

SEQ ID NO: 17645 - protein, 11 aa, Artificial Sequence
  Cholinesterase (154-164)
HVYDGKFLARV

SEQ ID NO: 17646 - protein, 9 aa, Artificial Sequence
  60S ribosomal protein L26 (61-69)
HYKGQQIGK

SEQ ID NO: 17647 - protein, 9 aa, Artificial Sequence
  HEAT repeat-containing protein 1 (578-586)
IAADILIKE

SEQ ID NO: 17648 - protein, 10 aa, Artificial Sequence
  Protein PRRC2C (2676-2685)
IAGRSTTPTS

SEQ ID NO: 17649 - protein, 9 aa, Artificial Sequence
  Endoplasmic reticulum lectin 1 (311-319)
IAIGSQPVL

SEQ ID NO: 17650 - protein, 9 aa, Artificial Sequence
  Monoacylglycerol lipase ABHD12 (84-92)
IAIPFLIKL

SEQ ID NO: 17651 - protein, 9 aa, Artificial Sequence
  Endoplasmin (166-174)
IAKSGTSEF

SEQ ID NO: 17652 - protein, 9 aa, Artificial Sequence
  Msx2-interacting protein (613-621)
IAPKITSVI

SEQ ID NO: 17653 - protein, 9 aa, Artificial Sequence
  Mitotic checkpoint serine/threonine-protein kinase BUB1 (382-390)
IAPPVPLKA

SEQ ID NO: 17654 - protein, 9 aa, Artificial Sequence
  Large proline-rich protein BAG6 (504-512)
IARPTPPQA

SEQ ID NO: 17655 - protein, 9 aa, Artificial Sequence
  Low-density lipoprotein receptor-related protein 1B (2001-2009)
IAVHPEKGL

SEQ ID NO: 17656 - protein, 10 aa, Artificial Sequence
  Signal transducing adapter molecule 2 (292-301)
IDEDKMDRAL

SEQ ID NO: 17657 - protein, 9 aa, Artificial Sequence
  Omega-amidase NIT2 (246-254)
IDLKKLAEI

SEQ ID NO: 17658 - protein, 9 aa, Artificial Sequence
  DENN domain-containing protein 1A (78-86)
IDSKQRFGF

SEQ ID NO: 17659 - protein, 9 aa, Artificial Sequence
  Histone-lysine N-methyltransferase EHMT1 (1232-1240)
IEAGEQLGF

SEQ ID NO: 17660 - protein, 8 aa, Artificial Sequence
  Basic helix-loop-helix domain-containing protein KIAA2018 (1140-1147)
IFDQENLE

SEQ ID NO: 17661 - protein, 9 aa, Artificial Sequence
  Neutral cholesterol ester hydrolase 1 (382-390)
IFTSWPTNF

SEQ ID NO: 17662 - protein, 9 aa, Artificial Sequence
  Olfactory receptor 5H15 (106-114)
IGVTTECFL

SEQ ID NO: 17663 - protein, 9 aa, Artificial Sequence
  Heterogeneous nuclear ribonucleoprotein U (749-757)
IGYPYPRAP

SEQ ID NO: 17664 - protein, 9 aa, Artificial Sequence
  BolA-like protein 2 (67-75)
IHAFEQKTL

SEQ ID NO: 17665 - protein, 9 aa, Artificial Sequence
  Histone H3.1 (113-121)
IHAKRVTIM

SEQ ID NO: 17666 - protein, 9 aa, Artificial Sequence
  Two pore calcium channel protein 1 (44-52)
IHDSQAPSL

SEQ ID NO: 17667 - protein, 9 aa, Artificial Sequence
  Probable ATP-dependent RNA helicase DDX41 (201-209)
IHHPTPIQI

SEQ ID NO: 17668 - protein, 9 aa, Artificial Sequence
  T-complex protein 1 subunit eta (281-289)
IHHSGAKVV

SEQ ID NO: 17669 - protein, 10 aa, Artificial Sequence
  T-complex protein 1 subunit eta (281-290)
IHHSGAKVVL

SEQ ID NO: 17670 - protein, 9 aa, Artificial Sequence
  Leucine-rich repeat-containing protein 16A (481-489)
IHNITSLDI

SEQ ID NO: 17671 - protein, 9 aa, Artificial Sequence
  UDP-N-acetylglucosamine-peptide N-acetylglucosaminyltransferase 110 kDa subunit (628-636)
IHQDGIHIL

SEQ ID NO: 17672 - protein, 9 aa, Artificial Sequence
  Calcium/calmodulin-dependent protein kinase type 1 (286-294)
IHQSVSEQI

SEQ ID NO: 17673 - protein, 10 aa, Artificial Sequence
  G-protein coupled receptor 98 (3507-3516)
IHSFTPASGI

SEQ ID NO: 17674 - protein, 9 aa, Artificial Sequence
  Wee1-like protein kinase (417-425)
IHSMSLVHM

SEQ ID NO: 17675 - protein, 9 aa, Artificial Sequence
  Toll-like receptor 9 (587-595)
IHSQVSQQL

SEQ ID NO: 17676 - protein, 9 aa, Artificial Sequence
  Tumor suppressor candidate 2 (99-107)
IHVDFPVIL

SEQ ID NO: 17677 - protein, 9 aa, Artificial Sequence
  DNA replication licensing factor MCM5 (694-702)
IIKDFTKQK

SEQ ID NO: 17678 - protein, 10 aa, Artificial Sequence
  Kelch-like protein 6 (114-123)
IIKGVDAETM

SEQ ID NO: 17679 - protein, 10 aa, Artificial Sequence
  Transcription factor Sp2 (277-286)
IIQAGNNLLI

SEQ ID NO: 17680 - protein, 9 aa, Artificial Sequence
  Stress-associated endoplasmic reticulum protein 1 (58-66)
IIQSIRMGM

SEQ ID NO: 17681 - protein, 9 aa, Artificial Sequence
  HEAT repeat-containing protein 5B (1006-1014)
IITTVGPEL

SEQ ID NO: 17682 - protein, 9 aa, Artificial Sequence
  Annexin A7 (223-231)
IKAAFKTSY

SEQ ID NO: 17683 - protein, 10 aa, Artificial Sequence
  Tetraspanin-8 (198-207)
IKDFLAKNLI

SEQ ID NO: 17684 - protein, 9 aa, Artificial Sequence
  Copine-3 (135-143)
IKDNRVVLF

SEQ ID NO: 17685 - protein, 9 aa, Artificial Sequence
  AP-3 complex subunit mu-1 (102-110)
IKDNVVIVY

SEQ ID NO: 17686 - protein, 9 aa, Artificial Sequence
  Geminin (90-98)
IKENPSSQY

SEQ ID NO: 17687 - protein, 9 aa, Artificial Sequence
  X-ray repair cross-complementing protein 5 (647-655)
IKFSEEQRF

SEQ ID NO: 17688 - protein, 9 aa, Artificial Sequence
  Serine/threonine-protein kinase TAO1 (83-91)
IKHPNSIEY

SEQ ID NO: 17689 - protein, 9 aa, Artificial Sequence
  60S ribosomal protein L12 (98-106)
IKHSGNITF

SEQ ID NO: 17690 - protein, 9 aa, Artificial Sequence
  Alkyldihydroxyacetonephosphate synthase, peroxisomal (379-387)
IKIRPVPEY

SEQ ID NO: 17691 - protein, 9 aa, Artificial Sequence
  Probable ATP-dependent RNA helicase DDX52 (255-263)
IKISEGTGF

SEQ ID NO: 17692 - protein, 9 aa, Artificial Sequence
  Nucleolar and spindle-associated protein 1 (108-116)
IKISNPTEF

SEQ ID NO: 17693 - protein, 9 aa, Artificial Sequence
  Serine/threonine-protein kinase 17A (79-87)
IKKDSGKEF

SEQ ID NO: 17694 - protein, 9 aa, Artificial Sequence
  Dynein light chain 1, cytoplasmic (42-50)
IKKEFDKKY

SEQ ID NO: 17695 - protein, 9 aa, Artificial Sequence
  Endoplasmin (472-480)
IKKIADDKY

SEQ ID NO: 17696 - protein, 10 aa, Artificial Sequence
  Elongation factor 2 (570-579)
IKKSDPVVSY

SEQ ID NO: 17697 - protein, 9 aa, Artificial Sequence
  DNA ligase 1 (608-616)
IKLPSVTSF

SEQ ID NO: 17698 - protein, 9 aa, Artificial Sequence
  Acetyl-coenzyme A transporter 1 (305-313)
IKMPAVLTF

SEQ ID NO: 17699 - protein, 9 aa, Artificial Sequence
  Ribulose-phosphate 3-epimerase (119-127)
IKPGTSVEY

SEQ ID NO: 17700 - protein, 8 aa, Artificial Sequence
  Serine/threonine-protein kinase tousled-like 1 (482-489)
IKPPIIHY

SEQ ID NO: 17701 - protein, 10 aa, Artificial Sequence
  Eukaryotic translation initiation factor 5B (366-375)
IKRLEELEAK

SEQ ID NO: 17702 - protein, 9 aa, Artificial Sequence
  F-box only protein 11 (714-722)
IKTDSNPTL

SEQ ID NO: 17703 - protein, 10 aa, Artificial Sequence
  60S ribosomal protein L11 (117-126)
IKYDPSIGIY

SEQ ID NO: 17704 - protein, 9 aa, Artificial Sequence
  Ubiquitin carboxyl-terminal hydrolase 40 (723-731)
ILIQDSHDD

SEQ ID NO: 17705 - protein, 9 aa, Artificial Sequence
  E3 ubiquitin-protein ligase UBR4 (654-662)
ILNFITSSM

SEQ ID NO: 17706 - protein, 9 aa, Artificial Sequence
  ATP-dependent RNA helicase DDX18 (529-537)
ILRPEELGF

SEQ ID NO: 17707 - protein, 11 aa, Artificial Sequence
  Trace amine-associated receptor 6 (212-222)
IMIILYGNIFL

SEQ ID NO: 17708 - protein, 9 aa, Artificial Sequence
  DNA polymerase delta subunit 2 (258-266)
INKAKYLTK

SEQ ID NO: 17709 - protein, 9 aa, Artificial Sequence
  40S ribosomal protein S18 (5-13)
IPEKFQHIL

SEQ ID NO: 17710 - protein, 9 aa, Artificial Sequence
  Nuclear factor of activated T-cells, cytoplasmic 2 (331-339)
IPESSGRIV

SEQ ID NO: 17711 - protein, 8 aa, Artificial Sequence
  Nuclear factor erythroid 2-related factor 2 (443-450)
IPFPVEKI

SEQ ID NO: 17712 - protein, 9 aa, Artificial Sequence
  Tetra-peptide repeat homeobox protein 1 (109-117)
IPGPLPGSI

SEQ ID NO: 17713 - protein, 9 aa, Artificial Sequence
  DNA replication licensing factor MCM6 (79-87)
IQEEFYRVY

SEQ ID NO: 17714 - protein, 11 aa, Artificial Sequence
  Poly (ADP-ribose) polymerase 8 (10-20)
IQKDIDVVIQK

SEQ ID NO: 17715 - protein, 9 aa, Artificial Sequence
  DNA-directed RNA polymerase II subunit RPB4 (134-142)
IQTKRSFQY

SEQ ID NO: 17716 - protein, 9 aa, Artificial Sequence
  Serine/threonine-protein phosphatase 4 regulatory subunit 2 (40-48)
IQWSQFKGY

SEQ ID NO: 17717 - protein, 9 aa, Artificial Sequence
  Maestro heat-like repeat-containing protein family member 1 (525-533)
IQYDAHASL

SEQ ID NO: 17718 - protein, 9 aa, Artificial Sequence
  Protein capicua homolog (862-870)
IRFTLPPGT

SEQ ID NO: 17719 - protein, 10 aa, Artificial Sequence
  Inactive serine/threonine-protein kinase VRK3 (422-431)
IRPSETLQKY

SEQ ID NO: 17720 - protein, 9 aa, Artificial Sequence
  Sphingomyelin phosphodiesterase 3 (179-187)
ISAASFSSL

SEQ ID NO: 17721 - protein, 9 aa, Artificial Sequence
  Sodium channel protein type 5 subunit alpha (1758-1766)
ISFLIVVNM

SEQ ID NO: 17722 - protein, 9 aa, Artificial Sequence
  Calsyntenin-1 (783-791)
ISNEFKVEV

SEQ ID NO: 17723 - protein, 10 aa, Artificial Sequence
  Calcineurin subunit B type 2 (107-116)
ISNGELFQVL

SEQ ID NO: 17724 - protein, 9 aa, Artificial Sequence
  AT-rich interactive domain-containing protein 2 (1322-1330)
ISNGPSLEL

SEQ ID NO: 17725 - protein, 9 aa, Artificial Sequence
  THUMP domain-containing protein 3 (77-85)
ISVESLAQV

SEQ ID NO: 17726 - protein, 9 aa, Artificial Sequence
  Methylcrotonoyl-CoA carboxylase subunit alpha, mitochondrial (547-555)
ISYTRNMTL

SEQ ID NO: 17727 - protein, 9 aa, Artificial Sequence
  Kelch repeat and BTB domain-containing protein 12 (77-85)
ITAESVSVL

SEQ ID NO: 17728 - protein, 9 aa, Artificial Sequence
  Titin (15022-15030)
ITKNTADLK

SEQ ID NO: 17729 - protein, 11 aa, Artificial Sequence
  Elongation factor 1-alpha 1 (170-180)
IVKEVSTYIKK

SEQ ID NO: 17730 - protein, 9 aa, Artificial Sequence
  Nucleolar protein 58 (41-49)
IVKLKHFEK

SEQ ID NO: 17731 - protein, 9 aa, Artificial Sequence
  NADH dehydrogenase (ubiquinone) 1 beta subcomplex subunit 1 (7-15)
IVRDHWVHV

SEQ ID NO: 17732 - protein, 9 aa, Artificial Sequence
  Serine/threonine-protein kinase RIO1 (209-217)
IYKTSILVF

SEQ ID NO: 17733 - protein, 9 aa, Artificial Sequence
  60S ribosomal protein L4 (269-277)
KAASLKSNY

SEQ ID NO: 17734 - protein, 9 aa, Artificial Sequence
  Pre-mRNA-splicing factor SYF2 (221-229)
KAERFYGKY

SEQ ID NO: 17735 - protein, 9 aa, Artificial Sequence
  Zinc finger protein 215 (386-394)
KAFCRSSSL

SEQ ID NO: 17736 - protein, 9 aa, Artificial Sequence
  Integrin alpha-4 (236-244)
KAFLDKQNQ

SEQ ID NO: 17737 - protein, 9 aa, Artificial Sequence
  Spermatid perinuclear RNA-binding protein (384-392)
KAIDLMNAL

SEQ ID NO: 17738 - protein, 9 aa, Artificial Sequence
  Collagen alpha-6(VI) chain (501-509)
KAIENIRQM

SEQ ID NO: 17739 - protein, 9 aa, Artificial Sequence
  T-complex protein 1 subunit gamma (163-171)
KAISRWSSL

SEQ ID NO: 17740 - protein, 9 aa, Artificial Sequence
  60S ribosomal protein L7 (53-61)
KAKHYHKEY

SEQ ID NO: 17741 - protein, 9 aa, Artificial Sequence
  N(G),N(G)-dimethylarginine dimethylaminohydrolase 1 (196-204)
KALKIMQQM

SEQ ID NO: 17742 - protein, 9 aa, Artificial Sequence
  Zinc finger protein 491 (250-258)
KALSRLISF

SEQ ID NO: 17743 - protein, 9 aa, Artificial Sequence
  Inositol 1,4,5-trisphosphate receptor type 3 (2312-2320)
KAMVMDMEF

SEQ ID NO: 17744 - protein, 10 aa, Artificial Sequence
  Mid1-interacting protein 1 (164-173)
KANILTNRYK

SEQ ID NO: 17745 - protein, 9 aa, Artificial Sequence
  Phosphoenolpyruvate carboxykinase, cytosolic (GTP) (547-555)
KASTKLTPI

SEQ ID NO: 17746 - protein, 9 aa, Artificial Sequence
  Zinc finger protein 726 (174-182)
KCKNCVKSF

SEQ ID NO: 17747 - protein, 9 aa, Artificial Sequence
  PDZ domain-containing protein 8 (559-567)
KDGNKPPPL

SEQ ID NO: 17748 - protein, 9 aa, Artificial Sequence
  Zinc finger protein 470 (79-87)
KDPWVIKGG

SEQ ID NO: 17749 - protein, 9 aa, Artificial Sequence
  HIV Tat-specific factor 1 (234-242)
KDYKKKLSM

SEQ ID NO: 17750 - protein, 9 aa, Artificial Sequence
  Glucose-6-phosphate translocase (212-220)
KEESTLQEL

SEQ ID NO: 17751 - protein, 9 aa, Artificial Sequence
  Protein bassoon (2970-2978)
KEIDAKLKY

SEQ ID NO: 17752 - protein, 9 aa, Artificial Sequence
  Nuclear fragile X mental retardation-interacting protein 2 (667-675)
KEMESIWNL

SEQ ID NO: 17753 - protein, 9 aa, Artificial Sequence
  Desmoplakin (423-431)
KEREKILEY

SEQ ID NO: 17754 - protein, 9 aa, Artificial Sequence
  Protein FAM91A1 (752-760)
KESLQNLLH

SEQ ID NO: 17755 - protein, 9 aa, Artificial Sequence
  Complement C4-A (189-197)
KEVYMPSSI

SEQ ID NO: 17756 - protein, 10 aa, Artificial Sequence
  Heterogeneous nuclear ribonucleoprotein U (565-574)
KFIEIAARKK

SEQ ID NO: 17757 - protein, 9 aa, Artificial Sequence
  Ciliogenesis-associated TTC17-interacting protein (302-310)
KFLDRKEEL

SEQ ID NO: 17758 - protein, 10 aa, Artificial Sequence
  Heparan-sulfate 6-O-sulfotransferase 2 (519-528)
KFLKGRLLQT

SEQ ID NO: 17759 - protein, 10 aa, Artificial Sequence
  78 kDa glucose-regulated protein (113-122)
KFLPFKVVEK

SEQ ID NO: 17760 - protein, 9 aa, Artificial Sequence
  Protein SON (16-24)
KFREIQQEL

SEQ ID NO: 17761 - protein, 10 aa, Artificial Sequence
  Mothers against decapentaplegic homolog 9 (159-168)
KFRSASLHSE

SEQ ID NO: 17762 - protein, 11 aa, Artificial Sequence
  Stabilin-2 (1755-1765)
KFSNLIQDSGL

SEQ ID NO: 17763 - protein, 9 aa, Artificial Sequence
  Desmoglein-2 (639-647)
KGAKGFTPI

SEQ ID NO: 17764 - protein, 9 aa, Artificial Sequence
  Tumor necrosis factor ligand superfamily member 11 (257-265)
KGGSTKYWS

SEQ ID NO: 17765 - protein, 11 aa, Artificial Sequence
  Arginase-1 (153-163)
KGKIPDVPGFS

SEQ ID NO: 17766 - protein, 10 aa, Artificial Sequence
  Casein kinase I isoform delta (242-251)
KGYPSEFATY

SEQ ID NO: 17767 - protein, 11 aa, Artificial Sequence
  40S ribosomal protein S17 (49-59)
KIAGYVTHLMK

SEQ ID NO: 17768 - protein, 9 aa, Artificial Sequence
  Repetin (489-497)
KIDRQDQSY

SEQ ID NO: 17769 - protein, 9 aa, Artificial Sequence
  T-complex protein 1 subunit eta (135-143)
KIKEIAVTV

SEQ ID NO: 17770 - protein, 9 aa, Artificial Sequence
  V-type proton ATPase catalytic subunit A (596-604)
KIKSDYAQL

SEQ ID NO: 17771 - protein, 9 aa, Artificial Sequence
  Potassium-transporting ATPase alpha chain 1 (737-745)
KKADIGVAM

SEQ ID NO: 17772 - protein, 9 aa, Artificial Sequence
  Histone H1.4 (63-71)
KKALAAAGY

SEQ ID NO: 17773 - protein, 9 aa, Artificial Sequence
  Ezrin (262-270)
KKAPDFVFY

SEQ ID NO: 17774 - protein, 9 aa, Artificial Sequence
  C1GALT1-specific chaperone 1 (160-168)
KKDPSQPFY

SEQ ID NO: 17775 - protein, 9 aa, Artificial Sequence
  Cofilin-1 (95-103)
KKEDLVFIF

SEQ ID NO: 17776 - protein, 10 aa, Artificial Sequence
  116 kDa U5 small nuclear ribonucleoprotein component (421-430)
KKFFGEFTGF

SEQ ID NO: 17777 - protein, 9 aa, Artificial Sequence
  Squalene monooxygenase (15-23)
KKFGDFITL

SEQ ID NO: 17778 - protein, 9 aa, Artificial Sequence
  UPF0729 protein C18orf32 (17-25)
KKFLEPYIY

SEQ ID NO: 17779 - protein, 9 aa, Artificial Sequence
  Cholesterol 24-hydroxylase (94-102)
KKFLMSTKY

SEQ ID NO: 17780 - protein, 11 aa, Artificial Sequence
  Spermidine synthase (134-144)
KKFLPGMAIGY

SEQ ID NO: 17781 - protein, 10 aa, Artificial Sequence
  Probable global transcription activator SNF2L2 (1110-1119)
KKFNEPGSQY

SEQ ID NO: 17782 - protein, 10 aa, Artificial Sequence
  TRAF-interacting protein with FHA domain-containing protein A (76-85)
KKFNSSVLSF

SEQ ID NO: 17783 - protein, 12 aa, Artificial Sequence
  Nicotinamide phosphoribosyltransferase (330-341)
KKFPVTENSKGY

SEQ ID NO: 17784 - protein, 11 aa, Artificial Sequence
  Cell cycle progression protein 1 (523-533)
KKFSDSVKSTF

SEQ ID NO: 17785 - protein, 10 aa, Artificial Sequence
  40S ribosomal protein S7 (85-94)
KKFSGKHVVF

SEQ ID NO: 17786 - protein, 11 aa, Artificial Sequence
  Lupus La protein (165-175)
KKFVETPGQKY

SEQ ID NO: 17787 - protein, 9 aa, Artificial Sequence
  Zinc finger protein 451 (219-227)
KKFVTQQQY

SEQ ID NO: 17788 - protein, 9 aa, Artificial Sequence
  Melanoma inhibitory activity protein 3 (67-75)
KKGDPVYVY

SEQ ID NO: 17789 - protein, 9 aa, Artificial Sequence
  Protein FAM173B (108-116)
KKGFTAVGY

SEQ ID NO: 17790 - protein, 9 aa, Artificial Sequence
  SEC14-like protein 1 (157-165)
KKGKEIIEY

SEQ ID NO: 17791 - protein, 9 aa, Artificial Sequence
  Na(+)/H(+) exchange regulatory cofactor NHE-RF1 (158-166)
KKGPSGYGF

SEQ ID NO: 17792 - protein, 9 aa, Artificial Sequence
  Serine/threonine-protein kinase RIO3 (353-361)
KKHILVMSF

SEQ ID NO: 17793 - protein, 9 aa, Artificial Sequence
  Heat shock protein HSP 90-beta (203-211)
KKHSQFIGY

SEQ ID NO: 17794 - protein, 9 aa, Artificial Sequence
  Dynactin subunit 3 (59-67)
KKIEDLIKY

SEQ ID NO: 17795 - protein, 9 aa, Artificial Sequence
  60S ribosomal protein L23a (88-96)
KKIEDNNTL

SEQ ID NO: 17796 - protein, 10 aa, Artificial Sequence
  Nardilysin (992-1001)
KKIEEFLSSF

SEQ ID NO: 17797 - protein, 9 aa, Artificial Sequence
  Leydig cell tumor 10 kDa protein homolog (59-67)
KKIEHDVVM

SEQ ID NO: 17798 - protein, 9 aa, Artificial Sequence
  Brain-specific angiogenesis inhibitor 1-associated protein 2-like protein 1 (106-114)
KKIELDVKY

SEQ ID NO: 17799 - protein, 10 aa, Artificial Sequence
  General transcription factor 3C polypeptide 4 (563-572)
KKIESSGVTY

SEQ ID NO: 17800 - protein, 10 aa, Artificial Sequence
  T-complex protein 1 subunit gamma (353-362)
KKIGDEYFTF

SEQ ID NO: 17801 - protein, 9 aa, Artificial Sequence
  Gamma-interferon-inducible protein 16 (256-264)
KKIIIISDY

SEQ ID NO: 17802 - protein, 9 aa, Artificial Sequence
  Synaptojanin-2 (121-129)
KKILSSGVF

SEQ ID NO: 17803 - protein, 9 aa, Artificial Sequence
  Golgin-45 (320-328)
KKIPSTVEF

SEQ ID NO: 17804 - protein, 9 aa, Artificial Sequence
  RNA exonuclease 4 (342-350)
KKIRDTQKY

SEQ ID NO: 17805 - protein, 9 aa, Artificial Sequence
  60S ribosomal protein L23a (38-46)
KKIRTSPTF

SEQ ID NO: 17806 - protein, 9 aa, Artificial Sequence
  Stress-induced-phosphoprotein 1 (237-245)
KKKDFDTAL

SEQ ID NO: 17807 - protein, 10 aa, Artificial Sequence
  Protein DEK (143-152)
KKKEEMLKKF

SEQ ID NO: 17808 - protein, 9 aa, Artificial Sequence
  Protein KIAA2022 (1378-1386)
KKKINSGSQ

SEQ ID NO: 17809 - protein, 9 aa, Artificial Sequence
  Regulatory factor X-associated protein (175-183)
KKKKSDQAL

SEQ ID NO: 17810 - protein, 9 aa, Artificial Sequence
  UBX domain-containing protein 4 (377-385)
KKKLLDLEL

SEQ ID NO: 17811 - protein, 10 aa, Artificial Sequence
  Prefoldin subunit 3 (51-60)
KKLDEQYQKY

SEQ ID NO: 17812 - protein, 10 aa, Artificial Sequence
  Non-specific lipid-transfer protein (442-451)
KKLEEEGEQF

SEQ ID NO: 17813 - protein, 10 aa, Artificial Sequence
  Alpha-taxilin (423-432)
KKLEKETTMY

SEQ ID NO: 17814 - protein, 9 aa, Artificial Sequence
  Mitogen-activated protein kinase kinase kinase 1 (792-800)
KKLLSLLTF

SEQ ID NO: 17815 - protein, 10 aa, Artificial Sequence
  Cold shock domain-containing protein E1 (411-420)
KKLPKGTVSF

SEQ ID NO: 17816 - protein, 9 aa, Artificial Sequence
  Hexokinase-2 (146-154)
KKLPLGFTF

SEQ ID NO: 17817 - protein, 9 aa, Artificial Sequence
  14-3-3 protein theta (74-82)
KKLQLIKDY

SEQ ID NO: 17818 - protein, 9 aa, Artificial Sequence
  Nibrin (236-244)
KKLSSAVVF

SEQ ID NO: 17819 - protein, 10 aa, Artificial Sequence
  Clustered mitochondria protein homolog (294-303)
KKNFAVLQKK

SEQ ID NO: 17820 - protein, 9 aa, Artificial Sequence
  General transcription factor II-I (644-652)
KKPELVISY

SEQ ID NO: 17821 - protein, 10 aa, Artificial Sequence
  SUMO-activating enzyme subunit 1 (117-126)
KKPESFFTQF

SEQ ID NO: 17822 - protein, 9 aa, Artificial Sequence
  Poly(ADP-ribose)ohydrolase (689-697)
KKPTGLVTF

SEQ ID NO: 17823 - protein, 9 aa, Artificial Sequence
  DnaJ homolog subfamily C member 3 (406-414)
KKQEIIKAY

SEQ ID NO: 17824 - protein, 10 aa, Artificial Sequence
  Ankyrin repeat domain-containing protein 17 (1650-1659)
KKQPSVLVTF

SEQ ID NO: 17825 - protein, 9 aa, Artificial Sequence
  Transmembrane emp24 domain-containing protein 3 (82-90)
KKQYDSFTY

SEQ ID NO: 17826 - protein, 10 aa, Artificial Sequence
  Heterogeneous nuclear ribonucleoproteins A2/B1 (151-160)
KKRGFGFVTF

SEQ ID NO: 17827 - protein, 9 aa, Artificial Sequence
  Heterogeneous nuclear ribonucleoproteins C1/C2 (29-37)
KKSDVEAIF

SEQ ID NO: 17828 - protein, 9 aa, Artificial Sequence
  RNA-binding protein Raly (34-42)
KKSDVETIF

SEQ ID NO: 17829 - protein, 9 aa, Artificial Sequence
  Endoplasmin (404-412)
KKSDYIKLY

SEQ ID NO: 17830 - protein, 9 aa, Artificial Sequence
  Exocyst complex component 2 (196-204)
KKSEGSLAY

SEQ ID NO: 17831 - protein, 8 aa, Artificial Sequence
  ATPase family AAA domain-containing protein 5 (1559-1566)
KKSQKKKQ

SEQ ID NO: 17832 - protein, 9 aa, Artificial Sequence
  60S ribosomal protein L18a (55-63)
KKSSGEIVY

SEQ ID NO: 17833 - protein, 9 aa, Artificial Sequence
  Copper transport protein ATOX1 (56-64)
KKTGKTVSY

SEQ ID NO: 17834 - protein, 9 aa, Artificial Sequence
  Melanoma-associated antigen 1 (104-112)
KKVADLVGF

SEQ ID NO: 17835 - protein, 9 aa, Artificial Sequence
  ATP-dependent RNA helicase DDX18 (647-655)
KKVEKSKIF

SEQ ID NO: 17836 - protein, 9 aa, Artificial Sequence
  Polyadenylate-binding protein 1 (268-276)
KKVERQTEL

SEQ ID NO: 17837 - protein, 10 aa, Artificial Sequence
  Asparagine synthetase (glutamine-hydrolyzing) (131-140)
KKVFLGRDTY

SEQ ID NO: 17838 - protein, 9 aa, Artificial Sequence
  60S ribosomal protein L37a (6-14)
KKVGIVGKY

SEQ ID NO: 17839 - protein, 9 aa, Artificial Sequence
  60S ribosomal protein L23 (74-82)
KKVHPAVVI

SEQ ID NO: 17840 - protein, 9 aa, Artificial Sequence
  Acyl-CoA desaturase (337-345)
KKVSKAAIL

SEQ ID NO: 17841 - protein, 9 aa, Artificial Sequence
  Condensin-2 complex subunit G2 (421-429)
KKVTGELAF

SEQ ID NO: 17842 - protein, 9 aa, Artificial Sequence
  Sorting nexin-29 (261-269)
KKVTNIISF

SEQ ID NO: 17843 - protein, 10 aa, Artificial Sequence
  3-hydroxyisobutyryl-CoA hydrolase, mitochondrial (73-82)
KKWEQDPETF

SEQ ID NO: 17844 - protein, 10 aa, Artificial Sequence
  Rho-related GTP-binding protein RhoE (115-124)
KKWKGEIQEF

SEQ ID NO: 17845 - protein, 9 aa, Artificial Sequence
  Conserved oligomeric Golgi complex subunit 2 (378-386)
KKWNLPVYF

SEQ ID NO: 17846 - protein, 9 aa, Artificial Sequence
  Oxysterol-binding protein 1 (288-296)
KKWQKSLQY

SEQ ID NO: 17847 - protein, 10 aa, Artificial Sequence
  Cytosolic phospholipase A2 (379-388)
KKYEENPLHF

SEQ ID NO: 17848 - protein, 9 aa, Artificial Sequence
  F-BAR and double SH3 domains protein 2 (153-161)
KKYFETEQM

SEQ ID NO: 17849 - protein, 10 aa, Artificial Sequence
  Cysteine andine-rich protein 1 (64-73)
KKYGPKGYGY

SEQ ID NO: 17850 - protein, 10 aa, Artificial Sequence
  WD repeat-containing protein 82 (62-71)
KKYGVDLIRY

SEQ ID NO: 17851 - protein, 9 aa, Artificial Sequence
  Gamma-interferon-inducible protein 16 (3-11)
KKYKNIVLL

SEQ ID NO: 17852 - protein, 10 aa, Artificial Sequence
  AT-rich interactive domain-containing protein 4B (387-396)
KKYLYGFEEY

SEQ ID NO: 17853 - protein, 11 aa, Artificial Sequence
  116 kDa U5 small nuclear ribonucleoprotein component (63-73)
KKYYPTAEEVY

SEQ ID NO: 17854 - protein, 9 aa, Artificial Sequence
  Astrocytic phosphoprotein PEA-15 (122-130)
KLAPPPKKA

SEQ ID NO: 17855 - protein, 9 aa, Artificial Sequence
  Remodeling and spacing factor 1 (587-595)
KLEKSKKTF

SEQ ID NO: 17856 - protein, 12 aa, Artificial Sequence
  Zymogen granule protein 16 homolog B (100-111)
KLGALGGNTQEV

SEQ ID NO: 17857 - protein, 8 aa, Artificial Sequence
  Ubiquitin carboxyl-terminal hydrolase 3 (107-114)
KLGLVQKV

SEQ ID NO: 17858 - protein, 9 aa, Artificial Sequence
  Sister chromatid cohesion protein PDS5 homolog A (112-120)
KLKDIFLFI

SEQ ID NO: 17859 - protein, 9 aa, Artificial Sequence
  DDB1- and CUL4-associated factor 13 (376-384)
KLKEKFQHY

SEQ ID NO: 17860 - protein, 11 aa, Artificial Sequence
  Heterogeneous nuclear ribonucleoproteins C1/C2 (187-197)
KLKGDDLQAIK

SEQ ID NO: 17861 - protein, 9 aa, Artificial Sequence
  Rap guanine nucleotide exchange factor 2 (828-836)
KLPNKYEKL

SEQ ID NO: 17862 - protein, 9 aa, Artificial Sequence
  Dynein heavy chain 1, axonemal (2025-2033)
KLPPLLKPY

SEQ ID NO: 17863 - protein, 10 aa, Artificial Sequence
  Signal peptidase complex subunit 2 (173-182)
KLTFISGRTK

SEQ ID NO: 17864 - protein, 10 aa, Artificial Sequence
  Heterogeneous nuclear ribonucleoprotein U-like protein 2 (521-530)
KLVQIASRTK

SEQ ID NO: 17865 - protein, 10 aa, Artificial Sequence
  Dedicator of cytokinesis protein 3 (182-191)
KMHLSSRQSV

SEQ ID NO: 17866 - protein, 9 aa, Artificial Sequence
  Neuroblast differentiation-associated protein AHNAK (5087-5095)
KMYFPDVEF

SEQ ID NO: 17867 - protein, 9 aa, Artificial Sequence
  A-kinase anchor protein 9 (1420-1428)
KNIDGTIEF

SEQ ID NO: 17868 - protein, 8 aa, Artificial Sequence
  Nucleoporin p58/p45 (71-78)
KPATGFTL

SEQ ID NO: 17869 - protein, 8 aa, Artificial Sequence
  MARCKS-related protein (96-103)
KPFKLSGL

SEQ ID NO: 17870 - protein, 9 aa, Artificial Sequence
  Zinc finger and BTB domain-containing protein 38 (175-183)
KQFQSPSTL

SEQ ID NO: 17871 - protein, 10 aa, Artificial Sequence
  ADP-sugar pyrophosphatase (81-90)
KQFRPPMGGY

SEQ ID NO: 17872 - protein, 9 aa, Artificial Sequence
  26S protease regulatory subunit 8 (30-38)
KQIKEIKEV

SEQ ID NO: 17873 - protein, 9 aa, Artificial Sequence
  Ubiquitin-40S ribosomal protein S27a (48-56)
KQLEDGRTL

SEQ ID NO: 17874 - protein, 9 aa, Artificial Sequence
  tRNA selenocysteine 1-associated protein 1 (88-96)
KQPDNSPEY

SEQ ID NO: 17875 - protein, 9 aa, Artificial Sequence
  MARVEL domain-containing protein 2 (540-548)
KQRIQEYDK

SEQ ID NO: 17876 - protein, 9 aa, Artificial Sequence
  Heat shock 70 kDa protein 1B (423-431)
KQTQIFTTY

SEQ ID NO: 17877 - protein, 9 aa, Artificial Sequence
  Mortality factor 4-like protein 1 (38-46)
KQVKYFIHY

SEQ ID NO: 17878 - protein, 10 aa, Artificial Sequence
  ADP-ribosylation factor-binding protein GGA2 (311-320)
KQVMEGRVTF

SEQ ID NO: 17879 - protein, 12 aa, Artificial Sequence
  60S ribosomal protein L17 (74-85)
KQWGWTQGRWPK

SEQ ID NO: 17880 - protein, 9 aa, Artificial Sequence
  ATP-dependent RNA helicase DDX3X (264-272)
KQYPISLVL

SEQ ID NO: 17881 - protein, 9 aa, Artificial Sequence
  Cancer-related nucleoside-triphosphatase (73-81)
KRECRVGQY

SEQ ID NO: 17882 - protein, 10 aa, Artificial Sequence
  Unconventional myosin-VIIb (624-633)
KRPSTLGSQF

SEQ ID NO: 17883 - protein, 11 aa, Artificial Sequence
  Vigilin (550-560)
KSDIVQLRGPK

SEQ ID NO: 17884 - protein, 10 aa, Artificial Sequence
  Cyclin-dependent kinase-like 5 (680-689)
KSEGGVYHDP

SEQ ID NO: 17885 - protein, 9 aa, Artificial Sequence
  Clathrin heavy chain 1 (706-714)
KSFEGLFYF

SEQ ID NO: 17886 - protein, 9 aa, Artificial Sequence
  General transcription factor 3C polypeptide 2 (146-154)
KSKAELLLL

SEQ ID NO: 17887 - protein, 11 aa, Artificial Sequence
  Calcyclin-binding protein (33-43)
KSKIETEIKNK

SEQ ID NO: 17888 - protein, 9 aa, Artificial Sequence
  Dol-P-Glc:Glc(2)Man(9)GlcNAc(2)-PP-Dol alpha-1,2-glucosyltransferase (389-397)
KSKSIFWNL

SEQ ID NO: 17889 - protein, 9 aa, Artificial Sequence
  Leucine-rich repeat-containing protein 40 (210-218)
KSLPAEINR

SEQ ID NO: 17890 - protein, 9 aa, Artificial Sequence
  Solute carrier family 7 member 13 (416-424)
KSPNVHYVY

SEQ ID NO: 17891 - protein, 9 aa, Artificial Sequence
  Aromatase (99-107)
KSSSMFHIM

SEQ ID NO: 17892 - protein, 9 aa, Artificial Sequence
  Thromboxane-A synthase (118-126)
KSVADSVLF

SEQ ID NO: 17893 - protein, 11 aa, Artificial Sequence
  Hypoxia up-regulated protein 1 (249-259)
KTKEAGMQPQL

SEQ ID NO: 17894 - protein, 10 aa, Artificial Sequence
  Translin (76-85)
KTKFPAEQYY

SEQ ID NO: 17895 - protein, 9 aa, Artificial Sequence
  RNA-binding protein PNO1 (189-197)
KTKFTIENV

SEQ ID NO: 17896 - protein, 9 aa, Artificial Sequence
  DNA damage-binding protein 1 (915-923)
KTKGDFILV

SEQ ID NO: 17897 - protein, 9 aa, Artificial Sequence
  N-acetylgalactosamine kinase (102-110)
KTKPLWHNY

SEQ ID NO: 17898 - protein, 9 aa, Artificial Sequence
  Splicing factor 3B subunit 3 (294-302)
KTKSMFFFL

SEQ ID NO: 17899 - protein, 12 aa, Artificial Sequence
  Heterogeneous nuclear ribonucleoproteins A2/B1 (3-14)
KTLETVPLERKK

SEQ ID NO: 17900 - protein, 9 aa, Artificial Sequence
  ADP-ribosylation factor-like protein 11 (25-33)
KTTLLYKLK

SEQ ID NO: 17901 - protein, 9 aa, Artificial Sequence
  Catenin alpha-2 (794-802)
KVKAEVQNL

SEQ ID NO: 17902 - protein, 9 aa, Artificial Sequence
  Serine/threonine-protein phosphatase 2A 65 kDa regulatory subunit A alpha isoform (305-313)
KVKEFCENL

SEQ ID NO: 17903 - protein, 9 aa, Artificial Sequence
  Septin-7 (364-372)
KVKEKVQKL

SEQ ID NO: 17904 - protein, 9 aa, Artificial Sequence
  Kelch-like protein 24 (128-136)
KVKITTENV

SEQ ID NO: 17905 - protein, 11 aa, Artificial Sequence
  Ubiquitin-40S ribosomal protein S27a (97-107)
KVKLAVLKYYK

SEQ ID NO: 17906 - protein, 10 aa, Artificial Sequence
  Thioredoxin-like protein 4A (51-60)
KVKNFAVIYL

SEQ ID NO: 17907 - protein, 9 aa, Artificial Sequence
  FACT complex subunit SPT16 (424-432)
KVKNVGIFL

SEQ ID NO: 17908 - protein, 10 aa, Artificial Sequence
  Peptidylprolyl isomerase domain and WD repeat-containing protein 1 (65-74)
KVLEFERVYL

SEQ ID NO: 17909 - protein, 10 aa, Artificial Sequence
  Exocyst complex component 4 (568-577)
KVLGVQRPLL

SEQ ID NO: 17910 - protein, 10 aa, Artificial Sequence
  60S ribosomal protein L15 (5-14)
KYIQELWRKK

SEQ ID NO: 17911 - protein, 9 aa, Artificial Sequence
  Proto-oncogene vav (272-280)
KYKERFLVY

SEQ ID NO: 17912 - protein, 10 aa, Artificial Sequence
  60S ribosomal protein L35 (77-86)
KYKPLDLRPK

SEQ ID NO: 17913 - protein, 12 aa, Artificial Sequence
  Protein mab-21-like 3 (2-13)
KYLTVGDLEDCL

SEQ ID NO: 17914 - protein, 9 aa, Artificial Sequence
  Protein archease (35-43)
KYPPVNRKY

SEQ ID NO: 17915 - protein, 9 aa, Artificial Sequence
  RNA-binding protein 42 (445-453)
KYVGSRPIK

SEQ ID NO: 17916 - protein, 9 aa, Artificial Sequence
  Suppressor of tumorigenicity 7 protein-like (66-74)
LAAVTVFLN

SEQ ID NO: 17917 - protein, 9 aa, Artificial Sequence
  Cytochrome c oxidase assembly protein COX14 (7-15)
LADIGYKTF

SEQ ID NO: 17918 - protein, 10 aa, Artificial Sequence
  Serine/arginine repetitive matrix protein 2 (2256-2265)
LADSRTPAAA

SEQ ID NO: 17919 - protein, 9 aa, Artificial Sequence
  Neutral amino acid transporter A (75-83)
LAFPGEMLL

SEQ ID NO: 17920 - protein, 9 aa, Artificial Sequence
  Apolipoprotein B receptor (1069-1077)
LAHPGMMQE

SEQ ID NO: 17921 - protein, 10 aa, Artificial Sequence
  Dystrophin-related protein 2 (299-308)
LAISDVHLSM

SEQ ID NO: 17922 - protein, 9 aa, Artificial Sequence
  Microtubule-associated protein 4 (558-566)
LAKDGVLTL

SEQ ID NO: 17923 - protein, 9 aa, Artificial Sequence
  Renin receptor (203-211)
LAKDHSPDL

SEQ ID NO: 17924 - protein, 9 aa, Artificial Sequence
  Minor histocompatibility antigen H13 (335-343)
LAKGEVTEM

SEQ ID NO: 17925 - protein, 9 aa, Artificial Sequence
  Nectin-1 (16-24)
LALGLTAFF

SEQ ID NO: 17926 - protein, 11 aa, Artificial Sequence
  Heterogeneous nuclear ribonucleoprotein M (609-619)
LAMGGGGGASF

SEQ ID NO: 17927 - protein, 10 aa, Artificial Sequence
  Golgin subfamily A member 3 (204-213)
LAMTKEYSFL

SEQ ID NO: 17928 - protein, 9 aa, Artificial Sequence
  Thioredoxin-interacting protein (222-230)
LANGQTKVL

SEQ ID NO: 17929 - protein, 11 aa, Artificial Sequence
  Orexin receptor type 1 (225-235)
LAPLGLMAMAY

SEQ ID NO: 17930 - protein, 9 aa, Artificial Sequence
  Dynein heavy chain 6, axonemal (1621-1629)
LARKMTQMY

SEQ ID NO: 17931 - protein, 9 aa, Artificial Sequence
  Nucleolar protein 16 (58-66)
LAVDPNRAV

SEQ ID NO: 17932 - protein, 9 aa, Artificial Sequence
  Ectonucleoside triphosphate diphosphohydrolase 1 (33-41)
LAVGLTQNK

SEQ ID NO: 17933 - protein, 9 aa, Artificial Sequence
  60S ribosomal protein L29 (96-104)
LAYIAHPKL

SEQ ID NO: 17934 - protein, 9 aa, Artificial Sequence
  Potassium-transporting ATPase alpha chain 2 (598-606)
LCFVGLLSM

SEQ ID NO: 17935 - protein, 10 aa, Artificial Sequence
  Eukaryotic translation initiation factor 3 subunit C-like protein (635-644)
LDIQSSGRAK

SEQ ID NO: 17936 - protein, 9 aa, Artificial Sequence
  Cullin-7 (163-171)
LDLLMHMLS

SEQ ID NO: 17937 - protein, 9 aa, Artificial Sequence
  Sodium-driven chloride bicarbonate exchanger (854-862)
LDLLMVAVM

SEQ ID NO: 17938 - protein, 9 aa, Artificial Sequence
  Fibrillin-3 (2702-2710)
LDSEALLTL

SEQ ID NO: 17939 - protein, 9 aa, Artificial Sequence
  Uncharacterized protein C9orf171 (285-293)
LDTFPTEAD

SEQ ID NO: 17940 - protein, 10 aa, Artificial Sequence
  Ankyrin repeat and LEM domain-containing protein 1 (184-193)
LEADPGPPSL

SEQ ID NO: 17941 - protein, 8 aa, Artificial Sequence
  Core histone macro-H2A.1 (61-68)
LELAGNAA

SEQ ID NO: 17942 - protein, 9 aa, Artificial Sequence
  Alpha-mannosidase 2x (1106-1114)
LFHGLDVVF

SEQ ID NO: 17943 - protein, 9 aa, Artificial Sequence
  Vasohibin-2 (48-56)
LFHVNKSGF

SEQ ID NO: 17944 - protein, 9 aa, Artificial Sequence
  Pre-mRNA-processing factor 17 (418-426)
LGAVNTIVF

SEQ ID NO: 17945 - protein, 9 aa, Artificial Sequence
  Pumilio homolog 1 (673-681)
LGFGSSSSL

SEQ ID NO: 17946 - protein, 9 aa, Artificial Sequence
  Putative nuclease HARBI1 (77-85)
LGFYTSGSF

SEQ ID NO: 17947 - protein, 10 aa, Artificial Sequence
  Hyaluronidase-4 (205-214)
LGIKSRPKGL

SEQ ID NO: 17948 - protein, 10 aa, Artificial Sequence
  NF-kappa-B-repressing factor (591-600)
LGLDVERVNK

SEQ ID NO: 17949 - protein, 9 aa, Artificial Sequence
  G-protein coupled receptor family C group 6 member A (447-455)
LGVLKNVTF

SEQ ID NO: 17950 - protein, 9 aa, Artificial Sequence
  L-xylulose reductase (27-35)
LHATGARVV

SEQ ID NO: 17951 - protein, 9 aa, Artificial Sequence
  Sterol regulatory element-binding protein 1 (1037-1045)
LHEATARLM

SEQ ID NO: 17952 - protein, 9 aa, Artificial Sequence
  U3 small nucleolar ribonucleoprotein protein MPP10 (405-413)
LHFDHAVRM

SEQ ID NO: 17953 - protein, 9 aa, Artificial Sequence
  Nucleoporin Nup43 (101-109)
LHHPNNQTL

SEQ ID NO: 17954 - protein, 9 aa, Artificial Sequence
  Delta(14)-sterol reductase (279-287)
LHHPQPLGL

SEQ ID NO: 17955 - protein, 9 aa, Artificial Sequence
  Phospholipid-transporting ATPase ID (589-597)
LHHSTQELL

SEQ ID NO: 17956 - protein, 10 aa, Artificial Sequence
  Neuron navigator 3 (2128-2137)
LHHVGSLSDI

SEQ ID NO: 17957 - protein, 9 aa, Artificial Sequence
  GTP-binding protein 1 (551-559)
LHIDQRLVF

SEQ ID NO: 17958 - protein, 9 aa, Artificial Sequence
  Cyclin-I (151-159)
LHIFHAIAV

SEQ ID NO: 17959 - protein, 9 aa, Artificial Sequence
  Thioredoxin domain-containing protein 9 (138-146)
LHIKVIPTL

SEQ ID NO: 17960 - protein, 9 aa, Artificial Sequence
  Myb-binding protein 1A (438-446)
LHMPERAVF

SEQ ID NO: 17961 - protein, 9 aa, Artificial Sequence
  Probable ATP-dependent RNA helicase DDX56 (212-220)
LHNPVTLKL

SEQ ID NO: 17962 - protein, 9 aa, Artificial Sequence
  Gem-associated protein 5 (107-115)
LHQHTISTL

SEQ ID NO: 17963 - protein, 9 aa, Artificial Sequence
  G patch domain-containing protein 8 (828-836)
LHQKSPSQY

SEQ ID NO: 17964 - protein, 9 aa, Artificial Sequence
  Actin-binding LIM protein 1 (664-672)
LHRPVSTDF

SEQ ID NO: 17965 - protein, 9 aa, Artificial Sequence
  Cytochrome c oxidase subunit 2 (160-168)
LHSWAVPTL

SEQ ID NO: 17966 - protein, 9 aa, Artificial Sequence
  IQ motif and SEC7 domain-containing protein 1 (263-271)
LHTEEAPAL

SEQ ID NO: 17967 - protein, 9 aa, Artificial Sequence
  Selenoprotein S (22-30)
LHTTVGSLL

SEQ ID NO: 17968 - protein, 9 aa, Artificial Sequence
  Plectin (1023-1031)
LHVDMKSLL

SEQ ID NO: 17969 - protein, 9 aa, Artificial Sequence
  Unconventional myosin-Ih (186-194)
LIEKSRVVY

SEQ ID NO: 17970 - protein, 11 aa, Artificial Sequence
  Heat shock 70 kDa protein 1-like (198-208)
LIFDLGGGTFD

SEQ ID NO: 17971 - protein, 9 aa, Artificial Sequence
  DnaJ homolog subfamily C member 13 (1046-1054)
LILNMLITM

SEQ ID NO: 17972 - protein, 9 aa, Artificial Sequence
  Probable ATP-dependent RNA helicase DDX59 (275-283)
LILTPTREL

SEQ ID NO: 17973 - protein, 9 aa, Artificial Sequence
  Integrin beta-7 (381-389)
LIMDAYNSL

SEQ ID NO: 17974 - protein, 9 aa, Artificial Sequence
  Leucine-rich repeat and fibronectin type-III domain-containing protein 4 (447-455)
LIYRIVPAS

SEQ ID NO: 17975 - protein, 9 aa, Artificial Sequence
  Protein disulfide-isomerase A2 (328-336)
LKAEAAPTL

SEQ ID NO: 17976 - protein, 9 aa, Artificial Sequence
  Mini-chromosome maintenance complex-binding protein (430-438)
LKFIPHKDY

SEQ ID NO: 17977 - protein, 9 aa, Artificial Sequence
  RNA-binding protein 8A (113-121)
LKGYTLVEY

SEQ ID NO: 17978 - protein, 9 aa, Artificial Sequence
  Mannosyl-oligosaccharide glucosidase (326-334)
LKIPISIEF

SEQ ID NO: 17979 - protein, 9 aa, Artificial Sequence
  ER membrane protein complex subunit 1 (411-419)
LKKDDSVGY

SEQ ID NO: 17980 - protein, 11 aa, Artificial Sequence
  DENN domain-containing protein 4C (704-714)
LKLFDRPQELK

SEQ ID NO: 17981 - protein, 9 aa, Artificial Sequence
  Eukaryotic translation initiation factor 3 subunit D (447-455)
LKLGYVSRY

SEQ ID NO: 17982 - protein, 9 aa, Artificial Sequence
  Serine/threonine-protein kinase PAK 2 (301-309)
LKNPNIVNF

SEQ ID NO: 17983 - protein, 9 aa, Artificial Sequence
  Elongation factor 1-alpha 1 (272-280)
LKPGMVVTF

SEQ ID NO: 17984 - protein, 9 aa, Artificial Sequence
  X-ray repair cross-complementing protein 6 (281-289)
LKPPPIKLY

SEQ ID NO: 17985 - protein, 9 aa, Artificial Sequence
  Choline/ethanolaminephosphotransferase 1 (48-56)
LKRLEEHRY

SEQ ID NO: 17986 - protein, 9 aa, Artificial Sequence
  Renin receptor (22-30)
LKSPGSVVF

SEQ ID NO: 17987 - protein, 9 aa, Artificial Sequence
  Nucleolin (323-331)
LKTGISDVF

SEQ ID NO: 17988 - protein, 9 aa, Artificial Sequence
  26S protease regulatory subunit 7 (33-41)
LKTYGQSTY

SEQ ID NO: 17989 - protein, 8 aa, Artificial Sequence
  60S ribosomal protein L19 (125-132)
LKVKGNVF

SEQ ID NO: 17990 - protein, 9 aa, Artificial Sequence
  Forkhead box protein O3 (93-101)
LLEDSARVL

SEQ ID NO: 17991 - protein, 9 aa, Artificial Sequence
  Dynein heavy chain 9, axonemal (368-376)
LLIQQASNY

SEQ ID NO: 17992 - protein, 11 aa, Artificial Sequence
  Dynein heavy chain 10, axonemal (1334-1344)
LLLDLKNEALR

SEQ ID NO: 17993 - protein, 9 aa, Artificial Sequence
  ER membrane protein complex subunit 3 (6-14)
LLLDSNIRL

SEQ ID NO: 17994 - protein, 9 aa, Artificial Sequence
  Echinoderm microtubule-associated protein-like 4 (278-286)
LLPTGKIVY

SEQ ID NO: 17995 - protein, 9 aa, Artificial Sequence
  Chromodomain-helicase-DNA-binding protein 2 (628-636)
LLYKTLIDF

SEQ ID NO: 17996 - protein, 9 aa, Artificial Sequence
  Integrator complex subunit 10 (519-527)
LMCYMVLPI

SEQ ID NO: 17997 - protein, 11 aa, Artificial Sequence
  Melatonin receptor type 1A (106-116)
LMGLSVIGSIF

SEQ ID NO: 17998 - protein, 9 aa, Artificial Sequence
  DNA-dependent protein kinase catalytic subunit (2219-2227)
LMKHVFHPK

SEQ ID NO: 17999 - protein, 11 aa, Artificial Sequence
  Eukaryotic translation initiation factor 3 subunit H (211-221)
LMWELEKKSAV

SEQ ID NO: 18000 - protein, 9 aa, Artificial Sequence
  CTP synthase 2 (334-342)
LMYIDSIDL

SEQ ID NO: 18001 - protein, 9 aa, Artificial Sequence
  Ubiquitin-like modifier-activating enzyme ATG7 (128-136)
LNKFLLLTF

SEQ ID NO: 18002 - protein, 10 aa, Artificial Sequence
  Carboxy-terminal domain RNA polymerase II polypeptide A small phosphatase 1 (54-63)
LPAHSGAPLL

SEQ ID NO: 18003 - protein, 9 aa, Artificial Sequence
  Neutrophil cytosol factor 4 (89-97)
LPAKVYVGV

SEQ ID NO: 18004 - protein, 9 aa, Artificial Sequence
  GPI transamidase component PIG-T (430-438)
LPANSVTKV

SEQ ID NO: 18005 - protein, 9 aa, Artificial Sequence
  Tyrosine-protein phosphatase non-receptor type 12 (677-685)
LPERTPESF

SEQ ID NO: 18006 - protein, 9 aa, Artificial Sequence
  Collagen alpha-2(IV) chain (385-393)
LPGPPGLSI

SEQ ID NO: 18007 - protein, 9 aa, Artificial Sequence
  DDB1- and CUL4-associated factor 13 (548-556)
LPKSIYSQI

SEQ ID NO: 18008 - protein, 9 aa, Artificial Sequence
  Interferon regulatory factor 2-binding protein-like (271-279)
LPPPPPHAL

SEQ ID NO: 18009 - protein, 9 aa, Artificial Sequence
  Neutral amino acid transporter A (142-150)
LPTHDLPLI

SEQ ID NO: 18010 - protein, 8 aa, Artificial Sequence
  General transcription factor 3C polypeptide 2 (665-672)
LPYNGVTV

SEQ ID NO: 18011 - protein, 9 aa, Artificial Sequence
  Signal peptidase complex catalytic subunit SEC11C (158-166)
LPYVGMVTI

SEQ ID NO: 18012 - protein, 9 aa, Artificial Sequence
  WD repeat-containing protein 34 (423-431)
LQAPPLTSL

SEQ ID NO: 18013 - protein, 9 aa, Artificial Sequence
  Protein unc-13 homolog C (117-125)
LQELSSIES

SEQ ID NO: 18014 - protein, 9 aa, Artificial Sequence
  TBC1 domain family member 4 (1186-1194)
LQESSYSCE

SEQ ID NO: 18015 - protein, 10 aa, Artificial Sequence
  WD repeat-containing protein 82 (288-297)
LQFNPKFMTF

SEQ ID NO: 18016 - protein, 11 aa, Artificial Sequence
  Serine/threonine-protein kinase RIO2 (521-531)
LQKGEANIFTK

SEQ ID NO: 18017 - protein, 10 aa, Artificial Sequence
  WAS protein family homolog 1 (40-49)
LQKVSGDIFS

SEQ ID NO: 18018 - protein, 9 aa, Artificial Sequence
  Tubulin beta chain (42-50)
LQLDRISVY

SEQ ID NO: 18019 - protein, 9 aa, Artificial Sequence
  Tubulin beta-4B chain (42-50)
LQLERINVY

SEQ ID NO: 18020 - protein, 9 aa, Artificial Sequence
  Acyl-coenzyme A synthetase ACSM5, mitochondrial (112-120)
LQPGDRMML

SEQ ID NO: 18021 - protein, 9 aa, Artificial Sequence
  GPI transamidase component PIG-T (58-66)
LQREGVSHY

SEQ ID NO: 18022 - protein, 9 aa, Artificial Sequence
  Splicing factor 1 (254-262)
LREDDNRIL

SEQ ID NO: 18023 - protein, 9 aa, Artificial Sequence
  FH1/FH2 domain-containing protein 1 (1156-1164)
LSKGPGLEV

SEQ ID NO: 18024 - protein, 10 aa, Artificial Sequence
  Phosphatidylethanolamine-binding protein 1 (5-14)
LSKWSGPLSL

SEQ ID NO: 18025 - protein, 8 aa, Artificial Sequence
  FYVE, RhoGEF and PH domain-containing protein 5 (524-531)
LSLEGKPL

SEQ ID NO: 18026 - protein, 9 aa, Artificial Sequence
  Cilia- and flagella-associated protein 54 (689-697)
LSMLKSMLL

SEQ ID NO: 18027 - protein, 9 aa, Artificial Sequence
  Alpha-ketoglutarate-dependent dioxygenase alkB homolog 7, mitochondrial (104-112)
LSSVHVLDL

SEQ ID NO: 18028 - protein, 9 aa, Artificial Sequence
  WD repeat-containing protein 7 (683-691)
LTDPDIHVL

SEQ ID NO: 18029 - protein, 9 aa, Artificial Sequence
  Transcription factor SOX-30 (235-243)
LVHGSAEVI

SEQ ID NO: 18030 - protein, 9 aa, Artificial Sequence
  60S ribosomal protein L32 (7-15)
LVKPKIVKK

SEQ ID NO: 18031 - protein, 9 aa, Artificial Sequence
  Probable ATP-dependent RNA helicase DDX41 (390-398)
LVKPVTINV

SEQ ID NO: 18032 - protein, 9 aa, Artificial Sequence
  Cationic amino acid transporter 3 (165-173)
LVLIVGFTF

SEQ ID NO: 18033 - protein, 9 aa, Artificial Sequence
  Mitogen-activated protein kinase kinase kinase 10 (901-909)
LVSFGRTLT

SEQ ID NO: 18034 - protein, 9 aa, Artificial Sequence
  Glypican-4 (385-393)
LVTDVKEKL

SEQ ID NO: 18035 - protein, 9 aa, Artificial Sequence
  Transmembrane protein with metallophosphoesterase domain (414-422)
LYQVAQATF

SEQ ID NO: 18036 - protein, 9 aa, Artificial Sequence
  Transcription factor SOX-6 (312-320)
MAAAAASGL

SEQ ID NO: 18037 - protein, 9 aa, Artificial Sequence
  28S ribosomal protein S14, mitochondrial (1-9)
MAAFMLGSL

SEQ ID NO: 18038 - protein, 9 aa, Artificial Sequence
  Steroid 21-hydroxylase (283-291)
MAAVDLLIG

SEQ ID NO: 18039 - protein, 9 aa, Artificial Sequence
  XK-related protein 5 (595-603)
MADISPILG

SEQ ID NO: 18040 - protein, 8 aa, Artificial Sequence
  Histone-binding protein RBBP4 (1-8)
MADKEAAF

SEQ ID NO: 18041 - protein, 9 aa, Artificial Sequence
  N-acetylated-alpha-linked acidic dipeptidase 2 (1-9)
MAESRGRLY

SEQ ID NO: 18042 - protein, 9 aa, Artificial Sequence
  Mucin-17 (161-169)
MAFVSTAPL

SEQ ID NO: 18043 - protein, 9 aa, Artificial Sequence
  Butyrophilin-like protein 8 (1-9)
MALMLSLVL

SEQ ID NO: 18044 - protein, 10 aa, Artificial Sequence
  Zinc finger protein 28 (1-10)
MALPQGLLTF

SEQ ID NO: 18045 - protein, 10 aa, Artificial Sequence
  Major facilitator superfamily domain-containing protein 9 (295-304)
MAMAVMLYYS

SEQ ID NO: 18046 - protein, 9 aa, Artificial Sequence
  Splicing factor 3A subunit 1 (775-783)
MANGAVIHL

SEQ ID NO: 18047 - protein, 9 aa, Artificial Sequence
  Small nuclear ribonucleoprotein-associated protein N (189-197)
MAPPPGMRP

SEQ ID NO: 18048 - protein, 8 aa, Artificial Sequence
  HLA class I histocompatibility antigen, Cw-7 alpha chain (4-11)
MAPRALLL

SEQ ID NO: 18049 - protein, 9 aa, Artificial Sequence
  Coiled-coil domain-containing protein 42A (261-269)
MATLNLFQI

SEQ ID NO: 18050 - protein, 9 aa, Artificial Sequence
  Frizzled-4 (474-482)
MAVEMLKIF

SEQ ID NO: 18051 - protein, 9 aa, Artificial Sequence
  Interferon alpha-inducible protein 6 (45-53)
MAVGGGLAV

SEQ ID NO: 18052 - protein, 11 aa, Artificial Sequence
  Thyroid adenoma-associated protein (70-80)
MCDPTIQSCLD

SEQ ID NO: 18053 - protein, 9 aa, Artificial Sequence
  Putative tripartite motif-containing protein 49B (236-244)
MCHKPDVEL

SEQ ID NO: 18054 - protein, 9 aa, Artificial Sequence
  C-C chemokine receptor type 9 (118-126)
MCKVVNSMY

SEQ ID NO: 18055 - protein, 9 aa, Artificial Sequence
  Centrosomal protein of 72 kDa (190-198)
MDADDEAVL

SEQ ID NO: 18056 - protein, 10 aa, Artificial Sequence
  Rho guanine nucleotide exchange factor 12 (1356-1365)
MDHMIMTPEM

SEQ ID NO: 18057 - protein, 9 aa, Artificial Sequence
  Adenosine receptor A2b (219-227)
MDHSRTTLQ

SEQ ID NO: 18058 - protein, 9 aa, Artificial Sequence
  Protein CREG1 (164-172)
MDIAKHSLF

SEQ ID NO: 18059 - protein, 9 aa, Artificial Sequence
  P2X purinoceptor 7 (140-148)
MDPQSKGIQ

SEQ ID NO: 18060 - protein, 10 aa, Artificial Sequence
  40S ribosomal protein S28 (1-10)
MDTSRVQPIK

SEQ ID NO: 18061 - protein, 9 aa, Artificial Sequence
  F-box only protein 44 (151-159)
MDTTRPDIE

SEQ ID NO: 18062 - protein, 12 aa, Artificial Sequence
  BEN domain-containing protein 7 (1-12)
MEFSERKRSRKS

SEQ ID NO: 18063 - protein, 10 aa, Artificial Sequence
  Rho guanine nucleotide exchange factor 11 (1442-1451)
MELAHRELLK

SEQ ID NO: 18064 - protein, 12 aa, Artificial Sequence
  Nitric oxide synthase, endothelial (1137-1148)
MELDEAGDVIGV

SEQ ID NO: 18065 - protein, 8 aa, Artificial Sequence
  Pseudouridylate synthase 7 homolog (1-8)
MEMTEMTG

SEQ ID NO: 18066 - protein, 9 aa, Artificial Sequence
  Lethal(3)malignant brain tumor-like protein 3 (52-60)
MENVKKATA

SEQ ID NO: 18067 - protein, 12 aa, Artificial Sequence
  Heme oxygenase 1 (1-12)
MERPQPDSMPQD

SEQ ID NO: 18068 - protein, 9 aa, Artificial Sequence
  Metalloreductase STEAP2 (1-9)
MESISMMGS

SEQ ID NO: 18069 - protein, 9 aa, Artificial Sequence
  CD97 antigen (1-9)
MGGRVFLAF

SEQ ID NO: 18070 - protein, 10 aa, Artificial Sequence
  Putative uncharacterized protein ENSP00000381562 (1-10)
MGSIPSKPCN

SEQ ID NO: 18071 - protein, 9 aa, Artificial Sequence
  Ubiquitin carboxyl-terminal hydrolase isozyme L3 (111-119)
MHFESGSTL

SEQ ID NO: 18072 - protein, 9 aa, Artificial Sequence
  Complex I assembly factor TMEM126B, mitochondrial (35-43)
MHGQPSPSL

SEQ ID NO: 18073 - protein, 9 aa, Artificial Sequence
  Transmembrane protein 114 (102-110)
MHGTFVILL

SEQ ID NO: 18074 - protein, 10 aa, Artificial Sequence
  Leucine-twenty homeobox (1-10)
MHPSLATMGK

SEQ ID NO: 18075 - protein, 9 aa, Artificial Sequence
  Protein Tob1 (226-234)
MHSLYGLGL

SEQ ID NO: 18076 - protein, 9 aa, Artificial Sequence
  Deoxyribonuclease-1-like 1 (1-9)
MHYPTALLF

SEQ ID NO: 18077 - protein, 9 aa, Artificial Sequence
  Neuronal acetylcholine receptor subunit alpha-4 (314-322)
MIFVTLSIV

SEQ ID NO: 18078 - protein, 9 aa, Artificial Sequence
  Eukaryotic translation initiation factor 3 subunit L (359-367)
MINKQNEQM

SEQ ID NO: 18079 - protein, 10 aa, Artificial Sequence
  Lysosomal protective protein (1-10)
MIRAAPPPLF

SEQ ID NO: 18080 - protein, 10 aa, Artificial Sequence
  60S ribosomal protein L18a (1-10)
MKASGTLREY

SEQ ID NO: 18081 - protein, 9 aa, Artificial Sequence
  Lymphocyte antigen 86 (1-9)
MKGFTATLF

SEQ ID NO: 18082 - protein, 9 aa, Artificial Sequence
  Sodium-coupled neutral amino acid transporter 5 (188-196)
MKHLGYLGY

SEQ ID NO: 18083 - protein, 9 aa, Artificial Sequence
  Neurexin-3 (694-702)
MKIIMPMVM

SEQ ID NO: 18084 - protein, 9 aa, Artificial Sequence
  Dentin matrix acidic phosphoprotein 1 (1-9)
MKISILLMF

SEQ ID NO: 18085 - protein, 9 aa, Artificial Sequence
  Sarcoplasmic/endoplasmic reticulum calcium ATPase 2 (479-487)
MKKEFTLEF

SEQ ID NO: 18086 - protein, 10 aa, Artificial Sequence
  60S ribosomal protein L18a (54-63)
MKKSSGEIVY

SEQ ID NO: 18087 - protein, 9 aa, Artificial Sequence
  Lysine-tRNA ligase (406-414)
MKLPETNLF

SEQ ID NO: 18088 - protein, 10 aa, Artificial Sequence
  Glucose-fructose oxidoreductase domain-containing protein 2 (1-10)
MKMLPGVGVF

SEQ ID NO: 18089 - protein, 9 aa, Artificial Sequence
  Striatin-interacting protein 1 (733-741)
MKTMSAIYQ

SEQ ID NO: 18090 - protein, 9 aa, Artificial Sequence
  Zinc finger protein 425 (38-46)
MKTNYETLD

SEQ ID NO: 18091 - protein, 9 aa, Artificial Sequence
  Peptidyl-prolyl cis-trans isomerase B (9-17)
MKVLLAAAL

SEQ ID NO: 18092 - protein, 9 aa, Artificial Sequence
  Protein tyrosine phosphatase type IVA 1 (124-132)
MKYEDAVQF

SEQ ID NO: 18093 - protein, 11 aa, Artificial Sequence
  Transmembrane protein 50A (102-112)
MLAFGSLIASM

SEQ ID NO: 18094 - protein, 11 aa, Artificial Sequence
  Inactive phospholipase C-like protein 1 (259-269)
MLEDTSVELIK

SEQ ID NO: 18095 - protein, 10 aa, Artificial Sequence
  Tyrosine-protein phosphatase non-receptor type 2 (134-143)
MLFKETGFSV

SEQ ID NO: 18096 - protein, 12 aa, Artificial Sequence
  SPARC-related modular calcium-binding protein 1 (1-12)
MLPARCARLLTP

SEQ ID NO: 18097 - protein, 9 aa, Artificial Sequence
  E3 ubiquitin-protein ligase TRIM22 (248-256)
MLQDVIDVM

SEQ ID NO: 18098 - protein, 9 aa, Artificial Sequence
  Condensin complex subunit 1 (56-64)
MLQHFDTIY

SEQ ID NO: 18099 - protein, 9 aa, Artificial Sequence
  Fibronectin (1-9)
MLRGPGPGL

SEQ ID NO: 18100 - protein, 9 aa, Artificial Sequence
  Protein S100-A8 (1-9)
MLTELEKAL

SEQ ID NO: 18101 - protein, 10 aa, Artificial Sequence
  NACHT, LRR and PYD domains-containing protein 4 (169-178)
MMAWSDNKIF

SEQ ID NO: 18102 - protein, 9 aa, Artificial Sequence
  Eukaryotic translation initiation factor 4 gamma 1 (88-96)
MMIPSQISY

SEQ ID NO: 18103 - protein, 9 aa, Artificial Sequence
  Olfactory receptor 4K1 (112-120)
MMLLVAMAY

SEQ ID NO: 18104 - protein, 10 aa, Artificial Sequence
  BUB3-interacting and GLEBS motif-containing protein ZNF207 (185-194)
MMPMGGMMPP

SEQ ID NO: 18105 - protein, 8 aa, Artificial Sequence
  C-myc promoter-binding protein (618-625)
MMTKTQMF

SEQ ID NO: 18106 - protein, 8 aa, Artificial Sequence
  Protein SSX4 (1-8)
MNGDDAFA

SEQ ID NO: 18107 - protein, 8 aa, Artificial Sequence
  Putative uncharacterized protein ENSP00000383407 (1-8)
MNLFCISL

SEQ ID NO: 18108 - protein, 11 aa, Artificial Sequence
  Coiled-coil domain-containing protein 127 (1-11)
MNNLNDPPNWN

SEQ ID NO: 18109 - protein, 9 aa, Artificial Sequence
  General transcription factor IIF subunit 1 (417-425)
MPAAKRLRL

SEQ ID NO: 18110 - protein, 9 aa, Artificial Sequence
  Actin-related protein 2/3 complex subunit 3 (1-9)
MPAYHSSLM

SEQ ID NO: 18111 - protein, 9 aa, Artificial Sequence
  Kelch domain-containing protein 10 (360-368)
MPEPVYFHC

SEQ ID NO: 18112 - protein, 10 aa, Artificial Sequence
  von Willebrand factor A domain-containing protein 5B2 (1-10)
MPGLYCPSSW

SEQ ID NO: 18113 - protein, 9 aa, Artificial Sequence
  Acid ceramidase (1-9)
MPGRSCVAL

SEQ ID NO: 18114 - protein, 8 aa, Artificial Sequence
  Eukaryotic translation initiation factor 2 subunit 1 (223-230)
MPIKINLI

SEQ ID NO: 18115 - protein, 12 aa, Artificial Sequence
  Cytochrome c oxidase subunit 8C, mitochondrial (1-12)
MPLLRGRCPARR

SEQ ID NO: 18116 - protein, 12 aa, Artificial Sequence
  Retrotransposon gag domain-containing protein 1 (964-975)
MPLMSAMASGEM

SEQ ID NO: 18117 - protein, 12 aa, Artificial Sequence
  BUB3-interacting and GLEBS motif-containing protein ZNF207 (181-192)
MPPGMMPMGGMM

SEQ ID NO: 18118 - protein, 9 aa, Artificial Sequence
  Pre-mRNA-processing-splicing factor 8 (108-116)
MPWEQIRDV

SEQ ID NO: 18119 - protein, 9 aa, Artificial Sequence
  Protein diaphanous homolog 2 (733-741)
MPYEDIRNV

SEQ ID NO: 18120 - protein, 9 aa, Artificial Sequence
  Nuclear receptor coactivator 2 (1151-1159)
MQDPNFHTM

SEQ ID NO: 18121 - protein, 9 aa, Artificial Sequence
  Heterogeneous nuclear ribonucleoprotein H (352-360)
MQHRYVELF

SEQ ID NO: 18122 - protein, 9 aa, Artificial Sequence
  Myosin-7 (77-85)
MQQNPPKFD

SEQ ID NO: 18123 - protein, 9 aa, Artificial Sequence
  Laminin subunit alpha-2 (1349-1357)
MRQSRISEI

SEQ ID NO: 18124 - protein, 10 aa, Artificial Sequence
  Toll-like receptor 3 (1-10)
MRQTLPCIYF

SEQ ID NO: 18125 - protein, 8 aa, Artificial Sequence
  Transmembrane channel-like protein 2 (170-177)
MRSKPWPM

SEQ ID NO: 18126 - protein, 9 aa, Artificial Sequence
  Clathrin coat assembly protein AP180 (156-164)
MRTMAPEKL

SEQ ID NO: 18127 - protein, 9 aa, Artificial Sequence
  Glucose-6-phosphate translocase (266-274)
MSALEVGGL

SEQ ID NO: 18128 - protein, 8 aa, Artificial Sequence
  RING finger protein 148 (1-8)
MSFLRITP

SEQ ID NO: 18129 - protein, 9 aa, Artificial Sequence
  Nesprin-1 (4697-4705)
MSKVPTDLA

SEQ ID NO: 18130 - protein, 8 aa, Artificial Sequence
  Zinc finger protein ZFPM2 (1-8)
MSRRKQSK

SEQ ID NO: 18131 - protein, 9 aa, Artificial Sequence
  Cerebral dopamine neurotrophic factor (103-111)
MSVHMPAMK

SEQ ID NO: 18132 - protein, 9 aa, Artificial Sequence
  Heat shock protein 105 kDa (1-9)
MSVVGLDVG

SEQ ID NO: 18133 - protein, 9 aa, Artificial Sequence
  Solute carrier family 35 member E2B (144-152)
MTMLFVGLM

SEQ ID NO: 18134 - protein, 9 aa, Artificial Sequence
  Integrin beta-7 (1-9)
MVALPMVLV

SEQ ID NO: 18135 - protein, 10 aa, Artificial Sequence
  Testis- and ovary-specific PAZ domain-containing protein 1 (583-592)
MVIKEPIIKD

SEQ ID NO: 18136 - protein, 8 aa, Artificial Sequence
  Transmembrane and coiled-coil domain-containing protein 1 (85-92)
MVRMKSMF

SEQ ID NO: 18137 - protein, 8 aa, Artificial Sequence
  Vomeronasal type-1 receptor 3 (279-286)
MVSPFVLM

SEQ ID NO: 18138 - protein, 9 aa, Artificial Sequence
  Receptor expression-enhancing protein 2 (1-9)
MVSWIISRL

SEQ ID NO: 18139 - protein, 9 aa, Artificial Sequence
  Secretogranin-1 (32-40)
MVTRCIIEV

SEQ ID NO: 18140 - protein, 10 aa, Artificial Sequence
  Protocadherin-19 (125-134)
NAPSFPAAQI

SEQ ID NO: 18141 - protein, 9 aa, Artificial Sequence
  Exportin-6 (750-758)
NHASLISAL

SEQ ID NO: 18142 - protein, 9 aa, Artificial Sequence
  Olfactomedin-like protein 2B (387-395)
NHASVGPTL

SEQ ID NO: 18143 - protein, 9 aa, Artificial Sequence
  Serine-protein kinase ATM (1801-1809)
NHDIWIKTL

SEQ ID NO: 18144 - protein, 12 aa, Artificial Sequence
  Histone-binding protein RBBP4 (122-133)
NHEGEVNRARYM

SEQ ID NO: 18145 - protein, 9 aa, Artificial Sequence
  WD repeat-containing protein 6 (772-780)
NHISSVRAV

SEQ ID NO: 18146 - protein, 9 aa, Artificial Sequence
  Integrator complex subunit 3 (462-470)
NHIVEKRVL

SEQ ID NO: 18147 - protein, 9 aa, Artificial Sequence
  Protein RMD5 homolog A (226-234)
NHQKDIQVL

SEQ ID NO: 18148 - protein, 9 aa, Artificial Sequence
  Protein dopey-2 (223-231)
NHQLTVKSL

SEQ ID NO: 18149 - protein, 9 aa, Artificial Sequence
  Protein FAM193A (991-999)
NHSEPRPGL

SEQ ID NO: 18150 - protein, 9 aa, Artificial Sequence
  Myb-binding protein 1A (554-562)
NHSHNVTTV

SEQ ID NO: 18151 - protein, 9 aa, Artificial Sequence
  E3 ubiquitin-protein ligase RNF19A (822-830)
NHSHQTMEL

SEQ ID NO: 18152 - protein, 11 aa, Artificial Sequence
  Vesicle transport protein SFT2B (73-83)
NIASIGSTIFL

SEQ ID NO: 18153 - protein, 9 aa, Artificial Sequence
  Bardet-Biedl syndrome 4 protein (82-90)
NIQESLELF

SEQ ID NO: 18154 - protein, 9 aa, Artificial Sequence
  V-type proton ATPase 116 kDa subunit a isoform 3 (810-818)
NKFYSGTGY

SEQ ID NO: 18155 - protein, 9 aa, Artificial Sequence
  WD repeat-containing protein 82 (83-91)
NKIDDTIRY

SEQ ID NO: 18156 - protein, 9 aa, Artificial Sequence
  C-X-C chemokine receptor type 4 (37-45)
NKIFLPTIY

SEQ ID NO: 18157 - protein, 12 aa, Artificial Sequence
  Sialic acid-binding Ig-like lectin 9 (225-236)
NKTVHLNVSYPP

SEQ ID NO: 18158 - protein, 9 aa, Artificial Sequence
  Zinc finger and BTB domain-containing protein 38 (494-502)
NKVFALAEY

SEQ ID NO: 18159 - protein, 9 aa, Artificial Sequence
  Probable ubiquitin carboxyl-terminal hydrolase FAF-X (359-367)
NKVISSVSY

SEQ ID NO: 18160 - protein, 9 aa, Artificial Sequence
  Monocarboxylate transporter 1 (81-89)
NKYGSRIVM

SEQ ID NO: 18161 - protein, 9 aa, Artificial Sequence
  Bifunctional glutamate/proline-tRNA ligase (369-377)
NKYNVYPTY

SEQ ID NO: 18162 - protein, 11 aa, Artificial Sequence
  60S ribosomal protein L7 (146-156)
NLKSVNELIYK

SEQ ID NO: 18163 - protein, 9 aa, Artificial Sequence
  Protein MMS22-like (862-870)
NLSEVKSIF

SEQ ID NO: 18164 - protein, 10 aa, Artificial Sequence
  Leucine-rich repeat and calponin homology domain-containing protein 2 (140-149)
NLYHNCIKTI

SEQ ID NO: 18165 - protein, 9 aa, Artificial Sequence
  Lysine-specific histone demethylase 1A (492-500)
NLYKAPILL

SEQ ID NO: 18166 - protein, 8 aa, Artificial Sequence
  Dynein regulatory complex protein 1 (2-9)
NPPGSLEA

SEQ ID NO: 18167 - protein, 9 aa, Artificial Sequence
  F-box only protein 8 (11-19)
NQQLQQEGY

SEQ ID NO: 18168 - protein, 9 aa, Artificial Sequence
  Serine/arginine repetitive matrix protein 2 (1399-1407)
NQSISSPVL

SEQ ID NO: 18169 - protein, 9 aa, Artificial Sequence
  COP9 signalosome complex subunit 2 (34-42)
NQYYNSKAL

SEQ ID NO: 18170 - protein, 10 aa, Artificial Sequence
  Gamma-aminobutyric acid receptor subunit delta (246-255)
NRGVYIIQSY

SEQ ID NO: 18171 - protein, 11 aa, Artificial Sequence
  Anaphase-promoting complex subunit CDC26 (75-85)
NRSSQFGSLEF

SEQ ID NO: 18172 - protein, 9 aa, Artificial Sequence
  Ubiquitin-like modifier-activating enzyme 1 (449-457)
NRYDGQVAV

SEQ ID NO: 18173 - protein, 9 aa, Artificial Sequence
  Small G protein signaling modulator 3 (329-337)
NSASIFNTL

SEQ ID NO: 18174 - protein, 8 aa, Artificial Sequence
  Nuclear transcription factor Y subunit alpha (232-239)
NSGGMVMM

SEQ ID NO: 18175 - protein, 9 aa, Artificial Sequence
  Unconventional myosin-XV (3472-3480)
NSSYPYVEI

SEQ ID NO: 18176 - protein, 9 aa, Artificial Sequence
  Junction plakoglobin (584-592)
NTIPLFVQL

SEQ ID NO: 18177 - protein, 9 aa, Artificial Sequence
  Olfactory receptor 5D18 (7-15)
NTSGTTFTL

SEQ ID NO: 18178 - protein, 9 aa, Artificial Sequence
  Kinetochore protein Nuf2 (10-18)
NVAEIVIHI

SEQ ID NO: 18179 - protein, 10 aa, Artificial Sequence
  Sodium- and chloride-dependentine transporter 2 (288-297)
NVIICYTLFY

SEQ ID NO: 18180 - protein, 12 aa, Artificial Sequence
  Alpha-enolase (118-129)
NVINGGSHAGNK

SEQ ID NO: 18181 - protein, 9 aa, Artificial Sequence
  Clustered mitochondria protein homolog (96-104)
NVLDHFSEL

SEQ ID NO: 18182 - protein, 10 aa, Artificial Sequence
  Myosin regulatory light chain 12B (155-164)
NYIEFTRILK

SEQ ID NO: 18183 - protein, 8 aa, Artificial Sequence
  Protein LYRIC (498-505)
PAEVLVKN

SEQ ID NO: 18184 - protein, 10 aa, Artificial Sequence
  Peroxiredoxin-4 (260-269)
PAGKLKYFDK

SEQ ID NO: 18185 - protein, 9 aa, Artificial Sequence
  Leucine-rich repeat-containing protein 26 (63-71)
PAVPPGLSL

SEQ ID NO: 18186 - protein, 9 aa, Artificial Sequence
  StAR-related lipid transfer protein 13 (243-251)
PFHPKNEKP

SEQ ID NO: 18187 - protein, 10 aa, Artificial Sequence
  Dystrophia myotonica WD repeat-containing protein (517-526)
PFSIGRFATL

SEQ ID NO: 18188 - protein, 10 aa, Artificial Sequence
  B-lymphocyte antigen CD19 (99-108)
PGPPSEKAWQ

SEQ ID NO: 18189 - protein, 9 aa, Artificial Sequence
  Zinc finger protein 853 (438-446)
PGYVVVQEL

SEQ ID NO: 18190 - protein, 12 aa, Artificial Sequence
  DNA replication licensing factor MCM6 (505-516)
PISGHYDRSKSL

SEQ ID NO: 18191 - protein, 10 aa, Artificial Sequence
  UPF0428 protein CXorf56 (2-11)
PKVVSRSVVC

SEQ ID NO: 18192 - protein, 9 aa, Artificial Sequence
  Integrin beta-6 (709-717)
PMIMLGVSL

SEQ ID NO: 18193 - protein, 10 aa, Artificial Sequence
  AF4/FMR2 family member 2 (271-280)
PPGLYCKTSM

SEQ ID NO: 18194 - protein, 9 aa, Artificial Sequence
  Basic salivary proline-rich protein 4 (50-58)
PPPPPGKPQ

SEQ ID NO: 18195 - protein, 9 aa, Artificial Sequence
  RAS guanyl-releasing protein 2 (400-408)
PPPRPPVLE

SEQ ID NO: 18196 - protein, 9 aa, Artificial Sequence
  Coiled-coil domain-containing protein 8 (89-97)
PPRLVVGTY

SEQ ID NO: 18197 - protein, 12 aa, Artificial Sequence
  RNA-binding protein FUS (344-355)
PPSAKAAIDWFD

SEQ ID NO: 18198 - protein, 8 aa, Artificial Sequence
  Cornulin (2-9)
PQLLQNIN

SEQ ID NO: 18199 - protein, 9 aa, Artificial Sequence
  Sialate O-acetylesterase (378-386)
PRDKQTVAY

SEQ ID NO: 18200 - protein, 9 aa, Artificial Sequence
  Metastasis-associated in colon cancer protein 1 (382-390)
PSFTVVLTV

SEQ ID NO: 18201 - protein, 11 aa, Artificial Sequence
  ATP synthase F(0) complex subunit B1, mitochondrial (43-53)
PVPPLPEYGGK

SEQ ID NO: 18202 - protein, 9 aa, Artificial Sequence
  MAP7 domain-containing protein 3 (645-653)
QAEDHLKLK

SEQ ID NO: 18203 - protein, 9 aa, Artificial Sequence
  26S proteasome non-ATPase regulatory subunit 12 (265-273)
QALKSVVLY

SEQ ID NO: 18204 - protein, 9 aa, Artificial Sequence
  Bromodomain-containing protein 8 (465-473)
QERDKPVPL

SEQ ID NO: 18205 - protein, 10 aa, Artificial Sequence
  Prolyl endopeptidase (268-277)
QESSGIAGIL

SEQ ID NO: 18206 - protein, 9 aa, Artificial Sequence
  Mitochondrial import inner membrane translocase subunit Tim17-B (140-148)
QFRNAPPFL

SEQ ID NO: 18207 - protein, 9 aa, Artificial Sequence
  60S acidic ribosomal protein P2 (57-65)
QGIGKLASV

SEQ ID NO: 18208 - protein, 11 aa, Artificial Sequence
  Salivary acidic proline-rich phosphoprotein 1/2 (82-92)
QGPPPPQGKPQ

SEQ ID NO: 18209 - protein, 9 aa, Artificial Sequence
  Protocadherin Fat 4 (557-565)
QGVHPKVSY

SEQ ID NO: 18210 - protein, 9 aa, Artificial Sequence
  Transmembrane protein 205 (75-83)
QHAWAQLTF

SEQ ID NO: 18211 - protein, 9 aa, Artificial Sequence
  MICOS complex subunit MIC10 (59-67)
QHDFQAPYL

SEQ ID NO: 18212 - protein, 8 aa, Artificial Sequence
  CX3C chemokine receptor 1 (144-151)
QHGVTISL

SEQ ID NO: 18213 - protein, 9 aa, Artificial Sequence
  60S ribosomal protein L8 (217-225)
QHIGKPSTI

SEQ ID NO: 18214 - protein, 9 aa, Artificial Sequence
  Inositol polyphosphate 5-phosphatase K (105-113)
QHLPYIQIL

SEQ ID NO: 18215 - protein, 9 aa, Artificial Sequence
  Torsin-3A (137-145)
QHLVQQLVL

SEQ ID NO: 18216 - protein, 11 aa, Artificial Sequence
  Forkhead box protein J3 (593-603)
QHMMPSQAFQM

SEQ ID NO: 18217 - protein, 9 aa, Artificial Sequence
  PAX-interacting protein 1 (506-514)
QHQLQQQQL

SEQ ID NO: 18218 - protein, 9 aa, Artificial Sequence
  Dual specificity tyrosine-phosphorylation-regulated kinase 1A (475-483)
QHSFFKKTA

SEQ ID NO: 18219 - protein, 9 aa, Artificial Sequence
  G protein-regulated inducer of neurite outgrowth 3 (749-757)
QHSVFQSML

SEQ ID NO: 18220 - protein, 9 aa, Artificial Sequence
  Histone-lysine N-methyltransferase 2E (207-215)
QHTPTSITL

SEQ ID NO: 18221 - protein, 9 aa, Artificial Sequence
  Class A basic helix-loop-helix protein 15 (151-159)
QHYQQQQQV

SEQ ID NO: 18222 - protein, 9 aa, Artificial Sequence
  Glutathione peroxidase 7 (62-70)
QHYRALQQL

SEQ ID NO: 18223 - protein, 9 aa, Artificial Sequence
  N-terminal EF-hand calcium-binding protein 2 (176-184)
QIQSLLSSV

SEQ ID NO: 18224 - protein, 10 aa, Artificial Sequence
  Ig heavy chain V-II region MCE (1-10)
QITLKESGPT

SEQ ID NO: 18225 - protein, 9 aa, Artificial Sequence
  CDGSH iron-sulfur domain-containing protein 3, mitochondrial (119-127)
QKAEVGSPL

SEQ ID NO: 18226 - protein, 9 aa, Artificial Sequence
  Splicing factor 3B subunit 3 (1087-1095)
QKAEVIMNY

SEQ ID NO: 18227 - protein, 9 aa, Artificial Sequence
  Apolipoprotein L6 (219-227)
QKAFAGTTL

SEQ ID NO: 18228 - protein, 10 aa, Artificial Sequence
  Synapsin-2 (317-326)
QKIGNNYKAY

SEQ ID NO: 18229 - protein, 9 aa, Artificial Sequence
  E3 ubiquitin-protein ligase DTX3L (683-691)
QKLIFTVGY

SEQ ID NO: 18230 - protein, 12 aa, Artificial Sequence
  Very-long-chain enoyl-CoA reductase (66-77)
QKLPVGTTATLY

SEQ ID NO: 18231 - protein, 9 aa, Artificial Sequence
  ATP-dependent DNA helicase Q1 (438-446)
QKLYEMVSY

SEQ ID NO: 18232 - protein, 10 aa, Artificial Sequence
  Melanoma inhibitory activity protein 3 (1518-1527)
QKVEILNELY

SEQ ID NO: 18233 - protein, 9 aa, Artificial Sequence
  Clathrin interactor 1 (130-138)
QKVKELVEF

SEQ ID NO: 18234 - protein, 9 aa, Artificial Sequence
  Cell growth-regulating nucleolar protein (56-64)
QKYGGKGYE

SEQ ID NO: 18235 - protein, 11 aa, Artificial Sequence
  Pre-mRNA-processing-splicing factor 8 (573-583)
QLADGLQYIFA

SEQ ID NO: 18236 - protein, 9 aa, Artificial Sequence
  Chloride transport protein 6 (651-659)
QLISNNIKF

SEQ ID NO: 18237 - protein, 9 aa, Artificial Sequence
  Probable helicase senataxin (307-315)
QLMDPIVAF

SEQ ID NO: 18238 - protein, 9 aa, Artificial Sequence
  BRCA1-associated protein (505-513)
QNKLKEEER

SEQ ID NO: 18239 - protein, 9 aa, Artificial Sequence
  dCTP pyrophosphatase 1 (52-60)
QPRNLLLAL

SEQ ID NO: 18240 - protein, 9 aa, Artificial Sequence
  E3 ubiquitin-protein ligase TRIM37 (638-646)
QPRPPASLL

SEQ ID NO: 18241 - protein, 12 aa, Artificial Sequence
  Salivary acidic proline-rich phosphoprotein 1/2 (81-92)
QQGPPPPQGKPQ

SEQ ID NO: 18242 - protein, 9 aa, Artificial Sequence
  GTP-binding protein 1 (587-595)
QQIKMQSTK

SEQ ID NO: 18243 - protein, 9 aa, Artificial Sequence
  Titin (1700-1708)
QQKPFFKKK

SEQ ID NO: 18244 - protein, 9 aa, Artificial Sequence
  Histamine H1 receptor (130-138)
QQPLRYLKY

SEQ ID NO: 18245 - protein, 9 aa, Artificial Sequence
  5-oxoprolinase (164-172)
QQPVDLGAL

SEQ ID NO: 18246 - protein, 9 aa, Artificial Sequence
  Protein sel-1 homolog 3 (692-700)
QQRLAQMLF

SEQ ID NO: 18247 - protein, 9 aa, Artificial Sequence
  60S ribosomal protein L3 (203-211)
QQVPVNQVF

SEQ ID NO: 18248 - protein, 9 aa, Artificial Sequence
  Pyruvate dehydrogenase protein X component, mitochondrial (463-471)
QRQLITVTM

SEQ ID NO: 18249 - protein, 9 aa, Artificial Sequence
  E3 ubiquitin-protein ligase RBBP6 (887-895)
QSHRSRNIG

SEQ ID NO: 18250 - protein, 9 aa, Artificial Sequence
  Mismatch repair endonuclease PMS2 (237-245)
QSLIPFVQL

SEQ ID NO: 18251 - protein, 9 aa, Artificial Sequence
  Myosin-7 (419-427)
QVIYATGAL

SEQ ID NO: 18252 - protein, 10 aa, Artificial Sequence
  CD160 antigen (101-110)
QVTPLHSGTY

SEQ ID NO: 18253 - protein, 9 aa, Artificial Sequence
  tRNA (adenine(58)-N(1))-methyltransferase non-catalytic subunit TRM6 (198-206)
RAGNKMIVM

SEQ ID NO: 18254 - protein, 9 aa, Artificial Sequence
  Nucleolar GTP-binding protein 2 (400-408)
RAKPEYISK

SEQ ID NO: 18255 - protein, 10 aa, Artificial Sequence
  Solute carrier family 15 member 3 (102-111)
RAVALSLLLY

SEQ ID NO: 18256 - protein, 9 aa, Artificial Sequence
  tRNA dimethylallyltransferase, mitochondrial (8-16)
RAVPVGSGL

SEQ ID NO: 18257 - protein, 10 aa, Artificial Sequence
  Translocating chain-associated membrane protein 1 (154-163)
RAYPHNLMTF

SEQ ID NO: 18258 - protein, 11 aa, Artificial Sequence
  Phosphoribosyl pyrophosphate synthase-associated protein 1 (68-78)
RDVNTAVMELL

SEQ ID NO: 18259 - protein, 9 aa, Artificial Sequence
  Voltage-dependent L-type calcium channel subunit alpha-1D (1825-1833)
REDPEIHGY

SEQ ID NO: 18260 - protein, 10 aa, Artificial Sequence
  Inner nuclear membrane protein Man1 (459-468)
REEVSPTGSF

SEQ ID NO: 18261 - protein, 9 aa, Artificial Sequence
  Gamma-glutamyltranspeptidase 1 (107-115)
REVAPRLAF

SEQ ID NO: 18262 - protein, 9 aa, Artificial Sequence
  Ras-related protein Rab-30 (70-78)
RFRSITQSY

SEQ ID NO: 18263 - protein, 9 aa, Artificial Sequence
  UHRF1-binding protein 1-like (15-23)
RFTKNLSPD

SEQ ID NO: 18264 - protein, 9 aa, Artificial Sequence
  DNA-directed RNA polymerase I subunit RPA2 (766-774)
RGFAHGSVY

SEQ ID NO: 18265 - protein, 11 aa, Artificial Sequence
  Endothelial differentiation-related factor 1 (133-143)
RGKDIGKPIEK

SEQ ID NO: 18266 - protein, 9 aa, Artificial Sequence
  NADH dehydrogenase (ubiquinone) iron-sulfur protein 2, mitochondrial (118-126)
RGTEKLIEY

SEQ ID NO: 18267 - protein, 9 aa, Artificial Sequence
  Membrane-associated tyrosine- and threonine-specific cdc2-inhibitory kinase (33-41)
RHAEPGFSL

SEQ ID NO: 18268 - protein, 9 aa, Artificial Sequence
  Colorectal mutant cancer protein (800-808)
RHETQVRML

SEQ ID NO: 18269 - protein, 10 aa, Artificial Sequence
  Beta-1,4-galactosyltransferase 6 (247-256)
RHFAAKLDKY

SEQ ID NO: 18270 - protein, 9 aa, Artificial Sequence
  Exophilin-5 (1818-1826)
RHFSESTSI

SEQ ID NO: 18271 - protein, 9 aa, Artificial Sequence
  PDZ domain-containing protein GIPC1 (190-198)
RHYEVARLL

SEQ ID NO: 18272 - protein, 10 aa, Artificial Sequence
  26S proteasome non-ATPase regulatory subunit 14 (198-207)
RHYYSITINY

SEQ ID NO: 18273 - protein, 9 aa, Artificial Sequence
  Ubiquitin carboxyl-terminal hydrolase 40 (780-788)
RIKAIKELK

SEQ ID NO: 18274 - protein, 10 aa, Artificial Sequence
  ADP-ribosylation factor-like protein 2-binding protein (84-93)
RIPEFNMAAF

SEQ ID NO: 18275 - protein, 9 aa, Artificial Sequence
  U5 small nuclear ribonucleoprotein 200 kDa helicase (234-242)
RIQSKLYRA

SEQ ID NO: 18276 - protein, 10 aa, Artificial Sequence
  60S ribosomal protein L4 (268-277)
RKAASLKSNY

SEQ ID NO: 18277 - protein, 9 aa, Artificial Sequence
  Selenoprotein H (8-16)
RKAEAAVVA

SEQ ID NO: 18278 - protein, 9 aa, Artificial Sequence
  Polyadenylate-binding protein 4 (374-382)
RKAHLTNQY

SEQ ID NO: 18279 - protein, 9 aa, Artificial Sequence
  Sterol regulatory element-binding protein 2 (371-379)
RKAIDYIKY

SEQ ID NO: 18280 - protein, 9 aa, Artificial Sequence
  DNA-directed RNA polymerase II subunit RPB1 (1375-1383)
RKALERELY

SEQ ID NO: 18281 - protein, 10 aa, Artificial Sequence
  Mid1-interacting protein 1 (163-172)
RKANILTNRY

SEQ ID NO: 18282 - protein, 11 aa, Artificial Sequence
  26S proteasome non-ATPase regulatory subunit 3 (314-324)
RKAPQHTAVGF

SEQ ID NO: 18283 - protein, 9 aa, Artificial Sequence
  60S ribosomal protein L23 (90-98)
RKDGVFLYF

SEQ ID NO: 18284 - protein, 9 aa, Artificial Sequence
  Eukaryotic translation initiation factor 5B (376-384)
RKEEERLEQ

SEQ ID NO: 18285 - protein, 9 aa, Artificial Sequence
  Uridine-cytidine kinase 2 (119-127)
RKEETVTVY

SEQ ID NO: 18286 - protein, 10 aa, Artificial Sequence
  Histone H2B type 1-K (34-43)
RKESYSVYVY

SEQ ID NO: 18287 - protein, 10 aa, Artificial Sequence
  MOB kinase activator 3A (20-29)
RKFEPGTQRF

SEQ ID NO: 18288 - protein, 9 aa, Artificial Sequence
  Group XV phospholipase A2 (296-304)
RKFFQDIGF

SEQ ID NO: 18289 - protein, 11 aa, Artificial Sequence
  General transcription factor II-I (878-888)
RKFGEAIGMGF

SEQ ID NO: 18290 - protein, 9 aa, Artificial Sequence
  Ribosome biogenesis protein TSR3 homolog (186-194)
RKFKWGKGF

SEQ ID NO: 18291 - protein, 11 aa, Artificial Sequence
  Elongation factor 1-gamma (51-61)
RKFPAGKVPAF

SEQ ID NO: 18292 - protein, 9 aa, Artificial Sequence
  Actin filament-associated protein 1-like 2 (481-489)
RKFSEPNTY

SEQ ID NO: 18293 - protein, 9 aa, Artificial Sequence
  Casein kinase I isoform delta (98-106)
RKFSLKTVL

SEQ ID NO: 18294 - protein, 9 aa, Artificial Sequence
  60S ribosomal protein L35 (70-78)
RKFYKGKKY

SEQ ID NO: 18295 - protein, 9 aa, Artificial Sequence
  Eukaryotic peptide chain release factor GTP-binding subunit ERF3B (315-323)
RKGEFETGF

SEQ ID NO: 18296 - protein, 10 aa, Artificial Sequence
  Cytochrome c oxidase subunit 5A, mitochondrial (71-80)
RKGINTLVTY

SEQ ID NO: 18297 - protein, 9 aa, Artificial Sequence
  Heat shock protein HSP 90-alpha (512-520)
RKHGLEVIY

SEQ ID NO: 18298 - protein, 10 aa, Artificial Sequence
  Nardilysin (545-554)
RKIEDNEFHY

SEQ ID NO: 18299 - protein, 10 aa, Artificial Sequence
  Lamin-B1 (473-482)
RKIGDTSVSY

SEQ ID NO: 18300 - protein, 9 aa, Artificial Sequence
  Mediator of RNA polymerase II transcription subunit 23 (123-131)
RKIIGGVDY

SEQ ID NO: 18301 - protein, 9 aa, Artificial Sequence
  Immunoglobulin superfamily member 10 (1201-1209)
RKIPWQQNF

SEQ ID NO: 18302 - protein, 9 aa, Artificial Sequence
  Ubiquitin carboxyl-terminal hydrolase 22 (420-428)
RKITTYVSF

SEQ ID NO: 18303 - protein, 9 aa, Artificial Sequence
  60S ribosomal protein L10 (38-46)
RKKAKVDEF

SEQ ID NO: 18304 - protein, 9 aa, Artificial Sequence
  Cytochrome c oxidase subunit 6C (45-53)
RKKAYADFY

SEQ ID NO: 18305 - protein, 9 aa, Artificial Sequence
  Protein ENL (20-28)
RKKPTTEGF

SEQ ID NO: 18306 - protein, 10 aa, Artificial Sequence
  60S ribosomal protein L15 (12-21)
RKKQSDVMRF

SEQ ID NO: 18307 - protein, 9 aa, Artificial Sequence
  Cytochrome c1, heme protein, mitochondrial (317-325)
RKLAYRPPK

SEQ ID NO: 18308 - protein, 11 aa, Artificial Sequence
  CD2 antigen cytoplasmic tail-binding protein 2 (320-330)
RKLDPPGGQFY

SEQ ID NO: 18309 - protein, 9 aa, Artificial Sequence
  Protein O-GlcNAcase (156-164)
RKLDQVSQF

SEQ ID NO: 18310 - protein, 9 aa, Artificial Sequence
  Neurabin-2 (179-187)
RKLDVVVRF

SEQ ID NO: 18311 - protein, 11 aa, Artificial Sequence
  Prohibitin (239-249)
RKLEAAEDIAY

SEQ ID NO: 18312 - protein, 9 aa, Artificial Sequence
  Thyroid transcription factor 1-associated protein 26 (59-67)
RKLKIQQSY

SEQ ID NO: 18313 - protein, 9 aa, Artificial Sequence
  Pre-mRNA-processing factor 19 (422-430)
RKLKNFKTL

SEQ ID NO: 18314 - protein, 9 aa, Artificial Sequence
  Toll-like receptor 9 (337-345)
RKLNLSFNY

SEQ ID NO: 18315 - protein, 10 aa, Artificial Sequence
  von Willebrand factor A domain-containing protein 9 (424-433)
RKLPEKTQTF

SEQ ID NO: 18316 - protein, 9 aa, Artificial Sequence
  UAP56-interacting factor (165-173)
RKNNIPANF

SEQ ID NO: 18317 - protein, 10 aa, Artificial Sequence
  Activating signal cointegrator 1 complex subunit 1 (17-26)
RKNPVQEQTY

SEQ ID NO: 18318 - protein, 9 aa, Artificial Sequence
  5'-AMP-activated protein kinase catalytic subunit alpha-1 (447-455)
RKNPVTSTY

SEQ ID NO: 18319 - protein, 10 aa, Artificial Sequence
  Nuclear pore complex protein Nup98-Nup96 (1206-1215)
RKPDEDMKLY

SEQ ID NO: 18320 - protein, 10 aa, Artificial Sequence
  Ubiquitin carboxyl-terminal hydrolase 47 (700-709)
RKPDQVFQSY

SEQ ID NO: 18321 - protein, 9 aa, Artificial Sequence
  Transcriptional regulator ATRX (81-89)
RKPSIVTKY

SEQ ID NO: 18322 - protein, 9 aa, Artificial Sequence
  Bifunctional polynucleotide phosphatase/kinase (483-491)
RKQFEAPTL

SEQ ID NO: 18323 - protein, 9 aa, Artificial Sequence
  DNA-dependent protein kinase catalytic subunit (70-78)
RKSLNSIEF

SEQ ID NO: 18324 - protein, 9 aa, Artificial Sequence
  Serine/threonine-protein phosphatase 6 regulatory subunit 1 (134-142)
RKTDQLVSF

SEQ ID NO: 18325 - protein, 11 aa, Artificial Sequence
  Histone H4 (79-89)
RKTVTAMDVVY

SEQ ID NO: 18326 - protein, 9 aa, Artificial Sequence
  Flap endonuclease 1 (29-37)
RKVAIDASM

SEQ ID NO: 18327 - protein, 11 aa, Artificial Sequence
  60S ribosome subunit biogenesis protein NIP7 homolog (154-164)
RKVDPMAIVVF

SEQ ID NO: 18328 - protein, 10 aa, Artificial Sequence
  E3 ubiquitin/ISG15 ligase TRIM25 (236-245)
RKVEQLQQEY

SEQ ID NO: 18329 - protein, 9 aa, Artificial Sequence
  Mitochondrial carrier homolog 2 (287-295)
RKVPFGKTY

SEQ ID NO: 18330 - protein, 9 aa, Artificial Sequence
  Fatty acid desaturase 1 (40-48)
RKVYNISEF

SEQ ID NO: 18331 - protein, 9 aa, Artificial Sequence
  Glucose-6-phosphate translocase (126-134)
RKWFEPSQF

SEQ ID NO: 18332 - protein, 12 aa, Artificial Sequence
  Heterogeneous nuclear ribonucleoprotein R (145-156)
RKYGGPPPDSVY

SEQ ID NO: 18333 - protein, 9 aa, Artificial Sequence
  Serine/threonine-protein phosphatase 4 catalytic subunit (132-140)
RKYGSVTVW

SEQ ID NO: 18334 - protein, 9 aa, Artificial Sequence
  Vigilin (87-95)
RKYKDMNQF

SEQ ID NO: 18335 - protein, 9 aa, Artificial Sequence
  Lysine-specific demethylase 5A (773-781)
RKYPENDLF

SEQ ID NO: 18336 - protein, 9 aa, Artificial Sequence
  Pre-mRNA-processing-splicing factor 8 (217-225)
RKYVNGSTY

SEQ ID NO: 18337 - protein, 9 aa, Artificial Sequence
  Max-binding protein MNT (295-303)
RLAELKHEL

SEQ ID NO: 18338 - protein, 9 aa, Artificial Sequence
  Protein unc-93 homolog B1 (374-382)
RLAYLLVAY

SEQ ID NO: 18339 - protein, 9 aa, Artificial Sequence
  Nuclear pore complex protein Nup85 (162-170)
RLDEARQML

SEQ ID NO: 18340 - protein, 9 aa, Artificial Sequence
  Acetyl-CoA carboxylase 2 (765-773)
RLGGIPVGV

SEQ ID NO: 18341 - protein, 9 aa, Artificial Sequence
  X-ray repair cross-complementing protein 6 (517-525)
RLGSLVDEF

SEQ ID NO: 18342 - protein, 9 aa, Artificial Sequence
  N-alpha-acetyltransferase 35, NatC auxiliary subunit (331-339)
RLIDRIKTV

SEQ ID NO: 18343 - protein, 10 aa, Artificial Sequence
  Cyclic GMP-AMP synthase (353-362)
RLKPFYLVPK

SEQ ID NO: 18344 - protein, 9 aa, Artificial Sequence
  Myosin light chain kinase 2, skeletal/cardiac muscle (553-561)
RLKSQILLK

SEQ ID NO: 18345 - protein, 9 aa, Artificial Sequence
  tRNA wybutosine-synthesizing protein 4 (311-319)
RLSPVSPAL

SEQ ID NO: 18346 - protein, 9 aa, Artificial Sequence
  DnaJ homolog subfamily C member 8 (45-53)
RLTRPGSSY

SEQ ID NO: 18347 - protein, 9 aa, Artificial Sequence
  C-type lectin domain family 4 member F (36-44)
RLVQATPAF

SEQ ID NO: 18348 - protein, 9 aa, Artificial Sequence
  Proteasome assembly chaperone 4 (20-28)
RLWEQLVHF

SEQ ID NO: 18349 - protein, 10 aa, Artificial Sequence
  Laminin subunit beta-3 (1125-1134)
RMKDMELELL

SEQ ID NO: 18350 - protein, 9 aa, Artificial Sequence
  Cytochrome c oxidase assembly protein COX15 homolog (153-161)
RMWGRLVGL

SEQ ID NO: 18351 - protein, 9 aa, Artificial Sequence
  Histone deacetylase complex subunit SAP18 (117-125)
RPGYRVKEI

SEQ ID NO: 18352 - protein, 10 aa, Artificial Sequence
  R3H domain-containing protein 2 (2-11)
RPPVTKASSF

SEQ ID NO: 18353 - protein, 9 aa, Artificial Sequence
  Short transient receptor potential channel 4-associated protein (31-39)
RPRPGNILL

SEQ ID NO: 18354 - protein, 9 aa, Artificial Sequence
  Glycogen synthase kinase-3 beta (306-314)
RPRTPPEAI

SEQ ID NO: 18355 - protein, 9 aa, Artificial Sequence
  Transcription initiation factor IIB (169-177)
RQEGVPRTF

SEQ ID NO: 18356 - protein, 10 aa, Artificial Sequence
  Protein FAM46A (224-233)
RQFEFSVDSF

SEQ ID NO: 18357 - protein, 9 aa, Artificial Sequence
  Pre-rRNA-processing protein TSR1 homolog (574-582)
RQGTPLIAF

SEQ ID NO: 18358 - protein, 9 aa, Artificial Sequence
  NADH dehydrogenase (ubiquinone) 1 subunit C2 (59-67)
RQLLYITAF

SEQ ID NO: 18359 - protein, 9 aa, Artificial Sequence
  Cytochrome b-245 heavy chain (147-155)
RQNESYLNF

SEQ ID NO: 18360 - protein, 9 aa, Artificial Sequence
  Rho GTPase-activating protein 4 (492-500)
RQPRPSSQY

SEQ ID NO: 18361 - protein, 10 aa, Artificial Sequence
  Protein strawberry notch homolog 1 (79-88)
RQQPPSTTTF

SEQ ID NO: 18362 - protein, 9 aa, Artificial Sequence
  Large proline-rich protein BAG6 (780-788)
RSFFHQHYL

SEQ ID NO: 18363 - protein, 9 aa, Artificial Sequence
  DnaJ homolog subfamily C member 10 (220-228)
RSKESLVSF

SEQ ID NO: 18364 - protein, 9 aa, Artificial Sequence
  DNA-dependent protein kinase catalytic subunit (3046-3054)
RSKLKLLLQ

SEQ ID NO: 18365 - protein, 10 aa, Artificial Sequence
  Protein SON (1072-1081)
RSMMSPMADR

SEQ ID NO: 18366 - protein, 9 aa, Artificial Sequence
  Small nuclear ribonucleoprotein E (28-36)
RSQIQVWLY

SEQ ID NO: 18367 - protein, 10 aa, Artificial Sequence
  PHD finger protein 3 (815-824)
RTKYIDDTVK

SEQ ID NO: 18368 - protein, 9 aa, Artificial Sequence
  60S ribosomal protein L34 (24-32)
RTPGNRIVY

SEQ ID NO: 18369 - protein, 9 aa, Artificial Sequence
  Androglobin (1138-1146)
RTSKPDAFI

SEQ ID NO: 18370 - protein, 9 aa, Artificial Sequence
  Eukaryotic translation initiation factor 2 subunit 2 (182-190)
RVFNIMREK

SEQ ID NO: 18371 - protein, 9 aa, Artificial Sequence
  Ankyrin repeat domain-containing protein 13C (353-361)
RVGNFLADF

SEQ ID NO: 18372 - protein, 9 aa, Artificial Sequence
  Eyes absent homolog 1 (440-448)
RVKEIYNTY

SEQ ID NO: 18373 - protein, 9 aa, Artificial Sequence
  NADH dehydrogenase (ubiquinone) 1 beta subcomplex subunit 5, mitochondrial (150-158)
RVKELEVRK

SEQ ID NO: 18374 - protein, 9 aa, Artificial Sequence
  Histone-lysine N-methyltransferase EZH2 (18-26)
RVKSEYMRL

SEQ ID NO: 18375 - protein, 9 aa, Artificial Sequence
  Bystin (257-265)
RVRDDVAEY

SEQ ID NO: 18376 - protein, 9 aa, Artificial Sequence
  Ribonucleoside-diphosphate reductase subunit M2 (288-296)
RVREIIINA

SEQ ID NO: 18377 - protein, 9 aa, Artificial Sequence
  Leydig cell tumor 10 kDa protein homolog (42-50)
RVVQQQKLK

SEQ ID NO: 18378 - protein, 10 aa, Artificial Sequence
  Thioredoxin-related transmembrane protein 2 (198-207)
RYTDVSTRYK

SEQ ID NO: 18379 - protein, 9 aa, Artificial Sequence
  Dipeptidyl peptidase 3 (692-700)
SAAGLIRSF

SEQ ID NO: 18380 - protein, 9 aa, Artificial Sequence
  Cyclin-dependent kinase 11B (785-793)
SAAGPGFSL

SEQ ID NO: 18381 - protein, 9 aa, Artificial Sequence
  Fanconi anemia group M protein (1313-1321)
SAAKNEELL

SEQ ID NO: 18382 - protein, 9 aa, Artificial Sequence
  Integrin beta-7 (338-346)
SAANIQPIF

SEQ ID NO: 18383 - protein, 9 aa, Artificial Sequence
  Deleted in malignant brain tumors 1 protein (202-210)
SAAQPQSTL

SEQ ID NO: 18384 - protein, 9 aa, Artificial Sequence
  Cell division cycle and apoptosis regulator protein 1 (253-261)
SAASITPLL

SEQ ID NO: 18385 - protein, 9 aa, Artificial Sequence
  Magnesium transporter protein 1 (108-116)
SAFTNRIFF

SEQ ID NO: 18386 - protein, 9 aa, Artificial Sequence
  Rho guanine nucleotide exchange factor 2 (122-130)
SAIYPSDSF

SEQ ID NO: 18387 - protein, 9 aa, Artificial Sequence
  Pleckstrin homology domain-containing family B member 1 (11-19)
SALESPFEE

SEQ ID NO: 18388 - protein, 9 aa, Artificial Sequence
  14-3-3 protein eta (25-33)
SAMKAVTEL

SEQ ID NO: 18389 - protein, 11 aa, Artificial Sequence
  Nuclease-sensitive element-binding protein 1 (314-324)
SAPEAEQGGAE

SEQ ID NO: 18390 - protein, 9 aa, Artificial Sequence
  Peroxisomal multifunctional enzyme type 2 (151-159)
SASGIYGNF

SEQ ID NO: 18391 - protein, 9 aa, Artificial Sequence
  Multidrug resistance-associated protein 4 (326-334)
SASKIIVFV

SEQ ID NO: 18392 - protein, 9 aa, Artificial Sequence
  CapZ-interacting protein (15-23)
SASPSVAQL

SEQ ID NO: 18393 - protein, 9 aa, Artificial Sequence
  Mucin-20 (558-566)
SAVGKTTSF

SEQ ID NO: 18394 - protein, 9 aa, Artificial Sequence
  ADP-dependent glucokinase (7-15)
SAYAGFLAL

SEQ ID NO: 18395 - protein, 9 aa, Artificial Sequence
  AFG3-like protein 2 (656-664)
SAYAQIVQF

SEQ ID NO: 18396 - protein, 11 aa, Artificial Sequence
  HLA class I histocompatibility antigen, Cw-7 alpha chain (115-125)
SAYDGKDYIAL

SEQ ID NO: 18397 - protein, 9 aa, Artificial Sequence
  Heterogeneous nuclear ribonucleoprotein D-like (363-371)
SAYGGDQNY

SEQ ID NO: 18398 - protein, 9 aa, Artificial Sequence
  Cyclic AMP-responsive element-binding protein 1 (143-151)
SDAPGVPRI

SEQ ID NO: 18399 - protein, 9 aa, Artificial Sequence
  Obscurin (2339-2347)
SDGLYRKLI

SEQ ID NO: 18400 - protein, 10 aa, Artificial Sequence
  Transgelin-2 (163-172)
SDNQLQEGKN

SEQ ID NO: 18401 - protein, 11 aa, Artificial Sequence
  Histone H2B type 1-K (113-123)
SEGTKAVTKYT

SEQ ID NO: 18402 - protein, 10 aa, Artificial Sequence
  Tumor protein D54 (166-175)
SFEDRVGTIK

SEQ ID NO: 18403 - protein, 12 aa, Artificial Sequence
  Ubiquitin-conjugating enzyme E2 J1 (236-247)
SFHQPTQPVAKN

SEQ ID NO: 18404 - protein, 9 aa, Artificial Sequence
  Lipase member J (205-213)
SFKKFIGSK

SEQ ID NO: 18405 - protein, 10 aa, Artificial Sequence
  DNA damage-binding protein 1 (1096-1105)
SFLDISRPKM

SEQ ID NO: 18406 - protein, 10 aa, Artificial Sequence
  Dynein heavy chain 14, axonemal (3238-3247)
SFLNMRVPTL

SEQ ID NO: 18407 - protein, 9 aa, Artificial Sequence
  Actin-related protein 3 (170-178)
SGDGVTHVI

SEQ ID NO: 18408 - protein, 9 aa, Artificial Sequence
  Protein phosphatase 1 regulatory subunit 14B (21-29)
SGGPGPRVY

SEQ ID NO: 18409 - protein, 10 aa, Artificial Sequence
  Dolichyl-diphosphooligosaccharide-proteinosyltransferase subunit 1 (272-281)
SGISSIRSFK

SEQ ID NO: 18410 - protein, 9 aa, Artificial Sequence
  Kinesin-like protein KIFC2 (600-608)
SHALVTLTL

SEQ ID NO: 18411 - protein, 9 aa, Artificial Sequence
  Sorting nexin-19 (151-159)
SHAVAQSVL

SEQ ID NO: 18412 - protein, 9 aa, Artificial Sequence
  Probable E3 ubiquitin-protein ligase HERC4 (280-288)
SHEINPRKV

SEQ ID NO: 18413 - protein, 12 aa, Artificial Sequence
  Mucin-7 (41-52)
SHFELPHYPGLL

SEQ ID NO: 18414 - protein, 9 aa, Artificial Sequence
  Histone-lysine N-methyltransferase 2D (2564-2572)
SHFGPGPTL

SEQ ID NO: 18415 - protein, 8 aa, Artificial Sequence
  Putative uncharacterized protein FLJ37218 (158-165)
SHFTDQEL

SEQ ID NO: 18416 - protein, 9 aa, Artificial Sequence
  Tapasin (318-326)
SHFYPSGGL

SEQ ID NO: 18417 - protein, 9 aa, Artificial Sequence
  Translational activator GCN1 (674-682)
SHHPSLVAV

SEQ ID NO: 18418 - protein, 9 aa, Artificial Sequence
  Transcriptional repressor p66-beta (322-330)
SHIQPGTVN

SEQ ID NO: 18419 - protein, 9 aa, Artificial Sequence
  Disintegrin and metalloproteinase domain-containing protein 10 (377-385)
SHITFAHEV

SEQ ID NO: 18420 - protein, 9 aa, Artificial Sequence
  Niemann-Pick C1 protein (1169-1177)
SHITRAFTV

SEQ ID NO: 18421 - protein, 9 aa, Artificial Sequence
  Endothelial PAS domain-containing protein 1 (49-57)
SHLDKASIM

SEQ ID NO: 18422 - protein, 9 aa, Artificial Sequence
  Retrotransposon-derived protein PEG10 (219-227)
SHLEVAKSL

SEQ ID NO: 18423 - protein, 9 aa, Artificial Sequence
  Dolichyl-diphosphooligosaccharide-proteinosyltransferase subunit 2 (169-177)
SHLSQQADL

SEQ ID NO: 18424 - protein, 9 aa, Artificial Sequence
  Protein FAM78A (95-103)
SHMEFYNQY

SEQ ID NO: 18425 - protein, 9 aa, Artificial Sequence
  THO complex subunit 5 homolog (470-478)
SHMETTMKL

SEQ ID NO: 18426 - protein, 9 aa, Artificial Sequence
  Nicastrin (219-227)
SHMHAVIST

SEQ ID NO: 18427 - protein, 9 aa, Artificial Sequence
  Regulation of nuclear pre-mRNA domain-containing protein 2 (503-511)
SHNPLANIL

SEQ ID NO: 18428 - protein, 9 aa, Artificial Sequence
  Myotubularin-related protein 6 (41-49)
SHQKETWIL

SEQ ID NO: 18429 - protein, 12 aa, Artificial Sequence
  Cytochrome c oxidase subunit 7B, mitochondrial (25-36)
SHQKRTPDFHDK

SEQ ID NO: 18430 - protein, 9 aa, Artificial Sequence
  Transmembrane protein 201 (295-303)
SHQTGVVAL

SEQ ID NO: 18431 - protein, 9 aa, Artificial Sequence
  Squalene monooxygenase (461-469)
SHSFVVNIL

SEQ ID NO: 18432 - protein, 9 aa, Artificial Sequence
  Zinc transporter ZIP6 (388-396)
SHSHEEPAM

SEQ ID NO: 18433 - protein, 9 aa, Artificial Sequence
  Transmembrane protein 214 (503-511)
SHSSFQASL

SEQ ID NO: 18434 - protein, 9 aa, Artificial Sequence
  39S ribosomal protein L17, mitochondrial (167-175)
SHTAQTPGI

SEQ ID NO: 18435 - protein, 9 aa, Artificial Sequence
  CLOCK-interacting pacemaker (249-257)
SHVAKAPSL

SEQ ID NO: 18436 - protein, 9 aa, Artificial Sequence
  Pre-mRNA-processing-splicing factor 8 (2254-2262)
SHYERVQML

SEQ ID NO: 18437 - protein, 9 aa, Artificial Sequence
  DNA-binding protein RFX7 (154-162)
SHYIGTKSM

SEQ ID NO: 18438 - protein, 9 aa, Artificial Sequence
  Dual specificity protein kinase CLK1 (54-62)
SHYLESRSI

SEQ ID NO: 18439 - protein, 9 aa, Artificial Sequence
  Protein EVI2B (202-210)
SIAAILIGV

SEQ ID NO: 18440 - protein, 9 aa, Artificial Sequence
  DNA-directed RNA polymerase II subunit RPB2 (468-476)
SIAPRMMSV

SEQ ID NO: 18441 - protein, 9 aa, Artificial Sequence
  E3 ubiquitin-protein ligase RNF19A (93-101)
SIESIHSEM

SEQ ID NO: 18442 - protein, 9 aa, Artificial Sequence
  Translocon-associated protein subunit delta (126-134)
SIIPPLFTV

SEQ ID NO: 18443 - protein, 12 aa, Artificial Sequence
  Alpha-enolase (2-13)
SILKIHAREIFD

SEQ ID NO: 18444 - protein, 9 aa, Artificial Sequence
  Copper-transporting ATPase 2 (876-884)
SINAHGSVL

SEQ ID NO: 18445 - protein, 9 aa, Artificial Sequence
  Protein Smaug homolog 2 (352-360)
SIQKLRERQ

SEQ ID NO: 18446 - protein, 9 aa, Artificial Sequence
  CCR4-NOT transcription complex subunit 1 (312-320)
SISAPGSGI

SEQ ID NO: 18447 - protein, 9 aa, Artificial Sequence
  AP-5 complex subunit mu-1 (477-485)
SKAPAPVTY

SEQ ID NO: 18448 - protein, 9 aa, Artificial Sequence
  Ubiquitin carboxyl-terminal hydrolase 19 (576-584)
SKASQFTGY

SEQ ID NO: 18449 - protein, 9 aa, Artificial Sequence
  Putative tRNA (cytidine(32)/guanosine(34)-2'-O)-methyltransferase (5-13)
SKDKRDVYY

SEQ ID NO: 18450 - protein, 9 aa, Artificial Sequence
  40S ribosomal protein S6 (148-156)
SKEDDVRQY

SEQ ID NO: 18451 - protein, 9 aa, Artificial Sequence
  60S ribosomal protein L11 (158-166)
SKEEAMRWF

SEQ ID NO: 18452 - protein, 9 aa, Artificial Sequence
  Gamma-glutamyltranspeptidase 1 (30-38)
SKEPDNHVY

SEQ ID NO: 18453 - protein, 9 aa, Artificial Sequence
  NADH dehydrogenase (ubiquinone) 1 beta subcomplex subunit 8, mitochondrial (175-183)
SKEPERVVH

SEQ ID NO: 18454 - protein, 9 aa, Artificial Sequence
  Neuroblast differentiation-associated protein AHNAK (5611-5619)
SKFAGGLHF

SEQ ID NO: 18455 - protein, 9 aa, Artificial Sequence
  Core-binding factor subunit beta (10-18)
SKFENEEFF

SEQ ID NO: 18456 - protein, 10 aa, Artificial Sequence
  Proteasomal ATPase-associated factor 1 (78-87)
SKFLAPYTTF

SEQ ID NO: 18457 - protein, 11 aa, Artificial Sequence
  CWF19-like protein 2 (623-633)
SKFMGKTDGDY

SEQ ID NO: 18458 - protein, 9 aa, Artificial Sequence
  Transcription intermediary factor 1-alpha (457-465)
SKFPTQISL

SEQ ID NO: 18459 - protein, 9 aa, Artificial Sequence
  40S ribosomal protein S25 (101-109)
SKHRAQVIY

SEQ ID NO: 18460 - protein, 11 aa, Artificial Sequence
  Proteasome subunit beta type-7 (75-85)
SKIHFISPNIY

SEQ ID NO: 18461 - protein, 9 aa, Artificial Sequence
  60S ribosomal protein L18a (148-156)
SKIKFPLPH

SEQ ID NO: 18462 - protein, 9 aa, Artificial Sequence
  Serine/threonine-protein phosphatase 4 regulatory subunit 3B (54-62)
SKINPNTAY

SEQ ID NO: 18463 - protein, 9 aa, Artificial Sequence
  Signal recognition particle receptor subunit alpha (128-136)
SKIRAPTTM

SEQ ID NO: 18464 - protein, 9 aa, Artificial Sequence
  NUAK family SNF1-like kinase 2 (123-131)
SKIVIVMEY

SEQ ID NO: 18465 - protein, 10 aa, Artificial Sequence
  E3 ubiquitin-protein ligase RING1 (108-117)
SKIYPSREEY

SEQ ID NO: 18466 - protein, 9 aa, Artificial Sequence
  60S ribosomal protein L19 (112-120)
SKKIDRHMY

SEQ ID NO: 18467 - protein, 9 aa, Artificial Sequence
  HAUS augmin-like complex subunit 8 (124-132)
SKKPESTSF

SEQ ID NO: 18468 - protein, 9 aa, Artificial Sequence
  60S ribosomal protein L10 (168-176)
SKKWGFTKF

SEQ ID NO: 18469 - protein, 10 aa, Artificial Sequence
  Golgi-associated PDZ and coiled-coil motif-containing protein (448-457)
SKLDDLHTLY

SEQ ID NO: 18470 - protein, 9 aa, Artificial Sequence
  Protein yippee-like 5 (78-86)
SKLGWIYEF

SEQ ID NO: 18471 - protein, 11 aa, Artificial Sequence
  Eukaryotic translation initiation factor 2A (459-469)
SKLHEEEPPQN

SEQ ID NO: 18472 - protein, 12 aa, Artificial Sequence
  T-complex protein 1 subunit eta (291-302)
SKLPIGDVATQY

SEQ ID NO: 18473 - protein, 9 aa, Artificial Sequence
  Ubiquitin-protein ligase E3C (217-225)
SKLPSSIEY

SEQ ID NO: 18474 - protein, 9 aa, Artificial Sequence
  Laminin subunit alpha-5 (3479-3487)
SKLPVTVGF

SEQ ID NO: 18475 - protein, 9 aa, Artificial Sequence
  Anaphase-promoting complex subunit 5 (144-152)
SKLSFSQVF

SEQ ID NO: 18476 - protein, 9 aa, Artificial Sequence
  Protein Red (280-288)
SKLTQILSY

SEQ ID NO: 18477 - protein, 9 aa, Artificial Sequence
  GPN-loop GTPase 2 (178-186)
SKMDLIEHY

SEQ ID NO: 18478 - protein, 10 aa, Artificial Sequence
  Hsp90 co-chaperone Cdc37 (322-331)
SKMDPTDAKY

SEQ ID NO: 18479 - protein, 9 aa, Artificial Sequence
  Ubiquitin-conjugating enzyme E2 A (74-82)
SKMFHPNVY

SEQ ID NO: 18480 - protein, 9 aa, Artificial Sequence
  Deoxyribonuclease-2-alpha (168-176)
SKMGKQLTY

SEQ ID NO: 18481 - protein, 9 aa, Artificial Sequence
  Small nuclear ribonucleoprotein-associated protein N (7-15)
SKMLQHIDY

SEQ ID NO: 18482 - protein, 9 aa, Artificial Sequence
  A-kinase anchor protein 9 (893-901)
SKNKQELEY

SEQ ID NO: 18483 - protein, 9 aa, Artificial Sequence
  Intraflagellar transport protein 80 homolog (558-566)
SKNPHIVSF

SEQ ID NO: 18484 - protein, 9 aa, Artificial Sequence
  E3 SUMO-protein ligase RanBP2 (1103-1111)
SKNVSGISF

SEQ ID NO: 18485 - protein, 9 aa, Artificial Sequence
  Protein yippee-like 3 (5-13)
SKPKTFQAY

SEQ ID NO: 18486 - protein, 9 aa, Artificial Sequence
  Coatomer subunit alpha (279-287)
SKRTGVQTF

SEQ ID NO: 18487 - protein, 9 aa, Artificial Sequence
  Calcium-dependent secretion activator 1 (390-398)
SKSDVVLSF

SEQ ID NO: 18488 - protein, 9 aa, Artificial Sequence
  S-adenosylmethionine synthase isoform type-2 (180-188)
SKTQVTVQY

SEQ ID NO: 18489 - protein, 9 aa, Artificial Sequence
  Protein YIPF1 (188-196)
SKVMNIVSY

SEQ ID NO: 18490 - protein, 9 aa, Artificial Sequence
  Nucleolar complex protein 4 homolog (137-145)
SKWEGNYLF

SEQ ID NO: 18491 - protein, 9 aa, Artificial Sequence
  EBNA1-binding protein 2 (257-265)
SKWNTRESY

SEQ ID NO: 18492 - protein, 10 aa, Artificial Sequence
  Nuclease-sensitive element-binding protein 1 (136-145)
SKYAADRNHY

SEQ ID NO: 18493 - protein, 9 aa, Artificial Sequence
  Transcription factor MafG (109-117)
SKYEALQTF

SEQ ID NO: 18494 - protein, 10 aa, Artificial Sequence
  7-dehydrocholesterol reductase (453-462)
SKYGRDWERY

SEQ ID NO: 18495 - protein, 9 aa, Artificial Sequence
  Gamma-tubulin complex component 6 (1622-1630)
SKYSGVFSF

SEQ ID NO: 18496 - protein, 11 aa, Artificial Sequence
  V-type proton ATPase catalytic subunit A (264-274)
SKYSNSDVIIY

SEQ ID NO: 18497 - protein, 9 aa, Artificial Sequence
  DNA polymerase delta catalytic subunit (737-745)
SKYTVENGY

SEQ ID NO: 18498 - protein, 11 aa, Artificial Sequence
  Fatty acid synthase (1747-1757)
SLAEEKLQASV

SEQ ID NO: 18499 - protein, 12 aa, Artificial Sequence
  Intraflagellar transport protein 140 homolog (561-572)
SLAELVPGVGGI

SEQ ID NO: 18500 - protein, 9 aa, Artificial Sequence
  DNA topoisomerase 3-beta-1 (12-20)
SLAQSIAKI

SEQ ID NO: 18501 - protein, 9 aa, Artificial Sequence
  PMS1 protein homolog 1 (605-613)
SLFNGSHYL

SEQ ID NO: 18502 - protein, 9 aa, Artificial Sequence
  Nuclear pore membraneoprotein 210-like (625-633)
SLGHTLVTV

SEQ ID NO: 18503 - protein, 9 aa, Artificial Sequence
  Bifunctional glutamate/proline-tRNA ligase (786-794)
SLKAEYKEK

SEQ ID NO: 18504 - protein, 9 aa, Artificial Sequence
  Bifunctional glutamate/proline-tRNA ligase (859-867)
SLKAQYKEK

SEQ ID NO: 18505 - protein, 9 aa, Artificial Sequence
  Heterogeneous nuclear ribonucleoprotein M (86-94)
SLKDLVKEK

SEQ ID NO: 18506 - protein, 8 aa, Artificial Sequence
  Serine/threonine-protein phosphatase 2A 65 kDa regulatory subunit A alpha isoform (403-410)
SLLPAIVE

SEQ ID NO: 18507 - protein, 10 aa, Artificial Sequence
  Protein transport protein Sec23B (156-165)
SLLPPDALVG

SEQ ID NO: 18508 - protein, 9 aa, Artificial Sequence
  Nesprin-1 (5397-5405)
SLQLAEVAL

SEQ ID NO: 18509 - protein, 9 aa, Artificial Sequence
  Tetratricopeptide repeat protein 28 (1301-1309)
SLWPVPVAA

SEQ ID NO: 18510 - protein, 9 aa, Artificial Sequence
  Probable E3 ubiquitin-protein ligase HECTD4 (1660-1668)
SMAAEVIAL

SEQ ID NO: 18511 - protein, 9 aa, Artificial Sequence
  Ribonuclease 3 (661-669)
SMHQILLYL

SEQ ID NO: 18512 - protein, 12 aa, Artificial Sequence
  B-cell CLL/lymphoma 9-like protein (1201-1212)
SMMMAPGGPDSL

SEQ ID NO: 18513 - protein, 10 aa, Artificial Sequence
  Titin (34201-34210)
SMTEMKFASM

SEQ ID NO: 18514 - protein, 12 aa, Artificial Sequence
  Protein S100-A7 (2-13)
SNTQAERSIIGM

SEQ ID NO: 18515 - protein, 12 aa, Artificial Sequence
  Basic salivary proline-rich protein 4 (241-252)
SPPGKPQGPPQQ

SEQ ID NO: 18516 - protein, 8 aa, Artificial Sequence
  Protein kinase C-binding protein 1 (698-705)
SPTVHLGL

SEQ ID NO: 18517 - protein, 9 aa, Artificial Sequence
  Protein AF-17 (915-923)
SQAGGAPTL

SEQ ID NO: 18518 - protein, 9 aa, Artificial Sequence
  4F2 cell-surface antigen heavy chain (436-444)
SQARLLTSF

SEQ ID NO: 18519 - protein, 9 aa, Artificial Sequence
  Dolichyl-diphosphooligosaccharide-proteinosyltransferase subunit 1 (210-218)
SQDTFKVHY

SEQ ID NO: 18520 - protein, 9 aa, Artificial Sequence
  Arf-GAP with SH3 domain, ANK repeat and PH domain-containing protein 2 (285-293)
SQIRQSTAY

SEQ ID NO: 18521 - protein, 9 aa, Artificial Sequence
  DNA mismatch repair protein Msh2 (717-725)
SQLKGVSTF

SEQ ID NO: 18522 - protein, 10 aa, Artificial Sequence
  Fanconi anemia group E protein (322-331)
SQMDLLCAQL

SEQ ID NO: 18523 - protein, 9 aa, Artificial Sequence
  Multidrug resistance-associated protein 4 (661-669)
SQQSSRPSL

SEQ ID NO: 18524 - protein, 9 aa, Artificial Sequence
  Heat shock protein 105 kDa (552-560)
SQSPPSPEL

SEQ ID NO: 18525 - protein, 9 aa, Artificial Sequence
  Cystatin-B (45-53)
SQVVAGTNY

SEQ ID NO: 18526 - protein, 10 aa, Artificial Sequence
  NEDD8-activating enzyme E1 catalytic subunit (290-299)
SQYNIRGVTY

SEQ ID NO: 18527 - protein, 9 aa, Artificial Sequence
  WD repeat-containing protein 97 (311-319)
SRDSTVKVW

SEQ ID NO: 18528 - protein, 12 aa, Artificial Sequence
  Nuclease-sensitive element-binding protein 1 (309-320)
SSAPEAEQGGAE

SEQ ID NO: 18529 - protein, 10 aa, Artificial Sequence
  Hematological and neurological expressed 1 protein (91-100)
SSGDFLDLKG

SEQ ID NO: 18530 - protein, 10 aa, Artificial Sequence
  Synaptotagmin-like protein 2 (602-611)
SSGMTSLSSV

SEQ ID NO: 18531 - protein, 9 aa, Artificial Sequence
  HLA class I histocompatibility antigen, alpha chain G (301-309)
SSLPTIPIM

SEQ ID NO: 18532 - protein, 9 aa, Artificial Sequence
  Mucin-1 (130-138)
STAPPAHGV

SEQ ID NO: 18533 - protein, 9 aa, Artificial Sequence
  Sperm-associated antigen 5 (305-313)
STCLTPNLV

SEQ ID NO: 18534 - protein, 9 aa, Artificial Sequence
  V-type proton ATPase catalytic subunit A (16-24)
STFGYVHGV

SEQ ID NO: 18535 - protein, 9 aa, Artificial Sequence
  Uncharacterized protein C20orf195 (2-10)
STHVAGLGL

SEQ ID NO: 18536 - protein, 10 aa, Artificial Sequence
  Ubiquitin carboxyl-terminal hydrolase 3 (394-403)
STKKFWIQKL

SEQ ID NO: 18537 - protein, 9 aa, Artificial Sequence
  Heat shock cognate 71 kDa protein (340-348)
STRIPKIQK

SEQ ID NO: 18538 - protein, 9 aa, Artificial Sequence
  Putativeosylation-dependent cell adhesion molecule 1 (14-22)
STSLAILDV

SEQ ID NO: 18539 - protein, 10 aa, Artificial Sequence
  Microtubule-actin cross-linking factor 1, isoforms 1/2/3/5 (844-853)
SVASLVGRSK

SEQ ID NO: 18540 - protein, 10 aa, Artificial Sequence
  Zinc finger protein 638 (1228-1237)
SVFAEERNLK

SEQ ID NO: 18541 - protein, 9 aa, Artificial Sequence
  Heat shock protein HSP 90-alpha (658-666)
SVKDLVILL

SEQ ID NO: 18542 - protein, 9 aa, Artificial Sequence
  Eukaryotic translation initiation factor 3 subunit E (27-35)
SVKEIYNEK

SEQ ID NO: 18543 - protein, 12 aa, Artificial Sequence
  Cytoskeleton-associated protein 2 (388-399)
SVVTQHEPAGQN

SEQ ID NO: 18544 - protein, 10 aa, Artificial Sequence
  Echinoderm microtubule-associated protein-like 4 (184-193)
SWENSDDSRN

SEQ ID NO: 18545 - protein, 10 aa, Artificial Sequence
  Cold-inducible RNA-binding protein (163-172)
SYDSYATHNE

SEQ ID NO: 18546 - protein, 11 aa, Artificial Sequence
  14-3-3 protein theta (210-220)
SYKDSTLIMQL

SEQ ID NO: 18547 - protein, 9 aa, Artificial Sequence
  Nucleolar and coiled-body phosphoprotein 1 (681-689)
SYRGGSISV

SEQ ID NO: 18548 - protein, 8 aa, Artificial Sequence
  Asparagine synthetase (glutamine-hydrolyzing) (409-416)
TAAHGLEL

SEQ ID NO: 18549 - protein, 10 aa, Artificial Sequence
  Ribosome biogenesis protein BOP1 (10-19)
TAAPSVRPEK

SEQ ID NO: 18550 - protein, 10 aa, Artificial Sequence
  Poly(rC)-binding protein 2 (91-100)
TAASRPPVTL

SEQ ID NO: 18551 - protein, 9 aa, Artificial Sequence
  Elongation factor 2 (73-81)
TAISLFYEL

SEQ ID NO: 18552 - protein, 10 aa, Artificial Sequence
  Ubiquitin-associated protein 2-like (322-331)
TAISQPASGN

SEQ ID NO: 18553 - protein, 12 aa, Artificial Sequence
  Intraflagellar transport protein 88 homolog (62-73)
TAKISSTAVTRP

SEQ ID NO: 18554 - protein, 8 aa, Artificial Sequence
  Max-like protein X (152-159)
TALKIMKV

SEQ ID NO: 18555 - protein, 9 aa, Artificial Sequence
  Nuclear pore membraneoprotein 210 (1573-1581)
TASKVIVAV

SEQ ID NO: 18556 - protein, 12 aa, Artificial Sequence
  Syndecan-1 (220-231)
TAVVAVEPDRRN

SEQ ID NO: 18557 - protein, 9 aa, Artificial Sequence
  Probable C-mannosyltransferase DPY19L3 (463-471)
TAYNLIHTI

SEQ ID NO: 18558 - protein, 9 aa, Artificial Sequence
  XK-related protein 9 (255-263)
TCISMEFLY

SEQ ID NO: 18559 - protein, 11 aa, Artificial Sequence
  Uncharacterized protein C9orf78 (274-284)
TDDYHYEKFKK

SEQ ID NO: 18560 - protein, 8 aa, Artificial Sequence
  Bcl-2-associated transcription factor 1 (341-348)
TDEESRVF

SEQ ID NO: 18561 - protein, 10 aa, Artificial Sequence
  Bcl-2-associated transcription factor 1 (341-350)
TDEESRVFLL

SEQ ID NO: 18562 - protein, 12 aa, Artificial Sequence
  Pleiotropic regulator 1 (74-85)
TDSYVHKQYPAN

SEQ ID NO: 18563 - protein, 9 aa, Artificial Sequence
  PRA1 family protein 3 (180-188)
TDYISKVKE

SEQ ID NO: 18564 - protein, 9 aa, Artificial Sequence
  Testis-expressed sequence 10 protein (733-741)
TEAVFHSLL

SEQ ID NO: 18565 - protein, 11 aa, Artificial Sequence
  Pre-mRNA cleavage complex 2 protein Pcf11 (561-571)
TEEERPQETTN

SEQ ID NO: 18566 - protein, 10 aa, Artificial Sequence
  cTAGE family member 5 (795-804)
TEHPEPQQET

SEQ ID NO: 18567 - protein, 12 aa, Artificial Sequence
  Tumor protein D52 (213-224)
TEPLPEKTQESL

SEQ ID NO: 18568 - protein, 12 aa, Artificial Sequence
  BAG family molecular chaperone regulator 4 (167-178)
TEVPSTYRSSGN

SEQ ID NO: 18569 - protein, 11 aa, Artificial Sequence
  Non-POU domain-containing octamer-binding protein (6-16)
TFNLEKQNHTP

SEQ ID NO: 18570 - protein, 12 aa, Artificial Sequence
  Non-POU domain-containing octamer-binding protein (6-17)
TFNLEKQNHTPR

SEQ ID NO: 18571 - protein, 10 aa, Artificial Sequence
  U2 snRNP-associated SURP motif-containing protein (134-143)
TFVRGGVVNA

SEQ ID NO: 18572 - protein, 12 aa, Artificial Sequence
  Ubiquitin-associated protein 2-like (225-236)
TGHFEPDDGTSA

SEQ ID NO: 18573 - protein, 12 aa, Artificial Sequence
  E3 ubiquitin-protein ligase HUWE1 (2557-2568)
TGHTIHVHYPGN

SEQ ID NO: 18574 - protein, 10 aa, Artificial Sequence
  Transcriptional repressor p66-beta (558-567)
TGIGGHKGPS

SEQ ID NO: 18575 - protein, 12 aa, Artificial Sequence
  Peptidyl-prolyl cis-trans isomerase FKBP1A (28-39)
TGMLEDGKKFDS

SEQ ID NO: 18576 - protein, 11 aa, Artificial Sequence
  Probable ATP-dependent RNA helicase DDX5 (560-570)
TGNPTGTYQNG

SEQ ID NO: 18577 - protein, 8 aa, Artificial Sequence
  60S ribosomal protein L13 (151-158)
TGPVMPVR

SEQ ID NO: 18578 - protein, 12 aa, Artificial Sequence
  AT-rich interactive domain-containing protein 1A (1514-1525)
TGSAPQGPAYHG

SEQ ID NO: 18579 - protein, 12 aa, Artificial Sequence
  Nuclear pore complex protein Nup153 (406-417)
TGYEKNMTPGQN

SEQ ID NO: 18580 - protein, 9 aa, Artificial Sequence
  Pumilio homolog 3 (361-369)
THDGARVAM

SEQ ID NO: 18581 - protein, 9 aa, Artificial Sequence
  Glutaryl-CoA dehydrogenase, mitochondrial (416-424)
THDIHALIL

SEQ ID NO: 18582 - protein, 9 aa, Artificial Sequence
  Nuclear pore complex protein Nup88 (408-416)
THEAGVHSV

SEQ ID NO: 18583 - protein, 9 aa, Artificial Sequence
  Endonuclease G, mitochondrial (227-235)
THFFKVLIL

SEQ ID NO: 18584 - protein, 9 aa, Artificial Sequence
  Bax inhibitor 1 (51-59)
THFIQAGLL

SEQ ID NO: 18585 - protein, 9 aa, Artificial Sequence
  BMP/retinoic acid-inducible neural-specific protein 2 (144-152)
THFLLSATL

SEQ ID NO: 18586 - protein, 9 aa, Artificial Sequence
  HEAT repeat-containing protein 1 (721-729)
THFPFAIRV

SEQ ID NO: 18587 - protein, 9 aa, Artificial Sequence
  Transitional endoplasmic reticulum ATPase (403-411)
THGHVGADL

SEQ ID NO: 18588 - protein, 9 aa, Artificial Sequence
  Zinc finger protein 638 (449-457)
THIESCRQL

SEQ ID NO: 18589 - protein, 8 aa, Artificial Sequence
  Leucine-rich PPR motif-containing protein, mitochondrial (1095-1102)
THIKGFTL

SEQ ID NO: 18590 - protein, 9 aa, Artificial Sequence
  Probable C-mannosyltransferase DPY19L1 (228-236)
THILRATKL

SEQ ID NO: 18591 - protein, 10 aa, Artificial Sequence
  Guanine nucleotide-binding protein-like 3-like protein (251-260)
THIRVGVVGL

SEQ ID NO: 18592 - protein, 12 aa, Artificial Sequence
  Neuroblast differentiation-associated protein AHNAK (1576-1587)
THKISMPDVGLN

SEQ ID NO: 18593 - protein, 9 aa, Artificial Sequence
  Homeodomain-interacting protein kinase 3 (1110-1118)
THLGGQPTL

SEQ ID NO: 18594 - protein, 9 aa, Artificial Sequence
  Nck-associated protein 1-like (1054-1062)
THLKEFLVV

SEQ ID NO: 18595 - protein, 8 aa, Artificial Sequence
  Bone marrow stromal antigen 2 (67-74)
THLLQQEL

SEQ ID NO: 18596 - protein, 9 aa, Artificial Sequence
  Dol-P-Man:Man(5)GlcNAc(2)-PP-Dol alpha-1,3-mannosyltransferase (381-389)
THLLRLLVL

SEQ ID NO: 18597 - protein, 9 aa, Artificial Sequence
  Myocyte-specific enhancer factor 2C (372-380)
THLSQSSNL

SEQ ID NO: 18598 - protein, 9 aa, Artificial Sequence
  Dolichyl-diphosphooligosaccharide-proteinosyltransferase 48 kDa subunit (400-408)
THLYSSTQV

SEQ ID NO: 18599 - protein, 9 aa, Artificial Sequence
  Bifunctional glutamate/proline-tRNA ligase (1422-1430)
THMVVANTM

SEQ ID NO: 18600 - protein, 9 aa, Artificial Sequence
  C-myc promoter-binding protein (1300-1308)
THSSPSFNL

SEQ ID NO: 18601 - protein, 9 aa, Artificial Sequence
  Heterogeneous nuclear ribonucleoprotein R (25-33)
THTEHYKTL

SEQ ID NO: 18602 - protein, 9 aa, Artificial Sequence
  Stromal cell-derived factor 2 (95-103)
THVNTGRNL

SEQ ID NO: 18603 - protein, 9 aa, Artificial Sequence
  Dolichyl-diphosphooligosaccharide-proteinosyltransferase subunit 2 (26-34)
THYLTKHDV

SEQ ID NO: 18604 - protein, 11 aa, Artificial Sequence
  Lymphoid-restricted membrane protein (375-385)
TIASLPRNIGN

SEQ ID NO: 18605 - protein, 12 aa, Artificial Sequence
  Myosin-binding protein H-like (137-148)
TIDILVIERPGP

SEQ ID NO: 18606 - protein, 9 aa, Artificial Sequence
  Glycerol-3-phosphate dehydrogenase 1-like protein (285-293)
TIEELEKEM

SEQ ID NO: 18607 - protein, 12 aa, Artificial Sequence
  BPI fold-containing family A member 2 (157-168)
TIETDPQTHQPV

SEQ ID NO: 18608 - protein, 9 aa, Artificial Sequence
  MOB kinase activator 1A (192-200)
TILKRLFRV

SEQ ID NO: 18609 - protein, 9 aa, Artificial Sequence
  Protein sel-1 homolog 1 (219-227)
TKALERVSY

SEQ ID NO: 18610 - protein, 9 aa, Artificial Sequence
  WD repeat-containing protein 5 (45-53)
TKAVSSVKF

SEQ ID NO: 18611 - protein, 9 aa, Artificial Sequence
  Transforming protein RhoA (163-171)
TKDGVREVF

SEQ ID NO: 18612 - protein, 9 aa, Artificial Sequence
  Disintegrin and metalloproteinase domain-containing protein 17 (159-167)
TKDKRMLVY

SEQ ID NO: 18613 - protein, 9 aa, Artificial Sequence
  Ras GTPase-activating-like protein IQGAP2 (912-920)
TKFMDTVIF

SEQ ID NO: 18614 - protein, 9 aa, Artificial Sequence
  Vigilin (613-621)
TKIDLPAEN

SEQ ID NO: 18615 - protein, 11 aa, Artificial Sequence
  Vigilin (613-623)
TKIDLPAENSN

SEQ ID NO: 18616 - protein, 9 aa, Artificial Sequence
  Vesicular integral-membrane protein VIP36 (290-298)
TKIEPSVNF

SEQ ID NO: 18617 - protein, 9 aa, Artificial Sequence
  Ubiquitin carboxyl-terminal hydrolase 33 (627-635)
TKISTHVSF

SEQ ID NO: 18618 - protein, 9 aa, Artificial Sequence
  Nucleoprotein TPR (712-720)
TKISTQLDF

SEQ ID NO: 18619 - protein, 12 aa, Artificial Sequence
  Eukaryotic translation initiation factor 4 gamma 1 (1070-1081)
TKITKPGSIDSN

SEQ ID NO: 18620 - protein, 9 aa, Artificial Sequence
  Pre-mRNA-processing factor 19 (264-272)
TKKVTSVVF

SEQ ID NO: 18621 - protein, 9 aa, Artificial Sequence
  Serine/threonine-protein kinase 24 (105-113)
TKLWIIMEY

SEQ ID NO: 18622 - protein, 9 aa, Artificial Sequence
  Parafibromin (282-290)
TKQPIPAAY

SEQ ID NO: 18623 - protein, 9 aa, Artificial Sequence
  Cerebral cavernous malformations 2 protein (253-261)
TKVDIKETY

SEQ ID NO: 18624 - protein, 9 aa, Artificial Sequence
  S-adenosylmethionine synthase isoform type-2 (288-296)
TKVDRSAAY

SEQ ID NO: 18625 - protein, 9 aa, Artificial Sequence
  ER membrane protein complex subunit 3 (138-146)
TKVPFPLTL

SEQ ID NO: 18626 - protein, 10 aa, Artificial Sequence
  ATP-binding cassette sub-family F member 2 (592-601)
TKWPGDILAY

SEQ ID NO: 18627 - protein, 9 aa, Artificial Sequence
  60S ribosomal protein L17 (45-53)
TKYLKDVTL

SEQ ID NO: 18628 - protein, 8 aa, Artificial Sequence
  DNA dC-dU-editing enzyme APOBEC-3C (84-91)
TKYQVTWY

SEQ ID NO: 18629 - protein, 10 aa, Artificial Sequence
  Tetratricopeptide repeat protein 27 (205-214)
TLAENCIDQV

SEQ ID NO: 18630 - protein, 9 aa, Artificial Sequence
  Proliferation-associated protein 2G4 (386-394)
TLEENEAGD

SEQ ID NO: 18631 - protein, 9 aa, Artificial Sequence
  Protein FAM185A (259-267)
TLGSVHGNI

SEQ ID NO: 18632 - protein, 12 aa, Artificial Sequence
  60S ribosomal protein L23a (126-137)
TLIRPDGEKKAY

SEQ ID NO: 18633 - protein, 9 aa, Artificial Sequence
  Transcription elongation factor SPT6 (835-843)
TLKKFLLNK

SEQ ID NO: 18634 - protein, 9 aa, Artificial Sequence
  AP-5 complex subunit mu-1 (115-123)
TLSPRPPLI

SEQ ID NO: 18635 - protein, 9 aa, Artificial Sequence
  40S ribosomal protein S7 (121-129)
TLTAVHDAI

SEQ ID NO: 18636 - protein, 11 aa, Artificial Sequence
  40S ribosomal protein S7 (121-131)
TLTAVHDAILE

SEQ ID NO: 18637 - protein, 12 aa, Artificial Sequence
  Translocating chain-associated membrane protein 1 (357-368)
TLTSNVADSPRN

SEQ ID NO: 18638 - protein, 12 aa, Artificial Sequence
  Peptidyl-prolyl cis-trans isomerase FKBP1A (97-108)
TLVFDVELLKLE

SEQ ID NO: 18639 - protein, 9 aa, Artificial Sequence
  Serine/threonine-protein kinase RIO2 (243-251)
TMIDFPQMV

SEQ ID NO: 18640 - protein, 10 aa, Artificial Sequence
  CDC42 small effector protein 1 (26-35)
TMIGEPMNFV

SEQ ID NO: 18641 - protein, 12 aa, Artificial Sequence
  Far upstream element-binding protein 2 (277-288)
TNVDKPLRIIGD

SEQ ID NO: 18642 - protein, 12 aa, Artificial Sequence
  Cell division cycle 5-like protein (373-384)
TNVDTPLKGGLN

SEQ ID NO: 18643 - protein, 10 aa, Artificial Sequence
  Vacuolar protein sorting-associated protein VTA1 homolog (224-233)
TPAEVPHSTG

SEQ ID NO: 18644 - protein, 12 aa, Artificial Sequence
  Vacuolar protein sorting-associated protein VTA1 homolog (224-235)
TPAEVPHSTGVA

SEQ ID NO: 18645 - protein, 10 aa, Artificial Sequence
  Polyadenylate-binding protein 1 (502-511)
TPAVRTVPQY

SEQ ID NO: 18646 - protein, 8 aa, Artificial Sequence
  Ubiquitin-associated protein 2-like (952-959)
TPFQQPSG

SEQ ID NO: 18647 - protein, 9 aa, Artificial Sequence
  IST1 homolog (241-249)
TPFSYPLPK

SEQ ID NO: 18648 - protein, 11 aa, Artificial Sequence
  IST1 homolog (241-251)
TPFSYPLPKGP

SEQ ID NO: 18649 - protein, 12 aa, Artificial Sequence
  TBC1 domain family member 30 (869-880)
TPIFSPFPSVKP

SEQ ID NO: 18650 - protein, 8 aa, Artificial Sequence
  Eukaryotic translation initiation factor 4 gamma 1 (647-654)
TPLRPLDP

SEQ ID NO: 18651 - protein, 9 aa, Artificial Sequence
  Eukaryotic translation initiation factor 4 gamma 1 (647-655)
TPLRPLDPT

SEQ ID NO: 18652 - protein, 10 aa, Artificial Sequence
  Eukaryotic translation initiation factor 4 gamma 1 (647-656)
TPLRPLDPTR

SEQ ID NO: 18653 - protein, 11 aa, Artificial Sequence
  Eukaryotic translation initiation factor 4 gamma 1 (647-657)
TPLRPLDPTRL

SEQ ID NO: 18654 - protein, 12 aa, Artificial Sequence
  Intercellular adhesion molecule 1 (521-532)
TPMKPNTQATPP

SEQ ID NO: 18655 - protein, 12 aa, Artificial Sequence
  Vesicular, overexpressed in cancer, prosurvival protein 1 (160-171)
TPPPPYEQVVKA

SEQ ID NO: 18656 - protein, 12 aa, Artificial Sequence
  GTPase-activating protein and VPS9 domain-containing protein 1 (462-473)
TPQLSPATTPAN

SEQ ID NO: 18657 - protein, 9 aa, Artificial Sequence
  Translocating chain-associated membrane protein 2 (334-342)
TPRLPARLI

SEQ ID NO: 18658 - protein, 9 aa, Artificial Sequence
  Target of Nesh-SH3 (160-168)
TPRPTGTPL

SEQ ID NO: 18659 - protein, 12 aa, Artificial Sequence
  Acidic leucine-rich nuclear phosphoprotein 32 family member A (15-26)
TPSDVKELVLDN

SEQ ID NO: 18660 - protein, 11 aa, Artificial Sequence
  ATP-dependent RNA helicase A (18-28)
TPSYEIRAVGN

SEQ ID NO: 18661 - protein, 9 aa, Artificial Sequence
  Protein DENND6A (343-351)
TQAPPSVIL

SEQ ID NO: 18662 - protein, 9 aa, Artificial Sequence
  Gamma-glutamyltranspeptidase 1 (475-483)
TQITTATAL

SEQ ID NO: 18663 - protein, 9 aa, Artificial Sequence
  Disks large homolog 5 (356-364)
TQQRDTAIQ

SEQ ID NO: 18664 - protein, 9 aa, Artificial Sequence
  U3 small nucleolar RNA-associated protein 14 homolog A (567-575)
TQSPSVKSL

SEQ ID NO: 18665 - protein, 9 aa, Artificial Sequence
  Splicing factor 1 (362-370)
TQSRPPWMN

SEQ ID NO: 18666 - protein, 11 aa, Artificial Sequence
  Serine/threonine-protein kinase VRK1 (378-388)
TQTEEAIQTRS

SEQ ID NO: 18667 - protein, 8 aa, Artificial Sequence
  Elongation factor 1-gamma (409-416)
TQTLVREY

SEQ ID NO: 18668 - protein, 9 aa, Artificial Sequence
  Nucleolar protein 58 (259-267)
TQVIEISEY

SEQ ID NO: 18669 - protein, 9 aa, Artificial Sequence
  Lon protease homolog 2, peroxisomal (556-564)
TREAGVRSL

SEQ ID NO: 18670 - protein, 11 aa, Artificial Sequence
  Fibronectin type III domain-containing protein 3B (182-192)
TREDQYSKPPH

SEQ ID NO: 18671 - protein, 9 aa, Artificial Sequence
  Myotubularin-related protein 10 (495-503)
TRISLFGTF

SEQ ID NO: 18672 - protein, 9 aa, Artificial Sequence
  Uncharacterized protein DKFZp434B061 (517-525)
TRSPPTASL

SEQ ID NO: 18673 - protein, 9 aa, Artificial Sequence
  Putative coiled-coil-helix-coiled-coil-helix domain-containing protein CHCHD2P9, mitochondrial (9-17)
TSRMAPPAS

SEQ ID NO: 18674 - protein, 10 aa, Artificial Sequence
  Splicing factor 1 (361-370)
TTQSRPPWMN

SEQ ID NO: 18675 - protein, 9 aa, Artificial Sequence
  Ubiquitin carboxyl-terminal hydrolase 22 (424-432)
TYVSFPLEL

SEQ ID NO: 18676 - protein, 9 aa, Artificial Sequence
  Ataxin-7 (448-456)
VEKHLNAQL

SEQ ID NO: 18677 - protein, 9 aa, Artificial Sequence
  X-ray repair cross-complementing protein 6 (231-239)
VHFEESSKL

SEQ ID NO: 18678 - protein, 9 aa, Artificial Sequence
  Sorting nexin-19 (246-254)
VILPLISRL

SEQ ID NO: 18679 - protein, 9 aa, Artificial Sequence
  Eukaryotic translation initiation factor 3 subunit G (59-67)
VINGNIKTV

SEQ ID NO: 18680 - protein, 9 aa, Artificial Sequence
  Inositol-tetrakisphosphate 1-kinase (261-269)
VIRELSRAL

SEQ ID NO: 18681 - protein, 9 aa, Artificial Sequence
  Serine/threonine-protein phosphatase 2A 65 kDa regulatory subunit A beta isoform (174-182)
VKAEIRQQF

SEQ ID NO: 18682 - protein, 9 aa, Artificial Sequence
  T-complex protein 1 subunit theta (234-242)
VKDAKIAVY

SEQ ID NO: 18683 - protein, 9 aa, Artificial Sequence
  Nodal modulator 2 (43-51)
VKSDVEINY

SEQ ID NO: 18684 - protein, 9 aa, Artificial Sequence
  Elongation factor 2 (480-488)
VKTGTITTF

SEQ ID NO: 18685 - protein, 9 aa, Artificial Sequence
  Alpha/beta hydrolase domain-containing protein 14B (150-158)
VKTPALIVY

SEQ ID NO: 18686 - protein, 9 aa, Artificial Sequence
  Eukaryotic translation initiation factor 3 subunit E (278-286)
VKVIQQESY

SEQ ID NO: 18687 - protein, 9 aa, Artificial Sequence
  Exocyst complex component 3 (40-48)
VLQRSLVTV

SEQ ID NO: 18688 - protein, 9 aa, Artificial Sequence
  HLA class II histocompatibility antigen, DRB1-11 beta chain (21-29)
VLSSPLALA

SEQ ID NO: 18689 - protein, 9 aa, Artificial Sequence
  Cytoplasmic dynein 1 heavy chain 1 (1684-1692)
VMFKTPVSI

SEQ ID NO: 18690 - protein, 9 aa, Artificial Sequence
  HEAT repeat-containing protein 1 (171-179)
VPLAKGTLI

SEQ ID NO: 18691 - protein, 9 aa, Artificial Sequence
  DNA-(apurinic or apyrimidinic site) lyase (172-180)
VPNAGRGLV

SEQ ID NO: 18692 - protein, 9 aa, Artificial Sequence
  DDB1- and CUL4-associated factor 13 (189-197)
VPREYIRAL

SEQ ID NO: 18693 - protein, 10 aa, Artificial Sequence
  Transketolase (505-514)
VPRSGKPAEL

SEQ ID NO: 18694 - protein, 9 aa, Artificial Sequence
  Calcineurin-binding protein cabin-1 (1016-1024)
VPRTERPAL

SEQ ID NO: 18695 - protein, 9 aa, Artificial Sequence
  ATP-dependent RNA helicase DDX24 (664-672)
VPRTSEIYV

SEQ ID NO: 18696 - protein, 9 aa, Artificial Sequence
  Transient receptor potential cation channel subfamily V member 2 (284-292)
VQLEDIRNL

SEQ ID NO: 18697 - protein, 9 aa, Artificial Sequence
  Putative eukaryotic translation initiation factor 2 subunit 3-like protein (234-242)
VVCEYIVKK

SEQ ID NO: 18698 - protein, 9 aa, Artificial Sequence
  ATP-citrate synthase (56-64)
VVKPDQLIK

SEQ ID NO: 18699 - protein, 9 aa, Artificial Sequence
  U4/U6 small nuclear ribonucleoprotein Prp31 (433-441)
VVYGGKSTI

SEQ ID NO: 18700 - protein, 9 aa, Artificial Sequence
  Integrin beta-7 (770-778)
WKQDSNPLY

SEQ ID NO: 18701 - protein, 8 aa, Artificial Sequence
  Heterogeneous nuclear ribonucleoprotein U (421-428)
YAKNGQDL

SEQ ID NO: 18702 - protein, 9 aa, Artificial Sequence
  Eukaryotic translation initiation factor 2 subunit 3 (83-91)
YANAKIYKL

SEQ ID NO: 18703 - protein, 9 aa, Artificial Sequence
  Pyruvate kinase PKM (83-91)
YHAETIKNV

SEQ ID NO: 18704 - protein, 9 aa, Artificial Sequence
  Interferon-induced GTP-binding protein Mx1 (584-592)
YHQEASKRI

SEQ ID NO: 18705 - protein, 10 aa, Artificial Sequence
  60S ribosomal protein L15 (53-62)
YKAKQGYVIY

SEQ ID NO: 18706 - protein, 9 aa, Artificial Sequence
  Bifunctional glutamate/proline-tRNA ligase (791-799)
YKEKTGQEY

SEQ ID NO: 18707 - protein, 10 aa, Artificial Sequence
  Eukaryotic translation initiation factor 3 subunit G (70-79)
YKIDEDGKKF

SEQ ID NO: 18708 - protein, 9 aa, Artificial Sequence
  Elongation factor 1-alpha 1 (254-262)
YKIGGIGTV

SEQ ID NO: 18709 - protein, 8 aa, Artificial Sequence
  Coatomer subunit alpha (73-80)
YKIKVWNY

SEQ ID NO: 18710 - protein, 8 aa, Artificial Sequence
  60S ribosomal protein L5 (219-226)
YKKQFSQY

SEQ ID NO: 18711 - protein, 9 aa, Artificial Sequence
  Eukaryotic translation initiation factor 3 subunit B (253-261)
YKLDKQHTF

SEQ ID NO: 18712 - protein, 9 aa, Artificial Sequence
  Cathepsin B (219-227)
YKQDKHYGY

SEQ ID NO: 18713 - protein, 12 aa, Artificial Sequence
  Peroxisomal carnitine O-octanoyltransferase (254-265)
YLIGLDPENLAL

SEQ ID NO: 18714 - protein, 9 aa, Artificial Sequence
  Putative ATP-dependent RNA helicase DDX11-like protein 8 (448-456)
YLLEKFVAV

SEQ ID NO: 18715 - protein, 10 aa, Artificial Sequence
  G1/S-specific cyclin-E1 (243-252)
YLNDLHEVLL

SEQ ID NO: 18716 - protein, 9 aa, Artificial Sequence
  DNA replication complex GINS protein PSF1 (79-87)
YLYDRLLRI

SEQ ID NO: 18717 - protein, 9 aa, Artificial Sequence
  Adenomatous polyposis coli protein (899-907)
YPADLAHKI

SEQ ID NO: 18718 - protein, 9 aa, Artificial Sequence
  Cathepsin D (203-211)
YPRISVNNV

SEQ ID NO: 18719 - protein, 9 aa, Artificial Sequence
  Dolichyl-diphosphooligosaccharide-proteinosyltransferase subunit 2 (53-61)
YSIVGLSSL

SEQ ID NO: 18720 - protein, 9 aa, Artificial Sequence
  Staphylococcal nuclease domain-containing protein 1 (178-186)
YTIENPRHF

SEQ ID NO: 18721 - protein, 9 aa, Artificial Sequence
  Glycogen synthase kinase-3 beta (134-142)
YVPETVYRV

SEQ ID NO: 18722 - protein, 9 aa, Artificial Sequence
  Titin (24337-24345)
ESDPIVAQY

SEQ ID NO: 18723 - protein, 8 aa, Artificial Sequence
  Thymidylate synthase (255-262)
AHIYLNHI

SEQ ID NO: 18724 - protein, 8 aa, Artificial Sequence
  Store-operated calcium entry-associated regulatory factor (104-111)
AYKFGKTV

SEQ ID NO: 18725 - protein, 9 aa, Artificial Sequence
  Junction plakoglobin (136-144)
DAELATRAL

SEQ ID NO: 18726 - protein, 8 aa, Artificial Sequence
  U1 small nuclear ribonucleoprotein 70 kDa (100-107)
DAFKTLFV

SEQ ID NO: 18727 - protein, 8 aa, Artificial Sequence
  Interferon-induced helicase C domain-containing protein 1 (514-521)
DAFTIKTV

SEQ ID NO: 18728 - protein, 8 aa, Artificial Sequence
  Gamma-interferon-inducible protein 16 (59-66)
DAGLGKLI

SEQ ID NO: 18729 - protein, 9 aa, Artificial Sequence
  Ubiquitin carboxyl-terminal hydrolase 30 (44-52)
DAHELFHVI

SEQ ID NO: 18730 - protein, 9 aa, Artificial Sequence
  Ubiquitin carboxyl-terminal hydrolase 51 (682-690)
DAIITKATI

SEQ ID NO: 18731 - protein, 9 aa, Artificial Sequence
  ATP-dependent RNA helicase DDX50 (215-223)
DAIRSLASV

SEQ ID NO: 18732 - protein, 9 aa, Artificial Sequence
  WD repeat-containing protein 11 (348-356)
DAIRVTKTV

SEQ ID NO: 18733 - protein, 9 aa, Artificial Sequence
  Protein disulfide-isomerase TMX3 (362-370)
DAKSTIVSI

SEQ ID NO: 18734 - protein, 9 aa, Artificial Sequence
  Cell division cycle protein 16 homolog (426-434)
DALEKIKAI

SEQ ID NO: 18735 - protein, 8 aa, Artificial Sequence
  Protein FAM127A (61-68)
DALKVTFL

SEQ ID NO: 18736 - protein, 9 aa, Artificial Sequence
  Glucosamine-6-phosphate isomerase 2 (125-133)
DAREVMILI

SEQ ID NO: 18737 - protein, 9 aa, Artificial Sequence
  Little elongation complex subunit 2 (170-178)
DARLFTEKI

SEQ ID NO: 18738 - protein, 10 aa, Artificial Sequence
  Myotubularin (299-308)
DAYHNAELFF

SEQ ID NO: 18739 - protein, 9 aa, Artificial Sequence
  C-Jun-amino-terminal kinase-interacting protein 4 (932-940)
DAYKDQISV

SEQ ID NO: 18740 - protein, 9 aa, Artificial Sequence
  Interleukin-1 receptor accessory protein-like 1 (406-414)
DAYLSYTKV

SEQ ID NO: 18741 - protein, 8 aa, Artificial Sequence
  T-complex protein 1 subunit eta (49-56)
DGATILKL

SEQ ID NO: 18742 - protein, 8 aa, Artificial Sequence
  Non-specific lipid-transfer protein (348-355)
DGFKANLV

SEQ ID NO: 18743 - protein, 8 aa, Artificial Sequence
  Ankyrin-1 (176-183)
DGFTPLAV

SEQ ID NO: 18744 - protein, 8 aa, Artificial Sequence
  Transmembrane protein 106C (116-123)
DGIKVVKV

SEQ ID NO: 18745 - protein, 8 aa, Artificial Sequence
  Retrotransposon-derived protein PEG10 (644-651)
DGLITPTI

SEQ ID NO: 18746 - protein, 9 aa, Artificial Sequence
  Phosphatidate phosphatase LPIN1 (456-464)
DGLRDLPSI

SEQ ID NO: 18747 - protein, 8 aa, Artificial Sequence
  Phosphatidylinositol transfer protein alpha isoform (159-166)
DPAKFKSI

SEQ ID NO: 18748 - protein, 9 aa, Artificial Sequence
  Structural maintenance of chromosomes protein 3 (21-29)
DPFSSKHNV

SEQ ID NO: 18749 - protein, 8 aa, Artificial Sequence
  Interferon regulatory factor 4 (120-127)
DPYKVYRI

SEQ ID NO: 18750 - protein, 9 aa, Artificial Sequence
  Interferon regulatory factor 4 (120-128)
DPYKVYRIV

SEQ ID NO: 18751 - protein, 8 aa, Artificial Sequence
  Plectin (4002-4009)
DPYSGKLI

SEQ ID NO: 18752 - protein, 9 aa, Artificial Sequence
  All-trans-retinol 13,14-reductase (23-31)
IAFHTIPVI

SEQ ID NO: 18753 - protein, 9 aa, Artificial Sequence
  Putative pre-mRNA-splicing factor ATP-dependent RNA helicase DHX16 (412-420)
IANHQVLII

SEQ ID NO: 18754 - protein, 9 aa, Artificial Sequence
  RNA-binding protein 12 (28-36)
IPDGGVHIV

SEQ ID NO: 18755 - protein, 9 aa, Artificial Sequence
  Integrator complex subunit 4 (508-516)
IPFSKPVKV

SEQ ID NO: 18756 - protein, 11 aa, Artificial Sequence
  14-3-3 protein zeta/delta (126-136)
IPNASQAESKV

SEQ ID NO: 18757 - protein, 8 aa, Artificial Sequence
  U5 small nuclear ribonucleoprotein 200 kDa helicase (821-828)
LPAHTVII

SEQ ID NO: 18758 - protein, 8 aa, Artificial Sequence
  Transportin-2 (392-399)
LPHLLPLL

SEQ ID NO: 18759 - protein, 9 aa, Artificial Sequence
  Histone-lysine N-methyltransferase SETD1A (1210-1218)
LPLDHASLV

SEQ ID NO: 18760 - protein, 9 aa, Artificial Sequence
  Polyhomeotic-like protein 3 (456-464)
LPLPASPVV

SEQ ID NO: 18761 - protein, 8 aa, Artificial Sequence
  Microphthalmia-associated transcription factor (107-114)
LPPPGLTI

SEQ ID NO: 18762 - protein, 8 aa, Artificial Sequence
  Flotillin-2 (345-352)
LPQIAAKI

SEQ ID NO: 18763 - protein, 9 aa, Artificial Sequence
  G1/S-specific cyclin-D3 (98-106)
LPRDRQALV

SEQ ID NO: 18764 - protein, 9 aa, Artificial Sequence
  Cyclic AMP-dependent transcription factor ATF-6 beta (296-304)
LPRPERKSI

SEQ ID NO: 18765 - protein, 11 aa, Artificial Sequence
  Charged multivesicular body protein 2b (147-157)
LPSASTSKATI

SEQ ID NO: 18766 - protein, 8 aa, Artificial Sequence
  Msx2-interacting protein (1295-1302)
LPYSNITV

SEQ ID NO: 18767 - protein, 8 aa, Artificial Sequence
  LIM domain kinase 2 (146-153)
LPYSVTLI

SEQ ID NO: 18768 - protein, 9 aa, Artificial Sequence
  Isoleucine-tRNA ligase, cytoplasmic (986-994)
MAREVINRI

SEQ ID NO: 18769 - protein, 8 aa, Artificial Sequence
  Probable ATP-dependent RNA helicase DHX37 (780-787)
NAYKTPLL

SEQ ID NO: 18770 - protein, 9 aa, Artificial Sequence
  Ubiquitin D (25-33)
NPYDSVKKI

SEQ ID NO: 18771 - protein, 10 aa, Artificial Sequence
  Host cell factor 1 (1378-1387)
PDATSSHRTV

SEQ ID NO: 18772 - protein, 8 aa, Artificial Sequence
  Queuine tRNA-ribosyltransferase subunit QTRTD1 (121-128)
PEDKPRLI

SEQ ID NO: 18773 - protein, 9 aa, Artificial Sequence
  Zinc finger and BTB domain-containing protein 7B (219-227)
PLPPPPPPP

SEQ ID NO: 18774 - protein, 8 aa, Artificial Sequence
  E3 ubiquitin-protein ligase UBR5 (666-673)
PVGKVLKV

SEQ ID NO: 18775 - protein, 9 aa, Artificial Sequence
  Probable ATP-dependent RNA helicase DDX5 (308-316)
SANHNILQI

SEQ ID NO: 18776 - protein, 8 aa, Artificial Sequence
  Lys-63-specific deubiquitinase BRCC36 (236-243)
SAVELPKI

SEQ ID NO: 18777 - protein, 9 aa, Artificial Sequence
  A-kinase anchor protein 9 (740-748)
SDAYQTREI

SEQ ID NO: 18778 - protein, 9 aa, Artificial Sequence
  WD repeat-containing protein 35 (500-508)
TASDKILIV

SEQ ID NO: 18779 - protein, 8 aa, Artificial Sequence
  Ubiquitin carboxyl-terminal hydrolase 36 (521-528)
TPTHMPTI

SEQ ID NO: 18780 - protein, 9 aa, Artificial Sequence
  DNA damage-binding protein 1 (463-471)
VAHQQLIQI

SEQ ID NO: 18781 - protein, 9 aa, Artificial Sequence
  Something about silencing protein 10 (290-298)
VPAHGHPVI

SEQ ID NO: 18782 - protein, 9 aa, Artificial Sequence
  RING finger protein unkempt homolog (549-557)
VPHPGSITI

SEQ ID NO: 18783 - protein, 9 aa, Artificial Sequence
  Ecto-NOX disulfide-thiol exchanger 1 (100-108)
VPPPPPTEV

SEQ ID NO: 18784 - protein, 9 aa, Artificial Sequence
  Epidermal growth factor receptor kinase substrate 8 (711-719)
VPRQNVPVI

SEQ ID NO: 18785 - protein, 8 aa, Artificial Sequence
  NEDD8-conjugating enzyme Ubc12 (86-93)
YPHDPPKV

SEQ ID NO: 18786 - protein, 8 aa, Artificial Sequence
  Protein SMG7 (359-366)
YPLPAVKV

SEQ ID NO: 18787 - protein, 8 aa, Artificial Sequence
  Nicotinamide phosphoribosyltransferase (26-33)
YPPNTSKV

SEQ ID NO: 18788 - protein, 9 aa, Artificial Sequence
  E3 ubiquitin-protein ligase RNF144A (27-35)
YPVEQMTTI

SEQ ID NO: 18789 - protein, 8 aa, Artificial Sequence
  Elongation of very long chain fatty acids protein 1 (202-209)
YPVIIHLI

SEQ ID NO: 18790 - protein, 9 aa, Artificial Sequence
  Mediator of RNA polymerase II transcription subunit 15 (438-446)
ARTPQNFSV

SEQ ID NO: 18791 - protein, 10 aa, Artificial Sequence
  Tubulin beta chain (335-344)
AVFRGRMSMK

SEQ ID NO: 18792 - protein, 16 aa, Artificial Sequence
  Myosin regulatory light chain 12A (110-125)
DEEATGTIQEDYLREL

SEQ ID NO: 18793 - protein, 16 aa, Artificial Sequence
  MARCKS-related protein (153-168)
EPQAKGAEASAASEEE

SEQ ID NO: 18794 - protein, 9 aa, Artificial Sequence
  Cytochrome c oxidase subunit 7C, mitochondrial (49-57)
FATPFLVVR

SEQ ID NO: 18795 - protein, 19 aa, Artificial Sequence
  Cytochrome c oxidase subunit 8A, mitochondrial (26-44)
FLLPAGWILSHLETYRRPE

SEQ ID NO: 18796 - protein, 15 aa, Artificial Sequence
  Disintegrin and metalloproteinase domain-containing protein 10 (292-306)
FPNIGVEKFLELNSE

SEQ ID NO: 18797 - protein, 9 aa, Artificial Sequence
  Hermansky-Pudlak syndrome 5 protein (380-388)
FQNSVIASR

SEQ ID NO: 18798 - protein, 10 aa, Artificial Sequence
  NADH dehydrogenase (ubiquinone) flavoprotein 3, mitochondrial (107-116)
FTDEGVPKFL

SEQ ID NO: 18799 - protein, 16 aa, Artificial Sequence
  Myristoylated alanine-rich C-kinase substrate (191-206)
GGKDEAAGGAAAAAAE

SEQ ID NO: 18800 - protein, 13 aa, Artificial Sequence
  Heat shock cognate 71 kDa protein (484-496)
GILNVSAVDKSTG

SEQ ID NO: 18801 - protein, 16 aa, Artificial Sequence
  Heat shock cognate 71 kDa protein (484-499)
GILNVSAVDKSTGKEN

SEQ ID NO: 18802 - protein, 15 aa, Artificial Sequence
  Myristoylated alanine-rich C-kinase substrate (192-206)
GKDEAAGGAAAAAAE

SEQ ID NO: 18803 - protein, 16 aa, Artificial Sequence
  Gamma-secretase C-terminal fragment 59 (185-200)
GSEDKVVEVAEEEEVA

SEQ ID NO: 18804 - protein, 8 aa, Artificial Sequence
  26S proteasome non-ATPase regulatory subunit 12 (115-122)
ITDLPIKL

SEQ ID NO: 18805 - protein, 14 aa, Artificial Sequence
  Myristoylated alanine-rich C-kinase substrate (193-206)
KDEAAGGAAAAAAE

SEQ ID NO: 18806 - protein, 17 aa, Artificial Sequence
  NEDD4 family-interacting protein 1 (63-79)
KPPSYNVATTLPSYDEA

SEQ ID NO: 18807 - protein, 14 aa, Artificial Sequence
  HLA class I histocompatibility antigen, A-24 alpha chain (143-156)
KRKWEAAHVAEQQR

SEQ ID NO: 18808 - protein, 13 aa, Artificial Sequence
  Glyceraldehyde-3-phosphate dehydrogenase (27-39)
KVDIVAINDPFID

SEQ ID NO: 18809 - protein, 18 aa, Artificial Sequence
  Cytochrome c oxidase subunit 8A, mitochondrial (27-44)
LLPAGWILSHLETYRRPE

SEQ ID NO: 18810 - protein, 14 aa, Artificial Sequence
  HLA class I histocompatibility antigen, Cw-7 alpha chain (154-167)
LRSWTAADTAAQIT

SEQ ID NO: 18811 - protein, 16 aa, Artificial Sequence
  HLA class I histocompatibility antigen, B-15 alpha chain (239-254)
LTWQRDGEDQTQDTEL

SEQ ID NO: 18812 - protein, 18 aa, Artificial Sequence
  HLA class I histocompatibility antigen, B-15 alpha chain (239-256)
LTWQRDGEDQTQDTELVE

SEQ ID NO: 18813 - protein, 23 aa, Artificial Sequence
  NADH dehydrogenase (ubiquinone) 1 alpha subcomplex subunit 8 (150-172)
PSPEIEGDLQPATHGSRFYFWTK

SEQ ID NO: 18814 - protein, 9 aa, Artificial Sequence
  Probable ATP-dependent RNA helicase DDX47 (371-379)
QRIEHLIGK

SEQ ID NO: 18815 - protein, 10 aa, Artificial Sequence
  Ras GTPase-activating-like protein IQGAP3 (482-491)
QRYFDALLKL

SEQ ID NO: 18816 - protein, 9 aa, Artificial Sequence
  Prelamin-A/C (213-221)
QSRIRIDSL

SEQ ID NO: 18817 - protein, 9 aa, Artificial Sequence
  Proteasome subunit beta type-2 (170-178)
RFILNLPTF

SEQ ID NO: 18818 - protein, 10 aa, Artificial Sequence
  Unconventional myosin-IXa (1043-1052)
RQASVIIQRF

SEQ ID NO: 18819 - protein, 12 aa, Artificial Sequence
  DNA polymerase delta subunit 3 (416-427)
RQVSITGFFQRK

SEQ ID NO: 18820 - protein, 10 aa, Artificial Sequence
  Calcipressin-1 (161-170)
RRPEYTPIHL

SEQ ID NO: 18821 - protein, 15 aa, Artificial Sequence
  Glyceraldehyde-3-phosphate dehydrogenase (25-39)
SGKVDIVAINDPFID

SEQ ID NO: 18822 - protein, 9 aa, Artificial Sequence
  Mitotic checkpoint serine/threonine-protein kinase BUB1 beta (486-494)
SQKIPGMTL

SEQ ID NO: 18823 - protein, 15 aa, Artificial Sequence
  HLA class I histocompatibility antigen, B-15 alpha chain (155-169)
SSWTAADTAAQITQR

SEQ ID NO: 18824 - protein, 11 aa, Artificial Sequence
  L-lactate dehydrogenase A chain (255-265)
SVADLAESIMK

SEQ ID NO: 18825 - protein, 15 aa, Artificial Sequence
  IST1 homolog (278-292)
TPPSYESVDDINADK

SEQ ID NO: 18826 - protein, 16 aa, Artificial Sequence
  IST1 homolog (278-293)
TPPSYESVDDINADKN

SEQ ID NO: 18827 - protein, 9 aa, Artificial Sequence
  Palladin (534-542)
VADGYPVRL

SEQ ID NO: 18828 - protein, 10 aa, Artificial Sequence
  Interferon-induced transmembrane protein 2 (89-98)
VGDVTGAQAY

SEQ ID NO: 18829 - protein, 20 aa, Artificial Sequence
  78 kDa glucose-regulated protein (425-444)
VPTKKSQIFSTASDNQPTVT

SEQ ID NO: 18830 - protein, 21 aa, Artificial Sequence
  Cytochrome c oxidase subunit 8A, mitochondrial (24-44)
VTFLLPAGWILSHLETYRRPE

SEQ ID NO: 18831 - protein, 14 aa, Artificial Sequence
  Alpha-enolase (70-83)
VVIGMDVAASEFFR

SEQ ID NO: 18832 - protein, 16 aa, Artificial Sequence
  HLA class I histocompatibility antigen, B-15 alpha chain (241-256)
WQRDGEDQTQDTELVE

SEQ ID NO: 18833 - protein, 14 aa, Artificial Sequence
  Vesicle-fusing ATPase (118-131)
AAEFIQQFNNQAFS

SEQ ID NO: 18834 - protein, 15 aa, Artificial Sequence
  Moesin (14-28)
AELEFAIQPNTTGKQ

SEQ ID NO: 18835 - protein, 16 aa, Artificial Sequence
  Moesin (13-28)
DAELEFAIQPNTTGKQ

SEQ ID NO: 18836 - protein, 15 aa, Artificial Sequence
  Dihydropyrimidinase-related protein 2 (340-354)
DENQFVAVTSTNAAK

SEQ ID NO: 18837 - protein, 16 aa, Artificial Sequence
  Dihydropyrimidinase-related protein 2 (340-355)
DENQFVAVTSTNAAKV

SEQ ID NO: 18838 - protein, 11 aa, Artificial Sequence
  Putative ATP-dependent RNA helicase DHX33 (87-97)
EAISDSLLRKY

SEQ ID NO: 18839 - protein, 9 aa, Artificial Sequence
  Ubiquitin-associated protein 2-like (88-96)
EGNPDTHSW

SEQ ID NO: 18840 - protein, 14 aa, Artificial Sequence
  Moesin (15-28)
ELEFAIQPNTTGKQ

SEQ ID NO: 18841 - protein, 16 aa, Artificial Sequence
  Acylamino-acid-releasing enzyme (440-455)
GQDSILSLPGNVGHQD

SEQ ID NO: 18842 - protein, 15 aa, Artificial Sequence
  Serine/threonine-protein phosphatase 2A 65 kDa regulatory subunit A alpha isoform (202-216)
KSEIIPMFSNLASDE

SEQ ID NO: 18843 - protein, 9 aa, Artificial Sequence
  60 kDa heat shock protein, mitochondrial (397-405)
LSDGVAVLK

SEQ ID NO: 18844 - protein, 14 aa, Artificial Sequence
  Disintegrin and metalloproteinase domain-containing protein 10 (83-96)
SDEFKVETSNKVLD

SEQ ID NO: 18845 - protein, 15 aa, Artificial Sequence
  Peptidyl-prolyl cis-trans isomerase A (77-91)
SIYGEKFEDENFILK

SEQ ID NO: 18846 - protein, 16 aa, Artificial Sequence
  Serine/threonine-protein phosphatase 2A 65 kDa regulatory subunit A alpha isoform (201-216)
VKSEIIPMFSNLASDE

SEQ ID NO: 18847 - protein, 17 aa, Artificial Sequence
  Serine/threonine-protein phosphatase 2A 65 kDa regulatory subunit A alpha isoform (201-217)
VKSEIIPMFSNLASDEQ

SEQ ID NO: 18848 - protein, 14 aa, Artificial Sequence
  Solute carrier family 2, facilitated glucose transporter member 1 (140-153)
VPMYVGEVSPTALR

SEQ ID NO: 18849 - protein, 15 aa, Artificial Sequence
  Glyceraldehyde-3-phosphate dehydrogenase (116-130)
AKRVIISAPSADAPM

SEQ ID NO: 18850 - protein, 15 aa, Artificial Sequence
  Glyceraldehyde-3-phosphate dehydrogenase (202-216)
ALQNIIPASTGAAKA

SEQ ID NO: 18851 - protein, 15 aa, Artificial Sequence
  60 kDa heat shock protein, mitochondrial (35-49)
DARALMLQGVDLLAD

SEQ ID NO: 18852 - protein, 15 aa, Artificial Sequence
  Tubulin beta-4B chain (22-36)
EVISDEHGIDPTGTY

SEQ ID NO: 18853 - protein, 15 aa, Artificial Sequence
  Glyceraldehyde-3-phosphate dehydrogenase (269-283)
ISWYDNEFGYSNRVV

SEQ ID NO: 18854 - protein, 8 aa, Artificial Sequence
  RNA cytidine acetyltransferase (478-485)
DAPAHHLF

SEQ ID NO: 18855 - protein, 29 aa, Artificial Sequence
  Alpha-synuclein (103-131)
NEEGAPQEGILEDMPVDPDNEAYEMPSEE

SEQ ID NO: 18856 - protein, 5 aa, Artificial Sequence
  Carbonic anhydrase 2 (85-89)
DGTYR

SEQ ID NO: 18857 - protein, 5 aa, Artificial Sequence
  Carbonic anhydrase 2 (155-159)
GLQKV

SEQ ID NO: 18858 - protein, 5 aa, Artificial Sequence
  Carbonic anhydrase 2 (22-26)
IAKGE

SEQ ID NO: 18859 - protein, 5 aa, Artificial Sequence
  Carbonic anhydrase 2 (253-257)
RQIKA

SEQ ID NO: 18860 - protein, 5 aa, Artificial Sequence
  Carbonic anhydrase 2 (218-222)
SSEQV

SEQ ID NO: 18861 - protein, 15 aa, Artificial Sequence
  Complement factor H (1110-1124)
GPPPPIDNGDITSFP

SEQ ID NO: 18862 - protein, 11 aa, Artificial Sequence
  Complement factor H (1112-1122)
PPPIDNGDITS

SEQ ID NO: 18863 - protein, 10 aa, Artificial Sequence
  Glutathione peroxidase 1 (7-16)
AAAAAAQSVY

SEQ ID NO: 18864 - protein, 12 aa, Artificial Sequence
  RalBP1-associated Eps domain-containing protein 2 (13-24)
AAAAAGGGCGSG

SEQ ID NO: 18865 - protein, 25 aa, Artificial Sequence
  Pre-mRNA-processing factor 40 homolog A (251-275)
AAAAVVAAAAAAAAAAAAANANAST

SEQ ID NO: 18866 - protein, 11 aa, Artificial Sequence
  Cytochrome b-c1 complex subunit 9 (2-12)
AAATLTSKLYS

SEQ ID NO: 18867 - protein, 62 aa, Artificial Sequence
  Cytochrome b-c1 complex subunit 9 (2-63)
AAATLTSKLYSLLFRRTSTFALTIIVGVMFFERAFDQGADAIYDHINEGKLWKHIKHKYENK

SEQ ID NO: 18868 - protein, 9 aa, Artificial Sequence
  Semaphorin-3A (191-199)
AADFMGRDF

SEQ ID NO: 18869 - protein, 9 aa, Artificial Sequence
  60S ribosomal protein L28 (54-62)
AADGKGVVV

SEQ ID NO: 18870 - protein, 9 aa, Artificial Sequence
  Glia-derived nexin (209-217)
AADGKSYQV

SEQ ID NO: 18871 - protein, 9 aa, Artificial Sequence
  AF4/FMR2 family member 4 (993-1001)
AADKRLTVL

SEQ ID NO: 18872 - protein, 9 aa, Artificial Sequence
  Enhancer of mRNA-decapping protein 4 (854-862)
AADLNLVLY

SEQ ID NO: 18873 - protein, 14 aa, Artificial Sequence
  Core histone macro-H2A.2 (57-70)
AAEILELAGNAARD

SEQ ID NO: 18874 - protein, 15 aa, Artificial Sequence
  Melanotransferrin (591-605)
AAELRSEDYELLCPN

SEQ ID NO: 18875 - protein, 10 aa, Artificial Sequence
  Cholinesterase (211-220)
AAFGGNPKSV

SEQ ID NO: 18876 - protein, 9 aa, Artificial Sequence
  Phospholipid transfer protein (155-163)
AAFGGTFKK

SEQ ID NO: 18877 - protein, 9 aa, Artificial Sequence
  Bax inhibitor 1 (88-96)
AAGAYVHMV

SEQ ID NO: 18878 - protein, 13 aa, Artificial Sequence
  Ran-binding protein 9 (182-194)
AAGPGPAGGAPTP

SEQ ID NO: 18879 - protein, 15 aa, Artificial Sequence
  SKI family transcriptional corepressor 2 (519-533)
AAGSAEAAPPPGQPP

SEQ ID NO: 18880 - protein, 14 aa, Artificial Sequence
  Fatty acid synthase (859-872)
AAIYNIDTSSESPD

SEQ ID NO: 18881 - protein, 15 aa, Artificial Sequence
  Fatty acid synthase (859-873)
AAIYNIDTSSESPDH

SEQ ID NO: 18882 - protein, 16 aa, Artificial Sequence
  Fatty acid synthase (859-874)
AAIYNIDTSSESPDHY

SEQ ID NO: 18883 - protein, 8 aa, Artificial Sequence
  Spectrin beta chain, non-erythrocytic 4 (2141-2148)
AAKAAPLL

SEQ ID NO: 18884 - protein, 15 aa, Artificial Sequence
  Talin-1 (859-873)
AAKILADATAKMVEA

SEQ ID NO: 18885 - protein, 12 aa, Artificial Sequence
  Prohibitin (2-13)
AAKVFESIGKFG

SEQ ID NO: 18886 - protein, 14 aa, Artificial Sequence
  Prohibitin (2-15)
AAKVFESIGKFGLA

SEQ ID NO: 18887 - protein, 15 aa, Artificial Sequence
  Beta-secretase 2 (74-88)
AANFLAMVDNLQGDS

SEQ ID NO: 18888 - protein, 9 aa, Artificial Sequence
  Rho guanine nucleotide exchange factor 2 (516-524)
AAPPEMYEV

SEQ ID NO: 18889 - protein, 9 aa, Artificial Sequence
  Collagen alpha-1(VI) chain (3-11)
AARALLPLL

SEQ ID NO: 18890 - protein, 9 aa, Artificial Sequence
  U2 small nuclear ribonucleoprotein B'' (202-210)
AARDALQGF

SEQ ID NO: 18891 - protein, 13 aa, Artificial Sequence
  Transport and Golgi organization protein 6 homolog (2-14)
AARQAVGSGAQET

SEQ ID NO: 18892 - protein, 8 aa, Artificial Sequence
  Protein AATF (31-38)
AARVIDRF

SEQ ID NO: 18893 - protein, 16 aa, Artificial Sequence
  Dachshund homolog 1 (110-125)
AASNGSGGGGGGISAG

SEQ ID NO: 18894 - protein, 19 aa, Artificial Sequence
  HLA class I histocompatibility antigen, A-23 alpha chain (347-365)
AASSDSAQGSDVSLTACKV

SEQ ID NO: 18895 - protein, 9 aa, Artificial Sequence
  Talin-1 (2432-2440)
AASTAQLLV

SEQ ID NO: 18896 - protein, 9 aa, Artificial Sequence
  Amyloid-like protein 2 (10-18)
AATGRLLLL

SEQ ID NO: 18897 - protein, 9 aa, Artificial Sequence
  Protein BTG1 (17-25)
AAVSFISKF

SEQ ID NO: 18898 - protein, 9 aa, Artificial Sequence
  Basement membrane-specific heparan sulfate proteoglycan core protein (1409-1417)
AAYGGKLRY

SEQ ID NO: 18899 - protein, 9 aa, Artificial Sequence
  Glycogen phosphorylase, muscle form (154-162)
AAYGYGIRY

SEQ ID NO: 18900 - protein, 10 aa, Artificial Sequence
  Tyrosine-tRNA ligase, cytoplasmic (339-348)
AAYPDPSKQK

SEQ ID NO: 18901 - protein, 10 aa, Artificial Sequence
  SPRY domain-containing SOCS box protein 1 (218-227)
ADAPLHSVGY

SEQ ID NO: 18902 - protein, 9 aa, Artificial Sequence
  Ataxin-10 (381-389)
ADASLLKKV

SEQ ID NO: 18903 - protein, 13 aa, Artificial Sequence
  Histidine triad nucleotide-binding protein 1 (2-14)
ADEIAKAQVARPG

SEQ ID NO: 18904 - protein, 9 aa, Artificial Sequence
  Eukaryotic initiation factor 4A-II (185-193)
ADEMLSRGF

SEQ ID NO: 18905 - protein, 9 aa, Artificial Sequence
  Cyclin-dependent kinase 4 (83-91)
ADFGLARIY

SEQ ID NO: 18906 - protein, 9 aa, Artificial Sequence
  Cyclin-dependent kinase 13 (240-248)
ADFGLARLY

SEQ ID NO: 18907 - protein, 7 aa, Artificial Sequence
  Coatomer subunit gamma-1 (761-767)
ADHIQKV

SEQ ID NO: 18908 - protein, 7 aa, Artificial Sequence
  Eukaryotic translation initiation factor 3 subunit H (222-228)
ADKHELL

SEQ ID NO: 18909 - protein, 7 aa, Artificial Sequence
  Dual specificity protein phosphatase 14 (94-100)
ADKIHSV

SEQ ID NO: 18910 - protein, 7 aa, Artificial Sequence
  Transformation/transcription domain-associated protein (380-386)
ADLVHHV

SEQ ID NO: 18911 - protein, 9 aa, Artificial Sequence
  Threonine-tRNA ligase, cytoplasmic (147-155)
ADNTVIAKV

SEQ ID NO: 18912 - protein, 17 aa, Artificial Sequence
  H(+)/Cl(-) exchange transporter 7 (526-542)
ADPGKYALMGAAAQLGG

SEQ ID NO: 18913 - protein, 9 aa, Artificial Sequence
  Cyclin-dependent kinase 18 (414-422)
AEAALSHSY

SEQ ID NO: 18914 - protein, 9 aa, Artificial Sequence
  Actin-binding protein anillin (758-766)
AEAERLLLI

SEQ ID NO: 18915 - protein, 12 aa, Artificial Sequence
  T-box transcription factor TBX2 (61-72)
AEAGLHVSALGP

SEQ ID NO: 18916 - protein, 10 aa, Artificial Sequence
  Synemin (1056-1065)
AEAPAAGIRF

SEQ ID NO: 18917 - protein, 10 aa, Artificial Sequence
  IgGFc-binding protein (407-416)
AEATTNLGLL

SEQ ID NO: 18918 - protein, 12 aa, Artificial Sequence
  Probable methyltransferase TARBP1 (184-195)
AEDAAALVAGRL

SEQ ID NO: 18919 - protein, 9 aa, Artificial Sequence
  Filamin-B (9-17)
AEDAPWKKI

SEQ ID NO: 18920 - protein, 10 aa, Artificial Sequence
  Cytochrome c oxidase subunit 6B1 (2-11)
AEDMETKIKN

SEQ ID NO: 18921 - protein, 10 aa, Artificial Sequence
  Voltage-dependent L-type calcium channel subunit alpha-1C (919-928)
AEDPVQHTSF

SEQ ID NO: 18922 - protein, 10 aa, Artificial Sequence
  F-box/WD repeat-containing protein 8 (326-335)
AEDSARTLLY

SEQ ID NO: 18923 - protein, 11 aa, Artificial Sequence
  ATP-binding cassette sub-family B member 8, mitochondrial (351-361)
AEELGRGIALF

SEQ ID NO: 18924 - protein, 9 aa, Artificial Sequence
  Vimentin (287-295)
AEEWYKSKF

SEQ ID NO: 18925 - protein, 21 aa, Artificial Sequence
  Proliferation-associated protein 2G4 (162-182)
AEFEVHEVYAVDVLVSSGEGK

SEQ ID NO: 18926 - protein, 12 aa, Artificial Sequence
  Gamma-secretase C-terminal fragment 59 (563-574)
AEFRHDSGYEVH

SEQ ID NO: 18927 - protein, 13 aa, Artificial Sequence
  Gamma-secretase C-terminal fragment 59 (563-575)
AEFRHDSGYEVHH

SEQ ID NO: 18928 - protein, 14 aa, Artificial Sequence
  Gamma-secretase C-terminal fragment 59 (563-576)
AEFRHDSGYEVHHQ

SEQ ID NO: 18929 - protein, 15 aa, Artificial Sequence
  Gamma-secretase C-terminal fragment 59 (563-577)
AEFRHDSGYEVHHQK

SEQ ID NO: 18930 - protein, 12 aa, Artificial Sequence
  Ataxin-10 (295-306)
AEGDISNVANGF

SEQ ID NO: 18931 - protein, 7 aa, Artificial Sequence
  Baculoviral IAP repeat-containing protein 6 (1093-1099)
AEGIHNF

SEQ ID NO: 18932 - protein, 10 aa, Artificial Sequence
  Zinc finger protein 516 (373-382)
AEGPSDTKQF

SEQ ID NO: 18933 - protein, 11 aa, Artificial Sequence
  Synemin (327-337)
AEHVENMPSEF

SEQ ID NO: 18934 - protein, 9 aa, Artificial Sequence
  Intraflagellar transport protein 81 homolog (43-51)
AEIDPKQLV

SEQ ID NO: 18935 - protein, 11 aa, Artificial Sequence
  Nucleolar pre-ribosomal-associated protein 1 (403-413)
AEIIGGERSVF

SEQ ID NO: 18936 - protein, 7 aa, Artificial Sequence
  Poly (ADP-ribose) polymerase 1 (811-817)
AEIIRKY

SEQ ID NO: 18937 - protein, 12 aa, Artificial Sequence
  Sorting nexin-18 (397-408)
AEKDEMVGANFF

SEQ ID NO: 18938 - protein, 12 aa, Artificial Sequence
  Actin-binding protein anillin (451-462)
AEKGGNSKSKQL

SEQ ID NO: 18939 - protein, 9 aa, Artificial Sequence
  A-kinase anchor protein 9 (834-842)
AEKNFEVNY

SEQ ID NO: 18940 - protein, 9 aa, Artificial Sequence
  Ribosomal protein S6 kinase alpha-5 (41-49)
AEKVGIENF

SEQ ID NO: 18941 - protein, 8 aa, Artificial Sequence
  Guanine nucleotide-binding protein G(olf) subunit alpha (78-85)
AEKVLAGK

SEQ ID NO: 18942 - protein, 12 aa, Artificial Sequence
  Myosin-10 (1603-1614)
AELEDERKQRAL

SEQ ID NO: 18943 - protein, 10 aa, Artificial Sequence
  Synemin (111-120)
AELGAQQREL

SEQ ID NO: 18944 - protein, 9 aa, Artificial Sequence
  YTH domain-containing family protein 3 (480-488)
AEMKSVVDY

SEQ ID NO: 18945 - protein, 12 aa, Artificial Sequence
  YTH domain-containing family protein 3 (480-491)
AEMKSVVDYNAY

SEQ ID NO: 18946 - protein, 11 aa, Artificial Sequence
  Melanoma-associated antigen 4 (134-144)
AEMLERVIKNY

SEQ ID NO: 18947 - protein, 11 aa, Artificial Sequence
  Melanoma-associated antigen 9 (132-142)
AEMLESVIKNY

SEQ ID NO: 18948 - protein, 7 aa, Artificial Sequence
  Probable ATP-dependent RNA helicase DHX37 (108-114)
AEMRLFY

SEQ ID NO: 18949 - protein, 11 aa, Artificial Sequence
  Synemin (1391-1401)
AEMTSGVSRSF

SEQ ID NO: 18950 - protein, 9 aa, Artificial Sequence
  Obscurin (5874-5882)
AENKLHVSL

SEQ ID NO: 18951 - protein, 9 aa, Artificial Sequence
  Plexin-B2 (399-407)
AENNHTVAF

SEQ ID NO: 18952 - protein, 10 aa, Artificial Sequence
  Heterogeneous nuclear ribonucleoprotein U (399-408)
AENPGKYNIL

SEQ ID NO: 18953 - protein, 9 aa, Artificial Sequence
  Protocadherin gamma-B2 (110-118)
AENPLNIFY

SEQ ID NO: 18954 - protein, 9 aa, Artificial Sequence
  Dolichyl-diphosphooligosaccharide-proteinosyltransferase subunit 2 (312-320)
AEPDNKNVY

SEQ ID NO: 18955 - protein, 10 aa, Artificial Sequence
  RING finger protein 112 (134-143)
AEPLLLVRIN

SEQ ID NO: 18956 - protein, 11 aa, Artificial Sequence
  Plectin (1676-1686)
AEQELEKQRQL

SEQ ID NO: 18957 - protein, 10 aa, Artificial Sequence
  Intraflagellar transport protein 81 homolog (40-49)
AEQENLGKKL

SEQ ID NO: 18958 - protein, 13 aa, Artificial Sequence
  Transcription factor SOX-10 (195-207)
AEQGGTAAIQAHY

SEQ ID NO: 18959 - protein, 10 aa, Artificial Sequence
  Vacuolar protein sorting-associated protein 13D (998-1007)
AEQGGTPIRY

SEQ ID NO: 18960 - protein, 9 aa, Artificial Sequence
  Tetratricopeptide repeat protein 19, mitochondrial (155-163)
AEQLFKATM

SEQ ID NO: 18961 - protein, 10 aa, Artificial Sequence
  Vacuolar protein sorting-associated protein 18 homolog (210-219)
AERGPDGRSF

SEQ ID NO: 18962 - protein, 9 aa, Artificial Sequence
  COP9 signalosome complex subunit 7a (56-64)
AESDFASTF

SEQ ID NO: 18963 - protein, 9 aa, Artificial Sequence
  Tumor suppressor candidate 3 (279-287)
AESHIILVL

SEQ ID NO: 18964 - protein, 9 aa, Artificial Sequence
  Melanoma-associated antigen 4 (102-110)
AESLFREAL

SEQ ID NO: 18965 - protein, 10 aa, Artificial Sequence
  Peroxisome assembly protein 12 (45-54)
AESNPTHYGF

SEQ ID NO: 18966 - protein, 10 aa, Artificial Sequence
  Collagen alpha-1(XI) chain (281-290)
AESVTEGPTV

SEQ ID NO: 18967 - protein, 9 aa, Artificial Sequence
  Procollagen-lysine,2-oxoglutarate 5-dioxygenase 3 (47-55)
AETEGYLRF

SEQ ID NO: 18968 - protein, 10 aa, Artificial Sequence
  Procollagen-lysine,2-oxoglutarate 5-dioxygenase 3 (47-56)
AETEGYLRFL

SEQ ID NO: 18969 - protein, 9 aa, Artificial Sequence
  Melanoma-associated antigen 4 (280-288)
AETSYVKVL

SEQ ID NO: 18970 - protein, 11 aa, Artificial Sequence
  Melanoma-associated antigen 1 (272-282)
AETSYVKVLEY

SEQ ID NO: 18971 - protein, 12 aa, Artificial Sequence
  THO complex subunit 5 homolog (41-52)
AEVDLRDPGRDY

SEQ ID NO: 18972 - protein, 11 aa, Artificial Sequence
  Peptidase M20 domain-containing protein 2 (78-88)
AEVGAAAALGV

SEQ ID NO: 18973 - protein, 7 aa, Artificial Sequence
  Probable cation-transporting ATPase 13A2 (443-449)
AFLPLVP

SEQ ID NO: 18974 - protein, 31 aa, Artificial Sequence
  Heat shock protein HSP 90-beta (38-68)
AFMEALQAGADISMIGQFGVGFYSAYLVAEK

SEQ ID NO: 18975 - protein, 11 aa, Artificial Sequence
  Integrin alpha-7 (107-117)
AFSPDSHYLLF

SEQ ID NO: 18976 - protein, 7 aa, Artificial Sequence
  Clustered mitochondria protein homolog (332-338)
AFVEHRY

SEQ ID NO: 18977 - protein, 9 aa, Artificial Sequence
  DnaJ homolog subfamily C member 3 (224-232)
AFYKISTLY

SEQ ID NO: 18978 - protein, 11 aa, Artificial Sequence
  SKI family transcriptional corepressor 2 (437-447)
AGAGGAGAAPK

SEQ ID NO: 18979 - protein, 9 aa, Artificial Sequence
  Actin, gamma-enteric smooth muscle (23-31)
AGDDAPRAV

SEQ ID NO: 18980 - protein, 16 aa, Artificial Sequence
  Tripartite motif-containing protein 67 (85-100)
AGGLGGGAGGGGDHAD

SEQ ID NO: 18981 - protein, 8 aa, Artificial Sequence
  Cytochrome c oxidase subunit 6C (68-75)
AGIFQSVK

SEQ ID NO: 18982 - protein, 23 aa, Artificial Sequence
  Histone-lysine N-methyltransferase EHMT1 (702-724)
AGLGRPTPGLSQGPGKETLESAL

SEQ ID NO: 18983 - protein, 26 aa, Artificial Sequence
  Trifunctional enzyme subunit beta, mitochondrial (344-369)
AGLTMNDIDAFEFHEAFSGQILANFK

SEQ ID NO: 18984 - protein, 12 aa, Artificial Sequence
  Collagen alpha-2(IV) chain (15-26)
AGPPGITGFPGF

SEQ ID NO: 18985 - protein, 10 aa, Artificial Sequence
  HLA class I histocompatibility antigen, B-8 alpha chain (89-98)
AGSHTLQSMY

SEQ ID NO: 18986 - protein, 8 aa, Artificial Sequence
  Actin-related protein 2/3 complex subunit 5 (75-82)
AGSIVLKV

SEQ ID NO: 18987 - protein, 9 aa, Artificial Sequence
  Glucosylceramidase (22-30)
AGSLTGLLL

SEQ ID NO: 18988 - protein, 13 aa, Artificial Sequence
  CD44 antigen (31-43)
AGVFHVEKNGRYS

SEQ ID NO: 18989 - protein, 12 aa, Artificial Sequence
  Cytochrome c oxidase subunit 5B, mitochondrial (118-129)
AHYKLVPQQLAH

SEQ ID NO: 18990 - protein, 9 aa, Artificial Sequence
  H(+)/Cl(-) exchange transporter 5 (533-541)
AIAGRLLGV

SEQ ID NO: 18991 - protein, 9 aa, Artificial Sequence
  HEAT repeat-containing protein 2 (474-482)
AIATELAQA

SEQ ID NO: 18992 - protein, 9 aa, Artificial Sequence
  Tetratricopeptide repeat protein 28 (1994-2002)
AIDEKVQAV

SEQ ID NO: 18993 - protein, 9 aa, Artificial Sequence
  Prolow-density lipoprotein receptor-related protein 1 (1748-1756)
AIDFPESKL

SEQ ID NO: 18994 - protein, 8 aa, Artificial Sequence
  L-dopachrome tautomerase (63-70)
AIDLPVSV

SEQ ID NO: 18995 - protein, 8 aa, Artificial Sequence
  CCR4-NOT transcription complex subunit 1 (94-101)
AIDNPLHY

SEQ ID NO: 18996 - protein, 9 aa, Artificial Sequence
  Leucine-rich repeat-containing protein 1 (516-524)
AIDRVTTSV

SEQ ID NO: 18997 - protein, 14 aa, Artificial Sequence
  Clathrin heavy chain 1 (1124-1137)
AIDSYIKADDPSSY

SEQ ID NO: 18998 - protein, 15 aa, Artificial Sequence
  Clathrin heavy chain 1 (1124-1138)
AIDSYIKADDPSSYM

SEQ ID NO: 18999 - protein, 8 aa, Artificial Sequence
  Eukaryotic translation initiation factor 4 gamma 1 (748-755)
AIDTEERL

SEQ ID NO: 19000 - protein, 9 aa, Artificial Sequence
  Probable phospholipid-transporting ATPase VB (1005-1013)
AIFQGKLEK

SEQ ID NO: 19001 - protein, 10 aa, Artificial Sequence
  Tubulin beta-2A chain (315-324)
AIFRGRMSMK

SEQ ID NO: 19002 - protein, 22 aa, Artificial Sequence
  Aldose reductase (156-177)
AIGISNFNHLQVEMILNKPGLK

SEQ ID NO: 19003 - protein, 9 aa, Artificial Sequence
  General transcription factor 3C polypeptide 1 (642-650)
AIIATGCFG

SEQ ID NO: 19004 - protein, 9 aa, Artificial Sequence
  Receptor-type tyrosine-protein phosphatase zeta (195-203)
AIIDGVESV

SEQ ID NO: 19005 - protein, 9 aa, Artificial Sequence
  Protein TANC1 (414-422)
AIISKLVAL

SEQ ID NO: 19006 - protein, 9 aa, Artificial Sequence
  Putative endoplasmin-like protein (265-273)
AIKDKIEKA

SEQ ID NO: 19007 - protein, 9 aa, Artificial Sequence
  Kinesin-like protein KIF2A (638-646)
AILEQKIDI

SEQ ID NO: 19008 - protein, 9 aa, Artificial Sequence
  CLIP-associating protein 2 (795-803)
AILKYIETL

SEQ ID NO: 19009 - protein, 9 aa, Artificial Sequence
  Heat shock 70 kDa protein 4 (381-389)
AILSPAFKV

SEQ ID NO: 19010 - protein, 9 aa, Artificial Sequence
  Arginyl-tRNA-protein transferase 1 (382-390)
AIMPYGVYK

SEQ ID NO: 19011 - protein, 9 aa, Artificial Sequence
  Probable ATP-dependent RNA helicase DDX17 (464-472)
AINPKLMQL

SEQ ID NO: 19012 - protein, 10 aa, Artificial Sequence
  Polypyrimidine tract-binding protein 1 (346-355)
AIPGLAGAGN

SEQ ID NO: 19013 - protein, 11 aa, Artificial Sequence
  Moesin (19-29)
AIQPNTTGKQL

SEQ ID NO: 19014 - protein, 13 aa, Artificial Sequence
  Moesin (19-31)
AIQPNTTGKQLFD

SEQ ID NO: 19015 - protein, 9 aa, Artificial Sequence
  EH domain-containing protein 2 (17-25)
AIRTVTSAL

SEQ ID NO: 19016 - protein, 10 aa, Artificial Sequence
  DNA-dependent protein kinase catalytic subunit (460-469)
AIVKVFLALA

SEQ ID NO: 19017 - protein, 12 aa, Artificial Sequence
  Solute carrier family 23 member 2 (58-69)
AIYTTENGIAEK

SEQ ID NO: 19018 - protein, 8 aa, Artificial Sequence
  Nuclear factor of activated T-cells 5 (154-161)
AKAPHYVL

SEQ ID NO: 19019 - protein, 32 aa, Artificial Sequence
  ATP synthase subunit epsilon, mitochondrial (20-51)
AKAVRDALKTEFKANAEKTSGSNVKIVKVKKE

SEQ ID NO: 19020 - protein, 14 aa, Artificial Sequence
  Alpha-protein kinase 2 (1992-2005)
AKIYAAEAQPLEGF

SEQ ID NO: 19021 - protein, 9 aa, Artificial Sequence
  Choline-phosphate cytidylyltransferase A (99-107)
AKNLFPNTY

SEQ ID NO: 19022 - protein, 9 aa, Artificial Sequence
  Putative hexokinase HKDC1 (389-397)
ALAAILTRL

SEQ ID NO: 19023 - protein, 13 aa, Artificial Sequence
  AT-rich interactive domain-containing protein 1B (2130-2142)
ALAARAIAVQKGS

SEQ ID NO: 19024 - protein, 9 aa, Artificial Sequence
  Lamin-B receptor (330-338)
ALAATVFCV

SEQ ID NO: 19025 - protein, 14 aa, Artificial Sequence
  Chondroitin sulfate proteoglycan 4 (1294-1307)
ALADEPPSLDPVQS

SEQ ID NO: 19026 - protein, 11 aa, Artificial Sequence
  Metastasis-associated protein MTA1 (57-67)
ALADKHATLSV

SEQ ID NO: 19027 - protein, 11 aa, Artificial Sequence
  Probable ATP-dependent RNA helicase DDX27 (69-79)
ALADVMSQLKK

SEQ ID NO: 19028 - protein, 9 aa, Artificial Sequence
  Seizure 6-like protein 2 (50-58)
ALAELLHGA

SEQ ID NO: 19029 - protein, 9 aa, Artificial Sequence
  Helicase SKI2W (784-792)
ALAELTKRL

SEQ ID NO: 19030 - protein, 10 aa, Artificial Sequence
  Chloride channel protein 2 (506-515)
ALAGAVTHTV

SEQ ID NO: 19031 - protein, 9 aa, Artificial Sequence
  RNA 3'-terminal phosphate cyclase (317-325)
ALANGVSRI

SEQ ID NO: 19032 - protein, 9 aa, Artificial Sequence
  La-related protein 1 (672-680)
ALANKLFGA

SEQ ID NO: 19033 - protein, 9 aa, Artificial Sequence
  Beclin-1 (316-324)
ALANKMGLK

SEQ ID NO: 19034 - protein, 10 aa, Artificial Sequence
  Nicastrin (550-559)
ALANLTGTVV

SEQ ID NO: 19035 - protein, 9 aa, Artificial Sequence
  Poly(rC)-binding protein 4 (256-264)
ALAQYLITA

SEQ ID NO: 19036 - protein, 9 aa, Artificial Sequence
  Oxidation resistance protein 1 (776-784)
ALASEPLKV

SEQ ID NO: 19037 - protein, 9 aa, Artificial Sequence
  Kinesin light chain 4 (108-116)
ALASHLSTV

SEQ ID NO: 19038 - protein, 9 aa, Artificial Sequence
  E3 ubiquitin-protein ligase TRIM33 (830-838)
ALASLENHV

SEQ ID NO: 19039 - protein, 10 aa, Artificial Sequence
  Ataxin-10 (300-309)
ALATIRLLDV

SEQ ID NO: 19040 - protein, 9 aa, Artificial Sequence
  Catenin alpha-1 (336-344)
ALCPQVINA

SEQ ID NO: 19041 - protein, 9 aa, Artificial Sequence
  Pre-mRNA-processing factor 40 homolog B (616-624)
ALDAGNIKL

SEQ ID NO: 19042 - protein, 9 aa, Artificial Sequence
  Coiled-coil domain-containing protein 14 (192-200)
ALDANIARL

SEQ ID NO: 19043 - protein, 9 aa, Artificial Sequence
  Hyccin (259-267)
ALDDIIYRA

SEQ ID NO: 19044 - protein, 9 aa, Artificial Sequence
  Protein transport protein Sec16A (815-823)
ALDFTLSRT

SEQ ID NO: 19045 - protein, 9 aa, Artificial Sequence
  Rho GTPase-activating protein 5 (624-632)
ALDGKIYEL

SEQ ID NO: 19046 - protein, 8 aa, Artificial Sequence
  Endoplasmin (90-97)
ALDKIRLI

SEQ ID NO: 19047 - protein, 7 aa, Artificial Sequence
  Heat shock protein HSP 90-beta (1-7)
ALDKIRY

SEQ ID NO: 19048 - protein, 10 aa, Artificial Sequence
  Puromycin-sensitive aminopeptidase-like protein (412-421)
ALDNSHPIEV

SEQ ID NO: 19049 - protein, 11 aa, Artificial Sequence
  Ubiquitin-like modifier-activating enzyme 1 (574-584)
ALDNVDARMYM

SEQ ID NO: 19050 - protein, 9 aa, Artificial Sequence
  Receptor-type tyrosine-protein phosphatase gamma (213-221)
ALDPIIHGL

SEQ ID NO: 19051 - protein, 9 aa, Artificial Sequence
  Chromobox protein homolog 8 (299-307)
ALDPNGTRV

SEQ ID NO: 19052 - protein, 9 aa, Artificial Sequence
  Microtubule-associated protein 1A (1498-1506)
ALDQKVRSV

SEQ ID NO: 19053 - protein, 9 aa, Artificial Sequence
  Cathepsin F (223-231)
ALDRGTAQY

SEQ ID NO: 19054 - protein, 9 aa, Artificial Sequence
  Probable helicase with zinc finger domain (1495-1503)
ALDRIHGSV

SEQ ID NO: 19055 - protein, 9 aa, Artificial Sequence
  Integrin beta-8 (291-299)
ALDSKLAGI

SEQ ID NO: 19056 - protein, 9 aa, Artificial Sequence
  C-type lectin domain family 11 member A (131-139)
ALDTRVVEL

SEQ ID NO: 19057 - protein, 9 aa, Artificial Sequence
  Keratin, type I cytoskeletal 27 (352-360)
ALEEQLHQV

SEQ ID NO: 19058 - protein, 9 aa, Artificial Sequence
  Serine-protein kinase ATM (1512-1520)
ALENHLHVI

SEQ ID NO: 19059 - protein, 9 aa, Artificial Sequence
  Tetratricopeptide repeat protein 28 (936-944)
ALEQHIASV

SEQ ID NO: 19060 - protein, 9 aa, Artificial Sequence
  DNA-dependent protein kinase catalytic subunit (315-323)
ALESFLKQV

SEQ ID NO: 19061 - protein, 9 aa, Artificial Sequence
  Uridine phosphorylase 1 (48-56)
ALFGDVKFV

SEQ ID NO: 19062 - protein, 9 aa, Artificial Sequence
  Ankyrin repeat and SAM domain-containing protein 1A (255-263)
ALFGKTDVV

SEQ ID NO: 19063 - protein, 11 aa, Artificial Sequence
  Eukaryotic translation initiation factor 2-alpha kinase 4 (1102-1112)
ALFMDHSGMLV

SEQ ID NO: 19064 - protein, 9 aa, Artificial Sequence
  Protein transport protein Sec61 subunit alpha isoform 2 (88-96)
ALFNGAQKL

SEQ ID NO: 19065 - protein, 10 aa, Artificial Sequence
  Transforming growth factor-beta-induced protein ig-h3 (2-11)
ALFVRLLALA

SEQ ID NO: 19066 - protein, 8 aa, Artificial Sequence
  Jerky protein homolog (486-493)
ALGAVVKV

SEQ ID NO: 19067 - protein, 10 aa, Artificial Sequence
  GTP-binding protein 2 (438-447)
ALGDFDRALL

SEQ ID NO: 19068 - protein, 8 aa, Artificial Sequence
  Ankyrin repeat domain-containing protein 40 (19-26)
ALGDIREV

SEQ ID NO: 19069 - protein, 9 aa, Artificial Sequence
  Integrin alpha-11 (344-352)
ALGDRIFSL

SEQ ID NO: 19070 - protein, 26 aa, Artificial Sequence
  Collagen alpha-3(VI) chain (105-130)
ALGFAGGELANIGLALDFVVENHFTR

SEQ ID NO: 19071 - protein, 8 aa, Artificial Sequence
  Fucose-1-phosphate guanylyltransferase (126-133)
ALGKIFTA

SEQ ID NO: 19072 - protein, 12 aa, Artificial Sequence
  NAD(P) transhydrogenase, mitochondrial (649-660)
ALGMIGVAGGLA

SEQ ID NO: 19073 - protein, 10 aa, Artificial Sequence
  ATP-binding cassette sub-family A member 13 (1237-1246)
ALGNALVSVK

SEQ ID NO: 19074 - protein, 8 aa, Artificial Sequence
  ATP-binding cassette sub-family B member 8, mitochondrial (320-327)
ALGNVRTV

SEQ ID NO: 19075 - protein, 9 aa, Artificial Sequence
  T-box transcription factor TBX2 (69-77)
ALGPHPPAA

SEQ ID NO: 19076 - protein, 9 aa, Artificial Sequence
  Dolichol-phosphate mannosyltransferase subunit 3 (74-82)
ALGTVGYRV

SEQ ID NO: 19077 - protein, 9 aa, Artificial Sequence
  Methionine-tRNA ligase, cytoplasmic (168-176)
ALHSWFQTL

SEQ ID NO: 19078 - protein, 9 aa, Artificial Sequence
  X-ray repair cross-complementing protein 5 (456-464)
ALIDSMSLA

SEQ ID NO: 19079 - protein, 10 aa, Artificial Sequence
  Gamma-tubulin complex component 2 (186-195)
ALIGDFLIGA

SEQ ID NO: 19080 - protein, 10 aa, Artificial Sequence
  Sodium-dependent phosphate transporter 2 (216-225)
ALISFGVALL

SEQ ID NO: 19081 - protein, 9 aa, Artificial Sequence
  Outer dense fiber protein 2-like (357-365)
ALKDEVVSV

SEQ ID NO: 19082 - protein, 9 aa, Artificial Sequence
  Lysine-specific demethylase 5B (1044-1052)
ALKDSVQRA

SEQ ID NO: 19083 - protein, 7 aa, Artificial Sequence
  Max-like protein X (153-159)
ALKIMKV

SEQ ID NO: 19084 - protein, 9 aa, Artificial Sequence
  Poly (ADP-ribose) polymerase 1 (194-202)
ALKKQLPGV

SEQ ID NO: 19085 - protein, 9 aa, Artificial Sequence
  Chondroitin sulfate proteoglycan 4 (2314-2322)
ALKNGQYWV

SEQ ID NO: 19086 - protein, 26 aa, Artificial Sequence
  ATP synthase subunit epsilon, mitochondrial (26-51)
ALKTEFKANAEKTSGSNVKIVKVKKE

SEQ ID NO: 19087 - protein, 9 aa, Artificial Sequence
  Ubiquitin thioesterase OTUB1 (103-111)
ALLDDSKEL

SEQ ID NO: 19088 - protein, 11 aa, Artificial Sequence
  Eukaryotic translation initiation factor 3 subunit C-like protein (633-643)
ALLDIQSSGRA

SEQ ID NO: 19089 - protein, 9 aa, Artificial Sequence
  Dystonin (5774-5782)
ALLDSLNEV

SEQ ID NO: 19090 - protein, 10 aa, Artificial Sequence
  G1/S-specific cyclin-D1 (253-262)
ALLESSLRQA

SEQ ID NO: 19091 - protein, 11 aa, Artificial Sequence
  Phosphatidylinositol 3-kinase catalytic subunit type 3 (575-585)
ALLGDNEKMNL

SEQ ID NO: 19092 - protein, 9 aa, Artificial Sequence
  WD repeat and FYVE domain-containing protein 3 (1152-1160)
ALLGHTDTV

SEQ ID NO: 19093 - protein, 12 aa, Artificial Sequence
  ATP-binding cassette sub-family A member 13 (940-951)
ALLGTNGAGKTT

SEQ ID NO: 19094 - protein, 9 aa, Artificial Sequence
  Immunity-related GTPase family Q protein (318-326)
ALLLPDAPL

SEQ ID NO: 19095 - protein, 9 aa, Artificial Sequence
  Ubiquitin-like modifier-activating enzyme 6 (782-790)
ALLNILSEV

SEQ ID NO: 19096 - protein, 9 aa, Artificial Sequence
  Transmembrane O-methyltransferase (232-240)
ALLPAGATV

SEQ ID NO: 19097 - protein, 11 aa, Artificial Sequence
  Insulin receptor substrate 2 (417-427)
ALLPAGGALQH

SEQ ID NO: 19098 - protein, 9 aa, Artificial Sequence
  General vesicular transport factor p115 (852-860)
ALLQETKEL

SEQ ID NO: 19099 - protein, 10 aa, Artificial Sequence
  Sulfate transporter (251-260)
ALLSGFVTGA

SEQ ID NO: 19100 - protein, 9 aa, Artificial Sequence
  Protein eva-1 homolog A (15-23)
ALLSNILAA

SEQ ID NO: 19101 - protein, 9 aa, Artificial Sequence
  Putative tyrosine-protein phosphatase auxilin (822-830)
ALLSTMHTV

SEQ ID NO: 19102 - protein, 10 aa, Artificial Sequence
  Ankyrin repeat and SOCS box protein 11 (33-42)
ALLTHFYIVK

SEQ ID NO: 19103 - protein, 9 aa, Artificial Sequence
  Multiple epidermal growth factor-like domains protein 8 (1267-1275)
ALLTNVSSV

SEQ ID NO: 19104 - protein, 11 aa, Artificial Sequence
  Protein TANC2 (1001-1011)
ALMDKEGLTAL

SEQ ID NO: 19105 - protein, 11 aa, Artificial Sequence
  Calpain-3 (37-47)
ALMDTDGSGKL

SEQ ID NO: 19106 - protein, 13 aa, Artificial Sequence
  Calpain-3 (37-49)
ALMDTDGSGKLNL

SEQ ID NO: 19107 - protein, 9 aa, Artificial Sequence
  Protein cordon-bleu (1169-1177)
ALMEAIHSA

SEQ ID NO: 19108 - protein, 11 aa, Artificial Sequence
  Bestrophin-1 (462-472)
ALMEHPEVSQV

SEQ ID NO: 19109 - protein, 9 aa, Artificial Sequence
  Integrin beta-8 (662-670)
ALMEQQHYV

SEQ ID NO: 19110 - protein, 21 aa, Artificial Sequence
  60 kDa heat shock protein, mitochondrial (38-58)
ALMLQGVDLLADAVAVTMGPK

SEQ ID NO: 19111 - protein, 9 aa, Artificial Sequence
  HLA class II histocompatibility antigen, DQ beta 1 chain (103-111)
ALNHHNLLV

SEQ ID NO: 19112 - protein, 9 aa, Artificial Sequence
  Putative ribosome-binding factor A, mitochondrial (243-251)
ALNKQIMEY

SEQ ID NO: 19113 - protein, 10 aa, Artificial Sequence
  Protocadherin gamma-A2 (171-180)
ALNPNDHFSL

SEQ ID NO: 19114 - protein, 11 aa, Artificial Sequence
  RELT-like protein 1 (5-15)
ALPGSAVLAAA

SEQ ID NO: 19115 - protein, 9 aa, Artificial Sequence
  Formin-1 (867-875)
ALPPPPASI

SEQ ID NO: 19116 - protein, 9 aa, Artificial Sequence
  E3 ubiquitin/ISG15 ligase TRIM25 (398-406)
ALPSKLPTF

SEQ ID NO: 19117 - protein, 11 aa, Artificial Sequence
  Epsin-2 (283-293)
ALPSSGPAAQK

SEQ ID NO: 19118 - protein, 10 aa, Artificial Sequence
  Transcription factor SOX-10 (341-350)
ALPTVSPPGV

SEQ ID NO: 19119 - protein, 9 aa, Artificial Sequence
  Nuclear receptor subfamily 1 group D member 2 (527-535)
ALQETLIRA

SEQ ID NO: 19120 - protein, 9 aa, Artificial Sequence
  Interleukin-17 receptor D (642-650)
ALQPLLHTV

SEQ ID NO: 19121 - protein, 9 aa, Artificial Sequence
  Golgin subfamily A member 3 (542-550)
ALQSQLQQV

SEQ ID NO: 19122 - protein, 9 aa, Artificial Sequence
  V-type proton ATPase subunit C 1 (264-272)
ALRVFVESV

SEQ ID NO: 19123 - protein, 9 aa, Artificial Sequence
  Rootletin (252-260)
ALSEDIRKV

SEQ ID NO: 19124 - protein, 11 aa, Artificial Sequence
  Catenin alpha-1 (773-783)
ALSEFKAMDSI

SEQ ID NO: 19125 - protein, 9 aa, Artificial Sequence
  Staphylococcal nuclease domain-containing protein 1 (626-634)
ALSKVHFTA

SEQ ID NO: 19126 - protein, 11 aa, Artificial Sequence
  Ubiquitin carboxyl-terminal hydrolase isozyme L5 (129-139)
ALSNSDVIRQV

SEQ ID NO: 19127 - protein, 9 aa, Artificial Sequence
  Serine incorporator 5 (278-286)
ALSSKPAEV

SEQ ID NO: 19128 - protein, 9 aa, Artificial Sequence
  NudC domain-containing protein 3 (153-161)
ALSSSSIRV

SEQ ID NO: 19129 - protein, 9 aa, Artificial Sequence
  Piezo-type mechanosensitive ion channel component 1 (218-226)
ALSSVYLLL

SEQ ID NO: 19130 - protein, 10 aa, Artificial Sequence
  Glutamate receptor ionotropic, kainate 3 (632-641)
ALSTRIIGGI

SEQ ID NO: 19131 - protein, 9 aa, Artificial Sequence
  A-kinase anchor protein 9 (1723-1731)
ALTDYITRL

SEQ ID NO: 19132 - protein, 9 aa, Artificial Sequence
  Transmembraneoprotein NMB (477-485)
ALTSTLISV

SEQ ID NO: 19133 - protein, 9 aa, Artificial Sequence
  Glutamine-tRNA ligase (715-723)
ALVDCSVAL

SEQ ID NO: 19134 - protein, 9 aa, Artificial Sequence
  (4658-4666)
ALVDWLYKV

SEQ ID NO: 19135 - protein, 11 aa, Artificial Sequence
  Ribosome biogenesis protein BRX1 homolog (228-238)
ALVEIGPRFVL

SEQ ID NO: 19136 - protein, 13 aa, Artificial Sequence
  Kinesin-like protein KIF1A (397-409)
ALVGMSPSSSLSA

SEQ ID NO: 19137 - protein, 10 aa, Artificial Sequence
  Plexin-A2 (475-484)
ALVGTTSGPV

SEQ ID NO: 19138 - protein, 10 aa, Artificial Sequence
  E3 ubiquitin-protein ligase TRIP12 (1669-1678)
ALVSQELQRA

SEQ ID NO: 19139 - protein, 9 aa, Artificial Sequence
  Diphthamide biosynthesis protein 1 (172-180)
ALVSTIQFV

SEQ ID NO: 19140 - protein, 10 aa, Artificial Sequence
  ER membrane protein complex subunit 7 (4-13)
ALWGFFPVLL

SEQ ID NO: 19141 - protein, 10 aa, Artificial Sequence
  Transmembrane protein 234 (16-25)
ALWGGTQPLL

SEQ ID NO: 19142 - protein, 10 aa, Artificial Sequence
  tRNA (uracil-5-)-methyltransferase homolog A (132-141)
ALWKGRPLSV

SEQ ID NO: 19143 - protein, 10 aa, Artificial Sequence
  WD repeat-containing protein 60 (1057-1066)
ALWPEGKLHK

SEQ ID NO: 19144 - protein, 9 aa, Artificial Sequence
  Beta-hexosaminidase subunit beta (43-51)
ALWPLPLSV

SEQ ID NO: 19145 - protein, 15 aa, Artificial Sequence
  Phosphatidate phosphatase LPIN1 (411-425)
ALYFPKNGDPSGLAK

SEQ ID NO: 19146 - protein, 9 aa, Artificial Sequence
  Caskin-2 (229-237)
ALYGKTEVV

SEQ ID NO: 19147 - protein, 9 aa, Artificial Sequence
  Ankyrin repeat and SAM domain-containing protein 1A (190-198)
ALYGRLEVV

SEQ ID NO: 19148 - protein, 10 aa, Artificial Sequence
  Hemicentin-1 (1594-1603)
ALYIDKGQYL

SEQ ID NO: 19149 - protein, 12 aa, Artificial Sequence
  Cytoplasmic dynein 1 heavy chain 1 (3101-3112)
ALYQVGKEFTSK

SEQ ID NO: 19150 - protein, 12 aa, Artificial Sequence
  Type II inositol 3,4-bisphosphate 4-phosphatase (472-483)
ALYTARPGGILK

SEQ ID NO: 19151 - protein, 13 aa, Artificial Sequence
  Type II inositol 3,4-bisphosphate 4-phosphatase (472-484)
ALYTARPGGILKK

SEQ ID NO: 19152 - protein, 9 aa, Artificial Sequence
  Dedicator of cytokinesis protein 7 (712-720)
AMASIINRL

SEQ ID NO: 19153 - protein, 9 aa, Artificial Sequence
  Protein transport protein Sec31A (697-705)
AMDTSTVGV

SEQ ID NO: 19154 - protein, 8 aa, Artificial Sequence
  Synemin (36-43)
AMFDKKVQ

SEQ ID NO: 19155 - protein, 11 aa, Artificial Sequence
  Exportin-4 (248-258)
AMFESSQNVLL

SEQ ID NO: 19156 - protein, 11 aa, Artificial Sequence
  NAD(P)H dehydrogenase (quinone) 1 (21-31)
AMKEAAAAALK

SEQ ID NO: 19157 - protein, 10 aa, Artificial Sequence
  Tryptophan-tRNA ligase, cytoplasmic (424-433)
AMLTGELKKA

SEQ ID NO: 19158 - protein, 9 aa, Artificial Sequence
  Nucleoporin p58/p45 (376-384)
AMQKIYQTF

SEQ ID NO: 19159 - protein, 9 aa, Artificial Sequence
  Tenascin (3-11)
AMTQLLAGV

SEQ ID NO: 19160 - protein, 9 aa, Artificial Sequence
  S-adenosylmethionine synthase isoform type-1 (75-83)
AMVDYQRVV

SEQ ID NO: 19161 - protein, 10 aa, Artificial Sequence
  Zinc finger protein 697 (233-242)
AMVGMMGVGV

SEQ ID NO: 19162 - protein, 11 aa, Artificial Sequence
  Leucine zipper putative tumor suppressor 1 (529-539)
AMYQRNQRLEK

SEQ ID NO: 19163 - protein, 8 aa, Artificial Sequence
  Eukaryotic translation initiation factor 2 subunit 3 (84-91)
ANAKIYKL

SEQ ID NO: 19164 - protein, 14 aa, Artificial Sequence
  Beta-secretase 2 (75-88)
ANFLAMVDNLQGDS

SEQ ID NO: 19165 - protein, 7 aa, Artificial Sequence
  EH domain-containing protein 1 (504-510)
ANHLIKV

SEQ ID NO: 19166 - protein, 8 aa, Artificial Sequence
  Galectin-3 (142-149)
ANRIALDF

SEQ ID NO: 19167 - protein, 9 aa, Artificial Sequence
  Spectrin alpha chain, non-erythrocytic 1 (94-102)
ANSGAIVKL

SEQ ID NO: 19168 - protein, 9 aa, Artificial Sequence
  AT-rich interactive domain-containing protein 2 (940-948)
APAIHQIVL

SEQ ID NO: 19169 - protein, 11 aa, Artificial Sequence
  E3 ubiquitin-protein ligase MIB2 (408-418)
APALGRVGKVV

SEQ ID NO: 19170 - protein, 10 aa, Artificial Sequence
  Biogenesis of lysosome-related organelles complex 1 subunit 3 (99-108)
APAPAPARSL

SEQ ID NO: 19171 - protein, 9 aa, Artificial Sequence
  Protein capicua homolog (1681-1689)
APAPPAVQF

SEQ ID NO: 19172 - protein, 10 aa, Artificial Sequence
  Cathepsin F (20-29)
APAQPRAASF

SEQ ID NO: 19173 - protein, 9 aa, Artificial Sequence
  Serum paraoxonase/arylesterase 2 (78-86)
APDKPGGIL

SEQ ID NO: 19174 - protein, 18 aa, Artificial Sequence
  Fructose-bisphosphate aldolase A (79-96)
APGKGILAADESTGSIAK

SEQ ID NO: 19175 - protein, 10 aa, Artificial Sequence
  Lysosome-associated membraneoprotein 1 (3-12)
APGSARRPLL

SEQ ID NO: 19176 - protein, 12 aa, Artificial Sequence
  Dynein heavy chain domain-containing protein 1 (4690-4701)
APGTSDLPAPAD

SEQ ID NO: 19177 - protein, 9 aa, Artificial Sequence
  Protein SEC13 homolog (98-106)
APHDYGLIL

SEQ ID NO: 19178 - protein, 9 aa, Artificial Sequence
  Chondroitin sulfate proteoglycan 4 (1875-1883)
APHNGFLSL

SEQ ID NO: 19179 - protein, 10 aa, Artificial Sequence
  Hypoxia-inducible factor 1-alpha (828-837)
APIQGSRNLL

SEQ ID NO: 19180 - protein, 8 aa, Artificial Sequence
  TRAF2 and NCK-interacting protein kinase (326-333)
APKPYHKF

SEQ ID NO: 19181 - protein, 10 aa, Artificial Sequence
  Ankyrin repeat and SOCS box protein 11 (248-257)
APKSSVEQAL

SEQ ID NO: 19182 - protein, 9 aa, Artificial Sequence
  Cancer/testis antigen 2 (114-122)
APLPRPGAV

SEQ ID NO: 19183 - protein, 16 aa, Artificial Sequence
  GTP-binding nuclear protein Ran (203-218)
APPEVVMDPALAAQYE

SEQ ID NO: 19184 - protein, 17 aa, Artificial Sequence
  GTP-binding nuclear protein Ran (203-219)
APPEVVMDPALAAQYEH

SEQ ID NO: 19185 - protein, 10 aa, Artificial Sequence
  DNA-binding protein inhibitor ID-4 (131-140)
APPRTPLTAL

SEQ ID NO: 19186 - protein, 13 aa, Artificial Sequence
  Heat shock cognate 71 kDa protein (630-642)
APPSGGASSGPTI

SEQ ID NO: 19187 - protein, 11 aa, Artificial Sequence
  Uncharacterized protein C17orf51 (66-76)
APPTRRAQAAL

SEQ ID NO: 19188 - protein, 12 aa, Artificial Sequence
  UPF0669 protein C6orf120 (3-14)
APRGRAAPWTTA

SEQ ID NO: 19189 - protein, 8 aa, Artificial Sequence
  Procollagen-lysine,2-oxoglutarate 5-dioxygenase 1 (691-698)
APRKGWTL

SEQ ID NO: 19190 - protein, 9 aa, Artificial Sequence
  La-related protein 7 (193-201)
APRKPGIFP

SEQ ID NO: 19191 - protein, 41 aa, Artificial Sequence
  DNA-binding protein RFX5 (352-392)
APRLSSGALKVATLPLSSRAGAPPAAVPIINMILPTVPALP

SEQ ID NO: 19192 - protein, 10 aa, Artificial Sequence
  RNA-binding protein 33 (702-711)
APRNSNLREL

SEQ ID NO: 19193 - protein, 9 aa, Artificial Sequence
  Alpha-2-macroglobulin receptor-associated protein (2-10)
APRRVRSFL

SEQ ID NO: 19194 - protein, 9 aa, Artificial Sequence
  Alpha-1-syntrophin (7-15)
APRTGLLEL

SEQ ID NO: 19195 - protein, 12 aa, Artificial Sequence
  Nance-Horan syndrome protein (1306-1317)
APSAGLEEVAQP

SEQ ID NO: 19196 - protein, 9 aa, Artificial Sequence
  Eukaryotic translation initiation factor 3 subunit C-like protein (203-211)
APSGESRKF

SEQ ID NO: 19197 - protein, 9 aa, Artificial Sequence
  Rho GTPase-activating protein 7 (241-249)
APSKLGLII

SEQ ID NO: 19198 - protein, 9 aa, Artificial Sequence
  Dickkopf-related protein 3 (30-38)
APVKPGPAL

SEQ ID NO: 19199 - protein, 9 aa, Artificial Sequence
  Hemicentin-1 (1702-1710)
AQEIDRGQY

SEQ ID NO: 19200 - protein, 11 aa, Artificial Sequence
  Coatomer subunit alpha (141-151)
AQFHPTEDLVV

SEQ ID NO: 19201 - protein, 10 aa, Artificial Sequence
  Voltage-dependent T-type calcium channel subunit alpha-1H (1841-1850)
AQFVLVNVVV

SEQ ID NO: 19202 - protein, 8 aa, Artificial Sequence
  Ran GTPase-activating protein 1 (175-182)
AQGKPLAL

SEQ ID NO: 19203 - protein, 12 aa, Artificial Sequence
  Heat shock 70 kDa protein 1B (623-634)
AQGPKGGSGSGP

SEQ ID NO: 19204 - protein, 13 aa, Artificial Sequence
  HLA class I histocompatibility antigen, A-69 alpha chain (234-246)
AQGSDVSLTACKV

SEQ ID NO: 19205 - protein, 17 aa, Artificial Sequence
  T-complex protein 1 subunit zeta (291-307)
AQLGVQAFADALLIIPK

SEQ ID NO: 19206 - protein, 9 aa, Artificial Sequence
  Retrotransposon-derived protein PEG10 (460-468)
AQNGIPLRI

SEQ ID NO: 19207 - protein, 11 aa, Artificial Sequence
  F-box/LRR-repeat protein 18 (437-447)
AQPAMHAVPRG

SEQ ID NO: 19208 - protein, 10 aa, Artificial Sequence
  Actin, aortic smooth muscle (60-69)
AQSKRGILTL

SEQ ID NO: 19209 - protein, 10 aa, Artificial Sequence
  Histone-lysine N-methyltransferase NSD3 (366-375)
AQWDIGIAHA

SEQ ID NO: 19210 - protein, 9 aa, Artificial Sequence
  Arrestin domain-containing protein 1 (236-244)
AQWHEQILV

SEQ ID NO: 19211 - protein, 9 aa, Artificial Sequence
  Glycogen phosphorylase, liver form (247-255)
ARAPNDFNL

SEQ ID NO: 19212 - protein, 9 aa, Artificial Sequence
  Myosin-10 (1639-1647)
ARDEVIKQL

SEQ ID NO: 19213 - protein, 9 aa, Artificial Sequence
  Apoptosis-inducing factor 1, mitochondrial (148-156)
ARDPGARVL

SEQ ID NO: 19214 - protein, 10 aa, Artificial Sequence
  HLA class II histocompatibility antigen, DQ beta 1 chain (33-42)
ARFDSDVGVY

SEQ ID NO: 19215 - protein, 11 aa, Artificial Sequence
  HLA class II histocompatibility antigen, DQ beta 1 chain (33-43)
ARFDSDVGVYR

SEQ ID NO: 19216 - protein, 10 aa, Artificial Sequence
  H/ACA ribonucleoprotein complex subunit 3 (33-42)
ARFSPDDKYS

SEQ ID NO: 19217 - protein, 8 aa, Artificial Sequence
  ATP-dependent RNA helicase DDX24 (411-418)
ARFTGIKT

SEQ ID NO: 19218 - protein, 9 aa, Artificial Sequence
  60S ribosomal protein L7 (75-83)
ARKAGNFYV

SEQ ID NO: 19219 - protein, 9 aa, Artificial Sequence
  Phospholipid transfer protein (319-327)
ARLSAKMAL

SEQ ID NO: 19220 - protein, 9 aa, Artificial Sequence
  V-type proton ATPase subunit S1 (217-225)
ARLSLTYER

SEQ ID NO: 19221 - protein, 9 aa, Artificial Sequence
  Peroxisomal acyl-coenzyme A oxidase 1 (492-500)
ARLVEIAAK

SEQ ID NO: 19222 - protein, 11 aa, Artificial Sequence
  Membrane-associated guanylate kinase, WW and PDZ domain-containing protein 2 (849-859)
ARNGQVNLTVR

SEQ ID NO: 19223 - protein, 11 aa, Artificial Sequence
  Melanotransferrin (274-284)
ARVPAHAVVVR

SEQ ID NO: 19224 - protein, 12 aa, Artificial Sequence
  Syntenin-1 (35-46)
ASAPIPHDGNLY

SEQ ID NO: 19225 - protein, 13 aa, Artificial Sequence
  Receptor-type tyrosine-protein phosphatase mu (849-861)
ASDTSSLVQSHTY

SEQ ID NO: 19226 - protein, 9 aa, Artificial Sequence
  Heterogeneous nuclear ribonucleoprotein M (578-586)
ASFDRAIEM

SEQ ID NO: 19227 - protein, 8 aa, Artificial Sequence
  Cytochrome c oxidase subunit 7A2, mitochondrial (76-83)
ASFPKKQE

SEQ ID NO: 19228 - protein, 29 aa, Artificial Sequence
  Cytochrome c oxidase subunit 5B, mitochondrial (32-60)
ASGGGVPTDEEQATGLEREIMLAAKKGLD

SEQ ID NO: 19229 - protein, 8 aa, Artificial Sequence
  Chromodomain-helicase-DNA-binding protein 4 (1045-1052)
ASGKLLLL

SEQ ID NO: 19230 - protein, 8 aa, Artificial Sequence
  Thioredoxin domain-containing protein 12 (52-59)
ASGLPLMV

SEQ ID NO: 19231 - protein, 8 aa, Artificial Sequence
  Histone deacetylase 6 (38-45)
ASGSVLRL

SEQ ID NO: 19232 - protein, 9 aa, Artificial Sequence
  DNA damage-binding protein 1 (882-890)
ASINSTVRL

SEQ ID NO: 19233 - protein, 8 aa, Artificial Sequence
  Alpha-actinin-3 (115-122)
ASKGVKLV

SEQ ID NO: 19234 - protein, 9 aa, Artificial Sequence
  Adhesion G protein-coupled receptor A3 (756-764)
ASLLHPVVY

SEQ ID NO: 19235 - protein, 9 aa, Artificial Sequence
  Dynein light chain roadblock-type 1 (43-51)
ASLMHSFIL

SEQ ID NO: 19236 - protein, 9 aa, Artificial Sequence
  Proline synthase co-transcribed bacterial homolog protein (77-85)
ASNPKILSL

SEQ ID NO: 19237 - protein, 10 aa, Artificial Sequence
  Solute carrier family 52, riboflavin transporter, member 2 (127-136)
ASNVTFLPFL

SEQ ID NO: 19238 - protein, 9 aa, Artificial Sequence
  Alanine-tRNA ligase, cytoplasmic (341-349)
ASRGFFATL

SEQ ID NO: 19239 - protein, 7 aa, Artificial Sequence
  Histone H2B type 2-F (78-84)
ASRLAHY

SEQ ID NO: 19240 - protein, 18 aa, Artificial Sequence
  HLA class I histocompatibility antigen, A-23 alpha chain (348-365)
ASSDSAQGSDVSLTACKV

SEQ ID NO: 19241 - protein, 9 aa, Artificial Sequence
  OTU domain-containing protein 5 (237-245)
ASSPEHPEL

SEQ ID NO: 19242 - protein, 9 aa, Artificial Sequence
  40S ribosomal protein S19 (58-66)
ASTARHLYL

SEQ ID NO: 19243 - protein, 10 aa, Artificial Sequence
  Cullin-1 (195-204)
ASTFQMAILL

SEQ ID NO: 19244 - protein, 9 aa, Artificial Sequence
  Dolichyl-diphosphooligosaccharide-proteinosyltransferase subunit DAD1 (100-108)
ASTILHLVV

SEQ ID NO: 19245 - protein, 10 aa, Artificial Sequence
  Thyroid adenoma-associated protein (153-162)
ASVNNLLKNV

SEQ ID NO: 19246 - protein, 8 aa, Artificial Sequence
  Cystic fibrosis transmembrane conductance regulator (9-16)
ASVVSKLF

SEQ ID NO: 19247 - protein, 9 aa, Artificial Sequence
  ATP-citrate synthase (223-231)
ATADYICKV

SEQ ID NO: 19248 - protein, 9 aa, Artificial Sequence
  Leucine-rich repeat-containing protein 47 (393-401)
ATAPPHVTV

SEQ ID NO: 19249 - protein, 10 aa, Artificial Sequence
  Hermansky-Pudlak syndrome 1 protein (7-16)
ATEGAEVLFY

SEQ ID NO: 19250 - protein, 9 aa, Artificial Sequence
  Kinesin-like protein KIF3C (506-514)
ATELLAAKY

SEQ ID NO: 19251 - protein, 9 aa, Artificial Sequence
  EF-hand calcium-binding domain-containing protein 4B isoform a (677-685)
ATENNLIFY

SEQ ID NO: 19252 - protein, 9 aa, Artificial Sequence
  Bestrophin-1 (573-581)
ATFTGILGK

SEQ ID NO: 19253 - protein, 9 aa, Artificial Sequence
  Apoptosis inhibitor 5 (19-27)
ATGENLPRV

SEQ ID NO: 19254 - protein, 8 aa, Artificial Sequence
  Amyloid-like protein 2 (11-18)
ATGRLLLL

SEQ ID NO: 19255 - protein, 11 aa, Artificial Sequence
  40S ribosomal protein S15 (135-145)
ATHSSRFIPLK

SEQ ID NO: 19256 - protein, 9 aa, Artificial Sequence
  Poly(rC)-binding protein 4 (135-143)
ATIPYHPSL

SEQ ID NO: 19257 - protein, 10 aa, Artificial Sequence
  Phosphatidylinositol 4-kinase alpha (169-178)
ATIRNVLREK

SEQ ID NO: 19258 - protein, 9 aa, Artificial Sequence
  Cathepsin D (182-190)
ATKQPGITF

SEQ ID NO: 19259 - protein, 12 aa, Artificial Sequence
  Protein FAM171B (413-424)
ATLPRKGQLVYG

SEQ ID NO: 19260 - protein, 9 aa, Artificial Sequence
  Nuclear fragile X mental retardation-interacting protein 2 (116-124)
ATNPISRVL

SEQ ID NO: 19261 - protein, 13 aa, Artificial Sequence
  UPF0606 protein KIAA1549L (947-959)
ATTLGSYTVQMVK

SEQ ID NO: 19262 - protein, 9 aa, Artificial Sequence
  PH domain leucine-rich repeat-containing protein phosphatase 1 (7-15)
ATVQRLPEL

SEQ ID NO: 19263 - protein, 9 aa, Artificial Sequence
  Myelin proteolipid protein (206-214)
ATYNFAVLK

SEQ ID NO: 19264 - protein, 10 aa, Artificial Sequence
  Eyes absent homolog 1 (124-133)
ATYPQPGQPY

SEQ ID NO: 19265 - protein, 9 aa, Artificial Sequence
  Sigma non-opioid intracellular receptor 1 (17-25)
AVAAVLTQV

SEQ ID NO: 19266 - protein, 9 aa, Artificial Sequence
  Unconventional myosin-Ic (83-91)
AVADTVYRA

SEQ ID NO: 19267 - protein, 9 aa, Artificial Sequence
  Membrane-associated guanylate kinase, WW and PDZ domain-containing protein 2 (1428-1436)
AVAPGPWKV

SEQ ID NO: 19268 - protein, 9 aa, Artificial Sequence
  Endothelin B receptor (291-299)
AVASWSRIK

SEQ ID NO: 19269 - protein, 9 aa, Artificial Sequence
  Sideroflexin-3 (161-169)
AVATALGLK

SEQ ID NO: 19270 - protein, 9 aa, Artificial Sequence
  Ubiquitin-like modifier-activating enzyme 1 (786-794)
AVATFLQSV

SEQ ID NO: 19271 - protein, 17 aa, Artificial Sequence
  Tubulin alpha-3E chain (374-390)
AVCMLSNTTAIAEAWAR

SEQ ID NO: 19272 - protein, 10 aa, Artificial Sequence
  SH3 domain-containing RING finger protein 3 (442-451)
AVDALLQGAV

SEQ ID NO: 19273 - protein, 9 aa, Artificial Sequence
  Ribosome biogenesis protein WDR12 (196-204)
AVDGSGTKF

SEQ ID NO: 19274 - protein, 9 aa, Artificial Sequence
  Protein fem-1 homolog A (542-550)
AVDKDTTNV

SEQ ID NO: 19275 - protein, 15 aa, Artificial Sequence
  Transmembraneoprotein NMB (550-564)
AVFFPGNQEKDPLLK

SEQ ID NO: 19276 - protein, 10 aa, Artificial Sequence
  GTP-binding protein Di-Ras2 (11-20)
AVFGAGGVGK

SEQ ID NO: 19277 - protein, 10 aa, Artificial Sequence
  Ankyrin-2 (1172-1181)
AVFPEGALTK

SEQ ID NO: 19278 - protein, 8 aa, Artificial Sequence
  Mitochondrial coenzyme A transporter SLC25A42 (298-305)
AVGISFTT

SEQ ID NO: 19279 - protein, 9 aa, Artificial Sequence
  Low-density lipoprotein receptor-related protein 2 (1967-1975)
AVHDSFLYY

SEQ ID NO: 19280 - protein, 9 aa, Artificial Sequence
  Exosome complex exonuclease RRP44 (286-294)
AVHEDIVAV

SEQ ID NO: 19281 - protein, 12 aa, Artificial Sequence
  Structural maintenance of chromosomes flexible hinge domain-containing protein 1 (181-192)
AVIDNGRGMTSK

SEQ ID NO: 19282 - protein, 11 aa, Artificial Sequence
  Pirin (150-160)
AVISGEALGIK

SEQ ID NO: 19283 - protein, 11 aa, Artificial Sequence
  Protein disulfide-isomerase (199-209)
AVKVHSFPTLK

SEQ ID NO: 19284 - protein, 9 aa, Artificial Sequence
  Influenza virus NS1A-binding protein (306-314)
AVLDGIFCV

SEQ ID NO: 19285 - protein, 9 aa, Artificial Sequence
  HLA class I histocompatibility antigen, Cw-5 alpha chain (322-330)
AVLGAVMAV

SEQ ID NO: 19286 - protein, 9 aa, Artificial Sequence
  HLA class I histocompatibility antigen, Cw-3 alpha chain (322-330)
AVLGAVVAV

SEQ ID NO: 19287 - protein, 9 aa, Artificial Sequence
  Kelch-like protein 21 (508-516)
AVLGGKLYV

SEQ ID NO: 19288 - protein, 9 aa, Artificial Sequence
  Transmembrane protein 147 (17-25)
AVLGHFLSH

SEQ ID NO: 19289 - protein, 8 aa, Artificial Sequence
  ER membrane protein complex subunit 1 (144-151)
AVLKKTTL

SEQ ID NO: 19290 - protein, 9 aa, Artificial Sequence
  Coronin-1B (42-50)
AVNPKFLAV

SEQ ID NO: 19291 - protein, 12 aa, Artificial Sequence
  Trinucleotide repeat-containing gene 6C protein (287-298)
AVQKEGSGGNAW

SEQ ID NO: 19292 - protein, 9 aa, Artificial Sequence
  Constitutive coactivator of peroxisome proliferator-activated receptor gamma (278-286)
AVSDHISKV

SEQ ID NO: 19293 - protein, 17 aa, Artificial Sequence
  Histone H2B type 2-F (111-127)
AVSEGTKAVTKYTSSKL

SEQ ID NO: 19294 - protein, 10 aa, Artificial Sequence
  Unconventional myosin-Ib (273-282)
AVVAAVLKLG

SEQ ID NO: 19295 - protein, 13 aa, Artificial Sequence
  HLA class I histocompatibility antigen, Cw-7 alpha chain (270-282)
AVVVPSGQEQRYT

SEQ ID NO: 19296 - protein, 18 aa, Artificial Sequence
  Transketolase (84-101)
AVWAEAGFLAEAELLNLR

SEQ ID NO: 19297 - protein, 9 aa, Artificial Sequence
  Fanconi anemia group B protein (310-318)
AVWKESFQV

SEQ ID NO: 19298 - protein, 9 aa, Artificial Sequence
  Glia-derived nexin (198-206)
AVYFKGLWK

SEQ ID NO: 19299 - protein, 10 aa, Artificial Sequence
  Ras GTPase-activating protein-binding protein 1 (54-63)
AVYGQKEIHR

SEQ ID NO: 19300 - protein, 9 aa, Artificial Sequence
  Probable helicase with zinc finger domain (533-541)
AVYLLPVPK

SEQ ID NO: 19301 - protein, 9 aa, Artificial Sequence
  Coagulation factor VIII (1262-1270)
AYAPVLQDF

SEQ ID NO: 19302 - protein, 10 aa, Artificial Sequence
  E3 ubiquitin-protein ligase TTC3 (578-587)
AYCGIGKVYL

SEQ ID NO: 19303 - protein, 9 aa, Artificial Sequence
  Serine/threonine-protein kinase SIK3 (371-379)
AYDHYSAIY

SEQ ID NO: 19304 - protein, 9 aa, Artificial Sequence
  E3 ubiquitin-protein ligase TRIM13 (217-225)
AYDPEINKL

SEQ ID NO: 19305 - protein, 9 aa, Artificial Sequence
  Lysophosphatidic acid receptor 1 (291-299)
AYEKFFLLL

SEQ ID NO: 19306 - protein, 8 aa, Artificial Sequence
  Annexin A5 (93-100)
AYELKHAL

SEQ ID NO: 19307 - protein, 8 aa, Artificial Sequence
  Collagen alpha-1(VI) chain (997-1004)
AYGESHLF

SEQ ID NO: 19308 - protein, 8 aa, Artificial Sequence
  Ribosomal protein S6 kinase alpha-4 (27-34)
AYGKVFLV

SEQ ID NO: 19309 - protein, 8 aa, Artificial Sequence
  Lipase maturation factor 2 (303-310)
AYGTVHYF

SEQ ID NO: 19310 - protein, 9 aa, Artificial Sequence
  Transportin-1 (520-528)
AYILDTLVF

SEQ ID NO: 19311 - protein, 9 aa, Artificial Sequence
  Poly(A)-specific ribonuclease PARN (337-345)
AYITGLCFI

SEQ ID NO: 19312 - protein, 9 aa, Artificial Sequence
  Collagen alpha-1(XXII) chain (141-149)
AYKQVAILL

SEQ ID NO: 19313 - protein, 9 aa, Artificial Sequence
  Nuclear receptor subfamily 2 group C member 2 (493-501)
AYLKAIVLF

SEQ ID NO: 19314 - protein, 9 aa, Artificial Sequence
  Low affinity sodium-glucose cotransporter (318-326)
AYLKLLPMF

SEQ ID NO: 19315 - protein, 9 aa, Artificial Sequence
  Phosphatidylinositide phosphatase SAC2 (390-398)
AYLKQVLLF

SEQ ID NO: 19316 - protein, 10 aa, Artificial Sequence
  TRPM8 channel-associated factor 1 (477-486)
AYLPEWKENI

SEQ ID NO: 19317 - protein, 9 aa, Artificial Sequence
  Catenin alpha-2 (811-819)
AYLQRIALY

SEQ ID NO: 19318 - protein, 9 aa, Artificial Sequence
  Signal recognition particle subunit SRP68 (191-199)
AYLSGMLRF

SEQ ID NO: 19319 - protein, 9 aa, Artificial Sequence
  Transmembraneoprotein NMB (36-44)
AYMREHNQL

SEQ ID NO: 19320 - protein, 10 aa, Artificial Sequence
  Serine/threonine-protein kinase mTOR (1308-1317)
AYNPMARDLF

SEQ ID NO: 19321 - protein, 9 aa, Artificial Sequence
  Eukaryotic translation initiation factor 2-alpha kinase 4 (919-927)
AYNQKVDLF

SEQ ID NO: 19322 - protein, 9 aa, Artificial Sequence
  Regulation of nuclear pre-mRNA domain-containing protein 2 (70-78)
AYPHRLNLF

SEQ ID NO: 19323 - protein, 9 aa, Artificial Sequence
  Alpha-mannosidase 2C1 (924-932)
AYSLNFPLL

SEQ ID NO: 19324 - protein, 9 aa, Artificial Sequence
  Glutamine-fructose-6-phosphate aminotransferase (isomerizing) 1 (477-485)
AYTSQFVSL

SEQ ID NO: 19325 - protein, 8 aa, Artificial Sequence
  Bax inhibitor 1 (91-98)
AYVHMVTH

SEQ ID NO: 19326 - protein, 49 aa, Artificial Sequence
  ATP synthase subunit epsilon, mitochondrial (3-51)
AYWRQAGLSYIRYSQICAKAVRDALKTEFKANAEKTSGSNVKIVKVKKE

SEQ ID NO: 19327 - protein, 9 aa, Artificial Sequence
  Serum albumin (500-508)
CCTESLVNR

SEQ ID NO: 19328 - protein, 9 aa, Artificial Sequence
  Phosphoglycerate kinase 1 (50-58)
CLDNGAKSV

SEQ ID NO: 19329 - protein, 9 aa, Artificial Sequence
  Sodium/potassium-transporting ATPase subunit alpha-3 (359-367)
CLVKNLEAV

SEQ ID NO: 19330 - protein, 8 aa, Artificial Sequence
  Unconventional myosin-Id (243-250)
DAAEFRVV

SEQ ID NO: 19331 - protein, 9 aa, Artificial Sequence
  Dual serine/threonine and tyrosine protein kinase (357-365)
DAAKALNLV

SEQ ID NO: 19332 - protein, 9 aa, Artificial Sequence
  Dynactin subunit 1 (411-419)
DAALGAEEM

SEQ ID NO: 19333 - protein, 9 aa, Artificial Sequence
  Cytoplasmic dynein 2 heavy chain 1 (311-319)
DAALQMITV

SEQ ID NO: 19334 - protein, 8 aa, Artificial Sequence
  Unconventional myosin-Ib (247-254)
DAANFRTV

SEQ ID NO: 19335 - protein, 8 aa, Artificial Sequence
  HLA class I histocompatibility antigen, alpha chain E (60-67)
DAASPRMV

SEQ ID NO: 19336 - protein, 10 aa, Artificial Sequence
  Density-regulated protein (69-78)
DADYPLRVLY

SEQ ID NO: 19337 - protein, 14 aa, Artificial Sequence
  Gamma-secretase C-terminal fragment 59 (562-575)
DAEFRHDSGYEVHH

SEQ ID NO: 19338 - protein, 9 aa, Artificial Sequence
  Uncharacterized protein C15orf52 (63-71)
DAELDRRIV

SEQ ID NO: 19339 - protein, 8 aa, Artificial Sequence
  Zinc finger SWIM domain-containing protein 6 (875-882)
DAFKIATL

SEQ ID NO: 19340 - protein, 9 aa, Artificial Sequence
  Fructosamine-3-kinase (34-42)
DAGPVFVKV

SEQ ID NO: 19341 - protein, 9 aa, Artificial Sequence
  WD repeat-containing protein 81 (428-436)
DAHFHFHQI

SEQ ID NO: 19342 - protein, 9 aa, Artificial Sequence
  Farnesyl pyrophosphate synthase (33-41)
DAIARLKEV

SEQ ID NO: 19343 - protein, 9 aa, Artificial Sequence
  Dolichyl-diphosphooligosaccharide-proteinosyltransferase subunit 2 (67-75)
DAKKACTYI

SEQ ID NO: 19344 - protein, 9 aa, Artificial Sequence
  Heat shock 70 kDa protein 1B (323-331)
DAKLDKAQI

SEQ ID NO: 19345 - protein, 9 aa, Artificial Sequence
  FERM, RhoGEF and pleckstrin domain-containing protein 2 (711-719)
DALKAITEV

SEQ ID NO: 19346 - protein, 9 aa, Artificial Sequence
  Protocadherin gamma-A12 (636-644)
DALKQSLVV

SEQ ID NO: 19347 - protein, 9 aa, Artificial Sequence
  Short-chain dehydrogenase/reductase 3 (138-146)
DALLKSQHI

SEQ ID NO: 19348 - protein, 9 aa, Artificial Sequence
  Importin subunit alpha-3 (326-334)
DALSHFPAL

SEQ ID NO: 19349 - protein, 9 aa, Artificial Sequence
  Rab GDP dissociation inhibitor beta (233-241)
DANSCQIII

SEQ ID NO: 19350 - protein, 8 aa, Artificial Sequence
  Cubilin (2289-2296)
DAPILSKF

SEQ ID NO: 19351 - protein, 8 aa, Artificial Sequence
  Fibronectin isoform 11 (1163-1170)
DAPIVNKV

SEQ ID NO: 19352 - protein, 9 aa, Artificial Sequence
  Fibronectin isoform 11 (1163-1171)
DAPIVNKVV

SEQ ID NO: 19353 - protein, 8 aa, Artificial Sequence
  Transcription activator BRG1 (696-703)
DAPKAGQL

SEQ ID NO: 19354 - protein, 9 aa, Artificial Sequence
  Protein scribble homolog (439-447)
DAPPSRVSV

SEQ ID NO: 19355 - protein, 9 aa, Artificial Sequence
  Protocadherin gamma-C3 (256-264)
DAPSGTRVV

SEQ ID NO: 19356 - protein, 9 aa, Artificial Sequence
  Fc receptor-like A (54-62)
DAREAGFQV

SEQ ID NO: 19357 - protein, 8 aa, Artificial Sequence
  Polymerase delta-interacting protein 3 (116-123)
DAREKISL

SEQ ID NO: 19358 - protein, 8 aa, Artificial Sequence
  Forkhead-associated domain-containing protein 1 (180-187)
DARKPPVI

SEQ ID NO: 19359 - protein, 8 aa, Artificial Sequence
  Polymerase delta-interacting protein 3 (55-62)
DARQKIGL

SEQ ID NO: 19360 - protein, 13 aa, Artificial Sequence
  Filamin-A (1614-1626)
DASKCTVTGAGIG

SEQ ID NO: 19361 - protein, 8 aa, Artificial Sequence
  Ataxin-10 (382-389)
DASLLKKV

SEQ ID NO: 19362 - protein, 10 aa, Artificial Sequence
  Rootletin (478-487)
DASNGSLRGL

SEQ ID NO: 19363 - protein, 9 aa, Artificial Sequence
  Basement membrane-specific heparan sulfate proteoglycan core protein (2026-2034)
DASPPPVKI

SEQ ID NO: 19364 - protein, 9 aa, Artificial Sequence
  Poly(A)-specific ribonuclease PARN (220-228)
DAVGFSRVI

SEQ ID NO: 19365 - protein, 8 aa, Artificial Sequence
  Uncharacterized protein KIAA1522 (204-211)
DAVRIPTV

SEQ ID NO: 19366 - protein, 8 aa, Artificial Sequence
  Peptidylprolyl isomerase domain and WD repeat-containing protein 1 (214-221)
DAVRLINI

SEQ ID NO: 19367 - protein, 8 aa, Artificial Sequence
  GCN1 general control of amino-acid synthesis 1-like 1 (1074-1081)
DAVRQSVV

SEQ ID NO: 19368 - protein, 9 aa, Artificial Sequence
  Putative segment polarity protein dishevelled homolog DVL1P1 (316-324)
DAVRVLREI

SEQ ID NO: 19369 - protein, 8 aa, Artificial Sequence
  WD repeat-containing protein 60 (576-583)
DAVVMPKI

SEQ ID NO: 19370 - protein, 9 aa, Artificial Sequence
  Acyl-coenzyme A thioesterase 1 isoform X1 (280-288)
DAWKQLQTF

SEQ ID NO: 19371 - protein, 8 aa, Artificial Sequence
  Nuclear factor erythroid 2-related factor 3 (109-116)
DAWLVHSV

SEQ ID NO: 19372 - protein, 9 aa, Artificial Sequence
  Zinc finger protein 148 (493-501)
DAYLNSPSL

SEQ ID NO: 19373 - protein, 8 aa, Artificial Sequence
  Phosphatidylinositide phosphatase SAC2 (555-562)
DAYRQAVI

SEQ ID NO: 19374 - protein, 9 aa, Artificial Sequence
  Type II inositol 3,4-bisphosphate 4-phosphatase (589-597)
DCMGEVVNR

SEQ ID NO: 19375 - protein, 18 aa, Artificial Sequence
  Prolow-density lipoprotein receptor-related protein 1 (2270-2287)
DDGSRRITIVENVGSVEG

SEQ ID NO: 19376 - protein, 16 aa, Artificial Sequence
  HLA class I histocompatibility antigen, alpha chain E (50-65)
DDTQFVRFDNDAASPR

SEQ ID NO: 19377 - protein, 13 aa, Artificial Sequence
  HLA class I histocompatibility antigen, B-15 alpha chain (53-65)
DDTQFVRFDSDAA

SEQ ID NO: 19378 - protein, 8 aa, Artificial Sequence
  Serum paraoxonase/arylesterase 2 (123-130)
DDTVYLFV

SEQ ID NO: 19379 - protein, 10 aa, Artificial Sequence
  Prohibitin (166-175)
DDVSLTHLTF

SEQ ID NO: 19380 - protein, 11 aa, Artificial Sequence
  Eukaryotic initiation factor 4A-II (183-193)
DEADEMLSRGF

SEQ ID NO: 19381 - protein, 10 aa, Artificial Sequence
  Protein Red (199-208)
DEDPENKIEF

SEQ ID NO: 19382 - protein, 10 aa, Artificial Sequence
  Nuclear pore complex protein Nup98-Nup96 (633-642)
DEDSLVSHFY

SEQ ID NO: 19383 - protein, 8 aa, Artificial Sequence
  Caseinolytic peptidase B protein homolog (340-347)
DEEHPLVF

SEQ ID NO: 19384 - protein, 10 aa, Artificial Sequence
  Splicing factor, proline- and glutamine-rich (311-320)
DEFKRLFAKY

SEQ ID NO: 19385 - protein, 9 aa, Artificial Sequence
  ER membrane protein complex subunit 1 (527-535)
DEFNLQKMM

SEQ ID NO: 19386 - protein, 9 aa, Artificial Sequence
  Aggrecan core protein (225-233)
DEFPGVRTY

SEQ ID NO: 19387 - protein, 9 aa, Artificial Sequence
  Alpha-actinin-3 (248-256)
DEKAIMTYV

SEQ ID NO: 19388 - protein, 7 aa, Artificial Sequence
  Probable ATP-dependent RNA helicase DDX27 (87-93)
DEKIEKV

SEQ ID NO: 19389 - protein, 9 aa, Artificial Sequence
  Heterogeneous nuclear ribonucleoprotein U (281-289)
DENDVITCF

SEQ ID NO: 19390 - protein, 10 aa, Artificial Sequence
  SURP and G-patch domain-containing protein 2 (569-578)
DENSLEYKYY

SEQ ID NO: 19391 - protein, 9 aa, Artificial Sequence
  Serine/threonine-protein phosphatase 2A 65 kDa regulatory subunit A beta isoform (227-235)
DEQDSVRLL

SEQ ID NO: 19392 - protein, 13 aa, Artificial Sequence
  Cytochrome c oxidase subunit 6B1 (5-17)
DEQRAEGTFPGKI

SEQ ID NO: 19393 - protein, 9 aa, Artificial Sequence
  Glycine-tRNA ligase (545-553)
DEQRTFFSF

SEQ ID NO: 19394 - protein, 16 aa, Artificial Sequence
  Prohibitin-2 (246-261)
DESFTRGSDSLIKGKK

SEQ ID NO: 19395 - protein, 15 aa, Artificial Sequence
  Annexin A2 (52-66)
DEVTIVNILTNRSNA

SEQ ID NO: 19396 - protein, 24 aa, Artificial Sequence
  Beta-2-microglobulin (75-98)
DEYACRVNHVTLSQPKIVKWDRDM

SEQ ID NO: 19397 - protein, 9 aa, Artificial Sequence
  Rho GTPase-activating protein 33 (76-84)
DFGHIQLLL

SEQ ID NO: 19398 - protein, 7 aa, Artificial Sequence
  Exocyst complex component 1 (516-522)
DFISKFF

SEQ ID NO: 19399 - protein, 10 aa, Artificial Sequence
  Chromodomain-helicase-DNA-binding protein 4 (1081-1090)
DFLEHEGYKY

SEQ ID NO: 19400 - protein, 7 aa, Artificial Sequence
  Prelamin-A/C (56-62)
DFQKNIY

SEQ ID NO: 19401 - protein, 10 aa, Artificial Sequence
  Vacuolar protein sorting-associated protein 51 homolog (75-84)
DFSARISATL

SEQ ID NO: 19402 - protein, 18 aa, Artificial Sequence
  Prohibitin-2 (174-191)
DFSLILDDVAITELSFSR

SEQ ID NO: 19403 - protein, 25 aa, Artificial Sequence
  Cytochrome c oxidase subunit 6C (51-75)
DFYRNYDVMKDFEEMRKAGIFQSVK

SEQ ID NO: 19404 - protein, 8 aa, Artificial Sequence
  Histone-lysine N-methyltransferase 2C (1502-1509)
DGAILGKL

SEQ ID NO: 19405 - protein, 8 aa, Artificial Sequence
  Melanocyte protein PMEL (233-240)
DGGNKHFL

SEQ ID NO: 19406 - protein, 22 aa, Artificial Sequence
  Cytochrome c oxidase subunit 6A1, mitochondrial (65-86)
DGNHTLFHNPHVNPLPTGYEDE

SEQ ID NO: 19407 - protein, 9 aa, Artificial Sequence
  E3 ubiquitin-protein ligase UBR4 (503-511)
DGPPAALSI

SEQ ID NO: 19408 - protein, 8 aa, Artificial Sequence
  Signal transducer and activator of transcription 2 (570-577)
DGRIMGFV

SEQ ID NO: 19409 - protein, 9 aa, Artificial Sequence
  Protein transport protein Sec31A (325-333)
DGRISVYSI

SEQ ID NO: 19410 - protein, 16 aa, Artificial Sequence
  Roundabout homolog 1 (1436-1451)
DGRQVVDMRTNPGDPR

SEQ ID NO: 19411 - protein, 8 aa, Artificial Sequence
  Ubiquitin-60S ribosomal protein L40 (57-64)
DGRTLSDY

SEQ ID NO: 19412 - protein, 9 aa, Artificial Sequence
  Low-density lipoprotein receptor-related protein 2 (857-865)
DGSHLLPVI

SEQ ID NO: 19413 - protein, 15 aa, Artificial Sequence
  Annexin A2 (182-196)
DGSVIDYELIDQDAR

SEQ ID NO: 19414 - protein, 8 aa, Artificial Sequence
  Neuroblast differentiation-associated protein AHNAK (730-737)
DGVKVPGI

SEQ ID NO: 19415 - protein, 20 aa, Artificial Sequence
  Glia-derived nexin (187-206)
DGVLTRLVLVNAVYFKGLWK

SEQ ID NO: 19416 - protein, 9 aa, Artificial Sequence
  Myotubularin-related protein 3 (99-107)
DGWDRTPQI

SEQ ID NO: 19417 - protein, 9 aa, Artificial Sequence
  Phosphorylase b kinase regulatory subunit alpha, skeletal muscle isoform (591-599)
DGYFGGARV

SEQ ID NO: 19418 - protein, 8 aa, Artificial Sequence
  Molybdenum cofactor sulfurase (53-60)
DHAGATLF

SEQ ID NO: 19419 - protein, 12 aa, Artificial Sequence
  Trifunctional enzyme subunit alpha, mitochondrial (752-763)
DHANSPNKKFYQ

SEQ ID NO: 19420 - protein, 7 aa, Artificial Sequence
  tRNA-splicing ligase RtcB homolog (149-155)
DHIPVGV

SEQ ID NO: 19421 - protein, 8 aa, Artificial Sequence
  T-complex protein 1 subunit beta (336-343)
DHPELVKL

SEQ ID NO: 19422 - protein, 7 aa, Artificial Sequence
  Syntenin-1 (292-298)
DHTIPEV

SEQ ID NO: 19423 - protein, 7 aa, Artificial Sequence
  GPI transamidase component PIG-T (163-169)
DHYFLRY

SEQ ID NO: 19424 - protein, 7 aa, Artificial Sequence
  Probable helicase with zinc finger domain (343-349)
DHYVYKV

SEQ ID NO: 19425 - protein, 9 aa, Artificial Sequence
  Probable helicase with zinc finger domain (343-351)
DHYVYKVGI

SEQ ID NO: 19426 - protein, 9 aa, Artificial Sequence
  Putative Polycomb group protein ASXL1 (616-624)
DIKARALQV

SEQ ID NO: 19427 - protein, 9 aa, Artificial Sequence
  Protein zyg-11 homolog B (263-271)
DILPNLVSL

SEQ ID NO: 19428 - protein, 14 aa, Artificial Sequence
  Collagen alpha-1(XI) chain (219-232)
DIQQFLITGDPKAA

SEQ ID NO: 19429 - protein, 16 aa, Artificial Sequence
  Collagen alpha-1(XI) chain (219-234)
DIQQFLITGDPKAAYD

SEQ ID NO: 19430 - protein, 9 aa, Artificial Sequence
  Eukaryotic translation initiation factor 3 subunit C-like protein (636-644)
DIQSSGRAK

SEQ ID NO: 19431 - protein, 14 aa, Artificial Sequence
  Protocadherin Fat 1 (2630-2643)
DITYAIEADSESVK

SEQ ID NO: 19432 - protein, 15 aa, Artificial Sequence
  Glia-derived nexin (118-132)
DIVTVANAVFVKNAS

SEQ ID NO: 19433 - protein, 8 aa, Artificial Sequence
  SWI/SNF complex subunit SMARCC1 (603-610)
DIYSKKTL

SEQ ID NO: 19434 - protein, 12 aa, Artificial Sequence
  Spectrin alpha chain, non-erythrocytic 1 (662-673)
DKGDSLDSVEAL

SEQ ID NO: 19435 - protein, 7 aa, Artificial Sequence
  V-type proton ATPase catalytic subunit A (466-472)
DKHFTEF

SEQ ID NO: 19436 - protein, 7 aa, Artificial Sequence
  Heat shock protein HSP 90-beta (498-504)
DKKVEKV

SEQ ID NO: 19437 - protein, 7 aa, Artificial Sequence
  Protein O-GlcNAcase (831-837)
DKRILEF

SEQ ID NO: 19438 - protein, 14 aa, Artificial Sequence
  Beta-enolase (195-208)
DKVVIGMDVAASEF

SEQ ID NO: 19439 - protein, 15 aa, Artificial Sequence
  L-lactate dehydrogenase A chain (43-57)
DLADELALVDVIEDK

SEQ ID NO: 19440 - protein, 23 aa, Artificial Sequence
  Neutral alpha-glucosidase AB (213-235)
DLGIFWLNAAETWVDISSNTAGK

SEQ ID NO: 19441 - protein, 19 aa, Artificial Sequence
  Biotin-protein ligase (615-633)
DLITEYNKQHKAELKPLRA

SEQ ID NO: 19442 - protein, 8 aa, Artificial Sequence
  1-phosphatidylinositol 4,5-bisphosphate phosphodiesterase beta-4 (280-287)
DLKKKGLI

SEQ ID NO: 19443 - protein, 9 aa, Artificial Sequence
  Protein AHNAK2 (2044-2052)
DLKVQTGQV

SEQ ID NO: 19444 - protein, 16 aa, Artificial Sequence
  Inosine triphosphate pyrophosphatase (41-56)
DLPEYQGEPDEISIQK

SEQ ID NO: 19445 - protein, 27 aa, Artificial Sequence
  Heat shock protein HSP 90-alpha (477-503)
DLVILLYETALLSSGFSLEDPQTHANR

SEQ ID NO: 19446 - protein, 8 aa, Artificial Sequence
  Melanocyte protein PMEL (9-16)
DLVLKRCL

SEQ ID NO: 19447 - protein, 27 aa, Artificial Sequence
  Heat shock protein HSP 90-beta (579-605)
DLVVLLFETALLSSGFSLEDPQTHSNR

SEQ ID NO: 19448 - protein, 11 aa, Artificial Sequence
  Fibronectin isoform 6 (1235-1245)
DNLSPGLEYNV

SEQ ID NO: 19449 - protein, 19 aa, Artificial Sequence
  Serine/threonine-protein phosphatase 2A 65 kDa regulatory subunit A alpha isoform (199-217)
DNVKSEIIPMFSNLASDEQ

SEQ ID NO: 19450 - protein, 8 aa, Artificial Sequence
  GPN-loop GTPase 2 (151-158)
DPAKFISV

SEQ ID NO: 19451 - protein, 16 aa, Artificial Sequence
  Cadherin-2 (380-395)
DPANWLKIDPVNGQIT

SEQ ID NO: 19452 - protein, 9 aa, Artificial Sequence
  DNA helicase MCM9 (298-306)
DPFAGRNVI

SEQ ID NO: 19453 - protein, 8 aa, Artificial Sequence
  Putative signal peptidase complex catalytic subunit SEC11B (62-69)
DPIRVGEI

SEQ ID NO: 19454 - protein, 10 aa, Artificial Sequence
  Maestro heat-like repeat-containing protein family member 6 (652-661)
DPKPAVAAAA

SEQ ID NO: 19455 - protein, 9 aa, Artificial Sequence
  Prolyl 4-hydroxylase subunit alpha-2 (368-376)
DPKTGVLTV

SEQ ID NO: 19456 - protein, 8 aa, Artificial Sequence
  Sulfate transporter (642-649)
DPLELHTI

SEQ ID NO: 19457 - protein, 8 aa, Artificial Sequence
  Signal recognition particle 9 kDa protein (21-28)
DPMKARVV

SEQ ID NO: 19458 - protein, 9 aa, Artificial Sequence
  Titin (17217-17225)
DPPGTPEPI

SEQ ID NO: 19459 - protein, 9 aa, Artificial Sequence
  Titin (16908-16916)
DPRSLAVPI

SEQ ID NO: 19460 - protein, 9 aa, Artificial Sequence
  Dedicator of cytokinesis protein 7 (1087-1095)
DPRYSDPQI

SEQ ID NO: 19461 - protein, 10 aa, Artificial Sequence
  Integral membrane protein DGCR2/IDD (52-61)
DPSHFHAVNV

SEQ ID NO: 19462 - protein, 15 aa, Artificial Sequence
  Cadherin-2 (267-281)
DPTGRFAIQTDPNSN

SEQ ID NO: 19463 - protein, 16 aa, Artificial Sequence
  Cadherin-2 (267-282)
DPTGRFAIQTDPNSND

SEQ ID NO: 19464 - protein, 17 aa, Artificial Sequence
  Cadherin-2 (267-283)
DPTGRFAIQTDPNSNDG

SEQ ID NO: 19465 - protein, 9 aa, Artificial Sequence
  Zinc finger protein 469 (3286-3294)
DPWAGGEPL

SEQ ID NO: 19466 - protein, 8 aa, Artificial Sequence
  Poly (ADP-ribose) polymerase 12 (148-155)
DPWLLPEI

SEQ ID NO: 19467 - protein, 26 aa, Artificial Sequence
  Protein S100-A6 (65-90)
DQEVNFQEYVTFLGALALIYNEALKG

SEQ ID NO: 19468 - protein, 24 aa, Artificial Sequence
  CREB-binding protein (539-562)
DQQPPNLISESALPTSLGATNPLM

SEQ ID NO: 19469 - protein, 7 aa, Artificial Sequence
  Paired amphipathic helix protein Sin3a (131-137)
DQVKLQF

SEQ ID NO: 19470 - protein, 7 aa, Artificial Sequence
  Cyclin-I (74-80)
DRFLATV

SEQ ID NO: 19471 - protein, 8 aa, Artificial Sequence
  SUN domain-containing protein 2 (41-48)
DRIGLADY

SEQ ID NO: 19472 - protein, 21 aa, Artificial Sequence
  Heterogeneous nuclear ribonucleoprotein U (184-204)
DRLSASSLTMESFAFLWAGGR

SEQ ID NO: 19473 - protein, 15 aa, Artificial Sequence
  HLA class I histocompatibility antigen, A-23 alpha chain (351-365)
DSAQGSDVSLTACKV

SEQ ID NO: 19474 - protein, 11 aa, Artificial Sequence
  HLA class I histocompatibility antigen, alpha chain E (338-348)
DSAQGSESHSL

SEQ ID NO: 19475 - protein, 11 aa, Artificial Sequence
  DNA-directed RNA polymerase I subunit RPA1 (1009-1019)
DSDGSVVQFLY

SEQ ID NO: 19476 - protein, 11 aa, Artificial Sequence
  ATP-dependent RNA helicase DHX29 (1132-1142)
DSDHLTIYNAY

SEQ ID NO: 19477 - protein, 9 aa, Artificial Sequence
  Sorbin and SH3 domain-containing protein 1 (255-263)
DSDLYSPRY

SEQ ID NO: 19478 - protein, 10 aa, Artificial Sequence
  Tyrosinase (454-463)
DSDPDSFQDY

SEQ ID NO: 19479 - protein, 7 aa, Artificial Sequence
  Cullin-4B (365-371)
DSFEQRF

SEQ ID NO: 19480 - protein, 16 aa, Artificial Sequence
  Alpha-endosulfine (66-81)
DSGDYNMAKAKMKNKQ

SEQ ID NO: 19481 - protein, 10 aa, Artificial Sequence
  Ral GTPase-activating protein subunit alpha-1 (921-930)
DSHSDSFSAF

SEQ ID NO: 19482 - protein, 14 aa, Artificial Sequence
  Acylamino-acid-releasing enzyme (442-455)
DSILSLPGNVGHQD

SEQ ID NO: 19483 - protein, 13 aa, Artificial Sequence
  Endoplasmin (205-217)
DSNEFSVIADPRG

SEQ ID NO: 19484 - protein, 14 aa, Artificial Sequence
  Endoplasmin (205-218)
DSNEFSVIADPRGN

SEQ ID NO: 19485 - protein, 15 aa, Artificial Sequence
  Endoplasmin (205-219)
DSNEFSVIADPRGNT

SEQ ID NO: 19486 - protein, 16 aa, Artificial Sequence
  Endoplasmin (205-220)
DSNEFSVIADPRGNTL

SEQ ID NO: 19487 - protein, 17 aa, Artificial Sequence
  Endoplasmin (205-221)
DSNEFSVIADPRGNTLG

SEQ ID NO: 19488 - protein, 8 aa, Artificial Sequence
  Serine/threonine-protein phosphatase 2A 65 kDa regulatory subunit A beta isoform isoform e (103-110)
DSVRLLAV

SEQ ID NO: 19489 - protein, 10 aa, Artificial Sequence
  Calpain-3 (40-49)
DTDGSGKLNL

SEQ ID NO: 19490 - protein, 19 aa, Artificial Sequence
  Beta-secretase 2 (110-128)
DTGSSNFAVAGTPHSYIDT

SEQ ID NO: 19491 - protein, 11 aa, Artificial Sequence
  Fibronectin isoform 6 (1261-1271)
DTIIPAVPPPT

SEQ ID NO: 19492 - protein, 12 aa, Artificial Sequence
  IST1 homolog (333-344)
DTLPTASAGAST

SEQ ID NO: 19493 - protein, 9 aa, Artificial Sequence
  Pre-mRNA-processing-splicing factor 8 (1782-1790)
DTNVYRVTI

SEQ ID NO: 19494 - protein, 16 aa, Artificial Sequence
  Glutamate receptor ionotropic, kainate 2 (79-94)
DTQKINLYDSFEASKK

SEQ ID NO: 19495 - protein, 7 aa, Artificial Sequence
  Zinc finger MYM-type protein 2 (612-618)
DTWRTEY

SEQ ID NO: 19496 - protein, 9 aa, Artificial Sequence
  V-type proton ATPase subunit S1 (142-150)
DVAVVAGGL

SEQ ID NO: 19497 - protein, 9 aa, Artificial Sequence
  Coatomer subunit epsilon (49-57)
DVERDVFLY

SEQ ID NO: 19498 - protein, 8 aa, Artificial Sequence
  Endothelial differentiation-related factor 1 (37-44)
DVETSKKW

SEQ ID NO: 19499 - protein, 10 aa, Artificial Sequence
  Inhibitor of nuclear factor kappa-B kinase subunit alpha (123-132)
DVGGKIIHKI

SEQ ID NO: 19500 - protein, 12 aa, Artificial Sequence
  Gamma-secretase C-terminal fragment 59 (584-595)
DVGSNKGAIIGL

SEQ ID NO: 19501 - protein, 18 aa, Artificial Sequence
  Gamma-secretase C-terminal fragment 59 (584-601)
DVGSNKGAIIGLMVGGVV

SEQ ID NO: 19502 - protein, 7 aa, Artificial Sequence
  40S ribosomal protein S13 (21-27)
DVKEQIY

SEQ ID NO: 19503 - protein, 16 aa, Artificial Sequence
  Laminin subunit alpha-4 (1287-1302)
DVKGIKVQSVDKQYND

SEQ ID NO: 19504 - protein, 17 aa, Artificial Sequence
  Laminin subunit alpha-4 (1287-1303)
DVKGIKVQSVDKQYNDG

SEQ ID NO: 19505 - protein, 8 aa, Artificial Sequence
  N6-adenosine-methyltransferase 70 kDa subunit (382-389)
DVSILGKF

SEQ ID NO: 19506 - protein, 9 aa, Artificial Sequence
  HLA class I histocompatibility antigen, A-23 alpha chain (357-365)
DVSLTACKV

SEQ ID NO: 19507 - protein, 12 aa, Artificial Sequence
  Ubiquitin carboxyl-terminal hydrolase 36 (576-587)
DVVLSTSPKLLA

SEQ ID NO: 19508 - protein, 6 aa, Artificial Sequence
  U5 small nuclear ribonucleoprotein 200 kDa helicase (1392-1397)
DWYEKF

SEQ ID NO: 19509 - protein, 9 aa, Artificial Sequence
  Growth arrest-specific protein 7 (285-293)
DYAKNLAKL

SEQ ID NO: 19510 - protein, 9 aa, Artificial Sequence
  ER membrane protein complex subunit 1 (634-642)
DYAKVLLLI

SEQ ID NO: 19511 - protein, 9 aa, Artificial Sequence
  Multidrug resistance-associated protein 5 (776-784)
DYATIFNNL

SEQ ID NO: 19512 - protein, 9 aa, Artificial Sequence
  Protein Niban (485-493)
DYDSSTIRK

SEQ ID NO: 19513 - protein, 7 aa, Artificial Sequence
  Plastin-3 (34-40)
DYELHEL

SEQ ID NO: 19514 - protein, 9 aa, Artificial Sequence
  14-3-3 protein epsilon (127-135)
DYHRYLAEF

SEQ ID NO: 19515 - protein, 9 aa, Artificial Sequence
  Cyclic AMP-dependent transcription factor ATF-4 (36-44)
DYLEVAKHF

SEQ ID NO: 19516 - protein, 9 aa, Artificial Sequence
  Lysosomal-trafficking regulator (2228-2236)
DYLKGLASF

SEQ ID NO: 19517 - protein, 9 aa, Artificial Sequence
  Importin-7 (93-101)
DYPSRWTAI

SEQ ID NO: 19518 - protein, 9 aa, Artificial Sequence
  L-dopachrome tautomerase (155-163)
DYVITTQHW

SEQ ID NO: 19519 - protein, 9 aa, Artificial Sequence
  Down syndrome critical region protein 3 (203-211)
EAAIRSVEL

SEQ ID NO: 19520 - protein, 10 aa, Artificial Sequence
  V-set and immunoglobulin domain-containing protein 10-like (447-456)
EAAVPAGSRL

SEQ ID NO: 19521 - protein, 8 aa, Artificial Sequence
  Laminin subunit gamma-1 (1193-1200)
EADDIVRV

SEQ ID NO: 19522 - protein, 8 aa, Artificial Sequence
  Poly (ADP-ribose) polymerase 1 (810-817)
EAEIIRKY

SEQ ID NO: 19523 - protein, 10 aa, Artificial Sequence
  Poly (ADP-ribose) polymerase 14 (805-814)
EAFAEAVKTV

SEQ ID NO: 19524 - protein, 8 aa, Artificial Sequence
  Alpha-mannosidase 2x (749-756)
EAFPLRVI

SEQ ID NO: 19525 - protein, 12 aa, Artificial Sequence
  Coronin-6 (123-134)
EAGGGGAFIVLP

SEQ ID NO: 19526 - protein, 8 aa, Artificial Sequence
  Leucine-tRNA ligase, cytoplasmic (462-469)
EAKEKIYL

SEQ ID NO: 19527 - protein, 9 aa, Artificial Sequence
  Guanine nucleotide-binding protein G(s) subunit alpha isoforms short (258-266)
EALNLFKSI

SEQ ID NO: 19528 - protein, 9 aa, Artificial Sequence
  60 kDa heat shock protein, mitochondrial (165-173)
EALSTLVLN

SEQ ID NO: 19529 - protein, 8 aa, Artificial Sequence
  Sulfhydryl oxidase 1 (224-231)
EANVVRKF

SEQ ID NO: 19530 - protein, 10 aa, Artificial Sequence
  General transcription factor IIF subunit 1 (356-365)
EASSALFMAK

SEQ ID NO: 19531 - protein, 9 aa, Artificial Sequence
  Spectrin beta chain, non-erythrocytic 2 (1585-1593)
EDALRAQQF

SEQ ID NO: 19532 - protein, 8 aa, Artificial Sequence
  Tyrosine-protein kinase BAZ1B (275-282)
EDELVKKY

SEQ ID NO: 19533 - protein, 9 aa, Artificial Sequence
  ATP-dependent RNA helicase DDX50 (3-11)
EDNPQTLLF

SEQ ID NO: 19534 - protein, 9 aa, Artificial Sequence
  Kinesin-like protein KIF13B (775-783)
EDNPVIRSY

SEQ ID NO: 19535 - protein, 8 aa, Artificial Sequence
  F-box only protein 32 (101-108)
EDQQNIRL

SEQ ID NO: 19536 - protein, 9 aa, Artificial Sequence
  Peptidyl-prolyl cis-trans isomerase FKBP9 (198-206)
EDQVQIHTY

SEQ ID NO: 19537 - protein, 8 aa, Artificial Sequence
  Eukaryotic translation initiation factor 3 subunit A (755-762)
EDRDLFVM

SEQ ID NO: 19538 - protein, 9 aa, Artificial Sequence
  Cullin-4B (405-413)
EEADRLITY

SEQ ID NO: 19539 - protein, 10 aa, Artificial Sequence
  Proteasome activator complex subunit 3 (93-102)
EEAFQGTKVF

SEQ ID NO: 19540 - protein, 10 aa, Artificial Sequence
  Heterogeneous nuclear ribonucleoprotein U (540-549)
EEAQKLLEQY

SEQ ID NO: 19541 - protein, 10 aa, Artificial Sequence
  Staphylococcal nuclease domain-containing protein 1 (554-563)
EEATLFTKEL

SEQ ID NO: 19542 - protein, 9 aa, Artificial Sequence
  Tribbles homolog 2 (149-157)
EEEAARLFY

SEQ ID NO: 19543 - protein, 10 aa, Artificial Sequence
  Cullin-4B (404-413)
EEEADRLITY

SEQ ID NO: 19544 - protein, 9 aa, Artificial Sequence
  Negative elongation factor E (11-19)
EEEALQKKF

SEQ ID NO: 19545 - protein, 10 aa, Artificial Sequence
  Synemin (68-77)
EEEENDGHWF

SEQ ID NO: 19546 - protein, 11 aa, Artificial Sequence
  Nestin (503-513)
EEEGSALKTSW

SEQ ID NO: 19547 - protein, 10 aa, Artificial Sequence
  Angiomotin-like protein 1 (596-605)
EEELREKQAY

SEQ ID NO: 19548 - protein, 10 aa, Artificial Sequence
  Nestin (316-325)
EEENLGKGEY

SEQ ID NO: 19549 - protein, 9 aa, Artificial Sequence
  SHC-transforming protein 1 (341-349)
EEEPPDHQY

SEQ ID NO: 19550 - protein, 10 aa, Artificial Sequence
  Synemin (856-865)
EEESTIRYSW

SEQ ID NO: 19551 - protein, 9 aa, Artificial Sequence
  (1052-1060)
EEFETLKEF

SEQ ID NO: 19552 - protein, 13 aa, Artificial Sequence
  HLA class II histocompatibility antigen, DR alpha chain (41-53)
EEFGRFASFEAQG

SEQ ID NO: 19553 - protein, 7 aa, Artificial Sequence
  cAMP-dependent protein kinase type I-beta regulatory subunit (247-253)
EEFLSKV

SEQ ID NO: 19554 - protein, 9 aa, Artificial Sequence
  Erlin-2 (50-58)
EEGHIGVYY

SEQ ID NO: 19555 - protein, 9 aa, Artificial Sequence
  STAM-binding protein (50-58)
EEGNIEHAF

SEQ ID NO: 19556 - protein, 9 aa, Artificial Sequence
  Rho guanine nucleotide exchange factor 11 (801-809)
EEGPIIKEI

SEQ ID NO: 19557 - protein, 10 aa, Artificial Sequence
  Nestin (504-513)
EEGSALKTSW

SEQ ID NO: 19558 - protein, 8 aa, Artificial Sequence
  Cytochrome c oxidase subunit 6A1, mitochondrial (8-15)
EEGSARMW

SEQ ID NO: 19559 - protein, 9 aa, Artificial Sequence
  Phosphopantothenate-cysteine ligase (283-291)
EEIEKGVEI

SEQ ID NO: 19560 - protein, 10 aa, Artificial Sequence
  A-kinase anchor protein 9 (822-831)
EEIEKQRNTF

SEQ ID NO: 19561 - protein, 10 aa, Artificial Sequence
  Vimentin (240-249)
EEIQELQAQI

SEQ ID NO: 19562 - protein, 9 aa, Artificial Sequence
  Zinc finger E-box-binding homeobox 2 (457-465)
EEISKLKGY

SEQ ID NO: 19563 - protein, 9 aa, Artificial Sequence
  Nuclear pore complex protein Nup205 (77-85)
EEISTVLQY

SEQ ID NO: 19564 - protein, 9 aa, Artificial Sequence
  Cadherin-2 (138-146)
EEIVFPRQF

SEQ ID NO: 19565 - protein, 9 aa, Artificial Sequence
  Leucine zipper putative tumor suppressor 1 (511-519)
EEKEKVIQY

SEQ ID NO: 19566 - protein, 11 aa, Artificial Sequence
  Intraflagellar transport protein 81 homolog (450-460)
EEKKGISGYSY

SEQ ID NO: 19567 - protein, 9 aa, Artificial Sequence
  FERM domain-containing protein 5 (259-267)
EEKKIILTY

SEQ ID NO: 19568 - protein, 9 aa, Artificial Sequence
  Receptor-type tyrosine-protein phosphatase zeta (1495-1503)
EEKLIIQDF

SEQ ID NO: 19569 - protein, 11 aa, Artificial Sequence
  Cyclic AMP-responsive element-binding protein 3-like protein 2 (268-278)
EEKRTLIAEGY

SEQ ID NO: 19570 - protein, 11 aa, Artificial Sequence
  Nestin (176-186)
EELARRLGEAW

SEQ ID NO: 19571 - protein, 14 aa, Artificial Sequence
  L-dopachrome tautomerase (49-62)
EELFLTSDQLGYSY

SEQ ID NO: 19572 - protein, 12 aa, Artificial Sequence
  Glia-derived nexin (40-51)
EELGSNTGIQVF

SEQ ID NO: 19573 - protein, 10 aa, Artificial Sequence
  Myotubularin-related protein 6 (290-299)
EELKLKEKTY

SEQ ID NO: 19574 - protein, 9 aa, Artificial Sequence
  HEAT repeat-containing protein 1 (773-781)
EELNSTQRV

SEQ ID NO: 19575 - protein, 8 aa, Artificial Sequence
  E3 ubiquitin-protein ligase RNF213 (1762-1769)
EELPLMLL

SEQ ID NO: 19576 - protein, 10 aa, Artificial Sequence
  Protein KRI1 homolog (27-36)
EELQRLKDRY

SEQ ID NO: 19577 - protein, 9 aa, Artificial Sequence
  Angiomotin-like protein 1 (597-605)
EELREKQAY

SEQ ID NO: 19578 - protein, 10 aa, Artificial Sequence
  Serpin H1 (373-382)
EELRSPKLFY

SEQ ID NO: 19579 - protein, 10 aa, Artificial Sequence
  Vimentin (374-383)
EEMARHLREY

SEQ ID NO: 19580 - protein, 10 aa, Artificial Sequence
  RANBP2-like and GRIP domain-containing protein 1 (1180-1189)
EEMKSGLKDF

SEQ ID NO: 19581 - protein, 10 aa, Artificial Sequence
  Non-POU domain-containing octamer-binding protein (88-97)
EEMRKLFEKY

SEQ ID NO: 19582 - protein, 9 aa, Artificial Sequence
  NudC domain-containing protein 3 (165-173)
EENGERVLM

SEQ ID NO: 19583 - protein, 10 aa, Artificial Sequence
  cGMP-inhibited 3',5'-cyclic phosphodiesterase B (605-614)
EENIFSKESF

SEQ ID NO: 19584 - protein, 11 aa, Artificial Sequence
  Pituitary tumor-transforming gene 1 protein-interacting protein (169-179)
EENPYARFENN

SEQ ID NO: 19585 - protein, 10 aa, Artificial Sequence
  Nestin (283-292)
EENQESLRSL

SEQ ID NO: 19586 - protein, 9 aa, Artificial Sequence
  Tropomodulin-2 (273-281)
EENSRILKF

SEQ ID NO: 19587 - protein, 10 aa, Artificial Sequence
  Syndecan-3 (422-431)
EEPKQASVTY

SEQ ID NO: 19588 - protein, 9 aa, Artificial Sequence
  Lymphoid enhancer-binding factor 1 (247-255)
EEQAKYYEL

SEQ ID NO: 19589 - protein, 9 aa, Artificial Sequence
  Receptor-type tyrosine-protein phosphatase gamma (1261-1269)
EEQIIIHDF

SEQ ID NO: 19590 - protein, 9 aa, Artificial Sequence
  Eukaryotic translation initiation factor 4 gamma 2 (197-205)
EEQRAIAKI

SEQ ID NO: 19591 - protein, 10 aa, Artificial Sequence
  General receptor for phosphoinositides 1-associated scaffold protein (125-134)
EEQRVEMVTF

SEQ ID NO: 19592 - protein, 10 aa, Artificial Sequence
  14-3-3 protein beta/alpha (41-50)
EERNLLSVAY

SEQ ID NO: 19593 - protein, 9 aa, Artificial Sequence
  Unconventional myosin-Va (255-263)
EERNYHIFY

SEQ ID NO: 19594 - protein, 9 aa, Artificial Sequence
  Protein RTF2 homolog (273-281)
EESEAYKSL

SEQ ID NO: 19595 - protein, 10 aa, Artificial Sequence
  Protein RTF2 homolog (273-282)
EESEAYKSLF

SEQ ID NO: 19596 - protein, 10 aa, Artificial Sequence
  Rho-associated protein kinase 2 (440-449)
EESQEIQKKL

SEQ ID NO: 19597 - protein, 11 aa, Artificial Sequence
  Rho-associated protein kinase 2 (440-450)
EESQEIQKKLY

SEQ ID NO: 19598 - protein, 9 aa, Artificial Sequence
  Spectrin beta chain, non-erythrocytic 1 (635-643)
EESRRLWKF

SEQ ID NO: 19599 - protein, 9 aa, Artificial Sequence
  Synemin (857-865)
EESTIRYSW

SEQ ID NO: 19600 - protein, 10 aa, Artificial Sequence
  Caldesmon (163-172)
EETETVTKSY

SEQ ID NO: 19601 - protein, 9 aa, Artificial Sequence
  Putative segment polarity protein dishevelled homolog DVL1P1 (13-21)
EETPYLVKL

SEQ ID NO: 19602 - protein, 9 aa, Artificial Sequence
  Trinucleotide repeat-containing gene 18 protein (2863-2871)
EETSPGKQF

SEQ ID NO: 19603 - protein, 8 aa, Artificial Sequence
  Dedicator of cytokinesis protein 10 (2044-2051)
EEVDMIRL

SEQ ID NO: 19604 - protein, 10 aa, Artificial Sequence
  ATR-interacting protein (133-142)
EEVLIKNGEI

SEQ ID NO: 19605 - protein, 9 aa, Artificial Sequence
  V-type proton ATPase subunit B, kidney isoform (273-281)
EEVPGRRGF

SEQ ID NO: 19606 - protein, 8 aa, Artificial Sequence
  Protein ITFG3 (235-242)
EEVSGHLY

SEQ ID NO: 19607 - protein, 9 aa, Artificial Sequence
  Tyrosinase (280-288)
EEYNSHQSL

SEQ ID NO: 19608 - protein, 10 aa, Artificial Sequence
  Hom s 1 (51-60)
EEYRGFTQDF

SEQ ID NO: 19609 - protein, 12 aa, Artificial Sequence
  Moesin (17-28)
EFAIQPNTTGKQ

SEQ ID NO: 19610 - protein, 13 aa, Artificial Sequence
  Moesin (17-29)
EFAIQPNTTGKQL

SEQ ID NO: 19611 - protein, 10 aa, Artificial Sequence
  Lamin-B receptor (208-217)
EFGGVPGVFL

SEQ ID NO: 19612 - protein, 9 aa, Artificial Sequence
  Nuclear factor erythroid 2-related factor 1 (312-320)
EFNELLSKY

SEQ ID NO: 19613 - protein, 10 aa, Artificial Sequence
  Maltase-glucoamylase  (594-603)
EFNLFGIPMV

SEQ ID NO: 19614 - protein, 9 aa, Artificial Sequence
  Signal peptidase complex subunit 2 (188-196)
EFTKSIAKF

SEQ ID NO: 19615 - protein, 8 aa, Artificial Sequence
  Inositol 1,4,5-trisphosphate receptor type 3 (835-842)
EFVEDYLN

SEQ ID NO: 19616 - protein, 7 aa, Artificial Sequence
  Melanoma-associated antigen D1 (610-616)
EFVKQKY

SEQ ID NO: 19617 - protein, 9 aa, Artificial Sequence
  Vimentin (405-413)
EGEESRISL

SEQ ID NO: 19618 - protein, 12 aa, Artificial Sequence
  Disintegrin and metalloproteinase domain-containing protein 10 (17-28)
EGFIQTRGGTFY

SEQ ID NO: 19619 - protein, 8 aa, Artificial Sequence
  Coiled-coil-helix-coiled-coil-helix domain-containing protein 2 (135-142)
EGFNEVLK

SEQ ID NO: 19620 - protein, 7 aa, Artificial Sequence
  Dual specificity protein phosphatase 6 (133-139)
EGGFSKF

SEQ ID NO: 19621 - protein, 9 aa, Artificial Sequence
  Heat shock protein beta-8 (131-139)
EGGIVSKNF

SEQ ID NO: 19622 - protein, 9 aa, Artificial Sequence
  Chondroitin sulfate proteoglycan 4 (257-265)
EGHLRAVVE

SEQ ID NO: 19623 - protein, 8 aa, Artificial Sequence
  Zinc finger protein 106 (925-932)
EGHSKTIL

SEQ ID NO: 19624 - protein, 7 aa, Artificial Sequence
  Activator of 90 kDa heat shock protein ATPase homolog 1 (249-255)
EGIKQTF

SEQ ID NO: 19625 - protein, 7 aa, Artificial Sequence
  Kremen protein 2 (107-113)
EGIYWRY

SEQ ID NO: 19626 - protein, 9 aa, Artificial Sequence
  Secretory phospholipase A2 receptor (1283-1291)
EGSNLLTIK

SEQ ID NO: 19627 - protein, 6 aa, Artificial Sequence
  Leucine-tRNA ligase, cytoplasmic (177-182)
EHIWTL

SEQ ID NO: 19628 - protein, 10 aa, Artificial Sequence
  Protein DBF4 homolog A (541-550)
EHLTVQAKAP

SEQ ID NO: 19629 - protein, 8 aa, Artificial Sequence
  Bestrophin-1 (465-472)
EHPEVSQV

SEQ ID NO: 19630 - protein, 6 aa, Artificial Sequence
  Glycine-tRNA ligase (536-541)
EHTFHV

SEQ ID NO: 19631 - protein, 8 aa, Artificial Sequence
  Fibronectin 1 (1541-1548)
EIDKPSQM

SEQ ID NO: 19632 - protein, 13 aa, Artificial Sequence
  39S ribosomal protein L37, mitochondrial (51-63)
EIPGLEPITFAGK

SEQ ID NO: 19633 - protein, 7 aa, Artificial Sequence
  ATP-dependent RNA helicase DDX24 (574-580)
EKDFYLY

SEQ ID NO: 19634 - protein, 8 aa, Artificial Sequence
  Tyrosinase (517-524)
EKEDYHSL

SEQ ID NO: 19635 - protein, 11 aa, Artificial Sequence
  Nuclear autoantigenic sperm protein (365-375)
EKPGQEAPVLP

SEQ ID NO: 19636 - protein, 9 aa, Artificial Sequence
  Exocyst complex component 3 (32-40)
ELAKQLWMV

SEQ ID NO: 19637 - protein, 9 aa, Artificial Sequence
  Eukaryotic initiation factor 4A-II (112-120)
ELAQQIQKV

SEQ ID NO: 19638 - protein, 9 aa, Artificial Sequence
  Probable ATP-dependent RNA helicase DDX5 (178-186)
ELAQQVQQV

SEQ ID NO: 19639 - protein, 9 aa, Artificial Sequence
  Splicing factor 3B subunit 3 (1196-1204)
ELDRTPPEV

SEQ ID NO: 19640 - protein, 9 aa, Artificial Sequence
  Microtubule cross-linking factor 1 (532-540)
ELEQELQKY

SEQ ID NO: 19641 - protein, 7 aa, Artificial Sequence
  Clathrin heavy chain 1 (362-368)
ELFARKF

SEQ ID NO: 19642 - protein, 22 aa, Artificial Sequence
  HEAT repeat-containing protein 5B (423-444)
ELGSLVQSLNATASPLIQEASI

SEQ ID NO: 19643 - protein, 8 aa, Artificial Sequence
  Leucine-rich repeat flightless-interacting protein 2 (198-205)
ELIEKHGL

SEQ ID NO: 19644 - protein, 9 aa, Artificial Sequence
  Golgin subfamily B member 1 (2901-2909)
ELKNLQQQY

SEQ ID NO: 19645 - protein, 7 aa, Artificial Sequence
  Eukaryotic translation initiation factor 3 subunit C-like protein (84-90)
ELLGKAY

SEQ ID NO: 19646 - protein, 9 aa, Artificial Sequence
  RHO/RAC effector protein (236-244)
ELNNQNFYL

SEQ ID NO: 19647 - protein, 8 aa, Artificial Sequence
  Presenilin-1 (3-10)
ELPAPLSY

SEQ ID NO: 19648 - protein, 6 aa, Artificial Sequence
  FERM domain-containing protein 4A (927-932)
ELRQWY

SEQ ID NO: 19649 - protein, 9 aa, Artificial Sequence
  Proteasome maturation protein (49-57)
ELSEKNFQL

SEQ ID NO: 19650 - protein, 8 aa, Artificial Sequence
  FACT complex subunit SSRP1 (312-319)
EMVSRVMK

SEQ ID NO: 19651 - protein, 10 aa, Artificial Sequence
  Ras GTPase-activating-like protein IQGAP2 (450-459)
ENDRVVAVGY

SEQ ID NO: 19652 - protein, 7 aa, Artificial Sequence
  Eukaryotic translation initiation factor 3 subunit L (295-301)
ENIELNK

SEQ ID NO: 19653 - protein, 34 aa, Artificial Sequence
  Glia-derived nexin (343-376)
ENLHVSHILQKAKIEVSEDGTKASAATTAILIAR

SEQ ID NO: 19654 - protein, 35 aa, Artificial Sequence
  Proteasome activator complex subunit 4 (1077-1111)
ENLNHDAIVVRKMAISAVAGILKQLKRTHKKLTIN

SEQ ID NO: 19655 - protein, 11 aa, Artificial Sequence
  FYVE, RhoGEF and PH domain-containing protein 6 (143-153)
ENSKIDETLTI

SEQ ID NO: 19656 - protein, 9 aa, Artificial Sequence
  Ankyrin repeat domain-containing protein SOWAHB (248-256)
EPAPVPAVA

SEQ ID NO: 19657 - protein, 11 aa, Artificial Sequence
  39S ribosomal protein L3, mitochondrial (91-101)
EPGSFRVGLIA

SEQ ID NO: 19658 - protein, 9 aa, Artificial Sequence
  Nurim (116-124)
EPIPKGPVL

SEQ ID NO: 19659 - protein, 10 aa, Artificial Sequence
  Ryanodine receptor 1 (370-379)
EPPTPEGSPI

SEQ ID NO: 19660 - protein, 9 aa, Artificial Sequence
  WD repeat-containing protein 18 (350-358)
EPRHGGLTL

SEQ ID NO: 19661 - protein, 11 aa, Artificial Sequence
  Gamma-secretase C-terminal fragment 59 (473-483)
EPRISYGNDAL

SEQ ID NO: 19662 - protein, 18 aa, Artificial Sequence
  Integral membrane protein GPR137C (19-36)
EPSTPGGGSGGGGAVAAA

SEQ ID NO: 19663 - protein, 41 aa, Artificial Sequence
  Ubiquitin-associated protein 2-like (364-404)
EQFKTAQALAQLAAQHSQSGSTTTSSWDMGSTTQSPSLVQY

SEQ ID NO: 19664 - protein, 10 aa, Artificial Sequence
  Keratin, type II cytoskeletal 1b (186-195)
EQQNQVLQTK

SEQ ID NO: 19665 - protein, 10 aa, Artificial Sequence
  Histone-lysine N-methyltransferase 2D (2989-2998)
EQQSKIQKQL

SEQ ID NO: 19666 - protein, 8 aa, Artificial Sequence
  Hsp90 co-chaperone Cdc37 (207-214)
EQVAHQTI

SEQ ID NO: 19667 - protein, 8 aa, Artificial Sequence
  Mucin-16 (582-589)
EQVFLDKT

SEQ ID NO: 19668 - protein, 7 aa, Artificial Sequence
  Serine/arginine-rich splicing factor 3 (27-33)
ERAFGYY

SEQ ID NO: 19669 - protein, 9 aa, Artificial Sequence
  Kinectin (367-375)
ERSNVVITR

SEQ ID NO: 19670 - protein, 7 aa, Artificial Sequence
  RAB6A-GEF complex partner protein 2 (263-269)
ERVQPEY

SEQ ID NO: 19671 - protein, 6 aa, Artificial Sequence
  Vacuolar protein sorting-associated protein 18 homolog (309-314)
ERVWEY

SEQ ID NO: 19672 - protein, 11 aa, Artificial Sequence
  Pre-mRNA-splicing factor ATP-dependent RNA helicase PRP16 (1005-1015)
ESDHLTYLNVY

SEQ ID NO: 19673 - protein, 19 aa, Artificial Sequence
  Endoplasmin (203-221)
ESDSNEFSVIADPRGNTLG

SEQ ID NO: 19674 - protein, 10 aa, Artificial Sequence
  Netrin receptor UNC5A (438-447)
ESEAGVPALV

SEQ ID NO: 19675 - protein, 9 aa, Artificial Sequence
  DNA-directed RNA polymerase I subunit RPA1 (186-194)
ESKSKLIAL

SEQ ID NO: 19676 - protein, 8 aa, Artificial Sequence
  Four and a half LIM domains protein 2 (122-129)
ESLFGKKY

SEQ ID NO: 19677 - protein, 8 aa, Artificial Sequence
  T-complex protein 1 subunit beta (114-121)
ESLIAKKI

SEQ ID NO: 19678 - protein, 7 aa, Artificial Sequence
  Heterogeneous nuclear ribonucleoproteins A2/B1 (23-29)
ESLRNYY

SEQ ID NO: 19679 - protein, 17 aa, Artificial Sequence
  AT-rich interactive domain-containing protein 1A (78-94)
ESNGGGGGGGAGSGGGP

SEQ ID NO: 19680 - protein, 7 aa, Artificial Sequence
  DENN domain-containing protein 4B (1394-1400)
ESVLRHV

SEQ ID NO: 19681 - protein, 9 aa, Artificial Sequence
  Protein kinase C-binding protein 1 (695-703)
ETDSPTVHL

SEQ ID NO: 19682 - protein, 9 aa, Artificial Sequence
  HEAT repeat-containing protein 1 (1479-1487)
ETIPKAVSF

SEQ ID NO: 19683 - protein, 9 aa, Artificial Sequence
  Receptor-type tyrosine-protein phosphatase C (52-60)
ETKLFTAKL

SEQ ID NO: 19684 - protein, 10 aa, Artificial Sequence
  Uridine-cytidine kinase-like 1 (329-338)
ETSRDEFIFY

SEQ ID NO: 19685 - protein, 18 aa, Artificial Sequence
  UPF0606 protein KIAA1549 (278-295)
ETTLFLSSRSLMPQPLGD

SEQ ID NO: 19686 - protein, 22 aa, Artificial Sequence
  ATP synthase subunit alpha, mitochondrial (339-360)
EVAAFAQFGSDLDAATQQLLSR

SEQ ID NO: 19687 - protein, 9 aa, Artificial Sequence
  40S ribosomal protein S21 (38-46)
EVDKVTGRF

SEQ ID NO: 19688 - protein, 9 aa, Artificial Sequence
  Melanoma-associated antigen 4 (169-177)
EVDPASNTY

SEQ ID NO: 19689 - protein, 10 aa, Artificial Sequence
  Dystrophin (1633-1642)
EVGEALKTVL

SEQ ID NO: 19690 - protein, 16 aa, Artificial Sequence
  Filamin-A (1150-1165)
EVGQFQVDCSSAGSAE

SEQ ID NO: 19691 - protein, 19 aa, Artificial Sequence
  Titin (5338-5356)
EVGSSSCETTFTVLDRDIA

SEQ ID NO: 19692 - protein, 9 aa, Artificial Sequence
  Nucleosome assembly protein 1-like 4 (87-95)
EVHDLERKY

SEQ ID NO: 19693 - protein, 8 aa, Artificial Sequence
  Pseudouridylate synthase 7 homolog-like protein (87-94)
EVHTLIKY

SEQ ID NO: 19694 - protein, 10 aa, Artificial Sequence
  Midasin (595-604)
EVIGSKLNIS

SEQ ID NO: 19695 - protein, 10 aa, Artificial Sequence
  Protein ZGRF1 (72-81)
EVKVAGAIGI

SEQ ID NO: 19696 - protein, 10 aa, Artificial Sequence
  RNA-binding protein Nova-1 (277-286)
EVLPTAAAAA

SEQ ID NO: 19697 - protein, 10 aa, Artificial Sequence
  Hemicentin-1 (2987-2996)
EVSGFPPPDL

SEQ ID NO: 19698 - protein, 7 aa, Artificial Sequence
  Basigin (49-55)
EVTGHRW

SEQ ID NO: 19699 - protein, 13 aa, Artificial Sequence
  Annexin A2 (53-65)
EVTIVNILTNRSN

SEQ ID NO: 19700 - protein, 15 aa, Artificial Sequence
  Annexin A2 (53-67)
EVTIVNILTNRSNAQ

SEQ ID NO: 19701 - protein, 9 aa, Artificial Sequence
  Myotubularin (410-418)
EWISFGHKF

SEQ ID NO: 19702 - protein, 9 aa, Artificial Sequence
  Zinc finger protein 317 (82-90)
EYAHLFEVF

SEQ ID NO: 19703 - protein, 9 aa, Artificial Sequence
  Lysophosphatidylcholine acyltransferase 2 (495-503)
EYAKIFTTY

SEQ ID NO: 19704 - protein, 10 aa, Artificial Sequence
  Meiosis arrest female protein 1 (1363-1372)
EYAKTFGYTF

SEQ ID NO: 19705 - protein, 9 aa, Artificial Sequence
  Tyrosine-protein kinase Fer (41-49)
EYASTLQNL

SEQ ID NO: 19706 - protein, 9 aa, Artificial Sequence
  Origin recognition complex subunit 3 (309-317)
EYASVLQLL

SEQ ID NO: 19707 - protein, 9 aa, Artificial Sequence
  Gamma-tubulin complex component 2 (312-320)
EYGQVNHAL

SEQ ID NO: 19708 - protein, 9 aa, Artificial Sequence
  Nuclear pore complex protein Nup214 (115-123)
EYGSIIAFF

SEQ ID NO: 19709 - protein, 9 aa, Artificial Sequence
  GDH/6PGL endoplasmic bifunctional protein (267-275)
EYGVIRDVL

SEQ ID NO: 19710 - protein, 9 aa, Artificial Sequence
  Probable ATP-dependent RNA helicase DDX52 (539-547)
EYIKGFQKL

SEQ ID NO: 19711 - protein, 9 aa, Artificial Sequence
  Myotubularin (566-574)
EYIKRLEEL

SEQ ID NO: 19712 - protein, 9 aa, Artificial Sequence
  Probable ATP-dependent RNA helicase DDX60-like (1185-1193)
EYINFLENL

SEQ ID NO: 19713 - protein, 11 aa, Artificial Sequence
  Aspartate aminotransferase, mitochondrial (95-105)
EYLPIGGLAEF

SEQ ID NO: 19714 - protein, 9 aa, Artificial Sequence
  Phosphatidylinositol-glycan biosynthesis class W protein (124-132)
EYNPAISCF

SEQ ID NO: 19715 - protein, 9 aa, Artificial Sequence
  Lysosomal protective protein (111-119)
EYNPYSWNL

SEQ ID NO: 19716 - protein, 9 aa, Artificial Sequence
  Dolichyl-diphosphooligosaccharide-proteinosyltransferase 48 kDa subunit (332-340)
EYSIVIQQL

SEQ ID NO: 19717 - protein, 9 aa, Artificial Sequence
  MAU2 chromatid cohesion factor homolog (89-97)
EYTRALFLL

SEQ ID NO: 19718 - protein, 9 aa, Artificial Sequence
  FERM, RhoGEF and pleckstrin domain-containing protein 2 (134-142)
EYTRYLFAL

SEQ ID NO: 19719 - protein, 9 aa, Artificial Sequence
  Dual specificity protein kinase CLK3 (343-351)
EYYRGFTLF

SEQ ID NO: 19720 - protein, 8 aa, Artificial Sequence
  Nuclear receptor corepressor 2 (1025-1032)
FAAEAQKL

SEQ ID NO: 19721 - protein, 8 aa, Artificial Sequence
  UDP-N-acetylglucosamine-peptide N-acetylglucosaminyltransferase 110 kDa subunit (428-435)
FADAHSNL

SEQ ID NO: 19722 - protein, 9 aa, Artificial Sequence
  Catenin alpha-2 (110-118)
FADDPCSSV

SEQ ID NO: 19723 - protein, 9 aa, Artificial Sequence
  Zinc finger MYM-type protein 1 (482-490)
FADELSHLL

SEQ ID NO: 19724 - protein, 10 aa, Artificial Sequence
  E3 ubiquitin-protein ligase UBR4 (495-504)
FADKETLIQF

SEQ ID NO: 19725 - protein, 10 aa, Artificial Sequence
  Histone-lysine N-methyltransferase SETDB1 (995-1004)
FADSDSHSSF

SEQ ID NO: 19726 - protein, 10 aa, Artificial Sequence
  Staphylococcal nuclease domain-containing protein 1 (819-828)
FADSKGDVGL

SEQ ID NO: 19727 - protein, 9 aa, Artificial Sequence
  Frizzled-1 (386-394)
FAEDGARTV

SEQ ID NO: 19728 - protein, 13 aa, Artificial Sequence
  Amyloid beta A4 protein (18-30)
FAEDVGSNKGAII

SEQ ID NO: 19729 - protein, 14 aa, Artificial Sequence
  Amyloid beta A4 protein (20-33)
FAEDVGSNKGAIIG

SEQ ID NO: 19730 - protein, 9 aa, Artificial Sequence
  Centromere protein F (1090-1098)
FAEERNQNL

SEQ ID NO: 19731 - protein, 8 aa, Artificial Sequence
  Superkiller viralicidic activity 2-like 2 (1024-1031)
FAEGITKI

SEQ ID NO: 19732 - protein, 9 aa, Artificial Sequence
  ATP-binding cassette sub-family C member 11 (241-249)
FAFEKLIQF

SEQ ID NO: 19733 - protein, 9 aa, Artificial Sequence
  Arf-GAP with SH3 domain, ANK repeat and PH domain-containing protein 3 (673-681)
FAFPLHVDY

SEQ ID NO: 19734 - protein, 8 aa, Artificial Sequence
  Filamin-A (333-340)
FAGQHIAK

SEQ ID NO: 19735 - protein, 9 aa, Artificial Sequence
  Elongation factor 1-gamma (198-206)
FAHLPKSTF

SEQ ID NO: 19736 - protein, 9 aa, Artificial Sequence
  Nuclear pore complex protein Nup85 (365-373)
FAHPSLWQL

SEQ ID NO: 19737 - protein, 12 aa, Artificial Sequence
  Moesin (18-29)
FAIQPNTTGKQL

SEQ ID NO: 19738 - protein, 9 aa, Artificial Sequence
  Sodium-dependent phosphate transport protein 2C (387-395)
FALQSSSVF

SEQ ID NO: 19739 - protein, 15 aa, Artificial Sequence
  Cytochrome c oxidase subunit 7C, mitochondrial (49-63)
FATPFLVVRHQLLKT

SEQ ID NO: 19740 - protein, 12 aa, Artificial Sequence
  Beta-secretase 2 (116-127)
FAVAGTPHSYID

SEQ ID NO: 19741 - protein, 9 aa, Artificial Sequence
  Protein FAM179B (1301-1309)
FAVVQEVKN

SEQ ID NO: 19742 - protein, 8 aa, Artificial Sequence
  WD repeat-containing protein 35 (933-940)
FDAAKLMF

SEQ ID NO: 19743 - protein, 7 aa, Artificial Sequence
  Synemin (38-44)
FDKKVQL

SEQ ID NO: 19744 - protein, 8 aa, Artificial Sequence
  Protein SET (138-145)
FEDIKSGY

SEQ ID NO: 19745 - protein, 14 aa, Artificial Sequence
  ATP synthase-coupling factor 6, mitochondrial (95-108)
FEDPKFEVIEKPQA

SEQ ID NO: 19746 - protein, 14 aa, Artificial Sequence
  Cytochrome c oxidase subunit 6C (62-75)
FEEMRKAGIFQSVK

SEQ ID NO: 19747 - protein, 7 aa, Artificial Sequence
  Myotubularin-related protein 13 (1490-1496)
FEFNLYY

SEQ ID NO: 19748 - protein, 11 aa, Artificial Sequence
  FACT complex subunit SSRP1 (391-401)
FEIETKQGTQY

SEQ ID NO: 19749 - protein, 9 aa, Artificial Sequence
  Myosin-9 (456-464)
FEIFDLNSF

SEQ ID NO: 19750 - protein, 8 aa, Artificial Sequence
  F-box/LRR-repeat protein 5 (75-82)
FEKGLKNV

SEQ ID NO: 19751 - protein, 9 aa, Artificial Sequence
  Integrin beta-5 (536-544)
FESEFGKIY

SEQ ID NO: 19752 - protein, 7 aa, Artificial Sequence
  Small subunit processome component 20 homolog (1420-1426)
FESGLKY

SEQ ID NO: 19753 - protein, 9 aa, Artificial Sequence
  ATP synthase-coupling factor 6, mitochondrial (100-108)
FEVIEKPQA

SEQ ID NO: 19754 - protein, 10 aa, Artificial Sequence
  Nuclear pore membraneoprotein 210 (396-405)
FFEVLSSSQN

SEQ ID NO: 19755 - protein, 9 aa, Artificial Sequence
  Dynein heavy chain 10, axonemal (148-156)
FFFISDDEL

SEQ ID NO: 19756 - protein, 6 aa, Artificial Sequence
  FACT complex subunit SSRP1 (88-93)
FFKTHY

SEQ ID NO: 19757 - protein, 9 aa, Artificial Sequence
  Sterol regulatory element-binding protein 2 (769-777)
FFMERSWSV

SEQ ID NO: 19758 - protein, 9 aa, Artificial Sequence
  L-dopachrome tautomerase (339-347)
FFQNSTFSF

SEQ ID NO: 19759 - protein, 7 aa, Artificial Sequence
  Protein MCM10 homolog (335-341)
FGEVHKA

SEQ ID NO: 19760 - protein, 9 aa, Artificial Sequence
  Dynein light chain 4, axonemal (77-85)
FGFEITHEV

SEQ ID NO: 19761 - protein, 9 aa, Artificial Sequence
  Myelin basic protein (46-54)
FGGDRGAPK

SEQ ID NO: 19762 - protein, 29 aa, Artificial Sequence
  Keratin, type I cytoskeletal 9 (90-118)
FGGGSRGFGGASGGGYSSSGGFGGGFGGG

SEQ ID NO: 19763 - protein, 8 aa, Artificial Sequence
  Oxysterol-binding protein-related protein 1 (367-374)
FGKELHKV

SEQ ID NO: 19764 - protein, 9 aa, Artificial Sequence
  Cyclin-dependent kinase 3 (146-154)
FGLARAFGV

SEQ ID NO: 19765 - protein, 16 aa, Artificial Sequence
  Pyruvate kinase PKM (157-172)
FGVEQDVDMVFASFIR

SEQ ID NO: 19766 - protein, 11 aa, Artificial Sequence
  AP-2 complex subunit beta (776-786)
FGVIPSTPLAI

SEQ ID NO: 19767 - protein, 10 aa, Artificial Sequence
  Myelin basic protein (152-161)
FGYGGRASDY

SEQ ID NO: 19768 - protein, 16 aa, Artificial Sequence
  Cytochrome c oxidase subunit 6A1, mitochondrial (71-86)
FHNPHVNPLPTGYEDE

SEQ ID NO: 19769 - protein, 6 aa, Artificial Sequence
  Large proline-rich protein BAG6 (789-794)
FHQHYL

SEQ ID NO: 19770 - protein, 9 aa, Artificial Sequence
  Transformation/transcription domain-associated protein (280-288)
FIAAQIKTL

SEQ ID NO: 19771 - protein, 10 aa, Artificial Sequence
  Vitamin K-dependent gamma-carboxylase (474-483)
FIADFPGLHL

SEQ ID NO: 19772 - protein, 9 aa, Artificial Sequence
  Ubiquitin carboxyl-terminal hydrolase 7 (183-191)
FIDDDKVTF

SEQ ID NO: 19773 - protein, 9 aa, Artificial Sequence
  Histone-lysine N-methyltransferase SETDB1 (43-51)
FIDEELEKM

SEQ ID NO: 19774 - protein, 9 aa, Artificial Sequence
  Dolichyl-diphosphooligosaccharide-proteinosyltransferase 48 kDa subunit (119-127)
FIDGGGSVL

SEQ ID NO: 19775 - protein, 10 aa, Artificial Sequence
  Dolichyl-diphosphooligosaccharide-proteinosyltransferase 48 kDa subunit (119-128)
FIDGGGSVLV

SEQ ID NO: 19776 - protein, 9 aa, Artificial Sequence
  Nck-associated protein 1 (400-408)
FIDKHIAEL

SEQ ID NO: 19777 - protein, 9 aa, Artificial Sequence
  ATP-dependent RNA helicase DDX19B (230-238)
FIDPKKIKV

SEQ ID NO: 19778 - protein, 9 aa, Artificial Sequence
  BTB/POZ domain-containing protein KCTD15 (102-110)
FIDRDGEIF

SEQ ID NO: 19779 - protein, 26 aa, Artificial Sequence
  Tubulin beta chain (387-412)
FIGNSTAIQELFKRISEQFTAMFRRK

SEQ ID NO: 19780 - protein, 9 aa, Artificial Sequence
  Receptor-type protein tyrosine phosphatase beta (1317-1325)
FIHDTLVEA

SEQ ID NO: 19781 - protein, 9 aa, Artificial Sequence
  Kelch-like protein 7 (120-128)
FIHQHFTEV

SEQ ID NO: 19782 - protein, 9 aa, Artificial Sequence
  Kelch-like protein 18 (97-105)
FIHQHFVEV

SEQ ID NO: 19783 - protein, 9 aa, Artificial Sequence
  Myotubularin-related protein 13 (272-280)
FIIGVHSVF

SEQ ID NO: 19784 - protein, 9 aa, Artificial Sequence
  LisH domain-containing protein ARMC9 (551-559)
FIKEGNAEM

SEQ ID NO: 19785 - protein, 9 aa, Artificial Sequence
  Importin-5 (200-208)
FILANEHNV

SEQ ID NO: 19786 - protein, 9 aa, Artificial Sequence
  WD repeat and FYVE domain-containing protein 3 (419-427)
FILESQHTL

SEQ ID NO: 19787 - protein, 9 aa, Artificial Sequence
  Cyclin-related protein FAM58A (33-41)
FIMEAGVKL

SEQ ID NO: 19788 - protein, 9 aa, Artificial Sequence
  Protein EFR3 homolog A (468-476)
FIMGKVPVF

SEQ ID NO: 19789 - protein, 9 aa, Artificial Sequence
  Translocated to HRX in t(11,19) leukemia (81-89)
FIMPIEVHF

SEQ ID NO: 19790 - protein, 6 aa, Artificial Sequence
  Endoplasmic reticulum metallopeptidase 1 (110-115)
FINFIY

SEQ ID NO: 19791 - protein, 10 aa, Artificial Sequence
  Sacsin (114-123)
FINGNFPGTF

SEQ ID NO: 19792 - protein, 9 aa, Artificial Sequence
  Tripartite motif-containing protein 2 (185-193)
FISEIIHQL

SEQ ID NO: 19793 - protein, 9 aa, Artificial Sequence
  Protein TANC1 (603-611)
FITKIISKF

SEQ ID NO: 19794 - protein, 7 aa, Artificial Sequence
  Gelsolin (365-371)
FITKMDY

SEQ ID NO: 19795 - protein, 9 aa, Artificial Sequence
  Calcium/calmodulin-dependent 3',5'-cyclic nucleotide phosphodiesterase 1C (433-441)
FIVEPTFTV

SEQ ID NO: 19796 - protein, 10 aa, Artificial Sequence
  Dopamine D4 receptor (72-81)
FIVSLAAADL

SEQ ID NO: 19797 - protein, 9 aa, Artificial Sequence
  Regulatory-associated protein of mTOR (277-285)
FIWAKILAV

SEQ ID NO: 19798 - protein, 9 aa, Artificial Sequence
  Unconventional myosin-X (583-591)
FIYDLFEHV

SEQ ID NO: 19799 - protein, 10 aa, Artificial Sequence
  Cullin-4B (578-587)
FIYGKDVFEA

SEQ ID NO: 19800 - protein, 13 aa, Artificial Sequence
  Cytochrome c oxidase subunit 7A2, mitochondrial (24-36)
FKNKVPEKQKLFQ

SEQ ID NO: 19801 - protein, 28 aa, Artificial Sequence
  Cytochrome c oxidase subunit 7A2, mitochondrial (24-51)
FKNKVPEKQKLFQEDDEIPLYLKGGVAD

SEQ ID NO: 19802 - protein, 60 aa, Artificial Sequence
  Cytochrome c oxidase subunit 7A2, mitochondrial (24-83)
FKNKVPEKQKLFQEDDEIPLYLKGGVADALLYRATMILTVGGTAYAIYELAVASFPKKQE

SEQ ID NO: 19803 - protein, 7 aa, Artificial Sequence
  Histone deacetylase 1 (241-247)
FKPVMSK

SEQ ID NO: 19804 - protein, 7 aa, Artificial Sequence
  Protein kinase C-binding protein 1 (213-219)
FLADAKW

SEQ ID NO: 19805 - protein, 10 aa, Artificial Sequence
  Methionine-tRNA ligase, cytoplasmic (395-404)
FLADRFVEGV

SEQ ID NO: 19806 - protein, 10 aa, Artificial Sequence
  Ras GTPase-activating-like protein IQGAP3 (868-877)
FLAEAELLKL

SEQ ID NO: 19807 - protein, 10 aa, Artificial Sequence
  Protein sel-1 homolog 1 (366-375)
FLAEKGDVQA

SEQ ID NO: 19808 - protein, 9 aa, Artificial Sequence
  H(+)/Cl(-) exchange transporter 3 (206-214)
FLAVSLVKV

SEQ ID NO: 19809 - protein, 9 aa, Artificial Sequence
  Sodium/potassium-transporting ATPase subunit alpha-1 (28-36)
FLAYSIQAA

SEQ ID NO: 19810 - protein, 8 aa, Artificial Sequence
  B-cell receptor-associated protein 29 (63-70)
FLDAVREV

SEQ ID NO: 19811 - protein, 9 aa, Artificial Sequence
  Cytoplasmic dynein 2 heavy chain 1 (42-50)
FLDDGNQML

SEQ ID NO: 19812 - protein, 9 aa, Artificial Sequence
  Guanine nucleotide-binding protein G(I)/G(S)/G(T) subunit beta-2 (151-159)
FLDDNQIIT

SEQ ID NO: 19813 - protein, 9 aa, Artificial Sequence
  Polycystin-1 (3400-3408)
FLDDSKSLV

SEQ ID NO: 19814 - protein, 9 aa, Artificial Sequence
  Guanine nucleotide-binding protein subunit beta-4 (151-159)
FLDDSQIVT

SEQ ID NO: 19815 - protein, 9 aa, Artificial Sequence
  F-box only protein 32 (25-33)
FLDEKSGSF

SEQ ID NO: 19816 - protein, 10 aa, Artificial Sequence
  F-box only protein 32 (25-34)
FLDEKSGSFV

SEQ ID NO: 19817 - protein, 8 aa, Artificial Sequence
  Dipeptidyl peptidase 8 (72-79)
FLDENVHF

SEQ ID NO: 19818 - protein, 9 aa, Artificial Sequence
  Ubiquitin-like-conjugating enzyme ATG10 (117-125)
FLDGRPLTL

SEQ ID NO: 19819 - protein, 9 aa, Artificial Sequence
  Mediator of RNA polymerase II transcription subunit 18 (51-59)
FLDHEMVFL

SEQ ID NO: 19820 - protein, 8 aa, Artificial Sequence
  Protein SMG8 (484-491)
FLDIDTKF

SEQ ID NO: 19821 - protein, 9 aa, Artificial Sequence
  Unconventional myosin-Ic (523-531)
FLDKNNDLL

SEQ ID NO: 19822 - protein, 9 aa, Artificial Sequence
  Sterol regulatory element-binding protein cleavage-activating protein (641-649)
FLDKRIVAA

SEQ ID NO: 19823 - protein, 9 aa, Artificial Sequence
  Major facilitator superfamily domain-containing protein 12 (410-418)
FLDKVANGL

SEQ ID NO: 19824 - protein, 8 aa, Artificial Sequence
  Putative bifunctional UDP-N-acetylglucosamine transferase and deubiquitinase ALG13 (156-163)
FLDKVVGL

SEQ ID NO: 19825 - protein, 8 aa, Artificial Sequence
  Formin-1 (471-478)
FLDLPHKV

SEQ ID NO: 19826 - protein, 9 aa, Artificial Sequence
  Group XV phospholipase A2 (126-134)
FLDPSKSSV

SEQ ID NO: 19827 - protein, 8 aa, Artificial Sequence
  Glycogen phosphorylase, muscle form (144-151)
FLDSMATL

SEQ ID NO: 19828 - protein, 9 aa, Artificial Sequence
  Basic leucine zipper and W2 domain-containing protein 2 (51-59)
FLDSTGSRL

SEQ ID NO: 19829 - protein, 9 aa, Artificial Sequence
  Tuftelin-interacting protein 11 (507-515)
FLDSWVHII

SEQ ID NO: 19830 - protein, 10 aa, Artificial Sequence
  Sulfate transporter (658-667)
FLDTAGIHTL

SEQ ID NO: 19831 - protein, 9 aa, Artificial Sequence
  Protein naked cuticle homolog 1 (320-328)
FLDTPIAKV

SEQ ID NO: 19832 - protein, 9 aa, Artificial Sequence
  Protein S100-A1 (45-53)
FLDVKELML

SEQ ID NO: 19833 - protein, 9 aa, Artificial Sequence
  Electron transfer flavoprotein subunit beta (232-240)
FLDWPQGTF

SEQ ID NO: 19834 - protein, 9 aa, Artificial Sequence
  A-kinase anchor protein 9 (882-890)
FLEERSVLL

SEQ ID NO: 19835 - protein, 9 aa, Artificial Sequence
  Paraneoplastic antigen Ma2 (107-115)
FLEKEGQTV

SEQ ID NO: 19836 - protein, 9 aa, Artificial Sequence
  Nitric oxide synthase-interacting protein (114-122)
FLEKESAIV

SEQ ID NO: 19837 - protein, 10 aa, Artificial Sequence
  Cytochrome c oxidase subunit 2 (127-136)
FLEPGDLRLL

SEQ ID NO: 19838 - protein, 7 aa, Artificial Sequence
  Calnexin (139-145)
FLFDTKP

SEQ ID NO: 19839 - protein, 9 aa, Artificial Sequence
  Transmembrane protein 97 (118-126)
FLFEDFSKA

SEQ ID NO: 19840 - protein, 9 aa, Artificial Sequence
  Melanoma-associated antigen 11 (321-329)
FLFGEPKRL

SEQ ID NO: 19841 - protein, 9 aa, Artificial Sequence
  Transmembrane protein 106B (155-163)
FLFPRSIDV

SEQ ID NO: 19842 - protein, 9 aa, Artificial Sequence
  Hephaestin (680-688)
FLFSNLPRL

SEQ ID NO: 19843 - protein, 9 aa, Artificial Sequence
  Unconventional myosin-Ib (362-370)
FLFSSDHLI

SEQ ID NO: 19844 - protein, 8 aa, Artificial Sequence
  POU domain, class 2, transcription factor 1 (70-77)
FLGHLHQV

SEQ ID NO: 19845 - protein, 9 aa, Artificial Sequence
  Glutathione S-transferase Mu 4 (141-149)
FLGKRPWFV

SEQ ID NO: 19846 - protein, 9 aa, Artificial Sequence
  Maltase-glucoamylase, intestinal (1217-1225)
FLGPTPELV

SEQ ID NO: 19847 - protein, 9 aa, Artificial Sequence
  Asparagine synthetase (glutamine-hydrolyzing) (51-59)
FLGRDTYGV

SEQ ID NO: 19848 - protein, 9 aa, Artificial Sequence
  Ras GTPase-activating protein 1 (583-591)
FLHEKLESL

SEQ ID NO: 19849 - protein, 9 aa, Artificial Sequence
  Kelch domain-containing protein 8B (171-179)
FLHGNKIYV

SEQ ID NO: 19850 - protein, 10 aa, Artificial Sequence
  VWFA and cache domain-containing protein 1 (212-221)
FLIDDKGYTL

SEQ ID NO: 19851 - protein, 10 aa, Artificial Sequence
  Adenylate kinase isoenzyme 5 (224-233)
FLIDGYPREV

SEQ ID NO: 19852 - protein, 9 aa, Artificial Sequence
  BTB/POZ domain-containing protein KCTD9 (136-144)
FLIDRSPEY

SEQ ID NO: 19853 - protein, 10 aa, Artificial Sequence
  Tensin-2 (1202-1211)
FLIETGPKGV

SEQ ID NO: 19854 - protein, 9 aa, Artificial Sequence
  Protein phosphatase 1 regulatory subunit 12A (37-45)
FLIGQGAHV

SEQ ID NO: 19855 - protein, 9 aa, Artificial Sequence
  Proline-rich protein 12 (641-649)
FLIQHLLQA

SEQ ID NO: 19856 - protein, 11 aa, Artificial Sequence
  Protein FAM73A (567-577)
FLKDIFDFEKV

SEQ ID NO: 19857 - protein, 9 aa, Artificial Sequence
  Catenin alpha-1 (85-93)
FLKEELVAA

SEQ ID NO: 19858 - protein, 9 aa, Artificial Sequence
  Threonylcarbamoyladenosine tRNA methylthiotransferase (278-286)
FLKEKVPGI

SEQ ID NO: 19859 - protein, 9 aa, Artificial Sequence
  Ankyrin-3 (171-179)
FLLDHGASL

SEQ ID NO: 19860 - protein, 10 aa, Artificial Sequence
  DNA-binding protein RFX7 (684-693)
FLLDSDSKSV

SEQ ID NO: 19861 - protein, 10 aa, Artificial Sequence
  Protein TANC2 (96-105)
FLLGEKVTEV

SEQ ID NO: 19862 - protein, 9 aa, Artificial Sequence
  Transmembrane emp24 domain-containing protein 10 (22-30)
FLLGPRLVL

SEQ ID NO: 19863 - protein, 9 aa, Artificial Sequence
  TBC1 domain family member 8B (190-198)
FLLGSEIKL

SEQ ID NO: 19864 - protein, 9 aa, Artificial Sequence
  Intraflagellar transport protein 56 (385-393)
FLLIQSEKM

SEQ ID NO: 19865 - protein, 10 aa, Artificial Sequence
  Peptidyl-prolyl cis-trans isomerase B (15-24)
FLLLPGPSAA

SEQ ID NO: 19866 - protein, 9 aa, Artificial Sequence
  G-protein coupled receptor 56 (460-468)
FLLSEPVAL

SEQ ID NO: 19867 - protein, 9 aa, Artificial Sequence
  Huntingtin (694-702)
FLLTGGKNV

SEQ ID NO: 19868 - protein, 12 aa, Artificial Sequence
  Protocadherin Fat 3 (2442-2453)
FLMDSKSGVITL

SEQ ID NO: 19869 - protein, 9 aa, Artificial Sequence
  Cortactin-binding protein 2 (1244-1252)
FLMGTIAKA

SEQ ID NO: 19870 - protein, 11 aa, Artificial Sequence
  5,6-dihydroxyindole-2-carboxylic acid oxidase (383-393)
FLNGTGGQTHL

SEQ ID NO: 19871 - protein, 9 aa, Artificial Sequence
  Multidrug and toxin extrusion protein 1 (134-142)
FLNTQHILL

SEQ ID NO: 19872 - protein, 9 aa, Artificial Sequence
  Peroxisome biogenesis factor 1 (613-621)
FLPASLRSV

SEQ ID NO: 19873 - protein, 9 aa, Artificial Sequence
  Paired amphipathic helix protein Sin3a (379-387)
FLPDANSSV

SEQ ID NO: 19874 - protein, 12 aa, Artificial Sequence
  Eukaryotic translation initiation factor 4 gamma 1 (1367-1378)
FLPEGQDIGAFV

SEQ ID NO: 19875 - protein, 9 aa, Artificial Sequence
  NADH dehydrogenase (ubiquinone) 1 alpha subcomplex subunit 9, mitochondrial (286-294)
FLPFPLPLF

SEQ ID NO: 19876 - protein, 9 aa, Artificial Sequence
  Mitochondrial dynamics protein MID51 (470-478)
FLPRQALLF

SEQ ID NO: 19877 - protein, 10 aa, Artificial Sequence
  Ubiquitin carboxyl-terminal hydrolase 19 (742-751)
FLPSHSLDTV

SEQ ID NO: 19878 - protein, 9 aa, Artificial Sequence
  Peroxisomal acyl-coenzyme A oxidase 1 (107-115)
FLPTLLHQA

SEQ ID NO: 19879 - protein, 10 aa, Artificial Sequence
  ATP-binding cassette sub-family C member 11 (455-464)
FLQESPVFYV

SEQ ID NO: 19880 - protein, 9 aa, Artificial Sequence
  Hemicentin-1 (2534-2542)
FLQITNVQV

SEQ ID NO: 19881 - protein, 9 aa, Artificial Sequence
  Protocadherin gamma-A12 (749-757)
FLQTYSHEV

SEQ ID NO: 19882 - protein, 9 aa, Artificial Sequence
  Melanocyte protein PMEL (239-247)
FLRNQPLTF

SEQ ID NO: 19883 - protein, 11 aa, Artificial Sequence
  Hemoglobin subunit alpha (5-15)
FLSFPTTKTYF

SEQ ID NO: 19884 - protein, 9 aa, Artificial Sequence
  Insulin receptor substrate 2 (1325-1333)
FLSHHLKEA

SEQ ID NO: 19885 - protein, 9 aa, Artificial Sequence
  Tensin-3 (1065-1073)
FLSHNFLTV

SEQ ID NO: 19886 - protein, 9 aa, Artificial Sequence
  Protein capicua homolog (1061-1069)
FLSIMSPEI

SEQ ID NO: 19887 - protein, 11 aa, Artificial Sequence
  Vitamin K-dependent protein S (26-36)
FLSKQQASQVL

SEQ ID NO: 19888 - protein, 12 aa, Artificial Sequence
  Vitamin K-dependent protein S (26-37)
FLSKQQASQVLV

SEQ ID NO: 19889 - protein, 8 aa, Artificial Sequence
  mRNA-decapping enzyme 1A (523-530)
FLSTLHEV

SEQ ID NO: 19890 - protein, 9 aa, Artificial Sequence
  Lysosomal-trafficking regulator (12-20)
FLTDVNRLC

SEQ ID NO: 19891 - protein, 10 aa, Artificial Sequence
  L-dopachrome tautomerase (52-61)
FLTSDQLGYS

SEQ ID NO: 19892 - protein, 11 aa, Artificial Sequence
  L-dopachrome tautomerase (52-62)
FLTSDQLGYSY

SEQ ID NO: 19893 - protein, 9 aa, Artificial Sequence
  Bifunctional glutamate/proline-tRNA ligase (1167-1175)
FLWQEGHSA

SEQ ID NO: 19894 - protein, 9 aa, Artificial Sequence
  Fatty acyl-CoA reductase 1 (362-370)
FLYDIYLRM

SEQ ID NO: 19895 - protein, 9 aa, Artificial Sequence
  Tetratricopeptide repeat protein 17 (740-748)
FLYNITSSV

SEQ ID NO: 19896 - protein, 9 aa, Artificial Sequence
  Chromodomain-helicase-DNA-binding protein 1-like (358-366)
FLYSGGHRV

SEQ ID NO: 19897 - protein, 9 aa, Artificial Sequence
  Ropporin-1A (163-171)
FLYTYIAKV

SEQ ID NO: 19898 - protein, 9 aa, Artificial Sequence
  Histone deacetylase 11 (141-149)
FMDDKRVYI

SEQ ID NO: 19899 - protein, 9 aa, Artificial Sequence
  Pre-mRNA-processing-splicing factor 8 (1561-1569)
FMHGKIPTL

SEQ ID NO: 19900 - protein, 9 aa, Artificial Sequence
  Maltase-glucoamylase (551-559)
FMNNRSFIL

SEQ ID NO: 19901 - protein, 9 aa, Artificial Sequence
  Adenosine 3'-phospho 5'-phosphosulfate transporter 1 (49-57)
FMVPGYLLV

SEQ ID NO: 19902 - protein, 9 aa, Artificial Sequence
  DNA-directed RNA polymerase II subunit RPB1 (1247-1255)
FNDDNAEKL

SEQ ID NO: 19903 - protein, 9 aa, Artificial Sequence
  Tumor susceptibility gene 101 protein (44-52)
FNDGSSREL

SEQ ID NO: 19904 - protein, 9 aa, Artificial Sequence
  Amyloid-like protein 2 (10-18)
FNGNGKINV

SEQ ID NO: 19905 - protein, 7 aa, Artificial Sequence
  Cytoplasmic FMR1-interacting protein 1 (472-478)
FNHAIRH

SEQ ID NO: 19906 - protein, 10 aa, Artificial Sequence
  WD repeat-containing protein 19 (187-196)
FPDPNGTRLV

SEQ ID NO: 19907 - protein, 8 aa, Artificial Sequence
  WD repeat-containing protein 6 (464-471)
FPGKVHSL

SEQ ID NO: 19908 - protein, 10 aa, Artificial Sequence
  Collagen alpha-1(VIII) chain (279-288)
FPGPQGPLGK

SEQ ID NO: 19909 - protein, 8 aa, Artificial Sequence
  Proline and serine-rich protein 1 (159-166)
FPGTPLKK

SEQ ID NO: 19910 - protein, 8 aa, Artificial Sequence
  Patatin-like phospholipase domain-containing protein 2 (454-461)
FPPEALRM

SEQ ID NO: 19911 - protein, 9 aa, Artificial Sequence
  Non-POU domain-containing octamer-binding protein (129-137)
FPRPVTVEP

SEQ ID NO: 19912 - protein, 9 aa, Artificial Sequence
  Alpha-mannosidase 2x (42-50)
FPRSQISVL

SEQ ID NO: 19913 - protein, 10 aa, Artificial Sequence
  Transformation/transcription domain-associated protein (2223-2232)
FPTEPSTSSV

SEQ ID NO: 19914 - protein, 9 aa, Artificial Sequence
  Protein 4.1 (223-231)
FPWPKVLKI

SEQ ID NO: 19915 - protein, 8 aa, Artificial Sequence
  DNA polymerase alpha catalytic subunit (594-601)
FPYAFKEV

SEQ ID NO: 19916 - protein, 9 aa, Artificial Sequence
  DnaJ homolog subfamily C member 11 (314-322)
FQDDDQTRV

SEQ ID NO: 19917 - protein, 8 aa, Artificial Sequence
  Structural maintenance of chromosomes flexible hinge domain-containing protein 1 (1128-1135)
FQDDHVSL

SEQ ID NO: 19918 - protein, 9 aa, Artificial Sequence
  Serine/threonine-protein kinase MRCK alpha (144-152)
FQDDNNLYL

SEQ ID NO: 19919 - protein, 9 aa, Artificial Sequence
  Zinc finger HIT domain-containing protein 1 (40-48)
FQDDPHAGL

SEQ ID NO: 19920 - protein, 9 aa, Artificial Sequence
  General transcription factor 3C polypeptide 1 (734-742)
FQDKDQVFI

SEQ ID NO: 19921 - protein, 9 aa, Artificial Sequence
  Citron Rho-interacting kinase (164-172)
FQDKNHLYL

SEQ ID NO: 19922 - protein, 9 aa, Artificial Sequence
  Protein PRR14L (1088-1096)
FQEDSRSTL

SEQ ID NO: 19923 - protein, 8 aa, Artificial Sequence
  Plectin (2903-2910)
FQGKTVTI

SEQ ID NO: 19924 - protein, 7 aa, Artificial Sequence
  Proteasome activator complex subunit 4 (789-795)
FQGSHKH

SEQ ID NO: 19925 - protein, 9 aa, Artificial Sequence
  Heat shock 70 kDa protein 1B (21-29)
FQHGKVEII

SEQ ID NO: 19926 - protein, 9 aa, Artificial Sequence
  Spatacsin (332-340)
FQIDRSWKA

SEQ ID NO: 19927 - protein, 8 aa, Artificial Sequence
  Sodium/potassium-transporting ATPase subunit alpha-3 (948-955)
FQQGMKNK

SEQ ID NO: 19928 - protein, 11 aa, Artificial Sequence
  Gamma-secretase C-terminal fragment 59 (565-575)
FRHDSGYEVHH

SEQ ID NO: 19929 - protein, 12 aa, Artificial Sequence
  Gamma-secretase C-terminal fragment 59 (565-576)
FRHDSGYEVHHQ

SEQ ID NO: 19930 - protein, 8 aa, Artificial Sequence
  60S ribosomal protein L4 (257-264)
FRKLDELY

SEQ ID NO: 19931 - protein, 9 aa, Artificial Sequence
  Annexin A5 (288-296)
FRKNFATSL

SEQ ID NO: 19932 - protein, 9 aa, Artificial Sequence
  Glycogen phosphorylase, brain form (546-554)
FSAFLEKEY

SEQ ID NO: 19933 - protein, 7 aa, Artificial Sequence
  Erlin-2 (43-49)
FSAVHKI

SEQ ID NO: 19934 - protein, 9 aa, Artificial Sequence
  Myb-binding protein 1A (239-247)
FSDENVPRL

SEQ ID NO: 19935 - protein, 8 aa, Artificial Sequence
  Leucine zipper putative tumor suppressor 1 (232-239)
FSDGGSKL

SEQ ID NO: 19936 - protein, 9 aa, Artificial Sequence
  Basic leucine zipper and W2 domain-containing protein 2 (143-151)
FSETEQTKL

SEQ ID NO: 19937 - protein, 10 aa, Artificial Sequence
  Cytoplasmic dynein 2 heavy chain 1 (202-211)
FSETGGGEKY

SEQ ID NO: 19938 - protein, 9 aa, Artificial Sequence
  Dual specificity protein phosphatase 4 (366-374)
FSFPVSVGV

SEQ ID NO: 19939 - protein, 10 aa, Artificial Sequence
  Protein FAM135A (667-676)
FSGENITVKL

SEQ ID NO: 19940 - protein, 9 aa, Artificial Sequence
  Uncharacterized protein C20orf194 (1005-1013)
FSGNIYHIL

SEQ ID NO: 19941 - protein, 8 aa, Artificial Sequence
  RNA-binding protein FUS (355-362)
FSGNPIKV

SEQ ID NO: 19942 - protein, 8 aa, Artificial Sequence
  5,6-dihydroxyindole-2-carboxylic acid oxidase (213-220)
FSHEGPAF

SEQ ID NO: 19943 - protein, 8 aa, Artificial Sequence
  L-dopachrome tautomerase (209-216)
FSHQGPAF

SEQ ID NO: 19944 - protein, 11 aa, Artificial Sequence
  Homeobox protein Hox-B7 (11-21)
FSKYPASSSVF

SEQ ID NO: 19945 - protein, 11 aa, Artificial Sequence
  Sodium/potassium/calcium exchanger 1 (352-362)
FSLINGLQPVP

SEQ ID NO: 19946 - protein, 9 aa, Artificial Sequence
  Small subunit processome component 20 homolog (925-933)
FSNPRALYL

SEQ ID NO: 19947 - protein, 14 aa, Artificial Sequence
  Paired box protein Pax-1 (59-72)
FSPSGSLLSGASAE

SEQ ID NO: 19948 - protein, 7 aa, Artificial Sequence
  ADP-ribosylation factor 4 (9-15)
FSRLFGK

SEQ ID NO: 19949 - protein, 10 aa, Artificial Sequence
  Synemin (764-773)
FSVPFKVEEV

SEQ ID NO: 19950 - protein, 10 aa, Artificial Sequence
  Elongation factor 1-gamma (335-344)
FSWEGAFQHV

SEQ ID NO: 19951 - protein, 9 aa, Artificial Sequence
  Eukaryotic translation initiation factor 3 subunit H (135-143)
FSYQHAIEE

SEQ ID NO: 19952 - protein, 8 aa, Artificial Sequence
  Bcl-2-associated transcription factor 1 (338-345)
FTDEESRV

SEQ ID NO: 19953 - protein, 9 aa, Artificial Sequence
  Nuclear pore complex protein Nup160 (151-159)
FTDIGKVDF

SEQ ID NO: 19954 - protein, 8 aa, Artificial Sequence
  Homeobox protein TGIF1 (222-229)
FTDTSLMY

SEQ ID NO: 19955 - protein, 9 aa, Artificial Sequence
  Transmembrane 9 superfamily member 4 (168-176)
FTDVNKIYL

SEQ ID NO: 19956 - protein, 9 aa, Artificial Sequence
  Fibronectin isoform 7 (286-294)
FTDVRAAVY

SEQ ID NO: 19957 - protein, 9 aa, Artificial Sequence
  Integrator complex subunit 1 (745-753)
FTEQPETYY

SEQ ID NO: 19958 - protein, 9 aa, Artificial Sequence
  CUB and sushi domain-containing protein 1 (3053-3061)
FTFNKTVSY

SEQ ID NO: 19959 - protein, 7 aa, Artificial Sequence
  Up-regulated during skeletal muscle growth protein 5 (12-18)
FTGIKKY

SEQ ID NO: 19960 - protein, 7 aa, Artificial Sequence
  Bestrophin-1 (575-581)
FTGILGK

SEQ ID NO: 19961 - protein, 9 aa, Artificial Sequence
  Ribosomal protein S6 kinase alpha-3 (519-527)
FTITKTVEY

SEQ ID NO: 19962 - protein, 9 aa, Artificial Sequence
  Nuclear factor erythroid 2-related factor 1 (300-308)
FTNDKIINL

SEQ ID NO: 19963 - protein, 9 aa, Artificial Sequence
  Serine-threonine kinase receptor-associated protein (108-116)
FTQDSNYLL

SEQ ID NO: 19964 - protein, 13 aa, Artificial Sequence
  FXYD domain-containing ion transport regulator 3 isoform 3 (28-40)
FTQSPLHGAAAAY

SEQ ID NO: 19965 - protein, 10 aa, Artificial Sequence
  FRAS1-related extracellular matrix protein 1 (471-480)
FTVADLQAGV

SEQ ID NO: 19966 - protein, 9 aa, Artificial Sequence
  CUB and sushi domain-containing protein 1 (2875-2883)
FTYGAVVHY

SEQ ID NO: 19967 - protein, 9 aa, Artificial Sequence
  Fibronectin (364-372)
FTYNGRTFY

SEQ ID NO: 19968 - protein, 9 aa, Artificial Sequence
  Leucine-rich repeat protein 1 (73-81)
FVDEGKATV

SEQ ID NO: 19969 - protein, 7 aa, Artificial Sequence
  Protein FAM127B (50-56)
FVDENTF

SEQ ID NO: 19970 - protein, 9 aa, Artificial Sequence
  Calsyntenin-1 (820-828)
FVDLSGHNL

SEQ ID NO: 19971 - protein, 9 aa, Artificial Sequence
  Ras-specific guanine nucleotide-releasing factor RalGPS2 (272-280)
FVEDDNYKL

SEQ ID NO: 19972 - protein, 9 aa, Artificial Sequence
  Smith-Magenis syndrome chromosomal region candidate gene 8 protein (117-125)
FVEDSKVVL

SEQ ID NO: 19973 - protein, 9 aa, Artificial Sequence
  Vacuolar protein sorting-associated protein 41 (267-275)
FVEETVYLL

SEQ ID NO: 19974 - protein, 13 aa, Artificial Sequence
  Tubulin beta chain (110-122)
FVFGQSGAGNNWA

SEQ ID NO: 19975 - protein, 9 aa, Artificial Sequence
  2-hydroxyacylsphingosine 1-beta-galactosyltransferase (145-153)
FVIAHLLGV

SEQ ID NO: 19976 - protein, 9 aa, Artificial Sequence
  Glioma tumor suppressor candidate region gene 1 protein (784-792)
FVIQNQLGV

SEQ ID NO: 19977 - protein, 9 aa, Artificial Sequence
  40S ribosomal protein S26 (39-47)
FVIRNIVEA

SEQ ID NO: 19978 - protein, 9 aa, Artificial Sequence
  Kelch-like protein 7 (430-438)
FVKDKIFAV

SEQ ID NO: 19979 - protein, 9 aa, Artificial Sequence
  Tectonic-1 (346-354)
FVLGTVSSV

SEQ ID NO: 19980 - protein, 9 aa, Artificial Sequence
  Zinc finger protein 618 (573-581)
FVMSEIRTV

SEQ ID NO: 19981 - protein, 10 aa, Artificial Sequence
  Integrin alpha-11 (525-534)
FVYNGTLKDS

SEQ ID NO: 19982 - protein, 11 aa, Artificial Sequence
  Protein disulfide-isomerase TMX3 (154-164)
FVYVGGESPLK

SEQ ID NO: 19983 - protein, 9 aa, Artificial Sequence
  Palmitoyl-protein thioesterase 1 (194-202)
FYAHIIPFL

SEQ ID NO: 19984 - protein, 9 aa, Artificial Sequence
  Serine/threonine-protein kinase 36 (200-208)
FYATSIFQL

SEQ ID NO: 19985 - protein, 9 aa, Artificial Sequence
  Tetratricopeptide repeat protein 31 (320-328)
FYHEAVVLF

SEQ ID NO: 19986 - protein, 10 aa, Artificial Sequence
  Ubinuclein-1 (160-169)
FYINSGTLQF

SEQ ID NO: 19987 - protein, 7 aa, Artificial Sequence
  HLA class I histocompatibility antigen, B-15 alpha chain (232-238)
FYPAEIT

SEQ ID NO: 19988 - protein, 9 aa, Artificial Sequence
  PX domain-containing protein kinase-like protein (233-241)
FYRSYFSQF

SEQ ID NO: 19989 - protein, 9 aa, Artificial Sequence
  HLA class II histocompatibility antigen, DO alpha chain (163-171)
FYSQPDHLF

SEQ ID NO: 19990 - protein, 11 aa, Artificial Sequence
  Hypoxia-inducible factor 1-alpha (545-555)
FYVDSDMVNEF

SEQ ID NO: 19991 - protein, 22 aa, Artificial Sequence
  Neurobeachin (23-44)
GAAGGGGGGSGGGGTGGSGMGE

SEQ ID NO: 19992 - protein, 9 aa, Artificial Sequence
  Myb-binding protein 1A (310-318)
GAALPLLTK

SEQ ID NO: 19993 - protein, 9 aa, Artificial Sequence
  Neutral amino acid transporter A (59-67)
GAALRGLSL

SEQ ID NO: 19994 - protein, 16 aa, Artificial Sequence
  Beta-secretase 2 (73-88)
GAANFLAMVDNLQGDS

SEQ ID NO: 19995 - protein, 13 aa, Artificial Sequence
  Transcription factor E2F3 (21-33)
GAAVVAAAAAASM

SEQ ID NO: 19996 - protein, 9 aa, Artificial Sequence
  U3 small nucleolar RNA-associated protein 15 homolog (121-129)
GADDYTVKL

SEQ ID NO: 19997 - protein, 9 aa, Artificial Sequence
  Pre-mRNA-processing factor 19 (241-249)
GADKNVVVF

SEQ ID NO: 19998 - protein, 19 aa, Artificial Sequence
  Myc-associated zinc finger protein (303-321)
GAGGGGGEAGAGGGAAAVA

SEQ ID NO: 19999 - protein, 12 aa, Artificial Sequence
  High affinity cationic amino acid transporter 1 (35-46)
GAGVYVLAGAVA

SEQ ID NO: 20000 - protein, 13 aa, Artificial Sequence
  Cytochrome c oxidase subunit 5B, mitochondrial (117-129)
GAHYKLVPQQLAH

SEQ ID NO: 20001 - protein, 15 aa, Artificial Sequence
  Adenosylhomocysteinase 3 (39-53)
GAMAPPAGGGDPEAP

SEQ ID NO: 20002 - protein, 13 aa, Artificial Sequence
  Sickle tail protein homolog (296-308)
GAPRPGSTAHPPH

SEQ ID NO: 20003 - protein, 11 aa, Artificial Sequence
  Fibrocystin (1261-1271)
GAPTVPAAVEV

SEQ ID NO: 20004 - protein, 19 aa, Artificial Sequence
  Collagen alpha-1(XVIII) chain (992-1010)
GARGESGLAGAPGPAGPPG

SEQ ID NO: 20005 - protein, 8 aa, Artificial Sequence
  Mastermind-like protein 2 (85-92)
GARKAGKH

SEQ ID NO: 20006 - protein, 33 aa, Artificial Sequence
  Frizzled-8 (634-666)
GATAAGGGGGPGGGGGGGPGGGGGPGGGGGSLY

SEQ ID NO: 20007 - protein, 20 aa, Artificial Sequence
  26S protease regulatory subunit 6A (376-395)
GATELTHEDYMEGILEVQAK

SEQ ID NO: 20008 - protein, 12 aa, Artificial Sequence
  Vesicle transport protein SFT2C (154-165)
GATLFAALGLRS

SEQ ID NO: 20009 - protein, 15 aa, Artificial Sequence
  Chondroitin sulfate proteoglycan 4 (2058-2072)
GATLRLDPTVLDAGE

SEQ ID NO: 20010 - protein, 9 aa, Artificial Sequence
  Pecanex-like protein 3 (1088-1096)
GAVGFFTHY

SEQ ID NO: 20011 - protein, 9 aa, Artificial Sequence
  Pecanex-like protein 2 (267-275)
GAVGFVTHY

SEQ ID NO: 20012 - protein, 9 aa, Artificial Sequence
  Tensin-3 (1204-1212)
GAYGLAMKV

SEQ ID NO: 20013 - protein, 23 aa, Artificial Sequence
  Cytochrome c oxidase subunit 6A1, mitochondrial (64-86)
GDGNHTLFHNPHVNPLPTGYEDE

SEQ ID NO: 20014 - protein, 18 aa, Artificial Sequence
  Cadherin-2 (266-283)
GDPTGRFAIQTDPNSNDG

SEQ ID NO: 20015 - protein, 10 aa, Artificial Sequence
  E3 ubiquitin-protein ligase makorin-1 (147-156)
GEAESRNSNF

SEQ ID NO: 20016 - protein, 10 aa, Artificial Sequence
  Suppression of tumorigenicity 5 protein (770-779)
GEDGSRRFGY

SEQ ID NO: 20017 - protein, 11 aa, Artificial Sequence
  Melanotransferrin (422-432)
GEDIYTAGKTY

SEQ ID NO: 20018 - protein, 10 aa, Artificial Sequence
  Protein capicua homolog (1390-1399)
GEDPEGNKGF

SEQ ID NO: 20019 - protein, 21 aa, Artificial Sequence
  Eukaryotic translation initiation factor 5A-1 (130-150)
GEEILITVLSAMTEEAAVAIK

SEQ ID NO: 20020 - protein, 9 aa, Artificial Sequence
  Nucleosome-remodeling factor subunit BPTF (1023-1031)
GEEYRVTGY

SEQ ID NO: 20021 - protein, 16 aa, Artificial Sequence
  Gamma-interferon-inducible protein 16 (644-659)
GEFTYYEIQDNTGKME

SEQ ID NO: 20022 - protein, 9 aa, Artificial Sequence
  Cyclin-dependent kinase 6 (20-28)
GEGAYGKVF

SEQ ID NO: 20023 - protein, 8 aa, Artificial Sequence
  Nestin (495-502)
GEGEGQIW

SEQ ID NO: 20024 - protein, 9 aa, Artificial Sequence
  Zinc finger and BTB domain-containing protein 10 (226-234)
GEGETVQHF

SEQ ID NO: 20025 - protein, 10 aa, Artificial Sequence
  Matrix metalloproteinase-24 (185-194)
GEGGFLAHAY

SEQ ID NO: 20026 - protein, 9 aa, Artificial Sequence
  Filamin-B (1548-1556)
GEGLLAVQI

SEQ ID NO: 20027 - protein, 10 aa, Artificial Sequence
  Chondroitin sulfate proteoglycan 4 (1563-1572)
GEHTSPGHFF

SEQ ID NO: 20028 - protein, 9 aa, Artificial Sequence
  EKC/KEOPS complex subunit TPRKB (113-121)
GEKQINQEY

SEQ ID NO: 20029 - protein, 9 aa, Artificial Sequence
  Peroxisomal biogenesis factor 19 (180-188)
GEMPPGLNF

SEQ ID NO: 20030 - protein, 9 aa, Artificial Sequence
  TRAF2 and NCK-interacting protein kinase (434-442)
GEMPTSVAY

SEQ ID NO: 20031 - protein, 10 aa, Artificial Sequence
  Girdin (1244-1253)
GENDRLNHTY

SEQ ID NO: 20032 - protein, 10 aa, Artificial Sequence
  Plectin (1154-1163)
GERDVEVERW

SEQ ID NO: 20033 - protein, 9 aa, Artificial Sequence
  Fragile X mental retardation syndrome-related protein 1 (266-274)
GESADAVKK

SEQ ID NO: 20034 - protein, 9 aa, Artificial Sequence
  Nestin (482-490)
GESGGSRVF

SEQ ID NO: 20035 - protein, 9 aa, Artificial Sequence
  Protein MON2 homolog (918-926)
GESLIRTAF

SEQ ID NO: 20036 - protein, 10 aa, Artificial Sequence
  Synemin (317-326)
GESNPEIVIW

SEQ ID NO: 20037 - protein, 9 aa, Artificial Sequence
  Protein piccolo (255-263)
GESVKPSLP

SEQ ID NO: 20038 - protein, 10 aa, Artificial Sequence
  Vacuolar protein sorting-associated protein 18 homolog (657-666)
GETEQAIHNY

SEQ ID NO: 20039 - protein, 10 aa, Artificial Sequence
  Spectrin beta chain, non-erythrocytic 2 (1112-1121)
GEVERAQSEY

SEQ ID NO: 20040 - protein, 9 aa, Artificial Sequence
  ATP-citrate synthase (392-400)
GEVGKTTGI

SEQ ID NO: 20041 - protein, 9 aa, Artificial Sequence
  Hermansky-Pudlak syndrome 5 protein (252-260)
GEVISTHQF

SEQ ID NO: 20042 - protein, 12 aa, Artificial Sequence
  Serum albumin (423-434)
GEYKFQNALLVR

SEQ ID NO: 20043 - protein, 11 aa, Artificial Sequence
  HLA class I histocompatibility antigen, B-15 alpha chain (231-241)
GFYPAEITLTW

SEQ ID NO: 20044 - protein, 20 aa, Artificial Sequence
  Transcription factor Maf (211-230)
GGAGGAGGGGPASAGGGGGG

SEQ ID NO: 20045 - protein, 7 aa, Artificial Sequence
  Inhibitor of nuclear factor kappa-B kinase subunit beta (42-48)
GGDLRKY

SEQ ID NO: 20046 - protein, 19 aa, Artificial Sequence
  Cadherin-2 (265-283)
GGDPTGRFAIQTDPNSNDG

SEQ ID NO: 20047 - protein, 31 aa, Artificial Sequence
  Keratin, type I cytoskeletal 9 (593-623)
GGESGGSYGGGEEASGSGGGYGGGSGKSSHS

SEQ ID NO: 20048 - protein, 23 aa, Artificial Sequence
  Prostaglandin reductase 1 (141-163)
GGETVMVNAAAGAVGSVVGQIAK

SEQ ID NO: 20049 - protein, 17 aa, Artificial Sequence
  Hemicentin-1 (3579-3595)
GGGEVLRISTAQVEDTG

SEQ ID NO: 20050 - protein, 19 aa, Artificial Sequence
  Regulator of nonsense transcripts 1 (55-73)
GGGGAGGPGGAGAGAAAGQ

SEQ ID NO: 20051 - protein, 23 aa, Artificial Sequence
  Electrogenic sodium bicarbonate cotransporter 4 (440-462)
GGGGGAPGGGNGGGGGGGSGGGA

SEQ ID NO: 20052 - protein, 17 aa, Artificial Sequence
  AT-rich interactive domain-containing protein 1B (322-338)
GGGGGGGAGAGGAGAGA

SEQ ID NO: 20053 - protein, 15 aa, Artificial Sequence
  Neuronal PAS domain-containing protein 3 (734-748)
GGGGGGGAGGGGPSA

SEQ ID NO: 20054 - protein, 19 aa, Artificial Sequence
  Homeobox even-skipped homolog protein 2 (416-434)
GGGGGGGGGGGGGAGAGGG

SEQ ID NO: 20055 - protein, 22 aa, Artificial Sequence
  WD repeat-containing protein 26 (8-29)
GGGGGGGGGGGGGGGGGGQGQT

SEQ ID NO: 20056 - protein, 18 aa, Artificial Sequence
  Keratin, type I cytoskeletal 9 (15-32)
GGGGGGGLGSGGSIRSSY

SEQ ID NO: 20057 - protein, 15 aa, Artificial Sequence
  Zinc finger SWIM domain-containing protein 6 (150-164)
GGGGGSSSSPAATSA

SEQ ID NO: 20058 - protein, 13 aa, Artificial Sequence
  40S ribosomal protein S16 (74-86)
GGGHVAQIYGESQ

SEQ ID NO: 20059 - protein, 10 aa, Artificial Sequence
  Serine/threonine-protein kinase TAO2 (869-878)
GGGLQAALLA

SEQ ID NO: 20060 - protein, 18 aa, Artificial Sequence
  Keratin, type II cytoskeletal 1 (595-612)
GGGSSGGRGSGGGSSGGS

SEQ ID NO: 20061 - protein, 13 aa, Artificial Sequence
  Keratin, type II cytoskeletal 3 (144-156)
GGGYGGGMGGGLG

SEQ ID NO: 20062 - protein, 20 aa, Artificial Sequence
  Protein scribble homolog (1289-1308)
GGKMAESPCSPSGQQPPSPP

SEQ ID NO: 20063 - protein, 13 aa, Artificial Sequence
  Protein TASOR (44-56)
GGLNIAEPSGGAG

SEQ ID NO: 20064 - protein, 26 aa, Artificial Sequence
  Keratin, type I cytoskeletal 18 (56-81)
GGMGSGGLATGIAGGLAGMGGIQNEK

SEQ ID NO: 20065 - protein, 18 aa, Artificial Sequence
  Inositol 1,4,5-trisphosphate receptor type 1 (1761-1778)
GGPGKPGGGGGGSGSSSM

SEQ ID NO: 20066 - protein, 10 aa, Artificial Sequence
  KN motif and ankyrin repeat domain-containing protein 2 (473-482)
GGPPAGVRSI

SEQ ID NO: 20067 - protein, 13 aa, Artificial Sequence
  AT-rich interactive domain-containing protein 1A (277-289)
GGPSAAGGGTPQP

SEQ ID NO: 20068 - protein, 16 aa, Artificial Sequence
  Protein transport protein Sec24C (725-740)
GGSVYKYASFQVENDQ

SEQ ID NO: 20069 - protein, 25 aa, Artificial Sequence
  HLA class I histocompatibility antigen, A-1 alpha chain (316-340)
GGSYTQAASSDSAQGSDVSLTACKV

SEQ ID NO: 20070 - protein, 9 aa, Artificial Sequence
  Abl interactor 2 (222-230)
GHPVQFYSM

SEQ ID NO: 20071 - protein, 28 aa, Artificial Sequence
  Guanine nucleotide-binding protein subunit beta-2-like 1 (61-88)
GHSHFVSDVVISSDGQFALSGSWDGTLR

SEQ ID NO: 20072 - protein, 9 aa, Artificial Sequence
  Spatacsin (1079-1087)
GHTLLALAT

SEQ ID NO: 20073 - protein, 9 aa, Artificial Sequence
  Protein Jumonji (51-59)
GIAGSLKTV

SEQ ID NO: 20074 - protein, 9 aa, Artificial Sequence
  Lipoprotein lipase (23-31)
GIAGSLTNK

SEQ ID NO: 20075 - protein, 13 aa, Artificial Sequence
  Protein transport protein Sec16A (84-96)
GIANPLLAVPAPS

SEQ ID NO: 20076 - protein, 10 aa, Artificial Sequence
  Interferon alpha-inducible protein 27, mitochondrial (57-66)
GIASSSIAAK

SEQ ID NO: 20077 - protein, 9 aa, Artificial Sequence
  HLA class II histocompatibility antigen, DQ beta 1 chain (233-241)
GIGGFVLGL

SEQ ID NO: 20078 - protein, 9 aa, Artificial Sequence
  Probable methyltransferase TARBP1 (1190-1198)
GIIDRIFQA

SEQ ID NO: 20079 - protein, 38 aa, Artificial Sequence
  Glyceraldehyde-3-phosphate dehydrogenase (272-309)
GILGYTEHQVVSSDFNSDTHSSTFDAGAGIALNDHFVK

SEQ ID NO: 20080 - protein, 9 aa, Artificial Sequence
  Zinc finger ZZ-type and EF-hand domain-containing protein 1 (2890-2898)
GILLPLHRA

SEQ ID NO: 20081 - protein, 8 aa, Artificial Sequence
  HEAT repeat-containing protein 5A (975-982)
GIRNGSCS

SEQ ID NO: 20082 - protein, 9 aa, Artificial Sequence
  NHP2-like protein 1 (49-57)
GISEFIVMA

SEQ ID NO: 20083 - protein, 9 aa, Artificial Sequence
  Putative segment polarity protein dishevelled homolog DVL1P1 (277-285)
GIYIGSIMK

SEQ ID NO: 20084 - protein, 9 aa, Artificial Sequence
  Afadin (1018-1026)
GIYVKSVVK

SEQ ID NO: 20085 - protein, 7 aa, Artificial Sequence
  Mesoderm induction early response protein 3 (303-309)
GKDFHLI

SEQ ID NO: 20086 - protein, 12 aa, Artificial Sequence
  Leucine-rich repeat serine/threonine-protein kinase 2 (780-791)
GKGDSQIISLLL

SEQ ID NO: 20087 - protein, 11 aa, Artificial Sequence
  E1A-binding protein p400 (281-291)
GKTITPAHFQL

SEQ ID NO: 20088 - protein, 10 aa, Artificial Sequence
  Probable E3 ubiquitin-protein ligase HERC1 (2585-2594)
GLADLERAQA

SEQ ID NO: 20089 - protein, 9 aa, Artificial Sequence
  Minor histocompatibility antigen H13 (189-197)
GLAFSLNGV

SEQ ID NO: 20090 - protein, 9 aa, Artificial Sequence
  Serpin H1 (48-56)
GLAFSLYQA

SEQ ID NO: 20091 - protein, 9 aa, Artificial Sequence
  Ral GTPase-activating protein subunit beta (790-798)
GLAKVKVMV

SEQ ID NO: 20092 - protein, 11 aa, Artificial Sequence
  Equilibrative nucleoside transporter 1 (483-493)
GLALGAVFSFL

SEQ ID NO: 20093 - protein, 11 aa, Artificial Sequence
  Prominin-2 (17-27)
GLALSQLAAGA

SEQ ID NO: 20094 - protein, 9 aa, Artificial Sequence
  Vacuolar protein sorting-associated protein 41 homolog (323-331)
GLAYINHLV

SEQ ID NO: 20095 - protein, 9 aa, Artificial Sequence
  Zinc finger and BTB domain-containing protein 39 (63-71)
GLDAARTYV

SEQ ID NO: 20096 - protein, 9 aa, Artificial Sequence
  C-type lectin domain family 11 member A (117-125)
GLDAGLHQL

SEQ ID NO: 20097 - protein, 10 aa, Artificial Sequence
  Protein PRR14L (130-139)
GLDELDGVKA

SEQ ID NO: 20098 - protein, 9 aa, Artificial Sequence
  Protein furry homolog-like (621-629)
GLDNETHFL

SEQ ID NO: 20099 - protein, 9 aa, Artificial Sequence
  Heat shock 70 kDa protein 12A (522-530)
GLDPAVIKV

SEQ ID NO: 20100 - protein, 9 aa, Artificial Sequence
  DNA polymerase alpha catalytic subunit (1240-1248)
GLDPTQFRV

SEQ ID NO: 20101 - protein, 9 aa, Artificial Sequence
  Sodium- and chloride-dependent creatine transporter 1 (299-307)
GLDSQFVGV

SEQ ID NO: 20102 - protein, 9 aa, Artificial Sequence
  ADP-ribosylation factor 5 (169-177)
GLDWLSHEL

SEQ ID NO: 20103 - protein, 10 aa, Artificial Sequence
  Trinucleotide repeat-containing gene 18 protein (737-746)
GLEESGLGLL

SEQ ID NO: 20104 - protein, 10 aa, Artificial Sequence
  Rho GTPase-activating protein 23 (525-534)
GLESTGIYRV

SEQ ID NO: 20105 - protein, 10 aa, Artificial Sequence
  Ciliary neurotrophic factor (150-159)
GLFEKKLWGL

SEQ ID NO: 20106 - protein, 10 aa, Artificial Sequence
  Oxysterol-binding protein-related protein 1 (365-374)
GLFGKELHKV

SEQ ID NO: 20107 - protein, 9 aa, Artificial Sequence
  Receptor-interacting serine/threonine-protein kinase 4 (180-188)
GLFGTIAYL

SEQ ID NO: 20108 - protein, 10 aa, Artificial Sequence
  Presenilin-2 (364-373)
GLGDFIFYSV

SEQ ID NO: 20109 - protein, 9 aa, Artificial Sequence
  Nurim (175-183)
GLGEPLALK

SEQ ID NO: 20110 - protein, 8 aa, Artificial Sequence
  Unconventional myosin-Va (1848-1855)
GLGFISRV

SEQ ID NO: 20111 - protein, 8 aa, Artificial Sequence
  Probable ATP-dependent RNA helicase YTHDC2 (1364-1371)
GLGGVFKV

SEQ ID NO: 20112 - protein, 8 aa, Artificial Sequence
  Sodium-dependent multivitamin transporter (227-234)
GLGRVWAV

SEQ ID NO: 20113 - protein, 11 aa, Artificial Sequence
  Vacuole membrane protein 1 (126-136)
GLGTGLHTFLL

SEQ ID NO: 20114 - protein, 12 aa, Artificial Sequence
  Elastin (104-115)
GLGVGAGVPGFG

SEQ ID NO: 20115 - protein, 9 aa, Artificial Sequence
  Bifunctional heparan sulfate N-deacetylase/N-sulfotransferase 3 (265-273)
GLHDGIQRV

SEQ ID NO: 20116 - protein, 9 aa, Artificial Sequence
  Vacuolar protein sorting-associated protein 13D (747-755)
GLHGLVVQA

SEQ ID NO: 20117 - protein, 9 aa, Artificial Sequence
  Ribosome-binding protein 1 (183-191)
GLHGQLQEA

SEQ ID NO: 20118 - protein, 11 aa, Artificial Sequence
  Dystonin (1614-1624)
GLIDEQILCQL

SEQ ID NO: 20119 - protein, 11 aa, Artificial Sequence
  28 kDa heat- and acid-stable phosphoprotein (79-89)
GLIDIENPNRV

SEQ ID NO: 20120 - protein, 11 aa, Artificial Sequence
  Dystonin (1576-1586)
GLIDYDTGIRL

SEQ ID NO: 20121 - protein, 14 aa, Artificial Sequence
  ATP-citrate synthase (832-845)
GLIRKPASFMTSIC

SEQ ID NO: 20122 - protein, 7 aa, Artificial Sequence
  Rho-related BTB domain-containing protein 3 (23-29)
GLIRTYL

SEQ ID NO: 20123 - protein, 9 aa, Artificial Sequence
  Nucleolar protein 6 (323-331)
GLKDGVALL

SEQ ID NO: 20124 - protein, 10 aa, Artificial Sequence
  Matrin-3 (27-36)
GLLAAATQSL

SEQ ID NO: 20125 - protein, 9 aa, Artificial Sequence
  Transmembrane protein 223 (112-120)
GLLFSLRSV

SEQ ID NO: 20126 - protein, 9 aa, Artificial Sequence
  Receptor-type tyrosine-protein phosphatase T (1083-1091)
GLLGFVRQV

SEQ ID NO: 20127 - protein, 9 aa, Artificial Sequence
  LanC-like protein 1 (313-321)
GLLKKGYGL

SEQ ID NO: 20128 - protein, 10 aa, Artificial Sequence
  Protein ELYS (20-29)
GLLPFPEVTL

SEQ ID NO: 20129 - protein, 9 aa, Artificial Sequence
  Protein farnesyltransferase subunit beta (256-264)
GLLPLLHRA

SEQ ID NO: 20130 - protein, 9 aa, Artificial Sequence
  Angiomotin (797-805)
GLLSHSSTL

SEQ ID NO: 20131 - protein, 9 aa, Artificial Sequence
  Helicase SKI2W (380-388)
GLLTGDVQL

SEQ ID NO: 20132 - protein, 9 aa, Artificial Sequence
  Glycerol-3-phosphate acyltransferase 3 (87-95)
GLMGIIQRA

SEQ ID NO: 20133 - protein, 9 aa, Artificial Sequence
  Glycerol-3-phosphate acyltransferase 4 (150-158)
GLMGVIQRA

SEQ ID NO: 20134 - protein, 10 aa, Artificial Sequence
  Contactin-associated protein-like 3B (447-456)
GLNDGQWHSV

SEQ ID NO: 20135 - protein, 9 aa, Artificial Sequence
  Basement membrane-specific heparan sulfate proteoglycan core protein (280-288)
GLNLHTLLY

SEQ ID NO: 20136 - protein, 10 aa, Artificial Sequence
  Sorting nexin-18 (488-497)
GLNQAIAFTG

SEQ ID NO: 20137 - protein, 10 aa, Artificial Sequence
  Cell surfaceoprotein MUC18 (416-425)
GLNRTQLVNV

SEQ ID NO: 20138 - protein, 11 aa, Artificial Sequence
  DnaJ homolog subfamily B member 11 (305-315)
GLPNFDNNNIK

SEQ ID NO: 20139 - protein, 13 aa, Artificial Sequence
  Epidermal growth factor receptor substrate 15 (256-268)
GLPSTLLAHIWSL

SEQ ID NO: 20140 - protein, 9 aa, Artificial Sequence
  Uridine phosphorylase 1 (55-63)
GLQAAVVCV

SEQ ID NO: 20141 - protein, 12 aa, Artificial Sequence
  Nestin (434-445)
GLQDPEGQSQQV

SEQ ID NO: 20142 - protein, 15 aa, Artificial Sequence
  Ryanodine receptor 1 (135-149)
GLQEDATGEACWWTM

SEQ ID NO: 20143 - protein, 9 aa, Artificial Sequence
  Catenin beta-1 (278-286)
GLQKMVALL

SEQ ID NO: 20144 - protein, 9 aa, Artificial Sequence
  Serine hydroxymethyltransferase, mitochondrial (399-407)
GLRLGAPAL

SEQ ID NO: 20145 - protein, 17 aa, Artificial Sequence
  AP-5 complex subunit beta-1 (121-137)
GLRQRAALDGGPRALAT

SEQ ID NO: 20146 - protein, 10 aa, Artificial Sequence
  Actin-like protein 6B (313-322)
GLSGNTMLGV

SEQ ID NO: 20147 - protein, 9 aa, Artificial Sequence
  Melanoma antigen preferentially expressed in tumors (432-440)
GLSNLTHVL

SEQ ID NO: 20148 - protein, 9 aa, Artificial Sequence
  G-protein coupled receptor 143 (150-158)
GLSTILLYH

SEQ ID NO: 20149 - protein, 9 aa, Artificial Sequence
  Purine nucleoside phosphorylase (37-45)
GLTDKLTQA

SEQ ID NO: 20150 - protein, 10 aa, Artificial Sequence
  Beta-glucuronidase (23-32)
GLVNYQISVK

SEQ ID NO: 20151 - protein, 38 aa, Artificial Sequence
  Testis anion transporter 1 (103-140)
GLVQVPQGLTLSLLARQLIPPLNIAYAAFCSSVIYVIF

SEQ ID NO: 20152 - protein, 9 aa, Artificial Sequence
  Laminin subunit alpha-4 (1544-1552)
GLWHDVIFI

SEQ ID NO: 20153 - protein, 10 aa, Artificial Sequence
  Disco-interacting protein 2 homolog C (547-556)
GLWHGILTSV

SEQ ID NO: 20154 - protein, 10 aa, Artificial Sequence
  Disco-interacting protein 2 homolog B (156-165)
GLWHGMFANV

SEQ ID NO: 20155 - protein, 9 aa, Artificial Sequence
  Adhesion G protein-coupled receptor A3 (1170-1178)
GLWKHETTV

SEQ ID NO: 20156 - protein, 9 aa, Artificial Sequence
  Zinc transporter ZIP14 (20-28)
GLWRTTPEA

SEQ ID NO: 20157 - protein, 10 aa, Artificial Sequence
  RNA pseudouridylate synthase domain-containing protein 1 (32-41)
GLYAGDPVSK

SEQ ID NO: 20158 - protein, 9 aa, Artificial Sequence
  Lysosomal-trafficking regulator (2306-2314)
GLYELLSGV

SEQ ID NO: 20159 - protein, 9 aa, Artificial Sequence
  Zinc finger BED domain-containing protein 1 (137-145)
GLYPASIVD

SEQ ID NO: 20160 - protein, 9 aa, Artificial Sequence
  ATP-dependent RNA helicase DHX36 (824-832)
GLYPKVAKI

SEQ ID NO: 20161 - protein, 9 aa, Artificial Sequence
  E3 ubiquitin-protein ligase HERC2 (1628-1636)
GLYPQSPLL

SEQ ID NO: 20162 - protein, 9 aa, Artificial Sequence
  Unconventional myosin-XVIIIa (758-766)
GLYSELFTL

SEQ ID NO: 20163 - protein, 9 aa, Artificial Sequence
  Gamma-tubulin complex component 2 (879-887)
GMASVISRL

SEQ ID NO: 20164 - protein, 9 aa, Artificial Sequence
  Intraflagellar transport protein 27 homolog (41-49)
GMDLVVKTV

SEQ ID NO: 20165 - protein, 10 aa, Artificial Sequence
  Lysophosphatidic acid phosphatase type 6 (118-127)
GMFAGQLTKV

SEQ ID NO: 20166 - protein, 12 aa, Artificial Sequence
  AP-3 complex subunit beta-1 (317-328)
GMFEPYLKSFYV

SEQ ID NO: 20167 - protein, 10 aa, Artificial Sequence
  ATP-dependent RNA helicase DHX29 (113-122)
GMISGRLTAK

SEQ ID NO: 20168 - protein, 9 aa, Artificial Sequence
  Glucocorticoid modulatory element-binding protein 2 (289-297)
GMLDLVKKV

SEQ ID NO: 20169 - protein, 9 aa, Artificial Sequence
  E3 ubiquitin-protein ligase HUWE1 (407-415)
GMMEALLKV

SEQ ID NO: 20170 - protein, 9 aa, Artificial Sequence
  Complement receptor type 1 (563-571)
GMVHVITDI

SEQ ID NO: 20171 - protein, 11 aa, Artificial Sequence
  Chromodomain-helicase-DNA-binding protein 4 (1035-1045)
GMYDGSALIRA

SEQ ID NO: 20172 - protein, 10 aa, Artificial Sequence
  Peroxisomal acyl-coenzyme A oxidase 3 (111-120)
GMYDSSLAAK

SEQ ID NO: 20173 - protein, 26 aa, Artificial Sequence
  ATP synthase-coupling factor 6, mitochondrial (83-108)
GNADMNTFPTFKFEDPKFEVIEKPQA

SEQ ID NO: 20174 - protein, 7 aa, Artificial Sequence
  Sorbitol dehydrogenase (58-64)
GNFIVKK

SEQ ID NO: 20175 - protein, 21 aa, Artificial Sequence
  Fibrillin-2 (463-483)
GNGFSPGVGGAGVGAGGQGPI

SEQ ID NO: 20176 - protein, 21 aa, Artificial Sequence
  Cytochrome c oxidase subunit 6A1, mitochondrial (66-86)
GNHTLFHNPHVNPLPTGYEDE

SEQ ID NO: 20177 - protein, 9 aa, Artificial Sequence
  Tyrosine-protein phosphatase non-receptor type substrate 1 (5-13)
GPAPGRLGP

SEQ ID NO: 20178 - protein, 22 aa, Artificial Sequence
  Heat shock cognate 71 kDa protein (4-25)
GPAVGIDLGTTYSCVGVFQHGK

SEQ ID NO: 20179 - protein, 11 aa, Artificial Sequence
  Kinesin-like protein KIF13A (1193-1203)
GPHASGVNSIL

SEQ ID NO: 20180 - protein, 17 aa, Artificial Sequence
  Myosin-IIIb (1132-1148)
GPHSPVAAGTRGSAEVQ

SEQ ID NO: 20181 - protein, 10 aa, Artificial Sequence
  Obscurin (6240-6249)
GPKAPGPSTG

SEQ ID NO: 20182 - protein, 12 aa, Artificial Sequence
  Collagen alpha-2(XI) chain (739-750)
GPKGAKGATGPG

SEQ ID NO: 20183 - protein, 13 aa, Artificial Sequence
  Collagen alpha-1(III) chain (660-672)
GPKGDAGAPGAPG

SEQ ID NO: 20184 - protein, 9 aa, Artificial Sequence
  Synaptic vesicle membrane protein VAT-1 homolog (289-297)
GPKRNLMAL

SEQ ID NO: 20185 - protein, 16 aa, Artificial Sequence
  Fibronectin isoform 6 (1673-1688)
GPMKEINLAPDSSSVV

SEQ ID NO: 20186 - protein, 17 aa, Artificial Sequence
  Fibronectin isoform 6 (1673-1689)
GPMKEINLAPDSSSVVV

SEQ ID NO: 20187 - protein, 12 aa, Artificial Sequence
  Histone acetyltransferase p300 (672-683)
GPNMGQPQPGMT

SEQ ID NO: 20188 - protein, 17 aa, Artificial Sequence
  Collagen alpha-3(IV) chain (637-653)
GPPGEAGPRGELSVSTP

SEQ ID NO: 20189 - protein, 12 aa, Artificial Sequence
  Collagen alpha-1(III) chain (43-54)
GPPGPAGNTGAP

SEQ ID NO: 20190 - protein, 10 aa, Artificial Sequence
  ETS translocation variant 5 (359-368)
GPPYQRRGSL

SEQ ID NO: 20191 - protein, 15 aa, Artificial Sequence
  REST corepressor 2 (504-518)
GPQPPPTLIGTPLEP

SEQ ID NO: 20192 - protein, 9 aa, Artificial Sequence
  Cathepsin D (303-311)
GPVDEVREL

SEQ ID NO: 20193 - protein, 16 aa, Artificial Sequence
  Collagen alpha-1(V) chain (1225-1240)
GPVGLQGLPGPPGEKG

SEQ ID NO: 20194 - protein, 7 aa, Artificial Sequence
  Barrier-to-autointegration factor (47-53)
GQFLVLK

SEQ ID NO: 20195 - protein, 17 aa, Artificial Sequence
  Filamin-A (1240-1256)
GQGVFREATTEFSVDAR

SEQ ID NO: 20196 - protein, 10 aa, Artificial Sequence
  UHRF1-binding protein 1-like (784-793)
GQKPSSSDTF

SEQ ID NO: 20197 - protein, 10 aa, Artificial Sequence
  Pleckstrin homology-like domain family B member 1 (354-363)
GQLPVVAISL

SEQ ID NO: 20198 - protein, 9 aa, Artificial Sequence
  Transcription elongation factor SPT5 (995-1003)
GQTGVIRSV

SEQ ID NO: 20199 - protein, 9 aa, Artificial Sequence
  Protein prune homolog 2 (1236-1244)
GQVEIVTKV

SEQ ID NO: 20200 - protein, 9 aa, Artificial Sequence
  E3 SUMO-protein ligase RanBP2 (112-120)
GRAKYWLER

SEQ ID NO: 20201 - protein, 9 aa, Artificial Sequence
  Hemicentin-1 (3137-3145)
GRDDKNFHL

SEQ ID NO: 20202 - protein, 38 aa, Artificial Sequence
  DnaJ homolog subfamily B member 11 (23-60)
GRDFYKILGVPRSASIKDIKKAYRKLALQLHPDRNPDD

SEQ ID NO: 20203 - protein, 9 aa, Artificial Sequence
  Integrin alpha-X (519-527)
GRFGAALTV

SEQ ID NO: 20204 - protein, 9 aa, Artificial Sequence
  Phosphorylase b kinase regulatory subunit alpha, skeletal muscle isoform (1123-1131)
GRFGTMTYL

SEQ ID NO: 20205 - protein, 9 aa, Artificial Sequence
  Glycerol-3-phosphate acyltransferase 4 (81-89)
GRFKEFMSK

SEQ ID NO: 20206 - protein, 9 aa, Artificial Sequence
  Tyrosine-protein phosphatase non-receptor type 21 (1024-1032)
GRFKITTRF

SEQ ID NO: 20207 - protein, 9 aa, Artificial Sequence
  Hemicentin-1 (2532-2540)
GRFLQITNV

SEQ ID NO: 20208 - protein, 9 aa, Artificial Sequence
  40S ribosomal protein S21 (44-52)
GRFNGQFKT

SEQ ID NO: 20209 - protein, 9 aa, Artificial Sequence
  Serine/threonine-protein kinase WNK1 (228-236)
GRGSFKTVY

SEQ ID NO: 20210 - protein, 10 aa, Artificial Sequence
  Homeodomain-interacting protein kinase 1 (197-206)
GRGTFGQVAK

SEQ ID NO: 20211 - protein, 9 aa, Artificial Sequence
  Exosome component 10 (399-407)
GRHSLDHLL

SEQ ID NO: 20212 - protein, 9 aa, Artificial Sequence
  Eukaryotic translation initiation factor 3 subunit L (261-269)
GRHSLYKML

SEQ ID NO: 20213 - protein, 10 aa, Artificial Sequence
  Hemicentin-1 (305-314)
GRHSVRITGL

SEQ ID NO: 20214 - protein, 9 aa, Artificial Sequence
  Sulfiredoxin-1 (29-37)
GRIAAVHNV

SEQ ID NO: 20215 - protein, 9 aa, Artificial Sequence
  FH2 domain-containing protein 1 (1122-1130)
GRILNPLRK

SEQ ID NO: 20216 - protein, 26 aa, Artificial Sequence
  40S ribosomal protein S19 (120-145)
GRKLTPQGQRDLDRIAGQVAAANKKH

SEQ ID NO: 20217 - protein, 9 aa, Artificial Sequence
  Plectin (581-589)
GRLDLQYAK

SEQ ID NO: 20218 - protein, 9 aa, Artificial Sequence
  Chondroitin sulfate proteoglycan 4 (2121-2129)
GRLGLEVGR

SEQ ID NO: 20219 - protein, 9 aa, Artificial Sequence
  CDK-activating kinase assembly factor MAT1 (225-233)
GRLGYLNHV

SEQ ID NO: 20220 - protein, 9 aa, Artificial Sequence
  Coiled-coil domain-containing protein 85B (43-51)
GRLMQEVNR

SEQ ID NO: 20221 - protein, 10 aa, Artificial Sequence
  Up-regulator of cell proliferation (625-634)
GRLPAGQRRF

SEQ ID NO: 20222 - protein, 9 aa, Artificial Sequence
  Pleckstrin homology-like domain family B member 1 (536-544)
GRLSPAYSL

SEQ ID NO: 20223 - protein, 9 aa, Artificial Sequence
  Muscleblind-like protein 3 (34-42)
GRNNLIQQK

SEQ ID NO: 20224 - protein, 10 aa, Artificial Sequence
  L-dopachrome tautomerase (313-322)
GRNSMKLPTL

SEQ ID NO: 20225 - protein, 11 aa, Artificial Sequence
  Probable ATP-dependent RNA helicase DDX17 (123-133)
GRSSQSSSQQF

SEQ ID NO: 20226 - protein, 9 aa, Artificial Sequence
  DNA-dependent protein kinase catalytic subunit (2721-2729)
GRTDLLRLR

SEQ ID NO: 20227 - protein, 9 aa, Artificial Sequence
  Alpha-1,3-mannosyl-glycoprotein 4-beta-N-acetylglucosaminyltransferase B (36-44)
GRTGVSVVM

SEQ ID NO: 20228 - protein, 9 aa, Artificial Sequence
  Ubiquitin-associated protein 2-like (711-719)
GRTSTSTLL

SEQ ID NO: 20229 - protein, 9 aa, Artificial Sequence
  Multidrug resistance protein 1 (515-523)
GRTTIVIAH

SEQ ID NO: 20230 - protein, 10 aa, Artificial Sequence
  Transmembraneoprotein NMB (76-85)
GRVQAVLTSD

SEQ ID NO: 20231 - protein, 9 aa, Artificial Sequence
  DNA-directed RNA polymerase III subunit RPC4 (335-343)
GRVQLLLGK

SEQ ID NO: 20232 - protein, 9 aa, Artificial Sequence
  Retinoic acid-induced protein 1 (110-118)
GRYAGEESL

SEQ ID NO: 20233 - protein, 13 aa, Artificial Sequence
  CD44 antigen (40-52)
GRYSISRTEAADL

SEQ ID NO: 20234 - protein, 18 aa, Artificial Sequence
  Cytochrome c oxidase subunit 7C, mitochondrial (46-63)
GSAFATPFLVVRHQLLKT

SEQ ID NO: 20235 - protein, 13 aa, Artificial Sequence
  Vimentin (41-53)
GSALRPSTSRSLY

SEQ ID NO: 20236 - protein, 9 aa, Artificial Sequence
  WD repeat-containing protein 81 (728-736)
GSDNGVIRL

SEQ ID NO: 20237 - protein, 10 aa, Artificial Sequence
  Protein-methionine sulfoxide oxidase MICAL1 (594-603)
GSDPLGLIAY

SEQ ID NO: 20238 - protein, 12 aa, Artificial Sequence
  A-kinase anchor protein 8 (159-170)
GSDRNGSFGGQY

SEQ ID NO: 20239 - protein, 10 aa, Artificial Sequence
  Plasminogen activator inhibitor 1 RNA-binding protein (114-123)
GSDRSSFSHY

SEQ ID NO: 20240 - protein, 12 aa, Artificial Sequence
  Retinoic acid-induced protein 1 (520-531)
GSEDPLERSFLY

SEQ ID NO: 20241 - protein, 9 aa, Artificial Sequence
  Ribosomal protein S6 kinase alpha-6 (82-90)
GSFGKVFLV

SEQ ID NO: 20242 - protein, 11 aa, Artificial Sequence
  V-type proton ATPase subunit H (179-189)
GSGVAVETGTV

SEQ ID NO: 20243 - protein, 14 aa, Artificial Sequence
  HLA class I histocompatibility antigen, A-1 alpha chain (25-38)
GSHSMRYFFTSVSR

SEQ ID NO: 20244 - protein, 15 aa, Artificial Sequence
  HLA class I histocompatibility antigen, A-1 alpha chain (25-39)
GSHSMRYFFTSVSRP

SEQ ID NO: 20245 - protein, 17 aa, Artificial Sequence
  HLA class I histocompatibility antigen, A-1 alpha chain (25-41)
GSHSMRYFFTSVSRPGR

SEQ ID NO: 20246 - protein, 18 aa, Artificial Sequence
  HLA class I histocompatibility antigen, A-1 alpha chain (25-42)
GSHSMRYFFTSVSRPGRG

SEQ ID NO: 20247 - protein, 26 aa, Artificial Sequence
  HLA class I histocompatibility antigen, A-1 alpha chain (25-50)
GSHSMRYFFTSVSRPGRGEPRFIAVG

SEQ ID NO: 20248 - protein, 29 aa, Artificial Sequence
  HLA class I histocompatibility antigen, A-1 alpha chain (25-53)
GSHSMRYFFTSVSRPGRGEPRFIAVGYVD

SEQ ID NO: 20249 - protein, 37 aa, Artificial Sequence
  HLA class I histocompatibility antigen, A-1 alpha chain (25-61)
GSHSMRYFFTSVSRPGRGEPRFIAVGYVDDTQFVRFD

SEQ ID NO: 20250 - protein, 39 aa, Artificial Sequence
  HLA class I histocompatibility antigen, A-1 alpha chain (25-63)
GSHSMRYFFTSVSRPGRGEPRFIAVGYVDDTQFVRFDSD

SEQ ID NO: 20251 - protein, 16 aa, Artificial Sequence
  HLA class I histocompatibility antigen, A-23 alpha chain (25-40)
GSHSMRYFSTSVSRPG

SEQ ID NO: 20252 - protein, 18 aa, Artificial Sequence
  HLA class I histocompatibility antigen, A-23 alpha chain (25-42)
GSHSMRYFSTSVSRPGRG

SEQ ID NO: 20253 - protein, 19 aa, Artificial Sequence
  HLA class I histocompatibility antigen, A-23 alpha chain (25-43)
GSHSMRYFSTSVSRPGRGE

SEQ ID NO: 20254 - protein, 21 aa, Artificial Sequence
  HLA class I histocompatibility antigen, A-23 alpha chain (25-45)
GSHSMRYFSTSVSRPGRGEPR

SEQ ID NO: 20255 - protein, 26 aa, Artificial Sequence
  HLA class I histocompatibility antigen, A-23 alpha chain (25-50)
GSHSMRYFSTSVSRPGRGEPRFIAVG

SEQ ID NO: 20256 - protein, 29 aa, Artificial Sequence
  HLA class I histocompatibility antigen, A-23 alpha chain (25-53)
GSHSMRYFSTSVSRPGRGEPRFIAVGYVD

SEQ ID NO: 20257 - protein, 30 aa, Artificial Sequence
  HLA class I histocompatibility antigen, A-23 alpha chain (25-54)
GSHSMRYFSTSVSRPGRGEPRFIAVGYVDD

SEQ ID NO: 20258 - protein, 36 aa, Artificial Sequence
  HLA class I histocompatibility antigen, A-23 alpha chain (25-60)
GSHSMRYFSTSVSRPGRGEPRFIAVGYVDDTQFVRF

SEQ ID NO: 20259 - protein, 37 aa, Artificial Sequence
  HLA class I histocompatibility antigen, A-23 alpha chain (25-61)
GSHSMRYFSTSVSRPGRGEPRFIAVGYVDDTQFVRFD

SEQ ID NO: 20260 - protein, 39 aa, Artificial Sequence
  HLA class I histocompatibility antigen, A-23 alpha chain (25-63)
GSHSMRYFSTSVSRPGRGEPRFIAVGYVDDTQFVRFDSD

SEQ ID NO: 20261 - protein, 37 aa, Artificial Sequence
  HLA class I histocompatibility antigen, B-39 alpha chain (25-61)
GSHSMRYFYTSVSRPGRGEPRFISVGYVDDTQFVRFD

SEQ ID NO: 20262 - protein, 39 aa, Artificial Sequence
  HLA class I histocompatibility antigen, B-39 alpha chain (25-63)
GSHSMRYFYTSVSRPGRGEPRFISVGYVDDTQFVRFDSD

SEQ ID NO: 20263 - protein, 8 aa, Artificial Sequence
  Inosine-5'-monophosphate dehydrogenase 1 (142-149)
GSKLVGIV

SEQ ID NO: 20264 - protein, 14 aa, Artificial Sequence
  Leucine-tRNA ligase, cytoplasmic (286-299)
GSMPELKKYMKKVM

SEQ ID NO: 20265 - protein, 16 aa, Artificial Sequence
  Beta-secretase 2 (112-127)
GSSNFAVAGTPHSYID

SEQ ID NO: 20266 - protein, 17 aa, Artificial Sequence
  Beta-secretase 2 (112-128)
GSSNFAVAGTPHSYIDT

SEQ ID NO: 20267 - protein, 18 aa, Artificial Sequence
  Keratin, type II cytoskeletal 71 (27-44)
GSSSSFRAGSKGLSGGFG

SEQ ID NO: 20268 - protein, 9 aa, Artificial Sequence
  PH-interacting protein (339-347)
GSTDHIIRV

SEQ ID NO: 20269 - protein, 9 aa, Artificial Sequence
  WD repeat-containing protein 48 (104-112)
GSTEKVLRV

SEQ ID NO: 20270 - protein, 9 aa, Artificial Sequence
  Interferon-induced protein with tetratricopeptide repeats 1 (265-273)
GSVDKALEL

SEQ ID NO: 20271 - protein, 9 aa, Artificial Sequence
  Polyadenylate-binding protein 2 (223-231)
GSVNRVTIL

SEQ ID NO: 20272 - protein, 11 aa, Artificial Sequence
  Immunoglobulin superfamily member 8 (138-148)
GSYSGKVELRV

SEQ ID NO: 20273 - protein, 24 aa, Artificial Sequence
  HLA class I histocompatibility antigen, A-23 alpha chain (342-365)
GSYSQAASSDSAQGSDVSLTACKV

SEQ ID NO: 20274 - protein, 24 aa, Artificial Sequence
  HLA class I histocompatibility antigen, A-1 alpha chain (317-340)
GSYTQAASSDSAQGSDVSLTACKV

SEQ ID NO: 20275 - protein, 9 aa, Artificial Sequence
  Myelin proteolipid protein (19-27)
GTASFFFLY

SEQ ID NO: 20276 - protein, 11 aa, Artificial Sequence
  Hemicentin-1 (688-698)
GTDKQNSTLRY

SEQ ID NO: 20277 - protein, 9 aa, Artificial Sequence
  Chondroitin sulfate proteoglycan 4 (1612-1620)
GTDPQLLLY

SEQ ID NO: 20278 - protein, 8 aa, Artificial Sequence
  Cathepsin F (454-461)
GTDWGEKG

SEQ ID NO: 20279 - protein, 10 aa, Artificial Sequence
  Cathepsin F (454-463)
GTDWGEKGYY

SEQ ID NO: 20280 - protein, 11 aa, Artificial Sequence
  Cathepsin F (454-464)
GTDWGEKGYYY

SEQ ID NO: 20281 - protein, 9 aa, Artificial Sequence
  Cytoplasmic dynein 1 heavy chain 1 (2749-2757)
GTFNRAMLR

SEQ ID NO: 20282 - protein, 31 aa, Artificial Sequence
  Nucleoporin p58/p45 (64-94)
GTGLFGSKPATGFTLGGTNTGTPATTSAATT

SEQ ID NO: 20283 - protein, 9 aa, Artificial Sequence
  DNA damage-binding protein 1 (702-710)
GTIDEIQKL

SEQ ID NO: 20284 - protein, 10 aa, Artificial Sequence
  60S ribosomal protein L6 (147-156)
GTILIILTGR

SEQ ID NO: 20285 - protein, 13 aa, Artificial Sequence
  D-3-phosphoglycerate dehydrogenase (49-61)
GTIQVITQGTSLK

SEQ ID NO: 20286 - protein, 9 aa, Artificial Sequence
  Hexokinase-1 (535-543)
GTNFRVLLV

SEQ ID NO: 20287 - protein, 9 aa, Artificial Sequence
  Calponin-3 (207-215)
GTNKVASQK

SEQ ID NO: 20288 - protein, 10 aa, Artificial Sequence
  Tripeptidyl-peptidase 1 (306-315)
GTPNFPALLK

SEQ ID NO: 20289 - protein, 9 aa, Artificial Sequence
  Histone-lysine N-methyltransferase ASH1L (311-319)
GTTAVFINK

SEQ ID NO: 20290 - protein, 9 aa, Artificial Sequence
  L-dopachrome tautomerase (301-309)
GTYEGLLRR

SEQ ID NO: 20291 - protein, 44 aa, Artificial Sequence
  Cytochrome c oxidase subunit 6C (32-75)
GVAALYKFRVADQRKKAYADFYRNYDVMKDFEEMRKAGIFQSVK

SEQ ID NO: 20292 - protein, 15 aa, Artificial Sequence
  Hemicentin-2 (666-680)
GVAPEDAGNYSCQAT

SEQ ID NO: 20293 - protein, 11 aa, Artificial Sequence
  Unconventional myosin-Ib (244-254)
GVDDAANFRTV

SEQ ID NO: 20294 - protein, 16 aa, Artificial Sequence
  Annexin A2 (50-65)
GVDEVTIVNILTNRSN

SEQ ID NO: 20295 - protein, 18 aa, Artificial Sequence
  Annexin A2 (50-67)
GVDEVTIVNILTNRSNAQ

SEQ ID NO: 20296 - protein, 9 aa, Artificial Sequence
  Complement C3 (1424-1432)
GVDRYISKY

SEQ ID NO: 20297 - protein, 9 aa, Artificial Sequence
  Biotinidase (443-451)
GVFDGLHTV

SEQ ID NO: 20298 - protein, 9 aa, Artificial Sequence
  T-cell immunomodulatory protein (25-33)
GVGPVPARA

SEQ ID NO: 20299 - protein, 9 aa, Artificial Sequence
  CD109 antigen (187-195)
GVISKTFQL

SEQ ID NO: 20300 - protein, 9 aa, Artificial Sequence
  Zinc finger CCCH domain-containing protein 14 (68-76)
GVLDKLRSV

SEQ ID NO: 20301 - protein, 11 aa, Artificial Sequence
  Probable E3 ubiquitin-protein ligase HERC1 (3840-3850)
GVLGLNMAPCM

SEQ ID NO: 20302 - protein, 19 aa, Artificial Sequence
  Glia-derived nexin (188-206)
GVLTRLVLVNAVYFKGLWK

SEQ ID NO: 20303 - protein, 8 aa, Artificial Sequence
  Nucleolar RNA helicase 2 (421-428)
GVLVATNV

SEQ ID NO: 20304 - protein, 13 aa, Artificial Sequence
  Neuronal cell adhesion molecule (398-410)
GVPIEIAPDDPSR

SEQ ID NO: 20305 - protein, 14 aa, Artificial Sequence
  Neuronal cell adhesion molecule (398-411)
GVPIEIAPDDPSRK

SEQ ID NO: 20306 - protein, 24 aa, Artificial Sequence
  Heat shock cognate 71 kDa protein (470-493)
GVPQIEVTFDIDANGILNVSAVDK

SEQ ID NO: 20307 - protein, 34 aa, Artificial Sequence
  Apolipoprotein L1 (146-179)
GVQKVHKGTTIANVVSGSLSISSGILTLVGMGLA

SEQ ID NO: 20308 - protein, 9 aa, Artificial Sequence
  Ropporin-1B (131-139)
GVTITKTLK

SEQ ID NO: 20309 - protein, 9 aa, Artificial Sequence
  Alpha-synuclein (47-55)
GVVHGVATV

SEQ ID NO: 20310 - protein, 10 aa, Artificial Sequence
  Melanoma-associated antigen C2 (257-266)
GVYAGREHFV

SEQ ID NO: 20311 - protein, 47 aa, Artificial Sequence
  Protein CDV3 homolog (167-213)
GVYRPPGARLTTTRKTPQGPPEIYSDTQFPSLQSTAKHVESRNRYLK

SEQ ID NO: 20312 - protein, 9 aa, Artificial Sequence
  Procollagen-lysine,2-oxoglutarate 5-dioxygenase 1 (159-167)
GYAPNLSKL

SEQ ID NO: 20313 - protein, 15 aa, Artificial Sequence
  Interferon alpha-inducible protein 6 (116-130)
GYATHKYLDSEEDEE

SEQ ID NO: 20314 - protein, 16 aa, Artificial Sequence
  HLA class I histocompatibility antigen, B-44 alpha chain (136-151)
GYDQDAYDGKDYIALN

SEQ ID NO: 20315 - protein, 9 aa, Artificial Sequence
  Alpha-parvin (305-313)
GYFVPLHSF

SEQ ID NO: 20316 - protein, 10 aa, Artificial Sequence
  Keratin, type II cytoskeletal 3 (100-109)
GYGGGFGGGF

SEQ ID NO: 20317 - protein, 16 aa, Artificial Sequence
  HLA class I histocompatibility antigen, A-2 alpha chain (111-126)
GYHQYAYDGKDYIALK

SEQ ID NO: 20318 - protein, 16 aa, Artificial Sequence
  Laminin subunit gamma-1 (666-681)
GYLDDVTLASARPGPG

SEQ ID NO: 20319 - protein, 11 aa, Artificial Sequence
  Unconventional myosin-XVIIIa (1111-1121)
GYPDHMVFSEF

SEQ ID NO: 20320 - protein, 9 aa, Artificial Sequence
  Heterogeneous nuclear ribonucleoprotein U-like protein 1 (231-239)
GYPLTIEGF

SEQ ID NO: 20321 - protein, 10 aa, Artificial Sequence
  Spectrin beta chain, non-erythrocytic 1 (189-198)
GYPNVNIHNF

SEQ ID NO: 20322 - protein, 9 aa, Artificial Sequence
  FERM domain-containing protein 5 (67-75)
GYSSKFQFF

SEQ ID NO: 20323 - protein, 20 aa, Artificial Sequence
  L-lactate dehydrogenase B chain (247-266)
GYTNWAIGLSVADLIESMLK

SEQ ID NO: 20324 - protein, 20 aa, Artificial Sequence
  L-lactate dehydrogenase A chain (275-294)
GYTSWAIGLSVADLAESIMK

SEQ ID NO: 20325 - protein, 9 aa, Artificial Sequence
  Beta-hexosaminidase subunit alpha (369-377)
GYVVWQEVF

SEQ ID NO: 20326 - protein, 9 aa, Artificial Sequence
  Nestin (55-63)
HADDELAAL

SEQ ID NO: 20327 - protein, 9 aa, Artificial Sequence
  Centrosomal protein C10orf90 (226-234)
HADDKETSF

SEQ ID NO: 20328 - protein, 9 aa, Artificial Sequence
  Sentrin-specific protease 6 (139-147)
HAHAQIPVV

SEQ ID NO: 20329 - protein, 9 aa, Artificial Sequence
  Sodium/potassium/calcium exchanger 1 (212-220)
HAITPRTTV

SEQ ID NO: 20330 - protein, 8 aa, Artificial Sequence
  Growth/differentiation factor 15 (241-248)
HAQIKTSL

SEQ ID NO: 20331 - protein, 9 aa, Artificial Sequence
  Beta-parvin (157-165)
HDLLRPRGW

SEQ ID NO: 20332 - protein, 12 aa, Artificial Sequence
  Kinase D-interacting substrate of 220 kDa (21-32)
HEGPPRAPSGYS

SEQ ID NO: 20333 - protein, 9 aa, Artificial Sequence
  Sex comb on midleg-like protein 2 (691-699)
HEIDGKALF

SEQ ID NO: 20334 - protein, 9 aa, Artificial Sequence
  Aldehyde dehydrogenase family 1 member A3 (41-49)
HESKSGKKF

SEQ ID NO: 20335 - protein, 9 aa, Artificial Sequence
  Echinoderm microtubule-associated protein-like 6 (1842-1850)
HEVPLGKQV

SEQ ID NO: 20336 - protein, 6 aa, Artificial Sequence
  Leucine-rich repeat-containing protein 42 (71-76)
HFIFTY

SEQ ID NO: 20337 - protein, 15 aa, Artificial Sequence
  Laminin subunit gamma-1 (101-115)
HGAAFLTDYNNQADT

SEQ ID NO: 20338 - protein, 16 aa, Artificial Sequence
  Laminin subunit gamma-1 (101-116)
HGAAFLTDYNNQADTT

SEQ ID NO: 20339 - protein, 9 aa, Artificial Sequence
  Fibrocystin-L (1809-1817)
HHSVSVVVG

SEQ ID NO: 20340 - protein, 9 aa, Artificial Sequence
  DIS3-like exonuclease 1 (421-429)
HIADVTHFV

SEQ ID NO: 20341 - protein, 9 aa, Artificial Sequence
  Protein arginine N-methyltransferase 3 (190-198)
HIFKDKVVL

SEQ ID NO: 20342 - protein, 9 aa, Artificial Sequence
  Carbonic anhydrase 14 (176-184)
HILSHLHEV

SEQ ID NO: 20343 - protein, 9 aa, Artificial Sequence
  Coatomer subunit gamma-2 (46-54)
HILTKILYL

SEQ ID NO: 20344 - protein, 9 aa, Artificial Sequence
  Chondroitin sulfate proteoglycan 4 (290-298)
HINAHRLEI

SEQ ID NO: 20345 - protein, 7 aa, Artificial Sequence
  Mediator of RNA polymerase II transcription subunit 23 (178-184)
HINQIGY

SEQ ID NO: 20346 - protein, 24 aa, Artificial Sequence
  Histidine triad nucleotide-binding protein 1 (59-82)
HISQISVAEDDDESLLGHLMIVGK

SEQ ID NO: 20347 - protein, 7 aa, Artificial Sequence
  Thymidylate synthase (256-262)
HIYLNHI

SEQ ID NO: 20348 - protein, 9 aa, Artificial Sequence
  Vesicle-trafficking protein SEC22c (208-216)
HLAEHSLQV

SEQ ID NO: 20349 - protein, 9 aa, Artificial Sequence
  Leucine-rich repeat-containing protein C10orf11 (68-76)
HLAEVTPAL

SEQ ID NO: 20350 - protein, 11 aa, Artificial Sequence
  Cytochrome c oxidase subunit 1 (151-161)
HLAGVSSILGA

SEQ ID NO: 20351 - protein, 9 aa, Artificial Sequence
  Beta-hexosaminidase subunit beta (59-67)
HLAPENFYI

SEQ ID NO: 20352 - protein, 9 aa, Artificial Sequence
  Zinc finger protein 638 (1613-1621)
HLAQALVTV

SEQ ID NO: 20353 - protein, 9 aa, Artificial Sequence
  Receptor-interacting serine/threonine-protein kinase 4 (730-738)
HLATVKLLV

SEQ ID NO: 20354 - protein, 9 aa, Artificial Sequence
  Unconventional myosin-Ic (1017-1025)
HLAVVAPRL

SEQ ID NO: 20355 - protein, 10 aa, Artificial Sequence
  Zinc finger protein 879 (30-39)
HLDSAQRALY

SEQ ID NO: 20356 - protein, 9 aa, Artificial Sequence
  Vacuolar protein sorting-associated protein 13C (1304-1312)
HLDSMNVSL

SEQ ID NO: 20357 - protein, 9 aa, Artificial Sequence
  Membrane-associated transporter protein (324-332)
HLIGWTAFL

SEQ ID NO: 20358 - protein, 8 aa, Artificial Sequence
  Neutral alpha-glucosidase AB (77-84)
HLIHEVTK

SEQ ID NO: 20359 - protein, 9 aa, Artificial Sequence
  Polypeptide N-acetylgalactosaminyltransferase 2 (166-174)
HLIKEIILV

SEQ ID NO: 20360 - protein, 11 aa, Artificial Sequence
  Myomegalin (201-211)
HLLEEPTSMEV

SEQ ID NO: 20361 - protein, 9 aa, Artificial Sequence
  Transmembrane and TPR repeat-containing protein 3 (93-101)
HLLNMIFHA

SEQ ID NO: 20362 - protein, 9 aa, Artificial Sequence
  Gamma-tubulin complex component 5 (435-443)
HLLNTLYKA

SEQ ID NO: 20363 - protein, 9 aa, Artificial Sequence
  RNA-binding protein EWS (499-507)
HLNGHIKQV

SEQ ID NO: 20364 - protein, 9 aa, Artificial Sequence
  Triple functional domain protein (852-860)
HLQAEVKQV

SEQ ID NO: 20365 - protein, 9 aa, Artificial Sequence
  Eukaryotic translation initiation factor 3 subunit C-like protein (594-602)
HLQDNIQHA

SEQ ID NO: 20366 - protein, 17 aa, Artificial Sequence
  Histone H2A.V (60-76)
HLQLAIRGDEELDSLIK

SEQ ID NO: 20367 - protein, 9 aa, Artificial Sequence
  Inhibitor of nuclear factor kappa-B kinase subunit alpha (688-696)
HLSTIIHEA

SEQ ID NO: 20368 - protein, 9 aa, Artificial Sequence
  Protein TANC1 (1149-1157)
HLSTVEFLL

SEQ ID NO: 20369 - protein, 9 aa, Artificial Sequence
  Pre-mRNA-splicing factor ATP-dependent RNA helicase PRP16 (1008-1016)
HLTYLNVYL

SEQ ID NO: 20370 - protein, 10 aa, Artificial Sequence
  ATPase family AAA domain-containing protein 1 (79-88)
HLVDPLNMHV

SEQ ID NO: 20371 - protein, 9 aa, Artificial Sequence
  Dedicator of cytokinesis protein 1 (422-430)
HLVDRTTAV

SEQ ID NO: 20372 - protein, 9 aa, Artificial Sequence
  Putative inactive carbonic anhydrase 5B-like protein (29-37)
HLVHWNAVK

SEQ ID NO: 20373 - protein, 9 aa, Artificial Sequence
  UDP-galactose translocator (109-117)
HLVLFLHEA

SEQ ID NO: 20374 - protein, 9 aa, Artificial Sequence
  Tonsoku-like protein (37-45)
HLYEDLFRA

SEQ ID NO: 20375 - protein, 9 aa, Artificial Sequence
  Alpha/beta hydrolase domain-containing protein 13 (38-46)
HLYGGIILL

SEQ ID NO: 20376 - protein, 9 aa, Artificial Sequence
  Interferon-related developmental regulator 1 (373-381)
HLYNSAAFK

SEQ ID NO: 20377 - protein, 6 aa, Artificial Sequence
  Bax inhibitor 1 (94-99)
HMVTHF

SEQ ID NO: 20378 - protein, 9 aa, Artificial Sequence
  Eukaryotic translation initiation factor 3 subunit C-like protein (433-441)
HNADQPLRV

SEQ ID NO: 20379 - protein, 15 aa, Artificial Sequence
  Tartrate-resistant acid phosphatase type 5 (240-254)
HNLQYLQDENGVGYV

SEQ ID NO: 20380 - protein, 9 aa, Artificial Sequence
  GMP synthase (glutamine-hydrolyzing) (555-563)
HNVNRVVYI

SEQ ID NO: 20381 - protein, 8 aa, Artificial Sequence
  60S ribosomal protein L10 (92-99)
HPFHVIRI

SEQ ID NO: 20382 - protein, 9 aa, Artificial Sequence
  Protein EURL homolog (214-222)
HPHYSREEL

SEQ ID NO: 20383 - protein, 9 aa, Artificial Sequence
  Porphobilinogen deaminase (109-117)
HPKFVGKTL

SEQ ID NO: 20384 - protein, 10 aa, Artificial Sequence
  Transmembrane protein 209 (465-474)
HPKYPDGKTF

SEQ ID NO: 20385 - protein, 9 aa, Artificial Sequence
  WD repeat-containing protein 43 (361-369)
HPNSAVLMV

SEQ ID NO: 20386 - protein, 8 aa, Artificial Sequence
  Angio-associated migratory cell protein (51-58)
HPRAPVLL

SEQ ID NO: 20387 - protein, 8 aa, Artificial Sequence
  Microtubule-associated proteins 1A/1B light chain 3B (27-34)
HPTKIPVI

SEQ ID NO: 20388 - protein, 9 aa, Artificial Sequence
  Uncharacterized protein C18orf8 (244-252)
HPVLPARSI

SEQ ID NO: 20389 - protein, 9 aa, Artificial Sequence
  Melanoma-derived growth regulatory protein (65-73)
HRGQVVYVF

SEQ ID NO: 20390 - protein, 9 aa, Artificial Sequence
  Platelet-derived growth factor D (2-10)
HRLIFVYTL

SEQ ID NO: 20391 - protein, 8 aa, Artificial Sequence
  Serine protease HTRA1 (143-150)
HRPPVIVL

SEQ ID NO: 20392 - protein, 9 aa, Artificial Sequence
  Asparagine synthetase (glutamine-hydrolyzing) (86-94)
HSATPFLKV

SEQ ID NO: 20393 - protein, 8 aa, Artificial Sequence
  Histone deacetylase 1 (68-75)
HSDDYIKF

SEQ ID NO: 20394 - protein, 11 aa, Artificial Sequence
  Histone-lysine N-methyltransferase NSD3 (877-887)
HSDPMFSSYAY

SEQ ID NO: 20395 - protein, 9 aa, Artificial Sequence
  Histone deacetylase 9 (697-705)
HSEHHSLLY

SEQ ID NO: 20396 - protein, 14 aa, Artificial Sequence
  Tubulin alpha-1C chain (209-222)
HSFGGGTGSGFTSL

SEQ ID NO: 20397 - protein, 8 aa, Artificial Sequence
  Neuropilin-2 (415-422)
HSGIALRL

SEQ ID NO: 20398 - protein, 8 aa, Artificial Sequence
  Pre-mRNA-processing factor 19 (391-398)
HSGPITSI

SEQ ID NO: 20399 - protein, 9 aa, Artificial Sequence
  Centrosome-associated protein 350 (1116-1124)
HSISIPTKL

SEQ ID NO: 20400 - protein, 9 aa, Artificial Sequence
  Serine/threonine-protein kinase MRCK alpha (1363-1371)
HSNDHTLSF

SEQ ID NO: 20401 - protein, 9 aa, Artificial Sequence
  Heterogeneous nuclear ribonucleoprotein K (187-195)
HSTDRVVLI

SEQ ID NO: 20402 - protein, 8 aa, Artificial Sequence
  COP9 signalosome complex subunit 6 (130-137)
HTDLPVSV

SEQ ID NO: 20403 - protein, 14 aa, Artificial Sequence
  Sodium/potassium-transporting ATPase subunit alpha-3 (688-701)
HTEIVFARTSPQQK

SEQ ID NO: 20404 - protein, 15 aa, Artificial Sequence
  Sodium/potassium-transporting ATPase subunit alpha-3 (688-702)
HTEIVFARTSPQQKL

SEQ ID NO: 20405 - protein, 14 aa, Artificial Sequence
  Tyrosine-protein phosphatase non-receptor type substrate 1 (453-466)
HTEYASIQTSPQPA

SEQ ID NO: 20406 - protein, 9 aa, Artificial Sequence
  H(+)/Cl(-) exchange transporter 3 (72-80)
HTIDWVREK

SEQ ID NO: 20407 - protein, 11 aa, Artificial Sequence
  Tensin-3 (344-354)
HTQGPVDGSLY

SEQ ID NO: 20408 - protein, 9 aa, Artificial Sequence
  Bifunctional glutamate/proline-tRNA ligase (1093-1101)
HVADFAPEV

SEQ ID NO: 20409 - protein, 12 aa, Artificial Sequence
  Cytochrome c oxidase subunit 6A1, mitochondrial (75-86)
HVNPLPTGYEDE

SEQ ID NO: 20410 - protein, 16 aa, Artificial Sequence
  Beta-2-microglobulin (83-98)
HVTLSQPKIVKWDRDM

SEQ ID NO: 20411 - protein, 6 aa, Artificial Sequence
  GPI transamidase component PIG-T (164-169)
HYFLRY

SEQ ID NO: 20412 - protein, 8 aa, Artificial Sequence
  Vacuolar protein sorting-associated protein 41 homolog (13-20)
HYGKVYLL

SEQ ID NO: 20413 - protein, 8 aa, Artificial Sequence
  Interferon-induced protein with tetratricopeptide repeats 1 (383-390)
HYGRFQEF

SEQ ID NO: 20414 - protein, 9 aa, Artificial Sequence
  Transcription factor SOX-10 (387-395)
HYGSAFPSI

SEQ ID NO: 20415 - protein, 9 aa, Artificial Sequence
  AF4/FMR2 family member 4 (917-925)
HYLQEAKKL

SEQ ID NO: 20416 - protein, 9 aa, Artificial Sequence
  KN motif and ankyrin repeat domain-containing protein 1 (1167-1175)
HYSVSHSNF

SEQ ID NO: 20417 - protein, 9 aa, Artificial Sequence
  L-dopachrome tautomerase (189-197)
HYYSVRDTL

SEQ ID NO: 20418 - protein, 8 aa, Artificial Sequence
  Brefeldin A-inhibited guanine nucleotide-exchange protein 2 (340-347)
IADDRQSL

SEQ ID NO: 20419 - protein, 9 aa, Artificial Sequence
  Tripartite motif-containing protein 44 (270-278)
IADEEQKAL

SEQ ID NO: 20420 - protein, 10 aa, Artificial Sequence
  Serine hydroxymethyltransferase, cytosolic (79-88)
IADENGAYLM

SEQ ID NO: 20421 - protein, 9 aa, Artificial Sequence
  Vitamin K-dependent gamma-carboxylase (475-483)
IADFPGLHL

SEQ ID NO: 20422 - protein, 9 aa, Artificial Sequence
  Chromodomain-helicase-DNA-binding protein 3 (372-380)
IADGGFTEL

SEQ ID NO: 20423 - protein, 8 aa, Artificial Sequence
  Probable dimethyladenosine transferase (116-123)
IADKIQQI

SEQ ID NO: 20424 - protein, 8 aa, Artificial Sequence
  Mitotic checkpoint serine/threonine-protein kinase BUB1 beta (956-963)
IADLAHLL

SEQ ID NO: 20425 - protein, 9 aa, Artificial Sequence
  Gamma-interferon-inducible protein 16 (48-56)
IADLMEEKF

SEQ ID NO: 20426 - protein, 8 aa, Artificial Sequence
  Ras association domain-containing protein 5 (335-342)
IADRPLYL

SEQ ID NO: 20427 - protein, 8 aa, Artificial Sequence
  Dolichyl-diphosphooligosaccharide-proteinosyltransferase subunit 2 (268-275)
IADSHQNF

SEQ ID NO: 20428 - protein, 9 aa, Artificial Sequence
  Consortin (202-210)
IAEDPKVFL

SEQ ID NO: 20429 - protein, 9 aa, Artificial Sequence
  Eukaryotic translation initiation factor 4 gamma 2 (5-13)
IAEGGASRF

SEQ ID NO: 20430 - protein, 9 aa, Artificial Sequence
  Tensin-3 (154-162)
IAFSRPVKY

SEQ ID NO: 20431 - protein, 30 aa, Artificial Sequence
  Flavin reductaseADPH) (6-35)
IAIFGATGQTGLTTLAQAVQAGYEVTVLVR

SEQ ID NO: 20432 - protein, 9 aa, Artificial Sequence
  Ras GTPase-activating-like protein IQGAP2 (219-227)
IAINEAVEK

SEQ ID NO: 20433 - protein, 9 aa, Artificial Sequence
  Ubiquitin carboxyl-terminal hydrolase 15 (259-267)
IAKSYAELI

SEQ ID NO: 20434 - protein, 9 aa, Artificial Sequence
  Prolow-density lipoprotein receptor-related protein 1 (1392-1400)
IALDPRDGI

SEQ ID NO: 20435 - protein, 12 aa, Artificial Sequence
  Transcription factor Sp1 (551-562)
IANAPGDHGAQL

SEQ ID NO: 20436 - protein, 9 aa, Artificial Sequence
  Dolichyl-diphosphooligosaccharide-proteinosyltransferase subunit 2 (220-228)
IANTVELRV

SEQ ID NO: 20437 - protein, 14 aa, Artificial Sequence
  Solute carrier family 2, facilitated glucose transporter member 1 (21-34)
IAQVFGLDSIMGNK

SEQ ID NO: 20438 - protein, 16 aa, Artificial Sequence
  Solute carrier family 2, facilitated glucose transporter member 1 (21-36)
IAQVFGLDSIMGNKDL

SEQ ID NO: 20439 - protein, 8 aa, Artificial Sequence
  60S ribosomal protein L35 (54-61)
IARVLTVI

SEQ ID NO: 20440 - protein, 9 aa, Artificial Sequence
  Alpha-actinin-3 (114-122)
IASKGVKLV

SEQ ID NO: 20441 - protein, 9 aa, Artificial Sequence
  Derlin-2 (50-58)
IAVGHIYFF

SEQ ID NO: 20442 - protein, 7 aa, Artificial Sequence
  Solute carrier family 25 member 35 (138-144)
IAVGHQY

SEQ ID NO: 20443 - protein, 9 aa, Artificial Sequence
  Ectonucleoside triphosphate diphosphohydrolase 4 (279-287)
IAYEVPKTV

SEQ ID NO: 20444 - protein, 9 aa, Artificial Sequence
  DNA topoisomerase 3-beta-1 (521-529)
ICQRNYVTV

SEQ ID NO: 20445 - protein, 10 aa, Artificial Sequence
  Zinc transporter ZIP14 (350-359)
IDGLAIGASF

SEQ ID NO: 20446 - protein, 9 aa, Artificial Sequence
  Nucleolin (454-462)
IDGRSISLY

SEQ ID NO: 20447 - protein, 10 aa, Artificial Sequence
  Nucleolin (454-463)
IDGRSISLYY

SEQ ID NO: 20448 - protein, 7 aa, Artificial Sequence
  Keratin, type II cytoskeletal 1b (179-185)
IDKVRFL

SEQ ID NO: 20449 - protein, 23 aa, Artificial Sequence
  Puromycin-sensitive aminopeptidase (305-327)
IDLIAIADFAAGAMENWGLVTYR

SEQ ID NO: 20450 - protein, 9 aa, Artificial Sequence
  Prelamin-A/C (80-88)
IDNGKQREF

SEQ ID NO: 20451 - protein, 10 aa, Artificial Sequence
  Structural maintenance of chromosomes flexible hinge domain-containing protein 1 (183-192)
IDNGRGMTSK

SEQ ID NO: 20452 - protein, 9 aa, Artificial Sequence
  DNA damage-binding protein 1 (794-802)
IDQHTFEVL

SEQ ID NO: 20453 - protein, 7 aa, Artificial Sequence
  Pre-mRNA-processing-splicing factor 8 (1380-1386)
IDSQRVW

SEQ ID NO: 20454 - protein, 14 aa, Artificial Sequence
  Clathrin heavy chain 1 (1125-1138)
IDSYIKADDPSSYM

SEQ ID NO: 20455 - protein, 15 aa, Artificial Sequence
  Clathrin heavy chain 1 (1125-1139)
IDSYIKADDPSSYME

SEQ ID NO: 20456 - protein, 7 aa, Artificial Sequence
  Talin-1 (292-298)
IEAKVRY

SEQ ID NO: 20457 - protein, 9 aa, Artificial Sequence
  Microtubule-associated protein 4 (17-25)
IEGEIKRDF

SEQ ID NO: 20458 - protein, 9 aa, Artificial Sequence
  Actin, cytoplasmic 2 (71-79)
IEHGIVTNW

SEQ ID NO: 20459 - protein, 6 aa, Artificial Sequence
  Fatty acid desaturase 2 (352-357)
IEHHLF

SEQ ID NO: 20460 - protein, 7 aa, Artificial Sequence
  Programmed cell death protein 5 (93-99)
IEILKKV

SEQ ID NO: 20461 - protein, 9 aa, Artificial Sequence
  DnaJ homolog subfamily C member 7 (216-224)
IEKAVQFFV

SEQ ID NO: 20462 - protein, 7 aa, Artificial Sequence
  Cysteine-rich protein 2-binding protein (156-162)
IEKHWTF

SEQ ID NO: 20463 - protein, 8 aa, Artificial Sequence
  rRNA-processing protein FCF1 homolog (110-117)
IEKLGQKY

SEQ ID NO: 20464 - protein, 10 aa, Artificial Sequence
  Lysosomal-trafficking regulator (3604-3613)
IEMETQIHLY

SEQ ID NO: 20465 - protein, 9 aa, Artificial Sequence
  Cholinesterase (384-392)
IFFPGVSEF

SEQ ID NO: 20466 - protein, 9 aa, Artificial Sequence
  Inositol 1,4,5-trisphosphate receptor type 2 (1770-1778)
IFSEGIFLG

SEQ ID NO: 20467 - protein, 10 aa, Artificial Sequence
  E3 ubiquitin-protein ligase UBR4 (2405-2414)
IGASVDPAGV

SEQ ID NO: 20468 - protein, 9 aa, Artificial Sequence
  Mannose-6-phosphate isomerase (121-129)
IGDEAATHL

SEQ ID NO: 20469 - protein, 9 aa, Artificial Sequence
  Beta-catenin-like protein 1 (430-438)
IGDGRSPEF

SEQ ID NO: 20470 - protein, 9 aa, Artificial Sequence
  Fructose-bisphosphate aldolase A (208-216)
IGEHTPSAL

SEQ ID NO: 20471 - protein, 7 aa, Artificial Sequence
  40S ribosomal protein S29 (50-56)
IGFIKLD

SEQ ID NO: 20472 - protein, 8 aa, Artificial Sequence
  Transmembrane protein 263 (60-67)
IGGKSLEV

SEQ ID NO: 20473 - protein, 10 aa, Artificial Sequence
  RNA-binding Raly-like protein (25-34)
IGNLNTAIVK

SEQ ID NO: 20474 - protein, 10 aa, Artificial Sequence
  RNA-binding protein Raly (25-34)
IGNLNTALVK

SEQ ID NO: 20475 - protein, 15 aa, Artificial Sequence
  Protocadherin Fat 1 (1606-1620)
IGNSFMIDPVLGSIK

SEQ ID NO: 20476 - protein, 15 aa, Artificial Sequence
  Protocadherin Fat 1 (1682-1696)
IGSFVGMVTAHSQSS

SEQ ID NO: 20477 - protein, 8 aa, Artificial Sequence
  Cilia- and flagella-associated protein 20 (17-24)
IGSKPLQI

SEQ ID NO: 20478 - protein, 7 aa, Artificial Sequence
  Retinoblastoma-like protein 1 (197-203)
IGTPRKF

SEQ ID NO: 20479 - protein, 24 aa, Artificial Sequence
  Heterogeneous nuclear ribonucleoprotein U (241-264)
IGWSLTTSGMLLGEEEFSYGYSLK

SEQ ID NO: 20480 - protein, 8 aa, Artificial Sequence
  Zinc finger protein 148 (258-265)
IHPPKLVL

SEQ ID NO: 20481 - protein, 9 aa, Artificial Sequence
  Trifunctional purine biosynthetic protein adenosine-3 (206-214)
IHPSLLPSF

SEQ ID NO: 20482 - protein, 7 aa, Artificial Sequence
  Dedicator of cytokinesis protein 7 (741-747)
IHYVFRL

SEQ ID NO: 20483 - protein, 8 aa, Artificial Sequence
  MICOS complex subunit MIC27 (159-166)
IIAKVTAK

SEQ ID NO: 20484 - protein, 8 aa, Artificial Sequence
  Protein PRRC2C (1659-1666)
IIDDHPEV

SEQ ID NO: 20485 - protein, 9 aa, Artificial Sequence
  26S protease regulatory subunit 4 (115-123)
IIDDNHAIV

SEQ ID NO: 20486 - protein, 8 aa, Artificial Sequence
  Lambda-crystallin homolog (90-97)
IIDDRVIL

SEQ ID NO: 20487 - protein, 9 aa, Artificial Sequence
  RANBP2-like and GRIP domain-containing protein 1 (712-720)
IIDDSDSNL

SEQ ID NO: 20488 - protein, 9 aa, Artificial Sequence
  Niemann-Pick C1 protein (1094-1102)
IIDDTIFNL

SEQ ID NO: 20489 - protein, 9 aa, Artificial Sequence
  Eukaryotic translation initiation factor 3 subunit L (186-194)
IIDEFIYQF

SEQ ID NO: 20490 - protein, 10 aa, Artificial Sequence
  UDP-N-acetylhexosamine pyrophosphorylase (491-500)
IIDENGVHEL

SEQ ID NO: 20491 - protein, 9 aa, Artificial Sequence
  Serine/threonine-protein kinase Kist (152-160)
IIDHIFASK

SEQ ID NO: 20492 - protein, 9 aa, Artificial Sequence
  AP-3 complex subunit mu-2 (190-198)
IIDKSGSTI

SEQ ID NO: 20493 - protein, 9 aa, Artificial Sequence
  Caspase recruitment domain-containing protein 19 (143-151)
IIDRHVSRY

SEQ ID NO: 20494 - protein, 8 aa, Artificial Sequence
  Double-strand-break repair protein rad21 homolog (444-451)
IIEEPSRL

SEQ ID NO: 20495 - protein, 21 aa, Artificial Sequence
  T-complex protein 1 subunit alpha (160-180)
IIGINGDFFANMVVDAVLAIK

SEQ ID NO: 20496 - protein, 9 aa, Artificial Sequence
  Ubiquitin-like modifier-activating enzyme 1 (91-99)
IILGGVKAV

SEQ ID NO: 20497 - protein, 9 aa, Artificial Sequence
  Transportin-1 (757-765)
IINRPNTPK

SEQ ID NO: 20498 - protein, 9 aa, Artificial Sequence
  Far upstream element-binding protein 1 (359-367)
IITDLLRSV

SEQ ID NO: 20499 - protein, 9 aa, Artificial Sequence
  Glycerol-3-phosphate acyltransferase 4 (30-38)
IIVPAIFGV

SEQ ID NO: 20500 - protein, 15 aa, Artificial Sequence
  Syntaxin-7 (70-84)
IKEFGSLPTTPSEQR

SEQ ID NO: 20501 - protein, 16 aa, Artificial Sequence
  Alpha-enolase (26-41)
IKEKYGKDATNVGDEG

SEQ ID NO: 20502 - protein, 7 aa, Artificial Sequence
  26S proteasome non-ATPase regulatory subunit 8 (133-139)
IKHPVSL

SEQ ID NO: 20503 - protein, 11 aa, Artificial Sequence
  Keratin, type II cytoskeletal 1 (184-194)
IKSLNNQFASF

SEQ ID NO: 20504 - protein, 10 aa, Artificial Sequence
  Synaptojanin-1 (895-904)
IKSSLPENNF

SEQ ID NO: 20505 - protein, 23 aa, Artificial Sequence
  Vimentin (444-466)
IKTVETRDGQVINETSQHHDDLE

SEQ ID NO: 20506 - protein, 9 aa, Artificial Sequence
  Talin-1 (862-870)
ILADATAKM

SEQ ID NO: 20507 - protein, 10 aa, Artificial Sequence
  DNA-dependent protein kinase catalytic subunit (544-553)
ILADEAFFSV

SEQ ID NO: 20508 - protein, 10 aa, Artificial Sequence
  Exonuclease 3'-5' domain-containing protein 2 (30-39)
ILADGTILKV

SEQ ID NO: 20509 - protein, 12 aa, Artificial Sequence
  Globoside alpha-1,3-N-acetylgalactosaminyltransferase 1 (266-277)
ILADKANGIMAA

SEQ ID NO: 20510 - protein, 11 aa, Artificial Sequence
  Catenin alpha-1 (140-150)
ILADMADVYKL

SEQ ID NO: 20511 - protein, 9 aa, Artificial Sequence
  Dynactin subunit 3 (87-95)
ILAEEQFIL

SEQ ID NO: 20512 - protein, 9 aa, Artificial Sequence
  Transmembrane protein 87A (234-242)
ILAELLSAV

SEQ ID NO: 20513 - protein, 9 aa, Artificial Sequence
  Serum paraoxonase/arylesterase 2 (239-247)
ILAHEIHVL

SEQ ID NO: 20514 - protein, 9 aa, Artificial Sequence
  Centrosomal protein of 170 kDa protein B (1269-1277)
ILAQEIHDV

SEQ ID NO: 20515 - protein, 9 aa, Artificial Sequence
  Unconventional myosin-XV (2127-2135)
ILAQLANQV

SEQ ID NO: 20516 - protein, 9 aa, Artificial Sequence
  Multidrug resistance-associated protein 1 (560-568)
ILDAQTAFV

SEQ ID NO: 20517 - protein, 9 aa, Artificial Sequence
  Unconventional myosin-Id (455-463)
ILDDACMNV

SEQ ID NO: 20518 - protein, 9 aa, Artificial Sequence
  Acyl-CoA synthetase short-chain family member 3, mitochondrial (486-494)
ILDDNMQKL

SEQ ID NO: 20519 - protein, 9 aa, Artificial Sequence
  FRAS1-related extracellular matrix protein 1 (98-106)
ILDEDTVKL

SEQ ID NO: 20520 - protein, 9 aa, Artificial Sequence
  HEAT repeat-containing protein 1 (1277-1285)
ILDEEKFNV

SEQ ID NO: 20521 - protein, 8 aa, Artificial Sequence
  Hemicentin-1 (2341-2348)
ILDEGHIL

SEQ ID NO: 20522 - protein, 10 aa, Artificial Sequence
  Hemicentin-1 (2341-2350)
ILDEGHILQL

SEQ ID NO: 20523 - protein, 9 aa, Artificial Sequence
  Pleckstrin homology domain-containing family H member 1 (1314-1322)
ILDHNTMQV

SEQ ID NO: 20524 - protein, 9 aa, Artificial Sequence
  Mitochondrial tRNA-specific 2-thiouridylase 1 (63-71)
ILDIPFHQV

SEQ ID NO: 20525 - protein, 9 aa, Artificial Sequence
  Protein GPR107 (122-130)
ILDISRSEV

SEQ ID NO: 20526 - protein, 8 aa, Artificial Sequence
  Heat shock protein HSP 90-beta (496-503)
ILDKKVEK

SEQ ID NO: 20527 - protein, 9 aa, Artificial Sequence
  Anthrax toxin receptor 1 (48-56)
ILDKSGSVL

SEQ ID NO: 20528 - protein, 10 aa, Artificial Sequence
  UDP-glucose 4-epimerase (67-76)
ILDQGALQRL

SEQ ID NO: 20529 - protein, 11 aa, Artificial Sequence
  Pleckstrin homology-like domain family B member 1 (850-860)
ILDSQAGQIRA

SEQ ID NO: 20530 - protein, 9 aa, Artificial Sequence
  Chromobox protein homolog 6 (48-56)
ILDSRLIAA

SEQ ID NO: 20531 - protein, 10 aa, Artificial Sequence
  Voltage-dependent calcium channel subunit alpha-2/delta-2 (731-740)
ILDTGITQQL

SEQ ID NO: 20532 - protein, 9 aa, Artificial Sequence
  Kinesin-like protein KIF1B (1497-1505)
ILDTSVAYV

SEQ ID NO: 20533 - protein, 9 aa, Artificial Sequence
  CAP-Gly domain-containing linker protein 4 (12-20)
ILFDPKTSV

SEQ ID NO: 20534 - protein, 9 aa, Artificial Sequence
  ATP-binding cassette sub-family A member 13 (826-834)
ILFEINPKL

SEQ ID NO: 20535 - protein, 9 aa, Artificial Sequence
  Carbonic anhydrase-related protein (233-241)
ILFRYPLTI

SEQ ID NO: 20536 - protein, 9 aa, Artificial Sequence
  Tribbles homolog 1 (150-158)
ILGETKAYV

SEQ ID NO: 20537 - protein, 9 aa, Artificial Sequence
  KH domain-containing, RNA-binding, signal transduction-associated protein 1 (176-184)
ILGPQGNTI

SEQ ID NO: 20538 - protein, 8 aa, Artificial Sequence
  Epidermal growth factor receptor substrate 15 (164-171)
ILGRVWEL

SEQ ID NO: 20539 - protein, 8 aa, Artificial Sequence
  Lecithin retinol acyltransferase (98-105)
ILGVIVKV

SEQ ID NO: 20540 - protein, 37 aa, Artificial Sequence
  Glyceraldehyde-3-phosphate dehydrogenase (273-309)
ILGYTEHQVVSSDFNSDTHSSTFDAGAGIALNDHFVK

SEQ ID NO: 20541 - protein, 8 aa, Artificial Sequence
  Sperm-associated antigen 7 (80-87)
ILHDVVEV

SEQ ID NO: 20542 - protein, 12 aa, Artificial Sequence
  Lysosomal-trafficking regulator (1804-1815)
ILHEIGGTGIFV

SEQ ID NO: 20543 - protein, 9 aa, Artificial Sequence
  Coiled-coil domain-containing protein 93 (480-488)
ILHRKIDEV

SEQ ID NO: 20544 - protein, 9 aa, Artificial Sequence
  S1 RNA-binding domain-containing protein 1 (186-194)
ILHTDVVYL

SEQ ID NO: 20545 - protein, 9 aa, Artificial Sequence
  Prolow-density lipoprotein receptor-related protein 1 (408-416)
ILIEHLYGL

SEQ ID NO: 20546 - protein, 9 aa, Artificial Sequence
  Tissue-type plasminogen activator (243-251)
ILIGKVYTA

SEQ ID NO: 20547 - protein, 19 aa, Artificial Sequence
  ATP-citrate synthase (337-355)
ILIIGGSIANFTNVAATFK

SEQ ID NO: 20548 - protein, 9 aa, Artificial Sequence
  Laminin subunit beta-1 (612-620)
ILIRYEPQL

SEQ ID NO: 20549 - protein, 9 aa, Artificial Sequence
  Receptor-interacting serine/threonine-protein kinase 4 (149-157)
ILLDAHYHV

SEQ ID NO: 20550 - protein, 10 aa, Artificial Sequence
  CD109 antigen (864-873)
ILLDLTDNRL

SEQ ID NO: 20551 - protein, 9 aa, Artificial Sequence
  Lon protease homolog 2, peroxisomal (293-301)
ILLDNDHYA

SEQ ID NO: 20552 - protein, 9 aa, Artificial Sequence
  Zinc finger protein basonuclin-1 (109-117)
ILLDRLFSV

SEQ ID NO: 20553 - protein, 9 aa, Artificial Sequence
  COP9 signalosome complex subunit 3 (213-221)
ILLGKVQQL

SEQ ID NO: 20554 - protein, 10 aa, Artificial Sequence
  T-lymphoma invasion and metastasis-inducing protein 1 (425-434)
ILLTAAQGTV

SEQ ID NO: 20555 - protein, 9 aa, Artificial Sequence
  Transcription factor IIIB 90 kDa subunit (434-442)
ILNESEARV

SEQ ID NO: 20556 - protein, 10 aa, Artificial Sequence
  G-protein coupled receptor 143 (297-306)
ILNPAQGFLL

SEQ ID NO: 20557 - protein, 9 aa, Artificial Sequence
  Adipocyte enhancer-binding protein 1 (945-953)
ILNPGEYRV

SEQ ID NO: 20558 - protein, 9 aa, Artificial Sequence
  Kinesin-like protein KIF13B (36-44)
ILNPVNTNL

SEQ ID NO: 20559 - protein, 9 aa, Artificial Sequence
  Lysine-specific demethylase 5B (178-186)
ILNPYNLFL

SEQ ID NO: 20560 - protein, 9 aa, Artificial Sequence
  Importin-7 (833-841)
ILPAFILLF

SEQ ID NO: 20561 - protein, 11 aa, Artificial Sequence
  Lysosome-associated membraneoprotein 1 (248-258)
ILPDARDPAFK

SEQ ID NO: 20562 - protein, 11 aa, Artificial Sequence
  Peroxisome biogenesis factor 1 (908-918)
ILPDESKFNMY

SEQ ID NO: 20563 - protein, 9 aa, Artificial Sequence
  E3 ubiquitin-protein ligase CBL-B (77-85)
ILPDTYQHL

SEQ ID NO: 20564 - protein, 9 aa, Artificial Sequence
  Estradiol 17-beta-dehydrogenase 11 (272-280)
ILPERFLAV

SEQ ID NO: 20565 - protein, 9 aa, Artificial Sequence
  E1A-binding protein p400 (1032-1040)
ILPKGSARV

SEQ ID NO: 20566 - protein, 9 aa, Artificial Sequence
  LINE-1 retrotransposable element ORF2 protein (817-825)
ILPKVIYRF

SEQ ID NO: 20567 - protein, 9 aa, Artificial Sequence
  Aryl hydrocarbon receptor (23-31)
ILPPQLALF

SEQ ID NO: 20568 - protein, 9 aa, Artificial Sequence
  Zinc finger and SCAN domain-containing protein 25 (93-101)
ILPREFYAW

SEQ ID NO: 20569 - protein, 9 aa, Artificial Sequence
  DDB1- and CUL4-associated factor 4 (318-326)
ILQDEQYLM

SEQ ID NO: 20570 - protein, 9 aa, Artificial Sequence
  Zinc finger protein RFP (330-338)
ILSDNLRQV

SEQ ID NO: 20571 - protein, 9 aa, Artificial Sequence
  AP2-associated protein kinase 1 (635-643)
ILSDVTHSA

SEQ ID NO: 20572 - protein, 9 aa, Artificial Sequence
  Ras GTPase-activating protein 1 (674-682)
ILSELVEKI

SEQ ID NO: 20573 - protein, 9 aa, Artificial Sequence
  Mediator of RNA polymerase II transcription subunit 13 (1076-1084)
ILSESVMNL

SEQ ID NO: 20574 - protein, 9 aa, Artificial Sequence
  Endoplasmic reticulum metallopeptidase 1 (340-348)
ILTDSIQRA

SEQ ID NO: 20575 - protein, 9 aa, Artificial Sequence
  Ankyrin repeat domain-containing protein 17 (886-894)
ILTETQQGL

SEQ ID NO: 20576 - protein, 9 aa, Artificial Sequence
  Notchless protein homolog 1 (240-248)
ILTGHTQSV

SEQ ID NO: 20577 - protein, 8 aa, Artificial Sequence
  InaD-like protein (50-57)
ILTLQQSI

SEQ ID NO: 20578 - protein, 9 aa, Artificial Sequence
  Fibrous sheath-interacting protein 2 (3738-3746)
ILTNNLQLS

SEQ ID NO: 20579 - protein, 9 aa, Artificial Sequence
  Midasin (1057-1065)
ILTSSVKLN

SEQ ID NO: 20580 - protein, 9 aa, Artificial Sequence
  Spatacsin (642-650)
ILTSYINEL

SEQ ID NO: 20581 - protein, 9 aa, Artificial Sequence
  Eukaryotic translation initiation factor 2-alpha kinase 4 (377-385)
ILVEHISGV

SEQ ID NO: 20582 - protein, 9 aa, Artificial Sequence
  Plexin-B2 (432-440)
ILVEINKRV

SEQ ID NO: 20583 - protein, 9 aa, Artificial Sequence
  Heat shock factor protein 4 (167-175)
ILWREVVTL

SEQ ID NO: 20584 - protein, 9 aa, Artificial Sequence
  1-phosphatidylinositol 4,5-bisphosphate phosphodiesterase gamma-1 (109-117)
ILYGMEFRL

SEQ ID NO: 20585 - protein, 10 aa, Artificial Sequence
  116 kDa U5 small nuclear ribonucleoprotein component (202-211)
IMDTPGHVNF

SEQ ID NO: 20586 - protein, 9 aa, Artificial Sequence
  Eukaryotic translation initiation factor 4 gamma 3 (915-923)
IMHDCVVKL

SEQ ID NO: 20587 - protein, 10 aa, Artificial Sequence
  Syntenin-1 (269-278)
IMPAFIFEHI

SEQ ID NO: 20588 - protein, 9 aa, Artificial Sequence
  CLIP-associating protein 1 (410-418)
IMPTIFNLI

SEQ ID NO: 20589 - protein, 10 aa, Artificial Sequence
  Hexokinase-2 (118-127)
IMRGSGTQLF

SEQ ID NO: 20590 - protein, 12 aa, Artificial Sequence
  Protein ERGIC-53 (496-507)
IMYRSQQEAAAK

SEQ ID NO: 20591 - protein, 22 aa, Artificial Sequence
  T-complex protein 1 subunit eta (413-434)
INALTAASEAACLIVSVDETIK

SEQ ID NO: 20592 - protein, 12 aa, Artificial Sequence
  Vimentin (455-466)
INETSQHHDDLE

SEQ ID NO: 20593 - protein, 8 aa, Artificial Sequence
  DNA-dependent protein kinase catalytic subunit (866-873)
INKNLLTV

SEQ ID NO: 20594 - protein, 7 aa, Artificial Sequence
  Deoxynucleotidyltransferase terminal-interacting protein 2 (255-261)
INKPNFY

SEQ ID NO: 20595 - protein, 11 aa, Artificial Sequence
  Pleckstrin homology domain-containing family H member 1 (922-932)
INVPVEAASVD

SEQ ID NO: 20596 - protein, 8 aa, Artificial Sequence
  Sodium/potassium-transporting ATPase subunit alpha-1 (2-9)
IPADLRII

SEQ ID NO: 20597 - protein, 10 aa, Artificial Sequence
  Far upstream element-binding protein 1 (213-222)
IPASKAGLVI

SEQ ID NO: 20598 - protein, 10 aa, Artificial Sequence
  Collagen alpha-1(XV) chain (185-194)
IPFQRSSQAL

SEQ ID NO: 20599 - protein, 15 aa, Artificial Sequence
  Leucine-rich repeat-containing G-protein coupled receptor 6 (62-76)
IPGQAFSGLYSLKIL

SEQ ID NO: 20600 - protein, 9 aa, Artificial Sequence
  Low-density lipoprotein receptor-related protein 2 (601-609)
IPHPFGVSL

SEQ ID NO: 20601 - protein, 8 aa, Artificial Sequence
  BCL-6 corepressor (730-737)
IPHTPIEI

SEQ ID NO: 20602 - protein, 9 aa, Artificial Sequence
  Chondroitin sulfate proteoglycan 4 (108-116)
IPHTVVLTV

SEQ ID NO: 20603 - protein, 9 aa, Artificial Sequence
  C-syn protooncogene  (266-274)
IPRESLQLI

SEQ ID NO: 20604 - protein, 9 aa, Artificial Sequence
  Interferon-induced transmembrane protein 10 (62-70)
IPRPPAGSP

SEQ ID NO: 20605 - protein, 9 aa, Artificial Sequence
  Basement membrane-specific heparan sulfate proteoglycan core protein (447-455)
IPSHPRVTV

SEQ ID NO: 20606 - protein, 15 aa, Artificial Sequence
  E3 ubiquitin-protein ligase RNF13 (145-159)
IPSVFIGESSANSLK

SEQ ID NO: 20607 - protein, 9 aa, Artificial Sequence
  Sorbin and SH3 domain-containing protein 2 (262-270)
IPTAIRTTV

SEQ ID NO: 20608 - protein, 9 aa, Artificial Sequence
  Procollagen-lysine,2-oxoglutarate 5-dioxygenase 2 (34-42)
IPTDKLLVI

SEQ ID NO: 20609 - protein, 9 aa, Artificial Sequence
  Rap1 GTPase-activating protein 1 (28-36)
IPYPSVHEV

SEQ ID NO: 20610 - protein, 9 aa, Artificial Sequence
  Spectrin beta chain, non-erythrocytic 1 (579-587)
IQAERVRGV

SEQ ID NO: 20611 - protein, 8 aa, Artificial Sequence
  N6-adenosine-methyltransferase 70 kDa subunit (8-15)
IQAHKKQL

SEQ ID NO: 20612 - protein, 10 aa, Artificial Sequence
  Potassium/sodium hyperpolarization-activated cyclic nucleotide-gated channel 4 (778-787)
IQAPLQAAAA

SEQ ID NO: 20613 - protein, 9 aa, Artificial Sequence
  CCAAT/enhancer-binding protein zeta (255-263)
IQDDAVHTL

SEQ ID NO: 20614 - protein, 14 aa, Artificial Sequence
  Beta-2-microglobulin (21-34)
IQRTPKIQVYSRHP

SEQ ID NO: 20615 - protein, 15 aa, Artificial Sequence
  Beta-2-microglobulin (21-35)
IQRTPKIQVYSRHPA

SEQ ID NO: 20616 - protein, 17 aa, Artificial Sequence
  Beta-2-microglobulin (21-37)
IQRTPKIQVYSRHPAEN

SEQ ID NO: 20617 - protein, 18 aa, Artificial Sequence
  Beta-2-microglobulin (21-38)
IQRTPKIQVYSRHPAENG

SEQ ID NO: 20618 - protein, 19 aa, Artificial Sequence
  Beta-2-microglobulin (21-39)
IQRTPKIQVYSRHPAENGK

SEQ ID NO: 20619 - protein, 20 aa, Artificial Sequence
  Beta-2-microglobulin (1-20)
IQRTPKIQVYSRHPAENGKS

SEQ ID NO: 20620 - protein, 21 aa, Artificial Sequence
  Beta-2-microglobulin (1-21)
IQRTPKIQVYSRHPAENGKSN

SEQ ID NO: 20621 - protein, 23 aa, Artificial Sequence
  Beta-2-microglobulin (21-43)
IQRTPKIQVYSRHPAENGKSNFL

SEQ ID NO: 20622 - protein, 24 aa, Artificial Sequence
  Beta-2-microglobulin (21-44)
IQRTPKIQVYSRHPAENGKSNFLN

SEQ ID NO: 20623 - protein, 9 aa, Artificial Sequence
  Hemicentin-1 (876-884)
IQSETTVTV

SEQ ID NO: 20624 - protein, 11 aa, Artificial Sequence
  Glia-derived nexin (392-402)
IRHNPTGAVLF

SEQ ID NO: 20625 - protein, 9 aa, Artificial Sequence
  Protein wntless homolog (302-310)
IRQGIFYAM

SEQ ID NO: 20626 - protein, 7 aa, Artificial Sequence
  Synembryn-B (156-162)
IRSQLRY

SEQ ID NO: 20627 - protein, 9 aa, Artificial Sequence
  Clathrin heavy chain 1 (170-178)
ISAQQNRVV

SEQ ID NO: 20628 - protein, 8 aa, Artificial Sequence
  HLA class I histocompatibility antigen, B-44 alpha chain (218-225)
ISDHEVTL

SEQ ID NO: 20629 - protein, 9 aa, Artificial Sequence
  Integrin-alpha FG-GAP repeat-containing protein 2 (132-140)
ISDIGGHAY

SEQ ID NO: 20630 - protein, 8 aa, Artificial Sequence
  Protein arginine N-methyltransferase 1 (112-119)
ISDYAVKI

SEQ ID NO: 20631 - protein, 9 aa, Artificial Sequence
  Membrane-associated transporter protein (237-245)
ISEAPLTEV

SEQ ID NO: 20632 - protein, 8 aa, Artificial Sequence
  26S proteasome non-ATPase regulatory subunit 13 (64-71)
ISEFEHRV

SEQ ID NO: 20633 - protein, 7 aa, Artificial Sequence
  Cleft lip and palate transmembrane protein 1 (109-115)
ISEHEHF

SEQ ID NO: 20634 - protein, 9 aa, Artificial Sequence
  Zinc finger protein ZFPM2 (861-869)
ISFNKVENY

SEQ ID NO: 20635 - protein, 10 aa, Artificial Sequence
  Neprilysin (536-545)
ISGAAVVNAF

SEQ ID NO: 20636 - protein, 11 aa, Artificial Sequence
  Annexin A2 (214-224)
ISIMTERSVPH

SEQ ID NO: 20637 - protein, 9 aa, Artificial Sequence
  Integrin alpha-6 (516-524)
ISIVGTLEA

SEQ ID NO: 20638 - protein, 9 aa, Artificial Sequence
  Transcription factor SOX-10 (334-342)
ISKPPGVAL

SEQ ID NO: 20639 - protein, 8 aa, Artificial Sequence
  Serine-protein kinase ATM (1999-2006)
ISLQDLLL

SEQ ID NO: 20640 - protein, 15 aa, Artificial Sequence
  Glia-derived nexin (263-277)
ISMLIALPTESSTPL

SEQ ID NO: 20641 - protein, 9 aa, Artificial Sequence
  Unconventional myosin-XVIIIa (62-70)
ISNPIPIKV

SEQ ID NO: 20642 - protein, 9 aa, Artificial Sequence
  Interferon regulatory factor 3 (68-76)
ISNSHPLSL

SEQ ID NO: 20643 - protein, 9 aa, Artificial Sequence
  Poly (ADP-ribose) polymerase 14 (310-318)
ISPGRYFLL

SEQ ID NO: 20644 - protein, 16 aa, Artificial Sequence
  Disintegrin and metalloproteinase domain-containing protein 10 (189-204)
ISSHVKAIDTIYQTTD

SEQ ID NO: 20645 - protein, 10 aa, Artificial Sequence
  Dolichyl-diphosphooligosaccharide-proteinosyltransferase subunit 2 (230-239)
ISTEVGITNV

SEQ ID NO: 20646 - protein, 9 aa, Artificial Sequence
  Peroxisome biogenesis factor 1 (593-601)
ISTREKLVL

SEQ ID NO: 20647 - protein, 9 aa, Artificial Sequence
  Hemicentin-1 (2-10)
ISWEVVHTV

SEQ ID NO: 20648 - protein, 9 aa, Artificial Sequence
  UDP-N-acetylhexosamine pyrophosphorylase (463-471)
ITADVNHNL

SEQ ID NO: 20649 - protein, 11 aa, Artificial Sequence
  Endoplasmin (418-428)
ITDDFHDMMPK

SEQ ID NO: 20650 - protein, 9 aa, Artificial Sequence
  Maltase-glucoamylase (141-149)
ITDFNNIRY

SEQ ID NO: 20651 - protein, 7 aa, Artificial Sequence
  Hemicentin-1 (2935-2941)
ITDIGRY

SEQ ID NO: 20652 - protein, 8 aa, Artificial Sequence
  Ral GTPase-activating protein subunit beta (1463-1470)
ITDIVNKY

SEQ ID NO: 20653 - protein, 8 aa, Artificial Sequence
  Myosin-9 (315-322)
ITDLEERL

SEQ ID NO: 20654 - protein, 9 aa, Artificial Sequence
  Protein piccolo (883-891)
ITDLQKEFY

SEQ ID NO: 20655 - protein, 10 aa, Artificial Sequence
  Titin (15513-15522)
ITGLTENQEY

SEQ ID NO: 20656 - protein, 9 aa, Artificial Sequence
  Leucine-rich repeat-containing protein 34 (306-314)
ITHDGMVYL

SEQ ID NO: 20657 - protein, 8 aa, Artificial Sequence
  Titin (14574-14581)
ITKDSVTL

SEQ ID NO: 20658 - protein, 7 aa, Artificial Sequence
  Elongation factor 2 (165-171)
ITKGVQY

SEQ ID NO: 20659 - protein, 9 aa, Artificial Sequence
  CLIP-associating protein 1 (390-398)
ITLGHLSSV

SEQ ID NO: 20660 - protein, 9 aa, Artificial Sequence
  Armadillo repeat-containing X-linked protein 2 (498-506)
ITNDYQHLL

SEQ ID NO: 20661 - protein, 10 aa, Artificial Sequence
  Titin (16885-16894)
ITNLTQGEEY

SEQ ID NO: 20662 - protein, 9 aa, Artificial Sequence
  Heat shock 70 kDa protein 1-like (299-307)
ITRARFEEL

SEQ ID NO: 20663 - protein, 20 aa, Artificial Sequence
  L-lactate dehydrogenase A chain (23-42)
ITVVGVGAVGMACAISILMK

SEQ ID NO: 20664 - protein, 20 aa, Artificial Sequence
  L-lactate dehydrogenase B chain (24-43)
ITVVGVGQVGMACAISILGK

SEQ ID NO: 20665 - protein, 9 aa, Artificial Sequence
  G protein-coupled receptor kinase 4 (6-14)
IVANSLLLK

SEQ ID NO: 20666 - protein, 9 aa, Artificial Sequence
  G protein-coupled receptor kinase 6 (6-14)
IVANTVLLK

SEQ ID NO: 20667 - protein, 9 aa, Artificial Sequence
  T-cell surfaceoprotein CD8 beta chain (211-219)
IVCLKISGF

SEQ ID NO: 20668 - protein, 9 aa, Artificial Sequence
  Sorting nexin-13 (161-169)
IVDDFGTHL

SEQ ID NO: 20669 - protein, 9 aa, Artificial Sequence
  Tripartite motif-containing protein 2 (200-208)
IVDDIHSTF

SEQ ID NO: 20670 - protein, 9 aa, Artificial Sequence
  Fibronectin isoform 7 (519-527)
IVDDITYNV

SEQ ID NO: 20671 - protein, 9 aa, Artificial Sequence
  U3 small nucleolar ribonucleoprotein protein MPP10 (190-198)
IVDDKFFKL

SEQ ID NO: 20672 - protein, 8 aa, Artificial Sequence
  Alpha-actinin-1 (115-122)
IVDGNVKM

SEQ ID NO: 20673 - protein, 10 aa, Artificial Sequence
  Methylcrotonoyl-CoA carboxylase beta chain, mitochondrial (300-309)
IVDGSRFTEF

SEQ ID NO: 20674 - protein, 9 aa, Artificial Sequence
  Proteasome inhibitor PI31 subunit (209-217)
IVDPLRSGF

SEQ ID NO: 20675 - protein, 9 aa, Artificial Sequence
  Neutral amino acid transporter A (156-164)
IVDRTTTVV

SEQ ID NO: 20676 - protein, 9 aa, Artificial Sequence
  HMG domain-containing protein 3 (1356-1364)
IVDSKPNGV

SEQ ID NO: 20677 - protein, 9 aa, Artificial Sequence
  Synemin (748-756)
IVEEPVSYV

SEQ ID NO: 20678 - protein, 11 aa, Artificial Sequence
  Glia-derived nexin (63-73)
IVISPHGIASV

SEQ ID NO: 20679 - protein, 12 aa, Artificial Sequence
  Sterol regulatory element-binding protein 2 (1129-1140)
IVKLGGGTAIAA

SEQ ID NO: 20680 - protein, 17 aa, Artificial Sequence
  Melanoma-associated antigen 4 (205-221)
IVLGTIAMEGDSASEEE

SEQ ID NO: 20681 - protein, 9 aa, Artificial Sequence
  Elongator complex protein 4 (107-115)
IVNGHTLLV

SEQ ID NO: 20682 - protein, 10 aa, Artificial Sequence
  Rho guanine nucleotide exchange factor 2 (500-509)
IVRDIANQEK

SEQ ID NO: 20683 - protein, 9 aa, Artificial Sequence
  Cytoplasmic dynein 1 heavy chain 1 (1043-1051)
IVSEVEQYV

SEQ ID NO: 20684 - protein, 14 aa, Artificial Sequence
  Glia-derived nexin (119-132)
IVTVANAVFVKNAS

SEQ ID NO: 20685 - protein, 10 aa, Artificial Sequence
  Neuropilin-2 (58-67)
IVYAPEPNQK

SEQ ID NO: 20686 - protein, 9 aa, Artificial Sequence
  Mitochondrial calcium uniporter regulator 1 (3-11)
IVYKDMVTK

SEQ ID NO: 20687 - protein, 9 aa, Artificial Sequence
  Transmembrane emp24 domain-containing protein 5 (5-13)
IWLPFPVLL

SEQ ID NO: 20688 - protein, 9 aa, Artificial Sequence
  Unconventional myosin-Va (407-415)
IYAKLFNWI

SEQ ID NO: 20689 - protein, 9 aa, Artificial Sequence
  Alpha-soluble NSF attachment protein (44-52)
IYARAANMF

SEQ ID NO: 20690 - protein, 9 aa, Artificial Sequence
  DNA polymerase delta subunit 2 (88-96)
IYATRLIQM

SEQ ID NO: 20691 - protein, 8 aa, Artificial Sequence
  39S ribosomal protein L20, mitochondrial (107-114)
IYEPKTFK

SEQ ID NO: 20692 - protein, 9 aa, Artificial Sequence
  V-type proton ATPase 116 kDa subunit a isoform 1 (560-568)
IYFKKPLNI

SEQ ID NO: 20693 - protein, 11 aa, Artificial Sequence
  Antizyme inhibitor 1 (258-268)
IYFPEGSGVKI

SEQ ID NO: 20694 - protein, 10 aa, Artificial Sequence
  Protein disulfide-isomerase A3 (453-462)
IYFSPANKKL

SEQ ID NO: 20695 - protein, 8 aa, Artificial Sequence
  Zinc finger protein 382 (116-123)
IYGKTFTL

SEQ ID NO: 20696 - protein, 9 aa, Artificial Sequence
  Protein kinase C and casein kinase substrate in neurons protein 2 (266-274)
IYHDLEQSI

SEQ ID NO: 20697 - protein, 9 aa, Artificial Sequence
  Ubiquitin-conjugating enzyme E2 N (75-83)
IYHPNVDKL

SEQ ID NO: 20698 - protein, 9 aa, Artificial Sequence
  Diacylglycerol kinase zeta (748-756)
IYILDPELL

SEQ ID NO: 20699 - protein, 9 aa, Artificial Sequence
  Lysosomal protective protein (183-191)
IYIPTLAVL

SEQ ID NO: 20700 - protein, 9 aa, Artificial Sequence
  Protein unc-119 homolog A (83-91)
IYKIDFVRF

SEQ ID NO: 20701 - protein, 10 aa, Artificial Sequence
  Alpha-2-macroglobulin (162-171)
IYKPGQTVKF

SEQ ID NO: 20702 - protein, 9 aa, Artificial Sequence
  Tubby-related protein 4 (640-648)
IYLPEVRKI

SEQ ID NO: 20703 - protein, 9 aa, Artificial Sequence
  Alpha-adducin (165-173)
IYNHITTRV

SEQ ID NO: 20704 - protein, 9 aa, Artificial Sequence
  Sprouty-related, EVH1 domain-containing protein 1 (81-89)
IYNKVTPTF

SEQ ID NO: 20705 - protein, 9 aa, Artificial Sequence
  Serine-protein kinase ATM (1147-1155)
IYNRKSVLL

SEQ ID NO: 20706 - protein, 9 aa, Artificial Sequence
  Spermine synthase (46-54)
IYPHGLVLL

SEQ ID NO: 20707 - protein, 9 aa, Artificial Sequence
  E3 ubiquitin-protein ligase RNF213 (3834-3842)
IYPQVLHSL

SEQ ID NO: 20708 - protein, 10 aa, Artificial Sequence
  Nuclear fragile X mental retardation-interacting protein 2 (473-482)
IYPSNMQTML

SEQ ID NO: 20709 - protein, 9 aa, Artificial Sequence
  Zinc finger protein castor homolog 1 (463-471)
IYQKYIARF

SEQ ID NO: 20710 - protein, 9 aa, Artificial Sequence
  Renin receptor (327-335)
IYRMTNQKI

SEQ ID NO: 20711 - protein, 9 aa, Artificial Sequence
  Pericentriolar material 1 protein (1385-1393)
IYSEVATLI

SEQ ID NO: 20712 - protein, 11 aa, Artificial Sequence
  Perilipin-2 (353-363)
IYSVFRNAASF

SEQ ID NO: 20713 - protein, 9 aa, Artificial Sequence
  Poly (ADP-ribose) polymerase 14 (1584-1592)
IYTHGNHSL

SEQ ID NO: 20714 - protein, 9 aa, Artificial Sequence
  Transmembraneoprotein NMB (174-182)
IYVFHTLGW

SEQ ID NO: 20715 - protein, 9 aa, Artificial Sequence
  Protein-methionine sulfoxide oxidase MICAL3 (1990-1998)
IYVPHALAF

SEQ ID NO: 20716 - protein, 9 aa, Artificial Sequence
  Clathrin heavy chain 1 (1130-1138)
KADDPSSYM

SEQ ID NO: 20717 - protein, 11 aa, Artificial Sequence
  L-dopachrome tautomerase (356-366)
KADGTLDSQVM

SEQ ID NO: 20718 - protein, 9 aa, Artificial Sequence
  Activating signal cointegrator 1 complex subunit 2 (32-40)
KADRYFVLY

SEQ ID NO: 20719 - protein, 9 aa, Artificial Sequence
  Lupus La protein (148-156)
KAFKGSIFV

SEQ ID NO: 20720 - protein, 9 aa, Artificial Sequence
  Neuronal PAS domain-containing protein 3 (509-517)
KAGEDGFGA

SEQ ID NO: 20721 - protein, 9 aa, Artificial Sequence
  Filamin-A (2252-2260)
KAGNNMLLV

SEQ ID NO: 20722 - protein, 9 aa, Artificial Sequence
  Alpha-soluble NSF attachment protein (180-188)
KAIDIYEQV

SEQ ID NO: 20723 - protein, 9 aa, Artificial Sequence
  Phosphorylase b kinase regulatory subunit beta (81-89)
KAKIQDSLY

SEQ ID NO: 20724 - protein, 11 aa, Artificial Sequence
  Vacuolar protein sorting-associated protein 13A (1058-1068)
KALVGGAVGGL

SEQ ID NO: 20725 - protein, 11 aa, Artificial Sequence
  Zinc finger homeobox protein 3 (2172-2182)
KANEVLGLAAQ

SEQ ID NO: 20726 - protein, 18 aa, Artificial Sequence
  Bifunctional glutamate/proline-tRNA ligase (778-795)
KAPKEDVDAAVKQLLSLK

SEQ ID NO: 20727 - protein, 9 aa, Artificial Sequence
  Treacle protein (215-223)
KASEKILQV

SEQ ID NO: 20728 - protein, 10 aa, Artificial Sequence
  Cytoplasmic dynein 1 heavy chain 1 (1729-1738)
KATSIDPNTY

SEQ ID NO: 20729 - protein, 9 aa, Artificial Sequence
  Tubulin alpha-1A chain (171-179)
KAYHEQLSV

SEQ ID NO: 20730 - protein, 10 aa, Artificial Sequence
  UDP-N-acetylhexosamine pyrophosphorylase-like protein 1 (151-160)
KAYPEEPVGV

SEQ ID NO: 20731 - protein, 25 aa, Artificial Sequence
  Beta-2-microglobulin (74-98)
KDEYACRVNHVTLSQPKIVKWDRDM

SEQ ID NO: 20732 - protein, 15 aa, Artificial Sequence
  Glia-derived nexin (117-131)
KDIVTVANAVFVKNA

SEQ ID NO: 20733 - protein, 16 aa, Artificial Sequence
  Glia-derived nexin (117-132)
KDIVTVANAVFVKNAS

SEQ ID NO: 20734 - protein, 9 aa, Artificial Sequence
  Serine-protein kinase ATM (129-137)
KDSSNGAIY

SEQ ID NO: 20735 - protein, 9 aa, Artificial Sequence
  E3 ubiquitin-protein ligase RNF213 (4774-4782)
KEAELRLVK

SEQ ID NO: 20736 - protein, 9 aa, Artificial Sequence
  Neuron navigator 2 (1035-1043)
KEDSRPHLF

SEQ ID NO: 20737 - protein, 10 aa, Artificial Sequence
  Multidrug resistance-associated protein 7 (836-845)
KEGAVALHVY

SEQ ID NO: 20738 - protein, 10 aa, Artificial Sequence
  Hemicentin-1 (4939-4948)
KEIGEAVNGF

SEQ ID NO: 20739 - protein, 9 aa, Artificial Sequence
  Synemin (925-933)
KEIKIPHEF

SEQ ID NO: 20740 - protein, 10 aa, Artificial Sequence
  Annexin A1 (147-156)
KEIRDINRVY

SEQ ID NO: 20741 - protein, 9 aa, Artificial Sequence
  Probable global transcription activator SNF2L1 (774-782)
KEKLLTQGF

SEQ ID NO: 20742 - protein, 19 aa, Artificial Sequence
  Protein FAM208B (1764-1782)
KENLSKEPLASFVSESFDT

SEQ ID NO: 20743 - protein, 9 aa, Artificial Sequence
  Cullin-4B (885-893)
KENPNQYNY

SEQ ID NO: 20744 - protein, 23 aa, Artificial Sequence
  60S ribosomal protein L18 (16-38)
KEPKSQDIYLRLLVKLYRFLARR

SEQ ID NO: 20745 - protein, 10 aa, Artificial Sequence
  Melanoma-associated antigen 10 (192-201)
KEVDPTGHSF

SEQ ID NO: 20746 - protein, 10 aa, Artificial Sequence
  Melanoma-associated antigen 11 (251-260)
KEVDPTSHSY

SEQ ID NO: 20747 - protein, 10 aa, Artificial Sequence
  Melanoma-associated antigen 4 (168-177)
KEVDPTSNTY

SEQ ID NO: 20748 - protein, 19 aa, Artificial Sequence
  ATP-dependent RNA helicase A (392-410)
KFESEILEAISQNSVVIIR

SEQ ID NO: 20749 - protein, 10 aa, Artificial Sequence
  ATP synthase-coupling factor 6, mitochondrial (99-108)
KFEVIEKPQA

SEQ ID NO: 20750 - protein, 14 aa, Artificial Sequence
  B-cell CLL/lymphoma 9 protein (45-58)
KFSNQGKQGGSASQ

SEQ ID NO: 20751 - protein, 9 aa, Artificial Sequence
  Collagen alpha-1(IV) chain (238-246)
KFSTMPFLF

SEQ ID NO: 20752 - protein, 9 aa, Artificial Sequence
  Protein diaphanous homolog 2 (949-957)
KFVEKMTSF

SEQ ID NO: 20753 - protein, 10 aa, Artificial Sequence
  V-type proton ATPase 116 kDa subunit a isoform 1 (813-822)
KFYSGTGFKF

SEQ ID NO: 20754 - protein, 20 aa, Artificial Sequence
  Collagen alpha-2(I) chain (441-460)
KGEPGVVGAVGTAGPSGPSG

SEQ ID NO: 20755 - protein, 16 aa, Artificial Sequence
  Calpain small subunit 1 (9-24)
KGGGGGGGGGGGLGGG

SEQ ID NO: 20756 - protein, 26 aa, Artificial Sequence
  HLA class I histocompatibility antigen, A-23 alpha chain (340-365)
KGGSYSQAASSDSAQGSDVSLTACKV

SEQ ID NO: 20757 - protein, 26 aa, Artificial Sequence
  HLA class I histocompatibility antigen, A-1 alpha chain (315-340)
KGGSYTQAASSDSAQGSDVSLTACKV

SEQ ID NO: 20758 - protein, 38 aa, Artificial Sequence
  Cytochrome c oxidase subunit 7A2, mitochondrial (46-83)
KGGVADALLYRATMILTVGGTAYAIYELAVASFPKKQE

SEQ ID NO: 20759 - protein, 10 aa, Artificial Sequence
  Nebulin (852-861)
KGKMIGALSI

SEQ ID NO: 20760 - protein, 10 aa, Artificial Sequence
  Fatty acid synthase (2391-2400)
KGLEERVAAA

SEQ ID NO: 20761 - protein, 9 aa, Artificial Sequence
  E3 ubiquitin-protein ligase HUWE1 (1718-1726)
KGNDTPLAL

SEQ ID NO: 20762 - protein, 9 aa, Artificial Sequence
  Vigilin (314-322)
KGNSLQEIL

SEQ ID NO: 20763 - protein, 8 aa, Artificial Sequence
  UDP-glucose:glycoprotein glucosyltransferase 1 (1055-1062)
KGPIAKFL

SEQ ID NO: 20764 - protein, 9 aa, Artificial Sequence
  Serine/arginine-rich splicing factor 4 (23-31)
KGYGKILEV

SEQ ID NO: 20765 - protein, 25 aa, Artificial Sequence
  Histidine triad nucleotide-binding protein 1 (58-82)
KHISQISVAEDDDESLLGHLMIVGK

SEQ ID NO: 20766 - protein, 8 aa, Artificial Sequence
  Trabeculin-alpha (4579-4586)
KHKEFQKT

SEQ ID NO: 20767 - protein, 9 aa, Artificial Sequence
  Unconventional myosin-VIIa (1948-1956)
KIADKVLSV

SEQ ID NO: 20768 - protein, 7 aa, Artificial Sequence
  LIM domain transcription factor LMO4 (29-35)
KIADRFL

SEQ ID NO: 20769 - protein, 10 aa, Artificial Sequence
  MICOS complex subunit MIC60 (45-54)
KIAGAGLLFV

SEQ ID NO: 20770 - protein, 12 aa, Artificial Sequence
  Calcium-binding mitochondrial carrier protein SCaMC-2 (252-263)
KIAPESAIKFMA

SEQ ID NO: 20771 - protein, 9 aa, Artificial Sequence
  Protein TASOR (673-681)
KIASNPLER

SEQ ID NO: 20772 - protein, 9 aa, Artificial Sequence
  UV excision repair protein RAD23 homolog B (42-50)
KIDEKNFVV

SEQ ID NO: 20773 - protein, 9 aa, Artificial Sequence
  RNA-binding protein 5 (302-310)
KIDGKTIGV

SEQ ID NO: 20774 - protein, 9 aa, Artificial Sequence
  26S protease regulatory subunit 7 (156-164)
KIDPTVTMM

SEQ ID NO: 20775 - protein, 11 aa, Artificial Sequence
  26S protease regulatory subunit 7 (156-166)
KIDPTVTMMQV

SEQ ID NO: 20776 - protein, 9 aa, Artificial Sequence
  Thioredoxin reductase 1, cytoplasmic (299-307)
KIGLETVGV

SEQ ID NO: 20777 - protein, 10 aa, Artificial Sequence
  1-phosphatidylinositol 4,5-bisphosphate phosphodiesterase gamma-1 (969-978)
KIGTERACYR

SEQ ID NO: 20778 - protein, 8 aa, Artificial Sequence
  Heat shock protein 105 kDa (711-718)
KIGTPVKV

SEQ ID NO: 20779 - protein, 10 aa, Artificial Sequence
  Pleckstrin homology domain-containing family G member 3 (122-131)
KIIDTPGLLK

SEQ ID NO: 20780 - protein, 9 aa, Artificial Sequence
  Unconventional myosin-Id (269-277)
KILAAILHL

SEQ ID NO: 20781 - protein, 10 aa, Artificial Sequence
  Kinesin-like protein KIF1B (1496-1505)
KILDTSVAYV

SEQ ID NO: 20782 - protein, 9 aa, Artificial Sequence
  28S ribosomal protein S2, mitochondrial (61-69)
KILNEPLKH

SEQ ID NO: 20783 - protein, 11 aa, Artificial Sequence
  D-3-phosphoglycerate dehydrogenase (21-31)
KILQDGGLQVV

SEQ ID NO: 20784 - protein, 9 aa, Artificial Sequence
  Endothelial differentiation-related factor 1 (98-106)
KINEKPQVI

SEQ ID NO: 20785 - protein, 9 aa, Artificial Sequence
  Upstream stimulatory factor 2 (138-146)
KINNWIVQL

SEQ ID NO: 20786 - protein, 9 aa, Artificial Sequence
  Sodium/potassium/calcium exchanger 5 (219-227)
KINQYIIKK

SEQ ID NO: 20787 - protein, 9 aa, Artificial Sequence
  Protein sidekick-1 (309-317)
KIQGLSSLT

SEQ ID NO: 20788 - protein, 9 aa, Artificial Sequence
  Keratinocyte-associated protein 2 (136-144)
KISSTLYQA

SEQ ID NO: 20789 - protein, 11 aa, Artificial Sequence
  Dolichyl-diphosphooligosaccharide-proteinosyltransferase subunit 2 (368-378)
KISTEVGITNV

SEQ ID NO: 20790 - protein, 11 aa, Artificial Sequence
  Melanoma-associated antigen 6 (220-230)
KIWEELSVLEV

SEQ ID NO: 20791 - protein, 11 aa, Artificial Sequence
  Ras GTPase-activating-like protein IQGAP1 (94-104)
KIYDREQTRYK

SEQ ID NO: 20792 - protein, 9 aa, Artificial Sequence
  NADH dehydrogenase (ubiquinone) 1 beta subcomplex subunit 5, mitochondrial (79-87)
KIYERTMAV

SEQ ID NO: 20793 - protein, 8 aa, Artificial Sequence
  Lariat debranching enzyme (72-79)
KKAPVLTL

SEQ ID NO: 20794 - protein, 8 aa, Artificial Sequence
  Myc proto-oncogene protein (412-419)
KKATAYIL

SEQ ID NO: 20795 - protein, 9 aa, Artificial Sequence
  Zinc phosphodiesterase ELAC protein 2 (366-374)
KKEGPTLSV

SEQ ID NO: 20796 - protein, 16 aa, Artificial Sequence
  Serum albumin (437-452)
KKVPQVSTPTLVEVSR

SEQ ID NO: 20797 - protein, 9 aa, Artificial Sequence
  Nuclear mitotic apparatus protein 1 (1-9)
KLADDLSTL

SEQ ID NO: 20798 - protein, 9 aa, Artificial Sequence
  SNW domain-containing protein 1 (28-36)
KLAEALYIA

SEQ ID NO: 20799 - protein, 9 aa, Artificial Sequence
  Vesicle transport protein USE1 (171-179)
KLAEEMLGL

SEQ ID NO: 20800 - protein, 9 aa, Artificial Sequence
  SLIT-ROBO Rho GTPase-activating protein 2C (69-77)
KLAEHFLAK

SEQ ID NO: 20801 - protein, 9 aa, Artificial Sequence
  Plexin-A3 (55-63)
KLAPNLTEL

SEQ ID NO: 20802 - protein, 9 aa, Artificial Sequence
  Peroxisome biogenesis factor 1 (411-419)
KLDAHVERV

SEQ ID NO: 20803 - protein, 9 aa, Artificial Sequence
  Probable helicase with zinc finger domain (944-952)
KLDDGSIGV

SEQ ID NO: 20804 - protein, 9 aa, Artificial Sequence
  Afadin (391-399)
KLDDNSIQL

SEQ ID NO: 20805 - protein, 9 aa, Artificial Sequence
  E3 ubiquitin-protein ligase RNF139 (456-464)
KLDDYVYYV

SEQ ID NO: 20806 - protein, 9 aa, Artificial Sequence
  Transcriptional regulator ATRX (1499-1507)
KLDFSTALV

SEQ ID NO: 20807 - protein, 9 aa, Artificial Sequence
  Probable ATP-dependent RNA helicase DHX58 (177-185)
KLDGAINHV

SEQ ID NO: 20808 - protein, 9 aa, Artificial Sequence
  Serine/threonine-protein kinase Sgk3 (115-123)
KLDGKFYAV

SEQ ID NO: 20809 - protein, 9 aa, Artificial Sequence
  Inter-alpha-trypsin inhibitor heavy chain H5 (522-530)
KLDHLHVEV

SEQ ID NO: 20810 - protein, 9 aa, Artificial Sequence
  Kin of IRRE-like protein 1 (435-443)
KLDIKVETV

SEQ ID NO: 20811 - protein, 9 aa, Artificial Sequence
  Tectonic-1 (198-206)
KLDIPTAAK

SEQ ID NO: 20812 - protein, 10 aa, Artificial Sequence
  Lactoperoxidase (313-322)
KLDLSPWASV

SEQ ID NO: 20813 - protein, 9 aa, Artificial Sequence
  WD repeat-containing protein 26 (306-314)
KLDNNLDSV

SEQ ID NO: 20814 - protein, 9 aa, Artificial Sequence
  Cytoplasmic dynein 1 heavy chain 1 (828-836)
KLDPYVQRL

SEQ ID NO: 20815 - protein, 9 aa, Artificial Sequence
  cAMP-dependent protein kinase type I-beta regulatory subunit (349-357)
KLDRPRFER

SEQ ID NO: 20816 - protein, 11 aa, Artificial Sequence
  SH3 domain-binding protein 4 (249-259)
KLDSSGGAVQL

SEQ ID NO: 20817 - protein, 9 aa, Artificial Sequence
  Eukaryotic initiation factor 4A-II (260-268)
KLDTLCDLY

SEQ ID NO: 20818 - protein, 10 aa, Artificial Sequence
  Eukaryotic translation initiation factor 3 subunit I (213-222)
KLFDSTTLEH

SEQ ID NO: 20819 - protein, 9 aa, Artificial Sequence
  Centromere protein R (110-118)
KLFEKSTGL

SEQ ID NO: 20820 - protein, 9 aa, Artificial Sequence
  Protein kinase C delta type (581-589)
KLFEREPTK

SEQ ID NO: 20821 - protein, 9 aa, Artificial Sequence
  Nucleolar complex protein 2 homolog (168-176)
KLFHEVVQA

SEQ ID NO: 20822 - protein, 10 aa, Artificial Sequence
  Unconventional myosin-Va (410-419)
KLFNWIVDNV

SEQ ID NO: 20823 - protein, 9 aa, Artificial Sequence
  Constitutive coactivator of PPAR-gamma-like protein 1 (805-813)
KLFQSKLLK

SEQ ID NO: 20824 - protein, 10 aa, Artificial Sequence
  GTPase-activating protein and VPS9 domain-containing protein 1 (42-51)
KLFSEGLFSA

SEQ ID NO: 20825 - protein, 8 aa, Artificial Sequence
  Pleckstrin homology domain-containing family M member 2 (338-345)
KLGDISAV

SEQ ID NO: 20826 - protein, 9 aa, Artificial Sequence
  Atrial natriuretic peptide receptor 2 (148-156)
KLGEFVVTL

SEQ ID NO: 20827 - protein, 8 aa, Artificial Sequence
  Destrin (151-158)
KLGGSLIV

SEQ ID NO: 20828 - protein, 8 aa, Artificial Sequence
  Transformation/transcription domain-associated protein (1157-1164)
KLGGVVSI

SEQ ID NO: 20829 - protein, 8 aa, Artificial Sequence
  Laminin subunit beta-2 (55-62)
KLGIVQGI

SEQ ID NO: 20830 - protein, 9 aa, Artificial Sequence
  TRPM8 channel-associated factor 1 (281-289)
KLGPFLLNA

SEQ ID NO: 20831 - protein, 12 aa, Artificial Sequence
  Transcription and mRNA export factor ENY2 (19-30)
KLIETGERERLK

SEQ ID NO: 20832 - protein, 9 aa, Artificial Sequence
  Ral GTPase-activating protein subunit beta (194-202)
KLIGVLFEV

SEQ ID NO: 20833 - protein, 9 aa, Artificial Sequence
  Protein FAM179B (1545-1553)
KLITGLLNA

SEQ ID NO: 20834 - protein, 12 aa, Artificial Sequence
  L-lactate dehydrogenase B chain (308-319)
KLKDDEVAQLKK

SEQ ID NO: 20835 - protein, 10 aa, Artificial Sequence
  Formin-1 (1119-1128)
KLLDKPEQFL

SEQ ID NO: 20836 - protein, 11 aa, Artificial Sequence
  Formin-1 (1119-1129)
KLLDKPEQFLH

SEQ ID NO: 20837 - protein, 10 aa, Artificial Sequence
  Inositol 1,4,5-trisphosphate receptor type 2 (474-483)
KLLEDLIFFV

SEQ ID NO: 20838 - protein, 10 aa, Artificial Sequence
  AP-3 complex delta subunit (1019-1028)
KLLESGDLSM

SEQ ID NO: 20839 - protein, 11 aa, Artificial Sequence
  Catenin beta-1 (158-168)
KLLNDEDQVVV

SEQ ID NO: 20840 - protein, 9 aa, Artificial Sequence
  Laminin subunit gamma-1 (646-654)
KLLNNLTSI

SEQ ID NO: 20841 - protein, 10 aa, Artificial Sequence
  Laminin subunit gamma-1 (646-655)
KLLNNLTSIK

SEQ ID NO: 20842 - protein, 10 aa, Artificial Sequence
  Dedicator of cytokinesis protein 5 (404-413)
KLLPGDLTQV

SEQ ID NO: 20843 - protein, 10 aa, Artificial Sequence
  Myosin-10 (1002-1011)
KLMEDRIAEC

SEQ ID NO: 20844 - protein, 9 aa, Artificial Sequence
  Heat shock protein HSP 90-beta (491-499)
KLMKEILDK

SEQ ID NO: 20845 - protein, 9 aa, Artificial Sequence
  Nuclear envelope integral membrane protein 1 (123-131)
KLNDTYVNV

SEQ ID NO: 20846 - protein, 9 aa, Artificial Sequence
  Zinc finger protein ZIC 1 (48-56)
KLNPSSHEL

SEQ ID NO: 20847 - protein, 9 aa, Artificial Sequence
  Lysine-specific histone demethylase 1A (609-617)
KLNTAVRQV

SEQ ID NO: 20848 - protein, 8 aa, Artificial Sequence
  Probable ATP-dependent RNA helicase DDX60-like (1106-1113)
KLPAIFFL

SEQ ID NO: 20849 - protein, 9 aa, Artificial Sequence
  Probable ATP-dependent RNA helicase DDX60-like (1106-1114)
KLPAIFFLF

SEQ ID NO: 20850 - protein, 8 aa, Artificial Sequence
  Probable ATP-dependent RNA helicase DDX60 (1126-1133)
KLPALFFL

SEQ ID NO: 20851 - protein, 9 aa, Artificial Sequence
  Probable ATP-dependent RNA helicase DDX60 (1126-1134)
KLPALFFLF

SEQ ID NO: 20852 - protein, 10 aa, Artificial Sequence
  Nuclear receptor coactivator 7 (189-198)
KLPDADLARK

SEQ ID NO: 20853 - protein, 9 aa, Artificial Sequence
  Dolichyl-diphosphooligosaccharide-proteinosyltransferase 48 kDa subunit (380-388)
KLPDVYGVF

SEQ ID NO: 20854 - protein, 9 aa, Artificial Sequence
  Neuropathy target esterase (713-721)
KLPEGTLGH

SEQ ID NO: 20855 - protein, 9 aa, Artificial Sequence
  von Willebrand factor A domain-containing protein 9 (368-376)
KLPEKTQTF

SEQ ID NO: 20856 - protein, 9 aa, Artificial Sequence
  Puratrophin-1 (608-616)
KLPPVGSTA

SEQ ID NO: 20857 - protein, 9 aa, Artificial Sequence
  MAU2 chromatid cohesion factor homolog (108-116)
KLQEVHPLL

SEQ ID NO: 20858 - protein, 9 aa, Artificial Sequence
  Myosin-10 (1284-1292)
KLQNELDNV

SEQ ID NO: 20859 - protein, 9 aa, Artificial Sequence
  Unconventional myosin-If (409-417)
KLQQIFIEL

SEQ ID NO: 20860 - protein, 11 aa, Artificial Sequence
  High affinity cAMP-specific and IBMX-insensitive 3',5'-cyclic phosphodiesterase 8B (264-274)
KLRACNSVFTA

SEQ ID NO: 20861 - protein, 9 aa, Artificial Sequence
  Laminin subunit beta-2 (210-218)
KLSAHTHTL

SEQ ID NO: 20862 - protein, 10 aa, Artificial Sequence
  Nischarin (1228-1237)
KLSDLQSVNV

SEQ ID NO: 20863 - protein, 9 aa, Artificial Sequence
  Threonine synthase-like 2 (359-367)
KLSEAVTSV

SEQ ID NO: 20864 - protein, 9 aa, Artificial Sequence
  Rho GTPase-activating protein 7 (720-728)
KLSETFLQI

SEQ ID NO: 20865 - protein, 8 aa, Artificial Sequence
  Myristoylated alanine-rich C-kinase substrate (165-172)
KLSGFSFK

SEQ ID NO: 20866 - protein, 9 aa, Artificial Sequence
  Kinesin-1 heavy chain (222-230)
KLSGKLYLV

SEQ ID NO: 20867 - protein, 10 aa, Artificial Sequence
  Cathepsin D (348-357)
KLSPEDYTLK

SEQ ID NO: 20868 - protein, 9 aa, Artificial Sequence
  26S proteasome non-ATPase regulatory subunit 4 (83-91)
KLTAFVNTL

SEQ ID NO: 20869 - protein, 9 aa, Artificial Sequence
  Kinesin-like protein KIF13A (701-709)
KLTDYQVTL

SEQ ID NO: 20870 - protein, 9 aa, Artificial Sequence
  Cyclin-dependent kinase 2 (24-32)
KLTGEVVAL

SEQ ID NO: 20871 - protein, 9 aa, Artificial Sequence
  E3 ubiquitin-protein ligase UBR2 (543-551)
KLTHVISMM

SEQ ID NO: 20872 - protein, 9 aa, Artificial Sequence
  AP-1 complex subunit beta-1 (901-909)
KLTNGIWVL

SEQ ID NO: 20873 - protein, 9 aa, Artificial Sequence
  Copine-3 (110-118)
KLTRPLVMK

SEQ ID NO: 20874 - protein, 9 aa, Artificial Sequence
  Rab3 GTPase-activating protein non-catalytic subunit (337-345)
KLTSALFNA

SEQ ID NO: 20875 - protein, 9 aa, Artificial Sequence
  Endothelin B receptor (175-183)
KLVPFIQKA

SEQ ID NO: 20876 - protein, 9 aa, Artificial Sequence
  Platelet-activating factor acetylhydrolase IB subunit alpha (53-61)
KLWDFQGFE

SEQ ID NO: 20877 - protein, 9 aa, Artificial Sequence
  Interleukin-24 (68-76)
KLWEAFWAV

SEQ ID NO: 20878 - protein, 9 aa, Artificial Sequence
  Coatomer subunit beta' (771-779)
KLWRENLSK

SEQ ID NO: 20879 - protein, 9 aa, Artificial Sequence
  Cullin-9 (1503-1511)
KLYEHLQRA

SEQ ID NO: 20880 - protein, 9 aa, Artificial Sequence
  Phosphatidylinositol 4,5-bisphosphate 3-kinase catalytic subunit beta isoform (191-199)
KLYGGKLIV

SEQ ID NO: 20881 - protein, 11 aa, Artificial Sequence
  Protein FAM3C (30-40)
KMDASLGNLFA

SEQ ID NO: 20882 - protein, 10 aa, Artificial Sequence
  Dihydropyrimidinase-related protein 2 (338-347)
KMDENQFVAV

SEQ ID NO: 20883 - protein, 12 aa, Artificial Sequence
  Splicing factor, arginine/serine-rich 19 (1112-1123)
KMEEANLASRAK

SEQ ID NO: 20884 - protein, 12 aa, Artificial Sequence
  Leucine-tRNA ligase, cytoplasmic (497-508)
KMIDAGDALIYM

SEQ ID NO: 20885 - protein, 11 aa, Artificial Sequence
  LisH domain-containing protein ARMC9 (259-269)
KMITPEYLQSV

SEQ ID NO: 20886 - protein, 10 aa, Artificial Sequence
  Neuron navigator 1 (1349-1358)
KMLDEAVFQV

SEQ ID NO: 20887 - protein, 9 aa, Artificial Sequence
  Eukaryotic translation initiation factor 3 subunit L (267-275)
KMLGYFSLV

SEQ ID NO: 20888 - protein, 9 aa, Artificial Sequence
  KDEL motif-containing protein 1 (7-15)
KMPDVELFV

SEQ ID NO: 20889 - protein, 9 aa, Artificial Sequence
  Ceramide synthase 1 (98-106)
KMPESAWKF

SEQ ID NO: 20890 - protein, 13 aa, Artificial Sequence
  Amyloid-like protein 2 (688-700)
KMQNHGYENPTYK

SEQ ID NO: 20891 - protein, 13 aa, Artificial Sequence
  Gamma-secretase C-terminal fragment 59 (641-653)
KMQQNGYENPTYK

SEQ ID NO: 20892 - protein, 11 aa, Artificial Sequence
  E3 ubiquitin-protein ligase UBR4 (905-915)
KMVDGVGVCTV

SEQ ID NO: 20893 - protein, 9 aa, Artificial Sequence
  Polypyrimidine tract-binding protein 2 (415-423)
KMYGKIIRV

SEQ ID NO: 20894 - protein, 10 aa, Artificial Sequence
  Protein diaphanous homolog 2 (637-646)
KMYKPEVSMK

SEQ ID NO: 20895 - protein, 9 aa, Artificial Sequence
  Nuclear pore complex protein Nup93 (510-518)
KNADKVLEL

SEQ ID NO: 20896 - protein, 9 aa, Artificial Sequence
  5'-nucleotidase domain-containing protein 1 (159-167)
KNAGKILLL

SEQ ID NO: 20897 - protein, 9 aa, Artificial Sequence
  60S ribosomal protein L13 (174-182)
KNFKAFASL

SEQ ID NO: 20898 - protein, 9 aa, Artificial Sequence
  Centrosome-associated protein 350 (625-633)
KNKRLQELY

SEQ ID NO: 20899 - protein, 9 aa, Artificial Sequence
  Aldehyde dehydrogenase family 1 member A3 (446-454)
KNLDKALKL

SEQ ID NO: 20900 - protein, 9 aa, Artificial Sequence
  Junction plakoglobin (278-286)
KNNPKFLAI

SEQ ID NO: 20901 - protein, 9 aa, Artificial Sequence
  COX assembly mitochondrial protein homolog (43-51)
KNSGVLMVV

SEQ ID NO: 20902 - protein, 9 aa, Artificial Sequence
  Cytosolic acyl coenzyme A thioester hydrolase (126-134)
KNVDKVLEV

SEQ ID NO: 20903 - protein, 9 aa, Artificial Sequence
  Synaptic vesicle membrane protein VAT-1 homolog (374-382)
KNVGKVLLV

SEQ ID NO: 20904 - protein, 9 aa, Artificial Sequence
  DnaJ homolog subfamily A member 4 (79-87)
KNVVHQLSV

SEQ ID NO: 20905 - protein, 12 aa, Artificial Sequence
  Triosephosphate isomerase (156-167)
KPEFVDIINAKQ

SEQ ID NO: 20906 - protein, 9 aa, Artificial Sequence
  Rho GTPase-activating protein 7 (369-377)
KPGTFPKAL

SEQ ID NO: 20907 - protein, 9 aa, Artificial Sequence
  Anion exchange protein 3 (360-368)
KPHVASLSF

SEQ ID NO: 20908 - protein, 7 aa, Artificial Sequence
  Kelch repeat and BTB domain-containing protein 6 (284-290)
KPIVKKY

SEQ ID NO: 20909 - protein, 9 aa, Artificial Sequence
  Protein quaking (6-14)
KPKPTPDYL

SEQ ID NO: 20910 - protein, 9 aa, Artificial Sequence
  Sulfate transporter (548-556)
KPKSSLLGL

SEQ ID NO: 20911 - protein, 9 aa, Artificial Sequence
  Adenylate cyclase type 1 (422-430)
KPNSSLVVL

SEQ ID NO: 20912 - protein, 7 aa, Artificial Sequence
  Serine/threonine-protein kinase tousled-like 1 (483-489)
KPPIIHY

SEQ ID NO: 20913 - protein, 18 aa, Artificial Sequence
  NEDD4 family-interacting protein 1 (63-80)
KPPSYNVATTLPSYDEAE

SEQ ID NO: 20914 - protein, 9 aa, Artificial Sequence
  Plexin-D1 (92-100)
KPRNLNVSF

SEQ ID NO: 20915 - protein, 11 aa, Artificial Sequence
  Collagen alpha-1(XV) chain (98-108)
KPSSTRGGVLF

SEQ ID NO: 20916 - protein, 21 aa, Artificial Sequence
  Nuclear pore complex protein Nup214 (1252-1272)
KPSYEAIPESSPPSGITSASN

SEQ ID NO: 20917 - protein, 9 aa, Artificial Sequence
  Phosphatidylinositol-binding clathrin assembly protein (465-473)
KPTVASQNQ

SEQ ID NO: 20918 - protein, 9 aa, Artificial Sequence
  Lysyl oxidase homolog 3 (52-60)
KPYEGRVEI

SEQ ID NO: 20919 - protein, 9 aa, Artificial Sequence
  Nuclear factor of activated T-cells, cytoplasmic 2 (50-58)
KPYSPLASL

SEQ ID NO: 20920 - protein, 9 aa, Artificial Sequence
  Procollagen galactosyltransferase 1 (274-282)
KQAEVQMYV

SEQ ID NO: 20921 - protein, 10 aa, Artificial Sequence
  Syntaxin-binding protein 6 (78-87)
KQFEGSTSFV

SEQ ID NO: 20922 - protein, 10 aa, Artificial Sequence
  Dystonin (5209-5218)
KQKETIKAFL

SEQ ID NO: 20923 - protein, 9 aa, Artificial Sequence
  EAW49110.1 (48-56)
KQLEDGRSL

SEQ ID NO: 20924 - protein, 9 aa, Artificial Sequence
  E3 ubiquitin-protein ligase RNF130 (159-167)
KQNDVVRIL

SEQ ID NO: 20925 - protein, 9 aa, Artificial Sequence
  Putative signal peptidase complex catalytic subunit SEC11B (91-99)
KQNGHIKFL

SEQ ID NO: 20926 - protein, 9 aa, Artificial Sequence
  Unconventional myosin-IXa (65-73)
KQPEEYHYL

SEQ ID NO: 20927 - protein, 9 aa, Artificial Sequence
  Rho guanine nucleotide exchange factor 2 (208-216)
KQQDVIYEL

SEQ ID NO: 20928 - protein, 16 aa, Artificial Sequence
  Heat shock 70 kDa protein 4 (754-769)
KQSLTMDPVVKSKEIE

SEQ ID NO: 20929 - protein, 10 aa, Artificial Sequence
  Serum albumin (549-558)
KQTALVELVK

SEQ ID NO: 20930 - protein, 10 aa, Artificial Sequence
  Tyrosine-protein kinase Fer (613-622)
KQYDHPNIVK

SEQ ID NO: 20931 - protein, 9 aa, Artificial Sequence
  Transmembrane emp24 domain-containing protein 3 (83-91)
KQYDSFTYR

SEQ ID NO: 20932 - protein, 12 aa, Artificial Sequence
  Protein Niban (482-493)
KQYDYDSSTIRK

SEQ ID NO: 20933 - protein, 13 aa, Artificial Sequence
  Protein Niban (482-494)
KQYDYDSSTIRKK

SEQ ID NO: 20934 - protein, 9 aa, Artificial Sequence
  Phosphatidylinositol 3,4,5-trisphosphate-dependent Rac exchanger 1 protein (1094-1102)
KQYVTQINR

SEQ ID NO: 20935 - protein, 9 aa, Artificial Sequence
  Unconventional myosin-Ib (37-45)
KRFDHSEIY

SEQ ID NO: 20936 - protein, 9 aa, Artificial Sequence
  Serine/threonine-protein kinase 10 (596-604)
KRFEQEINA

SEQ ID NO: 20937 - protein, 8 aa, Artificial Sequence
  60S ribosomal protein L10a (47-54)
KRFSGTVR

SEQ ID NO: 20938 - protein, 9 aa, Artificial Sequence
  Copine-1 (190-198)
KRFSVPVQH

SEQ ID NO: 20939 - protein, 10 aa, Artificial Sequence
  MAP/microtubule affinity-regulating kinase 3 (731-740)
KRISGTSIAF

SEQ ID NO: 20940 - protein, 9 aa, Artificial Sequence
  Intraflagellar transport protein 81 homolog (264-272)
KRLEEEIKF

SEQ ID NO: 20941 - protein, 10 aa, Artificial Sequence
  ATP-dependent RNA helicase A (30-39)
KRLGYIHRNF

SEQ ID NO: 20942 - protein, 9 aa, Artificial Sequence
  Maltase-glucoamylase (110-118)
KRLPSPSLF

SEQ ID NO: 20943 - protein, 9 aa, Artificial Sequence
  Serum albumin (468-476)
KRMPCAEDY

SEQ ID NO: 20944 - protein, 9 aa, Artificial Sequence
  Gamma-interferon-inducible protein 16 (202-210)
KRPVIVKVL

SEQ ID NO: 20945 - protein, 9 aa, Artificial Sequence
  Band 4.1-like protein 2 (451-459)
KRSNFYIKV

SEQ ID NO: 20946 - protein, 14 aa, Artificial Sequence
  Glyceraldehyde-3-phosphate dehydrogenase (117-130)
KRVIISAPSADAPM

SEQ ID NO: 20947 - protein, 9 aa, Artificial Sequence
  Glia-derived nexin (299-307)
KRVQVILPK

SEQ ID NO: 20948 - protein, 9 aa, Artificial Sequence
  Growth/differentiation factor 15 (45-53)
KRYEDLLTR

SEQ ID NO: 20949 - protein, 9 aa, Artificial Sequence
  Insulin-like growth factor 1 receptor (927-935)
KRYENFIHL

SEQ ID NO: 20950 - protein, 9 aa, Artificial Sequence
  Protein zyg-11 homolog B (68-76)
KRYSERAFF

SEQ ID NO: 20951 - protein, 10 aa, Artificial Sequence
  Glycerol-3-phosphate acyltransferase 4 (407-416)
KSAIARQGGL

SEQ ID NO: 20952 - protein, 9 aa, Artificial Sequence
  Centrosomal protein C10orf90 (33-41)
KSDFTKETL

SEQ ID NO: 20953 - protein, 10 aa, Artificial Sequence
  Transcriptional protein SWT1 (56-65)
KSDHTDVLYY

SEQ ID NO: 20954 - protein, 9 aa, Artificial Sequence
  78 kDa glucose-regulated protein (335-343)
KSDIDEIVL

SEQ ID NO: 20955 - protein, 9 aa, Artificial Sequence
  Copine-9 (167-175)
KSDPFLVFY

SEQ ID NO: 20956 - protein, 9 aa, Artificial Sequence
  Pre-mRNA-processing factor 40 homolog A (164-172)
KSDSGKPYY

SEQ ID NO: 20957 - protein, 16 aa, Artificial Sequence
  Serine/threonine-protein phosphatase 2A 65 kDa regulatory subunit A alpha isoform (202-217)
KSEIIPMFSNLASDEQ

SEQ ID NO: 20958 - protein, 9 aa, Artificial Sequence
  Minor histocompatibility antigen H13 (234-242)
KSFEAPIKL

SEQ ID NO: 20959 - protein, 18 aa, Artificial Sequence
  Protein HEG homolog 1 (147-164)
KSGDFQMSPYAEYPKNPR

SEQ ID NO: 20960 - protein, 9 aa, Artificial Sequence
  Protein LAP2 (860-868)
KSGPVGSVV

SEQ ID NO: 20961 - protein, 8 aa, Artificial Sequence
  Vacuolar protein sorting-associated protein 16 homolog (82-89)
KSGPVVSL

SEQ ID NO: 20962 - protein, 9 aa, Artificial Sequence
  Alpha-catulin (373-381)
KSIAEELEL

SEQ ID NO: 20963 - protein, 9 aa, Artificial Sequence
  60S ribosomal protein L35 (52-60)
KSIARVLTV

SEQ ID NO: 20964 - protein, 9 aa, Artificial Sequence
  Syntenin-1 (130-138)
KSIDNGIFV

SEQ ID NO: 20965 - protein, 9 aa, Artificial Sequence
  Protein disulfide-isomerase TMX3 (71-79)
KSIGSPVKV

SEQ ID NO: 20966 - protein, 9 aa, Artificial Sequence
  Protein RTF2 homolog (83-91)
KSIKNVTEL

SEQ ID NO: 20967 - protein, 9 aa, Artificial Sequence
  Adenylosuccinate synthetase isozyme 2 (203-211)
KSIYPTLEI

SEQ ID NO: 20968 - protein, 9 aa, Artificial Sequence
  Selenoprotein N (53-61)
KSKDGFLGV

SEQ ID NO: 20969 - protein, 10 aa, Artificial Sequence
  Nucleolar pre-ribosomal-associated protein 1 (429-438)
KSLTKLLIMK

SEQ ID NO: 20970 - protein, 9 aa, Artificial Sequence
  Astrotactin-2 (499-507)
KSMPFITYL

SEQ ID NO: 20971 - protein, 11 aa, Artificial Sequence
  Transmembrane protein 98 (144-154)
KSMYPPLDPKL

SEQ ID NO: 20972 - protein, 9 aa, Artificial Sequence
  CD44 antigen (303-311)
KSQEMVHLV

SEQ ID NO: 20973 - protein, 9 aa, Artificial Sequence
  Targeting protein for Xklp2 (686-694)
KSSDQPLTV

SEQ ID NO: 20974 - protein, 9 aa, Artificial Sequence
  Chromodomain-helicase-DNA-binding protein 1 (88-96)
KSSPSILAV

SEQ ID NO: 20975 - protein, 9 aa, Artificial Sequence
  Leucine-tRNA ligase, cytoplasmic (28-36)
KSTGNFLTL

SEQ ID NO: 20976 - protein, 9 aa, Artificial Sequence
  116 kDa U5 small nuclear ribonucleoprotein component (182-190)
KSTPVTVVL

SEQ ID NO: 20977 - protein, 9 aa, Artificial Sequence
  Lysosome-associated membraneoprotein 2 (402-410)
KSYAGYQTL

SEQ ID NO: 20978 - protein, 9 aa, Artificial Sequence
  2',3'-cyclic-nucleotide 3'-phosphodiesterase (256-264)
KSYSKAFTL

SEQ ID NO: 20979 - protein, 9 aa, Artificial Sequence
  Zinc finger protein ZIC 2 (401-409)
KSYTHPSSL

SEQ ID NO: 20980 - protein, 8 aa, Artificial Sequence
  Ubiquitin carboxyl-terminal hydrolase 8 (34-41)
KSYVHSAL

SEQ ID NO: 20981 - protein, 9 aa, Artificial Sequence
  Peptidyl-prolyl cis-trans isomerase A (31-39)
KTAENFRAL

SEQ ID NO: 20982 - protein, 9 aa, Artificial Sequence
  Endothelin B receptor (359-367)
KTAKDWWLF

SEQ ID NO: 20983 - protein, 9 aa, Artificial Sequence
  V-type proton ATPase 116 kDa subunit a isoform 4 (360-368)
KTAPPTFNR

SEQ ID NO: 20984 - protein, 9 aa, Artificial Sequence
  RAC-gamma serine/threonine-protein kinase (32-40)
KTDGSFIGY

SEQ ID NO: 20985 - protein, 11 aa, Artificial Sequence
  Growth/differentiation factor 15 (274-284)
KTDTGVSLQTY

SEQ ID NO: 20986 - protein, 17 aa, Artificial Sequence
  Myeloid-derived growth factor (132-148)
KTEEFEVTKTAVAHRPG

SEQ ID NO: 20987 - protein, 9 aa, Artificial Sequence
  Myosin-IIIb (442-450)
KTESAHLIV

SEQ ID NO: 20988 - protein, 9 aa, Artificial Sequence
  Cullin-4B (327-335)
KTIDGILLL

SEQ ID NO: 20989 - protein, 9 aa, Artificial Sequence
  UPF0769 protein C21orf59 (114-122)
KTIEEAKAI

SEQ ID NO: 20990 - protein, 10 aa, Artificial Sequence
  Protein FAM184A (180-189)
KTIGKLKTEL

SEQ ID NO: 20991 - protein, 9 aa, Artificial Sequence
  Probable C-mannosyltransferase DPY19L4 (129-137)
KTINAVQQM

SEQ ID NO: 20992 - protein, 9 aa, Artificial Sequence
  Transcription factor SOX-8 (16-24)
KTLGKLWRL

SEQ ID NO: 20993 - protein, 8 aa, Artificial Sequence
  Transcription factor Dp-2 (49-56)
KTLGPINV

SEQ ID NO: 20994 - protein, 20 aa, Artificial Sequence
  Uncharacterized protein KIAA1109 (4603-4622)
KTMTSNLEKSSQEQLLDAAH

SEQ ID NO: 20995 - protein, 9 aa, Artificial Sequence
  Catenin beta-1 (288-296)
KTNVKFLAI

SEQ ID NO: 20996 - protein, 8 aa, Artificial Sequence
  RNA-binding protein Raly (143-150)
KTNVPVKL

SEQ ID NO: 20997 - protein, 9 aa, Artificial Sequence
  THO complex subunit 2 (892-900)
KTPNFSTLL

SEQ ID NO: 20998 - protein, 9 aa, Artificial Sequence
  HEAT repeat-containing protein 2 (446-454)
KTPSASGLL

SEQ ID NO: 20999 - protein, 9 aa, Artificial Sequence
  Eukaryotic translation initiation factor 4 gamma 1 (717-725)
KTQDLFRRV

SEQ ID NO: 21000 - protein, 9 aa, Artificial Sequence
  Angiomotin-like protein 1 (332-340)
KTQEHGLFY

SEQ ID NO: 21001 - protein, 9 aa, Artificial Sequence
  Cohesin subunit SA-2 (965-973)
KTREAIAML

SEQ ID NO: 21002 - protein, 8 aa, Artificial Sequence
  Golgin subfamily B member 1 (382-389)
KTSHILSL

SEQ ID NO: 21003 - protein, 8 aa, Artificial Sequence
  ATP-binding cassette sub-family F member 3 (144-151)
KTSNPLVL

SEQ ID NO: 21004 - protein, 9 aa, Artificial Sequence
  Hemicentin-1 (971-979)
KTTSVVVHV

SEQ ID NO: 21005 - protein, 9 aa, Artificial Sequence
  Vigilin (294-302)
KTTTIAVEV

SEQ ID NO: 21006 - protein, 8 aa, Artificial Sequence
  Rab3 GTPase-activating protein non-catalytic subunit (1174-1181)
KTVKPLSL

SEQ ID NO: 21007 - protein, 9 aa, Artificial Sequence
  40S ribosomal protein S11 (136-144)
KTVRFNVLK

SEQ ID NO: 21008 - protein, 10 aa, Artificial Sequence
  Melanocyte protein PMEL (154-163)
KTWDQVPFSV

SEQ ID NO: 21009 - protein, 9 aa, Artificial Sequence
  Spermidine synthase (57-65)
KTYGNVLVL

SEQ ID NO: 21010 - protein, 13 aa, Artificial Sequence
  26S protease regulatory subunit 7 (34-46)
KTYGQSTYSRQIK

SEQ ID NO: 21011 - protein, 9 aa, Artificial Sequence
  Cyclin-dependent kinase 16 (470-478)
KTYNYPKYR

SEQ ID NO: 21012 - protein, 9 aa, Artificial Sequence
  Non-receptor tyrosine-protein kinase TNK1 (260-268)
KVADFGLVR

SEQ ID NO: 21013 - protein, 9 aa, Artificial Sequence
  GMP synthase (glutamine-hydrolyzing) (292-300)
KVADGFKVV

SEQ ID NO: 21014 - protein, 9 aa, Artificial Sequence
  Dynactin subunit 3 (32-40)
KVADGLVKV

SEQ ID NO: 21015 - protein, 9 aa, Artificial Sequence
  Phosphoglycerate kinase 1 (216-224)
KVADKIQLI

SEQ ID NO: 21016 - protein, 9 aa, Artificial Sequence
  Disks large homolog 1 (368-376)
KVAKPTSMY

SEQ ID NO: 21017 - protein, 10 aa, Artificial Sequence
  GPI mannosyltransferase 1 (15-24)
KVAPAGVFGV

SEQ ID NO: 21018 - protein, 12 aa, Artificial Sequence
  Coatomer subunit delta (123-134)
KVAPAPARPSGP

SEQ ID NO: 21019 - protein, 9 aa, Artificial Sequence
  Asparagine synthetase (glutamine-hydrolyzing) (112-120)
KVASVEMVK

SEQ ID NO: 21020 - protein, 23 aa, Artificial Sequence
  Pyridoxal kinase (152-174)
KVDAVFVGTGDLFAAMLLAWTHK

SEQ ID NO: 21021 - protein, 9 aa, Artificial Sequence
  Melanoma-associated antigen 4 (113-121)
KVDELAHFL

SEQ ID NO: 21022 - protein, 9 aa, Artificial Sequence
  Centromere protein F (738-746)
KVDELTTEI

SEQ ID NO: 21023 - protein, 9 aa, Artificial Sequence
  Beta-secretase 2 (314-322)
KVFDAVVEA

SEQ ID NO: 21024 - protein, 9 aa, Artificial Sequence
  Transcription factor HES-1 (214-222)
KVFGGFQVV

SEQ ID NO: 21025 - protein, 8 aa, Artificial Sequence
  Myelin expression factor 2 (123-130)
KVGEVTYV

SEQ ID NO: 21026 - protein, 8 aa, Artificial Sequence
  Uridine phosphorylase 1 (99-106)
KVGPVLSV

SEQ ID NO: 21027 - protein, 11 aa, Artificial Sequence
  Nucleosome-remodeling factor subunit BPTF (2095-2105)
KVGSPATVTFQ

SEQ ID NO: 21028 - protein, 6 aa, Artificial Sequence
  E3 ubiquitin/ISG15 ligase TRIM25 (596-601)
KVHLMY

SEQ ID NO: 21029 - protein, 10 aa, Artificial Sequence
  Unconventional myosin-Id (255-264)
KVIGFKPEEI

SEQ ID NO: 21030 - protein, 13 aa, Artificial Sequence
  Titin (15654-15666)
KVKEVTKTSVTLT

SEQ ID NO: 21031 - protein, 9 aa, Artificial Sequence
  Fructose-bisphosphate aldolase A (262-270)
KVLAAVYKA

SEQ ID NO: 21032 - protein, 51 aa, Artificial Sequence
  Titin (21056-21106)
KVLDTPAACQKLQVKHVSRGTVTLLWDPPLIDGGSPIINYVIEKRDATKRT

SEQ ID NO: 21033 - protein, 11 aa, Artificial Sequence
  F-box only protein 32 (98-108)
KVLEDQQNIRL

SEQ ID NO: 21034 - protein, 9 aa, Artificial Sequence
  Melanoma-associated antigen 4 (286-294)
KVLEHVVRV

SEQ ID NO: 21035 - protein, 9 aa, Artificial Sequence
  Chloride transport protein 6 (183-191)
KVLGVLFSV

SEQ ID NO: 21036 - protein, 9 aa, Artificial Sequence
  SLIT-ROBO Rho GTPase-activating protein 2 (155-163)
KVLNELYSV

SEQ ID NO: 21037 - protein, 9 aa, Artificial Sequence
  Signal recognition particle receptor subunit alpha (345-353)
KVMGTFSTV

SEQ ID NO: 21038 - protein, 9 aa, Artificial Sequence
  40S ribosomal protein S16 (32-40)
KVNGRPLEM

SEQ ID NO: 21039 - protein, 8 aa, Artificial Sequence
  E3 ubiquitin-protein ligase RING1 (361-368)
KVSRPLEL

SEQ ID NO: 21040 - protein, 9 aa, Artificial Sequence
  Solute carrier family 41 member 2 (192-200)
KVTEVFILV

SEQ ID NO: 21041 - protein, 9 aa, Artificial Sequence
  Hom s 1 (524-532)
KVVEIVKKL

SEQ ID NO: 21042 - protein, 6 aa, Artificial Sequence
  Poly (ADP-ribose) polymerase 12 (512-517)
KVWNLF

SEQ ID NO: 21043 - protein, 10 aa, Artificial Sequence
  Unconventional myosin-Id (707-716)
KVWRGTLARM

SEQ ID NO: 21044 - protein, 10 aa, Artificial Sequence
  Hemicentin-1 (2662-2671)
KVYIPPIINK

SEQ ID NO: 21045 - protein, 9 aa, Artificial Sequence
  Probable helicase with zinc finger domain (500-508)
KYAQNGQLF

SEQ ID NO: 21046 - protein, 9 aa, Artificial Sequence
  DNA cross-link repair 1A protein (370-378)
KYDEGLYRF

SEQ ID NO: 21047 - protein, 9 aa, Artificial Sequence
  EH domain-containing protein 2 (452-460)
KYDEIFYNL

SEQ ID NO: 21048 - protein, 9 aa, Artificial Sequence
  E3 ubiquitin-protein ligase SIAH1 (198-206)
KYDGHQQFF

SEQ ID NO: 21049 - protein, 9 aa, Artificial Sequence
  Dedicator of cytokinesis protein 4 (92-100)
KYGDMRVTM

SEQ ID NO: 21050 - protein, 8 aa, Artificial Sequence
  Serine/threonine-protein kinase PLK2 (513-520)
KYGFGYQL

SEQ ID NO: 21051 - protein, 9 aa, Artificial Sequence
  Protein SOGA1 (415-423)
KYGIVQEFF

SEQ ID NO: 21052 - protein, 8 aa, Artificial Sequence
  Glycerol-3-phosphate acyltransferase 4 (365-372)
KYGMVTYL

SEQ ID NO: 21053 - protein, 9 aa, Artificial Sequence
  RNA-binding motif protein, X chromosome (30-38)
KYGRIVEVL

SEQ ID NO: 21054 - protein, 9 aa, Artificial Sequence
  Non-specific lipid-transfer protein (92-100)
KYGTKIEHF

SEQ ID NO: 21055 - protein, 10 aa, Artificial Sequence
  Paired amphipathic helix protein Sin3b (300-309)
KYGTLQEFSF

SEQ ID NO: 21056 - protein, 9 aa, Artificial Sequence
  Kinase D-interacting substrate of 220 kDa (126-134)
KYGTTPLVW

SEQ ID NO: 21057 - protein, 9 aa, Artificial Sequence
  Peroxisome proliferator-activated receptor delta isoform 4 (185-193)
KYGVHEAIF

SEQ ID NO: 21058 - protein, 9 aa, Artificial Sequence
  Tubulin-tyrosine ligase-like protein 12 (451-459)
KYIESPVLF

SEQ ID NO: 21059 - protein, 9 aa, Artificial Sequence
  Protein yippee-like 3 (104-112)
KYIIELNHM

SEQ ID NO: 21060 - protein, 9 aa, Artificial Sequence
  3-hydroxy-3-methylglutaryl-coenzyme A reductase (89-97)
KYILGIAGL

SEQ ID NO: 21061 - protein, 9 aa, Artificial Sequence
  Alpha-fetoprotein (403-411)
KYIQESQAL

SEQ ID NO: 21062 - protein, 9 aa, Artificial Sequence
  Membrane progestin receptor alpha (193-201)
KYIQKPGLL

SEQ ID NO: 21063 - protein, 9 aa, Artificial Sequence
  Centrosomal protein of 135 kDa (857-865)
KYITEVSRW

SEQ ID NO: 21064 - protein, 9 aa, Artificial Sequence
  Transmembrane emp24 domain-containing protein 5 (84-92)
KYITGTDIL

SEQ ID NO: 21065 - protein, 9 aa, Artificial Sequence
  Kinesin light chain 1 (266-274)
KYKDAANLL

SEQ ID NO: 21066 - protein, 9 aa, Artificial Sequence
  Melanoma-associated antigen B1 (141-149)
KYKDHFTEI

SEQ ID NO: 21067 - protein, 9 aa, Artificial Sequence
  Melanoma-associated antigen C2 (173-181)
KYKDYFPVI

SEQ ID NO: 21068 - protein, 9 aa, Artificial Sequence
  Kinesin light chain 4 (191-199)
KYKEAAHLL

SEQ ID NO: 21069 - protein, 9 aa, Artificial Sequence
  Antizyme inhibitor 1 (341-349)
KYKEDEPLF

SEQ ID NO: 21070 - protein, 9 aa, Artificial Sequence
  Protein disulfide-isomerase (91-99)
KYKPESEEL

SEQ ID NO: 21071 - protein, 9 aa, Artificial Sequence
  Peroxisomal acyl-coenzyme A oxidase 3 (120-128)
KYLLHSLVF

SEQ ID NO: 21072 - protein, 9 aa, Artificial Sequence
  Gem-associated protein 4 (188-196)
KYLPALDEF

SEQ ID NO: 21073 - protein, 11 aa, Artificial Sequence
  Phosphatidylinositol-glycan biosynthesis class W protein (189-199)
KYMEGSKLHYF

SEQ ID NO: 21074 - protein, 10 aa, Artificial Sequence
  Histone acetyltransferase type B catalytic subunit (207-216)
KYNKDGATLF

SEQ ID NO: 21075 - protein, 9 aa, Artificial Sequence
  Formin-like protein 3 (158-166)
KYPDLANFW

SEQ ID NO: 21076 - protein, 9 aa, Artificial Sequence
  Rho guanine nucleotide exchange factor 12 (939-947)
KYPLLLDNI

SEQ ID NO: 21077 - protein, 9 aa, Artificial Sequence
  Rho guanine nucleotide exchange factor 11 (884-892)
KYPLLLESI

SEQ ID NO: 21078 - protein, 9 aa, Artificial Sequence
  Protein lifeguard 4 (139-147)
KYPLNLYLL

SEQ ID NO: 21079 - protein, 9 aa, Artificial Sequence
  Ceramide glucosyltransferase (104-112)
KYPNVDARL

SEQ ID NO: 21080 - protein, 7 aa, Artificial Sequence
  ATP-dependent RNA helicase A (169-175)
KYPSPFF

SEQ ID NO: 21081 - protein, 9 aa, Artificial Sequence
  Early endosome antigen 1 (387-395)
KYQHLKAEF

SEQ ID NO: 21082 - protein, 9 aa, Artificial Sequence
  Tetratricopeptide repeat protein 9C (156-164)
KYRDAVSRY

SEQ ID NO: 21083 - protein, 9 aa, Artificial Sequence
  Zinc finger protein ZFAT (350-358)
KYSDVKNLI

SEQ ID NO: 21084 - protein, 9 aa, Artificial Sequence
  Host cell factor 1 (105-113)
KYSNDLYEL

SEQ ID NO: 21085 - protein, 9 aa, Artificial Sequence
  Serine-protein kinase ATM (331-339)
KYSSGFRNI

SEQ ID NO: 21086 - protein, 9 aa, Artificial Sequence
  Zinc finger MYM-type protein 4 (1301-1309)
KYSTKMTYL

SEQ ID NO: 21087 - protein, 24 aa, Artificial Sequence
  Actin, gamma-enteric smooth muscle (294-317)
KYSVWIGGSILASLSTFQQMWISK

SEQ ID NO: 21088 - protein, 9 aa, Artificial Sequence
  DNA/RNA-binding protein KIN17 (311-319)
KYTAVVKMI

SEQ ID NO: 21089 - protein, 9 aa, Artificial Sequence
  Signal peptidase complex subunit 2 (73-81)
KYVENFGLI

SEQ ID NO: 21090 - protein, 9 aa, Artificial Sequence
  Sorting nexin-29 (103-111)
KYVGAVQML

SEQ ID NO: 21091 - protein, 8 aa, Artificial Sequence
  Zinc finger protein 195 (148-155)
KYVKIFDN

SEQ ID NO: 21092 - protein, 9 aa, Artificial Sequence
  Zinc finger protein 92 (117-125)
KYVKVFHKF

SEQ ID NO: 21093 - protein, 9 aa, Artificial Sequence
  Zinc finger protein 708 (80-88)
KYVKVFHKY

SEQ ID NO: 21094 - protein, 9 aa, Artificial Sequence
  Tubulin beta chain (78-86)
KYVPRAILV

SEQ ID NO: 21095 - protein, 9 aa, Artificial Sequence
  Centromere/kinetochore protein zw10 homolog (130-138)
KYVTGAQRL

SEQ ID NO: 21096 - protein, 9 aa, Artificial Sequence
  Ubiquitin carboxyl-terminal hydrolase 8 (65-73)
KYVTVYNLI

SEQ ID NO: 21097 - protein, 9 aa, Artificial Sequence
  Digestive organ expansion factor homolog (526-534)
KYYRQTLLF

SEQ ID NO: 21098 - protein, 10 aa, Artificial Sequence
  Probable E3 ubiquitin-protein ligase HERC1 (3206-3215)
LAAGLESLGL

SEQ ID NO: 21099 - protein, 11 aa, Artificial Sequence
  Glutamate receptor ionotropic, kainate 2 (827-837)
LAAGLVLSVFV

SEQ ID NO: 21100 - protein, 9 aa, Artificial Sequence
  Ankyrin repeat domain-containing protein 17 (848-856)
LAAGPLPPG

SEQ ID NO: 21101 - protein, 8 aa, Artificial Sequence
  Spectrin beta chain, non-erythrocytic 4 (1779-1786)
LAAVNQMV

SEQ ID NO: 21102 - protein, 9 aa, Artificial Sequence
  Vimentin (88-96)
LADAINTEF

SEQ ID NO: 21103 - protein, 9 aa, Artificial Sequence
  Exonuclease 3'-5' domain-containing protein 2 (31-39)
LADGTILKV

SEQ ID NO: 21104 - protein, 9 aa, Artificial Sequence
  Kinesin-associated protein 3 (289-297)
LAEDTRTEL

SEQ ID NO: 21105 - protein, 8 aa, Artificial Sequence
  Kinectin (601-608)
LAEELHKV

SEQ ID NO: 21106 - protein, 8 aa, Artificial Sequence
  CREB-binding protein (654-661)
LAEKIYKI

SEQ ID NO: 21107 - protein, 8 aa, Artificial Sequence
  Protein shisa-4 (79-86)
LAFSPKTI

SEQ ID NO: 21108 - protein, 8 aa, Artificial Sequence
  DNA-dependent protein kinase catalytic subunit (29-36)
LAGHQLIR

SEQ ID NO: 21109 - protein, 10 aa, Artificial Sequence
  Signal transducer and activator of transcription 3 (221-230)
LAGLLSAMEY

SEQ ID NO: 21110 - protein, 9 aa, Artificial Sequence
  Phosphoacetylglucosamine mutase (519-527)
LAHEVSLAV

SEQ ID NO: 21111 - protein, 11 aa, Artificial Sequence
  Ancient ubiquitous protein 1 (320-330)
LAKTGCVDLTI

SEQ ID NO: 21112 - protein, 9 aa, Artificial Sequence
  Splicing factor 3B subunit 3 (765-773)
LALEKLGAV

SEQ ID NO: 21113 - protein, 8 aa, Artificial Sequence
  EH domain-containing protein 1 (503-510)
LANHLIKV

SEQ ID NO: 21114 - protein, 8 aa, Artificial Sequence
  Alpha-2-macroglobulin-like protein 1 (37-44)
LAPDPSLV

SEQ ID NO: 21115 - protein, 8 aa, Artificial Sequence
  COP9 signalosome complex subunit 1 (358-365)
LAPHVRTL

SEQ ID NO: 21116 - protein, 9 aa, Artificial Sequence
  WAS/WASL-interacting protein family member 2 (294-302)
LAPPPPTSA

SEQ ID NO: 21117 - protein, 8 aa, Artificial Sequence
  Ancient ubiquitous protein 1 (300-307)
LAQRVKEV

SEQ ID NO: 21118 - protein, 9 aa, Artificial Sequence
  Fatty acid synthase (899-907)
LARALGLGV

SEQ ID NO: 21119 - protein, 10 aa, Artificial Sequence
  Molybdate-anion transporter (181-190)
LAVVAGVAAE

SEQ ID NO: 21120 - protein, 18 aa, Artificial Sequence
  Epidermal growth factor receptor (5-22)
LAVVSLNITSLGLRSLKE

SEQ ID NO: 21121 - protein, 7 aa, Artificial Sequence
  Serum albumin (484-490)
LCVLHEK

SEQ ID NO: 21122 - protein, 23 aa, Artificial Sequence
  Actin, cytoplasmic 2 (73-95)
LCYVALDFEQEMATAASSSSLEK

SEQ ID NO: 21123 - protein, 8 aa, Artificial Sequence
  Coiled-coil domain-containing protein 93 (525-532)
LDDKKVYL

SEQ ID NO: 21124 - protein, 10 aa, Artificial Sequence
  Melanoma inhibitory activity protein 3 (157-166)
LDDTAKNLRV

SEQ ID NO: 21125 - protein, 8 aa, Artificial Sequence
  Axin-1 (509-516)
LDEHVQRV

SEQ ID NO: 21126 - protein, 8 aa, Artificial Sequence
  Probable ATP-dependent RNA helicase DDX27 (86-93)
LDEKIEKV

SEQ ID NO: 21127 - protein, 8 aa, Artificial Sequence
  U6 snRNA-associated Sm-like protein LSm8 (17-24)
LDESHERV

SEQ ID NO: 21128 - protein, 37 aa, Artificial Sequence
  Collagen alpha-1(XX) chain (189-225)
LDFLQLGALAGLLSRLICQRLQGGSPRQGPAAAPALD

SEQ ID NO: 21129 - protein, 8 aa, Artificial Sequence
  Prelamin-A/C (55-62)
LDFQKNIY

SEQ ID NO: 21130 - protein, 10 aa, Artificial Sequence
  ATP-binding cassette sub-family A member 13 (447-456)
LDGALRNAIA

SEQ ID NO: 21131 - protein, 7 aa, Artificial Sequence
  Mitochondrial dicarboxylate carrier (145-151)
LDGLYRV

SEQ ID NO: 21132 - protein, 7 aa, Artificial Sequence
  Heat shock protein HSP 90-beta (497-503)
LDKKVEK

SEQ ID NO: 21133 - protein, 8 aa, Artificial Sequence
  RHO/RAC effector protein (1024-1031)
LDKNDHSL

SEQ ID NO: 21134 - protein, 7 aa, Artificial Sequence
  Small subunit processome component 20 homolog (301-307)
LDLHTKV

SEQ ID NO: 21135 - protein, 8 aa, Artificial Sequence
  Exportin-1 (715-722)
LDMLNVYK

SEQ ID NO: 21136 - protein, 9 aa, Artificial Sequence
  Mediator of RNA polymerase II transcription subunit 12 (1430-1438)
LDMLSVLIN

SEQ ID NO: 21137 - protein, 8 aa, Artificial Sequence
  Serine/threonine-protein kinase N1 (459-466)
LDNERHEV

SEQ ID NO: 21138 - protein, 9 aa, Artificial Sequence
  SWI/SNF-related matrix-associated actin-dependent regulator of chromatin subfamily A member 5 (921-929)
LDTKIGRYK

SEQ ID NO: 21139 - protein, 9 aa, Artificial Sequence
  Serine-protein kinase ATM (1050-1058)
LEADPYSKW

SEQ ID NO: 21140 - protein, 13 aa, Artificial Sequence
  Erlin-2 (327-339)
LEDEPLETATKEN

SEQ ID NO: 21141 - protein, 10 aa, Artificial Sequence
  Spectrin beta chain, non-erythrocytic 1 (740-749)
LEEASLLHQF

SEQ ID NO: 21142 - protein, 9 aa, Artificial Sequence
  Structural maintenance of chromosomes protein 1A (367-375)
LEENQVKKY

SEQ ID NO: 21143 - protein, 13 aa, Artificial Sequence
  Moesin (16-28)
LEFAIQPNTTGKQ

SEQ ID NO: 21144 - protein, 14 aa, Artificial Sequence
  Moesin (16-29)
LEFAIQPNTTGKQL

SEQ ID NO: 21145 - protein, 10 aa, Artificial Sequence
  Synemin (898-907)
LEGDLGSTHW

SEQ ID NO: 21146 - protein, 7 aa, Artificial Sequence
  Melanoma-associated antigen 4 (288-294)
LEHVVRV

SEQ ID NO: 21147 - protein, 9 aa, Artificial Sequence
  Keratin, type II cytoskeletal 1 (477-485)
LEIATYRTL

SEQ ID NO: 21148 - protein, 9 aa, Artificial Sequence
  Integrator complex subunit 11 (341-349)
LEMEGRQVL

SEQ ID NO: 21149 - protein, 9 aa, Artificial Sequence
  Voltage-dependent calcium channel subunit alpha-2/delta-1 (566-574)
LENDIKVEI

SEQ ID NO: 21150 - protein, 9 aa, Artificial Sequence
  Histone acetyltransferase type B catalytic subunit (44-52)
LENDIRTFF

SEQ ID NO: 21151 - protein, 17 aa, Artificial Sequence
  Thioredoxin domain-containing protein 15 (185-201)
LENFTLKILNMSQDLMD

SEQ ID NO: 21152 - protein, 12 aa, Artificial Sequence
  HLA class I histocompatibility antigen, A-2 alpha chain (171-182)
LENGKETLQRTD

SEQ ID NO: 21153 - protein, 9 aa, Artificial Sequence
  V-type proton ATPase subunit H (318-326)
LENLEQQKY

SEQ ID NO: 21154 - protein, 15 aa, Artificial Sequence
  Tubulin beta-6 chain (68-82)
LEPGTMDSVRSGPFG

SEQ ID NO: 21155 - protein, 9 aa, Artificial Sequence
  DNA repair protein RAD51 homolog 3 (91-99)
LEQEHTQGF

SEQ ID NO: 21156 - protein, 9 aa, Artificial Sequence
  Laminin subunit gamma-1 (1296-1304)
LEQLIDQKL

SEQ ID NO: 21157 - protein, 8 aa, Artificial Sequence
  Serine/arginine-rich splicing factor 3 (26-33)
LERAFGYY

SEQ ID NO: 21158 - protein, 8 aa, Artificial Sequence
  Melanoma-associated antigen 4 (137-144)
LERVIKNY

SEQ ID NO: 21159 - protein, 14 aa, Artificial Sequence
  Kin of IRRE-like protein 1 (338-351)
LERYTVERTNSGSG

SEQ ID NO: 21160 - protein, 7 aa, Artificial Sequence
  Cyclic AMP-dependent transcription factor ATF-4 (38-44)
LEVAKHF

SEQ ID NO: 21161 - protein, 22 aa, Artificial Sequence
  Calpain-2 catalytic subunit (459-480)
LFAQLAGEDAEISAFELQTILR

SEQ ID NO: 21162 - protein, 9 aa, Artificial Sequence
  Vacuolar protein sorting-associated protein 8 homolog (853-861)
LFDQVLEFL

SEQ ID NO: 21163 - protein, 10 aa, Artificial Sequence
  Titin (9698-9707)
LFFVSEPQSI

SEQ ID NO: 21164 - protein, 8 aa, Artificial Sequence
  Protein MCM10 homolog (334-341)
LFGEVHKA

SEQ ID NO: 21165 - protein, 8 aa, Artificial Sequence
  Guanine nucleotide-binding protein subunit beta-5 (321-328)
LFGHENRV

SEQ ID NO: 21166 - protein, 10 aa, Artificial Sequence
  Cullin-7 (1270-1279)
LFGPRAAFLL

SEQ ID NO: 21167 - protein, 10 aa, Artificial Sequence
  HLA class II histocompatibility antigen, DP alpha 1 chain (167-176)
LFLPRTDYSF

SEQ ID NO: 21168 - protein, 11 aa, Artificial Sequence
  ER membrane protein complex subunit 1 (430-440)
LFLQQLAGKVV

SEQ ID NO: 21169 - protein, 8 aa, Artificial Sequence
  Asparagine synthetase (glutamine-hydrolyzing) (155-162)
LFNNAVKK

SEQ ID NO: 21170 - protein, 9 aa, Artificial Sequence
  Chloride transport protein 6 (104-112)
LFTQLKFGV

SEQ ID NO: 21171 - protein, 10 aa, Artificial Sequence
  Cytochrome c oxidase subunit 1 (347-356)
LFTVGGLTGI

SEQ ID NO: 21172 - protein, 10 aa, Artificial Sequence
  Protein-glutamine gamma-glutamyltransferase 5 (627-636)
LGAAVVNQPL

SEQ ID NO: 21173 - protein, 11 aa, Artificial Sequence
  Elastin (48-58)
LGALGGGALGP

SEQ ID NO: 21174 - protein, 7 aa, Artificial Sequence
  Proteasome subunit beta type-4 (122-128)
LGDGHSY

SEQ ID NO: 21175 - protein, 9 aa, Artificial Sequence
  Mitogen-activated protein kinase 4 (26-34)
LGFGVNGLV

SEQ ID NO: 21176 - protein, 7 aa, Artificial Sequence
  Lipopolysaccharide-responsive and beige-like anchor protein (138-144)
LGKIEKV

SEQ ID NO: 21177 - protein, 7 aa, Artificial Sequence
  EH domain-containing protein 4 (484-490)
LGKIWKL

SEQ ID NO: 21178 - protein, 9 aa, Artificial Sequence
  Probable E3 ubiquitin-protein ligase HECTD4 (712-720)
LGKYAESIL

SEQ ID NO: 21179 - protein, 20 aa, Artificial Sequence
  14-3-3 protein beta/alpha (170-189)
LGLALNFSVFYYEILNSPEK

SEQ ID NO: 21180 - protein, 34 aa, Artificial Sequence
  Heat shock protein HSP 90-alpha (510-543)
LGLGIDEDDPTADDTSAAVTEEMPPLEGDDDTSR

SEQ ID NO: 21181 - protein, 10 aa, Artificial Sequence
  HLA class II histocompatibility antigen, DQ alpha 1 chain (223-232)
LGLSVGLVGI

SEQ ID NO: 21182 - protein, 9 aa, Artificial Sequence
  Splicing factor 3B subunit 2 (104-112)
LGPPPPLRV

SEQ ID NO: 21183 - protein, 10 aa, Artificial Sequence
  Ankyrin repeat domain-containing protein 17 (882-891)
LGQGILTETQ

SEQ ID NO: 21184 - protein, 11 aa, Artificial Sequence
  Transketolase (38-48)
LGQGLGAACGM

SEQ ID NO: 21185 - protein, 8 aa, Artificial Sequence
  60S ribosomal protein L13a (138-145)
LGRLAHEV

SEQ ID NO: 21186 - protein, 24 aa, Artificial Sequence
  Filamin-B (1896-1919)
LGSAADFLLDISETDLSSLTASIK

SEQ ID NO: 21187 - protein, 7 aa, Artificial Sequence
  YY1-associated protein 1 (323-329)
LGSETRY

SEQ ID NO: 21188 - protein, 10 aa, Artificial Sequence
  Cadherin-2 (351-360)
LHAGTMLTTF

SEQ ID NO: 21189 - protein, 8 aa, Artificial Sequence
  Mortality factor 4-like protein 1 (291-298)
LHDFLKYL

SEQ ID NO: 21190 - protein, 10 aa, Artificial Sequence
  Cyclin-G-associated kinase (18-27)
LHSEVGAGPA

SEQ ID NO: 21191 - protein, 32 aa, Artificial Sequence
  Glia-derived nexin (345-376)
LHVSHILQKAKIEVSEDGTKASAATTAILIAR

SEQ ID NO: 21192 - protein, 34 aa, Artificial Sequence
  Glia-derived nexin (345-378)
LHVSHILQKAKIEVSEDGTKASAATTAILIARSS

SEQ ID NO: 21193 - protein, 10 aa, Artificial Sequence
  Cyclin-dependent kinase 1 (135-144)
LIDDKGTIKL

SEQ ID NO: 21194 - protein, 9 aa, Artificial Sequence
  CCR4-NOT transcription complex subunit 3 (77-85)
LIDNRKLIE

SEQ ID NO: 21195 - protein, 9 aa, Artificial Sequence
  Eukaryotic translation initiation factor 3 subunit L (66-74)
LIDQKVYEL

SEQ ID NO: 21196 - protein, 8 aa, Artificial Sequence
  Dystonin (1766-1773)
LIDRETMF

SEQ ID NO: 21197 - protein, 10 aa, Artificial Sequence
  Elongation factor 2 (102-111)
LIDSPGHVDF

SEQ ID NO: 21198 - protein, 9 aa, Artificial Sequence
  Ubiquitin-like domain-containing CTD phosphatase 1 (226-234)
LIDVKPLGV

SEQ ID NO: 21199 - protein, 8 aa, Artificial Sequence
  Programmed cell death protein 5 (92-99)
LIEILKKV

SEQ ID NO: 21200 - protein, 8 aa, Artificial Sequence
  Nuclear pore complex protein Nup205 (249-256)
LIGHLERV

SEQ ID NO: 21201 - protein, 24 aa, Artificial Sequence
  Vimentin (443-466)
LIKTVETRDGQVINETSQHHDDLE

SEQ ID NO: 21202 - protein, 10 aa, Artificial Sequence
  Syndetin (107-116)
LILEKQPAYV

SEQ ID NO: 21203 - protein, 9 aa, Artificial Sequence
  Small subunit processome component 20 homolog (1298-1306)
LILPHVPAI

SEQ ID NO: 21204 - protein, 9 aa, Artificial Sequence
  Patatin-like phospholipase domain-containing protein 2 (154-162)
LIPPSLQGV

SEQ ID NO: 21205 - protein, 9 aa, Artificial Sequence
  Histone deacetylase 6 (119-127)
LIQEGLLDR

SEQ ID NO: 21206 - protein, 9 aa, Artificial Sequence
  Membrane-bound transcription factor site-2 protease (165-173)
LISGVVHEI

SEQ ID NO: 21207 - protein, 8 aa, Artificial Sequence
  Asparagine synthetase (glutamine-hydrolyzing) (264-271)
LISKYIRK

SEQ ID NO: 21208 - protein, 11 aa, Artificial Sequence
  Histone H4 (19-29)
LIYEETRGVLK

SEQ ID NO: 21209 - protein, 11 aa, Artificial Sequence
  Endoplasmic reticulum-Golgi intermediate compartment protein 3 (328-338)
LIYHSARAIQK

SEQ ID NO: 21210 - protein, 10 aa, Artificial Sequence
  Zinc finger protein 638 (6-15)
LKALNSNSIY

SEQ ID NO: 21211 - protein, 8 aa, Artificial Sequence
  Protein FAM171B (21-28)
LKARLVPA

SEQ ID NO: 21212 - protein, 11 aa, Artificial Sequence
  E3 ubiquitin-protein ligase UHRF1 (701-711)
LKDRPASGSPF

SEQ ID NO: 21213 - protein, 7 aa, Artificial Sequence
  Putative RNA exonuclease NEF-sp (343-349)
LKFLAKV

SEQ ID NO: 21214 - protein, 13 aa, Artificial Sequence
  Triosephosphate isomerase (155-167)
LKPEFVDIINAKQ

SEQ ID NO: 21215 - protein, 14 aa, Artificial Sequence
  Transmembrane protein 181 (194-207)
LKPIQILSNPLSTY

SEQ ID NO: 21216 - protein, 8 aa, Artificial Sequence
  Clathrin light chain A (223-230)
LKQAPLVH

SEQ ID NO: 21217 - protein, 8 aa, Artificial Sequence
  Eukaryotic translation initiation factor 4 gamma 1 (786-793)
LKVPTTEK

SEQ ID NO: 21218 - protein, 10 aa, Artificial Sequence
  T-complex protein 1 subunit eta (12-21)
LLAAEFLKQV

SEQ ID NO: 21219 - protein, 11 aa, Artificial Sequence
  E3 ubiquitin-protein ligase UBR4 (195-205)
LLAAGSQLDTV

SEQ ID NO: 21220 - protein, 9 aa, Artificial Sequence
  Torsin-1B (16-24)
LLAARVVAA

SEQ ID NO: 21221 - protein, 9 aa, Artificial Sequence
  Vacuolar protein sorting-associated protein 18 homolog (338-346)
LLADRVEAV

SEQ ID NO: 21222 - protein, 9 aa, Artificial Sequence
  Protein zyg-11 homolog B (139-147)
LLADVTHLL

SEQ ID NO: 21223 - protein, 9 aa, Artificial Sequence
  Tumor suppressor candidate 3 (48-56)
LLAEKVEQL

SEQ ID NO: 21224 - protein, 12 aa, Artificial Sequence
  Sulfhydryl oxidase 1 (651-662)
LLAESRAEKNRL

SEQ ID NO: 21225 - protein, 11 aa, Artificial Sequence
  Poly (ADP-ribose) polymerase 10 (465-475)
LLAGLGDVALL

SEQ ID NO: 21226 - protein, 9 aa, Artificial Sequence
  General transcription factor IIH subunit 3 (91-99)
LLAGSLAKA

SEQ ID NO: 21227 - protein, 9 aa, Artificial Sequence
  E3 ubiquitin-protein ligase MARCH6 (678-686)
LLAGVVPLL

SEQ ID NO: 21228 - protein, 10 aa, Artificial Sequence
  DNA-directed RNA polymerases I, II, and III subunit RPABC5 (49-58)
LLAHVDLIEK

SEQ ID NO: 21229 - protein, 25 aa, Artificial Sequence
  RWD domain-containing protein 1 (86-110)
LLALQAEENLGMVMIFTLVTAVQEK

SEQ ID NO: 21230 - protein, 9 aa, Artificial Sequence
  N-terminal kinase-like protein (58-66)
LLAPKLNEA

SEQ ID NO: 21231 - protein, 9 aa, Artificial Sequence
  Actin-binding protein anillin (610-618)
LLAPLAQTV

SEQ ID NO: 21232 - protein, 9 aa, Artificial Sequence
  Transmembrane and coiled-coil domain-containing protein 3 (411-419)
LLAPVLWRA

SEQ ID NO: 21233 - protein, 8 aa, Artificial Sequence
  Receptor-interacting serine/threonine-protein kinase 4 (150-157)
LLDAHYHV

SEQ ID NO: 21234 - protein, 9 aa, Artificial Sequence
  Brefeldin A-inhibited guanine nucleotide-exchange protein 1 (1477-1485)
LLDDIFAQL

SEQ ID NO: 21235 - protein, 11 aa, Artificial Sequence
  ETS translocation variant 1 (241-251)
LLDDPSNSHFI

SEQ ID NO: 21236 - protein, 10 aa, Artificial Sequence
  Contactin-associated protein-like 4 (266-275)
LLDDQHWHSV

SEQ ID NO: 21237 - protein, 9 aa, Artificial Sequence
  Protein FAM179B (402-410)
LLDDSNFKV

SEQ ID NO: 21238 - protein, 8 aa, Artificial Sequence
  von Willebrand factor A domain-containing protein 8 (512-519)
LLDGIHRV

SEQ ID NO: 21239 - protein, 9 aa, Artificial Sequence
  Leucine-rich repeat-containing protein 40 (571-579)
LLDGNPFRV

SEQ ID NO: 21240 - protein, 8 aa, Artificial Sequence
  Uridine-cytidine kinase-like 1 (454-461)
LLDHDVPE

SEQ ID NO: 21241 - protein, 9 aa, Artificial Sequence
  Armadillo repeat protein deleted in velo-cardio-facial syndrome (408-416)
LLDHPRAEV

SEQ ID NO: 21242 - protein, 9 aa, Artificial Sequence
  Integrator complex subunit 8 (617-625)
LLDIHTHEA

SEQ ID NO: 21243 - protein, 9 aa, Artificial Sequence
  RNA-binding protein 20 (68-76)
LLDKNPFSV

SEQ ID NO: 21244 - protein, 8 aa, Artificial Sequence
  Small subunit processome component 20 homolog (300-307)
LLDLHTKV

SEQ ID NO: 21245 - protein, 9 aa, Artificial Sequence
  AP-1 complex subunit beta-1 (395-403)
LLDLIQTKV

SEQ ID NO: 21246 - protein, 9 aa, Artificial Sequence
  ERI1 exoribonuclease 3 (155-163)
LLDPNVKSI

SEQ ID NO: 21247 - protein, 10 aa, Artificial Sequence
  DDB1- and CUL4-associated factor 16 (80-89)
LLDPSTPVHI

SEQ ID NO: 21248 - protein, 8 aa, Artificial Sequence
  Coiled-coil domain-containing protein 180 (707-714)
LLDQLRQQ

SEQ ID NO: 21249 - protein, 7 aa, Artificial Sequence
  Protein Bop (113-119)
LLDRFLA

SEQ ID NO: 21250 - protein, 8 aa, Artificial Sequence
  Nuclear pore complex protein Nup205 (319-326)
LLDRIVSV

SEQ ID NO: 21251 - protein, 10 aa, Artificial Sequence
  Plexin-B3 (450-459)
LLDSSGSHLY

SEQ ID NO: 21252 - protein, 9 aa, Artificial Sequence
  Protein PML (195-203)
LLDSSHSEL

SEQ ID NO: 21253 - protein, 11 aa, Artificial Sequence
  Asparagine synthetase (glutamine-hydrolyzing) (42-52)
LLDTANKKVFL

SEQ ID NO: 21254 - protein, 8 aa, Artificial Sequence
  Myosin-10 (265-272)
LLEKSRAV

SEQ ID NO: 21255 - protein, 10 aa, Artificial Sequence
  Serine/threonine-protein kinase Kist (127-136)
LLEMFSGMKL

SEQ ID NO: 21256 - protein, 10 aa, Artificial Sequence
  Serine/threonine-protein kinase MRCK gamma (979-988)
LLFDAPDLRL

SEQ ID NO: 21257 - protein, 9 aa, Artificial Sequence
  Cartilage-associated protein (322-330)
LLFDQNDKV

SEQ ID NO: 21258 - protein, 13 aa, Artificial Sequence
  Protein wntless homolog (297-309)
LLFGDIRQGIFYA

SEQ ID NO: 21259 - protein, 9 aa, Artificial Sequence
  Cytoplasmic dynein 2 heavy chain 1 (138-146)
LLFGDLLRV

SEQ ID NO: 21260 - protein, 10 aa, Artificial Sequence
  Protein YIF1B (224-233)
LLFGKIGYYL

SEQ ID NO: 21261 - protein, 9 aa, Artificial Sequence
  Probable palmitoyltransferase ZDHHC24 (214-222)
LLFHGMLLL

SEQ ID NO: 21262 - protein, 9 aa, Artificial Sequence
  Kelch-like protein 5 (518-526)
LLGDKLYAV

SEQ ID NO: 21263 - protein, 9 aa, Artificial Sequence
  E3 ubiquitin-protein ligase RNF213 (957-965)
LLGDMEWRL

SEQ ID NO: 21264 - protein, 8 aa, Artificial Sequence
  Receptor-type tyrosine-protein phosphatase T (1084-1091)
LLGFVRQV

SEQ ID NO: 21265 - protein, 11 aa, Artificial Sequence
  Neurosecretory protein VGF (286-296)
LLGGSEAGERL

SEQ ID NO: 21266 - protein, 8 aa, Artificial Sequence
  MAU2 chromatid cohesion factor homolog (357-364)
LLGHIFYV

SEQ ID NO: 21267 - protein, 8 aa, Artificial Sequence
  Polypeptide N-acetylgalactosaminyltransferase 2 (186-193)
LLGKIEKV

SEQ ID NO: 21268 - protein, 8 aa, Artificial Sequence
  Spectrin alpha chain, non-erythrocytic 1 (418-425)
LLGSAHEV

SEQ ID NO: 21269 - protein, 10 aa, Artificial Sequence
  Zinc finger X-linked protein ZXDA (257-266)
LLGSGPGVVL

SEQ ID NO: 21270 - protein, 10 aa, Artificial Sequence
  CUB and sushi domain-containing protein 1 (2833-2842)
LLGSSALTCM

SEQ ID NO: 21271 - protein, 9 aa, Artificial Sequence
  Protein virilizer homolog (786-794)
LLGTLHNLY

SEQ ID NO: 21272 - protein, 9 aa, Artificial Sequence
  Zinc transporter ZIP1 (215-223)
LLHKGILAV

SEQ ID NO: 21273 - protein, 11 aa, Artificial Sequence
  Catenin beta-1 (263-273)
LLHQEGAKMAV

SEQ ID NO: 21274 - protein, 9 aa, Artificial Sequence
  Actin-binding protein anillin (773-781)
LLIDELNKL

SEQ ID NO: 21275 - protein, 16 aa, Artificial Sequence
  Tastin (465-480)
LLIGLAVGGGGGEDST

SEQ ID NO: 21276 - protein, 9 aa, Artificial Sequence
  Mitochondrial dynamics protein MID49 (418-426)
LLIGSLEQA

SEQ ID NO: 21277 - protein, 25 aa, Artificial Sequence
  Vimentin (276-300)
LLIKTVETRDGQVINETSQHHDDLE

SEQ ID NO: 21278 - protein, 9 aa, Artificial Sequence
  Histone deacetylase 9 (93-101)
LLIQQQQQI

SEQ ID NO: 21279 - protein, 10 aa, Artificial Sequence
  Dolichyl-diphosphooligosaccharide-proteinosyltransferase 48 kDa subunit (180-189)
LLKAPTIVGK

SEQ ID NO: 21280 - protein, 9 aa, Artificial Sequence
  Protein FAM171B (20-28)
LLKARLVPA

SEQ ID NO: 21281 - protein, 8 aa, Artificial Sequence
  Melanoma-associated antigen 10 (311-318)
LLKFLAKV

SEQ ID NO: 21282 - protein, 9 aa, Artificial Sequence
  Protein TANC1 (360-368)
LLKPLLFEV

SEQ ID NO: 21283 - protein, 8 aa, Artificial Sequence
  Asparagine synthetase (glutamine-hydrolyzing) (187-194)
LLKQLKEA

SEQ ID NO: 21284 - protein, 11 aa, Artificial Sequence
  Transmembrane protein 132B (372-382)
LLKSGGPDAFT

SEQ ID NO: 21285 - protein, 13 aa, Artificial Sequence
  BAH and coiled-coil domain-containing protein 1 (636-648)
LLKYSSQALVVGQ

SEQ ID NO: 21286 - protein, 10 aa, Artificial Sequence
  Procollagen-lysine,2-oxoglutarate 5-dioxygenase 3 (319-328)
LLLDYPPDRV

SEQ ID NO: 21287 - protein, 12 aa, Artificial Sequence
  Procollagen-lysine,2-oxoglutarate 5-dioxygenase 3 (319-330)
LLLDYPPDRVTL

SEQ ID NO: 21288 - protein, 8 aa, Artificial Sequence
  Mediator of RNA polymerase II transcription subunit 12 (988-995)
LLLEDLIR

SEQ ID NO: 21289 - protein, 9 aa, Artificial Sequence
  Mediator of RNA polymerase II transcription subunit 12 (988-996)
LLLEDLIRC

SEQ ID NO: 21290 - protein, 9 aa, Artificial Sequence
  Myosin phosphatase Rho-interacting protein (997-1005)
LLLEKTQEL

SEQ ID NO: 21291 - protein, 21 aa, Artificial Sequence
  Fatty acid synthase (81-101)
LLLEVTYEAIVDGGINPDSLR

SEQ ID NO: 21292 - protein, 15 aa, Artificial Sequence
  Ephrin type-B receptor 3 (28-42)
LLLLPAGCRALEETL

SEQ ID NO: 21293 - protein, 9 aa, Artificial Sequence
  TBC1 domain family member 9 (215-223)
LLLPDVIKV

SEQ ID NO: 21294 - protein, 9 aa, Artificial Sequence
  Lysosomal thioesterase PPT2 (16-24)
LLLPFLPLL

SEQ ID NO: 21295 - protein, 9 aa, Artificial Sequence
  Tartrate-resistant acid phosphatase type 5 (13-21)
LLLPSLADG

SEQ ID NO: 21296 - protein, 9 aa, Artificial Sequence
  Cathepsin K (7-15)
LLLPVVSFA

SEQ ID NO: 21297 - protein, 9 aa, Artificial Sequence
  4F2 cell-surface antigen heavy chain (521-529)
LLLRFPYAA

SEQ ID NO: 21298 - protein, 11 aa, Artificial Sequence
  Glypican-6 (15-25)
LLLSLPAGADV

SEQ ID NO: 21299 - protein, 11 aa, Artificial Sequence
  Tyrosinase (514-524)
LLMEKEDYHSL

SEQ ID NO: 21300 - protein, 9 aa, Artificial Sequence
  Glutamine-tRNA ligase (137-145)
LLMGEARAV

SEQ ID NO: 21301 - protein, 9 aa, Artificial Sequence
  Nucleolar protein 11 (405-413)
LLNAILHSA

SEQ ID NO: 21302 - protein, 11 aa, Artificial Sequence
  Eukaryotic translation initiation factor 4 gamma 1 (363-373)
LLNGAPSPPAV

SEQ ID NO: 21303 - protein, 9 aa, Artificial Sequence
  Plexin-B3 (1376-1384)
LLNSKLFLL

SEQ ID NO: 21304 - protein, 9 aa, Artificial Sequence
  E3 ubiquitin-protein ligase CBL (87-95)
LLPDTYQHL

SEQ ID NO: 21305 - protein, 9 aa, Artificial Sequence
  F-box only protein 46 (301-309)
LLPEHVLVK

SEQ ID NO: 21306 - protein, 11 aa, Artificial Sequence
  Fibronectin isoform 6 (1328-1338)
LLPGTEYVVSV

SEQ ID NO: 21307 - protein, 9 aa, Artificial Sequence
  Fibronectin type III domain-containing protein 3B (282-290)
LLPGTVYRF

SEQ ID NO: 21308 - protein, 9 aa, Artificial Sequence
  Transportin-2 (391-399)
LLPHLLPLL

SEQ ID NO: 21309 - protein, 9 aa, Artificial Sequence
  Atlastin-3 (264-272)
LLPHPGLQV

SEQ ID NO: 21310 - protein, 9 aa, Artificial Sequence
  Probable E3 SUMO-protein ligase RNF212 (145-153)
LLPPHSSAP

SEQ ID NO: 21311 - protein, 9 aa, Artificial Sequence
  Matrix metalloproteinase-17 (588-596)
LLPPLSPGA

SEQ ID NO: 21312 - protein, 9 aa, Artificial Sequence
  Astrotactin-2 (41-49)
LLPPPPLLA

SEQ ID NO: 21313 - protein, 9 aa, Artificial Sequence
  Serine/threonine-protein kinase 32A (347-355)
LLQEHLDSV

SEQ ID NO: 21314 - protein, 14 aa, Artificial Sequence
  Adhesion G-protein coupled receptor F3 (210-223)
LLQPGTQVSVTSSH

SEQ ID NO: 21315 - protein, 10 aa, Artificial Sequence
  Interleukin-24 (91-100)
LLQQEVLQNV

SEQ ID NO: 21316 - protein, 9 aa, Artificial Sequence
  Oxysterol-binding protein-related protein 10 (231-239)
LLQQSVHQA

SEQ ID NO: 21317 - protein, 9 aa, Artificial Sequence
  Nodal modulator 3 (688-696)
LLRDGENYV

SEQ ID NO: 21318 - protein, 7 aa, Artificial Sequence
  Serine/threonine-protein phosphatase PP1-beta catalytic subunit (71-77)
LLRLFEY

SEQ ID NO: 21319 - protein, 9 aa, Artificial Sequence
  Sorting nexin-10 (27-35)
LLSDSSLHL

SEQ ID NO: 21320 - protein, 9 aa, Artificial Sequence
  Brefeldin A-inhibited guanine nucleotide-exchange protein 2 (1424-1432)
LLSDVFAQL

SEQ ID NO: 21321 - protein, 9 aa, Artificial Sequence
  BTB/POZ domain-containing protein 1 (67-75)
LLSDVRFVL

SEQ ID NO: 21322 - protein, 9 aa, Artificial Sequence
  Spermatogenesis-associated protein 20 (129-137)
LLSEDFVSV

SEQ ID NO: 21323 - protein, 9 aa, Artificial Sequence
  Mediator of RNA polymerase II transcription subunit 13 (188-196)
LLSEEHITL

SEQ ID NO: 21324 - protein, 9 aa, Artificial Sequence
  Synemin (707-715)
LLSKDIKEV

SEQ ID NO: 21325 - protein, 12 aa, Artificial Sequence
  Plexin-B3 (33-44)
LLSPPPLPLTGA

SEQ ID NO: 21326 - protein, 9 aa, Artificial Sequence
  Nuclear pore complex protein Nup88 (115-123)
LLSPTQHHV

SEQ ID NO: 21327 - protein, 9 aa, Artificial Sequence
  Fanconi anemia group D2 protein (1110-1118)
LLSQSVHYL

SEQ ID NO: 21328 - protein, 8 aa, Artificial Sequence
  Regulatory-associated protein of mTOR (224-231)
LLSQVHRL

SEQ ID NO: 21329 - protein, 10 aa, Artificial Sequence
  Muskelin (78-87)
LLSSGLKNDY

SEQ ID NO: 21330 - protein, 8 aa, Artificial Sequence
  Ras GTPase-activating-like protein IQGAP2 (416-423)
LLSVKLEV

SEQ ID NO: 21331 - protein, 9 aa, Artificial Sequence
  Mediator of RNA polymerase II transcription subunit 13 (1410-1418)
LLTDGIMRV

SEQ ID NO: 21332 - protein, 9 aa, Artificial Sequence
  T-complex protein 1 subunit zeta-2 (471-479)
LLVDEIMRA

SEQ ID NO: 21333 - protein, 11 aa, Artificial Sequence
  Nuclear factor of activated T-cells, cytoplasmic 2 (115-125)
LLVEQPPLAGV

SEQ ID NO: 21334 - protein, 11 aa, Artificial Sequence
  Ankyrin repeat and KH domain-containing protein 1 (1008-1018)
LLVQEPDGLMV

SEQ ID NO: 21335 - protein, 9 aa, Artificial Sequence
  Structure-specific endonuclease subunit SLX1 (242-250)
LLWGDLIWL

SEQ ID NO: 21336 - protein, 9 aa, Artificial Sequence
  Interleukin-24 (41-49)
LLWSQVSGA

SEQ ID NO: 21337 - protein, 11 aa, Artificial Sequence
  Interleukin-24 (41-51)
LLWSQVSGAQG

SEQ ID NO: 21338 - protein, 9 aa, Artificial Sequence
  Glutamate receptor ionotropic, kainate 3 (325-333)
LLYDAVHIV

SEQ ID NO: 21339 - protein, 11 aa, Artificial Sequence
  AT-rich interactive domain-containing protein 1A (1336-1346)
LLYDDNSIMTF

SEQ ID NO: 21340 - protein, 10 aa, Artificial Sequence
  Intron-binding protein aquarius (152-161)
LLYDFQLINV

SEQ ID NO: 21341 - protein, 9 aa, Artificial Sequence
  Nicastrin (501-509)
LLYGFLIKA

SEQ ID NO: 21342 - protein, 10 aa, Artificial Sequence
  Adenosine 3'-phospho 5'-phosphosulfate transporter 1 (251-260)
LLYGHTVTVV

SEQ ID NO: 21343 - protein, 10 aa, Artificial Sequence
  DNA-dependent protein kinase catalytic subunit (421-430)
LLYLDTVPEV

SEQ ID NO: 21344 - protein, 9 aa, Artificial Sequence
  Unconventional myosin-Ib (533-541)
LLYRDLSQA

SEQ ID NO: 21345 - protein, 9 aa, Artificial Sequence
  Nuclear pore complex protein Nup85 (266-274)
LLYSNPTVK

SEQ ID NO: 21346 - protein, 10 aa, Artificial Sequence
  Microtubule-actin cross-linking factor 1, isoforms 1/2/3/5 (794-803)
LMDEKLLHNV

SEQ ID NO: 21347 - protein, 10 aa, Artificial Sequence
  Tyrosinase (515-524)
LMEKEDYHSL

SEQ ID NO: 21348 - protein, 11 aa, Artificial Sequence
  Tyrosinase (515-525)
LMEKEDYHSLY

SEQ ID NO: 21349 - protein, 8 aa, Artificial Sequence
  Leucine-tRNA ligase, cytoplasmic (211-218)
LMEVTHDL

SEQ ID NO: 21350 - protein, 8 aa, Artificial Sequence
  Dynein light chain roadblock-type 1 (52-59)
LMHSFILK

SEQ ID NO: 21351 - protein, 10 aa, Artificial Sequence
  T-complex protein 1 subunit beta (159-168)
LMNIAGTTLS

SEQ ID NO: 21352 - protein, 8 aa, Artificial Sequence
  Phosphatidylinositol 5-phosphate 4-kinase type-2 beta (66-73)
LMPDDFKA

SEQ ID NO: 21353 - protein, 9 aa, Artificial Sequence
  Folliculin-interacting protein 1 (804-812)
LMSDLSHAV

SEQ ID NO: 21354 - protein, 9 aa, Artificial Sequence
  Constitutive coactivator of PPAR-gamma-like protein 2 (619-627)
LMYPYIYHV

SEQ ID NO: 21355 - protein, 9 aa, Artificial Sequence
  Sodium channel protein type 5 subunit alpha (1513-1521)
LNKYQGFIF

SEQ ID NO: 21356 - protein, 6 aa, Artificial Sequence
  Heterogeneous nuclear ribonucleoprotein K (133-138)
LNYQHY

SEQ ID NO: 21357 - protein, 8 aa, Artificial Sequence
  Tropomodulin-2 (46-53)
LPAGFRQK

SEQ ID NO: 21358 - protein, 7 aa, Artificial Sequence
  Probable ATP-dependent RNA helicase DDX5 (150-156)
LPAIVHI

SEQ ID NO: 21359 - protein, 11 aa, Artificial Sequence
  Basement membrane-specific heparan sulfate proteoglycan core protein (1907-1917)
LPAKAQIHGGI

SEQ ID NO: 21360 - protein, 8 aa, Artificial Sequence
  UV excision repair protein RAD23 homolog B (278-285)
LPALLQQI

SEQ ID NO: 21361 - protein, 9 aa, Artificial Sequence
  Potassium/sodium hyperpolarization-activated cyclic nucleotide-gated channel 3 (671-679)
LPAPPARTL

SEQ ID NO: 21362 - protein, 10 aa, Artificial Sequence
  AT-hook-containing transcription factor (393-402)
LPAPSGQAPM

SEQ ID NO: 21363 - protein, 10 aa, Artificial Sequence
  Lysosome-associated membraneoprotein 1 (249-258)
LPDARDPAFK

SEQ ID NO: 21364 - protein, 16 aa, Artificial Sequence
  Legumain (198-213)
LPDNINVYATTAANPR

SEQ ID NO: 21365 - protein, 8 aa, Artificial Sequence
  Serine/threonine-protein kinase ULK3 (109-116)
LPEKVARV

SEQ ID NO: 21366 - protein, 8 aa, Artificial Sequence
  Solute carrier family 23 member 2 (603-610)
LPFGMNII

SEQ ID NO: 21367 - protein, 12 aa, Artificial Sequence
  Retinoic acid receptor RXR-beta (168-179)
LPGGGSGPPEDV

SEQ ID NO: 21368 - protein, 15 aa, Artificial Sequence
  Mucin-19 (5182-5196)
LPGVSAGLTGTIGSP

SEQ ID NO: 21369 - protein, 9 aa, Artificial Sequence
  (Pyruvate dehydrogenase (acetyl-transferring))-phosphatase 1, mitochondrial (168-176)
LPHETLLEI

SEQ ID NO: 21370 - protein, 8 aa, Artificial Sequence
  Transportin-1 (395-402)
LPHILPLL

SEQ ID NO: 21371 - protein, 9 aa, Artificial Sequence
  Phosphatidylcholine translocator ABCB4 (1167-1175)
LPHKYETRV

SEQ ID NO: 21372 - protein, 9 aa, Artificial Sequence
  HMG domain-containing protein 3 (213-221)
LPHLPQSEI

SEQ ID NO: 21373 - protein, 9 aa, Artificial Sequence
  Low-density lipoprotein receptor-related protein 2 (704-712)
LPHPFAITI

SEQ ID NO: 21374 - protein, 8 aa, Artificial Sequence
  Melanophilin (392-399)
LPIFLPRV

SEQ ID NO: 21375 - protein, 15 aa, Artificial Sequence
  Collagen alpha-1(I) chain (1013-1027)
LPIIDVAPLDVGAPD

SEQ ID NO: 21376 - protein, 9 aa, Artificial Sequence
  Coatomer subunit gamma-1 (712-720)
LPKEDPTAV

SEQ ID NO: 21377 - protein, 9 aa, Artificial Sequence
  Tight junction protein ZO-1 (478-486)
LPKGEEVTI

SEQ ID NO: 21378 - protein, 8 aa, Artificial Sequence
  40S ribosomal protein S26 (64-71)
LPKLYVKL

SEQ ID NO: 21379 - protein, 9 aa, Artificial Sequence
  Interferon alpha-inducible protein 27, mitochondrial (28-36)
LPLARIATV

SEQ ID NO: 21380 - protein, 9 aa, Artificial Sequence
  Receptor tyrosine-protein kinase erbB-3 (97-105)
LPLPNLRVV

SEQ ID NO: 21381 - protein, 9 aa, Artificial Sequence
  Ubiquitin domain-containing protein UBFD1 (251-259)
LPMGSIKNV

SEQ ID NO: 21382 - protein, 9 aa, Artificial Sequence
  Ras-related protein Rab-38 (114-122)
LPNGKPVSV

SEQ ID NO: 21383 - protein, 9 aa, Artificial Sequence
  Transcriptional regulator Kaiso (298-306)
LPNHMPSSI

SEQ ID NO: 21384 - protein, 9 aa, Artificial Sequence
  Bromodomain-containing protein 4 (958-966)
LPPPPHPSV

SEQ ID NO: 21385 - protein, 9 aa, Artificial Sequence
  Shootin-1 (302-310)
LPPPPPNPI

SEQ ID NO: 21386 - protein, 8 aa, Artificial Sequence
  Nicotinamide phosphoribosyltransferase (344-351)
LPPYLRVI

SEQ ID NO: 21387 - protein, 9 aa, Artificial Sequence
  Kinase D-interacting substrate of 220 kDa (104-112)
LPRDQNNGL

SEQ ID NO: 21388 - protein, 9 aa, Artificial Sequence
  Cap-specific mRNAucleoside-2'-O-)-methyltransferase 1 (631-639)
LPRDTLLSV

SEQ ID NO: 21389 - protein, 10 aa, Artificial Sequence
  Serine/threonine-protein kinase 32A (171-180)
LPRETQITTM

SEQ ID NO: 21390 - protein, 10 aa, Artificial Sequence
  Ubiquitin-associated protein 1 (236-245)
LPRGGSGSVL

SEQ ID NO: 21391 - protein, 9 aa, Artificial Sequence
  Intercellular adhesion molecule 1 (16-24)
LPRGGSVLV

SEQ ID NO: 21392 - protein, 9 aa, Artificial Sequence
  Ropporin-1B (153-161)
LPRIPFSTF

SEQ ID NO: 21393 - protein, 9 aa, Artificial Sequence
  LIM domain and actin-binding protein 1 (161-169)
LPRLSETSI

SEQ ID NO: 21394 - protein, 9 aa, Artificial Sequence
  Apolipoprotein L1 (85-93)
LPRNEADEL

SEQ ID NO: 21395 - protein, 9 aa, Artificial Sequence
  E3 ubiquitin-protein ligase TRIP12 (518-526)
LPRSSAVVV

SEQ ID NO: 21396 - protein, 9 aa, Artificial Sequence
  Periaxin (1315-1323)
LPRVGLAAP

SEQ ID NO: 21397 - protein, 8 aa, Artificial Sequence
  SET domain-containing protein 5 (1382-1389)
LPSDLRTI

SEQ ID NO: 21398 - protein, 16 aa, Artificial Sequence
  Cathepsin F (337-352)
LPSNAYSAIKNLGGLE

SEQ ID NO: 21399 - protein, 9 aa, Artificial Sequence
  Ropporin-1B (99-107)
LPTDLFNSV

SEQ ID NO: 21400 - protein, 8 aa, Artificial Sequence
  AP-5 complex subunit zeta-1 (154-161)
LPVMAKVV

SEQ ID NO: 21401 - protein, 8 aa, Artificial Sequence
  Rho guanine nucleotide exchange factor 2 (884-891)
LPVTTRSV

SEQ ID NO: 21402 - protein, 8 aa, Artificial Sequence
  Protein O-mannosyl-transferase 1 (538-545)
LPVVLQHI

SEQ ID NO: 21403 - protein, 9 aa, Artificial Sequence
  Histone-lysine N-methyltransferase 2A (1096-1104)
LPWEEREKI

SEQ ID NO: 21404 - protein, 9 aa, Artificial Sequence
  Lathosterol oxidase (84-92)
LPWISILTV

SEQ ID NO: 21405 - protein, 9 aa, Artificial Sequence
  Metallophosphoesterase MPPED2 (106-114)
LPYEYKIVI

SEQ ID NO: 21406 - protein, 8 aa, Artificial Sequence
  Glia-derived nexin (256-263)
LPYHGESI

SEQ ID NO: 21407 - protein, 10 aa, Artificial Sequence
  Glia-derived nexin (256-265)
LPYHGESISM

SEQ ID NO: 21408 - protein, 8 aa, Artificial Sequence
  Neurofibromin (488-495)
LPYLFHVV

SEQ ID NO: 21409 - protein, 10 aa, Artificial Sequence
  NAD-dependent protein deacetylase sirtuin-2 (95-104)
LPYPEAIFEI

SEQ ID NO: 21410 - protein, 10 aa, Artificial Sequence
  NAD-dependent protein deacetylase sirtuin-3, mitochondrial (173-182)
LPYPEAIFEL

SEQ ID NO: 21411 - protein, 9 aa, Artificial Sequence
  CDK5 and ABL1 enzyme substrate 1 (27-35)
LPYRDSTQV

SEQ ID NO: 21412 - protein, 8 aa, Artificial Sequence
  Serpin B6 (104-111)
LPYVGKEL

SEQ ID NO: 21413 - protein, 11 aa, Artificial Sequence
  Guanine nucleotide exchange factor VAV3 (680-690)
LQAETELINRV

SEQ ID NO: 21414 - protein, 9 aa, Artificial Sequence
  Peroxisome proliferator-activated receptor gamma coactivator-related protein 1 (1097-1105)
LQAPELANV

SEQ ID NO: 21415 - protein, 12 aa, Artificial Sequence
  Zinc finger homeobox protein 2 (544-555)
LQGFQAGPGGQG

SEQ ID NO: 21416 - protein, 16 aa, Artificial Sequence
  Proline-rich transmembrane protein 3 (172-187)
LQHEGQEGQWPPRDEG

SEQ ID NO: 21417 - protein, 24 aa, Artificial Sequence
  Plectin (387-410)
LQMEAGLCEEQLNQADALLQSDVR

SEQ ID NO: 21418 - protein, 11 aa, Artificial Sequence
  T-complex protein 1 subunit gamma (268-278)
LQMEEEYIQQL

SEQ ID NO: 21419 - protein, 14 aa, Artificial Sequence
  Glyceraldehyde-3-phosphate dehydrogenase (203-216)
LQNIIPASTGAAKA

SEQ ID NO: 21420 - protein, 9 aa, Artificial Sequence
  Ubiquitin carboxyl-terminal hydrolase 22 (305-313)
LQSDVTCQV

SEQ ID NO: 21421 - protein, 8 aa, Artificial Sequence
  Titin (123-130)
LQVRVTGI

SEQ ID NO: 21422 - protein, 18 aa, Artificial Sequence
  Collagen alpha-1(VI) chain (694-711)
LQWMAGGTFTGEALQYTR

SEQ ID NO: 21423 - protein, 8 aa, Artificial Sequence
  Interferon regulatory factor 2-binding protein 1 (301-308)
LREPGKAL

SEQ ID NO: 21424 - protein, 11 aa, Artificial Sequence
  Disintegrin and metalloproteinase domain-containing protein 10 (60-70)
LRLDFHAHGRH

SEQ ID NO: 21425 - protein, 10 aa, Artificial Sequence
  Keratin, type I cytoskeletal 10 (294-303)
LRNVSTGDVN

SEQ ID NO: 21426 - protein, 11 aa, Artificial Sequence
  Casein kinase II subunit alpha (305-315)
LRYDHQSRLTA

SEQ ID NO: 21427 - protein, 13 aa, Artificial Sequence
  SKI family transcriptional corepressor 2 (329-341)
LSAAAASLSVAAA

SEQ ID NO: 21428 - protein, 9 aa, Artificial Sequence
  DNA-binding protein RFX7 (64-72)
LSAADFGKI

SEQ ID NO: 21429 - protein, 19 aa, Artificial Sequence
  Heterogeneous nuclear ribonucleoprotein U (186-204)
LSASSLTMESFAFLWAGGR

SEQ ID NO: 21430 - protein, 9 aa, Artificial Sequence
  Unconventional myosin-Ib (87-95)
LSDEAYRSL

SEQ ID NO: 21431 - protein, 9 aa, Artificial Sequence
  Leucine-tRNA ligase, cytoplasmic (166-174)
LSDEEIVKF

SEQ ID NO: 21432 - protein, 9 aa, Artificial Sequence
  1-phosphatidylinositol 4,5-bisphosphate phosphodiesterase beta-4 (725-733)
LSDKKIGTY

SEQ ID NO: 21433 - protein, 9 aa, Artificial Sequence
  CCAAT/enhancer-binding protein beta (118-126)
LSDLFSDDY

SEQ ID NO: 21434 - protein, 9 aa, Artificial Sequence
  Ras association domain-containing protein 3 (88-96)
LSDREHPLY

SEQ ID NO: 21435 - protein, 9 aa, Artificial Sequence
  Plexin-D1 (920-928)
LSDVAHGVW

SEQ ID NO: 21436 - protein, 9 aa, Artificial Sequence
  Melanoma antigen preferentially expressed in tumors (334-342)
LSEGDVMHL

SEQ ID NO: 21437 - protein, 9 aa, Artificial Sequence
  Putative pre-mRNA-splicing factor ATP-dependent RNA helicase DHX16 (506-514)
LSEPDLASY

SEQ ID NO: 21438 - protein, 7 aa, Artificial Sequence
  Hemoglobin subunit alpha (6-12)
LSFPTTK

SEQ ID NO: 21439 - protein, 9 aa, Artificial Sequence
  Hemoglobin subunit alpha (6-14)
LSFPTTKTY

SEQ ID NO: 21440 - protein, 9 aa, Artificial Sequence
  Sister chromatid cohesion protein PDS5 homolog B (656-664)
LSFTHPISF

SEQ ID NO: 21441 - protein, 10 aa, Artificial Sequence
  Zinc transporter ZIP12 (31-40)
LSGDALLHLI

SEQ ID NO: 21442 - protein, 10 aa, Artificial Sequence
  Asparagine synthetase (glutamine-hydrolyzing) (174-183)
LSGGLDSSLV

SEQ ID NO: 21443 - protein, 9 aa, Artificial Sequence
  Phosphorylase b kinase regulatory subunit alpha, liver isoform (46-54)
LSGQHGVTV

SEQ ID NO: 21444 - protein, 11 aa, Artificial Sequence
  PCNA-interacting partner (149-159)
LSIPTSPTSKY

SEQ ID NO: 21445 - protein, 8 aa, Artificial Sequence
  Synemin (708-715)
LSKDIKEV

SEQ ID NO: 21446 - protein, 8 aa, Artificial Sequence
  Ryanodine receptor 1 (442-449)
LSLQDLII

SEQ ID NO: 21447 - protein, 11 aa, Artificial Sequence
  Codanin-1 (382-392)
LSNLDKGTLKL

SEQ ID NO: 21448 - protein, 10 aa, Artificial Sequence
  Caprin-2 (108-117)
LSSAASPSQA

SEQ ID NO: 21449 - protein, 19 aa, Artificial Sequence
  Protein unc-13 homolog D (375-393)
LSSGQKDQGQAANMLCVVV

SEQ ID NO: 21450 - protein, 10 aa, Artificial Sequence
  Melanocyte-stimulating hormone receptor (129-138)
LSSLCFLGAI

SEQ ID NO: 21451 - protein, 9 aa, Artificial Sequence
  Protein prune homolog 2 (1282-1290)
LSSPETGKY

SEQ ID NO: 21452 - protein, 9 aa, Artificial Sequence
  Kelch-like protein 12 (386-394)
LSSVEAYNI

SEQ ID NO: 21453 - protein, 12 aa, Artificial Sequence
  AP-2 complex subunit beta (710-721)
LSTGIGMAPGGY

SEQ ID NO: 21454 - protein, 10 aa, Artificial Sequence
  Peroxisome assembly protein 12 (247-256)
LSTGLSVGVF

SEQ ID NO: 21455 - protein, 9 aa, Artificial Sequence
  Amyloid protein-binding protein 2 (472-480)
LSVGHLASL

SEQ ID NO: 21456 - protein, 7 aa, Artificial Sequence
  Serine/threonine-protein kinase mTOR (1960-1966)
LTDIGRY

SEQ ID NO: 21457 - protein, 8 aa, Artificial Sequence
  Tyrosine-protein kinase BAZ1B (894-901)
LTDMKQVF

SEQ ID NO: 21458 - protein, 10 aa, Artificial Sequence
  CDC2L5 protein kinase  (1231-1240)
LTDPHAGVKA

SEQ ID NO: 21459 - protein, 9 aa, Artificial Sequence
  Zinc finger with UFM1-specific peptidase domain protein (139-147)
LTEIKGSVY

SEQ ID NO: 21460 - protein, 8 aa, Artificial Sequence
  Protocadherin-15 (1267-1274)
LTEILDRY

SEQ ID NO: 21461 - protein, 9 aa, Artificial Sequence
  Beta-1-syntrophin (254-262)
LTEKDLLIY

SEQ ID NO: 21462 - protein, 9 aa, Artificial Sequence
  Alpha-1-syntrophin (122-130)
LTEKELLLY

SEQ ID NO: 21463 - protein, 9 aa, Artificial Sequence
  Nucleoprotein TPR (587-595)
LTELEQLRK

SEQ ID NO: 21464 - protein, 9 aa, Artificial Sequence
  Zinc finger MIZ domain-containing protein 1 (470-478)
LTFPVRDGV

SEQ ID NO: 21465 - protein, 16 aa, Artificial Sequence
  Basement membrane-specific heparan sulfate proteoglycan core protein (350-365)
LTGEFTVEPVPEGAQL

SEQ ID NO: 21466 - protein, 8 aa, Artificial Sequence
  Erythrocyte band 7 integral membrane protein (109-116)
LTKDSVTI

SEQ ID NO: 21467 - protein, 9 aa, Artificial Sequence
  CCR4-NOT transcription complex subunit 1 (247-255)
LTKPMQILY

SEQ ID NO: 21468 - protein, 9 aa, Artificial Sequence
  Phenylalanine-tRNA ligase alpha subunit (381-389)
LTLGHLMGV

SEQ ID NO: 21469 - protein, 9 aa, Artificial Sequence
  Plectin (1055-1063)
LTLGKLEQV

SEQ ID NO: 21470 - protein, 27 aa, Artificial Sequence
  POU domain, class 6, transcription factor 2 (131-157)
LTLPTANLTNIQGLVAAAAAGGIMTLP

SEQ ID NO: 21471 - protein, 9 aa, Artificial Sequence
  Cytoplasmic dynein 1 heavy chain 1 (469-477)
LTMEINPKV

SEQ ID NO: 21472 - protein, 10 aa, Artificial Sequence
  Plasma membrane calcium-transporting ATPase 1 (480-489)
LTMNRMTVVQ

SEQ ID NO: 21473 - protein, 12 aa, Artificial Sequence
  Insulin-like growth factor-binding protein complex acid labile subunit (399-410)
LTNVAVMNLSGN

SEQ ID NO: 21474 - protein, 9 aa, Artificial Sequence
  Peroxisomal acyl-coenzyme A oxidase 1 (273-281)
LTYGTMVFV

SEQ ID NO: 21475 - protein, 12 aa, Artificial Sequence
  Potassium/sodium hyperpolarization-activated cyclic nucleotide-gated channel 4 (1006-1017)
LVAGASGGASPV

SEQ ID NO: 21476 - protein, 10 aa, Artificial Sequence
  ER membrane protein complex subunit 7 (68-77)
LVDGEEHVGF

SEQ ID NO: 21477 - protein, 8 aa, Artificial Sequence
  Manganese-transporting ATPase 13A1 (282-289)
LVDIPVEF

SEQ ID NO: 21478 - protein, 9 aa, Artificial Sequence
  Supervillin (1622-1630)
LVDNHHEVY

SEQ ID NO: 21479 - protein, 9 aa, Artificial Sequence
  Aldehyde dehydrogenase family 1 member A3 (106-114)
LVERDRATL

SEQ ID NO: 21480 - protein, 9 aa, Artificial Sequence
  A-kinase anchor protein 11 (654-662)
LVFEGIMEV

SEQ ID NO: 21481 - protein, 10 aa, Artificial Sequence
  Serum albumin (66-75)
LVNEVTEFAK

SEQ ID NO: 21482 - protein, 8 aa, Artificial Sequence
  Cytochrome c oxidase subunit 5B, mitochondrial (122-129)
LVPQQLAH

SEQ ID NO: 21483 - protein, 10 aa, Artificial Sequence
  Stabilin-2 (1032-1041)
LVPSQQATED

SEQ ID NO: 21484 - protein, 8 aa, Artificial Sequence
  Adenomatous polyposis coli protein 2 (11-18)
LVRQVEAL

SEQ ID NO: 21485 - protein, 16 aa, Artificial Sequence
  60S ribosomal protein L9 (153-168)
LVSNSAALIQQATTVK

SEQ ID NO: 21486 - protein, 11 aa, Artificial Sequence
  Thioredoxin reductase 2, mitochondrial (4-14)
LVVGGGSGGLA

SEQ ID NO: 21487 - protein, 9 aa, Artificial Sequence
  Midasin (3107-3115)
LVVSDGRGL

SEQ ID NO: 21488 - protein, 10 aa, Artificial Sequence
  Kelch-like protein 29 (511-520)
LVYDGKIYTL

SEQ ID NO: 21489 - protein, 9 aa, Artificial Sequence
  Pre-mRNA-processing-splicing factor 8 (405-413)
LWAPRPFNL

SEQ ID NO: 21490 - protein, 9 aa, Artificial Sequence
  Plexin-B3 (1462-1470)
LYAFLREVA

SEQ ID NO: 21491 - protein, 10 aa, Artificial Sequence
  Aldehyde dehydrogenase family 1 member A3 (471-480)
LYAQAPFGGF

SEQ ID NO: 21492 - protein, 9 aa, Artificial Sequence
  DNA-binding protein RFXANK (131-139)
LYAVRGNHV

SEQ ID NO: 21493 - protein, 9 aa, Artificial Sequence
  Asparagine synthetase (glutamine-hydrolyzing) (132-140)
LYDNVEKLF

SEQ ID NO: 21494 - protein, 8 aa, Artificial Sequence
  Mediator of RNA polymerase II transcription subunit 12 (572-579)
LYDQPRHV

SEQ ID NO: 21495 - protein, 8 aa, Artificial Sequence
  Signal recognition particle subunit SRP68 (454-461)
LYDRVLKY

SEQ ID NO: 21496 - protein, 9 aa, Artificial Sequence
  GPI mannosyltransferase 2 (80-88)
LYEHNFAFF

SEQ ID NO: 21497 - protein, 9 aa, Artificial Sequence
  Hemicentin-1 (1595-1603)
LYIDKGQYL

SEQ ID NO: 21498 - protein, 9 aa, Artificial Sequence
  Cleavage and polyadenylation specificity factor subunit 6 (83-91)
LYIGNLTWW

SEQ ID NO: 21499 - protein, 9 aa, Artificial Sequence
  Myotubularin-related protein 12 (484-492)
LYIPIFSTF

SEQ ID NO: 21500 - protein, 9 aa, Artificial Sequence
  Disintegrin and metalloproteinase domain-containing protein 10 (167-175)
LYIQTDHLF

SEQ ID NO: 21501 - protein, 9 aa, Artificial Sequence
  SUN domain-containing ossification factor (723-731)
LYIVEPLKF

SEQ ID NO: 21502 - protein, 10 aa, Artificial Sequence
  Solute carrier family 25 member 34 (267-276)
LYKGLGPAYL

SEQ ID NO: 21503 - protein, 9 aa, Artificial Sequence
  ER membrane protein complex subunit 1 (731-739)
LYKSLNPNL

SEQ ID NO: 21504 - protein, 9 aa, Artificial Sequence
  NTF2-related export protein 2 (39-47)
LYLDKATLI

SEQ ID NO: 21505 - protein, 10 aa, Artificial Sequence
  NTF2-related export protein 2 (39-48)
LYLDKATLIW

SEQ ID NO: 21506 - protein, 9 aa, Artificial Sequence
  SWI/SNF-related matrix-associated actin-dependent regulator of chromatin subfamily A containing DEAD/H box 1 (320-328)
LYLGLFNRL

SEQ ID NO: 21507 - protein, 9 aa, Artificial Sequence
  Protein CLN8 (226-234)
LYLPHLTLF

SEQ ID NO: 21508 - protein, 7 aa, Artificial Sequence
  Mitochondrial carrier homolog 1 (63-69)
LYLPSFF

SEQ ID NO: 21509 - protein, 9 aa, Artificial Sequence
  DnaJ homolog subfamily A member 2 (129-137)
LYNGKTTKL

SEQ ID NO: 21510 - protein, 11 aa, Artificial Sequence
  Melanocyte protein PMEL (55-65)
LYPEWTEAQRL

SEQ ID NO: 21511 - protein, 9 aa, Artificial Sequence
  Protein transport protein Sec23B (560-568)
LYPQFMFHL

SEQ ID NO: 21512 - protein, 9 aa, Artificial Sequence
  Vacuolar protein sorting-associated protein 4A (31-39)
LYQHAVEYF

SEQ ID NO: 21513 - protein, 9 aa, Artificial Sequence
  CCAAT/enhancer-binding protein zeta (212-220)
LYQHEINLF

SEQ ID NO: 21514 - protein, 9 aa, Artificial Sequence
  Engulfment and cell motility protein 2 (207-215)
LYQKIAEEI

SEQ ID NO: 21515 - protein, 8 aa, Artificial Sequence
  E3 ubiquitin-protein ligase UBR5 (1255-1262)
LYRLLTAT

SEQ ID NO: 21516 - protein, 9 aa, Artificial Sequence
  Unconventional myosin-Ib (356-364)
LYSRLFSWL

SEQ ID NO: 21517 - protein, 9 aa, Artificial Sequence
  Ubiquitin-like modifier-activating enzyme 7 (14-22)
LYSRQLYVL

SEQ ID NO: 21518 - protein, 8 aa, Artificial Sequence
  Mitochondrial ubiquitin ligase activator of NFKB 1 (25-32)
LYSVYRQK

SEQ ID NO: 21519 - protein, 9 aa, Artificial Sequence
  Melanoma antigen preferentially expressed in tumors (301-309)
LYVDSLFFL

SEQ ID NO: 21520 - protein, 9 aa, Artificial Sequence
  Beta-galactosidase-1-like protein (586-594)
LYVPRFLLF

SEQ ID NO: 21521 - protein, 8 aa, Artificial Sequence
  40S ribosomal protein S29 (6-13)
LYWSHPRK

SEQ ID NO: 21522 - protein, 13 aa, Artificial Sequence
  Mitogen-activated protein kinase 1 (1-13)
MAAAAAAGAGPEM

SEQ ID NO: 21523 - protein, 9 aa, Artificial Sequence
  B-cell CLL/lymphoma 9-like protein (186-194)
MAAPQLGPG

SEQ ID NO: 21524 - protein, 10 aa, Artificial Sequence
  Glucosylceramidase (21-30)
MAGSLTGLLL

SEQ ID NO: 21525 - protein, 8 aa, Artificial Sequence
  Dystonin (1657-1664)
MAIKVLEI

SEQ ID NO: 21526 - protein, 8 aa, Artificial Sequence
  BRAF (48-55)
MAPEVIRM

SEQ ID NO: 21527 - protein, 8 aa, Artificial Sequence
  HLA class I histocompatibility antigen, alpha chain F (1-8)
MAPRSLLL

SEQ ID NO: 21528 - protein, 8 aa, Artificial Sequence
  HLA class I histocompatibility antigen, B-39 alpha chain (4-11)
MAPRTVLL

SEQ ID NO: 21529 - protein, 16 aa, Artificial Sequence
  Gamma-secretase C-terminal fragment 59 (561-576)
MDAEFRHDSGYEVHHQ

SEQ ID NO: 21530 - protein, 16 aa, Artificial Sequence
  Dihydropyrimidinase-related protein 2 (339-354)
MDENQFVAVTSTNAAK

SEQ ID NO: 21531 - protein, 7 aa, Artificial Sequence
  Insulin receptor substrate 2 (545-551)
MDRPLSH

SEQ ID NO: 21532 - protein, 9 aa, Artificial Sequence
  Receptor-type tyrosine-protein phosphatase gamma (796-804)
MEAIPVKQF

SEQ ID NO: 21533 - protein, 10 aa, Artificial Sequence
  Protein wntless homolog (185-194)
MEIGSVAHKF

SEQ ID NO: 21534 - protein, 9 aa, Artificial Sequence
  Tyrosinase (516-524)
MEKEDYHSL

SEQ ID NO: 21535 - protein, 10 aa, Artificial Sequence
  PRELI domain containing protein 3B (91-100)
MELKSTNISF

SEQ ID NO: 21536 - protein, 10 aa, Artificial Sequence
  Fructose-bisphosphate aldolase A (219-228)
MENANVLARY

SEQ ID NO: 21537 - protein, 10 aa, Artificial Sequence
  Poly(U)-binding-splicing factor PUF60 (74-83)
MEQSIKSVLV

SEQ ID NO: 21538 - protein, 10 aa, Artificial Sequence
  Melanoma-associated antigen 3 (167-176)
MEVDPIGHLY

SEQ ID NO: 21539 - protein, 8 aa, Artificial Sequence
  Synemin (37-44)
MFDKKVQL

SEQ ID NO: 21540 - protein, 6 aa, Artificial Sequence
  Proliferating cell nuclear antigen (244-249)
MGHLKY

SEQ ID NO: 21541 - protein, 20 aa, Artificial Sequence
  Actin, aortic smooth muscle (49-68)
MGQKDSYVGDEAQSKRGILT

SEQ ID NO: 21542 - protein, 8 aa, Artificial Sequence
  Ankyrin-1 (733-740)
MGYTPLHV

SEQ ID NO: 21543 - protein, 7 aa, Artificial Sequence
  Dynein light chain roadblock-type 1 (53-59)
MHSFILK

SEQ ID NO: 21544 - protein, 9 aa, Artificial Sequence
  Glycogen phosphorylase, liver form (619-627)
MIIKLITSV

SEQ ID NO: 21545 - protein, 9 aa, Artificial Sequence
  Phenylalanine-tRNA ligase alpha subunit (465-473)
MIKYGINNI

SEQ ID NO: 21546 - protein, 10 aa, Artificial Sequence
  Malate dehydrogenase, mitochondrial (273-282)
MISDAIPELK

SEQ ID NO: 21547 - protein, 9 aa, Artificial Sequence
  ER membrane protein complex subunit 1 (976-984)
MITKRLAQV

SEQ ID NO: 21548 - protein, 9 aa, Artificial Sequence
  Huntingtin (537-545)
MITTHPALV

SEQ ID NO: 21549 - protein, 9 aa, Artificial Sequence
  EH domain-containing protein 3 (385-393)
MLAHDIAQL

SEQ ID NO: 21550 - protein, 8 aa, Artificial Sequence
  Chondroitin sulfate proteoglycan 4 (22-29)
MLARLASA

SEQ ID NO: 21551 - protein, 11 aa, Artificial Sequence
  COP9 signalosome complex subunit 1 (344-354)
MLDEMKDNLLL

SEQ ID NO: 21552 - protein, 11 aa, Artificial Sequence
  Baculoviral IAP repeat-containing protein 6 (1752-1762)
MLEDEKVTMFL

SEQ ID NO: 21553 - protein, 7 aa, Artificial Sequence
  Spectrin beta chain, non-erythrocytic 4 (2042-2048)
MLEVHQF

SEQ ID NO: 21554 - protein, 9 aa, Artificial Sequence
  Mitotic checkpoint serine/threonine-protein kinase BUB1 (998-1006)
MLFGTYMKV

SEQ ID NO: 21555 - protein, 8 aa, Artificial Sequence
  Collagen alpha-1(XVIII) chain (1454-1461)
MLGQVHEV

SEQ ID NO: 21556 - protein, 9 aa, Artificial Sequence
  Tetratricopeptide repeat protein 28 (1354-1362)
MLIGSDVKL

SEQ ID NO: 21557 - protein, 9 aa, Artificial Sequence
  Phosphatidylinositol 5-phosphate 4-kinase type-2 beta (65-73)
MLMPDDFKA

SEQ ID NO: 21558 - protein, 22 aa, Artificial Sequence
  T-complex protein 1 subunit beta (445-466)
MLPTIIADNAGYDSADLVAQLR

SEQ ID NO: 21559 - protein, 9 aa, Artificial Sequence
  DNA-binding protein SATB2 (142-150)
MLQDVYHVV

SEQ ID NO: 21560 - protein, 58 aa, Artificial Sequence
  6.8 kDa mitochondrial proteolipid (1-58)
MLQSIIKNIWIPMKPYYTKVYQEIWIGMGLMGFIVYKIRAADKRSKALKASAPAPGHH

SEQ ID NO: 21561 - protein, 10 aa, Artificial Sequence
  BTB/POZ domain-containing protein KCTD3 (428-437)
MLSEKHLVSV

SEQ ID NO: 21562 - protein, 9 aa, Artificial Sequence
  Death-associated protein kinase 1 (763-771)
MMFEPGLTK

SEQ ID NO: 21563 - protein, 9 aa, Artificial Sequence
  RB1-inducible coiled-coil protein 1 (107-115)
MMPAVFHTV

SEQ ID NO: 21564 - protein, 16 aa, Artificial Sequence
  Exostosin-like 1 (589-604)
MNFIVAAVTKLPPIKV

SEQ ID NO: 21565 - protein, 9 aa, Artificial Sequence
  Sodium/potassium/calcium exchanger 5 (298-306)
MPEADLKRI

SEQ ID NO: 21566 - protein, 8 aa, Artificial Sequence
  Filamin-B (1129-1136)
MPFDPSKV

SEQ ID NO: 21567 - protein, 23 aa, Artificial Sequence
  Heat shock cognate 71 kDa protein (621-643)
MPGGFPGGGAPPSGGASSGPTIE

SEQ ID NO: 21568 - protein, 9 aa, Artificial Sequence
  Protein polybromo-1 (1078-1086)
MPISSVRFV

SEQ ID NO: 21569 - protein, 9 aa, Artificial Sequence
  Malignant T-cell-amplified sequence 1 (45-53)
MPKKDPVKI

SEQ ID NO: 21570 - protein, 9 aa, Artificial Sequence
  Melanoma antigen preferentially expressed in tumors (218-226)
MPMQDIKMI

SEQ ID NO: 21571 - protein, 9 aa, Artificial Sequence
  Nuclear factor related to kappa-B-binding protein (810-818)
MPPKAGQTI

SEQ ID NO: 21572 - protein, 9 aa, Artificial Sequence
  E3 ubiquitin-protein ligase Itchy homolog (380-388)
MPQHIKITV

SEQ ID NO: 21573 - protein, 13 aa, Artificial Sequence
  Myotubularin-related protein 5 (315-327)
MPRYADASGRNTL

SEQ ID NO: 21574 - protein, 10 aa, Artificial Sequence
  Splicing factor 3B subunit 2 (596-605)
MPVGPNAHKV

SEQ ID NO: 21575 - protein, 9 aa, Artificial Sequence
  Zinc finger protein 512B (211-219)
MPVTKPITV

SEQ ID NO: 21576 - protein, 9 aa, Artificial Sequence
  Dihydropyrimidinase-related protein 3 (192-200)
MPYKGMTTV

SEQ ID NO: 21577 - protein, 7 aa, Artificial Sequence
  Transmembraneoprotein NMB (38-44)
MREHNQL

SEQ ID NO: 21578 - protein, 9 aa, Artificial Sequence
  WD repeat-containing protein 81 (60-68)
MSEEHTAVY

SEQ ID NO: 21579 - protein, 9 aa, Artificial Sequence
  Bombesin receptor-activated protein C6orf89 (44-52)
MSEKAIEKF

SEQ ID NO: 21580 - protein, 9 aa, Artificial Sequence
  Inactive ubiquitin carboxyl-terminal hydrolase 53 (1045-1053)
MTDTYRLKY

SEQ ID NO: 21581 - protein, 6 aa, Artificial Sequence
  Neuronal membraneoprotein M6-a (202-207)
MTFHLF

SEQ ID NO: 21582 - protein, 29 aa, Artificial Sequence
  POTE ankyrin domain family member I (36-64)
MTQIMFETFNTPAMYVAIQAVLSLYASGR

SEQ ID NO: 21583 - protein, 12 aa, Artificial Sequence
  Protein disulfide-isomerase A3 (285-296)
MVAKKFLDAGHK

SEQ ID NO: 21584 - protein, 8 aa, Artificial Sequence
  Unconventional myosin-Id (310-317)
MVEKALLY

SEQ ID NO: 21585 - protein, 9 aa, Artificial Sequence
  Putative eukaryotic translation initiation factor 2 subunit 3-like protein (353-361)
MVGQILGAV

SEQ ID NO: 21586 - protein, 14 aa, Artificial Sequence
  MICOS complex subunit MIC60 (88-101)
MVLGPAAYNVPLPK

SEQ ID NO: 21587 - protein, 9 aa, Artificial Sequence
  ER membrane protein complex subunit 7 (169-177)
MVLPLLIFV

SEQ ID NO: 21588 - protein, 23 aa, Artificial Sequence
  X-ray repair cross-complementing protein 5 (210-232)
MVMISLEGEDGLDEIYSFSESLR

SEQ ID NO: 21589 - protein, 10 aa, Artificial Sequence
  Threonine-tRNA ligase, cytoplasmic (655-664)
MVVPVGPTCD

SEQ ID NO: 21590 - protein, 10 aa, Artificial Sequence
  NAD(P)H dehydrogenase (quinone) 1 (129-138)
MYDKGPFRSK

SEQ ID NO: 21591 - protein, 10 aa, Artificial Sequence
  Exportin-1 (545-554)
MYIVGQYPRF

SEQ ID NO: 21592 - protein, 9 aa, Artificial Sequence
  MICOS complex subunit MIC25 (169-177)
MYKLSSEQF

SEQ ID NO: 21593 - protein, 9 aa, Artificial Sequence
  F-box only protein 21 (417-425)
MYPDQVQLL

SEQ ID NO: 21594 - protein, 10 aa, Artificial Sequence
  Sodium/potassium-transporting ATPase subunit alpha-1 (980-989)
MYPLKPTWWF

SEQ ID NO: 21595 - protein, 9 aa, Artificial Sequence
  Sphingomyelin phosphodiesterase 4 (377-385)
MYTKLFVGF

SEQ ID NO: 21596 - protein, 11 aa, Artificial Sequence
  DNA-binding protein SATB1 (453-463)
NAASAMGPAPL

SEQ ID NO: 21597 - protein, 10 aa, Artificial Sequence
  Eukaryotic translation initiation factor 3 subunit L (169-178)
NADGPAPLEL

SEQ ID NO: 21598 - protein, 9 aa, Artificial Sequence
  Far upstream element-binding protein 1 (418-426)
NADPNMKLF

SEQ ID NO: 21599 - protein, 9 aa, Artificial Sequence
  Erythrocyte band 7 integral membrane protein (138-146)
NADSATRLL

SEQ ID NO: 21600 - protein, 9 aa, Artificial Sequence
  AP-2 complex subunit beta (874-882)
NADTVSSKL

SEQ ID NO: 21601 - protein, 9 aa, Artificial Sequence
  CD44 antigen (137-145)
NAFDGPITI

SEQ ID NO: 21602 - protein, 12 aa, Artificial Sequence
  Catenin alpha-1 (43-54)
NAGNEQDLGIQY

SEQ ID NO: 21603 - protein, 8 aa, Artificial Sequence
  Helicase-like transcription factor (96-103)
NAIKVNNV

SEQ ID NO: 21604 - protein, 8 aa, Artificial Sequence
  Similar to 60S ribosomal protein L7 (171-178)
NALIARSL

SEQ ID NO: 21605 - protein, 11 aa, Artificial Sequence
  Forkhead box protein C1 (212-222)
NAPGPQPPPVR

SEQ ID NO: 21606 - protein, 8 aa, Artificial Sequence
  Serine/threonine-protein phosphatase 2A regulatory subunit B'' subunit alpha (81-88)
NAPLSINI

SEQ ID NO: 21607 - protein, 7 aa, Artificial Sequence
  Protein FAM208B (1664-1670)
NATLTHY

SEQ ID NO: 21608 - protein, 8 aa, Artificial Sequence
  Rho guanine nucleotide exchange factor 11 (1029-1036)
NAVLIRSV

SEQ ID NO: 21609 - protein, 10 aa, Artificial Sequence
  T-complex protein 1 subunit theta (48-57)
NDAATILREL

SEQ ID NO: 21610 - protein, 9 aa, Artificial Sequence
  Pumilio homolog 2 (927-935)
NDGPHSALY

SEQ ID NO: 21611 - protein, 8 aa, Artificial Sequence
  Ribonuclease P protein subunit p21 (126-133)
NDPGHLLW

SEQ ID NO: 21612 - protein, 10 aa, Artificial Sequence
  Protein TANC1 (587-596)
NEAEFHKPDY

SEQ ID NO: 21613 - protein, 10 aa, Artificial Sequence
  Hemicentin-1 (2650-2659)
NEAGEMIKHY

SEQ ID NO: 21614 - protein, 10 aa, Artificial Sequence
  Hemicentin-1 (3510-3519)
NEAGEVSKHF

SEQ ID NO: 21615 - protein, 10 aa, Artificial Sequence
  E3 ubiquitin-protein ligase MYCBP2 (2115-2124)
NEALFSLETA

SEQ ID NO: 21616 - protein, 9 aa, Artificial Sequence
  Insulin-like growth factor 1 receptor (1048-1056)
NEASVMKEF

SEQ ID NO: 21617 - protein, 10 aa, Artificial Sequence
  Neutral amino acid transporter B(0) (61-70)
NEATMVLVSW

SEQ ID NO: 21618 - protein, 9 aa, Artificial Sequence
  Kinesin-like protein KIF13B (360-368)
NEDPNARII

SEQ ID NO: 21619 - protein, 9 aa, Artificial Sequence
  Smith-Magenis syndrome chromosomal region candidate gene 8 protein (896-904)
NEDVRVVQY

SEQ ID NO: 21620 - protein, 9 aa, Artificial Sequence
  RNA-binding motif, single-stranded-interacting protein 3 (399-407)
NEHAPAYSY

SEQ ID NO: 21621 - protein, 10 aa, Artificial Sequence
  2-hydroxyacylsphingosine 1-beta-galactosyltransferase (284-293)
NEHGFVLVSF

SEQ ID NO: 21622 - protein, 10 aa, Artificial Sequence
  Protocadherin gamma-A9 (143-152)
NEIAVPGARY

SEQ ID NO: 21623 - protein, 11 aa, Artificial Sequence
  Protein transport protein Sec23A (436-446)
NEIGTGGTCQW

SEQ ID NO: 21624 - protein, 10 aa, Artificial Sequence
  Serine incorporator 3 (396-405)
NEKEGVQYSY

SEQ ID NO: 21625 - protein, 9 aa, Artificial Sequence
  Pre-rRNA-processing protein TSR1 homolog (69-77)
NELGNTQNF

SEQ ID NO: 21626 - protein, 9 aa, Artificial Sequence
  T-box transcription factor TBX2 (676-684)
NELQSIQRL

SEQ ID NO: 21627 - protein, 9 aa, Artificial Sequence
  Spectrin beta chain, non-erythrocytic 1 (32-40)
NENSSARLF

SEQ ID NO: 21628 - protein, 9 aa, Artificial Sequence
  Cytoplasmic FMR1-interacting protein 2 (99-107)
NEQPNRVEI

SEQ ID NO: 21629 - protein, 10 aa, Artificial Sequence
  Serine incorporator 1 (377-386)
NERDGVTYSY

SEQ ID NO: 21630 - protein, 9 aa, Artificial Sequence
  Transcription factor SOX-10 (146-154)
NESDKRPFI

SEQ ID NO: 21631 - protein, 9 aa, Artificial Sequence
  Laminin subunit beta-1 (541-549)
NEVEPGYYF

SEQ ID NO: 21632 - protein, 7 aa, Artificial Sequence
  AP-1 complex subunit sigma-1A (105-111)
NFEKAYF

SEQ ID NO: 21633 - protein, 6 aa, Artificial Sequence
  Serine/threonine-protein phosphatase 2A 55 kDa regulatory subunit B alpha isoform (364-369)
NFFRMF

SEQ ID NO: 21634 - protein, 9 aa, Artificial Sequence
  Astrotactin-2 (354-362)
NFIKDFPQL

SEQ ID NO: 21635 - protein, 7 aa, Artificial Sequence
  Absent in melanoma 1 protein (1462-1468)
NFTGNQY

SEQ ID NO: 21636 - protein, 8 aa, Artificial Sequence
  RNA-binding protein 12B (194-201)
NGDAIVKF

SEQ ID NO: 21637 - protein, 9 aa, Artificial Sequence
  Receptor-interacting serine/threonine-protein kinase 4 (562-570)
NGDESSTRL

SEQ ID NO: 21638 - protein, 8 aa, Artificial Sequence
  Ankyrin-1 (403-410)
NGFTPLHI

SEQ ID NO: 21639 - protein, 11 aa, Artificial Sequence
  Insulin-like growth factor-binding protein complex acid labile subunit (458-468)
NGLVGIEEQSL

SEQ ID NO: 21640 - protein, 26 aa, Artificial Sequence
  RNA-binding protein Nova-2 (369-394)
NGYLGAGAGGGAGGGGGPLVAAAAAA

SEQ ID NO: 21641 - protein, 8 aa, Artificial Sequence
  Ankyrin-1 (634-641)
NGYTPLHI

SEQ ID NO: 21642 - protein, 10 aa, Artificial Sequence
  Hemicentin-1 (4034-4043)
NHAVLPSGGL

SEQ ID NO: 21643 - protein, 15 aa, Artificial Sequence
  Tyrosine-protein phosphatase non-receptor type substrate 1 (452-466)
NHTEYASIQTSPQPA

SEQ ID NO: 21644 - protein, 17 aa, Artificial Sequence
  Tyrosine-protein phosphatase non-receptor type substrate 1 (452-468)
NHTEYASIQTSPQPASE

SEQ ID NO: 21645 - protein, 18 aa, Artificial Sequence
  Tyrosine-protein phosphatase non-receptor type substrate 1 (452-469)
NHTEYASIQTSPQPASED

SEQ ID NO: 21646 - protein, 20 aa, Artificial Sequence
  Cytochrome c oxidase subunit 6A1, mitochondrial (67-86)
NHTLFHNPHVNPLPTGYEDE

SEQ ID NO: 21647 - protein, 17 aa, Artificial Sequence
  Beta-2-microglobulin (82-98)
NHVTLSQPKIVKWDRDM

SEQ ID NO: 21648 - protein, 6 aa, Artificial Sequence
  Ketosamine-3-kinase (149-154)
NHWNHF

SEQ ID NO: 21649 - protein, 9 aa, Artificial Sequence
  Probable ATP-dependent RNA helicase YTHDC2 (689-697)
NIAETSITV

SEQ ID NO: 21650 - protein, 10 aa, Artificial Sequence
  Retinoic acid receptor RXR-gamma (268-277)
NICHAADKQL

SEQ ID NO: 21651 - protein, 9 aa, Artificial Sequence
  ATP-dependent RNA helicase A (346-354)
NIDEGPLAF

SEQ ID NO: 21652 - protein, 9 aa, Artificial Sequence
  P2X purinoceptor 7 (195-203)
NIDFPGHNY

SEQ ID NO: 21653 - protein, 15 aa, Artificial Sequence
  Tyrosinase (122-136)
NIFDLSAPEKDKFFA

SEQ ID NO: 21654 - protein, 12 aa, Artificial Sequence
  Glyceraldehyde-3-phosphate dehydrogenase, testis-specific (277-288)
NIIPASTGAAKA

SEQ ID NO: 21655 - protein, 9 aa, Artificial Sequence
  SLIT-ROBO Rho GTPase-activating protein 2 (123-131)
NIIPRFVQV

SEQ ID NO: 21656 - protein, 9 aa, Artificial Sequence
  Heterogeneous nuclear ribonucleoprotein U-like protein 1 (451-459)
NILGTNAIM

SEQ ID NO: 21657 - protein, 26 aa, Artificial Sequence
  ATP synthase-coupling factor 6, mitochondrial (33-58)
NKELDPIQKLFVDKIREYKSKRQTSG

SEQ ID NO: 21658 - protein, 30 aa, Artificial Sequence
  ATP synthase-coupling factor 6, mitochondrial (33-62)
NKELDPIQKLFVDKIREYKSKRQTSGGPVD

SEQ ID NO: 21659 - protein, 11 aa, Artificial Sequence
  Eukaryotic translation initiation factor 3 subunit C-like protein (131-141)
NKNNAKALSTL

SEQ ID NO: 21660 - protein, 17 aa, Artificial Sequence
  Heat shock 70 kDa protein 4 (753-769)
NKQSLTMDPVVKSKEIE

SEQ ID NO: 21661 - protein, 9 aa, Artificial Sequence
  Bifunctional glutamate/proline-tRNA ligase (1023-1031)
NLADWYSQV

SEQ ID NO: 21662 - protein, 8 aa, Artificial Sequence
  Vimentin (177-184)
NLAEDIMR

SEQ ID NO: 21663 - protein, 11 aa, Artificial Sequence
  Dystonin (208-218)
NLANLEHAFYV

SEQ ID NO: 21664 - protein, 9 aa, Artificial Sequence
  CMP-sialic acid transporter (111-119)
NLDAAVYQV

SEQ ID NO: 21665 - protein, 9 aa, Artificial Sequence
  Cysteine andine-rich protein 1 (43-51)
NLDSTTVAV

SEQ ID NO: 21666 - protein, 10 aa, Artificial Sequence
  Phospholipase A1 member A (42-51)
NLFEGTDLKV

SEQ ID NO: 21667 - protein, 9 aa, Artificial Sequence
  Eukaryotic translation initiation factor 3 subunit L (162-170)
NLFNYILNA

SEQ ID NO: 21668 - protein, 8 aa, Artificial Sequence
  Eukaryotic translation initiation factor 2-alpha kinase 4 (1314-1321)
NLGLVYKV

SEQ ID NO: 21669 - protein, 9 aa, Artificial Sequence
  F-box/LRR-repeat protein 18 (261-269)
NLHAFLISV

SEQ ID NO: 21670 - protein, 33 aa, Artificial Sequence
  Glia-derived nexin (344-376)
NLHVSHILQKAKIEVSEDGTKASAATTAILIAR

SEQ ID NO: 21671 - protein, 34 aa, Artificial Sequence
  Glia-derived nexin (344-377)
NLHVSHILQKAKIEVSEDGTKASAATTAILIARS

SEQ ID NO: 21672 - protein, 9 aa, Artificial Sequence
  GPI ethanolamine phosphate transferase 3 (51-59)
NLIKQLTSA

SEQ ID NO: 21673 - protein, 9 aa, Artificial Sequence
  Protein EFR3 homolog B (453-461)
NLISQLTTV

SEQ ID NO: 21674 - protein, 10 aa, Artificial Sequence
  Protein FAM179B (401-410)
NLLDDSNFKV

SEQ ID NO: 21675 - protein, 10 aa, Artificial Sequence
  FERM domain-containing protein 5 (46-55)
NLLEKDYFGI

SEQ ID NO: 21676 - protein, 9 aa, Artificial Sequence
  Plexin-B3 (1375-1383)
NLLNSKLFL

SEQ ID NO: 21677 - protein, 9 aa, Artificial Sequence
  Vacuolar protein sorting-associated protein 53 homolog (176-184)
NLLQGVMNV

SEQ ID NO: 21678 - protein, 9 aa, Artificial Sequence
  Transcription factor SOX-6 (265-273)
NLLQQQIQV

SEQ ID NO: 21679 - protein, 11 aa, Artificial Sequence
  Putative segment polarity protein dishevelled homolog DVL1P1 (257-267)
NLNSGSSGTSD

SEQ ID NO: 21680 - protein, 9 aa, Artificial Sequence
  Melanophilin (391-399)
NLPIFLPRV

SEQ ID NO: 21681 - protein, 8 aa, Artificial Sequence
  CUB and sushi domain-containing protein 3 (2038-2045)
NLPIGFGV

SEQ ID NO: 21682 - protein, 9 aa, Artificial Sequence
  Krueppel-like factor 15 (273-281)
NLPSKFVRI

SEQ ID NO: 21683 - protein, 10 aa, Artificial Sequence
  Clathrin heavy chain 1 (795-804)
NLQKYIEIYV

SEQ ID NO: 21684 - protein, 11 aa, Artificial Sequence
  Histone-lysine N-methyltransferase, H3 lysine-79 specific (241-251)
NLSDIGTIMRV

SEQ ID NO: 21685 - protein, 9 aa, Artificial Sequence
  Talin-1 (583-591)
NLTEMSRGV

SEQ ID NO: 21686 - protein, 9 aa, Artificial Sequence
  Cytoplasmic dynein 2 heavy chain 1 (271-279)
NLWEDPYYL

SEQ ID NO: 21687 - protein, 9 aa, Artificial Sequence
  Receptor-type tyrosine-protein phosphatase kappa (420-428)
NLWNSTHHV

SEQ ID NO: 21688 - protein, 10 aa, Artificial Sequence
  Contactin-associated protein-like 3B (1097-1106)
NMADGQLHQV

SEQ ID NO: 21689 - protein, 9 aa, Artificial Sequence
  Nucleolar pre-ribosomal-associated protein 1 (1538-1546)
NMDKVPGFY

SEQ ID NO: 21690 - protein, 12 aa, Artificial Sequence
  Unconventional myosin-Va (131-142)
NMGDMDPHIFAV

SEQ ID NO: 21691 - protein, 9 aa, Artificial Sequence
  Sodium-dependent proline transporter (134-142)
NMIIAYVLF

SEQ ID NO: 21692 - protein, 9 aa, Artificial Sequence
  Striatin-interacting protein 2 (728-736)
NMKTMSAIY

SEQ ID NO: 21693 - protein, 9 aa, Artificial Sequence
  Laminin subunit gamma-1 (71-79)
NMLKQLQEA

SEQ ID NO: 21694 - protein, 9 aa, Artificial Sequence
  UDP-glucose:glycoprotein glucosyltransferase 2 (920-928)
NMSDFIMKV

SEQ ID NO: 21695 - protein, 9 aa, Artificial Sequence
  Lysine-tRNA ligase (423-431)
NMVEELEKA

SEQ ID NO: 21696 - protein, 9 aa, Artificial Sequence
  Tetratricopeptide repeat protein 28 (1500-1508)
NMVGMLHQV

SEQ ID NO: 21697 - protein, 10 aa, Artificial Sequence
  Sodium/potassium-transporting ATPase subunit alpha-3 (166-175)
NMVPQQALVI

SEQ ID NO: 21698 - protein, 9 aa, Artificial Sequence
  Inositol 1,4,5-trisphosphate receptor type 1 (2083-2091)
NNASKLLLA

SEQ ID NO: 21699 - protein, 7 aa, Artificial Sequence
  F-box only protein 25 (151-157)
NNILYRF

SEQ ID NO: 21700 - protein, 8 aa, Artificial Sequence
  Keratin, type II cytoskeletal 1b (325-332)
NNRSLDLD

SEQ ID NO: 21701 - protein, 16 aa, Artificial Sequence
  Filamin-A (2114-2129)
NPAEFVVNTSNAGAGA

SEQ ID NO: 21702 - protein, 17 aa, Artificial Sequence
  Filamin-A (2114-2130)
NPAEFVVNTSNAGAGAL

SEQ ID NO: 21703 - protein, 10 aa, Artificial Sequence
  Ras GTPase-activating-like protein IQGAP1 (1197-1206)
NPAIVAPDAF

SEQ ID NO: 21704 - protein, 9 aa, Artificial Sequence
  Leucine-rich repeat serine/threonine-protein kinase 2 (1842-1850)
NPDQPRLTI

SEQ ID NO: 21705 - protein, 15 aa, Artificial Sequence
  Calreticulin (296-310)
NPEYSPDPSIYAYDN

SEQ ID NO: 21706 - protein, 14 aa, Artificial Sequence
  Cytochrome c oxidase subunit 6A1, mitochondrial (73-86)
NPHVNPLPTGYEDE

SEQ ID NO: 21707 - protein, 9 aa, Artificial Sequence
  Pre-mRNA-splicing factor ATP-dependent RNA helicase PRP16 (832-840)
NPRIGMDAL

SEQ ID NO: 21708 - protein, 18 aa, Artificial Sequence
  E3 ubiquitin-protein ligase UBR4 (202-219)
NPRTVASQPISTQTLVEG

SEQ ID NO: 21709 - protein, 9 aa, Artificial Sequence
  Angiomotin (27-35)
NPSENRSLL

SEQ ID NO: 21710 - protein, 10 aa, Artificial Sequence
  E3 ubiquitin-protein ligase HERC2 (1771-1780)
NPSGPSLGTI

SEQ ID NO: 21711 - protein, 9 aa, Artificial Sequence
  Poly (ADP-ribose) polymerase 14 (87-95)
NPYNGGGRV

SEQ ID NO: 21712 - protein, 8 aa, Artificial Sequence
  Ceramide synthase 2 (123-130)
NQDRPSLL

SEQ ID NO: 21713 - protein, 9 aa, Artificial Sequence
  Exosome complex exonuclease RRP44 (115-123)
NQEKHFYTF

SEQ ID NO: 21714 - protein, 20 aa, Artificial Sequence
  Heterogeneous nuclear ribonucleoprotein A1-like 2 (148-167)
NQGGYGGSSSSSSYGSGRRF

SEQ ID NO: 21715 - protein, 7 aa, Artificial Sequence
  Mid1-interacting protein 1 (8-14)
NQKHSLF

SEQ ID NO: 21716 - protein, 9 aa, Artificial Sequence
  Splicing factor U2AF 65 kDa subunit (348-356)
NQTPVTLQV

SEQ ID NO: 21717 - protein, 7 aa, Artificial Sequence
  DNA polymerase epsilon catalytic subunit A (1795-1801)
NQVMHFY

SEQ ID NO: 21718 - protein, 10 aa, Artificial Sequence
  Ankyrin repeat domain-containing protein 26 (77-86)
NRKLIPRENL

SEQ ID NO: 21719 - protein, 8 aa, Artificial Sequence
  Myosin-9 (710-717)
NRVVFQEF

SEQ ID NO: 21720 - protein, 14 aa, Artificial Sequence
  Hemicentin-1 (685-698)
NSAGTDKQNSTLRY

SEQ ID NO: 21721 - protein, 8 aa, Artificial Sequence
  Mitochondrial import inner membrane translocase subunit TIM50 (276-283)
NSDDRVLL

SEQ ID NO: 21722 - protein, 12 aa, Artificial Sequence
  Cell adhesion molecule-related/down-regulated by oncogenes (944-955)
NSLGSGGNVGPA

SEQ ID NO: 21723 - protein, 10 aa, Artificial Sequence
  Protein phosphatase 1 regulatory subunit 12A (714-723)
NSLVGITSAY

SEQ ID NO: 21724 - protein, 14 aa, Artificial Sequence
  Synaptotagmin-like protein 2 (277-290)
NSSSSSTDSETLRY

SEQ ID NO: 21725 - protein, 11 aa, Artificial Sequence
  ATP synthase subunit epsilon-like protein, mitochondrial (41-51)
NSVKIVKVKKE

SEQ ID NO: 21726 - protein, 13 aa, Artificial Sequence
  Ankyrin-2 (1558-1570)
NTEPLQERISHSY

SEQ ID NO: 21727 - protein, 9 aa, Artificial Sequence
  GRB2-associated-binding protein 1 (88-96)
NTIDRIFYL

SEQ ID NO: 21728 - protein, 11 aa, Artificial Sequence
  Microphthalmia-associated transcription factor (237-247)
NTLPVSGNLID

SEQ ID NO: 21729 - protein, 12 aa, Artificial Sequence
  Microphthalmia-associated transcription factor (90-101)
NTLPVSGNLIDL

SEQ ID NO: 21730 - protein, 9 aa, Artificial Sequence
  Multidrug and toxin extrusion protein 1 (136-144)
NTQHILLLF

SEQ ID NO: 21731 - protein, 10 aa, Artificial Sequence
  Hemicentin-1 (2932-2941)
NTQITDIGRY

SEQ ID NO: 21732 - protein, 11 aa, Artificial Sequence
  Titin (6557-6567)
NVAGDDACSGI

SEQ ID NO: 21733 - protein, 9 aa, Artificial Sequence
  Rho guanine nucleotide exchange factor 2 (401-409)
NVDEGIYQL

SEQ ID NO: 21734 - protein, 9 aa, Artificial Sequence
  Hemicentin-1 (3845-3853)
NVDQNQNSY

SEQ ID NO: 21735 - protein, 9 aa, Artificial Sequence
  Serine/threonine-protein phosphatase PP1-beta catalytic subunit (7-15)
NVDSLITRL

SEQ ID NO: 21736 - protein, 16 aa, Artificial Sequence
  Alpha-enolase (36-51)
NVGDEGGFAPNILENK

SEQ ID NO: 21737 - protein, 7 aa, Artificial Sequence
  tRNA (adenine(58)-N(1))-methyltransferase non-catalytic subunit TRM6 (56-62)
NVIGHSY

SEQ ID NO: 21738 - protein, 27 aa, Artificial Sequence
  Heat shock-related 70 kDa protein 2 (197-223)
NVLIFDLGGGTFDVSILTIEDGIFEVK

SEQ ID NO: 21739 - protein, 16 aa, Artificial Sequence
  Heat shock 70 kDa protein 1-like (170-185)
NVLRIINEPTAAAIAY

SEQ ID NO: 21740 - protein, 17 aa, Artificial Sequence
  78 kDa glucose-regulated protein (176-192)
NVMRIINEPTAAAIAYG

SEQ ID NO: 21741 - protein, 15 aa, Artificial Sequence
  Guanine nucleotide-binding protein G(i) subunit alpha-1 (331-345)
NVQFVFDAVTDVIIK

SEQ ID NO: 21742 - protein, 8 aa, Artificial Sequence
  Nuclease-sensitive element-binding protein 1 (67-74)
NVRNGYGF

SEQ ID NO: 21743 - protein, 9 aa, Artificial Sequence
  Receptor-type tyrosine-protein phosphatase kappa (1423-1431)
NVVDVFHAV

SEQ ID NO: 21744 - protein, 9 aa, Artificial Sequence
  Fidgetin-like protein 1 (81-89)
NYAENILTL

SEQ ID NO: 21745 - protein, 7 aa, Artificial Sequence
  DNA-directed RNA polymerases I, II, and III subunit RPABC5 (61-67)
NYAPLEK

SEQ ID NO: 21746 - protein, 9 aa, Artificial Sequence
  Melanoma-associated antigen 10 (167-175)
NYEDHFPLL

SEQ ID NO: 21747 - protein, 11 aa, Artificial Sequence
  Protein phosphatase Slingshot homolog 1 (196-206)
NYFPGGVALIW

SEQ ID NO: 21748 - protein, 9 aa, Artificial Sequence
  Transformation/transcription domain-associated protein (1707-1715)
NYGDIELLF

SEQ ID NO: 21749 - protein, 9 aa, Artificial Sequence
  Isocitrate dehydrogenase (NAD) subunit gamma, mitochondrial (298-306)
NYGHVYAVF

SEQ ID NO: 21750 - protein, 9 aa, Artificial Sequence
  Lathosterol oxidase (239-247)
NYGQYFTLW

SEQ ID NO: 21751 - protein, 9 aa, Artificial Sequence
  Beta-Ala-His dipeptidase (489-497)
NYIEGTKLF

SEQ ID NO: 21752 - protein, 9 aa, Artificial Sequence
  Procollagen-lysine,2-oxoglutarate 5-dioxygenase 1 (255-263)
NYIPRFWTF

SEQ ID NO: 21753 - protein, 9 aa, Artificial Sequence
  Probable E3 ubiquitin-protein ligase HERC3 (467-475)
NYITAALKL

SEQ ID NO: 21754 - protein, 7 aa, Artificial Sequence
  Heat shock protein HSP 90-beta (351-357)
NYKKFYE

SEQ ID NO: 21755 - protein, 9 aa, Artificial Sequence
  Heat shock protein HSP 90-beta (351-359)
NYKKFYEAF

SEQ ID NO: 21756 - protein, 11 aa, Artificial Sequence
  Muskelin (29-39)
NYPPQYLILKL

SEQ ID NO: 21757 - protein, 9 aa, Artificial Sequence
  Pleckstrin homology domain-containing family G member 2 (150-158)
NYPSSLALL

SEQ ID NO: 21758 - protein, 11 aa, Artificial Sequence
  DNA polymerase zeta catalytic subunit (1024-1034)
NYSDVMSKLGF

SEQ ID NO: 21759 - protein, 9 aa, Artificial Sequence
  Transmembraneoprotein NMB (275-283)
NYSTINYKW

SEQ ID NO: 21760 - protein, 9 aa, Artificial Sequence
  1,2-dihydroxy-3-keto-5-methylthiopentene dioxygenase (141-149)
NYTKAMRLF

SEQ ID NO: 21761 - protein, 10 aa, Artificial Sequence
  HLA class II histocompatibility antigen, DR alpha chain (103-112)
NYTPITNDKF

SEQ ID NO: 21762 - protein, 9 aa, Artificial Sequence
  DNA-dependent protein kinase catalytic subunit (289-297)
NYVSLFEVL

SEQ ID NO: 21763 - protein, 9 aa, Artificial Sequence
  Polycystin-1 (3-11)
PAAPARLAL

SEQ ID NO: 21764 - protein, 8 aa, Artificial Sequence
  Exportin-T (609-616)
PAERKQAL

SEQ ID NO: 21765 - protein, 12 aa, Artificial Sequence
  Collagen alpha-1(V) chain (1145-1156)
PAGPVGPPGEDG

SEQ ID NO: 21766 - protein, 8 aa, Artificial Sequence
  tRNA pseudouridine synthase-like 1 (273-280)
PAHGLFLK

SEQ ID NO: 21767 - protein, 8 aa, Artificial Sequence
  Sushi repeat-containing protein SRPX (4-11)
PAHRPALL

SEQ ID NO: 21768 - protein, 13 aa, Artificial Sequence
  Syntenin-1 (29-41)
PAILSEASAPIPH

SEQ ID NO: 21769 - protein, 8 aa, Artificial Sequence
  Acetolactate synthase-like protein (225-232)
PAKPPKGL

SEQ ID NO: 21770 - protein, 9 aa, Artificial Sequence
  Calmodulin-regulated spectrin-associated protein 3 (958-966)
PAPAARAPA

SEQ ID NO: 21771 - protein, 9 aa, Artificial Sequence
  Tissue factor pathway inhibitor 2 (3-11)
PARPLGLSI

SEQ ID NO: 21772 - protein, 7 aa, Artificial Sequence
  Phosphoinositide 3-kinase regulatory subunit 5 (495-501)
PASRPQR

SEQ ID NO: 21773 - protein, 9 aa, Artificial Sequence
  m7GpppX diphosphatase (134-142)
PATEKHLQK

SEQ ID NO: 21774 - protein, 12 aa, Artificial Sequence
  Nardilysin (738-749)
PAYEADVAQLEY

SEQ ID NO: 21775 - protein, 9 aa, Artificial Sequence
  Lysosome-associated membraneoprotein 1 (250-258)
PDARDPAFK

SEQ ID NO: 21776 - protein, 7 aa, Artificial Sequence
  Uncharacterized protein C14orf119 (123-129)
PDFVAKF

SEQ ID NO: 21777 - protein, 8 aa, Artificial Sequence
  RNA-binding protein 12B (29-36)
PDGGVHII

SEQ ID NO: 21778 - protein, 7 aa, Artificial Sequence
  Thyroid transcription factor 1-associated protein 26 (90-96)
PDNLKHL

SEQ ID NO: 21779 - protein, 8 aa, Artificial Sequence
  Tubulin beta-6 chain (95-102)
PDRIMNTF

SEQ ID NO: 21780 - protein, 12 aa, Artificial Sequence
  SH3 and multiple ankyrin repeat domains protein 1 (980-991)
PDTPAPATPLPP

SEQ ID NO: 21781 - protein, 10 aa, Artificial Sequence
  Copper-transporting ATPase 1 (1234-1243)
PEAELAIHIL

SEQ ID NO: 21782 - protein, 15 aa, Artificial Sequence
  Putative endoplasmin-like protein (220-234)
PEFDGKRFQNVAKEG

SEQ ID NO: 21783 - protein, 11 aa, Artificial Sequence
  Fatty acid synthase (753-763)
PEHAVVLEIAP

SEQ ID NO: 21784 - protein, 8 aa, Artificial Sequence
  Proteasome-associated protein ECM29 homolog (684-691)
PEKLATKF

SEQ ID NO: 21785 - protein, 7 aa, Artificial Sequence
  Serine/threonine-protein kinase ULK3 (110-116)
PEKVARV

SEQ ID NO: 21786 - protein, 11 aa, Artificial Sequence
  Alsin (1431-1441)
PELPEEGSTIP

SEQ ID NO: 21787 - protein, 10 aa, Artificial Sequence
  Serine/arginine repetitive matrix protein 2 (361-370)
PEPPAPTPLL

SEQ ID NO: 21788 - protein, 12 aa, Artificial Sequence
  Homeobox protein SIX5 (88-99)
PEQVACVCEALL

SEQ ID NO: 21789 - protein, 10 aa, Artificial Sequence
  Putative exonuclease GOR (33-42)
PERPGGAVLF

SEQ ID NO: 21790 - protein, 24 aa, Artificial Sequence
  Neutral alpha-glucosidase AB (824-847)
PETSVLVLRKPGINVASDWSIHLR

SEQ ID NO: 21791 - protein, 7 aa, Artificial Sequence
  Coatomer subunit alpha (635-641)
PEVALHF

SEQ ID NO: 21792 - protein, 9 aa, Artificial Sequence
  Melanocyte protein PMEL (57-65)
PEWTEAQRL

SEQ ID NO: 21793 - protein, 14 aa, Artificial Sequence
  Calreticulin (297-310)
PEYSPDPSIYAYDN

SEQ ID NO: 21794 - protein, 8 aa, Artificial Sequence
  Tyrosine-protein phosphatase non-receptor type 11 (284-291)
PFDHTRVV

SEQ ID NO: 21795 - protein, 8 aa, Artificial Sequence
  Polypyrimidine tract-binding protein 2 (92-99)
PFGKVTNI

SEQ ID NO: 21796 - protein, 8 aa, Artificial Sequence
  Polypyrimidine tract-binding protein 3 (124-131)
PFGKVTNL

SEQ ID NO: 21797 - protein, 10 aa, Artificial Sequence
  Uncharacterized protein KIAA0556 (546-555)
PFHPPLQLFF

SEQ ID NO: 21798 - protein, 10 aa, Artificial Sequence
  Transmembrane and TPR repeat-containing protein 1 (393-402)
PFIPASNLFF

SEQ ID NO: 21799 - protein, 9 aa, Artificial Sequence
  Glycine dehydrogenase (decarboxylating), mitochondrial (778-786)
PFLPNHPVI

SEQ ID NO: 21800 - protein, 12 aa, Artificial Sequence
  Cytochrome c oxidase subunit 7C, mitochondrial (52-63)
PFLVVRHQLLKT

SEQ ID NO: 21801 - protein, 7 aa, Artificial Sequence
  Interferon-induced 35 kDa protein (53-59)
PFSVPKI

SEQ ID NO: 21802 - protein, 9 aa, Artificial Sequence
  U2 small nuclear ribonucleoprotein B'' (73-81)
PFYGKPMRI

SEQ ID NO: 21803 - protein, 13 aa, Artificial Sequence
  SH2 domain-containing protein 3A (404-416)
PGAAGDLPGLAAV

SEQ ID NO: 21804 - protein, 10 aa, Artificial Sequence
  NADH dehydrogenase (ubiquinone) 1 beta subcomplex subunit 7 (126-135)
PGEVDPKVAL

SEQ ID NO: 21805 - protein, 16 aa, Artificial Sequence
  Heat shock cognate 71 kDa protein (622-637)
PGGFPGGGAPPSGGAS

SEQ ID NO: 21806 - protein, 13 aa, Artificial Sequence
  Shadow of prion protein (108-120)
PGGNGTGPGIYSY

SEQ ID NO: 21807 - protein, 8 aa, Artificial Sequence
  HLA class II histocompatibility antigen, DR beta 5 chain (7-14)
PGGSYMAK

SEQ ID NO: 21808 - protein, 8 aa, Artificial Sequence
  BAG family molecular chaperone regulator 3 (334-341)
PGHIPIQV

SEQ ID NO: 21809 - protein, 18 aa, Artificial Sequence
  Collagen alpha-5(IV) chain (1035-1052)
PGPQGVEGPPGPSGVPGQ

SEQ ID NO: 21810 - protein, 8 aa, Artificial Sequence
  Adenomatous polyposis coli protein 2 (1191-1198)
PGPRATPR

SEQ ID NO: 21811 - protein, 9 aa, Artificial Sequence
  Mucin-5B (364-372)
PGTAPPPKV

SEQ ID NO: 21812 - protein, 20 aa, Artificial Sequence
  Elastin (116-135)
PGVGGLGVSAGAVVPQPGAG

SEQ ID NO: 21813 - protein, 7 aa, Artificial Sequence
  Mitochondrial import inner membrane translocase subunit TIM50 (216-222)
PHGFISY

SEQ ID NO: 21814 - protein, 6 aa, Artificial Sequence
  BolA-like protein 2 (65-70)
PHIHAF

SEQ ID NO: 21815 - protein, 8 aa, Artificial Sequence
  ATP synthase subunit d, mitochondrial (130-137)
PHQPIENL

SEQ ID NO: 21816 - protein, 8 aa, Artificial Sequence
  Dolichyl-diphosphooligosaccharide-proteinosyltransferase subunit 2 (292-299)
PHQTFVRL

SEQ ID NO: 21817 - protein, 20 aa, Artificial Sequence
  Syndecan-3 (6-25)
PHRAGAAHGAGAGAGAAAGP

SEQ ID NO: 21818 - protein, 13 aa, Artificial Sequence
  Cytochrome c oxidase subunit 6A1, mitochondrial (74-86)
PHVNPLPTGYEDE

SEQ ID NO: 21819 - protein, 7 aa, Artificial Sequence
  BAG family molecular chaperone regulator 3 (292-298)
PIRVHTV

SEQ ID NO: 21820 - protein, 8 aa, Artificial Sequence
  Major facilitator superfamily domain-containing protein 12 (309-316)
PKKFIATI

SEQ ID NO: 21821 - protein, 21 aa, Artificial Sequence
  MICOS complex subunit MIC27 (248-268)
PKLMDHGQSHPEDIDMYSTRS

SEQ ID NO: 21822 - protein, 7 aa, Artificial Sequence
  40S ribosomal protein S26 (65-71)
PKLYVKL

SEQ ID NO: 21823 - protein, 8 aa, Artificial Sequence
  26S proteasome non-ATPase regulatory subunit 6 (12-19)
PKNPDLRI

SEQ ID NO: 21824 - protein, 8 aa, Artificial Sequence
  Ran-binding protein 9 (351-358)
PKQPPLAL

SEQ ID NO: 21825 - protein, 8 aa, Artificial Sequence
  High mobility group protein B1 (95-102)
PKRPPSAF

SEQ ID NO: 21826 - protein, 12 aa, Artificial Sequence
  Ras-associated and pleckstrin homology domains-containing protein 1 (1085-1096)
PKVAVVNPQPQQ

SEQ ID NO: 21827 - protein, 14 aa, Artificial Sequence
  Annexin A2 (211-224)
PKWISIMTERSVPH

SEQ ID NO: 21828 - protein, 8 aa, Artificial Sequence
  Guanine nucleotide-binding protein-like 3 (296-303)
PLDKQITI

SEQ ID NO: 21829 - protein, 10 aa, Artificial Sequence
  MAX gene-associated protein (2401-2410)
PLFSGPVVAV

SEQ ID NO: 21830 - protein, 7 aa, Artificial Sequence
  A-kinase anchor protein 6 (596-602)
PLLSKHK

SEQ ID NO: 21831 - protein, 7 aa, Artificial Sequence
  Ubiquitin carboxyl-terminal hydrolase 11 (444-450)
PLPISHK

SEQ ID NO: 21832 - protein, 10 aa, Artificial Sequence
  Protein transport protein Sec23B (244-253)
PLRSTGVALS

SEQ ID NO: 21833 - protein, 7 aa, Artificial Sequence
  Muskelin (629-635)
PLSALKY

SEQ ID NO: 21834 - protein, 8 aa, Artificial Sequence
  X-ray repair cross-complementing protein 5 (529-536)
PLSKIKTL

SEQ ID NO: 21835 - protein, 9 aa, Artificial Sequence
  HLA class I histocompatibility antigen, B-15 alpha chain (293-301)
PLTLRWEPS

SEQ ID NO: 21836 - protein, 21 aa, Artificial Sequence
  60 kDa heat shock protein, mitochondrial (154-174)
PLVIIAEDVDGEALSTLVLNR

SEQ ID NO: 21837 - protein, 9 aa, Artificial Sequence
  Protein DBF4 homolog A (45-53)
PLWGKVFYL

SEQ ID NO: 21838 - protein, 9 aa, Artificial Sequence
  Extracellular matrix protein FRAS1 (1653-1661)
PMATGDTFT

SEQ ID NO: 21839 - protein, 8 aa, Artificial Sequence
  Alpha/beta hydrolase domain-containing protein 14B (204-211)
PNHRVLIM

SEQ ID NO: 21840 - protein, 8 aa, Artificial Sequence
  Ubiquitin-associated protein 2-like (269-276)
PPAPFMHI

SEQ ID NO: 21841 - protein, 9 aa, Artificial Sequence
  Transforming acidic coiled-coil-containing protein 2 (1969-1977)
PPAPPPPPP

SEQ ID NO: 21842 - protein, 10 aa, Artificial Sequence
  Rho GTPase-activating protein 33 (668-677)
PPAVLELLGA

SEQ ID NO: 21843 - protein, 16 aa, Artificial Sequence
  Transmembrane protein 238 (14-29)
PPGAPSAPAAAPAPAA

SEQ ID NO: 21844 - protein, 12 aa, Artificial Sequence
  Homeobox protein SIX5 (441-452)
PPGPVPAVAAPQ

SEQ ID NO: 21845 - protein, 12 aa, Artificial Sequence
  Collagen alpha-1(VII) chain (2384-2395)
PPGVKGDLGLPG

SEQ ID NO: 21846 - protein, 9 aa, Artificial Sequence
  Mitochondrial fission regulator 1 (151-159)
PPHPPPPPP

SEQ ID NO: 21847 - protein, 7 aa, Artificial Sequence
  Sentrin-specific protease 6 (157-163)
PPHVQKV

SEQ ID NO: 21848 - protein, 10 aa, Artificial Sequence
  CCR4-NOT transcription complex subunit 1 (574-583)
PPITTTTTST

SEQ ID NO: 21849 - protein, 7 aa, Artificial Sequence
  Cyclin E variant ex7del (21-27)
PPKLHQF

SEQ ID NO: 21850 - protein, 9 aa, Artificial Sequence
  Drebrin (365-373)
PPLPPPPPP

SEQ ID NO: 21851 - protein, 14 aa, Artificial Sequence
  Tuberin (1264-1277)
PPLPRSNTVASFSS

SEQ ID NO: 21852 - protein, 9 aa, Artificial Sequence
  Multiple epidermal growth factor-like domains protein 8 (2528-2536)
PPPAPPPPP

SEQ ID NO: 21853 - protein, 9 aa, Artificial Sequence
  Shootin-1 (299-307)
PPPLPPPPP

SEQ ID NO: 21854 - protein, 13 aa, Artificial Sequence
  Serine/threonine-protein kinase WNK2 (136-148)
PPPSDMGTVGGQA

SEQ ID NO: 21855 - protein, 14 aa, Artificial Sequence
  Retinoic acid-induced protein 1 (1033-1046)
PPQGQMEGAGAPGR

SEQ ID NO: 21856 - protein, 9 aa, Artificial Sequence
  Retrotransposon-derived protein PEG10 (765-773)
PPQPPPPPP

SEQ ID NO: 21857 - protein, 9 aa, Artificial Sequence
  Acrosin (110-118)
PPSPPPPPP

SEQ ID NO: 21858 - protein, 9 aa, Artificial Sequence
  Transcription factor SOX-9 (356-364)
PQAPPQPQA

SEQ ID NO: 21859 - protein, 7 aa, Artificial Sequence
  Protein transport protein Sec23B (562-568)
PQFMFHL

SEQ ID NO: 21860 - protein, 9 aa, Artificial Sequence
  Squalene monooxygenase (366-374)
PQIPDHLKE

SEQ ID NO: 21861 - protein, 11 aa, Artificial Sequence
  Histone-lysine N-methyltransferase 2C (2512-2522)
PQLRRSVSVDM

SEQ ID NO: 21862 - protein, 9 aa, Artificial Sequence
  Disintegrin and metalloproteinase domain-containing protein 18 (67-75)
PQNFLVYTY

SEQ ID NO: 21863 - protein, 9 aa, Artificial Sequence
  Retrotransposon-derived protein PEG10 (766-774)
PQPPPPPPP

SEQ ID NO: 21864 - protein, 13 aa, Artificial Sequence
  Serum albumin (440-452)
PQVSTPTLVEVSR

SEQ ID NO: 21865 - protein, 8 aa, Artificial Sequence
  Neural Wiskott-Aldrich syndrome protein (83-90)
PRGYFHTF

SEQ ID NO: 21866 - protein, 10 aa, Artificial Sequence
  60S ribosomal protein L13 (48-57)
PRPASGPIRP

SEQ ID NO: 21867 - protein, 8 aa, Artificial Sequence
  Histone H2A deubiquitinase MYSM1 (447-454)
PRPTKSSF

SEQ ID NO: 21868 - protein, 8 aa, Artificial Sequence
  ATP-dependent RNA helicase DDX24 (200-207)
PRPVLRAL

SEQ ID NO: 21869 - protein, 8 aa, Artificial Sequence
  Splicing factor 3B subunit 3 (431-438)
PRSSLRVL

SEQ ID NO: 21870 - protein, 8 aa, Artificial Sequence
  Ankyrin repeat and KH domain-containing protein 1 (749-756)
PRVPTHTL

SEQ ID NO: 21871 - protein, 14 aa, Artificial Sequence
  AT-rich interactive domain-containing protein 1A (279-292)
PSAAGGGTPQPTAT

SEQ ID NO: 21872 - protein, 9 aa, Artificial Sequence
  Large proline-rich protein BAG6 (53-61)
PSEKQRLIY

SEQ ID NO: 21873 - protein, 11 aa, Artificial Sequence
  Ankyrin-2 (1035-1045)
PSGAQFLGPVI

SEQ ID NO: 21874 - protein, 8 aa, Artificial Sequence
  Eukaryotic translation initiation factor 3 subunit C-like protein (204-211)
PSGESRKF

SEQ ID NO: 21875 - protein, 9 aa, Artificial Sequence
  BAI1-associated protein 3 (124-132)
PSLGLRALA

SEQ ID NO: 21876 - protein, 28 aa, Artificial Sequence
  Attractin (1008-1035)
PSNTGKGKCIEGSYKGPVKMPSQAPTGN

SEQ ID NO: 21877 - protein, 18 aa, Artificial Sequence
  Zinc finger protein 469 (879-896)
PSSGHPLKSKAGVTPESK

SEQ ID NO: 21878 - protein, 24 aa, Artificial Sequence
  Serine/threonine-protein kinase WNK1 (1547-1570)
PSSSSSPGAGVSSYISQPGGLHPL

SEQ ID NO: 21879 - protein, 12 aa, Artificial Sequence
  Fibronectin isoform 6 (769-780)
PSTATSVNIPDL

SEQ ID NO: 21880 - protein, 7 aa, Artificial Sequence
  Transcription factor HES-1 (104-110)
PSVLGKY

SEQ ID NO: 21881 - protein, 8 aa, Artificial Sequence
  Basement membrane-specific heparan sulfate proteoglycan core protein (2626-2633)
PSVSPPIR

SEQ ID NO: 21882 - protein, 9 aa, Artificial Sequence
  Serine/threonine-protein kinase ICK (273-281)
PTASQALRY

SEQ ID NO: 21883 - protein, 9 aa, Artificial Sequence
  Myotubularin-related protein 14 (360-368)
PTEILYLTV

SEQ ID NO: 21884 - protein, 10 aa, Artificial Sequence
  Nicastrin (540-549)
PTNTTYVVQY

SEQ ID NO: 21885 - protein, 7 aa, Artificial Sequence
  Sorting nexin-5 (259-265)
PTVIKKY

SEQ ID NO: 21886 - protein, 10 aa, Artificial Sequence
  Doublesex- and mab-3-related transcription factor A2 (25-34)
PVASVASVAA

SEQ ID NO: 21887 - protein, 9 aa, Artificial Sequence
  UPF0609 protein C4orf27 (230-238)
PVDKNDVGY

SEQ ID NO: 21888 - protein, 9 aa, Artificial Sequence
  Hephaestin (425-433)
PVDLLTGKV

SEQ ID NO: 21889 - protein, 11 aa, Artificial Sequence
  Single-stranded DNA-binding protein 3 (128-138)
PVPPGGSRSNF

SEQ ID NO: 21890 - protein, 9 aa, Artificial Sequence
  Enolase-like protein ENO4 (194-202)
PVPPPPPPP

SEQ ID NO: 21891 - protein, 9 aa, Artificial Sequence
  Obscurin (6294-6302)
PVVPTLYVT

SEQ ID NO: 21892 - protein, 8 aa, Artificial Sequence
  Matrin-3 (231-238)
PYGKIKNY

SEQ ID NO: 21893 - protein, 10 aa, Artificial Sequence
  Alpha-actinin-4 (178-187)
PYKNVNVQNF

SEQ ID NO: 21894 - protein, 9 aa, Artificial Sequence
  Dedicator of cytokinesis protein 7 (627-635)
PYLDKFFAL

SEQ ID NO: 21895 - protein, 9 aa, Artificial Sequence
  Dedicator of cytokinesis protein 6 (722-730)
PYLDKFFTL

SEQ ID NO: 21896 - protein, 9 aa, Artificial Sequence
  Eukaryotic peptide chain release factor GTP-binding subunit ERF3A (285-293)
PYLDNLPNF

SEQ ID NO: 21897 - protein, 9 aa, Artificial Sequence
  Melanoma antigen preferentially expressed in tumors (254-262)
PYLGQMINL

SEQ ID NO: 21898 - protein, 9 aa, Artificial Sequence
  Elongation of very long chain fatty acids protein 5 (194-202)
PYLWWKKYI

SEQ ID NO: 21899 - protein, 11 aa, Artificial Sequence
  Tubulin beta-6 chain (117-127)
PYNATLSVHQL

SEQ ID NO: 21900 - protein, 8 aa, Artificial Sequence
  LYR motif-containing protein 1 (80-87)
PYPRPIHL

SEQ ID NO: 21901 - protein, 9 aa, Artificial Sequence
  Cubilin (2661-2669)
PYSQVWIHF

SEQ ID NO: 21902 - protein, 12 aa, Artificial Sequence
  Pumilio homolog 1 (440-451)
PYTAGLAAAATL

SEQ ID NO: 21903 - protein, 9 aa, Artificial Sequence
  Serine/threonine-protein kinase Nek6 (236-244)
PYYMSPERI

SEQ ID NO: 21904 - protein, 8 aa, Artificial Sequence
  Progestin and adipoQ receptor family member 4 (113-120)
QAAARLLV

SEQ ID NO: 21905 - protein, 16 aa, Artificial Sequence
  HLA class I histocompatibility antigen, B-15 alpha chain (346-361)
QAASSDSAQGSDVSLT

SEQ ID NO: 21906 - protein, 20 aa, Artificial Sequence
  HLA class I histocompatibility antigen, A-23 alpha chain (346-365)
QAASSDSAQGSDVSLTACKV

SEQ ID NO: 21907 - protein, 9 aa, Artificial Sequence
  Nuclear distribution protein nudE-like 1 (66-74)
QADNQRLKY

SEQ ID NO: 21908 - protein, 14 aa, Artificial Sequence
  Glycogenin-1 (2-15)
QAFVTLTTNDAYAK

SEQ ID NO: 21909 - protein, 13 aa, Artificial Sequence
  CREB-binding protein (405-417)
QAILGSPASGIQN

SEQ ID NO: 21910 - protein, 10 aa, Artificial Sequence
  Scavenger receptor cysteine-rich type 1 protein M160 (412-421)
QALVVCKQLG

SEQ ID NO: 21911 - protein, 9 aa, Artificial Sequence
  Myelin basic protein (108-116)
QDENPVVHF

SEQ ID NO: 21912 - protein, 7 aa, Artificial Sequence
  Clathrin heavy chain 1 (723-729)
QDPDVHF

SEQ ID NO: 21913 - protein, 9 aa, Artificial Sequence
  Fatty acid synthase (1595-1603)
QDSLLGMEF

SEQ ID NO: 21914 - protein, 9 aa, Artificial Sequence
  Stathmin-3 (88-96)
QEAQVLKQL

SEQ ID NO: 21915 - protein, 11 aa, Artificial Sequence
  Formin-1 (1099-1109)
QEDELVKIRKY

SEQ ID NO: 21916 - protein, 9 aa, Artificial Sequence
  WD repeat-containing protein 26 (508-516)
QEDHPIMSF

SEQ ID NO: 21917 - protein, 11 aa, Artificial Sequence
  Large proline-rich protein BAG6 (1111-1121)
QEDPNYSPQRF

SEQ ID NO: 21918 - protein, 9 aa, Artificial Sequence
  Vigilin (1012-1020)
QEDRALRSF

SEQ ID NO: 21919 - protein, 12 aa, Artificial Sequence
  Nestin (502-513)
QEEEGSALKTSW

SEQ ID NO: 21920 - protein, 9 aa, Artificial Sequence
  DNA (cytosine-5)-methyltransferase 3A (426-434)
QEFDPPKVY

SEQ ID NO: 21921 - protein, 10 aa, Artificial Sequence
  AT-rich interactive domain-containing protein 1B (1797-1806)
QEFNSGLLHW

SEQ ID NO: 21922 - protein, 9 aa, Artificial Sequence
  Hemicentin-1 (1703-1711)
QEIDRGQYI

SEQ ID NO: 21923 - protein, 7 aa, Artificial Sequence
  Annexin A2 (141-147)
QEINRVY

SEQ ID NO: 21924 - protein, 10 aa, Artificial Sequence
  Mitogen-activated protein kinase kinase kinase kinase 5 (802-811)
QEISDETRVF

SEQ ID NO: 21925 - protein, 9 aa, Artificial Sequence
  Serine-protein kinase ATM (95-103)
QEISSLVKY

SEQ ID NO: 21926 - protein, 13 aa, Artificial Sequence
  Desmoglein-2 (903-915)
QEIVTERSVSSRQ

SEQ ID NO: 21927 - protein, 10 aa, Artificial Sequence
  Synemin (16-25)
QELNARLYDY

SEQ ID NO: 21928 - protein, 12 aa, Artificial Sequence
  Nestin (337-348)
QELPQSADVQRW

SEQ ID NO: 21929 - protein, 9 aa, Artificial Sequence
  Receptor-interacting serine/threonine-protein kinase 4 (597-605)
QENIVRILL

SEQ ID NO: 21930 - protein, 9 aa, Artificial Sequence
  TSC22 domain family protein 1 (93-101)
QENNLLKTL

SEQ ID NO: 21931 - protein, 10 aa, Artificial Sequence
  Protein flightless-1 homolog (1024-1033)
QENPKFLSHF

SEQ ID NO: 21932 - protein, 10 aa, Artificial Sequence
  RNA-binding motif, single-stranded-interacting protein 3 (126-135)
QEQDPTNLYI

SEQ ID NO: 21933 - protein, 11 aa, Artificial Sequence
  T-complex protein 1 subunit theta (20-30)
QEQEVGDGTNF

SEQ ID NO: 21934 - protein, 9 aa, Artificial Sequence
  ETS translocation variant 1 (65-73)
QEQPFKFSY

SEQ ID NO: 21935 - protein, 9 aa, Artificial Sequence
  Nucleolar complex protein 2 homolog (188-196)
QESAEANKF

SEQ ID NO: 21936 - protein, 10 aa, Artificial Sequence
  Protein transport protein Sec24D (86-95)
QESQSVIHNL

SEQ ID NO: 21937 - protein, 10 aa, Artificial Sequence
  Ankycorbin (839-848)
QEVNELLQKF

SEQ ID NO: 21938 - protein, 8 aa, Artificial Sequence
  Up-regulated during skeletal muscle growth protein 5 (11-18)
QFTGIKKY

SEQ ID NO: 21939 - protein, 10 aa, Artificial Sequence
  Proprotein convertase subtilisin/kexin type 7 (93-102)
QGHYLFVQPA

SEQ ID NO: 21940 - protein, 6 aa, Artificial Sequence
  All-trans-retinol 13,14-reductase (57-62)
QGIHYI

SEQ ID NO: 21941 - protein, 11 aa, Artificial Sequence
  Serine/threonine-protein phosphatase 1 regulatory subunit 10 (572-582)
QGPGGGGINVQ

SEQ ID NO: 21942 - protein, 12 aa, Artificial Sequence
  HLA class I histocompatibility antigen, A-23 alpha chain (354-365)
QGSDVSLTACKV

SEQ ID NO: 21943 - protein, 10 aa, Artificial Sequence
  Fibronectin isoform 6 (1715-1724)
QGVVTTLENV

SEQ ID NO: 21944 - protein, 19 aa, Artificial Sequence
  Heterogeneous nuclear ribonucleoprotein L (52-70)
QHGGGGGGGGGAGAAGGGG

SEQ ID NO: 21945 - protein, 22 aa, Artificial Sequence
  Splicing factor, proline- and glutamine-rich (246-267)
QHHPPYHQQHHQGPPPGGPGGR

SEQ ID NO: 21946 - protein, 13 aa, Artificial Sequence
  Dynein heavy chain 8, axonemal (2665-2677)
QHKAVLLTGEQGT

SEQ ID NO: 21947 - protein, 11 aa, Artificial Sequence
  Synaptic vesicle membrane protein VAT-1 homolog (26-36)
QHPAASEGAAA

SEQ ID NO: 21948 - protein, 13 aa, Artificial Sequence
  Band 4.1-like protein 2 (54-66)
QIDGGAGGDSGTL

SEQ ID NO: 21949 - protein, 8 aa, Artificial Sequence
  60S ribosomal protein L26 (66-73)
QIGKVVQV

SEQ ID NO: 21950 - protein, 9 aa, Artificial Sequence
  Cytoskeleton-associated protein 5 (1667-1675)
QILDHLTMI

SEQ ID NO: 21951 - protein, 9 aa, Artificial Sequence
  DNA-dependent protein kinase catalytic subunit (865-873)
QINKNLLTV

SEQ ID NO: 21952 - protein, 17 aa, Artificial Sequence
  Transmembraneoprotein NMB (370-386)
QINRYGHFQATITIVEG

SEQ ID NO: 21953 - protein, 9 aa, Artificial Sequence
  Dehydrogenase/reductase SDR family member 2, mitochondrial (127-135)
QIWDKILSV

SEQ ID NO: 21954 - protein, 12 aa, Artificial Sequence
  Nodal modulator 2 (399-410)
QLADIVATGFSV

SEQ ID NO: 21955 - protein, 9 aa, Artificial Sequence
  Laminin subunit alpha-4 (470-478)
QLDDYNAKL

SEQ ID NO: 21956 - protein, 9 aa, Artificial Sequence
  Myotubularin-related protein 6 (229-237)
QLDGDPKEV

SEQ ID NO: 21957 - protein, 9 aa, Artificial Sequence
  Circadian clock protein PASD1 (383-391)
QLEERTWLL

SEQ ID NO: 21958 - protein, 7 aa, Artificial Sequence
  ATP-dependent RNA helicase DHX8 (283-289)
QLEGLRK

SEQ ID NO: 21959 - protein, 9 aa, Artificial Sequence
  Erlin-2 (26-34)
QLGAVVAVA

SEQ ID NO: 21960 - protein, 9 aa, Artificial Sequence
  Probable histidine-tRNA ligase, mitochondrial (60-68)
QLGDFLIKV

SEQ ID NO: 21961 - protein, 9 aa, Artificial Sequence
  Complement factor I (347-355)
QLGDLPWQV

SEQ ID NO: 21962 - protein, 9 aa, Artificial Sequence
  E3 ubiquitin-protein ligase TRIM63 (281-289)
QLIKSIVEA

SEQ ID NO: 21963 - protein, 9 aa, Artificial Sequence
  Class E basic helix-loop-helix protein 41 (161-169)
QLINHLHAV

SEQ ID NO: 21964 - protein, 9 aa, Artificial Sequence
  E3 ubiquitin-protein ligase listerin (245-253)
QLIPFIDAV

SEQ ID NO: 21965 - protein, 9 aa, Artificial Sequence
  Intron-binding protein aquarius (224-232)
QLIQKFISV

SEQ ID NO: 21966 - protein, 11 aa, Artificial Sequence
  Pleckstrin homology domain-containing family H member 1 (700-710)
QLISEKKTYYL

SEQ ID NO: 21967 - protein, 10 aa, Artificial Sequence
  WASH complex subunit 7 (254-263)
QLLDGMIFQA

SEQ ID NO: 21968 - protein, 11 aa, Artificial Sequence
  Transmembrane protein 209 (327-337)
QLLDHMDSWTA

SEQ ID NO: 21969 - protein, 9 aa, Artificial Sequence
  StAR-related lipid transfer protein 13 (922-930)
QLLGGVRAV

SEQ ID NO: 21970 - protein, 9 aa, Artificial Sequence
  Small subunit processome component 20 homolog (1596-1604)
QLMEGKVVL

SEQ ID NO: 21971 - protein, 9 aa, Artificial Sequence
  Serine/threonine-protein kinase mTOR (66-74)
QLNHHIFEL

SEQ ID NO: 21972 - protein, 11 aa, Artificial Sequence
  Liprin-alpha-2 (76-86)
QLNSALPQDIE

SEQ ID NO: 21973 - protein, 9 aa, Artificial Sequence
  Protein Shroom4 (1452-1460)
QLQDYQHFV

SEQ ID NO: 21974 - protein, 13 aa, Artificial Sequence
  Plectin (3123-3135)
QLSTGGIVDPSKS

SEQ ID NO: 21975 - protein, 9 aa, Artificial Sequence
  Protein wntless homolog (517-525)
QLTTTITHV

SEQ ID NO: 21976 - protein, 9 aa, Artificial Sequence
  Chondroitin sulfate proteoglycan 4 (77-85)
QLYSGRLQV

SEQ ID NO: 21977 - protein, 10 aa, Artificial Sequence
  Solute carrier family 12 member 6 (45-54)
QMGTFMGVYL

SEQ ID NO: 21978 - protein, 9 aa, Artificial Sequence
  Synemin (724-732)
QMIGDIINL

SEQ ID NO: 21979 - protein, 12 aa, Artificial Sequence
  DNA-dependent protein kinase catalytic subunit (947-958)
QMPEGGQGAPPM

SEQ ID NO: 21980 - protein, 9 aa, Artificial Sequence
  Actin-like protein 6A (239-247)
QMPTVHYEF

SEQ ID NO: 21981 - protein, 9 aa, Artificial Sequence
  Talin-1 (288-296)
QMSEIEAKV

SEQ ID NO: 21982 - protein, 12 aa, Artificial Sequence
  L-lactate dehydrogenase A chain (20-31)
QNKITVVGVGAV

SEQ ID NO: 21983 - protein, 9 aa, Artificial Sequence
  POU domain, class 2, transcription factor 1 (208-216)
QPATPTRTI

SEQ ID NO: 21984 - protein, 9 aa, Artificial Sequence
  Integrin alpha-6 (55-63)
QPEDKRLLL

SEQ ID NO: 21985 - protein, 11 aa, Artificial Sequence
  Beta-2-microglobulin (88-98)
QPKIVKWDRDM

SEQ ID NO: 21986 - protein, 8 aa, Artificial Sequence
  Potassium voltage-gated channel subfamily H member 2 (335-342)
QPLAVVDL

SEQ ID NO: 21987 - protein, 11 aa, Artificial Sequence
  Histone-lysine N-methyltransferase 2A (3086-3096)
QPLYVLQTLPN

SEQ ID NO: 21988 - protein, 9 aa, Artificial Sequence
  Rho GTPase-activating protein 31 (988-996)
QPQAPRREI

SEQ ID NO: 21989 - protein, 9 aa, Artificial Sequence
  Tribbles homolog 1 (15-23)
QPRGPALLF

SEQ ID NO: 21990 - protein, 10 aa, Artificial Sequence
  Transcription intermediary factor 1-alpha (611-620)
QPRPPSNRTV

SEQ ID NO: 21991 - protein, 9 aa, Artificial Sequence
  DNA-directed RNA polymerase II subunit RPB3 (6-14)
QPTVRITEL

SEQ ID NO: 21992 - protein, 12 aa, Artificial Sequence
  Guanine nucleotide exchange factor VAV3 (393-404)
QPVLLFGRPQGD

SEQ ID NO: 21993 - protein, 8 aa, Artificial Sequence
  Dual specificity protein kinase CLK3 (230-237)
QPYPLPHV

SEQ ID NO: 21994 - protein, 20 aa, Artificial Sequence
  CCR4-NOT transcription complex subunit 1 (48-67)
QQGILKTDDLITRFFRLCTE

SEQ ID NO: 21995 - protein, 9 aa, Artificial Sequence
  Tetratricopeptide repeat protein 37 (642-650)
QQILGKYKE

SEQ ID NO: 21996 - protein, 8 aa, Artificial Sequence
  Eukaryotic initiation factor 4A-I (114-121)
QQIQKVVM

SEQ ID NO: 21997 - protein, 9 aa, Artificial Sequence
  Pyridoxal kinase (30-38)
QQNPRLVYV

SEQ ID NO: 21998 - protein, 8 aa, Artificial Sequence
  Titin (12085-12092)
QRAEVVPV

SEQ ID NO: 21999 - protein, 9 aa, Artificial Sequence
  Caprin-1 (666-674)
QRDGYQQNF

SEQ ID NO: 22000 - protein, 7 aa, Artificial Sequence
  Signal transducer and activator of transcription 6 (89-95)
QRDPLKL

SEQ ID NO: 22001 - protein, 9 aa, Artificial Sequence
  Interleukin-24 (5-13)
QRLQSLWTL

SEQ ID NO: 22002 - protein, 9 aa, Artificial Sequence
  Tight junction protein ZO-1 (750-758)
QRSSGIIRL

SEQ ID NO: 22003 - protein, 9 aa, Artificial Sequence
  Mastermind-like protein 2 (349-357)
QRSTPRPSL

SEQ ID NO: 22004 - protein, 9 aa, Artificial Sequence
  Polypyrimidine tract-binding protein 1 (384-392)
QRVKILFNK

SEQ ID NO: 22005 - protein, 9 aa, Artificial Sequence
  KN motif and ankyrin repeat domain-containing protein 2 (79-87)
QSEIASMLY

SEQ ID NO: 22006 - protein, 10 aa, Artificial Sequence
  Nuclear factor erythroid 2-related factor 2 (93-102)
QSETSGSANY

SEQ ID NO: 22007 - protein, 7 aa, Artificial Sequence
  Golgin subfamily A member 4 (541-547)
QSEYLKI

SEQ ID NO: 22008 - protein, 10 aa, Artificial Sequence
  RNA-binding protein 27 (597-606)
QSGGAGEDCQ

SEQ ID NO: 22009 - protein, 11 aa, Artificial Sequence
  Heterogeneous nuclear ribonucleoprotein K (153-163)
QSLAGGIIGVK

SEQ ID NO: 22010 - protein, 10 aa, Artificial Sequence
  Interphotoreceptor matrix proteoglycan 1 (289-298)
QSLDVGTIQF

SEQ ID NO: 22011 - protein, 9 aa, Artificial Sequence
  Hsc70-interacting protein (339-347)
QSNPKVMNL

SEQ ID NO: 22012 - protein, 9 aa, Artificial Sequence
  Hemicentin-1 (1877-1885)
QSSGRVLQI

SEQ ID NO: 22013 - protein, 9 aa, Artificial Sequence
  CUB and sushi domain-containing protein 3 (16-24)
QTASGFIYT

SEQ ID NO: 22014 - protein, 9 aa, Artificial Sequence
  Nodal modulator 1 (450-458)
QTFPLTVTN

SEQ ID NO: 22015 - protein, 12 aa, Artificial Sequence
  Receptor-type tyrosine-protein phosphatase delta (33-44)
QTGVSGGVASFI

SEQ ID NO: 22016 - protein, 9 aa, Artificial Sequence
  Ribosome maturation protein SBDS (52-60)
QTHSVFVNV

SEQ ID NO: 22017 - protein, 10 aa, Artificial Sequence
  Histone-lysine N-methyltransferase EHMT1 (170-179)
QTPAAPPATL

SEQ ID NO: 22018 - protein, 7 aa, Artificial Sequence
  rRNA 2'-O-methyltransferase fibrillarin (239-245)
QTRIVAL

SEQ ID NO: 22019 - protein, 11 aa, Artificial Sequence
  Protein FAM135A (647-657)
QTTPSLGVRTI

SEQ ID NO: 22020 - protein, 10 aa, Artificial Sequence
  Catenin beta-1 (78-87)
QVADIDGQYA

SEQ ID NO: 22021 - protein, 41 aa, Artificial Sequence
  E1A-binding protein p400 (51-91)
QVASLRAERIAKEKKALADQQKAQQPAVAQPPPPQPQPPPP

SEQ ID NO: 22022 - protein, 10 aa, Artificial Sequence
  Integrator complex subunit 1 (125-134)
QVASRVLAMK

SEQ ID NO: 22023 - protein, 9 aa, Artificial Sequence
  ATP-binding cassette sub-family A member 2 (2330-2338)
QVFSKMEQV

SEQ ID NO: 22024 - protein, 14 aa, Artificial Sequence
  Zinc finger protein 423 (1103-1116)
QVGGLAPPEPADRP

SEQ ID NO: 22025 - protein, 10 aa, Artificial Sequence
  Transcription factor SOX-5 (88-97)
QVLDGKVAVV

SEQ ID NO: 22026 - protein, 15 aa, Artificial Sequence
  T-complex protein 1 subunit beta (502-516)
QVLLSAAEAAEVILR

SEQ ID NO: 22027 - protein, 7 aa, Artificial Sequence
  Peptidyl-prolyl cis-trans isomerase FKBP9 (200-206)
QVQIHTY

SEQ ID NO: 22028 - protein, 21 aa, Artificial Sequence
  Poly(rC)-binding protein 2 (304-324)
QVTITGSAASISLAQYLINVR

SEQ ID NO: 22029 - protein, 9 aa, Artificial Sequence
  Transcriptional regulator ATRX (1486-1494)
QVVSFLHTV

SEQ ID NO: 22030 - protein, 9 aa, Artificial Sequence
  14-3-3 protein eta (46-54)
QYESKVFYL

SEQ ID NO: 22031 - protein, 9 aa, Artificial Sequence
  TELO2-interacting protein 1 homolog (50-58)
QYILFPLRF

SEQ ID NO: 22032 - protein, 9 aa, Artificial Sequence
  Vam6/Vps39-like protein (296-304)
QYPNPLPVL

SEQ ID NO: 22033 - protein, 15 aa, Artificial Sequence
  Forkhead box protein D3 (302-316)
QYPYALPPVAPVLPP

SEQ ID NO: 22034 - protein, 9 aa, Artificial Sequence
  Spectrin beta chain, non-erythrocytic 1 (17-25)
QYSDVNNRW

SEQ ID NO: 22035 - protein, 10 aa, Artificial Sequence
  Ubiquitin-like modifier-activating enzyme 1 (717-726)
QYSNNIRQLL

SEQ ID NO: 22036 - protein, 10 aa, Artificial Sequence
  Golgin subfamily A member 4 (432-441)
RAAFEELEKA

SEQ ID NO: 22037 - protein, 9 aa, Artificial Sequence
  HDAC2 (27-35)
RAFPAPPPL

SEQ ID NO: 22038 - protein, 9 aa, Artificial Sequence
  Formin-like protein 2 (15-23)
RAHNVPLKL

SEQ ID NO: 22039 - protein, 9 aa, Artificial Sequence
  Catenin beta-1 (151-159)
RAIPELTKL

SEQ ID NO: 22040 - protein, 11 aa, Artificial Sequence
  Fatty acid synthase (2352-2362)
RAKLTPGCEAE

SEQ ID NO: 22041 - protein, 9 aa, Artificial Sequence
  Junction plakoglobin (142-150)
RALPELTKL

SEQ ID NO: 22042 - protein, 8 aa, Artificial Sequence
  Astrotactin-2 (360-367)
RANTPIEI

SEQ ID NO: 22043 - protein, 9 aa, Artificial Sequence
  Microtubule-associated protein 4 (356-364)
RASPIKMDL

SEQ ID NO: 22044 - protein, 9 aa, Artificial Sequence
  Protein scribble homolog (473-481)
RATPHPSEL

SEQ ID NO: 22045 - protein, 11 aa, Artificial Sequence
  Perilipin-2 (230-240)
RAYQQALSRVK

SEQ ID NO: 22046 - protein, 9 aa, Artificial Sequence
  Probable E3 ubiquitin-protein ligase HERC1 (2112-2120)
RAYSGNLYH

SEQ ID NO: 22047 - protein, 9 aa, Artificial Sequence
  Fibronectin isoform 6 (1162-1170)
RDAPIVNKV

SEQ ID NO: 22048 - protein, 17 aa, Artificial Sequence
  Vimentin (450-466)
RDGQVINETSQHHDDLE

SEQ ID NO: 22049 - protein, 15 aa, Artificial Sequence
  Protein NipSnap homolog 2 (40-54)
REDSWLKSLFVRKVD

SEQ ID NO: 22050 - protein, 11 aa, Artificial Sequence
  Vimentin (196-206)
REEAENTLQSF

SEQ ID NO: 22051 - protein, 9 aa, Artificial Sequence
  Transcription elongation factor SPT5 (606-614)
REGEIRHLF

SEQ ID NO: 22052 - protein, 43 aa, Artificial Sequence
  Vimentin (258-300)
RETNLDSLPLVDTHSKRTLLIKTVETRDGQVINETSQHHDDLE

SEQ ID NO: 22053 - protein, 8 aa, Artificial Sequence
  Myosin-7 (243-250)
RFGKFIRI

SEQ ID NO: 22054 - protein, 12 aa, Artificial Sequence
  Protein YIF1B (85-96)
RFIPITKLKYYF

SEQ ID NO: 22055 - protein, 11 aa, Artificial Sequence
  Filamin-A (2059-2069)
RFIPRENGVYL

SEQ ID NO: 22056 - protein, 9 aa, Artificial Sequence
  Uncharacterized protein C11orf96 (157-165)
RFKTQPVTF

SEQ ID NO: 22057 - protein, 9 aa, Artificial Sequence
  Serine/threonine-protein phosphatase 2A 56 kDa regulatory subunit epsilon isoform (227-235)
RFVYETEHF

SEQ ID NO: 22058 - protein, 13 aa, Artificial Sequence
  NADH dehydrogenase (ubiquinone) 1 beta subcomplex subunit 5, mitochondrial (61-73)
RFYDRRFLKLLRF

SEQ ID NO: 22059 - protein, 11 aa, Artificial Sequence
  Collagen alpha-2(I) chain (495-505)
RGAPGAVGAPG

SEQ ID NO: 22060 - protein, 10 aa, Artificial Sequence
  Nuclear receptor corepressor 2 (1514-1523)
RGAPVIVPEL

SEQ ID NO: 22061 - protein, 9 aa, Artificial Sequence
  Pre-mRNA-processing-splicing factor 8 (763-771)
RGATVDKTV

SEQ ID NO: 22062 - protein, 10 aa, Artificial Sequence
  Inositol 1,4,5-trisphosphate receptor type 2 (1365-1374)
RGDESGPLAY

SEQ ID NO: 22063 - protein, 9 aa, Artificial Sequence
  Collagen alpha-2(V) chain (785-793)
RGFTGLQGL

SEQ ID NO: 22064 - protein, 10 aa, Artificial Sequence
  Inactive phospholipase C-like protein 2 (6-15)
RGGAAGGALP

SEQ ID NO: 22065 - protein, 8 aa, Artificial Sequence
  Eukaryotic translation initiation factor 4 gamma 1 (993-1000)
RGGPPGPP

SEQ ID NO: 22066 - protein, 11 aa, Artificial Sequence
  Plexin-B3 (190-200)
RGLAGKLSAGV

SEQ ID NO: 22067 - protein, 14 aa, Artificial Sequence
  Collagen alpha-1(III) chain (761-774)
RGPTGPIGPPGPAG

SEQ ID NO: 22068 - protein, 9 aa, Artificial Sequence
  Heat shock protein HSP 90-beta (103-111)
RGTKVILHL

SEQ ID NO: 22069 - protein, 9 aa, Artificial Sequence
  UDP-N-acetylhexosamine pyrophosphorylase-like protein 1 (111-119)
RGVEFVHVY

SEQ ID NO: 22070 - protein, 6 aa, Artificial Sequence
  Msx2-interacting protein (535-540)
RHFCRY

SEQ ID NO: 22071 - protein, 10 aa, Artificial Sequence
  Krueppel-like factor 15 (280-289)
RIAPVPIAAK

SEQ ID NO: 22072 - protein, 10 aa, Artificial Sequence
  Phosphoglycerate kinase 1 (39-48)
RIKAAVPSIK

SEQ ID NO: 22073 - protein, 8 aa, Artificial Sequence
  General transcription factor II-I (492-499)
RIKFVIKR

SEQ ID NO: 22074 - protein, 11 aa, Artificial Sequence
  Alpha-globin transcription factor CP2 (148-158)
RILDIDIPMSV

SEQ ID NO: 22075 - protein, 9 aa, Artificial Sequence
  Asparagine synthetase (glutamine-hydrolyzing) (153-161)
RILFNNAVK

SEQ ID NO: 22076 - protein, 9 aa, Artificial Sequence
  Nuclear factor of activated T-cells, cytoplasmic 2 (247-255)
RILKPHAFY

SEQ ID NO: 22077 - protein, 10 aa, Artificial Sequence
  cAMP-dependent protein kinase type I-beta regulatory subunit (233-242)
RILMGSTLRK

SEQ ID NO: 22078 - protein, 11 aa, Artificial Sequence
  CCR4-NOT transcription complex subunit 1 (238-248)
RILPDSGGVAK

SEQ ID NO: 22079 - protein, 9 aa, Artificial Sequence
  Centrin-2 (164-172)
RIMKKTSLY

SEQ ID NO: 22080 - protein, 10 aa, Artificial Sequence
  Transcription factor HES-1 (49-58)
RINESLSQLK

SEQ ID NO: 22081 - protein, 9 aa, Artificial Sequence
  Vigilin (291-299)
RINIPPPSV

SEQ ID NO: 22082 - protein, 9 aa, Artificial Sequence
  Pumilio homolog 1 (920-928)
RIRGHVLSL

SEQ ID NO: 22083 - protein, 9 aa, Artificial Sequence
  Proteasome subunit beta type-5 (76-84)
RISGATFSV

SEQ ID NO: 22084 - protein, 11 aa, Artificial Sequence
  Cubilin (1911-1921)
RIYDGPSIHAR

SEQ ID NO: 22085 - protein, 9 aa, Artificial Sequence
  Centrosomal protein C10orf90 (654-662)
RIYDNLPEV

SEQ ID NO: 22086 - protein, 13 aa, Artificial Sequence
  Probable phospholipid-transporting ATPase VB (153-165)
RIYERKEQTYVQK

SEQ ID NO: 22087 - protein, 27 aa, Artificial Sequence
  HLA class I histocompatibility antigen, A-23 alpha chain (339-365)
RKGGSYSQAASSDSAQGSDVSLTACKV

SEQ ID NO: 22088 - protein, 27 aa, Artificial Sequence
  HLA class I histocompatibility antigen, A-1 alpha chain (314-340)
RKGGSYTQAASSDSAQGSDVSLTACKV

SEQ ID NO: 22089 - protein, 9 aa, Artificial Sequence
  Ellis-van Creveld syndrome protein (396-404)
RLAAISHGL

SEQ ID NO: 22090 - protein, 9 aa, Artificial Sequence
  Interferon-induced protein with tetratricopeptide repeats 1 (110-118)
RLAEAQTYL

SEQ ID NO: 22091 - protein, 9 aa, Artificial Sequence
  EMILIN-1 (205-213)
RLAEDVQRA

SEQ ID NO: 22092 - protein, 9 aa, Artificial Sequence
  Periodic tryptophan protein 2 homolog (276-284)
RLAKYFFNK

SEQ ID NO: 22093 - protein, 9 aa, Artificial Sequence
  Keratin, type I cytoskeletal 24 (150-158)
RLANYLDKV

SEQ ID NO: 22094 - protein, 9 aa, Artificial Sequence
  Histone-lysine N-methyltransferase 2D (2762-2770)
RLAPSMAMV

SEQ ID NO: 22095 - protein, 9 aa, Artificial Sequence
  Ankyrin-2 (1004-1012)
RLATMPPMV

SEQ ID NO: 22096 - protein, 10 aa, Artificial Sequence
  Coatomer subunit gamma-1 (208-217)
RLAVNKMISK

SEQ ID NO: 22097 - protein, 9 aa, Artificial Sequence
  Apolipoprotein E (246-254)
RLDEVKEQV

SEQ ID NO: 22098 - protein, 8 aa, Artificial Sequence
  Vimentin (217-224)
RLDLERKV

SEQ ID NO: 22099 - protein, 10 aa, Artificial Sequence
  Protein kinase C and casein kinase substrate in neurons protein 2 (468-477)
RLDNGQVGLY

SEQ ID NO: 22100 - protein, 9 aa, Artificial Sequence
  Sestrin-3 (71-79)
RLDNITQVM

SEQ ID NO: 22101 - protein, 9 aa, Artificial Sequence
  Glutamine and serine-rich protein 1 (616-624)
RLEDQVIGV

SEQ ID NO: 22102 - protein, 9 aa, Artificial Sequence
  Myosin-10 (1407-1415)
RLEEKALAY

SEQ ID NO: 22103 - protein, 11 aa, Artificial Sequence
  40S ribosomal protein S9 (9-19)
RLFEGNALLRR

SEQ ID NO: 22104 - protein, 9 aa, Artificial Sequence
  Spectrin beta chain, erythrocytic (38-46)
RLFERSRIK

SEQ ID NO: 22105 - protein, 9 aa, Artificial Sequence
  Unconventional myosin-XVIIIa (821-829)
RLFHERTFV

SEQ ID NO: 22106 - protein, 10 aa, Artificial Sequence
  Cytochrome P450 4V2 (390-399)
RLFPSVPLFA

SEQ ID NO: 22107 - protein, 9 aa, Artificial Sequence
  Mitogen-activated protein kinase-binding protein 1 (328-336)
RLFSGVANA

SEQ ID NO: 22108 - protein, 9 aa, Artificial Sequence
  Cysteine andine-rich protein 2 (87-95)
RLGIKPESV

SEQ ID NO: 22109 - protein, 8 aa, Artificial Sequence
  E3 ubiquitin-protein ligase HECTD1 (175-182)
RLGVISKV

SEQ ID NO: 22110 - protein, 9 aa, Artificial Sequence
  Protein fantom (56-64)
RLHDENILL

SEQ ID NO: 22111 - protein, 10 aa, Artificial Sequence
  General transcription factor 3C polypeptide 1 (377-386)
RLIESLFTIQ

SEQ ID NO: 22112 - protein, 9 aa, Artificial Sequence
  Heterogeneous nuclear ribonucleoprotein U-like protein 1 (490-498)
RLIQIAARK

SEQ ID NO: 22113 - protein, 9 aa, Artificial Sequence
  Cytochrome c oxidase subunit 2 (134-142)
RLLDVDNRV

SEQ ID NO: 22114 - protein, 11 aa, Artificial Sequence
  Keratin, type I cytoskeletal 18 (324-334)
RLLEDGEDFNL

SEQ ID NO: 22115 - protein, 10 aa, Artificial Sequence
  Cytoplasmic FMR1-interacting protein 1 (113-122)
RLLGYQGIAV

SEQ ID NO: 22116 - protein, 10 aa, Artificial Sequence
  Histone-lysine N-methyltransferase 2D (4468-4477)
RLLNLDLDLW

SEQ ID NO: 22117 - protein, 11 aa, Artificial Sequence
  Homeobox protein Hox-B9 (220-230)
RLLNLSERQVK

SEQ ID NO: 22118 - protein, 9 aa, Artificial Sequence
  Apolipoprotein C-II (4-12)
RLLPALFLV

SEQ ID NO: 22119 - protein, 10 aa, Artificial Sequence
  Syndecan-3 (138-147)
RLLPLPLTTV

SEQ ID NO: 22120 - protein, 13 aa, Artificial Sequence
  Long-chain fatty acid transport protein 1 (273-285)
RLLPQVDTTGTFK

SEQ ID NO: 22121 - protein, 9 aa, Artificial Sequence
  Muskelin (14-22)
RLLPYALHK

SEQ ID NO: 22122 - protein, 9 aa, Artificial Sequence
  Regulator of G-protein signaling 12 (718-726)
RLLQDPVGV

SEQ ID NO: 22123 - protein, 11 aa, Artificial Sequence
  G2/mitotic-specific cyclin-B1 (217-227)
RLLQETMYMTV

SEQ ID NO: 22124 - protein, 11 aa, Artificial Sequence
  Interleukin-24 (90-100)
RLLQQEVLQNV

SEQ ID NO: 22125 - protein, 9 aa, Artificial Sequence
  Unconventional myosin-Ic (138-146)
RLLQSNPVL

SEQ ID NO: 22126 - protein, 10 aa, Artificial Sequence
  AP-1 complex subunit beta-1 (528-537)
RLLSTDPVAA

SEQ ID NO: 22127 - protein, 9 aa, Artificial Sequence
  Neurochondrin (561-569)
RLLSTSPAL

SEQ ID NO: 22128 - protein, 10 aa, Artificial Sequence
  Bombesin receptor-activated protein C6orf89 (119-128)
RLMSLPIAKK

SEQ ID NO: 22129 - protein, 9 aa, Artificial Sequence
  Cytochrome c oxidase subunit 2 (178-186)
RLNQTTFTA

SEQ ID NO: 22130 - protein, 9 aa, Artificial Sequence
  Lysosome-associated membraneoprotein 2 (273-281)
RLNSSTIKY

SEQ ID NO: 22131 - protein, 9 aa, Artificial Sequence
  Lysosomal thioesterase PPT2 (8-16)
RLPAAWVLL

SEQ ID NO: 22132 - protein, 10 aa, Artificial Sequence
  Protein scribble homolog (257-266)
RLPDGIGQLK

SEQ ID NO: 22133 - protein, 9 aa, Artificial Sequence
  Neuron navigator 2 (921-929)
RLPDGMAVV

SEQ ID NO: 22134 - protein, 10 aa, Artificial Sequence
  Lysine-specific demethylase 5B (1280-1289)
RLPEGDALRY

SEQ ID NO: 22135 - protein, 11 aa, Artificial Sequence
  Transformation/transcription domain-associated protein (696-706)
RLPEMGSNVEL

SEQ ID NO: 22136 - protein, 9 aa, Artificial Sequence
  Probable E3 ubiquitin-protein ligase HERC6 (578-586)
RLPENTFNI

SEQ ID NO: 22137 - protein, 9 aa, Artificial Sequence
  WD repeat-containing protein 90 (1359-1367)
RLPEPVHGV

SEQ ID NO: 22138 - protein, 11 aa, Artificial Sequence
  YrdC domain-containing protein, mitochondrial (48-58)
RLPGSGAVQAA

SEQ ID NO: 22139 - protein, 11 aa, Artificial Sequence
  Insulin receptor substrate 2 (1043-1053)
RLPPASAVATA

SEQ ID NO: 22140 - protein, 9 aa, Artificial Sequence
  Zinc finger BED domain-containing protein 6 (445-453)
RLPSETYFF

SEQ ID NO: 22141 - protein, 9 aa, Artificial Sequence
  DNA-dependent protein kinase catalytic subunit (2530-2538)
RLPSNTLDR

SEQ ID NO: 22142 - protein, 9 aa, Artificial Sequence
  T-cell immunomodulatory protein (6-14)
RLPSSWALF

SEQ ID NO: 22143 - protein, 10 aa, Artificial Sequence
  Peroxisome proliferator-activated receptor gamma coactivator-related protein 1 (1096-1105)
RLQAPELANV

SEQ ID NO: 22144 - protein, 9 aa, Artificial Sequence
  DNA-dependent protein kinase catalytic subunit (14-22)
RLQETLSAA

SEQ ID NO: 22145 - protein, 9 aa, Artificial Sequence
  DNA ligase 3 (740-748)
RLQNELDMV

SEQ ID NO: 22146 - protein, 11 aa, Artificial Sequence
  2'-5'-oligoadenylate synthase 3 (18-28)
RLQPRKEFVEK

SEQ ID NO: 22147 - protein, 9 aa, Artificial Sequence
  Plectin (2433-2441)
RLREAIAEL

SEQ ID NO: 22148 - protein, 9 aa, Artificial Sequence
  Tripeptidyl-peptidase 1 (60-68)
RLSELVQAV

SEQ ID NO: 22149 - protein, 9 aa, Artificial Sequence
  Desumoylating isopeptidase 1 (23-31)
RLSPIMLGK

SEQ ID NO: 22150 - protein, 9 aa, Artificial Sequence
  GCN1 general control of amino-acid synthesis 1-like 1 (2013-2021)
RLTSADALR

SEQ ID NO: 22151 - protein, 12 aa, Artificial Sequence
  Melanoma antigen preferentially expressed in tumors (25-36)
RLVELAGQSLLK

SEQ ID NO: 22152 - protein, 8 aa, Artificial Sequence
  Lysophosphatidic acid phosphatase type 6 (9-16)
RLWTPVGV

SEQ ID NO: 22153 - protein, 11 aa, Artificial Sequence
  Tubulin-specific chaperone C (217-227)
RLYGNPNTLRL

SEQ ID NO: 22154 - protein, 10 aa, Artificial Sequence
  Tetratricopeptide repeat protein 30A (82-91)
RLYQAQALYK

SEQ ID NO: 22155 - protein, 9 aa, Artificial Sequence
  Protein asteroid homolog 1 (274-282)
RLYSGSLVH

SEQ ID NO: 22156 - protein, 9 aa, Artificial Sequence
  Filamin-A (2280-2288)
RLYSVSYLL

SEQ ID NO: 22157 - protein, 10 aa, Artificial Sequence
  Unconventional myosin-X (1476-1485)
RLYTKLLNEA

SEQ ID NO: 22158 - protein, 10 aa, Artificial Sequence
  Vimentin (13-22)
RMFGGPGTAS

SEQ ID NO: 22159 - protein, 15 aa, Artificial Sequence
  Vimentin (13-27)
RMFGGPGTASRPSSS

SEQ ID NO: 22160 - protein, 16 aa, Artificial Sequence
  Vimentin (13-28)
RMFGGPGTASRPSSSR

SEQ ID NO: 22161 - protein, 17 aa, Artificial Sequence
  Vimentin (13-29)
RMFGGPGTASRPSSSRS

SEQ ID NO: 22162 - protein, 10 aa, Artificial Sequence
  Mitochondrial 2-oxoglutarate/malate carrier protein (240-249)
RMIDGKPEYK

SEQ ID NO: 22163 - protein, 14 aa, Artificial Sequence
  Spermine synthase (79-92)
RMKELSQDSTGRVK

SEQ ID NO: 22164 - protein, 9 aa, Artificial Sequence
  Eukaryotic translation initiation factor 2 subunit 3 (352-360)
RMVGQVLGA

SEQ ID NO: 22165 - protein, 10 aa, Artificial Sequence
  tRNA (adenine(58)-N(1))-methyltransferase non-catalytic subunit TRM6 (197-206)
RNADGLIVAS

SEQ ID NO: 22166 - protein, 9 aa, Artificial Sequence
  Probable global transcription activator SNF2L1 (166-174)
RNIPGPHMV

SEQ ID NO: 22167 - protein, 9 aa, Artificial Sequence
  Melanocyte protein PMEL (241-249)
RNQPLTFAL

SEQ ID NO: 22168 - protein, 32 aa, Artificial Sequence
  HLA class I histocompatibility antigen, A-23 alpha chain (334-365)
RNSSDRKGGSYSQAASSDSAQGSDVSLTACKV

SEQ ID NO: 22169 - protein, 9 aa, Artificial Sequence
  Heterogeneous nuclear ribonucleoprotein K (37-45)
RNTDEMVEL

SEQ ID NO: 22170 - protein, 9 aa, Artificial Sequence
  V-type proton ATPase subunit D (136-144)
RNYAKAVEL

SEQ ID NO: 22171 - protein, 10 aa, Artificial Sequence
  Fibronectin isoform 6 (1712-1721)
RPAQGVVTTL

SEQ ID NO: 22172 - protein, 9 aa, Artificial Sequence
  Putative inactive carbonic anhydrase 5B-like protein (84-92)
RPAQKHWVL

SEQ ID NO: 22173 - protein, 9 aa, Artificial Sequence
  Glycosylated lysosomal membrane protein (121-129)
RPAQPPRLL

SEQ ID NO: 22174 - protein, 9 aa, Artificial Sequence
  Chondroitin sulfate synthase 2 (384-392)
RPASRFEVL

SEQ ID NO: 22175 - protein, 8 aa, Artificial Sequence
  L-dopachrome tautomerase (266-273)
RPDDPTLI

SEQ ID NO: 22176 - protein, 9 aa, Artificial Sequence
  Cancer/testis antigen 2 (82-90)
RPDSRLLQL

SEQ ID NO: 22177 - protein, 15 aa, Artificial Sequence
  Titin (9911-9925)
RPGPPVGPIKFESVS

SEQ ID NO: 22178 - protein, 21 aa, Artificial Sequence
  Glia-derived nexin (58-78)
RPHDNIVISPHGIASVLGMLQ

SEQ ID NO: 22179 - protein, 17 aa, Artificial Sequence
  Collagen alpha-2(I) chain (949-965)
RPKDYEVDATLKSLNNQ

SEQ ID NO: 22180 - protein, 9 aa, Artificial Sequence
  6-phosphofructo-2-kinase/fructose-2,6-bisphosphatase 2 (486-494)
RPLKPLSPL

SEQ ID NO: 22181 - protein, 10 aa, Artificial Sequence
  Protein transport protein Sec23A (259-268)
RPLRSSGVAL

SEQ ID NO: 22182 - protein, 9 aa, Artificial Sequence
  VPS10 domain-containing receptor SorCS1 (1153-1161)
RPNVPQTEL

SEQ ID NO: 22183 - protein, 7 aa, Artificial Sequence
  40S ribosomal protein S26 (109-115)
RPPPKPM

SEQ ID NO: 22184 - protein, 10 aa, Artificial Sequence
  Dystonin (1741-1750)
RPQEGGRITL

SEQ ID NO: 22185 - protein, 8 aa, Artificial Sequence
  Kelch-like protein 20 (247-254)
RPQLPQVL

SEQ ID NO: 22186 - protein, 8 aa, Artificial Sequence
  Renin receptor (59-66)
RPRATVMV

SEQ ID NO: 22187 - protein, 9 aa, Artificial Sequence
  UPF0524 protein C3orf70 (87-95)
RPREPTNTI

SEQ ID NO: 22188 - protein, 9 aa, Artificial Sequence
  Thiosulfate sulfurtransferase/rhodanese-like domain-containing protein 2 (485-493)
RPRIPRELL

SEQ ID NO: 22189 - protein, 9 aa, Artificial Sequence
  Homocysteine-responsive endoplasmic reticulum-resident ubiquitin-like domain member 1 protein (48-56)
RPRPEDQRL

SEQ ID NO: 22190 - protein, 9 aa, Artificial Sequence
  Transmembraneoprotein NMB (331-339)
RPSKPTPSL

SEQ ID NO: 22191 - protein, 9 aa, Artificial Sequence
  Rho GTPase-activating protein 7 (565-573)
RPSLNSVSL

SEQ ID NO: 22192 - protein, 9 aa, Artificial Sequence
  Vimentin (45-53)
RPSTSRSLY

SEQ ID NO: 22193 - protein, 10 aa, Artificial Sequence
  Vimentin (45-54)
RPSTSRSLYA

SEQ ID NO: 22194 - protein, 8 aa, Artificial Sequence
  Kinase D-interacting substrate of 220 kDa (97-104)
RPSVKTSL

SEQ ID NO: 22195 - protein, 9 aa, Artificial Sequence
  Integrin beta-5 (445-453)
RPVGFRDSL

SEQ ID NO: 22196 - protein, 9 aa, Artificial Sequence
  Dual specificity protein phosphatase 6 (6-14)
RPVPFASEM

SEQ ID NO: 22197 - protein, 9 aa, Artificial Sequence
  L-dopachrome tautomerase (69-77)
RPWSGPYIL

SEQ ID NO: 22198 - protein, 9 aa, Artificial Sequence
  Mannosyl-oligosaccharide 1,2-alpha-mannosidase IB (132-140)
RQAEKYYIL

SEQ ID NO: 22199 - protein, 9 aa, Artificial Sequence
  V-type proton ATPase subunit H (132-140)
RQDPFTVHM

SEQ ID NO: 22200 - protein, 9 aa, Artificial Sequence
  Dol-P-Man:Man(5)GlcNAc(2)-PP-Dol alpha-1,3-mannosyltransferase (218-226)
RQFLFHWTV

SEQ ID NO: 22201 - protein, 13 aa, Artificial Sequence
  Cohesin subunit SA-1 (249-261)
RQYEAERNKMIGK

SEQ ID NO: 22202 - protein, 9 aa, Artificial Sequence
  X-ray repair cross-complementing protein 5 (431-439)
RQYMFSSLK

SEQ ID NO: 22203 - protein, 7 aa, Artificial Sequence
  HLA class II histocompatibility antigen, DQ alpha 1 chain (55-61)
RRFDPQF

SEQ ID NO: 22204 - protein, 9 aa, Artificial Sequence
  HLA class II histocompatibility antigen, DQ alpha 1 chain (55-63)
RRFDPQFAL

SEQ ID NO: 22205 - protein, 10 aa, Artificial Sequence
  HLA class II histocompatibility antigen, DQ alpha 1 chain (55-64)
RRFDPQFALT

SEQ ID NO: 22206 - protein, 9 aa, Artificial Sequence
  Inosine-5'-monophosphate dehydrogenase 2 (355-363)
RRFGVPVIA

SEQ ID NO: 22207 - protein, 9 aa, Artificial Sequence
  Basement membrane-specific heparan sulfate proteoglycan core protein (587-595)
RRFLVHDSF

SEQ ID NO: 22208 - protein, 10 aa, Artificial Sequence
  C-1-tetrahydrofolate synthase, cytoplasmic (487-496)
RRFSDIQIRR

SEQ ID NO: 22209 - protein, 7 aa, Artificial Sequence
  PDZ domain-containing protein 2 (308-314)
RRFSKGG

SEQ ID NO: 22210 - protein, 9 aa, Artificial Sequence
  Casein kinase I isoform alpha (106-114)
RRFTMKTVL

SEQ ID NO: 22211 - protein, 8 aa, Artificial Sequence
  Cytochrome c oxidase subunit 7C, mitochondrial (7-14)
RRFTTSVV

SEQ ID NO: 22212 - protein, 8 aa, Artificial Sequence
  Acyl-CoA desaturase (174-181)
RRGFFFSH

SEQ ID NO: 22213 - protein, 37 aa, Artificial Sequence
  Growth arrest-specific protein 6 (314-350)
RRGPRPWQDILPCVPFSVAKSVKSLYLGRMFSGTPVI

SEQ ID NO: 22214 - protein, 9 aa, Artificial Sequence
  Homeobox protein Hox-A4 (244-252)
RRIEIAHTL

SEQ ID NO: 22215 - protein, 9 aa, Artificial Sequence
  WD repeat-containing protein 6 (233-241)
RRISGHVGI

SEQ ID NO: 22216 - protein, 9 aa, Artificial Sequence
  Protein kinase C-binding protein 1 (354-362)
RRKFGVFNY

SEQ ID NO: 22217 - protein, 9 aa, Artificial Sequence
  Hemicentin-1 (827-835)
RRLDNMPIF

SEQ ID NO: 22218 - protein, 10 aa, Artificial Sequence
  Hemicentin-1 (827-836)
RRLDNMPIFS

SEQ ID NO: 22219 - protein, 11 aa, Artificial Sequence
  Hemicentin-1 (827-837)
RRLDNMPIFSR

SEQ ID NO: 22220 - protein, 9 aa, Artificial Sequence
  Golgi resident protein GCP60 (73-81)
RRLEQRWGF

SEQ ID NO: 22221 - protein, 9 aa, Artificial Sequence
  N-alpha-acetyltransferase 10 (82-90)
RRLGLAQKL

SEQ ID NO: 22222 - protein, 9 aa, Artificial Sequence
  Caldesmon (347-355)
RRLKEEIER

SEQ ID NO: 22223 - protein, 10 aa, Artificial Sequence
  Glyoxylate reductase/hydroxypyruvate reductase (170-179)
RRLKPFGVQR

SEQ ID NO: 22224 - protein, 9 aa, Artificial Sequence
  Ubiquitin-conjugating enzyme E2 variant 3 (9-17)
RRLLGKYKF

SEQ ID NO: 22225 - protein, 10 aa, Artificial Sequence
  L-dopachrome tautomerase (529-538)
RRLRKGYTPL

SEQ ID NO: 22226 - protein, 13 aa, Artificial Sequence
  Vimentin (12-24)
RRMFGGPGTASRP

SEQ ID NO: 22227 - protein, 16 aa, Artificial Sequence
  Vimentin (12-27)
RRMFGGPGTASRPSSS

SEQ ID NO: 22228 - protein, 18 aa, Artificial Sequence
  Vimentin (12-29)
RRMFGGPGTASRPSSSRS

SEQ ID NO: 22229 - protein, 9 aa, Artificial Sequence
  G-protein coupled receptor 143 (256-264)
RRMGAVIKI

SEQ ID NO: 22230 - protein, 9 aa, Artificial Sequence
  Polymerase I and transcript release factor (148-156)
RRNFKVMIY

SEQ ID NO: 22231 - protein, 33 aa, Artificial Sequence
  HLA class I histocompatibility antigen, A-23 alpha chain (333-365)
RRNSSDRKGGSYSQAASSDSAQGSDVSLTACKV

SEQ ID NO: 22232 - protein, 10 aa, Artificial Sequence
  Sodium/potassium-transporting ATPase subunit alpha-3 (943-952)
RRNSVFQQGM

SEQ ID NO: 22233 - protein, 9 aa, Artificial Sequence
  NADH dehydrogenase (ubiquinone) 1 alpha subcomplex subunit 13 (48-56)
RRRLQIEDF

SEQ ID NO: 22234 - protein, 9 aa, Artificial Sequence
  Dual specificity protein phosphatase 4 (313-321)
RRSIISPNF

SEQ ID NO: 22235 - protein, 9 aa, Artificial Sequence
  Hsp90 co-chaperone Cdc37 (166-174)
RRWDDSQKY

SEQ ID NO: 22236 - protein, 9 aa, Artificial Sequence
  Transmembraneoprotein NMB (169-177)
RRWNFIYVF

SEQ ID NO: 22237 - protein, 10 aa, Artificial Sequence
  Transmembraneoprotein NMB (169-178)
RRWNFIYVFH

SEQ ID NO: 22238 - protein, 9 aa, Artificial Sequence
  Eukaryotic translation initiation factor 3 subunit L (537-545)
RRYGDFFIR

SEQ ID NO: 22239 - protein, 8 aa, Artificial Sequence
  Eukaryotic initiation factor 4A-I (168-175)
RRYLSPKY

SEQ ID NO: 22240 - protein, 9 aa, Artificial Sequence
  Chondroitin sulfate glucuronyltransferase (416-424)
RRYQPRLRF

SEQ ID NO: 22241 - protein, 12 aa, Artificial Sequence
  60S ribosomal protein L6 (59-70)
RSAMYSRKAMYK

SEQ ID NO: 22242 - protein, 9 aa, Artificial Sequence
  Krueppel-like factor 6 (250-258)
RSDELTRHF

SEQ ID NO: 22243 - protein, 9 aa, Artificial Sequence
  Synaptotagmin-like protein 2 (665-673)
RSDPYVKAY

SEQ ID NO: 22244 - protein, 8 aa, Artificial Sequence
  Isoleucine-tRNA ligase, cytoplasmic (402-409)
RSDTPLIY

SEQ ID NO: 22245 - protein, 9 aa, Artificial Sequence
  ETS homologous factor (209-217)
RSEGVFRFL

SEQ ID NO: 22246 - protein, 9 aa, Artificial Sequence
  Phosphatidylinositide phosphatase SAC2 (349-357)
RSEKETVAY

SEQ ID NO: 22247 - protein, 20 aa, Artificial Sequence
  Keratin, type I cytoskeletal 9 (13-32)
RSGGGGGGGLGSGGSIRSSY

SEQ ID NO: 22248 - protein, 10 aa, Artificial Sequence
  Son of sevenless homolog 2 (593-602)
RSGIPIIKGG

SEQ ID NO: 22249 - protein, 9 aa, Artificial Sequence
  Manganese-transporting ATPase 13A1 (667-675)
RSIDGSIVL

SEQ ID NO: 22250 - protein, 9 aa, Artificial Sequence
  Basement membrane-specific heparan sulfate proteoglycan core protein (92-100)
RSIEYSPQL

SEQ ID NO: 22251 - protein, 9 aa, Artificial Sequence
  Fragile X mental retardation syndrome-related protein 1 (190-198)
RSIRTKLML

SEQ ID NO: 22252 - protein, 9 aa, Artificial Sequence
  LIM domain kinase 2 (381-389)
RSLDHPNVL

SEQ ID NO: 22253 - protein, 16 aa, Artificial Sequence
  rRNA-processing protein UTP23 homolog (234-249)
RSNPKVLSEKQNAEGE

SEQ ID NO: 22254 - protein, 13 aa, Artificial Sequence
  Histone H2B type 2-F (32-44)
RSRKESYSVYVYK

SEQ ID NO: 22255 - protein, 9 aa, Artificial Sequence
  Deoxynucleotidyltransferase terminal-interacting protein 2 (272-280)
RSSENILTV

SEQ ID NO: 22256 - protein, 8 aa, Artificial Sequence
  DNA replication licensing factor MCM5 (603-610)
RSSIPITV

SEQ ID NO: 22257 - protein, 10 aa, Artificial Sequence
  DBIRD complex subunit ZNF326 (80-89)
RSSLGGRDLY

SEQ ID NO: 22258 - protein, 9 aa, Artificial Sequence
  HMG box-containing protein 1 (133-141)
RSSPVHIIA

SEQ ID NO: 22259 - protein, 9 aa, Artificial Sequence
  Helicase with zinc finger domain 2 (147-155)
RSSSEVLVL

SEQ ID NO: 22260 - protein, 9 aa, Artificial Sequence
  Cytoplasmic dynein 1 heavy chain 1 (3474-3482)
RSTALLKSL

SEQ ID NO: 22261 - protein, 9 aa, Artificial Sequence
  Cyclin-dependent kinase 5 activator 1 (179-187)
RSVDRSLLL

SEQ ID NO: 22262 - protein, 9 aa, Artificial Sequence
  Annexin A2 (220-228)
RSVPHLQKV

SEQ ID NO: 22263 - protein, 9 aa, Artificial Sequence
  Proline and serine-rich protein 2 (7-15)
RSVPTPLVM

SEQ ID NO: 22264 - protein, 9 aa, Artificial Sequence
  Signal peptidase complex subunit 3 (35-43)
RSVPVRLHV

SEQ ID NO: 22265 - protein, 11 aa, Artificial Sequence
  Zinc finger protein 770 (328-338)
RSYNYKTIVKK

SEQ ID NO: 22266 - protein, 13 aa, Artificial Sequence
  Protein Hook homolog 3 (706-718)
RSYPGHVQPATAR

SEQ ID NO: 22267 - protein, 9 aa, Artificial Sequence
  Annexin A1 (228-236)
RSYPQLRRV

SEQ ID NO: 22268 - protein, 9 aa, Artificial Sequence
  Coatomer subunit alpha (1106-1114)
RTALNLFFK

SEQ ID NO: 22269 - protein, 9 aa, Artificial Sequence
  Neuron navigator 2 (898-906)
RTDDITSGY

SEQ ID NO: 22270 - protein, 9 aa, Artificial Sequence
  Glycine-tRNA ligase (606-614)
RTDEIGVAF

SEQ ID NO: 22271 - protein, 9 aa, Artificial Sequence
  Cirhin (46-54)
RTDGTVEIY

SEQ ID NO: 22272 - protein, 9 aa, Artificial Sequence
  Origin recognition complex subunit 5 (322-330)
RTDKRFFLK

SEQ ID NO: 22273 - protein, 10 aa, Artificial Sequence
  1-phosphatidylinositol 4,5-bisphosphate phosphodiesterase beta-1 (39-48)
RTDPQGFFFY

SEQ ID NO: 22274 - protein, 9 aa, Artificial Sequence
  Dedicator of cytokinesis protein 9 (1494-1502)
RTEASQLLY

SEQ ID NO: 22275 - protein, 9 aa, Artificial Sequence
  DDB1- and CUL4-associated factor 16 (191-199)
RTEPINTTY

SEQ ID NO: 22276 - protein, 9 aa, Artificial Sequence
  Rho guanine nucleotide exchange factor 2 (679-687)
RTFNGSIEL

SEQ ID NO: 22277 - protein, 11 aa, Artificial Sequence
  Insulin receptor substrate 2 (718-728)
RTFPASGGGYK

SEQ ID NO: 22278 - protein, 8 aa, Artificial Sequence
  Vigilin (146-153)
RTGAHLEL

SEQ ID NO: 22279 - protein, 8 aa, Artificial Sequence
  E3 ubiquitin-protein ligase HERC2 (17-24)
RTGSPLSL

SEQ ID NO: 22280 - protein, 13 aa, Artificial Sequence
  Prelamin-A/C (16-28)
RTGTLLAQHPAWG

SEQ ID NO: 22281 - protein, 9 aa, Artificial Sequence
  TGF-beta receptor type-1 (199-207)
RTIARTIVL

SEQ ID NO: 22282 - protein, 9 aa, Artificial Sequence
  Nuclear pore complex protein Nup155 (332-340)
RTIDRSVFK

SEQ ID NO: 22283 - protein, 9 aa, Artificial Sequence
  Protein CASP (616-624)
RTIGFFYTL

SEQ ID NO: 22284 - protein, 9 aa, Artificial Sequence
  Bifunctional glutamate/proline-tRNA ligase (1278-1286)
RTIGVMTMV

SEQ ID NO: 22285 - protein, 9 aa, Artificial Sequence
  Helicase-like transcription factor (616-624)
RTIQRPVTM

SEQ ID NO: 22286 - protein, 9 aa, Artificial Sequence
  AF4/FMR2 family member 4 (46-54)
RTISQSSSL

SEQ ID NO: 22287 - protein, 9 aa, Artificial Sequence
  Ankyrin repeat domain-containing protein 17 (1031-1039)
RTKDTPLSL

SEQ ID NO: 22288 - protein, 9 aa, Artificial Sequence
  Inositol 1,4,5-trisphosphate receptor type 3 (1667-1675)
RTLQQMLLK

SEQ ID NO: 22289 - protein, 11 aa, Artificial Sequence
  Phosphatidylserine synthase 1 (8-18)
RTLSKDDVNYK

SEQ ID NO: 22290 - protein, 28 aa, Artificial Sequence
  Heat shock cognate 71 kDa protein (272-299)
RTLSSSTQASIEIDSLYEGIDFYTSITR

SEQ ID NO: 22291 - protein, 9 aa, Artificial Sequence
  60S ribosomal protein L18 (55-63)
RTNRPPLSL

SEQ ID NO: 22292 - protein, 9 aa, Artificial Sequence
  60S ribosomal protein L18 (38-46)
RTNSTFNQV

SEQ ID NO: 22293 - protein, 9 aa, Artificial Sequence
  HLA class II histocompatibility antigen, DM beta chain (111-119)
RTRPPSVQV

SEQ ID NO: 22294 - protein, 9 aa, Artificial Sequence
  Solute carrier family 22 member 6 (423-431)
RTSLAVLGK

SEQ ID NO: 22295 - protein, 9 aa, Artificial Sequence
  Actin-related protein 3 (290-298)
RTVDARLKL

SEQ ID NO: 22296 - protein, 9 aa, Artificial Sequence
  Dolichyl-diphosphooligosaccharide-proteinosyltransferase subunit 1 (38-46)
RTVDLSSHL

SEQ ID NO: 22297 - protein, 9 aa, Artificial Sequence
  Host cell factor 1 (1385-1393)
RTVESGLEV

SEQ ID NO: 22298 - protein, 13 aa, Artificial Sequence
  Myosin-9 (644-656)
RTVGQLYKEQLAK

SEQ ID NO: 22299 - protein, 8 aa, Artificial Sequence
  Probable C-mannosyltransferase DPY19L4 (518-525)
RTVHPILL

SEQ ID NO: 22300 - protein, 31 aa, Artificial Sequence
  Fructose-bisphosphate aldolase A (313-343)
RTVPPAVTGITFLSGGQSEEEASINLNAINK

SEQ ID NO: 22301 - protein, 13 aa, Artificial Sequence
  Programmed cell death protein 6 (100-112)
RTYDRDNSGMIDK

SEQ ID NO: 22302 - protein, 9 aa, Artificial Sequence
  Chondroitin sulfate synthase 2 (347-355)
RTYQEIQEL

SEQ ID NO: 22303 - protein, 9 aa, Artificial Sequence
  Vimentin (36-44)
RTYSLGSAL

SEQ ID NO: 22304 - protein, 9 aa, Artificial Sequence
  Mucolipin-1 (420-428)
RVALPSVMR

SEQ ID NO: 22305 - protein, 11 aa, Artificial Sequence
  Multiple epidermal growth factor-like domains protein 8 (2514-2524)
RVAPDTGVHTV

SEQ ID NO: 22306 - protein, 9 aa, Artificial Sequence
  Rab11 family-interacting protein 5 (210-218)
RVAPPRALL

SEQ ID NO: 22307 - protein, 13 aa, Artificial Sequence
  FUN14 domain-containing protein 1 (35-47)
RVFGHSSGPMVEK

SEQ ID NO: 22308 - protein, 12 aa, Artificial Sequence
  Putative ATP-dependent RNA helicase DHX33 (247-258)
RVFQGAPKGYRK

SEQ ID NO: 22309 - protein, 11 aa, Artificial Sequence
  Annexin A1 (235-245)
RVFQKYTKYSK

SEQ ID NO: 22310 - protein, 9 aa, Artificial Sequence
  Centrosomal protein C10orf90 (146-154)
RVGPPARAL

SEQ ID NO: 22311 - protein, 9 aa, Artificial Sequence
  E3 ubiquitin-protein ligase MIB2 (385-393)
RVIGDLDTV

SEQ ID NO: 22312 - protein, 13 aa, Artificial Sequence
  Protein FAM177A1 (56-68)
RVIHFVSGETMEE

SEQ ID NO: 22313 - protein, 13 aa, Artificial Sequence
  Glyceraldehyde-3-phosphate dehydrogenase (118-130)
RVIISAPSADAPM

SEQ ID NO: 22314 - protein, 10 aa, Artificial Sequence
  Nuclear valosin-containing protein-like (16-25)
RVIQYLTSNK

SEQ ID NO: 22315 - protein, 10 aa, Artificial Sequence
  Translation initiation factor eIF-2B subunit alpha (136-145)
RVLEAAVAAK

SEQ ID NO: 22316 - protein, 10 aa, Artificial Sequence
  Ribosomal RNA-processing protein 8 (380-389)
RVLKPGGLLK

SEQ ID NO: 22317 - protein, 9 aa, Artificial Sequence
  Nidogen-2 (738-746)
RVLRFAVTN

SEQ ID NO: 22318 - protein, 9 aa, Artificial Sequence
  HLA class I histocompatibility antigen, Cw-3 alpha chain (2-10)
RVMAPRTLI

SEQ ID NO: 22319 - protein, 9 aa, Artificial Sequence
  HLA class I histocompatibility antigen, Cw-2 alpha chain (2-10)
RVMAPRTLL

SEQ ID NO: 22320 - protein, 9 aa, Artificial Sequence
  Carbohydrate sulfotransferase 14 (126-134)
RVMKVLAGV

SEQ ID NO: 22321 - protein, 9 aa, Artificial Sequence
  Polycomb group RING finger protein 1 (90-98)
RVMQDIVYK

SEQ ID NO: 22322 - protein, 11 aa, Artificial Sequence
  Spectrin alpha chain, non-erythrocytic 1 (204-214)
RVNEVNQFAAK

SEQ ID NO: 22323 - protein, 19 aa, Artificial Sequence
  Beta-2-microglobulin (80-98)
RVNHVTLSQPKIVKWDRDM

SEQ ID NO: 22324 - protein, 9 aa, Artificial Sequence
  Ribonuclease inhibitor (53-61)
RVNPALAEL

SEQ ID NO: 22325 - protein, 9 aa, Artificial Sequence
  Major centromere autoantigen B (26-34)
RVQSHILHL

SEQ ID NO: 22326 - protein, 9 aa, Artificial Sequence
  Mannose-1-phosphate guanyltransferase alpha (390-398)
RVRIPAEVL

SEQ ID NO: 22327 - protein, 9 aa, Artificial Sequence
  Probable cation-transporting ATPase 13A2 (897-905)
RVRPPGALL

SEQ ID NO: 22328 - protein, 9 aa, Artificial Sequence
  Transmembrane protein 121 (244-252)
RVSAIFVGK

SEQ ID NO: 22329 - protein, 9 aa, Artificial Sequence
  Protein kinase C and casein kinase substrate in neurons protein 2 (92-100)
RVSELHLEV

SEQ ID NO: 22330 - protein, 9 aa, Artificial Sequence
  Ectonucleoside triphosphate diphosphohydrolase 6 (359-367)
RVSEVLQNR

SEQ ID NO: 22331 - protein, 9 aa, Artificial Sequence
  HLA class I histocompatibility antigen, B-15 alpha chain (2-10)
RVTAPRTVL

SEQ ID NO: 22332 - protein, 10 aa, Artificial Sequence
  F-box/LRR-repeat protein 7 (354-363)
RVTDVGIRYV

SEQ ID NO: 22333 - protein, 11 aa, Artificial Sequence
  Titin (16492-16502)
RVTGLIENHDY

SEQ ID NO: 22334 - protein, 9 aa, Artificial Sequence
  Phospholipid transfer protein (25-33)
RVTSKALEL

SEQ ID NO: 22335 - protein, 9 aa, Artificial Sequence
  UPF0769 protein C21orf59 (33-41)
RVYNGRLKV

SEQ ID NO: 22336 - protein, 18 aa, Artificial Sequence
  HLA class I histocompatibility antigen, A-2 alpha chain (272-289)
RWEPSSQPTIPIVGIIAG

SEQ ID NO: 22337 - protein, 17 aa, Artificial Sequence
  HLA class I histocompatibility antigen, Cw-17 alpha chain (297-313)
RWGGKGGSCSQAASSNS

SEQ ID NO: 22338 - protein, 9 aa, Artificial Sequence
  Calpain-3 (104-112)
RYADKHMNI

SEQ ID NO: 22339 - protein, 9 aa, Artificial Sequence
  Tetratricopeptide repeat protein 30A (26-34)
RYAEAVQLL

SEQ ID NO: 22340 - protein, 8 aa, Artificial Sequence
  Sodium/potassium-transporting ATPase subunit alpha-1 (276-283)
RYAKIVEI

SEQ ID NO: 22341 - protein, 10 aa, Artificial Sequence
  Sodium/potassium-transporting ATPase subunit alpha-1 (276-285)
RYAKIVEIPF

SEQ ID NO: 22342 - protein, 9 aa, Artificial Sequence
  Zinc finger and BTB domain-containing protein 11 (581-589)
RYALIMHKL

SEQ ID NO: 22343 - protein, 10 aa, Artificial Sequence
  Bestrophin-1 (70-79)
RYANLGNVLI

SEQ ID NO: 22344 - protein, 9 aa, Artificial Sequence
  Probable helicase with zinc finger domain (214-222)
RYASRLIKL

SEQ ID NO: 22345 - protein, 9 aa, Artificial Sequence
  (Pyruvate dehydrogenase (acetyl-transferring))-phosphatase 1, mitochondrial (106-114)
RYASTPQKF

SEQ ID NO: 22346 - protein, 9 aa, Artificial Sequence
  Kelch-like protein 20 (384-392)
RYDPKTNQW

SEQ ID NO: 22347 - protein, 9 aa, Artificial Sequence
  Kelch-like protein 20 (337-345)
RYDPQTNEW

SEQ ID NO: 22348 - protein, 9 aa, Artificial Sequence
  Protein FAM91A1 (437-445)
RYFDHALTL

SEQ ID NO: 22349 - protein, 9 aa, Artificial Sequence
  Heterogeneous nuclear ribonucleoprotein H2 (275-283)
RYGDGGSSF

SEQ ID NO: 22350 - protein, 9 aa, Artificial Sequence
  Transmembraneoprotein NMB (373-381)
RYGHFQATI

SEQ ID NO: 22351 - protein, 8 aa, Artificial Sequence
  Protocadherin gamma-A11 (881-888)
RYGPQFTL

SEQ ID NO: 22352 - protein, 9 aa, Artificial Sequence
  Melanocyte protein PMEL (486-494)
RYGSFSVTL

SEQ ID NO: 22353 - protein, 9 aa, Artificial Sequence
  FTS and Hook-interacting protein (249-257)
RYIADHSYF

SEQ ID NO: 22354 - protein, 9 aa, Artificial Sequence
  Hemicentin-1 (697-705)
RYIEAPKLM

SEQ ID NO: 22355 - protein, 11 aa, Artificial Sequence
  Leucine-rich repeat LGI family member 3 (441-451)
RYIGDSKILRW

SEQ ID NO: 22356 - protein, 9 aa, Artificial Sequence
  DNA repair protein RAD50 (184-192)
RYIKALETL

SEQ ID NO: 22357 - protein, 10 aa, Artificial Sequence
  1,2-dihydroxy-3-keto-5-methylthiopentene dioxygenase (96-105)
RYILDGSGYF

SEQ ID NO: 22358 - protein, 9 aa, Artificial Sequence
  Serine/threonine-protein phosphatase 4 regulatory subunit 3B (575-583)
RYITKGNLF

SEQ ID NO: 22359 - protein, 9 aa, Artificial Sequence
  HLA class II histocompatibility antigen, DP beta 1 chain (22-30)
RYIYNREEF

SEQ ID NO: 22360 - protein, 9 aa, Artificial Sequence
  Unconventional myosin-XVIIIa (834-842)
RYKEENIEL

SEQ ID NO: 22361 - protein, 9 aa, Artificial Sequence
  Tubulin polyglutamylase TTLL4 (750-758)
RYLHKPYLI

SEQ ID NO: 22362 - protein, 9 aa, Artificial Sequence
  Zinc finger protein 45 (95-103)
RYLPHEELF

SEQ ID NO: 22363 - protein, 9 aa, Artificial Sequence
  Leucine-rich repeat flightless-interacting protein 2 (360-368)
RYMQGLKEL

SEQ ID NO: 22364 - protein, 8 aa, Artificial Sequence
  60S ribosomal protein L28 (39-46)
RYNGLIHR

SEQ ID NO: 22365 - protein, 9 aa, Artificial Sequence
  Leucine-rich repeat transmembrane neuronal protein 3 (444-452)
RYPASMKQL

SEQ ID NO: 22366 - protein, 9 aa, Artificial Sequence
  Serine/threonine-protein phosphatase 2A catalytic subunit beta isoform (106-114)
RYPERITIL

SEQ ID NO: 22367 - protein, 9 aa, Artificial Sequence
  SPRY domain-containing protein 3 (41-49)
RYQERFKHI

SEQ ID NO: 22368 - protein, 9 aa, Artificial Sequence
  Cation-independent mannose-6-phosphate receptor (1386-1394)
RYSDNWEAI

SEQ ID NO: 22369 - protein, 9 aa, Artificial Sequence
  Phosphatidylcholine translocator ABCB4 (47-55)
RYSDWQDKL

SEQ ID NO: 22370 - protein, 10 aa, Artificial Sequence
  Phosphatidylinositol 3-kinase catalytic subunit type 3 (811-820)
RYSNLILNLF

SEQ ID NO: 22371 - protein, 10 aa, Artificial Sequence
  E3 ubiquitin-protein ligase UBR2 (462-471)
RYTALQAFKF

SEQ ID NO: 22372 - protein, 9 aa, Artificial Sequence
  DnaJ homolog subfamily C member 3 (283-291)
RYTDATSKY

SEQ ID NO: 22373 - protein, 12 aa, Artificial Sequence
  E3 ubiquitin-protein ligase HUWE1 (156-167)
RYTDMESEDYHF

SEQ ID NO: 22374 - protein, 9 aa, Artificial Sequence
  Ubiquitin carboxyl-terminal hydrolase 13 (490-498)
RYTERVDYL

SEQ ID NO: 22375 - protein, 9 aa, Artificial Sequence
  Cullin-1 (190-198)
RYTLQASTF

SEQ ID NO: 22376 - protein, 9 aa, Artificial Sequence
  Serine/threonine-protein kinase SMG1 (1394-1402)
RYTMYQNQL

SEQ ID NO: 22377 - protein, 8 aa, Artificial Sequence
  Rho guanine nucleotide exchange factor 2 (8-15)
RYTNGHLF

SEQ ID NO: 22378 - protein, 11 aa, Artificial Sequence
  Rho guanine nucleotide exchange factor 2 (8-18)
RYTNGHLFTTI

SEQ ID NO: 22379 - protein, 9 aa, Artificial Sequence
  Cyclin-dependent kinase 9 (184-192)
RYTNRVVTL

SEQ ID NO: 22380 - protein, 9 aa, Artificial Sequence
  Chloride channel protein 2 (25-33)
RYTQDLGAF

SEQ ID NO: 22381 - protein, 9 aa, Artificial Sequence
  CDK5 regulatory subunit-associated protein 3 (428-436)
RYVDRVTEF

SEQ ID NO: 22382 - protein, 9 aa, Artificial Sequence
  Protein orai-3 (145-153)
RYVELAWGF

SEQ ID NO: 22383 - protein, 9 aa, Artificial Sequence
  Eukaryotic translation initiation factor 2 subunit 1 (234-242)
RYVMTTTTL

SEQ ID NO: 22384 - protein, 13 aa, Artificial Sequence
  HLA class I histocompatibility antigen, B-51 alpha chain (82-94)
RYYNQSEAGSHTW

SEQ ID NO: 22385 - protein, 9 aa, Artificial Sequence
  Homeodomain-interacting protein kinase 2 (365-373)
RYYRAPEII

SEQ ID NO: 22386 - protein, 9 aa, Artificial Sequence
  Glycogen synthase kinase-3 beta (220-228)
RYYRAPELI

SEQ ID NO: 22387 - protein, 14 aa, Artificial Sequence
  Motor neuron and pancreas homeobox protein 1 (169-182)
SAAAAAAALAGQHP

SEQ ID NO: 22388 - protein, 11 aa, Artificial Sequence
  AT-rich interactive domain-containing protein 1B (270-280)
SAAAAGAPGSM

SEQ ID NO: 22389 - protein, 9 aa, Artificial Sequence
  Beta-2-syntrophin (491-499)
SADDGIRNL

SEQ ID NO: 22390 - protein, 10 aa, Artificial Sequence
  Eukaryotic translation initiation factor 3 subunit K (79-88)
SADESGQIFI

SEQ ID NO: 22391 - protein, 27 aa, Artificial Sequence
  Filamin-B (567-593)
SADFVVESIGSEVGSLGFAIEGPSQAK

SEQ ID NO: 22392 - protein, 8 aa, Artificial Sequence
  COMM domain-containing protein 4 (177-184)
SADKFQVL

SEQ ID NO: 22393 - protein, 9 aa, Artificial Sequence
  COMM domain-containing protein 4 (177-185)
SADKFQVLL

SEQ ID NO: 22394 - protein, 8 aa, Artificial Sequence
  Transcription factor MafF (16-23)
SAEEVTRL

SEQ ID NO: 22395 - protein, 9 aa, Artificial Sequence
  E3 SUMO-protein ligase RanBP2 (993-1001)
SAESKTIEF

SEQ ID NO: 22396 - protein, 9 aa, Artificial Sequence
  Mucin-19 (2343-2351)
SAEVSGRIE

SEQ ID NO: 22397 - protein, 17 aa, Artificial Sequence
  Cytochrome c oxidase subunit 7C, mitochondrial (47-63)
SAFATPFLVVRHQLLKT

SEQ ID NO: 22398 - protein, 9 aa, Artificial Sequence
  Ankyrin repeat and KH domain-containing protein 1 (2266-2274)
SAFLGNSVL

SEQ ID NO: 22399 - protein, 9 aa, Artificial Sequence
  AP-5 complex subunit mu-1 (88-96)
SAFSGPYKF

SEQ ID NO: 22400 - protein, 31 aa, Artificial Sequence
  PR domain zinc finger protein 8 (458-488)
SAFTSVPQLGSAGSTSGGGGTGAGAAGGAGG

SEQ ID NO: 22401 - protein, 7 aa, Artificial Sequence
  Transmembrane emp24 domain-containing protein 10 (79-85)
SAGHILY

SEQ ID NO: 22402 - protein, 16 aa, Artificial Sequence
  Laminin subunit gamma-1 (664-679)
SAGYLDDVTLASARPG

SEQ ID NO: 22403 - protein, 17 aa, Artificial Sequence
  Laminin subunit gamma-1 (664-680)
SAGYLDDVTLASARPGP

SEQ ID NO: 22404 - protein, 18 aa, Artificial Sequence
  Laminin subunit gamma-1 (664-681)
SAGYLDDVTLASARPGPG

SEQ ID NO: 22405 - protein, 8 aa, Artificial Sequence
  Nuclear factor of activated T-cells, cytoplasmic 2 (354-361)
SAHELPMV

SEQ ID NO: 22406 - protein, 9 aa, Artificial Sequence
  Armadillo repeat-containing protein 1 (96-104)
SAIASTKVM

SEQ ID NO: 22407 - protein, 9 aa, Artificial Sequence
  Tripeptidyl-peptidase 1 (315-323)
SALPHVHTV

SEQ ID NO: 22408 - protein, 14 aa, Artificial Sequence
  3-hydroxy-3-methylglutaryl-coenzyme A reductase (687-700)
SAMAGSIGGYNAHA

SEQ ID NO: 22409 - protein, 9 aa, Artificial Sequence
  Phosphoglucomutase-1 (263-271)
SANDKVYTV

SEQ ID NO: 22410 - protein, 10 aa, Artificial Sequence
  WD repeat and FYVE domain-containing protein 3 (1236-1245)
SANPPVVSTV

SEQ ID NO: 22411 - protein, 8 aa, Artificial Sequence
  Serine/threonine-protein phosphatase 2A regulatory subunit B'' subunit gamma (114-121)
SAPSALRV

SEQ ID NO: 22412 - protein, 9 aa, Artificial Sequence
  Microtubule-associated protein 9 (372-380)
SARLMTSEF

SEQ ID NO: 22413 - protein, 9 aa, Artificial Sequence
  Importin-5 (974-982)
SAVGKIMKF

SEQ ID NO: 22414 - protein, 10 aa, Artificial Sequence
  Transcription factor SOX-10 (331-340)
SAWISKPPGV

SEQ ID NO: 22415 - protein, 9 aa, Artificial Sequence
  Nuclear export mediator factor NEMF (468-476)
SAYANAKKY

SEQ ID NO: 22416 - protein, 8 aa, Artificial Sequence
  Zinc finger MYM-type protein 4 (449-456)
SAYRVKMV

SEQ ID NO: 22417 - protein, 9 aa, Artificial Sequence
  Small subunit processome component 20 homolog (1418-1426)
SDFESGLKY

SEQ ID NO: 22418 - protein, 7 aa, Artificial Sequence
  Fas apoptotic inhibitory molecule 1 (47-53)
SDGVHKI

SEQ ID NO: 22419 - protein, 7 aa, Artificial Sequence
  Fructose-bisphosphate aldolase A (272-278)
SDHHIYL

SEQ ID NO: 22420 - protein, 17 aa, Artificial Sequence
  Galectin-3-binding protein (311-327)
SDLAVPSELALLKAVDT

SEQ ID NO: 22421 - protein, 29 aa, Artificial Sequence
  HLA class I histocompatibility antigen, A-23 alpha chain (337-365)
SDRKGGSYSQAASSDSAQGSDVSLTACKV

SEQ ID NO: 22422 - protein, 16 aa, Artificial Sequence
  HLA class I histocompatibility antigen, A-23 alpha chain (350-365)
SDSAQGSDVSLTACKV

SEQ ID NO: 22423 - protein, 9 aa, Artificial Sequence
  Immunoglobulin superfamily member 3 (355-363)
SDSVFVLKI

SEQ ID NO: 22424 - protein, 10 aa, Artificial Sequence
  HLA class I histocompatibility antigen, A-23 alpha chain (356-365)
SDVSLTACKV

SEQ ID NO: 22425 - protein, 10 aa, Artificial Sequence
  Kelch repeat and BTB domain-containing protein 6 (137-146)
SEANVERLYA

SEQ ID NO: 22426 - protein, 9 aa, Artificial Sequence
  YTH domain-containing family protein 1 (301-309)
SEDDIHRSI

SEQ ID NO: 22427 - protein, 9 aa, Artificial Sequence
  RNA-binding protein 28 (126-134)
SEDDLKTVF

SEQ ID NO: 22428 - protein, 9 aa, Artificial Sequence
  Sister chromatid cohesion protein PDS5 homolog A (59-67)
SEDEKQQYL

SEQ ID NO: 22429 - protein, 9 aa, Artificial Sequence
  Hermansky-Pudlak syndrome 5 protein (476-484)
SEDERFKEF

SEQ ID NO: 22430 - protein, 9 aa, Artificial Sequence
  Ras-specific guanine nucleotide-releasing factor RalGPS2 (420-428)
SEDLAVHLY

SEQ ID NO: 22431 - protein, 10 aa, Artificial Sequence
  Peptidyl-prolyl cis-trans isomerase FKBP9 (197-206)
SEDQVQIHTY

SEQ ID NO: 22432 - protein, 9 aa, Artificial Sequence
  WD repeat-containing protein 6 (258-266)
SEDRSVRIW

SEQ ID NO: 22433 - protein, 9 aa, Artificial Sequence
  Thioredoxin-like protein 4A (20-28)
SEEDRVVVI

SEQ ID NO: 22434 - protein, 9 aa, Artificial Sequence
  Vacuolar protein sorting-associated protein 41 homolog (24-32)
SEEEPKLKY

SEQ ID NO: 22435 - protein, 10 aa, Artificial Sequence
  Protocadherin Fat 1 (2947-2956)
SEEINRQVTY

SEQ ID NO: 22436 - protein, 9 aa, Artificial Sequence
  Thioredoxin-related transmembrane protein 2 (247-255)
SEENVIREF

SEQ ID NO: 22437 - protein, 7 aa, Artificial Sequence
  26S proteasome non-ATPase regulatory subunit 13 (65-71)
SEFEHRV

SEQ ID NO: 22438 - protein, 9 aa, Artificial Sequence
  Protein PRR14L (1206-1214)
SEFGKESTF

SEQ ID NO: 22439 - protein, 10 aa, Artificial Sequence
  Aldehyde dehydrogenase family 1 member A3 (328-337)
SEFVRRSVEY

SEQ ID NO: 22440 - protein, 9 aa, Artificial Sequence
  Alpha-parvin (149-157)
SEIAQKQKL

SEQ ID NO: 22441 - protein, 10 aa, Artificial Sequence
  Microtubule cross-linking factor 1 (653-662)
SEIEDHNRQL

SEQ ID NO: 22442 - protein, 9 aa, Artificial Sequence
  Protein AHNAK2 (1652-1660)
SEIEGNVTF

SEQ ID NO: 22443 - protein, 10 aa, Artificial Sequence
  Manganese-transporting ATPase 13A1 (95-104)
SEIRAAEKKF

SEQ ID NO: 22444 - protein, 9 aa, Artificial Sequence
  Vesicle transport protein USE1 (81-89)
SEKALANQF

SEQ ID NO: 22445 - protein, 10 aa, Artificial Sequence
  Centromere protein F (130-139)
SELDKLLSSF

SEQ ID NO: 22446 - protein, 12 aa, Artificial Sequence
  Proline-rich protein 12 (622-633)
SELLAGPGGPPA

SEQ ID NO: 22447 - protein, 10 aa, Artificial Sequence
  LisH domain-containing protein ARMC9 (9-18)
SELLGLVKEY

SEQ ID NO: 22448 - protein, 9 aa, Artificial Sequence
  T-box transcription factor TBX3 (698-706)
SELQSIQRL

SEQ ID NO: 22449 - protein, 9 aa, Artificial Sequence
  Sal-like protein 1 (1206-1214)
SENGTNFRF

SEQ ID NO: 22450 - protein, 35 aa, Artificial Sequence
  Glia-derived nexin (342-376)
SENLHVSHILQKAKIEVSEDGTKASAATTAILIAR

SEQ ID NO: 22451 - protein, 9 aa, Artificial Sequence
  H/ACA ribonucleoprotein complex subunit 1 (130-138)
SENMKASSF

SEQ ID NO: 22452 - protein, 9 aa, Artificial Sequence
  Plectin (3824-3832)
SEPSEVRSY

SEQ ID NO: 22453 - protein, 9 aa, Artificial Sequence
  Integrin alpha-3 (534-542)
SESAVFHGF

SEQ ID NO: 22454 - protein, 10 aa, Artificial Sequence
  Arfaptin-1 (44-53)
SETQITSHGF

SEQ ID NO: 22455 - protein, 9 aa, Artificial Sequence
  Laminin subunit gamma-1 (617-625)
SETTVKYVF

SEQ ID NO: 22456 - protein, 9 aa, Artificial Sequence
  Plexin-B2 (30-38)
SETVVERML

SEQ ID NO: 22457 - protein, 10 aa, Artificial Sequence
  U5 small nuclear ribonucleoprotein 200 kDa helicase (1230-1239)
SEVILHHEYF

SEQ ID NO: 22458 - protein, 8 aa, Artificial Sequence
  Eukaryotic translation initiation factor 3 subunit D (444-451)
SEYLKLGY

SEQ ID NO: 22459 - protein, 9 aa, Artificial Sequence
  Homeobox protein Hox-D9 (57-65)
SFAPRSAVF

SEQ ID NO: 22460 - protein, 9 aa, Artificial Sequence
  Renin receptor (256-264)
SFDTSLIRK

SEQ ID NO: 22461 - protein, 8 aa, Artificial Sequence
  Liprin-beta-1 (507-514)
SFGRGFFK

SEQ ID NO: 22462 - protein, 9 aa, Artificial Sequence
  Zinc finger protein 697 (92-100)
SFIQSSHLI

SEQ ID NO: 22463 - protein, 10 aa, Artificial Sequence
  High affinity cationic amino acid transporter 1 (57-66)
SFLIAALASV

SEQ ID NO: 22464 - protein, 8 aa, Artificial Sequence
  Immediate early response gene 5 protein (276-283)
SFSGLLRK

SEQ ID NO: 22465 - protein, 9 aa, Artificial Sequence
  Zinc finger protein 175 (287-295)
SFTQKSHLF

SEQ ID NO: 22466 - protein, 23 aa, Artificial Sequence
  Eukaryotic peptide chain release factor GTP-binding subunit ERF3A (163-185)
SFVPNMIGGASQADLAVLVISAR

SEQ ID NO: 22467 - protein, 14 aa, Artificial Sequence
  Protein HEG homolog 1 (148-161)
SGDFQMSPYAEYPK

SEQ ID NO: 22468 - protein, 17 aa, Artificial Sequence
  Protein HEG homolog 1 (148-164)
SGDFQMSPYAEYPKNPR

SEQ ID NO: 22469 - protein, 9 aa, Artificial Sequence
  Trabeculin-alpha (4239-4247)
SGDPKVIEV

SEQ ID NO: 22470 - protein, 9 aa, Artificial Sequence
  Nicastrin (47-55)
SGDTGVIHV

SEQ ID NO: 22471 - protein, 9 aa, Artificial Sequence
  Bifunctional apoptosis regulator (310-318)
SGEDIVTKL

SEQ ID NO: 22472 - protein, 22 aa, Artificial Sequence
  Beta-enolase (330-351)
SGETEDTFIADLVVGLCTGQIK

SEQ ID NO: 22473 - protein, 18 aa, Artificial Sequence
  Putative ATP-dependent RNA helicase DHX57 (36-53)
SGGGGGGGGGGGGGNRKA

SEQ ID NO: 22474 - protein, 13 aa, Artificial Sequence
  Signal recognition particle subunit SRP68 (27-39)
SGGGRGAGGEENK

SEQ ID NO: 22475 - protein, 9 aa, Artificial Sequence
  Elongation factor 2 (418-426)
SGLVSTGLK

SEQ ID NO: 22476 - protein, 9 aa, Artificial Sequence
  ATP-dependent RNA helicase DDX39A (90-98)
SGMGKTAVF

SEQ ID NO: 22477 - protein, 15 aa, Artificial Sequence
  Collagen alpha-1(III) chain (60-74)
SGPKGDAGQPGEKGS

SEQ ID NO: 22478 - protein, 16 aa, Artificial Sequence
  Phosphatidylethanolamine-binding protein 1 (9-24)
SGPLSLQEVDEQPQHP

SEQ ID NO: 22479 - protein, 14 aa, Artificial Sequence
  Laminin subunit alpha-4 (576-589)
SHDLVQEAIDHAQD

SEQ ID NO: 22480 - protein, 10 aa, Artificial Sequence
  Protein phosphatase 1J (227-236)
SHESLVVGAV

SEQ ID NO: 22481 - protein, 10 aa, Artificial Sequence
  Protein unc-93 homolog B1 (264-273)
SHGILSGFNK

SEQ ID NO: 22482 - protein, 9 aa, Artificial Sequence
  Plasma protease C1 inhibitor (350-358)
SHNLSLVIL

SEQ ID NO: 22483 - protein, 7 aa, Artificial Sequence
  Protein phosphatase 1 regulatory subunit 3F (177-183)
SHPLGIL

SEQ ID NO: 22484 - protein, 18 aa, Artificial Sequence
  Cytochrome c oxidase subunit 7C, mitochondrial (17-34)
SHYEEGPGKNLPFSVENK

SEQ ID NO: 22485 - protein, 23 aa, Artificial Sequence
  Cytochrome c oxidase subunit 7C, mitochondrial (17-39)
SHYEEGPGKNLPFSVENKWSLLA

SEQ ID NO: 22486 - protein, 47 aa, Artificial Sequence
  Cytochrome c oxidase subunit 7C, mitochondrial (17-63)
SHYEEGPGKNLPFSVENKWSLLAKMCLYFGSAFATPFLVVRHQLLKT

SEQ ID NO: 22487 - protein, 9 aa, Artificial Sequence
  Clustered mitochondria protein homolog (225-233)
SIDFGKTVV

SEQ ID NO: 22488 - protein, 9 aa, Artificial Sequence
  Charged multivesicular body protein 5 (30-38)
SIDKKISRL

SEQ ID NO: 22489 - protein, 9 aa, Artificial Sequence
  Nodal modulator 3 (272-280)
SIDSEPALV

SEQ ID NO: 22490 - protein, 9 aa, Artificial Sequence
  Eukaryotic translation initiation factor 4 gamma 1 (1038-1046)
SIDSNNQLF

SEQ ID NO: 22491 - protein, 10 aa, Artificial Sequence
  Vacuolar protein sorting-associated protein 13B (1953-1962)
SIFDAVLKGV

SEQ ID NO: 22492 - protein, 9 aa, Artificial Sequence
  Transmembrane channel-like protein 4 (391-399)
SIFIAGVNF

SEQ ID NO: 22493 - protein, 9 aa, Artificial Sequence
  Nischarin (214-222)
SIFKSLHQV

SEQ ID NO: 22494 - protein, 9 aa, Artificial Sequence
  Adenylate kinase 9 (1441-1449)
SIGGALRYV

SEQ ID NO: 22495 - protein, 9 aa, Artificial Sequence
  Protein ELYS (1701-1709)
SIHETIPLV

SEQ ID NO: 22496 - protein, 9 aa, Artificial Sequence
  Hom s 5 (332-340)
SIIAEVKAQ

SEQ ID NO: 22497 - protein, 10 aa, Artificial Sequence
  Zinc finger E-box-binding homeobox 2 (500-509)
SIIDYTLEKV

SEQ ID NO: 22498 - protein, 10 aa, Artificial Sequence
  Poly(rC)-binding protein 2 (27-36)
SIIGKKGESV

SEQ ID NO: 22499 - protein, 55 aa, Artificial Sequence
  6.8 kDa mitochondrial proteolipid (4-58)
SIIKNIWIPMKPYYTKVYQEIWIGMGLMGFIVYKIRAADKRSKALKASAPAPGHH

SEQ ID NO: 22500 - protein, 9 aa, Artificial Sequence
  Neuron navigator 2 (1370-1378)
SIIPYLLEA

SEQ ID NO: 22501 - protein, 9 aa, Artificial Sequence
  Protein transport protein Sec23B (625-633)
SILADRILL

SEQ ID NO: 22502 - protein, 9 aa, Artificial Sequence
  Raftlin-2 (58-66)
SILDIVTKV

SEQ ID NO: 22503 - protein, 9 aa, Artificial Sequence
  Tripartite motif-containing protein 2 (120-128)
SILETVTAV

SEQ ID NO: 22504 - protein, 9 aa, Artificial Sequence
  N6-adenosine-methyltransferase 70 kDa subunit (384-392)
SILGKFAVV

SEQ ID NO: 22505 - protein, 23 aa, Artificial Sequence
  Heat shock cognate 71 kDa protein (362-384)
SINPDEAVAYGAAVQAAILSGDK

SEQ ID NO: 22506 - protein, 9 aa, Artificial Sequence
  Eukaryotic translation initiation factor 4 gamma 1 (244-252)
SIPGDTMTT

SEQ ID NO: 22507 - protein, 9 aa, Artificial Sequence
  Cyclic AMP-dependent transcription factor ATF-6 alpha (178-186)
SIQPKPLLL

SEQ ID NO: 22508 - protein, 9 aa, Artificial Sequence
  E3 ubiquitin-protein ligase UBR5 (550-558)
SISAGIPKV

SEQ ID NO: 22509 - protein, 9 aa, Artificial Sequence
  Tuberin (341-349)
SITRLIKKY

SEQ ID NO: 22510 - protein, 9 aa, Artificial Sequence
  ATP-dependent DNA helicase Q1 (13-21)
SITSELHAV

SEQ ID NO: 22511 - protein, 10 aa, Artificial Sequence
  Alpha-2-macroglobulin (161-170)
SIYKPGQTVK

SEQ ID NO: 22512 - protein, 21 aa, Artificial Sequence
  Heat shock protein HSP 90-beta (408-428)
SIYYITGESKEQVANSAFVER

SEQ ID NO: 22513 - protein, 9 aa, Artificial Sequence
  Pre-mRNA-processing-splicing factor 8 (1179-1187)
SKDNPNLLF

SEQ ID NO: 22514 - protein, 8 aa, Artificial Sequence
  Histone-lysine N-methyltransferase SETDB1 (427-434)
SKGPVVQY

SEQ ID NO: 22515 - protein, 7 aa, Artificial Sequence
  Histone deacetylase 1 (88-94)
SKQMQRF

SEQ ID NO: 22516 - protein, 9 aa, Artificial Sequence
  AT-rich interactive domain-containing protein 1A (1821-1829)
SLAARAIAV

SEQ ID NO: 22517 - protein, 13 aa, Artificial Sequence
  Tenascin (1578-1590)
SLADLSPSTHYTA

SEQ ID NO: 22518 - protein, 11 aa, Artificial Sequence
  Integrin alpha-7 (461-471)
SLADTAVLFRA

SEQ ID NO: 22519 - protein, 11 aa, Artificial Sequence
  Melanocyte protein PMEL (577-587)
SLADTNSLAVV

SEQ ID NO: 22520 - protein, 9 aa, Artificial Sequence
  Sestrin-2 (190-198)
SLAELIQAL

SEQ ID NO: 22521 - protein, 9 aa, Artificial Sequence
  Fatty acid synthase (2500-2508)
SLAEPRVSV

SEQ ID NO: 22522 - protein, 11 aa, Artificial Sequence
  Ankyrin-2 (84-94)
SLAGQAEVVKV

SEQ ID NO: 22523 - protein, 9 aa, Artificial Sequence
  Putative WAS protein family homolog 3 (9-17)
SLAGQTYAV

SEQ ID NO: 22524 - protein, 9 aa, Artificial Sequence
  Transmembrane protein 25 isoform 5 (201-209)
SLAHNLSVV

SEQ ID NO: 22525 - protein, 10 aa, Artificial Sequence
  T-complex protein 1 subunit beta (5-14)
SLAPVNIFKA

SEQ ID NO: 22526 - protein, 10 aa, Artificial Sequence
  Hermansky-Pudlak syndrome 4 protein (570-579)
SLASLNGLEV

SEQ ID NO: 22527 - protein, 9 aa, Artificial Sequence
  Inversin (13-21)
SLASQVHAA

SEQ ID NO: 22528 - protein, 10 aa, Artificial Sequence
  Serine/threonine-protein kinase SMG1 (1090-1099)
SLASVIISAL

SEQ ID NO: 22529 - protein, 9 aa, Artificial Sequence
  Unconventional myosin-Ic (701-709)
SLATKIQAA

SEQ ID NO: 22530 - protein, 9 aa, Artificial Sequence
  Growth factor receptor-bound protein 10 (498-506)
SLDDGNTKF

SEQ ID NO: 22531 - protein, 11 aa, Artificial Sequence
  L-dopachrome tautomerase (288-298)
SLDDYNHLVTL

SEQ ID NO: 22532 - protein, 10 aa, Artificial Sequence
  Proline-rich protein 12 (709-718)
SLDEGATAAL

SEQ ID NO: 22533 - protein, 9 aa, Artificial Sequence
  Heat shock protein 105 kDa (204-212)
SLDEKPRIV

SEQ ID NO: 22534 - protein, 9 aa, Artificial Sequence
  Adenomatous polyposis coli protein (1410-1418)
SLDEPFIQK

SEQ ID NO: 22535 - protein, 10 aa, Artificial Sequence
  Sister chromatid cohesion protein PDS5 homolog A (493-502)
SLDPNAVKAL

SEQ ID NO: 22536 - protein, 9 aa, Artificial Sequence
  Regulator of G-protein signaling 20 (174-182)
SLDSRVREV

SEQ ID NO: 22537 - protein, 9 aa, Artificial Sequence
  Protein AHNAK2 (497-505)
SLDVSAPKV

SEQ ID NO: 22538 - protein, 11 aa, Artificial Sequence
  Importin subunit alpha-4 (6-16)
SLENHRIKSFK

SEQ ID NO: 22539 - protein, 9 aa, Artificial Sequence
  mRNA cap guanine-N7 methyltransferase (14-22)
SLEQAKASV

SEQ ID NO: 22540 - protein, 10 aa, Artificial Sequence
  Cytokine receptor common subunit beta (667-676)
SLESGGGPAP

SEQ ID NO: 22541 - protein, 9 aa, Artificial Sequence
  G-protein coupled receptor 56 (216-224)
SLESKLTSV

SEQ ID NO: 22542 - protein, 12 aa, Artificial Sequence
  Tetratricopeptide repeat protein 28 (808-819)
SLFDLQTSSYQA

SEQ ID NO: 22543 - protein, 10 aa, Artificial Sequence
  WD repeat-containing protein 27 (376-385)
SLFGGKIAVL

SEQ ID NO: 22544 - protein, 7 aa, Artificial Sequence
  Four and a half LIM domains protein 2 (123-129)
SLFGKKY

SEQ ID NO: 22545 - protein, 9 aa, Artificial Sequence
  Four and a half LIM domains protein 2 (123-131)
SLFGKKYIL

SEQ ID NO: 22546 - protein, 9 aa, Artificial Sequence
  Mannosyl-oligosaccharide 1,2-alpha-mannosidase IA (231-239)
SLFGNIKGA

SEQ ID NO: 22547 - protein, 9 aa, Artificial Sequence
  Plectin (6-14)
SLFPSLVVV

SEQ ID NO: 22548 - protein, 13 aa, Artificial Sequence
  GPI transamidase component PIG-T (490-502)
SLFPVSDGSNYFV

SEQ ID NO: 22549 - protein, 9 aa, Artificial Sequence
  Hsp90 co-chaperone Cdc37 (27-35)
SLFRWRHQA

SEQ ID NO: 22550 - protein, 9 aa, Artificial Sequence
  Zinc finger MYM-type protein 3 (596-604)
SLFSGKPEV

SEQ ID NO: 22551 - protein, 9 aa, Artificial Sequence
  Uracil phosphoribosyltransferase homolog (268-276)
SLFSTPHGA

SEQ ID NO: 22552 - protein, 10 aa, Artificial Sequence
  Formin-like protein 2 (880-889)
SLFYNELHYV

SEQ ID NO: 22553 - protein, 9 aa, Artificial Sequence
  Cation-independent mannose-6-phosphate receptor (2149-2157)
SLGDIYFKL

SEQ ID NO: 22554 - protein, 9 aa, Artificial Sequence
  Dynein heavy chain domain-containing protein 1 (1476-1484)
SLGEALKQL

SEQ ID NO: 22555 - protein, 9 aa, Artificial Sequence
  Neuroblast differentiation-associated protein AHNAK (969-977)
SLGEGHLSV

SEQ ID NO: 22556 - protein, 8 aa, Artificial Sequence
  TBC1 domain family member 4 (1089-1096)
SLGFVARV

SEQ ID NO: 22557 - protein, 10 aa, Artificial Sequence
  Caspase-4 (16-25)
SLGKDFLTGV

SEQ ID NO: 22558 - protein, 8 aa, Artificial Sequence
  Solute carrier family 26 member 6 (325-332)
SLGKIFAL

SEQ ID NO: 22559 - protein, 8 aa, Artificial Sequence
  Circadian clock protein PASD1 (699-706)
SLGPVVQV

SEQ ID NO: 22560 - protein, 8 aa, Artificial Sequence
  Vesicular glutamate transporter 2 (23-30)
SLGQIYRV

SEQ ID NO: 22561 - protein, 9 aa, Artificial Sequence
  Cathepsin K (65-73)
SLGVHTYEL

SEQ ID NO: 22562 - protein, 9 aa, Artificial Sequence
  Vacuolar protein sorting-associated protein 16 homolog (139-147)
SLHDTVTTL

SEQ ID NO: 22563 - protein, 9 aa, Artificial Sequence
  Probable phospholipid-transporting ATPase IH (690-698)
SLHDVLFEL

SEQ ID NO: 22564 - protein, 9 aa, Artificial Sequence
  Sarcoplasmic/endoplasmic reticulum calcium ATPase 1 (817-825)
SLHFLILYV

SEQ ID NO: 22565 - protein, 9 aa, Artificial Sequence
  Coatomer subunit alpha (27-35)
SLHNGVIQL

SEQ ID NO: 22566 - protein, 9 aa, Artificial Sequence
  Forkhead box protein O1 (252-260)
SLHSKFIRV

SEQ ID NO: 22567 - protein, 12 aa, Artificial Sequence
  Serum albumin (89-100)
SLHTLFGDKLCT

SEQ ID NO: 22568 - protein, 9 aa, Artificial Sequence
  Adenosylhomocysteinase (198-206)
SLIDGIKRA

SEQ ID NO: 22569 - protein, 9 aa, Artificial Sequence
  AP-1 complex subunit beta-1 (665-673)
SLIGGTNFV

SEQ ID NO: 22570 - protein, 7 aa, Artificial Sequence
  Myoferlin (1042-1048)
SLIGWKF

SEQ ID NO: 22571 - protein, 9 aa, Artificial Sequence
  Protein LMBR1L (107-115)
SLIHGLWNL

SEQ ID NO: 22572 - protein, 9 aa, Artificial Sequence
  Abelson tyrosine-protein kinase 2 (153-161)
SLINGSFLV

SEQ ID NO: 22573 - protein, 11 aa, Artificial Sequence
  RNA-binding protein 34 (218-228)
SLIPAEGTLSK

SEQ ID NO: 22574 - protein, 9 aa, Artificial Sequence
  DENN domain-containing protein 5B (1249-1257)
SLIRILQTI

SEQ ID NO: 22575 - protein, 9 aa, Artificial Sequence
  Putative bifunctional UDP-N-acetylglucosamine transferase and deubiquitinase ALG13 (66-74)
SLKEDIQKA

SEQ ID NO: 22576 - protein, 9 aa, Artificial Sequence
  Manganese-transporting ATPase 13A1 (594-602)
SLKFVGFIV

SEQ ID NO: 22577 - protein, 9 aa, Artificial Sequence
  Protocadherin gamma-C3 (402-410)
SLKNYFTLK

SEQ ID NO: 22578 - protein, 9 aa, Artificial Sequence
  AP-3 complex delta subunit (882-890)
SLLAENSYV

SEQ ID NO: 22579 - protein, 10 aa, Artificial Sequence
  Exocyst complex component 1 (476-485)
SLLDMGNMSA

SEQ ID NO: 22580 - protein, 9 aa, Artificial Sequence
  Rotatin (1619-1627)
SLLDNLLTI

SEQ ID NO: 22581 - protein, 12 aa, Artificial Sequence
  Eukaryotic translation initiation factor 3 subunit L (282-293)
SLLGDYYQAIKV

SEQ ID NO: 22582 - protein, 9 aa, Artificial Sequence
  Long-chain-fatty-acid-CoA ligase 3 (439-447)
SLLGGNIRL

SEQ ID NO: 22583 - protein, 10 aa, Artificial Sequence
  Solute carrier family 22 member 18 (168-177)
SLLGGTLVSA

SEQ ID NO: 22584 - protein, 9 aa, Artificial Sequence
  Neurochondrin (337-345)
SLLKEPQKV

SEQ ID NO: 22585 - protein, 8 aa, Artificial Sequence
  Melanoma-associated antigen 10 (310-317)
SLLKFLAK

SEQ ID NO: 22586 - protein, 9 aa, Artificial Sequence
  Melanoma-associated antigen 10 (310-318)
SLLKFLAKV

SEQ ID NO: 22587 - protein, 9 aa, Artificial Sequence
  Zinc finger protein 644 (1297-1305)
SLLKKPASI

SEQ ID NO: 22588 - protein, 9 aa, Artificial Sequence
  Metallophosphoesterase 1 (21-29)
SLLLKLIAV

SEQ ID NO: 22589 - protein, 9 aa, Artificial Sequence
  Chromodomain-helicase-DNA-binding protein 4 (1004-1012)
SLLNVVMDL

SEQ ID NO: 22590 - protein, 9 aa, Artificial Sequence
  Importin-4 (220-228)
SLLPYFPAI

SEQ ID NO: 22591 - protein, 9 aa, Artificial Sequence
  G-protein coupled receptor 56 (5-13)
SLLQTTLFL

SEQ ID NO: 22592 - protein, 9 aa, Artificial Sequence
  Pericentrin (2516-2524)
SLLSEIQAL

SEQ ID NO: 22593 - protein, 9 aa, Artificial Sequence
  Bromodomain adjacent to zinc finger domain protein 2A (217-225)
SLLSSSVLT

SEQ ID NO: 22594 - protein, 9 aa, Artificial Sequence
  Zinc finger ZZ-type and EF-hand domain-containing protein 1 (401-409)
SLLTSLVTA

SEQ ID NO: 22595 - protein, 12 aa, Artificial Sequence
  Delphilin (264-275)
SLLVGGLAGPGG

SEQ ID NO: 22596 - protein, 9 aa, Artificial Sequence
  Band 4.1-like protein 2 (562-570)
SLMKDFPGA

SEQ ID NO: 22597 - protein, 8 aa, Artificial Sequence
  Oxysterol-binding protein-related protein 5 (301-308)
SLMWTLLK

SEQ ID NO: 22598 - protein, 9 aa, Artificial Sequence
  EMILIN-1 (224-232)
SLNELQTTV

SEQ ID NO: 22599 - protein, 9 aa, Artificial Sequence
  Glutamine and serine-rich protein 1 (920-928)
SLNGNQVTV

SEQ ID NO: 22600 - protein, 9 aa, Artificial Sequence
  Neurofibromin (545-553)
SLPKFYLLF

SEQ ID NO: 22601 - protein, 10 aa, Artificial Sequence
  Ras-related protein Rab-38 (113-122)
SLPNGKPVSV

SEQ ID NO: 22602 - protein, 24 aa, Artificial Sequence
  Talin-1 (1227-1250)
SLPPSTGTFQEAQSRLNEAAAGLN

SEQ ID NO: 22603 - protein, 9 aa, Artificial Sequence
  Disabled homolog 2 (264-272)
SLPRPTPQA

SEQ ID NO: 22604 - protein, 10 aa, Artificial Sequence
  P2X purinoceptor 7 (420-429)
SLQDVKGQEV

SEQ ID NO: 22605 - protein, 9 aa, Artificial Sequence
  Unconventional myosin-Va (987-995)
SLQEEIAKL

SEQ ID NO: 22606 - protein, 10 aa, Artificial Sequence
  Hyccin (485-494)
SLQEEKLIYV

SEQ ID NO: 22607 - protein, 9 aa, Artificial Sequence
  A-kinase anchor protein 9 (576-584)
SLQKDLSQV

SEQ ID NO: 22608 - protein, 9 aa, Artificial Sequence
  Sulfate transporter (477-485)
SLQKSVLGV

SEQ ID NO: 22609 - protein, 11 aa, Artificial Sequence
  Matrix metalloproteinase-14 (60-70)
SLSAAIAAMQK

SEQ ID NO: 22610 - protein, 9 aa, Artificial Sequence
  Ethanolamine kinase 2 (36-44)
SLSADVPKV

SEQ ID NO: 22611 - protein, 9 aa, Artificial Sequence
  Unconventional myosin-Ic (936-944)
SLSDSLFVL

SEQ ID NO: 22612 - protein, 13 aa, Artificial Sequence
  Mucin-16 (10281-10293)
SLSEAMTSFATTG

SEQ ID NO: 22613 - protein, 9 aa, Artificial Sequence
  CD109 antigen (1332-1340)
SLSETVKKV

SEQ ID NO: 22614 - protein, 10 aa, Artificial Sequence
  Melanoma antigen preferentially expressed in tumors (355-364)
SLSGVMLTDV

SEQ ID NO: 22615 - protein, 9 aa, Artificial Sequence
  WD repeat-containing protein 1 (156-164)
SLSGYINYL

SEQ ID NO: 22616 - protein, 9 aa, Artificial Sequence
  Protein phosphatase 1 regulatory subunit 21 (218-226)
SLSIINEKV

SEQ ID NO: 22617 - protein, 10 aa, Artificial Sequence
  DNA dC-dU-editing enzyme APOBEC-3B (446-455)
SLSPGHLPVP

SEQ ID NO: 22618 - protein, 10 aa, Artificial Sequence
  Alpha-ketoglutarate-dependent dioxygenase alkB homolog 3 (81-90)
SLSPTGVSRV

SEQ ID NO: 22619 - protein, 9 aa, Artificial Sequence
  E3 ubiquitin-protein ligase TRIM56 (586-594)
SLSQASHAV

SEQ ID NO: 22620 - protein, 9 aa, Artificial Sequence
  Coiled-coil domain-containing protein 91 (414-422)
SLSSLELFL

SEQ ID NO: 22621 - protein, 9 aa, Artificial Sequence
  Centrosomal protein of 290 kDa (11-19)
SLSSLLVKL

SEQ ID NO: 22622 - protein, 11 aa, Artificial Sequence
  Transcription factor HIVEP3 (1019-1029)
SLTGPSAPAPV

SEQ ID NO: 22623 - protein, 9 aa, Artificial Sequence
  CDK5 regulatory subunit-associated protein 2 (1447-1455)
SLTSEIHFL

SEQ ID NO: 22624 - protein, 9 aa, Artificial Sequence
  Epsilon-sarcoglycan (250-258)
SLVDKTKQV

SEQ ID NO: 22625 - protein, 11 aa, Artificial Sequence
  Transcription factor AP-2-epsilon (290-300)
SLVEGEAVHLA

SEQ ID NO: 22626 - protein, 9 aa, Artificial Sequence
  Tumor suppressor candidate 3 (209-217)
SLVGGLLYL

SEQ ID NO: 22627 - protein, 9 aa, Artificial Sequence
  U5 small nuclear ribonucleoprotein 200 kDa helicase (42-50)
SLVGKLEGT

SEQ ID NO: 22628 - protein, 9 aa, Artificial Sequence
  Niban-like protein 1 (77-85)
SLVPHNYGL

SEQ ID NO: 22629 - protein, 7 aa, Artificial Sequence
  DNA mismatch repair protein Msh6 (342-348)
SLVQKGY

SEQ ID NO: 22630 - protein, 9 aa, Artificial Sequence
  Piezo-type mechanosensitive ion channel component 1 (1709-1717)
SLVRSVVGV

SEQ ID NO: 22631 - protein, 10 aa, Artificial Sequence
  Arylsulfatase B (320-329)
SLWEGGVRGV

SEQ ID NO: 22632 - protein, 11 aa, Artificial Sequence
  Cohesin subunit SA-1 (487-497)
SLWESSQELLK

SEQ ID NO: 22633 - protein, 9 aa, Artificial Sequence
  Membrane magnesium transporter 1 (4-12)
SLWKGLVGI

SEQ ID NO: 22634 - protein, 9 aa, Artificial Sequence
  Rho guanine nucleotide exchange factor 5 (1151-1159)
SLWQEIPVV

SEQ ID NO: 22635 - protein, 9 aa, Artificial Sequence
  Lysosomal-trafficking regulator (2437-2445)
SLYDNILLH

SEQ ID NO: 22636 - protein, 11 aa, Artificial Sequence
  Lysosomal-trafficking regulator (2437-2447)
SLYDNILLHNA

SEQ ID NO: 22637 - protein, 9 aa, Artificial Sequence
  Chloride channel protein 2 (551-559)
SLYDSIIRI

SEQ ID NO: 22638 - protein, 10 aa, Artificial Sequence
  WD repeat-containing protein 3 (586-595)
SLYGHKLPVI

SEQ ID NO: 22639 - protein, 9 aa, Artificial Sequence
  Protein YIPF4 (129-137)
SLYGQFRVV

SEQ ID NO: 22640 - protein, 11 aa, Artificial Sequence
  Glutaminyl-peptide cyclotransferase (212-222)
SLYGSRHLAAK

SEQ ID NO: 22641 - protein, 10 aa, Artificial Sequence
  Clathrin heavy chain 1 (1532-1541)
SLYKDAMQYA

SEQ ID NO: 22642 - protein, 9 aa, Artificial Sequence
  Laminin subunit alpha-4 (855-863)
SLYMKPPVK

SEQ ID NO: 22643 - protein, 9 aa, Artificial Sequence
  Membrane-associated transporter protein (382-390)
SLYSYFQKV

SEQ ID NO: 22644 - protein, 9 aa, Artificial Sequence
  Cytoplasmic dynein 1 heavy chain 1 (3309-3317)
SMANPPAAV

SEQ ID NO: 22645 - protein, 9 aa, Artificial Sequence
  Charged multivesicular body protein 2a (98-106)
SMAQAMKGV

SEQ ID NO: 22646 - protein, 9 aa, Artificial Sequence
  Probable ATP-dependent RNA helicase DDX59 (525-533)
SMDEYVHQL

SEQ ID NO: 22647 - protein, 12 aa, Artificial Sequence
  Zinc finger protein 160 (58-69)
SMLEEGKEPWTV

SEQ ID NO: 22648 - protein, 10 aa, Artificial Sequence
  Serine palmitoyltransferase 3 (235-244)
SMNIPALVGK

SEQ ID NO: 22649 - protein, 9 aa, Artificial Sequence
  Neuroblast differentiation-associated protein AHNAK (3672-3680)
SMPDFDLNL

SEQ ID NO: 22650 - protein, 9 aa, Artificial Sequence
  Eukaryotic translation initiation factor 3 subunit L (303-311)
SMYSRVPEC

SEQ ID NO: 22651 - protein, 12 aa, Artificial Sequence
  Histone-lysine N-methyltransferase 2C (3371-3382)
SNANPQSGPPPR

SEQ ID NO: 22652 - protein, 12 aa, Artificial Sequence
  ATP-dependent RNA helicase A (233-244)
SNKKLAAQSCAL

SEQ ID NO: 22653 - protein, 8 aa, Artificial Sequence
  Voltage-dependent L-type calcium channel subunit alpha-1C (157-164)
SNLERVEY

SEQ ID NO: 22654 - protein, 8 aa, Artificial Sequence
  Aldehyde dehydrogenase, mitochondrial (130-137)
SNLKRVTL

SEQ ID NO: 22655 - protein, 9 aa, Artificial Sequence
  Protocadherin gamma-A12 (544-552)
SNVSLSLFV

SEQ ID NO: 22656 - protein, 9 aa, Artificial Sequence
  Neuropilin-2 (579-587)
SPAGIGMRL

SEQ ID NO: 22657 - protein, 9 aa, Artificial Sequence
  Sushi repeat-containing protein SRPX (3-11)
SPAHRPALL

SEQ ID NO: 22658 - protein, 10 aa, Artificial Sequence
  Sushi repeat-containing protein SRPX (3-12)
SPAHRPALLL

SEQ ID NO: 22659 - protein, 8 aa, Artificial Sequence
  Staphylococcal nuclease domain-containing protein 1 (730-737)
SPAKIHVF

SEQ ID NO: 22660 - protein, 9 aa, Artificial Sequence
  Plectin (1284-1292)
SPAKKPKVQ

SEQ ID NO: 22661 - protein, 9 aa, Artificial Sequence
  Integrin beta-5 (81-89)
SPASSFHVL

SEQ ID NO: 22662 - protein, 9 aa, Artificial Sequence
  Nesprin-1 (72-80)
SPEVGRLSL

SEQ ID NO: 22663 - protein, 9 aa, Artificial Sequence
  Tetratricopeptide repeat protein 28 (1765-1773)
SPFQKVGKL

SEQ ID NO: 22664 - protein, 12 aa, Artificial Sequence
  Carcinoembryonic antigen-related cell adhesion molecule 1 isoform 3 (361-372)
SPGAIAGIVIGV

SEQ ID NO: 22665 - protein, 12 aa, Artificial Sequence
  Transport and Golgi organization protein 6 homolog (29-40)
SPGGSGSSSLQV

SEQ ID NO: 22666 - protein, 12 aa, Artificial Sequence
  Vimentin (56-67)
SPGGVYATRSSA

SEQ ID NO: 22667 - protein, 9 aa, Artificial Sequence
  HEAT repeat-containing protein 5B (63-71)
SPGPPTRKL

SEQ ID NO: 22668 - protein, 9 aa, Artificial Sequence
  Rho guanine nucleotide exchange factor 26 (304-312)
SPGSLRRGL

SEQ ID NO: 22669 - protein, 9 aa, Artificial Sequence
  Glia-derived nexin (66-74)
SPHGIASVL

SEQ ID NO: 22670 - protein, 10 aa, Artificial Sequence
  Tensin-3 (1123-1132)
SPHSGSTISI

SEQ ID NO: 22671 - protein, 9 aa, Artificial Sequence
  Ankyrin repeat and BTB/POZ domain-containing protein 2 (632-640)
SPIPSIPEI

SEQ ID NO: 22672 - protein, 9 aa, Artificial Sequence
  F-box only protein 7 (406-414)
SPKGRFVML

SEQ ID NO: 22673 - protein, 9 aa, Artificial Sequence
  Synaptic vesicle membrane protein VAT-1 homolog (249-257)
SPKGVDIVM

SEQ ID NO: 22674 - protein, 9 aa, Artificial Sequence
  Sodium-dependent neutral amino acid transporter B(0)AT2 (30-38)
SPKLGGIGF

SEQ ID NO: 22675 - protein, 10 aa, Artificial Sequence
  Collagen alpha-1(XV) chain (314-323)
SPKQGSGEIL

SEQ ID NO: 22676 - protein, 9 aa, Artificial Sequence
  E3 ubiquitin-protein ligase RLIM (89-97)
SPLHPMSEI

SEQ ID NO: 22677 - protein, 10 aa, Artificial Sequence
  Cleavage stimulation factor subunit 2 (154-163)
SPQEARNMLL

SEQ ID NO: 22678 - protein, 9 aa, Artificial Sequence
  L-dopachrome tautomerase (134-142)
SPQEREQFL

SEQ ID NO: 22679 - protein, 9 aa, Artificial Sequence
  Immunoglobulin superfamily member 11 (234-242)
SPQPRNIGL

SEQ ID NO: 22680 - protein, 9 aa, Artificial Sequence
  Collagen triple helix repeat-containing protein 1 (9-17)
SPQRLRGLL

SEQ ID NO: 22681 - protein, 9 aa, Artificial Sequence
  Ropporin-1A (153-161)
SPRIPFSTF

SEQ ID NO: 22682 - protein, 8 aa, Artificial Sequence
  Procollagen-lysine,2-oxoglutarate 5-dioxygenase 3 (702-709)
SPRKGWAL

SEQ ID NO: 22683 - protein, 8 aa, Artificial Sequence
  Procollagen-lysine,2-oxoglutarate 5-dioxygenase 2 (174-181)
SPRKGWSF

SEQ ID NO: 22684 - protein, 8 aa, Artificial Sequence
  Delta-like protein 3 (3-10)
SPRMSGLL

SEQ ID NO: 22685 - protein, 11 aa, Artificial Sequence
  Delta-like protein 3 (3-13)
SPRMSGLLSQT

SEQ ID NO: 22686 - protein, 9 aa, Artificial Sequence
  Integrin alpha-7 (803-811)
SPRPNILHL

SEQ ID NO: 22687 - protein, 9 aa, Artificial Sequence
  Protocadherin gamma-C3 (65-73)
SPRQTLTVL

SEQ ID NO: 22688 - protein, 9 aa, Artificial Sequence
  RPA-interacting protein (7-15)
SPRRSLYKL

SEQ ID NO: 22689 - protein, 9 aa, Artificial Sequence
  E3 ubiquitin-protein ligase RING1 (9-17)
SPRSLHSEL

SEQ ID NO: 22690 - protein, 9 aa, Artificial Sequence
  AP-1 complex subunit sigma-1A (146-154)
SPRSVLEEM

SEQ ID NO: 22691 - protein, 18 aa, Artificial Sequence
  Fatty acid synthase (856-873)
SPSAAIYNIDTSSESPDH

SEQ ID NO: 22692 - protein, 9 aa, Artificial Sequence
  Rho GTPase-activating protein 32 (243-251)
SPSTKLLTL

SEQ ID NO: 22693 - protein, 10 aa, Artificial Sequence
  Melanoma antigen preferentially expressed in tumors (345-354)
SPSVSQLSVL

SEQ ID NO: 22694 - protein, 9 aa, Artificial Sequence
  SAM and SH3 domain-containing protein 1 (442-450)
SPTASRISL

SEQ ID NO: 22695 - protein, 9 aa, Artificial Sequence
  Transcription factor Dp-2 (24-32)
SPTKGNISF

SEQ ID NO: 22696 - protein, 9 aa, Artificial Sequence
  Bestrophin-1 (499-507)
SPTNIHTTL

SEQ ID NO: 22697 - protein, 9 aa, Artificial Sequence
  Nuclear factor 1 X-type (373-381)
SPYFTHPTI

SEQ ID NO: 22698 - protein, 9 aa, Artificial Sequence
  Zinc finger CCHC domain-containing protein 24 (93-101)
SPYGSLNNI

SEQ ID NO: 22699 - protein, 9 aa, Artificial Sequence
  Zinc finger protein 503 (341-349)
SPYKPGQTV

SEQ ID NO: 22700 - protein, 10 aa, Artificial Sequence
  Retinoic acid receptor RXR-gamma (68-77)
SPYRVITSAM

SEQ ID NO: 22701 - protein, 8 aa, Artificial Sequence
  Filamin-A (1603-1610)
SPYRVRAV

SEQ ID NO: 22702 - protein, 21 aa, Artificial Sequence
  HLA class I histocompatibility antigen, A-23 alpha chain (345-365)
SQAASSDSAQGSDVSLTACKV

SEQ ID NO: 22703 - protein, 24 aa, Artificial Sequence
  AT-rich interactive domain-containing protein 1A (334-357)
SQCWGAAAAAAAAAAASGGAQQRS

SEQ ID NO: 22704 - protein, 8 aa, Artificial Sequence
  Hemicentin-1 (1082-1089)
SQDKPVEI

SEQ ID NO: 22705 - protein, 9 aa, Artificial Sequence
  Very large A-kinase anchor protein (777-785)
SQDPNRVEL

SEQ ID NO: 22706 - protein, 9 aa, Artificial Sequence
  Transmembrane protein 131 (324-332)
SQFSGKITV

SEQ ID NO: 22707 - protein, 21 aa, Artificial Sequence
  Hsp70-binding protein 1 (65-85)
SQGCSSGGGGGGSSAGGSGNS

SEQ ID NO: 22708 - protein, 10 aa, Artificial Sequence
  Histone acetyltransferase p300 (1897-1906)
SQGKAAGQVT

SEQ ID NO: 22709 - protein, 12 aa, Artificial Sequence
  Beta-2-microglobulin (87-98)
SQPKIVKWDRDM

SEQ ID NO: 22710 - protein, 13 aa, Artificial Sequence
  Ras-associating and dilute domain-containing protein (258-270)
SQQHDSLVYVLNR

SEQ ID NO: 22711 - protein, 10 aa, Artificial Sequence
  Oxysterol-binding protein-related protein 10 (232-241)
SQYSGQLHEV

SEQ ID NO: 22712 - protein, 9 aa, Artificial Sequence
  Transmembrane and TPR repeat-containing protein 2 (541-549)
SRFAEALHY

SEQ ID NO: 22713 - protein, 9 aa, Artificial Sequence
  Pre-mRNA-processing-splicing factor 8 (979-987)
SRFEKMYEK

SEQ ID NO: 22714 - protein, 9 aa, Artificial Sequence
  Glia-derived nexin (207-215)
SRFQPENTK

SEQ ID NO: 22715 - protein, 6 aa, Artificial Sequence
  ER membrane protein complex subunit 1 (7-12)
SRFWLW

SEQ ID NO: 22716 - protein, 8 aa, Artificial Sequence
  Splicing factor 3B subunit 3 (33-40)
SRGKILEL

SEQ ID NO: 22717 - protein, 9 aa, Artificial Sequence
  Maltase-glucoamylase (658-666)
SRHYLNIRY

SEQ ID NO: 22718 - protein, 9 aa, Artificial Sequence
  B-cell lymphoma 6 protein (444-452)
SRLNNIVNR

SEQ ID NO: 22719 - protein, 9 aa, Artificial Sequence
  Centrosomal protein C10orf90 (199-207)
SRNSSVVRL

SEQ ID NO: 22720 - protein, 9 aa, Artificial Sequence
  Maltase-glucoamylase, intestinal (1482-1490)
SRNVLQTRY

SEQ ID NO: 22721 - protein, 22 aa, Artificial Sequence
  Glia-derived nexin (57-78)
SRPHDNIVISPHGIASVLGMLQ

SEQ ID NO: 22722 - protein, 8 aa, Artificial Sequence
  Arylsulfatase B (42-49)
SRPPHLVF

SEQ ID NO: 22723 - protein, 9 aa, Artificial Sequence
  Fatty acid synthase (1916-1924)
SRSGIRTGY

SEQ ID NO: 22724 - protein, 9 aa, Artificial Sequence
  Vasorin (3-11)
SRVPLLLPL

SEQ ID NO: 22725 - protein, 8 aa, Artificial Sequence
  Semaphorin-3A (543-550)
SRYFPTAK

SEQ ID NO: 22726 - protein, 16 aa, Artificial Sequence
  Alpha-1D adrenergic receptor (23-38)
SSAGGGGGSAGGAAPS

SEQ ID NO: 22727 - protein, 9 aa, Artificial Sequence
  Insulin receptor substrate 2 (311-319)
SSATHPISV

SEQ ID NO: 22728 - protein, 9 aa, Artificial Sequence
  Protein CMSS1 (145-153)
SSAVRALEL

SEQ ID NO: 22729 - protein, 9 aa, Artificial Sequence
  Protein FAM127A (59-67)
SSDALKVTF

SEQ ID NO: 22730 - protein, 10 aa, Artificial Sequence
  Beta-1-syntrophin (489-498)
SSDDGIRMLY

SEQ ID NO: 22731 - protein, 9 aa, Artificial Sequence
  Transcription elongation factor B polypeptide 1 (7-15)
SSDGHEFIV

SEQ ID NO: 22732 - protein, 9 aa, Artificial Sequence
  Cyclin-dependent kinase-like 3 (88-96)
SSDLLHHEY

SEQ ID NO: 22733 - protein, 9 aa, Artificial Sequence
  Neutrophil collagenase (228-236)
SSDPGALMY

SEQ ID NO: 22734 - protein, 17 aa, Artificial Sequence
  HLA class I histocompatibility antigen, A-23 alpha chain (349-365)
SSDSAQGSDVSLTACKV

SEQ ID NO: 22735 - protein, 28 aa, Artificial Sequence
  NADH dehydrogenase (ubiquinone) 1 beta subcomplex subunit 11, mitochondrial (31-58)
SSFSRTVVAPSAVAGKRPPEPTTPWQED

SEQ ID NO: 22736 - protein, 13 aa, Artificial Sequence
  Keratin, type I cytoskeletal 10 (570-582)
SSGSVGESSSKGP

SEQ ID NO: 22737 - protein, 7 aa, Artificial Sequence
  Zinc finger protein 697 (329-335)
SSHLLSH

SEQ ID NO: 22738 - protein, 7 aa, Artificial Sequence
  BTB/POZ domain-containing protein KCTD20 (144-150)
SSKLYRF

SEQ ID NO: 22739 - protein, 13 aa, Artificial Sequence
  Voltage-dependent anion-selective channel protein 1 (240-252)
SSLIGLGYTQTLK

SEQ ID NO: 22740 - protein, 9 aa, Artificial Sequence
  Phosphatidylinositol 4-phosphate 3-kinase C2 domain-containing subunit alpha (1113-1121)
SSNAVPLKV

SEQ ID NO: 22741 - protein, 9 aa, Artificial Sequence
  Niemann-Pick C1 protein (167-175)
SSNDKALGL

SEQ ID NO: 22742 - protein, 9 aa, Artificial Sequence
  Ligand of Numb protein X 2 (382-390)
SSNDRVLAI

SEQ ID NO: 22743 - protein, 14 aa, Artificial Sequence
  Beta-secretase 2 (113-126)
SSNFAVAGTPHSYI

SEQ ID NO: 22744 - protein, 15 aa, Artificial Sequence
  Beta-secretase 2 (113-127)
SSNFAVAGTPHSYID

SEQ ID NO: 22745 - protein, 16 aa, Artificial Sequence
  Beta-secretase 2 (113-128)
SSNFAVAGTPHSYIDT

SEQ ID NO: 22746 - protein, 9 aa, Artificial Sequence
  Alpha-taxilin (438-446)
SSNKALLEM

SEQ ID NO: 22747 - protein, 9 aa, Artificial Sequence
  Plakophilin-4 (457-465)
SSQRSTLTY

SEQ ID NO: 22748 - protein, 9 aa, Artificial Sequence
  Golgin subfamily B member 1 (3000-3008)
SSQTQPLKV

SEQ ID NO: 22749 - protein, 11 aa, Artificial Sequence
  Transducin-like enhancer protein 3 (167-177)
SSSGLLALGAL

SEQ ID NO: 22750 - protein, 14 aa, Artificial Sequence
  Keratin, type I cytoskeletal 10 (37-50)
SSSKGSLGGGFSSG

SEQ ID NO: 22751 - protein, 15 aa, Artificial Sequence
  Keratin, type I cytoskeletal 10 (37-51)
SSSKGSLGGGFSSGG

SEQ ID NO: 22752 - protein, 16 aa, Artificial Sequence
  Keratin, type I cytoskeletal 10 (37-52)
SSSKGSLGGGFSSGGF

SEQ ID NO: 22753 - protein, 18 aa, Artificial Sequence
  Keratin, type I cytoskeletal 10 (37-54)
SSSKGSLGGGFSSGGFSG

SEQ ID NO: 22754 - protein, 19 aa, Artificial Sequence
  Keratin, type I cytoskeletal 10 (37-55)
SSSKGSLGGGFSSGGFSGG

SEQ ID NO: 22755 - protein, 9 aa, Artificial Sequence
  Actin, gamma-enteric smooth muscle (190-198)
SSSSLEKSY

SEQ ID NO: 22756 - protein, 13 aa, Artificial Sequence
  Synaptotagmin-like protein 2 (277-289)
SSSSSTDSETLRY

SEQ ID NO: 22757 - protein, 12 aa, Artificial Sequence
  Synaptotagmin-like protein 2 (279-290)
SSSSTDSETLRY

SEQ ID NO: 22758 - protein, 10 aa, Artificial Sequence
  Synaptotagmin-like protein 2 (281-290)
SSTDSETLRY

SEQ ID NO: 22759 - protein, 9 aa, Artificial Sequence
  F-actin-capping protein subunit beta (41-49)
SSVDQPLKI

SEQ ID NO: 22760 - protein, 7 aa, Artificial Sequence
  TATA-binding protein-associated factor 2N (44-50)
SSYGQNY

SEQ ID NO: 22761 - protein, 9 aa, Artificial Sequence
  Poly(rC)-binding protein 4 (68-76)
STAAVFHAV

SEQ ID NO: 22762 - protein, 8 aa, Artificial Sequence
  40S ribosomal protein S19 (59-66)
STARHLYL

SEQ ID NO: 22763 - protein, 11 aa, Artificial Sequence
  Regulator of G-protein signaling 12 (284-294)
STDKAGVVAEY

SEQ ID NO: 22764 - protein, 10 aa, Artificial Sequence
  Neuropilin-2 (829-838)
STDKEKSWLY

SEQ ID NO: 22765 - protein, 10 aa, Artificial Sequence
  Protein LZIC (168-177)
STDLGRPPSY

SEQ ID NO: 22766 - protein, 9 aa, Artificial Sequence
  Transcription factor HES-1 (101-109)
STDPSVLGK

SEQ ID NO: 22767 - protein, 8 aa, Artificial Sequence
  Heterogeneous nuclear ribonucleoprotein K (188-195)
STDRVVLI

SEQ ID NO: 22768 - protein, 10 aa, Artificial Sequence
  CUB and sushi domain-containing protein 1 (1359-1368)
STFNSLTLQF

SEQ ID NO: 22769 - protein, 8 aa, Artificial Sequence
  Transcription termination factor 2 (827-834)
STGRPLVI

SEQ ID NO: 22770 - protein, 8 aa, Artificial Sequence
  Basic leucine zipper and W2 domain-containing protein 2 (54-61)
STGSRLDY

SEQ ID NO: 22771 - protein, 7 aa, Artificial Sequence
  Synemin (859-865)
STIRYSW

SEQ ID NO: 22772 - protein, 18 aa, Artificial Sequence
  Transformation/transcription domain-associated protein (377-394)
STLADLVHHVRQHLPLSD

SEQ ID NO: 22773 - protein, 7 aa, Artificial Sequence
  Nicalin (264-270)
STLEHHL

SEQ ID NO: 22774 - protein, 31 aa, Artificial Sequence
  CXXC-type zinc finger protein 5 (18-48)
STNGSGGSGSSGPKAGAADKSAVVAAAAPAS

SEQ ID NO: 22775 - protein, 10 aa, Artificial Sequence
  Transmembraneoprotein NMB (294-303)
STNHTVNHTY

SEQ ID NO: 22776 - protein, 9 aa, Artificial Sequence
  Patatin-like phospholipase domain-containing protein 2 (199-207)
STNIHELRV

SEQ ID NO: 22777 - protein, 9 aa, Artificial Sequence
  Sodium/potassium-transporting ATPase subunit alpha-3 (487-495)
STNKYQLSI

SEQ ID NO: 22778 - protein, 9 aa, Artificial Sequence
  Transmembrane emp24 domain-containing protein 10 (181-189)
STNTRVLYF

SEQ ID NO: 22779 - protein, 9 aa, Artificial Sequence
  DNA-directed RNA polymerase I subunit RPA2 (156-164)
STQKQVLNY

SEQ ID NO: 22780 - protein, 8 aa, Artificial Sequence
  Protein-methionine sulfoxide oxidase MICAL3 (646-653)
STRSPISF

SEQ ID NO: 22781 - protein, 15 aa, Artificial Sequence
  Vimentin (2-16)
STRSVSSSSYRRMFG

SEQ ID NO: 22782 - protein, 15 aa, Artificial Sequence
  Vimentin (47-61)
STSRSLYASSPGGVY

SEQ ID NO: 22783 - protein, 7 aa, Artificial Sequence
  WD repeat-containing protein 36 (352-358)
STVHEKF

SEQ ID NO: 22784 - protein, 9 aa, Artificial Sequence
  Zinc finger CCHC domain-containing protein 3 (228-236)
SVAAQLTGV

SEQ ID NO: 22785 - protein, 9 aa, Artificial Sequence
  Zinc finger protein 518B (424-432)
SVALKGHSL

SEQ ID NO: 22786 - protein, 11 aa, Artificial Sequence
  Latent-transforming growth factor beta-binding protein 3 (178-188)
SVASKHAIYAV

SEQ ID NO: 22787 - protein, 9 aa, Artificial Sequence
  3-hydroxybutyrate dehydrogenase type 2 (133-141)
SVASSVKGV

SEQ ID NO: 22788 - protein, 20 aa, Artificial Sequence
  Chondroitin sulfate proteoglycan 4 (124-143)
SVDGFLNASSAVPGAPLEVP

SEQ ID NO: 22789 - protein, 9 aa, Artificial Sequence
  GDNF-inducible zinc finger protein 1 (69-77)
SVDGTRTNV

SEQ ID NO: 22790 - protein, 9 aa, Artificial Sequence
  Protein AHNAK2 (2175-2183)
SVDVSPPKV

SEQ ID NO: 22791 - protein, 9 aa, Artificial Sequence
  Phospholipase B-like 1 (304-312)
SVFNKTLLK

SEQ ID NO: 22792 - protein, 7 aa, Artificial Sequence
  Clathrin interactor 1 (166-172)
SVGGFRY

SEQ ID NO: 22793 - protein, 19 aa, Artificial Sequence
  Prelamin-A/C (479-497)
SVGGSGGGSFGDNLVTRSY

SEQ ID NO: 22794 - protein, 9 aa, Artificial Sequence
  Heterogeneous nuclear ribonucleoprotein C-like 1 (47-55)
SVHKGFAFV

SEQ ID NO: 22795 - protein, 9 aa, Artificial Sequence
  COUP transcription factor 2 (223-231)
SVIEQLFFV

SEQ ID NO: 22796 - protein, 9 aa, Artificial Sequence
  Serine/threonine-protein kinase ICK (533-541)
SVISKVNSV

SEQ ID NO: 22797 - protein, 23 aa, Artificial Sequence
  Glutathione reductase, mitochondrial (234-256)
SVIVGAGYIAVEMAGILSALGSK

SEQ ID NO: 22798 - protein, 9 aa, Artificial Sequence
  Kelch-like protein 21 (378-386)
SVLDGLLYV

SEQ ID NO: 22799 - protein, 10 aa, Artificial Sequence
  Protein transport protein Sec61 subunit alpha isoform 1 (353-362)
SVLEDPVHAV

SEQ ID NO: 22800 - protein, 7 aa, Artificial Sequence
  Tetratricopeptide repeat protein 27 (74-80)
SVLFQQF

SEQ ID NO: 22801 - protein, 9 aa, Artificial Sequence
  Histone-lysine N-methyltransferase SETD1B (168-176)
SVMGNIIHV

SEQ ID NO: 22802 - protein, 9 aa, Artificial Sequence
  E3 ubiquitin-protein ligase UBR4 (884-892)
SVNRYILQL

SEQ ID NO: 22803 - protein, 12 aa, Artificial Sequence
  Integral membrane protein GPR137C (4-15)
SVPGPAAAAAPA

SEQ ID NO: 22804 - protein, 26 aa, Artificial Sequence
  CCR4-NOT transcription complex subunit 3 (392-417)
SVQPSGGGGGGSGGGGSSSSSNSSAG

SEQ ID NO: 22805 - protein, 10 aa, Artificial Sequence
  Transmembrane protein 98 (124-133)
SVSDIIVVAK

SEQ ID NO: 22806 - protein, 9 aa, Artificial Sequence
  Adipocyte enhancer-binding protein 1 (926-934)
SVSGINHGV

SEQ ID NO: 22807 - protein, 9 aa, Artificial Sequence
  Dimethyladenosine transferase 1, mitochondrial (145-153)
SVSTPLIIK

SEQ ID NO: 22808 - protein, 9 aa, Artificial Sequence
  Dolichyl-diphosphooligosaccharide-proteinosyltransferase subunit 2 (121-129)
SVTQIYHAV

SEQ ID NO: 22809 - protein, 9 aa, Artificial Sequence
  Lysine-specific demethylase 4B (1000-1008)
SVTSHIYQV

SEQ ID NO: 22810 - protein, 9 aa, Artificial Sequence
  PR domain zinc finger protein 2 (684-692)
SVYLSSKLK

SEQ ID NO: 22811 - protein, 8 aa, Artificial Sequence
  Suppressor of tumorigenicity 7 protein (439-446)
SVYPKKEL

SEQ ID NO: 22812 - protein, 12 aa, Artificial Sequence
  Semaphorin-3D (430-441)
SVYPVAGGPTFK

SEQ ID NO: 22813 - protein, 10 aa, Artificial Sequence
  Melanophilin (449-458)
SVYRGSLTQR

SEQ ID NO: 22814 - protein, 10 aa, Artificial Sequence
  Cathepsin B (254-263)
SVYSDFLLYK

SEQ ID NO: 22815 - protein, 12 aa, Artificial Sequence
  Synaptotagmin-like protein 2 (618-629)
SVYSGDFGNLEV

SEQ ID NO: 22816 - protein, 9 aa, Artificial Sequence
  Retrotransposon gag domain-containing protein 4 (253-261)
SYADAFQFL

SEQ ID NO: 22817 - protein, 9 aa, Artificial Sequence
  WD repeat-containing protein 11 (156-164)
SYADNILSF

SEQ ID NO: 22818 - protein, 9 aa, Artificial Sequence
  SH3 domain-binding protein 1 (158-166)
SYANYFIRL

SEQ ID NO: 22819 - protein, 20 aa, Artificial Sequence
  Thioredoxin reductase 1, cytoplasmic (10-29)
SYDYDLIIIGGGSGGLAAAK

SEQ ID NO: 22820 - protein, 9 aa, Artificial Sequence
  Dedicator of cytokinesis protein 7 (739-747)
SYIHYVFRL

SEQ ID NO: 22821 - protein, 9 aa, Artificial Sequence
  Transportin-2 (516-524)
SYILDTLVF

SEQ ID NO: 22822 - protein, 9 aa, Artificial Sequence
  E3 ubiquitin-protein ligase TRIM58 (431-439)
SYIYTFNQL

SEQ ID NO: 22823 - protein, 9 aa, Artificial Sequence
  SMC5-SMC6 complex localization factor protein 2 (901-909)
SYKPIFSTL

SEQ ID NO: 22824 - protein, 7 aa, Artificial Sequence
  Nicotinamide phosphoribosyltransferase (17-23)
SYKVTHY

SEQ ID NO: 22825 - protein, 9 aa, Artificial Sequence
  Zinc finger CCHC domain-containing protein 24 (70-78)
SYLNSFFQL

SEQ ID NO: 22826 - protein, 9 aa, Artificial Sequence
  Glycogenin-1 (194-202)
SYLPAFKVF

SEQ ID NO: 22827 - protein, 9 aa, Artificial Sequence
  DNA-directed RNA polymerase III subunit RPC2 (532-540)
SYPNVFLVF

SEQ ID NO: 22828 - protein, 9 aa, Artificial Sequence
  Helicase-like transcription factor (29-37)
SYPTFFPRF

SEQ ID NO: 22829 - protein, 9 aa, Artificial Sequence
  Nesprin-1 (3393-3401)
SYQDGVRQF

SEQ ID NO: 22830 - protein, 9 aa, Artificial Sequence
  RB1-inducible coiled-coil protein 1 (163-171)
SYQKLLFKF

SEQ ID NO: 22831 - protein, 9 aa, Artificial Sequence
  Farnesyl pyrophosphate synthase (314-322)
SYSHIMALI

SEQ ID NO: 22832 - protein, 8 aa, Artificial Sequence
  2',3'-cyclic-nucleotide 3'-phosphodiesterase (257-264)
SYSKAFTL

SEQ ID NO: 22833 - protein, 23 aa, Artificial Sequence
  HLA class I histocompatibility antigen, A-23 alpha chain (343-365)
SYSQAASSDSAQGSDVSLTACKV

SEQ ID NO: 22834 - protein, 23 aa, Artificial Sequence
  HLA class I histocompatibility antigen, A-1 alpha chain (318-340)
SYTQAASSDSAQGSDVSLTACKV

SEQ ID NO: 22835 - protein, 9 aa, Artificial Sequence
  Mediator of RNA polymerase II transcription subunit 13-like (933-941)
SYVHKVPSF

SEQ ID NO: 22836 - protein, 6 aa, Artificial Sequence
  Amyloid protein-binding protein 2 (340-345)
SYVHQY

SEQ ID NO: 22837 - protein, 9 aa, Artificial Sequence
  Melanoma-associated antigen 12 (282-290)
SYVKVLHHL

SEQ ID NO: 22838 - protein, 9 aa, Artificial Sequence
  Dolichyl-diphosphooligosaccharide-proteinosyltransferase 48 kDa subunit (22-30)
TAARAWALF

SEQ ID NO: 22839 - protein, 9 aa, Artificial Sequence
  Protein AATF (30-38)
TAARVIDRF

SEQ ID NO: 22840 - protein, 10 aa, Artificial Sequence
  Dolichyl-diphosphooligosaccharide-proteinosyltransferase 48 kDa subunit (78-87)
TADDPSLSLI

SEQ ID NO: 22841 - protein, 8 aa, Artificial Sequence
  Triokinase/FMN cyclase (233-240)
TADEIVKL

SEQ ID NO: 22842 - protein, 9 aa, Artificial Sequence
  Calcium homeostasis endoplasmic reticulum protein (170-178)
TADGAHFEL

SEQ ID NO: 22843 - protein, 9 aa, Artificial Sequence
  Transducin beta-like protein 3 (197-205)
TADHNLLLY

SEQ ID NO: 22844 - protein, 9 aa, Artificial Sequence
  Late secretory pathway protein AVL9 homolog (340-348)
TADVSHTNL

SEQ ID NO: 22845 - protein, 10 aa, Artificial Sequence
  Histone acetyltransferase type B catalytic subunit (274-283)
TAEDPSKSYV

SEQ ID NO: 22846 - protein, 21 aa, Artificial Sequence
  3-hydroxyacyl-CoA dehydrogenase type-2 (26-46)
TAERLVGQGASAVLLDLPNSG

SEQ ID NO: 22847 - protein, 8 aa, Artificial Sequence
  H(+)/Cl(-) exchange transporter 7 (101-108)
TAFRTVEI

SEQ ID NO: 22848 - protein, 28 aa, Artificial Sequence
  Alpha-1,6-mannosylglycoprotein 6-beta-N-acetylglucosaminyltransferase A (288-315)
TAFSGGPLGELVQWSDLITSLYLLGHDI

SEQ ID NO: 22849 - protein, 8 aa, Artificial Sequence
  Cleavage and polyadenylation specificity factor subunit 2 (239-246)
TAGRVLEL

SEQ ID NO: 22850 - protein, 9 aa, Artificial Sequence
  Biorientation of chromosomes in cell division protein 1-like 1 (1268-1276)
TAKDPSVSI

SEQ ID NO: 22851 - protein, 8 aa, Artificial Sequence
  Guanine nucleotide exchange factor for Rab-3A (87-94)
TALKTLVI

SEQ ID NO: 22852 - protein, 25 aa, Artificial Sequence
  60 kDa heat shock protein, mitochondrial (527-551)
TALLDAAGVASLLTTAEVVVTEIPK

SEQ ID NO: 22853 - protein, 28 aa, Artificial Sequence
  60 kDa heat shock protein, mitochondrial (527-554)
TALLDAAGVASLLTTAEVVVTEIPKEEK

SEQ ID NO: 22854 - protein, 14 aa, Artificial Sequence
  Plexin-B2 (1522-1535)
TAQILSDLDLTSQR

SEQ ID NO: 22855 - protein, 7 aa, Artificial Sequence
  40S ribosomal protein S19 (60-66)
TARHLYL

SEQ ID NO: 22856 - protein, 16 aa, Artificial Sequence
  Zinc finger SWIM domain-containing protein 8 (1087-1102)
TASQRSPSKHGGPSAP

SEQ ID NO: 22857 - protein, 17 aa, Artificial Sequence
  Eukaryotic initiation factor 4A-I (83-99)
TATFAISILQQIELDLK

SEQ ID NO: 22858 - protein, 14 aa, Artificial Sequence
  Tubulin alpha-1C chain (249-262)
TAVVEPYNSILTTH

SEQ ID NO: 22859 - protein, 10 aa, Artificial Sequence
  Endoplasmin (419-428)
TDDFHDMMPK

SEQ ID NO: 22860 - protein, 8 aa, Artificial Sequence
  GPI transamidase component PIG-T (162-169)
TDHYFLRY

SEQ ID NO: 22861 - protein, 14 aa, Artificial Sequence
  Alpha-enolase (67-80)
TDKVVIGMDVAASE

SEQ ID NO: 22862 - protein, 16 aa, Artificial Sequence
  Alpha-enolase (67-82)
TDKVVIGMDVAASEFF

SEQ ID NO: 22863 - protein, 14 aa, Artificial Sequence
  4F2 cell-surface antigen heavy chain (174-187)
TDLLQIDPNFGSKE

SEQ ID NO: 22864 - protein, 15 aa, Artificial Sequence
  4F2 cell-surface antigen heavy chain (174-188)
TDLLQIDPNFGSKED

SEQ ID NO: 22865 - protein, 8 aa, Artificial Sequence
  Synaptotagmin-like protein 2 (283-290)
TDSETLRY

SEQ ID NO: 22866 - protein, 7 aa, Artificial Sequence
  40S ribosomal protein SA (150-156)
TDSPLRY

SEQ ID NO: 22867 - protein, 16 aa, Artificial Sequence
  Carbonic anhydrase 14 (52-67)
TDSVTFDPDLPALQPH

SEQ ID NO: 22868 - protein, 10 aa, Artificial Sequence
  CD44 antigen (47-56)
TEAADLCKAF

SEQ ID NO: 22869 - protein, 9 aa, Artificial Sequence
  Rho GTPase-activating protein 5 (467-475)
TEADSKEVY

SEQ ID NO: 22870 - protein, 10 aa, Artificial Sequence
  Protein kinase C-binding protein 1 (210-219)
TEAFLADAKW

SEQ ID NO: 22871 - protein, 9 aa, Artificial Sequence
  Inosine-5'-monophosphate dehydrogenase 1 isoform f (446-454)
TEAPGEYFF

SEQ ID NO: 22872 - protein, 11 aa, Artificial Sequence
  Glycogen phosphorylase, muscle form (672-682)
TEASGTGNMKF

SEQ ID NO: 22873 - protein, 10 aa, Artificial Sequence
  Zinc finger BED domain-containing protein 4 (394-403)
TEDLQSHLNP

SEQ ID NO: 22874 - protein, 14 aa, Artificial Sequence
  Large neutral amino acids transporter small subunit 1 (264-277)
TEEMINPYRNLPLA

SEQ ID NO: 22875 - protein, 7 aa, Artificial Sequence
  Nuclear factor erythroid 2-related factor 1 (9-15)
TEGLLQF

SEQ ID NO: 22876 - protein, 9 aa, Artificial Sequence
  G-protein coupled receptor 98 (3712-3720)
TEGQVLSTI

SEQ ID NO: 22877 - protein, 10 aa, Artificial Sequence
  Fibronectin isoform 7 (376-385)
TEGRQDGHLW

SEQ ID NO: 22878 - protein, 11 aa, Artificial Sequence
  Tribbles homolog 2 (117-127)
TEIILGETKAY

SEQ ID NO: 22879 - protein, 8 aa, Artificial Sequence
  Flotillin-2 (60-67)
TEKELLAV

SEQ ID NO: 22880 - protein, 11 aa, Artificial Sequence
  Centrosomal protein of 41 kDa (40-50)
TEKLEEIKKNY

SEQ ID NO: 22881 - protein, 11 aa, Artificial Sequence
  Integrin alpha-6 (905-915)
TEKQIDDNRKF

SEQ ID NO: 22882 - protein, 9 aa, Artificial Sequence
  Programmed cell death protein 5 (103-111)
TEKTTTVKF

SEQ ID NO: 22883 - protein, 10 aa, Artificial Sequence
  SH3 domain-binding protein 5 (34-43)
TELEDARQKF

SEQ ID NO: 22884 - protein, 9 aa, Artificial Sequence
  Vesicle-trafficking protein SEC22b (140-148)
TELQDVQRI

SEQ ID NO: 22885 - protein, 9 aa, Artificial Sequence
  NHL repeat-containing protein 2 (296-304)
TENHLIRKI

SEQ ID NO: 22886 - protein, 7 aa, Artificial Sequence
  Zinc finger CCCH domain-containing protein 18 (68-74)
TEPYHNY

SEQ ID NO: 22887 - protein, 10 aa, Artificial Sequence
  Baculoviral IAP repeat-containing protein 6 (1992-2001)
TEQLRTIIRY

SEQ ID NO: 22888 - protein, 9 aa, Artificial Sequence
  Vacuolar protein sorting-associated protein 13C (969-977)
TEQTVKVAF

SEQ ID NO: 22889 - protein, 9 aa, Artificial Sequence
  Centrosomal protein C10orf90 isoform X1 (20-28)
TETAVHRTF

SEQ ID NO: 22890 - protein, 9 aa, Artificial Sequence
  Lysosomal-trafficking regulator (2635-2643)
TETELAQRL

SEQ ID NO: 22891 - protein, 11 aa, Artificial Sequence
  Receptor-type protein tyrosine phosphatase beta (1331-1341)
TEVLDSHIHAY

SEQ ID NO: 22892 - protein, 9 aa, Artificial Sequence
  Apolipoprotein E (36-44)
TEWQSGQRW

SEQ ID NO: 22893 - protein, 9 aa, Artificial Sequence
  Calmodulin-regulated spectrin-associated protein 2 (1318-1326)
TEYTGPKLY

SEQ ID NO: 22894 - protein, 9 aa, Artificial Sequence
  Telomeric repeat-binding factor 1 (223-231)
TFHSFFQHF

SEQ ID NO: 22895 - protein, 10 aa, Artificial Sequence
  Dolichyl-diphosphooligosaccharide-proteinosyltransferase subunit 2 (266-275)
TFIADSHQNF

SEQ ID NO: 22896 - protein, 9 aa, Artificial Sequence
  Phospholipid transfer protein (118-126)
TFITSGMRF

SEQ ID NO: 22897 - protein, 6 aa, Artificial Sequence
  Ras GTPase-activating-like protein IQGAP1 (1614-1619)
TFMLHY

SEQ ID NO: 22898 - protein, 20 aa, Artificial Sequence
  ATP synthase-coupling factor 6, mitochondrial (89-108)
TFPTFKFEDPKFEVIEKPQA

SEQ ID NO: 22899 - protein, 9 aa, Artificial Sequence
  Zinc finger protein 480 (28-36)
TFRDVAIEF

SEQ ID NO: 22900 - protein, 9 aa, Artificial Sequence
  Zinc finger protein 98 (14-22)
TFRDVALEF

SEQ ID NO: 22901 - protein, 9 aa, Artificial Sequence
  Zinc finger protein 697 (8-16)
TFSVSSHLF

SEQ ID NO: 22902 - protein, 8 aa, Artificial Sequence
  Bestrophin-1 (574-581)
TFTGILGK

SEQ ID NO: 22903 - protein, 10 aa, Artificial Sequence
  Glyceraldehyde-3-phosphate dehydrogenase (211-220)
TGAAKAVGKV

SEQ ID NO: 22904 - protein, 15 aa, Artificial Sequence
  4F2 cell-surface antigen heavy chain (120-134)
TGALYRIGDLQAFQG

SEQ ID NO: 22905 - protein, 7 aa, Artificial Sequence
  Glia-derived nexin (397-403)
TGAVLFM

SEQ ID NO: 22906 - protein, 9 aa, Artificial Sequence
  DNA-dependent protein kinase catalytic subunit (402-410)
TGDDRVYQM

SEQ ID NO: 22907 - protein, 9 aa, Artificial Sequence
  Hsp90 co-chaperone Cdc37 (370-378)
TGDEKDVSV

SEQ ID NO: 22908 - protein, 9 aa, Artificial Sequence
  Ubiquitin carboxyl-terminal hydrolase 8 (508-516)
TGDVPHTSV

SEQ ID NO: 22909 - protein, 14 aa, Artificial Sequence
  Basement membrane-specific heparan sulfate proteoglycan core protein (351-364)
TGEFTVEPVPEGAQ

SEQ ID NO: 22910 - protein, 11 aa, Artificial Sequence
  Titin (7053-7063)
TGGVLGASCIL

SEQ ID NO: 22911 - protein, 14 aa, Artificial Sequence
  Transferrin receptor protein 1 (518-531)
TGQFLYQDSNWASK

SEQ ID NO: 22912 - protein, 18 aa, Artificial Sequence
  Beta-secretase 2 (111-128)
TGSSNFAVAGTPHSYIDT

SEQ ID NO: 22913 - protein, 33 aa, Artificial Sequence
  Histone-lysine N-methyltransferase, H3 lysine-36 and H4 lysine-20 specific (2131-2163)
THLAEQSTGMAAQAPKMSDKPPADTNQMLSLSK

SEQ ID NO: 22914 - protein, 9 aa, Artificial Sequence
  Ras GTPase-activating-like protein IQGAP1 (446-454)
THPELSVAV

SEQ ID NO: 22915 - protein, 9 aa, Artificial Sequence
  Phosphatidylinositol 4-kinase alpha (399-407)
TIDADAPEL

SEQ ID NO: 22916 - protein, 8 aa, Artificial Sequence
  Protein prune homolog 2 (1960-1967)
TIDDMSKL

SEQ ID NO: 22917 - protein, 8 aa, Artificial Sequence
  DNA damage-binding protein 1 (703-710)
TIDEIQKL

SEQ ID NO: 22918 - protein, 8 aa, Artificial Sequence
  Calmodulin (66-73)
TIDFPEFL

SEQ ID NO: 22919 - protein, 8 aa, Artificial Sequence
  Filamin-A (2133-2140)
TIDGPSKV

SEQ ID NO: 22920 - protein, 9 aa, Artificial Sequence
  Coatomer subunit alpha (591-599)
TIDPTEFKF

SEQ ID NO: 22921 - protein, 9 aa, Artificial Sequence
  Alpha-actinin-1 (506-514)
TIDQLYLEY

SEQ ID NO: 22922 - protein, 8 aa, Artificial Sequence
  HEAT repeat-containing protein 1 (38-45)
TIDRDTAF

SEQ ID NO: 22923 - protein, 11 aa, Artificial Sequence
  Melanoma-associated antigen C2 (347-357)
TIDTADDATVM

SEQ ID NO: 22924 - protein, 9 aa, Artificial Sequence
  Vascular endothelial growth factor receptor 2 (1076-1084)
TIFDRVYTI

SEQ ID NO: 22925 - protein, 9 aa, Artificial Sequence
  Tripartite motif-containing protein 2 (338-346)
TIIGQPMSV

SEQ ID NO: 22926 - protein, 9 aa, Artificial Sequence
  Obscurin-like protein 1 (641-649)
TIIQGTWFL

SEQ ID NO: 22927 - protein, 12 aa, Artificial Sequence
  Lysosome-associated membraneoprotein 1 (247-258)
TILPDARDPAFK

SEQ ID NO: 22928 - protein, 9 aa, Artificial Sequence
  Eukaryotic translation initiation factor 3 subunit A (435-443)
TILRLLQQV

SEQ ID NO: 22929 - protein, 9 aa, Artificial Sequence
  Putative ATP-dependent RNA helicase DHX30 (700-708)
TINDIVHVV

SEQ ID NO: 22930 - protein, 9 aa, Artificial Sequence
  Chloride intracellular channel protein 1 (198-206)
TIPEAFRGV

SEQ ID NO: 22931 - protein, 9 aa, Artificial Sequence
  Lysosomal-trafficking regulator (1800-1808)
TIQGILHEI

SEQ ID NO: 22932 - protein, 9 aa, Artificial Sequence
  Plexin-B3 (1547-1555)
TITQVKEKV

SEQ ID NO: 22933 - protein, 10 aa, Artificial Sequence
  Serine/threonine-protein kinase DCLK1 (231-240)
TIVDGPLYTV

SEQ ID NO: 22934 - protein, 9 aa, Artificial Sequence
  Phosphopantothenoylcysteine decarboxylase (109-117)
TIVDKVKEV

SEQ ID NO: 22935 - protein, 11 aa, Artificial Sequence
  Heat shock protein HSP 90-alpha (90-100)
TIVDTGIGMTK

SEQ ID NO: 22936 - protein, 9 aa, Artificial Sequence
  Mitotic checkpoint serine/threonine-protein kinase BUB1 beta (868-876)
TIVEMLHKA

SEQ ID NO: 22937 - protein, 11 aa, Artificial Sequence
  Heat shock 70 kDa protein 13 (95-105)
TIYDAKRFIGK

SEQ ID NO: 22938 - protein, 9 aa, Artificial Sequence
  Probable dolichyl pyrophosphate Glc1Man9GlcNAc2 alpha-1,3-glucosyltransferase (438-446)
TIYSISSLK

SEQ ID NO: 22939 - protein, 27 aa, Artificial Sequence
  Activating signal cointegrator 1 complex subunit 3 (112-138)
TKAIKQMFGPFPSSSATAACNATNRII

SEQ ID NO: 22940 - protein, 27 aa, Artificial Sequence
  Transmembrane protease serine 9 (436-462)
TKASMPLAPTMAPAPAAPSTAWPTSPE

SEQ ID NO: 22941 - protein, 9 aa, Artificial Sequence
  Protein kinase C delta type (402-410)
TLAAENPFL

SEQ ID NO: 22942 - protein, 9 aa, Artificial Sequence
  Hexokinase-2 (389-397)
TLAAVLQRI

SEQ ID NO: 22943 - protein, 9 aa, Artificial Sequence
  Protein SOGA1 (670-678)
TLADMKVTL

SEQ ID NO: 22944 - protein, 9 aa, Artificial Sequence
  Ethanolaminephosphotransferase 1 (355-363)
TLAHIHYGV

SEQ ID NO: 22945 - protein, 10 aa, Artificial Sequence
  WD repeat-containing protein 73 (144-153)
TLAPGVLHGA

SEQ ID NO: 22946 - protein, 9 aa, Artificial Sequence
  Protein kinase C delta-binding protein (77-85)
TLAQLLAKA

SEQ ID NO: 22947 - protein, 11 aa, Artificial Sequence
  E3 ubiquitin-protein ligase UBR4 (345-355)
TLDAAISKVQV

SEQ ID NO: 22948 - protein, 9 aa, Artificial Sequence
  Melanoma-associated antigen C2 (140-148)
TLDEKVAEL

SEQ ID NO: 22949 - protein, 9 aa, Artificial Sequence
  Lysine-specific demethylase 5C (1342-1350)
TLDENHSIP

SEQ ID NO: 22950 - protein, 10 aa, Artificial Sequence
  Calcium-dependent secretion activator 2 (651-660)
TLDHRLNDSY

SEQ ID NO: 22951 - protein, 8 aa, Artificial Sequence
  Rho guanine nucleotide exchange factor 2 (487-494)
TLDKPSVV

SEQ ID NO: 22952 - protein, 9 aa, Artificial Sequence
  Alpha-mannosidase 2C1 (688-696)
TLDNGIIRV

SEQ ID NO: 22953 - protein, 9 aa, Artificial Sequence
  RING finger protein 150 (368-376)
TLDPAVRTV

SEQ ID NO: 22954 - protein, 9 aa, Artificial Sequence
  Proteinase-activated receptor 1 (37-45)
TLDPRSFLL

SEQ ID NO: 22955 - protein, 8 aa, Artificial Sequence
  Eukaryotic initiation factor 4A-I (242-249)
TLEGIRQF

SEQ ID NO: 22956 - protein, 15 aa, Artificial Sequence
  Kin of IRRE-like protein 1 (337-351)
TLERYTVERTNSGSG

SEQ ID NO: 22957 - protein, 9 aa, Artificial Sequence
  TBC1 domain family member 4 (1082-1090)
TLFASQFSL

SEQ ID NO: 22958 - protein, 9 aa, Artificial Sequence
  Centrosomal protein C10orf90 (172-180)
TLFQAPPAL

SEQ ID NO: 22959 - protein, 11 aa, Artificial Sequence
  Ubiquitin carboxyl-terminal hydrolase 11 (92-102)
TLFQDEINWRL

SEQ ID NO: 22960 - protein, 9 aa, Artificial Sequence
  Transmembraneoprotein NMB (202-210)
TLGPQLMEV

SEQ ID NO: 22961 - protein, 10 aa, Artificial Sequence
  Transmembrane channel-like protein 4 (331-340)
TLGQQARVWL

SEQ ID NO: 22962 - protein, 8 aa, Artificial Sequence
  E3 ubiquitin-protein ligase TRIP12 (804-811)
TLGRVYTI

SEQ ID NO: 22963 - protein, 8 aa, Artificial Sequence
  Ubiquitin-60S ribosomal protein L40 (71-78)
TLHLVLRL

SEQ ID NO: 22964 - protein, 9 aa, Artificial Sequence
  Alpha-adducin (222-230)
TLHSAIYAA

SEQ ID NO: 22965 - protein, 9 aa, Artificial Sequence
  Peptidyl-tRNA hydrolase 2, mitochondrial (125-133)
TLIALLAHA

SEQ ID NO: 22966 - protein, 9 aa, Artificial Sequence
  Nebulin (5609-5617)
TLIESDLKY

SEQ ID NO: 22967 - protein, 11 aa, Artificial Sequence
  Ethanolamine-phosphate phospho-lyase (355-365)
TLIGDIRGIGL

SEQ ID NO: 22968 - protein, 9 aa, Artificial Sequence
  COP9 signalosome complex subunit 7a (29-37)
TLIHQVLEA

SEQ ID NO: 22969 - protein, 9 aa, Artificial Sequence
  Translocating chain-associated membrane protein 1 (264-272)
TLILSVLTV

SEQ ID NO: 22970 - protein, 9 aa, Artificial Sequence
  Essential MCU regulator, mitochondrial (82-90)
TLISKNFAA

SEQ ID NO: 22971 - protein, 14 aa, Artificial Sequence
  Ryanodine receptor 1 (3790-3803)
TLKLGISILNGGNA

SEQ ID NO: 22972 - protein, 10 aa, Artificial Sequence
  General transcription factor IIH subunit 3 (90-99)
TLLAGSLAKA

SEQ ID NO: 22973 - protein, 12 aa, Artificial Sequence
  ETS translocation variant 5 (376-387)
TLLDDPANAHFI

SEQ ID NO: 22974 - protein, 9 aa, Artificial Sequence
  Protein kinase C delta-binding protein (27-35)
TLLEKLASM

SEQ ID NO: 22975 - protein, 9 aa, Artificial Sequence
  Spermatogenesis-associated protein 20 (211-219)
TLLENSQRV

SEQ ID NO: 22976 - protein, 9 aa, Artificial Sequence
  E3 ubiquitin-protein ligase HERC2 (204-212)
TLLESIQHV

SEQ ID NO: 22977 - protein, 9 aa, Artificial Sequence
  Putative WAS protein family homolog 3 (362-370)
TLLESIRQA

SEQ ID NO: 22978 - protein, 9 aa, Artificial Sequence
  WD repeat-containing protein 26 (56-64)
TLLGIIVRM

SEQ ID NO: 22979 - protein, 26 aa, Artificial Sequence
  Vimentin (275-300)
TLLIKTVETRDGQVINETSQHHDDLE

SEQ ID NO: 22980 - protein, 9 aa, Artificial Sequence
  Maltase-glucoamylase (871-879)
TLLPYLYTL

SEQ ID NO: 22981 - protein, 9 aa, Artificial Sequence
  Vacuolar protein-sorting-associated protein 25 (148-156)
TLLRALQAL

SEQ ID NO: 22982 - protein, 9 aa, Artificial Sequence
  Histone acetyltransferase KAT2B (310-318)
TLLRSVFTV

SEQ ID NO: 22983 - protein, 11 aa, Artificial Sequence
  Importin-7 (679-689)
TLLSDTKYLEM

SEQ ID NO: 22984 - protein, 9 aa, Artificial Sequence
  Integrator complex subunit 2 (1086-1094)
TLLTVLTQA

SEQ ID NO: 22985 - protein, 11 aa, Artificial Sequence
  Rho GTPase-activating protein 7 (136-146)
TLMDLSERQEV

SEQ ID NO: 22986 - protein, 7 aa, Artificial Sequence
  Glutamine-fructose-6-phosphate aminotransferase (isomerizing) 1 (429-435)
TLMGLRY

SEQ ID NO: 22987 - protein, 9 aa, Artificial Sequence
  Ubiquitin conjugation factor E4 B (1239-1247)
TLMTDPVRL

SEQ ID NO: 22988 - protein, 9 aa, Artificial Sequence
  Nuclear factor related to kappa-B-binding protein (308-316)
TLNDIMTRV

SEQ ID NO: 22989 - protein, 9 aa, Artificial Sequence
  EMILIN-1 (236-244)
TLNEIQHQL

SEQ ID NO: 22990 - protein, 9 aa, Artificial Sequence
  Kelch-like protein 21 (467-475)
TLNGLMYFV

SEQ ID NO: 22991 - protein, 11 aa, Artificial Sequence
  Nuclear pore complex protein Nup214 (188-198)
TLPSTVAVTSV

SEQ ID NO: 22992 - protein, 9 aa, Artificial Sequence
  Nuclear mitotic apparatus protein 1 (151-159)
TLQEALAHA

SEQ ID NO: 22993 - protein, 9 aa, Artificial Sequence
  DENN domain-containing protein 5A (930-938)
TLQEFNITL

SEQ ID NO: 22994 - protein, 9 aa, Artificial Sequence
  Uveal autoantigen with coiled-coil domains and ankyrin repeats (714-722)
TLQKEIEKV

SEQ ID NO: 22995 - protein, 9 aa, Artificial Sequence
  Glycogen phosphorylase, liver form (95-103)
TLQNTMINL

SEQ ID NO: 22996 - protein, 10 aa, Artificial Sequence
  Hemicentin-1 (4435-4444)
TLQSPPIITL

SEQ ID NO: 22997 - protein, 9 aa, Artificial Sequence
  Interleukin-6 receptor subunit beta (3-11)
TLQTWLVQA

SEQ ID NO: 22998 - protein, 9 aa, Artificial Sequence
  Alpha-actinin-4 (226-234)
TLSDIKALI

SEQ ID NO: 22999 - protein, 9 aa, Artificial Sequence
  Nucleolar pre-ribosomal-associated protein 1 (546-554)
TLSEDMILL

SEQ ID NO: 23000 - protein, 9 aa, Artificial Sequence
  Serine/threonine-protein kinase ULK2 (102-110)
TLSEDTIRV

SEQ ID NO: 23001 - protein, 9 aa, Artificial Sequence
  Alpha-actinin-1 (426-434)
TLSEIKALL

SEQ ID NO: 23002 - protein, 11 aa, Artificial Sequence
  Ribosomal protein S6 kinase beta-1 (376-386)
TLSESANQVFL

SEQ ID NO: 23003 - protein, 11 aa, Artificial Sequence
  TRPM8 channel-associated factor 1 (309-319)
TLSGLLAVGGI

SEQ ID NO: 23004 - protein, 9 aa, Artificial Sequence
  RRP12-like protein (274-282)
TLSHVLVTA

SEQ ID NO: 23005 - protein, 9 aa, Artificial Sequence
  CLIP-associating protein 1 (164-172)
TLSKIVPHI

SEQ ID NO: 23006 - protein, 10 aa, Artificial Sequence
  Biorientation of chromosomes in cell division protein 1-like 1 (282-291)
TLSPVKAGPA

SEQ ID NO: 23007 - protein, 14 aa, Artificial Sequence
  Beta-2-microglobulin (85-98)
TLSQPKIVKWDRDM

SEQ ID NO: 23008 - protein, 9 aa, Artificial Sequence
  Laminin subunit gamma-1 (1109-1117)
TLSSQISRL

SEQ ID NO: 23009 - protein, 27 aa, Artificial Sequence
  Heat shock cognate 71 kDa protein (273-299)
TLSSSTQASIEIDSLYEGIDFYTSITR

SEQ ID NO: 23010 - protein, 27 aa, Artificial Sequence
  Heat shock 70 kDa protein 1B (273-299)
TLSSSTQASLEIDSLFEGIDFYTSITR

SEQ ID NO: 23011 - protein, 9 aa, Artificial Sequence
  MAX gene-associated protein (1410-1418)
TLSTVISKV

SEQ ID NO: 23012 - protein, 11 aa, Artificial Sequence
  Semaphorin-4C (57-67)
TLTEPTGLLYV

SEQ ID NO: 23013 - protein, 9 aa, Artificial Sequence
  Ras GTPase-activating protein 3 (509-517)
TLTLISKTV

SEQ ID NO: 23014 - protein, 10 aa, Artificial Sequence
  26S proteasome non-ATPase regulatory subunit 12 (319-328)
TLVEDYGMEL

SEQ ID NO: 23015 - protein, 9 aa, Artificial Sequence
  Aggrecan core protein (1921-1929)
TLVESVTQA

SEQ ID NO: 23016 - protein, 9 aa, Artificial Sequence
  WD repeat-containing protein 5B (36-44)
TLVGHTEAV

SEQ ID NO: 23017 - protein, 9 aa, Artificial Sequence
  Transcription factor SOX-9 (87-95)
TLVPMPVRV

SEQ ID NO: 23018 - protein, 9 aa, Artificial Sequence
  Eukaryotic translation initiation factor 4 gamma 1 (1438-1446)
TLVRALMTA

SEQ ID NO: 23019 - protein, 9 aa, Artificial Sequence
  Cyclin-dependent kinase 3 (165-173)
TLWYRAPEI

SEQ ID NO: 23020 - protein, 9 aa, Artificial Sequence
  Cyclin-dependent kinase 11B (347-355)
TLWYRAPEL

SEQ ID NO: 23021 - protein, 9 aa, Artificial Sequence
  Cyclin-dependent kinase 4 (103-111)
TLWYRAPEV

SEQ ID NO: 23022 - protein, 11 aa, Artificial Sequence
  Cyclin-dependent kinase 4 (103-113)
TLWYRAPEVLL

SEQ ID NO: 23023 - protein, 9 aa, Artificial Sequence
  Cyclin-dependent kinase 9 (191-199)
TLWYRPPEL

SEQ ID NO: 23024 - protein, 9 aa, Artificial Sequence
  Bifunctional lysine-specific demethylase and histidyl-hydroxylase NO66 (625-633)
TLYDKGLLL

SEQ ID NO: 23025 - protein, 9 aa, Artificial Sequence
  Ubiquitin-conjugating enzyme E2 G1 (48-56)
TLYEGGVFK

SEQ ID NO: 23026 - protein, 9 aa, Artificial Sequence
  Vacuolar protein sorting-associated protein 13B (1255-1263)
TMAGPVPTS

SEQ ID NO: 23027 - protein, 8 aa, Artificial Sequence
  Insulin receptor substrate 2 (544-551)
TMDRPLSH

SEQ ID NO: 23028 - protein, 9 aa, Artificial Sequence
  Polyadenylate-binding protein 1 (489-497)
TMGPRPAAA

SEQ ID NO: 23029 - protein, 10 aa, Artificial Sequence
  ER membrane protein complex subunit 1 (975-984)
TMITKRLAQV

SEQ ID NO: 23030 - protein, 8 aa, Artificial Sequence
  Chondroitin sulfate proteoglycan 4 (21-28)
TMLARLAS

SEQ ID NO: 23031 - protein, 9 aa, Artificial Sequence
  Protein wntless homolog (257-265)
TMMSRPPVL

SEQ ID NO: 23032 - protein, 16 aa, Artificial Sequence
  Cytoplasmic polyadenylation element-binding protein 2 (92-107)
TMQDELLLGLTQQPAR

SEQ ID NO: 23033 - protein, 9 aa, Artificial Sequence
  Gamma-aminobutyric acid receptor subunit beta-2 (6-14)
TMTTINTHL

SEQ ID NO: 23034 - protein, 9 aa, Artificial Sequence
  Eukaryotic translation initiation factor 4 gamma 1 (249-257)
TMTTIQMSV

SEQ ID NO: 23035 - protein, 7 aa, Artificial Sequence
  Cyclin-dependent kinase 13 (257-263)
TNKVITL

SEQ ID NO: 23036 - protein, 11 aa, Artificial Sequence
  Ankyrin-3 (871-881)
TNVSARFWLAD

SEQ ID NO: 23037 - protein, 9 aa, Artificial Sequence
  Guanine nucleotide exchange factor for Rab-3A (97-105)
TPASPNREL

SEQ ID NO: 23038 - protein, 13 aa, Artificial Sequence
  Sterol regulatory element-binding protein 1 (959-971)
TPASSSIDKAVQL

SEQ ID NO: 23039 - protein, 16 aa, Artificial Sequence
  Clathrin heavy chain 1 (394-409)
TPDTIRRFQSVPAQPG

SEQ ID NO: 23040 - protein, 7 aa, Artificial Sequence
  TRAF2 and NCK-interacting protein kinase (190-196)
TPEIRKY

SEQ ID NO: 23041 - protein, 8 aa, Artificial Sequence
  Importin-7 (508-515)
TPFIRPVM

SEQ ID NO: 23042 - protein, 9 aa, Artificial Sequence
  (Pyruvate dehydrogenase (acetyl-transferring))-phosphatase 1, mitochondrial (83-91)
TPHPAYATF

SEQ ID NO: 23043 - protein, 13 aa, Artificial Sequence
  Zinc finger protein 354B (90-102)
TPKMTKSTQTQDS

SEQ ID NO: 23044 - protein, 8 aa, Artificial Sequence
  ATP-dependent RNA helicase DDX51 (308-315)
TPLRVSLV

SEQ ID NO: 23045 - protein, 10 aa, Artificial Sequence
  Homeobox protein TGIF1 (249-258)
TPPPTPPDLN

SEQ ID NO: 23046 - protein, 21 aa, Artificial Sequence
  Annexin A2 (19-39)
TPPSAYGSVKAYTNFDAERDA

SEQ ID NO: 23047 - protein, 11 aa, Artificial Sequence
  Nodal modulator 1 (365-375)
TPQLADIIATG

SEQ ID NO: 23048 - protein, 9 aa, Artificial Sequence
  Glycogen phosphorylase, brain form (48-56)
TPRDYFFAL

SEQ ID NO: 23049 - protein, 9 aa, Artificial Sequence
  Sialidase-1 (85-93)
TPRGTLLAF

SEQ ID NO: 23050 - protein, 9 aa, Artificial Sequence
  DNA-directed RNA polymerase III subunit RPC1 (167-175)
TPRNGEPLI

SEQ ID NO: 23051 - protein, 9 aa, Artificial Sequence
  E3 ubiquitin-protein ligase RNF169 (410-418)
TPRNLNRSL

SEQ ID NO: 23052 - protein, 9 aa, Artificial Sequence
  Galactose-3-O-sulfotransferase 4 (2-10)
TPRSPTSAF

SEQ ID NO: 23053 - protein, 10 aa, Artificial Sequence
  Rho GTPase-activating protein 7 (170-179)
TPRTNSVISV

SEQ ID NO: 23054 - protein, 29 aa, Artificial Sequence
  Beta-2-microglobulin (70-98)
TPTEKDEYACRVNHVTLSQPKIVKWDRDM

SEQ ID NO: 23055 - protein, 21 aa, Artificial Sequence
  HLA class I histocompatibility antigen, A-1 alpha chain (320-340)
TQAASSDSAQGSDVSLTACKV

SEQ ID NO: 23056 - protein, 11 aa, Artificial Sequence
  NADH dehydrogenase (ubiquinone) iron-sulfur protein 2, mitochondrial (453-463)
TQDIVFGEVDR

SEQ ID NO: 23057 - protein, 10 aa, Artificial Sequence
  Myosin-IIIa (288-297)
TQIEGKDVML

SEQ ID NO: 23058 - protein, 14 aa, Artificial Sequence
  Basement membrane-specific heparan sulfate proteoglycan core protein (2340-2353)
TQPIRIEPSSSQVA

SEQ ID NO: 23059 - protein, 15 aa, Artificial Sequence
  Basement membrane-specific heparan sulfate proteoglycan core protein (2340-2354)
TQPIRIEPSSSQVAE

SEQ ID NO: 23060 - protein, 11 aa, Artificial Sequence
  Regulator of nonsense transcripts 1 (44-54)
TQTPPGGPGGP

SEQ ID NO: 23061 - protein, 9 aa, Artificial Sequence
  Cytoplasmic FMR1-interacting protein 1 (680-688)
TRFNKQFLY

SEQ ID NO: 23062 - protein, 10 aa, Artificial Sequence
  Alpha-1-syntrophin (178-187)
TRHGVDTHLF

SEQ ID NO: 23063 - protein, 10 aa, Artificial Sequence
  Peroxisomal membrane protein PMP34 (90-99)
TRLKLQGAKF

SEQ ID NO: 23064 - protein, 9 aa, Artificial Sequence
  Maltase-glucoamylase (1080-1088)
TRLPSQYIY

SEQ ID NO: 23065 - protein, 9 aa, Artificial Sequence
  Protein disulfide-isomerase A5 (45-53)
TRNNVLVLY

SEQ ID NO: 23066 - protein, 10 aa, Artificial Sequence
  HLA class I histocompatibility antigen, Cw-7 alpha chain (257-266)
TRPAGDGTFQ

SEQ ID NO: 23067 - protein, 10 aa, Artificial Sequence
  L-dopachrome tautomerase (68-77)
TRPWSGPYIL

SEQ ID NO: 23068 - protein, 9 aa, Artificial Sequence
  Glycerol-3-phosphate acyltransferase 3 (128-136)
TRTNVNFQY

SEQ ID NO: 23069 - protein, 9 aa, Artificial Sequence
  Multiple PDZ domain protein (66-74)
TSATSNIEY

SEQ ID NO: 23070 - protein, 10 aa, Artificial Sequence
  Protein prune homolog 2 (1091-1100)
TSDGMNFTKY

SEQ ID NO: 23071 - protein, 9 aa, Artificial Sequence
  Bifunctional glutamate/proline-tRNA ligase (269-277)
TSDHFETIM

SEQ ID NO: 23072 - protein, 9 aa, Artificial Sequence
  ATP-dependent RNA helicase DDX50 (268-276)
TSDKGFVTM

SEQ ID NO: 23073 - protein, 8 aa, Artificial Sequence
  Ubinuclein-2 (527-534)
TSDKPLMY

SEQ ID NO: 23074 - protein, 10 aa, Artificial Sequence
  Beta-1-syntrophin (132-141)
TSDPPSSQSF

SEQ ID NO: 23075 - protein, 8 aa, Artificial Sequence
  Polymerase delta-interacting protein 3 (356-363)
TSDQPILL

SEQ ID NO: 23076 - protein, 9 aa, Artificial Sequence
  HEAT repeat-containing protein 5A (1033-1041)
TSENAKLHY

SEQ ID NO: 23077 - protein, 10 aa, Artificial Sequence
  HEAT repeat-containing protein 5A (1033-1042)
TSENAKLHYY

SEQ ID NO: 23078 - protein, 8 aa, Artificial Sequence
  Nuclear pore complex protein Nup205 (1076-1083)
TSGPTMRY

SEQ ID NO: 23079 - protein, 10 aa, Artificial Sequence
  GREB1-like protein (1129-1138)
TSGSIMENGV

SEQ ID NO: 23080 - protein, 9 aa, Artificial Sequence
  E3 ubiquitin-protein ligase UBR4 (516-524)
TSIQRIQRL

SEQ ID NO: 23081 - protein, 9 aa, Artificial Sequence
  Dolichyl-diphosphooligosaccharide-proteinosyltransferase subunit 1 (228-236)
TSMTRVIEV

SEQ ID NO: 23082 - protein, 13 aa, Artificial Sequence
  Treacle protein (596-608)
TSPAGSSPAVAGG

SEQ ID NO: 23083 - protein, 8 aa, Artificial Sequence
  Chromodomain Y-like protein (94-101)
TSPKALVI

SEQ ID NO: 23084 - protein, 9 aa, Artificial Sequence
  Mitogen-activated protein kinase kinase kinase 14 (448-456)
TSPRIVPLY

SEQ ID NO: 23085 - protein, 9 aa, Artificial Sequence
  Interferon alpha-inducible protein 27, mitochondrial (12-20)
TSVAKVVRV

SEQ ID NO: 23086 - protein, 11 aa, Artificial Sequence
  RNA binding protein fox-1 homolog 2 (243-253)
TTAAAFRGAHL

SEQ ID NO: 23087 - protein, 10 aa, Artificial Sequence
  Transcriptional regulator ATRX (461-470)
TTAKVTKELY

SEQ ID NO: 23088 - protein, 16 aa, Artificial Sequence
  ATP-citrate synthase (677-692)
TTDGVYEGVAIGGDRY

SEQ ID NO: 23089 - protein, 9 aa, Artificial Sequence
  Hemicentin-1 (97-105)
TTDPKKFQY

SEQ ID NO: 23090 - protein, 7 aa, Artificial Sequence
  Elongation factor 1-alpha 1 (23-29)
TTGHLIY

SEQ ID NO: 23091 - protein, 9 aa, Artificial Sequence
  Signal-induced proliferation-associated 1-like protein 3 (1102-1110)
TTPGHAQSL

SEQ ID NO: 23092 - protein, 9 aa, Artificial Sequence
  Disabled homolog 2-interacting protein (945-953)
TTQKLVLEY

SEQ ID NO: 23093 - protein, 9 aa, Artificial Sequence
  Basement membrane-specific heparan sulfate proteoglycan core protein (3563-3571)
TTQSHVLLL

SEQ ID NO: 23094 - protein, 9 aa, Artificial Sequence
  Importin-4 (577-585)
TVAEKSFAV

SEQ ID NO: 23095 - protein, 9 aa, Artificial Sequence
  Nicotinamide phosphoribosyltransferase (220-228)
TVAGLALIK

SEQ ID NO: 23096 - protein, 9 aa, Artificial Sequence
  Keratin, type I cytoskeletal 18 (86-94)
TVDNARIVL

SEQ ID NO: 23097 - protein, 8 aa, Artificial Sequence
  Signal-induced proliferation-associated 1-like protein 2 (821-828)
TVDTSVKF

SEQ ID NO: 23098 - protein, 21 aa, Artificial Sequence
  Vimentin (446-466)
TVETRDGQVINETSQHHDDLE

SEQ ID NO: 23099 - protein, 9 aa, Artificial Sequence
  Runt-related transcription factor 1 (36-44)
TVFTNPPQV

SEQ ID NO: 23100 - protein, 9 aa, Artificial Sequence
  Proto-oncogene tyrosine-protein kinase receptor Ret (350-358)
TVHDYRLVL

SEQ ID NO: 23101 - protein, 16 aa, Artificial Sequence
  Endoplasmin (688-703)
TVLDLAVVLFETATLR

SEQ ID NO: 23102 - protein, 9 aa, Artificial Sequence
  Transmembrane protein 9 (177-185)
TVLERVEGA

SEQ ID NO: 23103 - protein, 10 aa, Artificial Sequence
  Cytoskeleton-associated protein 5 (947-956)
TVLGDSKNNV

SEQ ID NO: 23104 - protein, 10 aa, Artificial Sequence
  DNA annealing helicase and endonuclease ZRANB3 (73-82)
TVLGYGLLTA

SEQ ID NO: 23105 - protein, 9 aa, Artificial Sequence
  HEAT repeat-containing protein 1 (1553-1561)
TVLGYISAV

SEQ ID NO: 23106 - protein, 15 aa, Artificial Sequence
  Actin, cytoplasmic 2 (36-50)
TVLSGGTTMYPGIAD

SEQ ID NO: 23107 - protein, 9 aa, Artificial Sequence
  Neuron navigator 2 (1903-1911)
TVMQLRNEL

SEQ ID NO: 23108 - protein, 9 aa, Artificial Sequence
  Ryanodine receptor 2 (3867-3875)
TVNIIISTV

SEQ ID NO: 23109 - protein, 30 aa, Artificial Sequence
  Fructose-bisphosphate aldolase A (314-343)
TVPPAVTGITFLSGGQSEEEASINLNAINK

SEQ ID NO: 23110 - protein, 9 aa, Artificial Sequence
  Mucin-16 (11203-11211)
TVQGLVTSL

SEQ ID NO: 23111 - protein, 28 aa, Artificial Sequence
  Nucleophosmin (46-73)
TVSLGAGAKDELHIVEAEAMNYEGSPIK

SEQ ID NO: 23112 - protein, 11 aa, Artificial Sequence
  Complement C4-A (408-418)
TVSSPGSVPEV

SEQ ID NO: 23113 - protein, 9 aa, Artificial Sequence
  Exportin-6 (585-593)
TVVERLVKV

SEQ ID NO: 23114 - protein, 11 aa, Artificial Sequence
  U4/U6 small nuclear ribonucleoprotein Prp3 (29-39)
TVVTAALNCVG

SEQ ID NO: 23115 - protein, 10 aa, Artificial Sequence
  Multidrug resistance-associated protein 7 (941-950)
TVYATIAGVN

SEQ ID NO: 23116 - protein, 10 aa, Artificial Sequence
  MMS19 nucleotide excision repair protein homolog (150-159)
TVYNIITNFM

SEQ ID NO: 23117 - protein, 9 aa, Artificial Sequence
  RNA-binding protein 26 (673-681)
TVYNPAALK

SEQ ID NO: 23118 - protein, 14 aa, Artificial Sequence
  Protein SZT2 (605-618)
TWGLPHAPPSPGPL

SEQ ID NO: 23119 - protein, 10 aa, Artificial Sequence
  Tyrosine-protein phosphatase non-receptor type substrate 1 (472-481)
TYADLDMVHL

SEQ ID NO: 23120 - protein, 11 aa, Artificial Sequence
  Serine/threonine-protein kinase SMG1 (743-753)
TYAPLFSLPSF

SEQ ID NO: 23121 - protein, 9 aa, Artificial Sequence
  Muskelin (680-688)
TYAQRTQLF

SEQ ID NO: 23122 - protein, 8 aa, Artificial Sequence
  Low-density lipoprotein receptor-related protein 2 (585-592)
TYDGIQRK

SEQ ID NO: 23123 - protein, 9 aa, Artificial Sequence
  Diamine acetyltransferase 1 (80-88)
TYDPWIGKL

SEQ ID NO: 23124 - protein, 8 aa, Artificial Sequence
  L-dopachrome tautomerase (302-309)
TYEGLLRR

SEQ ID NO: 23125 - protein, 9 aa, Artificial Sequence
  GPI-anchor transamidase (386-394)
TYGIKHMKF

SEQ ID NO: 23126 - protein, 9 aa, Artificial Sequence
  Ral GTPase-activating protein subunit beta (252-260)
TYGPSFPAF

SEQ ID NO: 23127 - protein, 9 aa, Artificial Sequence
  Talin-1 (307-315)
TYGVSFFLV

SEQ ID NO: 23128 - protein, 8 aa, Artificial Sequence
  Parafibromin (314-321)
TYHGMTLK

SEQ ID NO: 23129 - protein, 9 aa, Artificial Sequence
  Down syndrome critical region protein 3 (108-116)
TYHGVFVNI

SEQ ID NO: 23130 - protein, 9 aa, Artificial Sequence
  AP-2 complex subunit alpha-1 (544-552)
TYIKFINLF

SEQ ID NO: 23131 - protein, 10 aa, Artificial Sequence
  Transmembrane protein 231 (34-43)
TYIPPLLVAF

SEQ ID NO: 23132 - protein, 9 aa, Artificial Sequence
  Phosphatidylinositol 4-phosphate 3-kinase C2 domain-containing subunit alpha (731-739)
TYKNFFYLI

SEQ ID NO: 23133 - protein, 9 aa, Artificial Sequence
  Serine-protein kinase ATM (2359-2367)
TYLEKAVEV

SEQ ID NO: 23134 - protein, 9 aa, Artificial Sequence
  T-complex protein 1 subunit theta (427-435)
TYLGKYWAI

SEQ ID NO: 23135 - protein, 9 aa, Artificial Sequence
  G1/S-specific cyclin-E1 (111-119)
TYLRDQHFL

SEQ ID NO: 23136 - protein, 9 aa, Artificial Sequence
  Digestive organ expansion factor homolog (692-700)
TYPHFYSEI

SEQ ID NO: 23137 - protein, 9 aa, Artificial Sequence
  Sorbin and SH3 domain-containing protein 2 (215-223)
TYPQHAQSL

SEQ ID NO: 23138 - protein, 9 aa, Artificial Sequence
  Exportin-T (46-54)
TYSDDHVKF

SEQ ID NO: 23139 - protein, 9 aa, Artificial Sequence
  Nuclear receptor subfamily 2 group C member 2 (532-540)
TYSEDTYRL

SEQ ID NO: 23140 - protein, 9 aa, Artificial Sequence
  SRSF protein kinase 2 (426-434)
TYSSSYEQF

SEQ ID NO: 23141 - protein, 9 aa, Artificial Sequence
  Cartilage acidic protein 1 (144-152)
TYTDKLFKF

SEQ ID NO: 23142 - protein, 9 aa, Artificial Sequence
  Cation-independent mannose-6-phosphate receptor (884-892)
TYTTRIHLV

SEQ ID NO: 23143 - protein, 9 aa, Artificial Sequence
  Cathepsin D (130-138)
TYVKNGTSF

SEQ ID NO: 23144 - protein, 12 aa, Artificial Sequence
  Protein YIF1B (149-160)
TYVLVAGLALGT

SEQ ID NO: 23145 - protein, 9 aa, Artificial Sequence
  Histone-binding protein RBBP4 (186-194)
VADDQKLMI

SEQ ID NO: 23146 - protein, 9 aa, Artificial Sequence
  E3 ubiquitin-protein ligase TRIM56 (523-531)
VADEQNRAL

SEQ ID NO: 23147 - protein, 8 aa, Artificial Sequence
  Coatomer subunit gamma-1 (760-767)
VADHIQKV

SEQ ID NO: 23148 - protein, 9 aa, Artificial Sequence
  HMG domain-containing protein 4 (317-325)
VADHPGIDF

SEQ ID NO: 23149 - protein, 8 aa, Artificial Sequence
  Laminin subunit gamma-1 (1042-1049)
VADHRVKL

SEQ ID NO: 23150 - protein, 10 aa, Artificial Sequence
  Catenin beta-1 (79-88)
VADIDGQYAM

SEQ ID NO: 23151 - protein, 8 aa, Artificial Sequence
  Dual specificity protein phosphatase 14 (93-100)
VADKIHSV

SEQ ID NO: 23152 - protein, 9 aa, Artificial Sequence
  Translin-associated protein X (191-199)
VADLTGELM

SEQ ID NO: 23153 - protein, 9 aa, Artificial Sequence
  Neutral alpha-glucosidase AB (23-31)
VADPPIARL

SEQ ID NO: 23154 - protein, 9 aa, Artificial Sequence
  Polypeptide N-acetylgalactosaminyltransferase 2 (241-249)
VAEDRTRVV

SEQ ID NO: 23155 - protein, 9 aa, Artificial Sequence
  Protein PRR14L (111-119)
VAESAVSKL

SEQ ID NO: 23156 - protein, 9 aa, Artificial Sequence
  UPF0415 protein C7orf25 (292-300)
VAFPTEIKV

SEQ ID NO: 23157 - protein, 10 aa, Artificial Sequence
  Cytoskeleton-associated protein 5 (883-892)
VAGIINDAKF

SEQ ID NO: 23158 - protein, 11 aa, Artificial Sequence
  HLA class I histocompatibility antigen, alpha chain F (305-315)
VAGLVVLGAVV

SEQ ID NO: 23159 - protein, 8 aa, Artificial Sequence
  Phosphofurin acidic cluster sorting protein 1 (109-116)
VAGRVMQY

SEQ ID NO: 23160 - protein, 13 aa, Artificial Sequence
  CLIP-associating protein 2 (347-359)
VAGRVSAGSSKAS

SEQ ID NO: 23161 - protein, 10 aa, Artificial Sequence
  CAD protein (1548-1557)
VAGSAAGLKL

SEQ ID NO: 23162 - protein, 9 aa, Artificial Sequence
  CLOCK-interacting pacemaker (251-259)
VAKAPSLTF

SEQ ID NO: 23163 - protein, 15 aa, Artificial Sequence
  Glucose-6-phosphate isomerase (250-264)
VAKHFVALSTNTTKV

SEQ ID NO: 23164 - protein, 16 aa, Artificial Sequence
  Glucose-6-phosphate isomerase (250-265)
VAKHFVALSTNTTKVK

SEQ ID NO: 23165 - protein, 9 aa, Artificial Sequence
  Proline and serine-rich protein 1 (85-93)
VALELLASN

SEQ ID NO: 23166 - protein, 11 aa, Artificial Sequence
  Phosphatidylcholine translocator ABCB4 (985-995)
VALGHASSFAP

SEQ ID NO: 23167 - protein, 10 aa, Artificial Sequence
  ATP-binding cassette sub-family A member 13 (1236-1245)
VALGNALVSV

SEQ ID NO: 23168 - protein, 9 aa, Artificial Sequence
  Neural cell adhesion molecule L1 (3-11)
VALRYVWPL

SEQ ID NO: 23169 - protein, 8 aa, Artificial Sequence
  Constitutive coactivator of PPAR-gamma-like protein 1 (551-558)
VAPEVLRV

SEQ ID NO: 23170 - protein, 9 aa, Artificial Sequence
  Glutamate receptor ionotropic, kainate 3 (516-524)
VAPLTITHV

SEQ ID NO: 23171 - protein, 9 aa, Artificial Sequence
  Transcription factor p65 (404-412)
VAPPAPKPT

SEQ ID NO: 23172 - protein, 11 aa, Artificial Sequence
  Protein NLRC3 (955-965)
VASIGASGAQV

SEQ ID NO: 23173 - protein, 8 aa, Artificial Sequence
  Endothelin B receptor (292-299)
VASWSRIK

SEQ ID NO: 23174 - protein, 9 aa, Artificial Sequence
  Zinc finger MYM-type protein 4 (1069-1077)
VAVEPRSLI

SEQ ID NO: 23175 - protein, 9 aa, Artificial Sequence
  Transient receptor potential cation channel subfamily V member 2 (408-416)
VAYHQPTLK

SEQ ID NO: 23176 - protein, 50 aa, Artificial Sequence
  ATP synthase subunit epsilon, mitochondrial (2-51)
VAYWRQAGLSYIRYSQICAKAVRDALKTEFKANAEKTSGSNVKIVKVKKE

SEQ ID NO: 23177 - protein, 22 aa, Artificial Sequence
  Pyridoxal kinase (153-174)
VDAVFVGTGDLFAAMLLAWTHK

SEQ ID NO: 23178 - protein, 10 aa, Artificial Sequence
  Titin (5174-5183)
VDDLIALGGQ

SEQ ID NO: 23179 - protein, 18 aa, Artificial Sequence
  HLA class I histocompatibility antigen, B-51 alpha chain (27-44)
VDDTQFVRFDSDAASPRT

SEQ ID NO: 23180 - protein, 20 aa, Artificial Sequence
  HLA class I histocompatibility antigen, B-51 alpha chain (27-46)
VDDTQFVRFDSDAASPRTEP

SEQ ID NO: 23181 - protein, 22 aa, Artificial Sequence
  Transducin-like enhancer protein 2 (117-138)
VDEDQPSEPPSPATTPCGKVPI

SEQ ID NO: 23182 - protein, 15 aa, Artificial Sequence
  Annexin A2 (51-65)
VDEVTIVNILTNRSN

SEQ ID NO: 23183 - protein, 17 aa, Artificial Sequence
  Annexin A2 (51-67)
VDEVTIVNILTNRSNAQ

SEQ ID NO: 23184 - protein, 12 aa, Artificial Sequence
  Glyceraldehyde-3-phosphate dehydrogenase (28-39)
VDIVAINDPFID

SEQ ID NO: 23185 - protein, 9 aa, Artificial Sequence
  Eukaryotic translation initiation factor 2A (267-275)
VDKTGASYY

SEQ ID NO: 23186 - protein, 8 aa, Artificial Sequence
  40S ribosomal protein S21 (39-46)
VDKVTGRF

SEQ ID NO: 23187 - protein, 20 aa, Artificial Sequence
  Collagen alpha-4(IV) chain (1284-1303)
VDLLRGEPGDCGLPGPPGPP

SEQ ID NO: 23188 - protein, 11 aa, Artificial Sequence
  Immunoglobulin superfamily DCC subclass member 4 (828-838)
VDMDGPFGSVV

SEQ ID NO: 23189 - protein, 15 aa, Artificial Sequence
  Multidrug resistance-associated protein 6 (610-624)
VDPGVVDSSSSGSAA

SEQ ID NO: 23190 - protein, 8 aa, Artificial Sequence
  Histone deacetylase 9 (79-86)
VDPVVREK

SEQ ID NO: 23191 - protein, 17 aa, Artificial Sequence
  Neuron navigator 1 (1420-1436)
VDSLVFETLIPKPMMQH

SEQ ID NO: 23192 - protein, 8 aa, Artificial Sequence
  Microtubule-actin cross-linking factor 1, isoforms 1/2/3/5 (329-336)
VDSRWQEY

SEQ ID NO: 23193 - protein, 20 aa, Artificial Sequence
  Beta-secretase 2 (109-128)
VDTGSSNFAVAGTPHSYIDT

SEQ ID NO: 23194 - protein, 11 aa, Artificial Sequence
  Probable C-mannosyltransferase DPY19L1 (75-85)
VEAPSFLNGVW

SEQ ID NO: 23195 - protein, 12 aa, Artificial Sequence
  Dynein heavy chain 17, axonemal (1541-1552)
VEATSKPGLYNK

SEQ ID NO: 23196 - protein, 9 aa, Artificial Sequence
  Putative RNA-binding protein 15 (166-174)
VEDGLFHEF

SEQ ID NO: 23197 - protein, 9 aa, Artificial Sequence
  Protein phosphatase 1 regulatory subunit 12B (100-108)
VEEDSNRDY

SEQ ID NO: 23198 - protein, 10 aa, Artificial Sequence
  Protrudin (99-108)
VEFFRVVSEY

SEQ ID NO: 23199 - protein, 10 aa, Artificial Sequence
  Glycogen phosphorylase, brain form (207-216)
VEHTPDGVKW

SEQ ID NO: 23200 - protein, 7 aa, Artificial Sequence
  CDK5 regulatory subunit-associated protein 1 (383-389)
VELVHHI

SEQ ID NO: 23201 - protein, 9 aa, Artificial Sequence
  Chondroitin sulfate glucuronyltransferase (720-728)
VEPGLVQKF

SEQ ID NO: 23202 - protein, 13 aa, Artificial Sequence
  Beta-hexosaminidase subunit alpha (437-449)
VEPLAFEGTPEQK

SEQ ID NO: 23203 - protein, 14 aa, Artificial Sequence
  40S ribosomal protein S18 (64-77)
VERVITIMQNPRQY

SEQ ID NO: 23204 - protein, 15 aa, Artificial Sequence
  40S ribosomal protein S18 (64-78)
VERVITIMQNPRQYK

SEQ ID NO: 23205 - protein, 9 aa, Artificial Sequence
  Myoferlin (1325-1333)
VESVVIKNL

SEQ ID NO: 23206 - protein, 20 aa, Artificial Sequence
  Vimentin (447-466)
VETRDGQVINETSQHHDDLE

SEQ ID NO: 23207 - protein, 16 aa, Artificial Sequence
  HLA class I histocompatibility antigen, Cw-7 alpha chain (255-270)
VETRPAGDGTFQKWAA

SEQ ID NO: 23208 - protein, 9 aa, Artificial Sequence
  Integrin beta-5 (441-449)
VFALRPVGF

SEQ ID NO: 23209 - protein, 9 aa, Artificial Sequence
  Ribosomal protein S6 kinase alpha-5 (487-495)
VFHDQLHTF

SEQ ID NO: 23210 - protein, 9 aa, Artificial Sequence
  Nuclear factor erythroid 2-related factor 3 (266-274)
VFHNHTYHL

SEQ ID NO: 23211 - protein, 9 aa, Artificial Sequence
  Integrin alpha-7 (708-716)
VFIELPLSI

SEQ ID NO: 23212 - protein, 9 aa, Artificial Sequence
  Leucine-rich repeat serine/threonine-protein kinase 2 (619-627)
VFIGTGHLL

SEQ ID NO: 23213 - protein, 10 aa, Artificial Sequence
  Putative pre-mRNA-splicing factor ATP-dependent RNA helicase DHX16 (968-977)
VFIHPNSSLF

SEQ ID NO: 23214 - protein, 9 aa, Artificial Sequence
  E3 ubiquitin-protein ligase RNF213 (400-408)
VFIRGGEEF

SEQ ID NO: 23215 - protein, 9 aa, Artificial Sequence
  Receptor-type tyrosine-protein phosphatase zeta (120-128)
VFKASKITF

SEQ ID NO: 23216 - protein, 9 aa, Artificial Sequence
  Baculoviral IAP repeat-containing protein 6 (448-456)
VFKPISSTW

SEQ ID NO: 23217 - protein, 8 aa, Artificial Sequence
  Farnesyl pyrophosphate synthase (333-340)
VFLGLARK

SEQ ID NO: 23218 - protein, 11 aa, Artificial Sequence
  Transmembraneoprotein NMB (543-553)
VFLNRAKAVFF

SEQ ID NO: 23219 - protein, 10 aa, Artificial Sequence
  HLA class II histocompatibility antigen, DQ alpha 1 chain (162-171)
VFLPREDHLF

SEQ ID NO: 23220 - protein, 11 aa, Artificial Sequence
  Extracellular matrix protein FRAS1 (2887-2897)
VFLSSAQGAEL

SEQ ID NO: 23221 - protein, 9 aa, Artificial Sequence
  Beta-hexosaminidase subunit alpha (311-319)
VFPDFYLHL

SEQ ID NO: 23222 - protein, 9 aa, Artificial Sequence
  Sal-like protein 1 (304-312)
VFPSPLPNI

SEQ ID NO: 23223 - protein, 9 aa, Artificial Sequence
  Lysosomal-trafficking regulator (976-984)
VFQKQFYRL

SEQ ID NO: 23224 - protein, 9 aa, Artificial Sequence
  Filamin-A (1243-1251)
VFREATTEF

SEQ ID NO: 23225 - protein, 9 aa, Artificial Sequence
  Tubulin beta chain (336-344)
VFRGRMSMK

SEQ ID NO: 23226 - protein, 10 aa, Artificial Sequence
  Transformation/transcription domain-associated protein (638-647)
VFTMMNPLTF

SEQ ID NO: 23227 - protein, 9 aa, Artificial Sequence
  Cell division cycle protein 23 homolog (185-193)
VFVEATHVL

SEQ ID NO: 23228 - protein, 11 aa, Artificial Sequence
  Delphilin (267-277)
VGGLAGPGGAR

SEQ ID NO: 23229 - protein, 7 aa, Artificial Sequence
  Peroxisomal membrane protein 2 (69-75)
VGGPLRY

SEQ ID NO: 23230 - protein, 9 aa, Artificial Sequence
  Eukaryotic translation initiation factor 6 (64-72)
VGNRHGLLV

SEQ ID NO: 23231 - protein, 9 aa, Artificial Sequence
  Nuclear factor of activated T-cells, cytoplasmic 2 (274-282)
VGNTKVLEI

SEQ ID NO: 23232 - protein, 15 aa, Artificial Sequence
  Filamin-A (1151-1165)
VGQFQVDCSSAGSAE

SEQ ID NO: 23233 - protein, 11 aa, Artificial Sequence
  Cullin-4A (15-25)
VGRTNGLTKPA

SEQ ID NO: 23234 - protein, 8 aa, Artificial Sequence
  F-box only protein 3 (82-89)
VGRYIDHY

SEQ ID NO: 23235 - protein, 13 aa, Artificial Sequence
  HLA class I histocompatibility antigen, B-13 alpha chain (24-36)
VGYVDDTQFVRFD

SEQ ID NO: 23236 - protein, 9 aa, Artificial Sequence
  Lysosomal-trafficking regulator (893-901)
VHINTINLF

SEQ ID NO: 23237 - protein, 7 aa, Artificial Sequence
  Bax inhibitor 1 (93-99)
VHMVTHF

SEQ ID NO: 23238 - protein, 9 aa, Artificial Sequence
  Sterol 26-hydroxylase, mitochondrial (181-189)
VIDDFMTRL

SEQ ID NO: 23239 - protein, 10 aa, Artificial Sequence
  Keratin, type I cytoskeletal 18 (130-139)
VIDDTNITRL

SEQ ID NO: 23240 - protein, 9 aa, Artificial Sequence
  Laminin subunit alpha-4 (1790-1798)
VIDGHPVSF

SEQ ID NO: 23241 - protein, 8 aa, Artificial Sequence
  Prefoldin subunit 1 (20-27)
VIDTQQKV

SEQ ID NO: 23242 - protein, 9 aa, Artificial Sequence
  Protein PRRC2C (1668-1676)
VIEDPQSNL

SEQ ID NO: 23243 - protein, 9 aa, Artificial Sequence
  Helicase SKI2W (419-427)
VIFDEVHYI

SEQ ID NO: 23244 - protein, 21 aa, Artificial Sequence
  Dolichyl-diphosphooligosaccharide-proteinosyltransferase 48 kDa subunit (255-275)
VIFSGSLDFFSDSFFNSAVQK

SEQ ID NO: 23245 - protein, 9 aa, Artificial Sequence
  CLIP-associating protein 1 (218-226)
VIFTKFDEV

SEQ ID NO: 23246 - protein, 8 aa, Artificial Sequence
  Tyrosine-protein phosphatase non-receptor type 13 (1869-1876)
VIGRVLEL

SEQ ID NO: 23247 - protein, 24 aa, Artificial Sequence
  Glyceraldehyde-3-phosphate dehydrogenase (163-186)
VIHDNFGIVEGLMTTVHAITATQK

SEQ ID NO: 23248 - protein, 8 aa, Artificial Sequence
  ELAV-like protein 1 (102-109)
VIKDANLY

SEQ ID NO: 23249 - protein, 7 aa, Artificial Sequence
  U5 small nuclear ribonucleoprotein 200 kDa helicase (1232-1238)
VILHHEY

SEQ ID NO: 23250 - protein, 16 aa, Artificial Sequence
  Heat shock protein HSP 90-beta (107-122)
VILHLKEDQTEYLEER

SEQ ID NO: 23251 - protein, 9 aa, Artificial Sequence
  Zinc finger BED domain-containing protein 1 (183-191)
VILKELAEA

SEQ ID NO: 23252 - protein, 9 aa, Artificial Sequence
  Natural resistance-associated macrophage protein 2 (259-267)
VIMPHNMYL

SEQ ID NO: 23253 - protein, 13 aa, Artificial Sequence
  Vimentin (454-466)
VINETSQHHDDLE

SEQ ID NO: 23254 - protein, 9 aa, Artificial Sequence
  NEDD8 ultimate buster 1 (130-138)
VINKKQLQL

SEQ ID NO: 23255 - protein, 9 aa, Artificial Sequence
  Spectrin beta chain, non-erythrocytic 1 (2228-2236)
VINNQEMGF

SEQ ID NO: 23256 - protein, 10 aa, Artificial Sequence
  Glia-derived nexin (64-73)
VISPHGIASV

SEQ ID NO: 23257 - protein, 9 aa, Artificial Sequence
  Serine-protein kinase ATM (120-128)
VIYTLIHYI

SEQ ID NO: 23258 - protein, 9 aa, Artificial Sequence
  Protein-L-isoaspartate(D-aspartate) O-methyltransferase (92-100)
VIYVPLTDK

SEQ ID NO: 23259 - protein, 10 aa, Artificial Sequence
  Collagen alpha-1(XII) chain (423-432)
VKGAPRNLKV

SEQ ID NO: 23260 - protein, 9 aa, Artificial Sequence
  Transferrin receptor protein 1 (188-196)
VKIQVKDSA

SEQ ID NO: 23261 - protein, 17 aa, Artificial Sequence
  Protocadherin Fat 3 (438-454)
VKKEVYKLEVTNKEGDL

SEQ ID NO: 23262 - protein, 16 aa, Artificial Sequence
  Gamma-secretase C-terminal fragment 59 (559-574)
VKMDAEFRHDSGYEVH

SEQ ID NO: 23263 - protein, 17 aa, Artificial Sequence
  Gamma-secretase C-terminal fragment 59 (559-575)
VKMDAEFRHDSGYEVHH

SEQ ID NO: 23264 - protein, 18 aa, Artificial Sequence
  Gamma-secretase C-terminal fragment 59 (559-576)
VKMDAEFRHDSGYEVHHQ

SEQ ID NO: 23265 - protein, 10 aa, Artificial Sequence
  Small conductance calcium-activated potassium channel protein 2 (419-428)
VKNAAANVLR

SEQ ID NO: 23266 - protein, 11 aa, Artificial Sequence
  Intraflagellar transport protein 81 homolog (41-51)
VLAEIDPKQLV

SEQ ID NO: 23267 - protein, 9 aa, Artificial Sequence
  Rootletin (677-685)
VLAKELVEV

SEQ ID NO: 23268 - protein, 9 aa, Artificial Sequence
  Protein FAM13B (15-23)
VLANKIFGI

SEQ ID NO: 23269 - protein, 9 aa, Artificial Sequence
  A-kinase anchor protein 1, mitochondrial (363-371)
VLATTVGKV

SEQ ID NO: 23270 - protein, 11 aa, Artificial Sequence
  Laminin subunit gamma-1 (20-30)
VLAVLAAAAAA

SEQ ID NO: 23271 - protein, 10 aa, Artificial Sequence
  U5 small nuclear ribonucleoprotein 200 kDa helicase (139-148)
VLAVLKNEKL

SEQ ID NO: 23272 - protein, 9 aa, Artificial Sequence
  Microtubule-actin cross-linking factor 1 (1174-1182)
VLDEEIAKA

SEQ ID NO: 23273 - protein, 9 aa, Artificial Sequence
  E3 ubiquitin-protein ligase RNF123 (218-226)
VLDGAVMMY

SEQ ID NO: 23274 - protein, 9 aa, Artificial Sequence
  Homologous-pairing protein 2 homolog (88-97)
VLDGKIVAL

SEQ ID NO: 23275 - protein, 9 aa, Artificial Sequence
  Transcription factor SOX-5 (89-97)
VLDGKVAVV

SEQ ID NO: 23276 - protein, 9 aa, Artificial Sequence
  Serine/arginine-rich splicing factor 2 (79-87)
VLDGRELRV

SEQ ID NO: 23277 - protein, 9 aa, Artificial Sequence
  60S ribosomal protein L13a (8-16)
VLDGRGHLL

SEQ ID NO: 23278 - protein, 8 aa, Artificial Sequence
  Clustered mitochondria protein homolog (97-104)
VLDHFSEL

SEQ ID NO: 23279 - protein, 9 aa, Artificial Sequence
  Microtubule-associated proteins 1A/1B light chain 3B (46-54)
VLDKTKFLV

SEQ ID NO: 23280 - protein, 9 aa, Artificial Sequence
  Coilin (145-153)
VLDLEPKAV

SEQ ID NO: 23281 - protein, 9 aa, Artificial Sequence
  Protein flightless-1 homolog (107-115)
VLDLSHNQL

SEQ ID NO: 23282 - protein, 9 aa, Artificial Sequence
  Cadherin-2 (399-407)
VLDRESPNV

SEQ ID NO: 23283 - protein, 9 aa, Artificial Sequence
  Receptor-type protein tyrosine phosphatase beta (1333-1341)
VLDSHIHAY

SEQ ID NO: 23284 - protein, 9 aa, Artificial Sequence
  Ubiquitin carboxyl-terminal hydrolase 19 (713-721)
VLDSLSQSV

SEQ ID NO: 23285 - protein, 9 aa, Artificial Sequence
  Biorientation of chromosomes in cell division protein 1-like 1 (1543-1551)
VLDSRIETA

SEQ ID NO: 23286 - protein, 10 aa, Artificial Sequence
  Probable tRNA methyltransferase 9-like protein (350-359)
VLDSTAFMRY

SEQ ID NO: 23287 - protein, 9 aa, Artificial Sequence
  Tubulin-specific chaperone A (71-79)
VLDSVKLEA

SEQ ID NO: 23288 - protein, 9 aa, Artificial Sequence
  COP9 signalosome complex subunit 7b (34-42)
VLEAPGVYV

SEQ ID NO: 23289 - protein, 9 aa, Artificial Sequence
  Ras GTPase-activating-like protein IQGAP3 (1063-1071)
VLEDKVLSV

SEQ ID NO: 23290 - protein, 8 aa, Artificial Sequence
  Melanoma-associated antigen 4 (287-294)
VLEHVVRV

SEQ ID NO: 23291 - protein, 9 aa, Artificial Sequence
  Leucine-tRNA ligase, cytoplasmic (271-279)
VLEPYPSKL

SEQ ID NO: 23292 - protein, 9 aa, Artificial Sequence
  E3 ubiquitin-protein ligase RNF123 (425-433)
VLFDVLRSV

SEQ ID NO: 23293 - protein, 10 aa, Artificial Sequence
  Nucleolar protein 56 (6-15)
VLFEHAVGYA

SEQ ID NO: 23294 - protein, 9 aa, Artificial Sequence
  NADH dehydrogenase (ubiquinone) iron-sulfur protein 2, mitochondrial (172-180)
VLFGEITRL

SEQ ID NO: 23295 - protein, 12 aa, Artificial Sequence
  Heat shock 70 kDa protein 12A (519-530)
VLFGLDPAVIKV

SEQ ID NO: 23296 - protein, 6 aa, Artificial Sequence
  Maestro heat-like repeat-containing protein family member 1 (158-163)
VLFHQW

SEQ ID NO: 23297 - protein, 9 aa, Artificial Sequence
  Exostosin-like 1 (657-665)
VLFKDPVSV

SEQ ID NO: 23298 - protein, 10 aa, Artificial Sequence
  Histone-lysine N-methyltransferase 2D (4817-4826)
VLFPESPARA

SEQ ID NO: 23299 - protein, 9 aa, Artificial Sequence
  Ribosomal protein S6 kinase alpha-3 (517-525)
VLFTITKTV

SEQ ID NO: 23300 - protein, 10 aa, Artificial Sequence
  TAF6-like RNA polymerase II p300/CBP-associated factor-associated factor 65 kDa subunit 6L (168-177)
VLGDDPQLMK

SEQ ID NO: 23301 - protein, 11 aa, Artificial Sequence
  TAF6-like RNA polymerase II p300/CBP-associated factor-associated factor 65 kDa subunit 6L (168-178)
VLGDDPQLMKV

SEQ ID NO: 23302 - protein, 8 aa, Artificial Sequence
  Kelch-like protein 21 (509-516)
VLGGKLYV

SEQ ID NO: 23303 - protein, 8 aa, Artificial Sequence
  Lipopolysaccharide-responsive and beige-like anchor protein (137-144)
VLGKIEKV

SEQ ID NO: 23304 - protein, 8 aa, Artificial Sequence
  EH domain-containing protein 4 (483-490)
VLGKIWKL

SEQ ID NO: 23305 - protein, 8 aa, Artificial Sequence
  Dynactin subunit 2 (288-295)
VLGKVNEI

SEQ ID NO: 23306 - protein, 9 aa, Artificial Sequence
  Nuclear autoantigenic sperm protein (105-113)
VLGNALEGV

SEQ ID NO: 23307 - protein, 9 aa, Artificial Sequence
  Hepatoma-derived growth factor-related protein 2 (550-558)
VLGPKIEAV

SEQ ID NO: 23308 - protein, 9 aa, Artificial Sequence
  Zinc finger protein 518A (419-427)
VLGPTLKNV

SEQ ID NO: 23309 - protein, 9 aa, Artificial Sequence
  EAW51983.1 (1173-1181)
VLGPTPELV

SEQ ID NO: 23310 - protein, 9 aa, Artificial Sequence
  Transferrin receptor protein 1 (488-496)
VLGTSNFKV

SEQ ID NO: 23311 - protein, 8 aa, Artificial Sequence
  HEAT repeat-containing protein 1 (1554-1561)
VLGYISAV

SEQ ID NO: 23312 - protein, 10 aa, Artificial Sequence
  Integrin-linked protein kinase (219-228)
VLHEGTNFVV

SEQ ID NO: 23313 - protein, 9 aa, Artificial Sequence
  Dolichyl-diphosphooligosaccharide-proteinosyltransferase subunit 1 (138-146)
VLHPYPTQI

SEQ ID NO: 23314 - protein, 9 aa, Artificial Sequence
  Ral GTPase-activating protein subunit beta (21-29)
VLHSYPESV

SEQ ID NO: 23315 - protein, 9 aa, Artificial Sequence
  Alpha-parvin (100-108)
VLIDWINDV

SEQ ID NO: 23316 - protein, 9 aa, Artificial Sequence
  Leucine-tRNA ligase, cytoplasmic (203-211)
VLIHSSQYL

SEQ ID NO: 23317 - protein, 9 aa, Artificial Sequence
  Hemicentin-1 (1559-1567)
VLINSLIKL

SEQ ID NO: 23318 - protein, 9 aa, Artificial Sequence
  Neuron navigator 2 (119-127)
VLLAQIIQV

SEQ ID NO: 23319 - protein, 9 aa, Artificial Sequence
  Protein MON2 homolog (1145-1153)
VLLDHIQSA

SEQ ID NO: 23320 - protein, 11 aa, Artificial Sequence
  Ankyrin-2 (527-537)
VLLEAGAAHSL

SEQ ID NO: 23321 - protein, 9 aa, Artificial Sequence
  Protein wntless homolog (264-272)
VLLEKVIFA

SEQ ID NO: 23322 - protein, 12 aa, Artificial Sequence
  Tumor necrosis factor receptor superfamily member 19 (5-16)
VLLEQEKTFFTL

SEQ ID NO: 23323 - protein, 9 aa, Artificial Sequence
  Hemicentin-1 (3258-3266)
VLLGENVEL

SEQ ID NO: 23324 - protein, 10 aa, Artificial Sequence
  Nucleolar protein 56 (91-100)
VLLGVGDPKI

SEQ ID NO: 23325 - protein, 9 aa, Artificial Sequence
  Receptor tyrosine-protein kinase erbB-3 (840-848)
VLLKSPSQV

SEQ ID NO: 23326 - protein, 11 aa, Artificial Sequence
  A-kinase anchor protein 6 (1028-1038)
VLLPNDLLEKV

SEQ ID NO: 23327 - protein, 9 aa, Artificial Sequence
  Lysosomal-trafficking regulator (260-268)
VLLSLLEKV

SEQ ID NO: 23328 - protein, 9 aa, Artificial Sequence
  Cyclic AMP-dependent transcription factor ATF-6 alpha (233-241)
VLLSQPTVV

SEQ ID NO: 23329 - protein, 9 aa, Artificial Sequence
  Regulatory-associated protein of mTOR (223-231)
VLLSQVHRL

SEQ ID NO: 23330 - protein, 11 aa, Artificial Sequence
  Synaptic vesicle membrane protein VAT-1 homolog (379-389)
VLLVPGPEKEN

SEQ ID NO: 23331 - protein, 11 aa, Artificial Sequence
  Serine/threonine-protein phosphatase 6 regulatory ankyrin repeat subunit A (378-388)
VLMETSGTDML

SEQ ID NO: 23332 - protein, 9 aa, Artificial Sequence
  HEAT repeat-containing protein 1 (847-855)
VLMKLFIKV

SEQ ID NO: 23333 - protein, 9 aa, Artificial Sequence
  Urocortin-2 (11-19)
VLMLGRVLV

SEQ ID NO: 23334 - protein, 9 aa, Artificial Sequence
  Structural maintenance of chromosomes protein 2 (153-161)
VLNMKPPEI

SEQ ID NO: 23335 - protein, 9 aa, Artificial Sequence
  Bifunctional 3'-phosphoadenosine 5'-phosphosulfate synthase 1 (479-487)
VLNPETTVV

SEQ ID NO: 23336 - protein, 9 aa, Artificial Sequence
  Receptor activity-modifying protein 2 (34-42)
VLNPHEALA

SEQ ID NO: 23337 - protein, 9 aa, Artificial Sequence
  Probable cytosolic iron-sulfur protein assembly protein CIAO1 (145-153)
VLNSHTQDV

SEQ ID NO: 23338 - protein, 9 aa, Artificial Sequence
  Nucleosome-remodeling factor subunit BPTF (2314-2322)
VLPGPGQQL

SEQ ID NO: 23339 - protein, 9 aa, Artificial Sequence
  Transmembrane protein 94 (322-330)
VLPILPLLF

SEQ ID NO: 23340 - protein, 7 aa, Artificial Sequence
  40S ribosomal protein S26 (63-69)
VLPKLYV

SEQ ID NO: 23341 - protein, 11 aa, Artificial Sequence
  Protocadherin Fat 3 (2698-2708)
VLPPETFLPSF

SEQ ID NO: 23342 - protein, 9 aa, Artificial Sequence
  Oxysterol-binding protein-related protein 10 (353-361)
VLPTFILEK

SEQ ID NO: 23343 - protein, 9 aa, Artificial Sequence
  Oxysterol-binding protein-related protein 9 (402-410)
VLPTFILER

SEQ ID NO: 23344 - protein, 10 aa, Artificial Sequence
  Protein-associating with the carboxyl-terminal domain of ezrin (30-39)
VLQDGKFASV

SEQ ID NO: 23345 - protein, 9 aa, Artificial Sequence
  Zinc finger MYM-type protein 4 (793-801)
VLQGAVPTV

SEQ ID NO: 23346 - protein, 10 aa, Artificial Sequence
  Serum paraoxonase/arylesterase 2 (326-335)
VLQGSSVASV

SEQ ID NO: 23347 - protein, 10 aa, Artificial Sequence
  Microspherule protein 1 (219-228)
VLQTNDLTSV

SEQ ID NO: 23348 - protein, 14 aa, Artificial Sequence
  Heat shock 70 kDa protein 1-like (171-184)
VLRIINEPTAAAIA

SEQ ID NO: 23349 - protein, 9 aa, Artificial Sequence
  Probable helicase with zinc finger domain (252-260)
VLSECIEGV

SEQ ID NO: 23350 - protein, 9 aa, Artificial Sequence
  Magnesium transporter protein 1 (68-76)
VLSEKVSQL

SEQ ID NO: 23351 - protein, 10 aa, Artificial Sequence
  Protein misato homolog 1 (109-118)
VLSSDGVWRV

SEQ ID NO: 23352 - protein, 8 aa, Artificial Sequence
  Small integral membrane protein 15 (39-46)
VLSWKLAK

SEQ ID NO: 23353 - protein, 9 aa, Artificial Sequence
  Autophagy-related protein 16-1 (517-525)
VLTGKVEKV

SEQ ID NO: 23354 - protein, 9 aa, Artificial Sequence
  Transmembraneoprotein NMB (81-89)
VLTSDSPAL

SEQ ID NO: 23355 - protein, 9 aa, Artificial Sequence
  E3 ubiquitin-protein ligase XIAP (409-417)
VLVADLVNA

SEQ ID NO: 23356 - protein, 9 aa, Artificial Sequence
  Eukaryotic translation initiation factor 3 subunit E (318-326)
VLVNDFFLV

SEQ ID NO: 23357 - protein, 9 aa, Artificial Sequence
  Hemicentin-1 (2884-2892)
VLVNKSALI

SEQ ID NO: 23358 - protein, 10 aa, Artificial Sequence
  Cadherin EGF LAG seven-pass G-type receptor 2 (1100-1109)
VLVSDGVHSV

SEQ ID NO: 23359 - protein, 10 aa, Artificial Sequence
  Protocadherin beta-8 (440-449)
VLVSDVNDNA

SEQ ID NO: 23360 - protein, 9 aa, Artificial Sequence
  Elongator complex protein 2 (41-49)
VLYDPLKRV

SEQ ID NO: 23361 - protein, 11 aa, Artificial Sequence
  Maltase-glucoamylase (708-718)
VLYEGVDEVKA

SEQ ID NO: 23362 - protein, 10 aa, Artificial Sequence
  Slit homolog 3 protein (361-370)
VLYGNKITEI

SEQ ID NO: 23363 - protein, 10 aa, Artificial Sequence
  Slit homolog 2 protein (354-363)
VLYGNKITEL

SEQ ID NO: 23364 - protein, 9 aa, Artificial Sequence
  Protein nepro homolog (10-18)
VLYKGVLKR

SEQ ID NO: 23365 - protein, 12 aa, Artificial Sequence
  Melanocyte protein PMEL (483-494)
VLYRYGSFSVTL

SEQ ID NO: 23366 - protein, 9 aa, Artificial Sequence
  Putative eukaryotic translation initiation factor 2 subunit 3-like protein (151-159)
VMDAALLLI

SEQ ID NO: 23367 - protein, 10 aa, Artificial Sequence
  Putative eukaryotic translation initiation factor 2 subunit 3-like protein (151-160)
VMDAALLLIA

SEQ ID NO: 23368 - protein, 9 aa, Artificial Sequence
  Carboxypeptidase Q (442-450)
VMDPKQMNV

SEQ ID NO: 23369 - protein, 11 aa, Artificial Sequence
  Lipopolysaccharide-responsive and beige-like anchor protein (1389-1399)
VMFNFPDPATV

SEQ ID NO: 23370 - protein, 18 aa, Artificial Sequence
  Cytochrome c oxidase subunit 6C (58-75)
VMKDFEEMRKAGIFQSVK

SEQ ID NO: 23371 - protein, 10 aa, Artificial Sequence
  Scavenger receptor class B member 1 (146-155)
VMMENKPMTL

SEQ ID NO: 23372 - protein, 9 aa, Artificial Sequence
  Xylosyltransferase 1 (587-595)
VMPKKVFKI

SEQ ID NO: 23373 - protein, 14 aa, Artificial Sequence
  78 kDa glucose-regulated protein (177-190)
VMRIINEPTAAAIA

SEQ ID NO: 23374 - protein, 15 aa, Artificial Sequence
  78 kDa glucose-regulated protein (177-191)
VMRIINEPTAAAIAY

SEQ ID NO: 23375 - protein, 9 aa, Artificial Sequence
  Non-structural maintenance of chromosomes element 1 homolog (4-12)
VMTDVHRRF

SEQ ID NO: 23376 - protein, 11 aa, Artificial Sequence
  DNA (cytosine-5)-methyltransferase 3A (139-149)
VMWFGDGKFSV

SEQ ID NO: 23377 - protein, 7 aa, Artificial Sequence
  Interferon-induced protein with tetratricopeptide repeats 1 (396-402)
VNAIIHY

SEQ ID NO: 23378 - protein, 18 aa, Artificial Sequence
  Beta-2-microglobulin (81-98)
VNHVTLSQPKIVKWDRDM

SEQ ID NO: 23379 - protein, 14 aa, Artificial Sequence
  Protocadherin gamma-C3 (553-566)
VNIFVTDRNDNAPQ

SEQ ID NO: 23380 - protein, 9 aa, Artificial Sequence
  T-complex protein 1 subunit eta (46-54)
VNKIKEIAV

SEQ ID NO: 23381 - protein, 11 aa, Artificial Sequence
  Cytochrome c oxidase subunit 6A1, mitochondrial (76-86)
VNPLPTGYEDE

SEQ ID NO: 23382 - protein, 11 aa, Artificial Sequence
  Pumilio homolog 1 (533-543)
VNSALAFGQGL

SEQ ID NO: 23383 - protein, 7 aa, Artificial Sequence
  T-complex protein 1 subunit zeta-2 (199-205)
VNSGFFY

SEQ ID NO: 23384 - protein, 7 aa, Artificial Sequence
  Bifunctional glutamate/proline-tRNA ligase (51-57)
VNSILRY

SEQ ID NO: 23385 - protein, 24 aa, Artificial Sequence
  Ras GTPase-activating-like protein IQGAP1 (303-326)
VNTFSALANIDLALEQGDALALFR

SEQ ID NO: 23386 - protein, 9 aa, Artificial Sequence
  40S ribosomal protein S30 (117-125)
VNVVPTFGK

SEQ ID NO: 23387 - protein, 10 aa, Artificial Sequence
  Transmembraneoprotein NMB (485-494)
VPDRDPASPL

SEQ ID NO: 23388 - protein, 9 aa, Artificial Sequence
  Endothelin B receptor (266-274)
VPFIQKASV

SEQ ID NO: 23389 - protein, 9 aa, Artificial Sequence
  Nectin-3 (335-343)
VPFKQTSSI

SEQ ID NO: 23390 - protein, 8 aa, Artificial Sequence
  Heat shock protein 105 kDa (412-419)
VPFPISLI

SEQ ID NO: 23391 - protein, 11 aa, Artificial Sequence
  Elastin (436-446)
VPGAPGAVPGV

SEQ ID NO: 23392 - protein, 17 aa, Artificial Sequence
  Carboxypeptidase D (836-852)
VPGTYKITASARGYNPV

SEQ ID NO: 23393 - protein, 15 aa, Artificial Sequence
  Transmembraneoprotein NMB (221-235)
VPIAQVKDVYVVTDQ

SEQ ID NO: 23394 - protein, 26 aa, Artificial Sequence
  Transmembraneoprotein NMB (221-246)
VPIAQVKDVYVVTDQIPVFVTMFQKN

SEQ ID NO: 23395 - protein, 12 aa, Artificial Sequence
  Neuronal cell adhesion molecule (399-410)
VPIEIAPDDPSR

SEQ ID NO: 23396 - protein, 13 aa, Artificial Sequence
  Neuronal cell adhesion molecule (399-411)
VPIEIAPDDPSRK

SEQ ID NO: 23397 - protein, 16 aa, Artificial Sequence
  Neuronal cell adhesion molecule (399-414)
VPIEIAPDDPSRKIDG

SEQ ID NO: 23398 - protein, 9 aa, Artificial Sequence
  pre-rRNA processing protein FTSJ3 (78-86)
VPIKPLPNV

SEQ ID NO: 23399 - protein, 14 aa, Artificial Sequence
  Thioredoxin reductase 1, cytoplasmic (252-265)
VPIKVEQIEAGTPG

SEQ ID NO: 23400 - protein, 9 aa, Artificial Sequence
  Endoglin (526-534)
VPIPKTGTL

SEQ ID NO: 23401 - protein, 9 aa, Artificial Sequence
  Interferon-induced 35 kDa protein (73-81)
VPKSLVSNL

SEQ ID NO: 23402 - protein, 14 aa, Artificial Sequence
  Solute carrier family 2, facilitated glucose transporter member 14 (177-190)
VPMYIGEISPTALR

SEQ ID NO: 23403 - protein, 15 aa, Artificial Sequence
  Solute carrier family 2, facilitated glucose transporter member 1 (140-154)
VPMYVGEVSPTALRG

SEQ ID NO: 23404 - protein, 9 aa, Artificial Sequence
  Nucleosome-remodeling factor subunit BPTF (238-246)
VPNEHIMNV

SEQ ID NO: 23405 - protein, 10 aa, Artificial Sequence
  COMM domain-containing protein 7 (78-87)
VPNGALKKSL

SEQ ID NO: 23406 - protein, 9 aa, Artificial Sequence
  Diacylglycerol O-acyltransferase 1 (328-336)
VPNHLIWLI

SEQ ID NO: 23407 - protein, 9 aa, Artificial Sequence
  Selenoprotein N (214-222)
VPNHRSLNV

SEQ ID NO: 23408 - protein, 8 aa, Artificial Sequence
  Polymerase I and transcript release factor (228-235)
VPPFTFHV

SEQ ID NO: 23409 - protein, 8 aa, Artificial Sequence
  Sodium/potassium-transporting ATPase subunit alpha-3 (168-175)
VPQQALVI

SEQ ID NO: 23410 - protein, 9 aa, Artificial Sequence
  Neurofibromin (199-207)
VPQSHMPEI

SEQ ID NO: 23411 - protein, 9 aa, Artificial Sequence
  Krueppel-like factor 15 (133-141)
VPRPFQPTL

SEQ ID NO: 23412 - protein, 8 aa, Artificial Sequence
  Transmembrane emp24 domain-containing protein 7 (5-12)
VPRSASVL

SEQ ID NO: 23413 - protein, 9 aa, Artificial Sequence
  Transmembrane emp24 domain-containing protein 7 (5-13)
VPRSASVLL

SEQ ID NO: 23414 - protein, 10 aa, Artificial Sequence
  Transmembrane emp24 domain-containing protein 7 (5-14)
VPRSASVLLL

SEQ ID NO: 23415 - protein, 9 aa, Artificial Sequence
  F-box/WD repeat-containing protein 9 (435-443)
VPTDPPRTI

SEQ ID NO: 23416 - protein, 8 aa, Artificial Sequence
  Protein Smaug homolog 1 (103-110)
VPTTINTI

SEQ ID NO: 23417 - protein, 9 aa, Artificial Sequence
  Major facilitator superfamily domain-containing protein 12 (214-222)
VPVFRNLSL

SEQ ID NO: 23418 - protein, 9 aa, Artificial Sequence
  Mitogen-activated protein kinase 7 (125-133)
VPYGEFKSV

SEQ ID NO: 23419 - protein, 8 aa, Artificial Sequence
  Solute carrier family 22 member 18 (47-54)
VPYLSRKL

SEQ ID NO: 23420 - protein, 8 aa, Artificial Sequence
  Glycogen debranching enzyme (1050-1057)
VPYRLNEI

SEQ ID NO: 23421 - protein, 9 aa, Artificial Sequence
  Phosphatidylinositol 3-kinase catalytic subunit type 3 (400-408)
VQALKYENF

SEQ ID NO: 23422 - protein, 9 aa, Artificial Sequence
  Adipocyte enhancer-binding protein 1 (657-665)
VQDTRIHLV

SEQ ID NO: 23423 - protein, 9 aa, Artificial Sequence
  Spectrin beta chain, non-erythrocytic 5 (994-1002)
VQLAHSVEV

SEQ ID NO: 23424 - protein, 9 aa, Artificial Sequence
  Mitochondrial pyruvate carrier 1 (19-27)
VQPRNWLLF

SEQ ID NO: 23425 - protein, 9 aa, Artificial Sequence
  Mitogen-activated protein kinase kinase kinase 6 (125-133)
VQPSLFYHL

SEQ ID NO: 23426 - protein, 8 aa, Artificial Sequence
  CD99 antigen (178-185)
VQRTLLEK

SEQ ID NO: 23427 - protein, 9 aa, Artificial Sequence
  eIF-2-alpha kinase activator GCN1 (1752-1760)
VRDGYIMMF

SEQ ID NO: 23428 - protein, 9 aa, Artificial Sequence
  Lysosomal-trafficking regulator (3248-3256)
VRMPPFTKM

SEQ ID NO: 23429 - protein, 9 aa, Artificial Sequence
  Tripeptidyl-peptidase 1 (151-159)
VRSPHPYQL

SEQ ID NO: 23430 - protein, 8 aa, Artificial Sequence
  Anion exchange protein (986-993)
VSAAAVVF

SEQ ID NO: 23431 - protein, 8 aa, Artificial Sequence
  V-type proton ATPase subunit H (400-407)
VSDDPQVL

SEQ ID NO: 23432 - protein, 8 aa, Artificial Sequence
  Cofilin-1 (7-14)
VSDGVIKV

SEQ ID NO: 23433 - protein, 9 aa, Artificial Sequence
  Cofilin-1 (7-15)
VSDGVIKVF

SEQ ID NO: 23434 - protein, 8 aa, Artificial Sequence
  HLA class I histocompatibility antigen, Cw-3 alpha chain (218-225)
VSDHEATL

SEQ ID NO: 23435 - protein, 8 aa, Artificial Sequence
  Proteasome subunit beta type-8 (264-271)
VSDLLHQY

SEQ ID NO: 23436 - protein, 9 aa, Artificial Sequence
  Baculoviral IAP repeat-containing protein 6 (689-697)
VSDPNLIHV

SEQ ID NO: 23437 - protein, 13 aa, Artificial Sequence
  Microtubule-associated protein (1369-1381)
VSEENKTDAANRY

SEQ ID NO: 23438 - protein, 8 aa, Artificial Sequence
  Neuroblast differentiation-associated protein AHNAK (3336-3343)
VSGPKLNI

SEQ ID NO: 23439 - protein, 14 aa, Artificial Sequence
  PR domain zinc finger protein 10 (909-922)
VSGQPLSPSAQQAQ

SEQ ID NO: 23440 - protein, 10 aa, Artificial Sequence
  Melanocyte protein PMEL (412-421)
VSIVVLSGTT

SEQ ID NO: 23441 - protein, 9 aa, Artificial Sequence
  Kinesin-like protein KIF27 (522-530)
VSLKEAQKV

SEQ ID NO: 23442 - protein, 8 aa, Artificial Sequence
  HLA class I histocompatibility antigen, A-23 alpha chain (358-365)
VSLTACKV

SEQ ID NO: 23443 - protein, 9 aa, Artificial Sequence
  Potassium-transporting ATPase alpha chain 1 (600-608)
VSMIDPPRA

SEQ ID NO: 23444 - protein, 9 aa, Artificial Sequence
  Cyclic AMP-dependent transcription factor ATF-6 alpha (445-453)
VSNDKALMV

SEQ ID NO: 23445 - protein, 9 aa, Artificial Sequence
  Vacuolar protein sorting-associated protein 13D (2458-2466)
VSNERHLEV

SEQ ID NO: 23446 - protein, 9 aa, Artificial Sequence
  Transcription initiation factor TFIID subunit 1 (307-315)
VSQKSLWNY

SEQ ID NO: 23447 - protein, 9 aa, Artificial Sequence
  Neuron navigator 3 (198-206)
VSSKTTLQY

SEQ ID NO: 23448 - protein, 9 aa, Artificial Sequence
  Dolichyl-diphosphooligosaccharide-proteinosyltransferase subunit 1 (300-308)
VSTSHLLIL

SEQ ID NO: 23449 - protein, 9 aa, Artificial Sequence
  DNA damage-binding protein 1 (7-15)
VTAQKPTAV

SEQ ID NO: 23450 - protein, 9 aa, Artificial Sequence
  General transcription factor II-I (201-209)
VTDADRSIL

SEQ ID NO: 23451 - protein, 23 aa, Artificial Sequence
  Nebulin (5596-5618)
VTDDKNTVLALRNTLIESDLKYK

SEQ ID NO: 23452 - protein, 9 aa, Artificial Sequence
  HLA class II histocompatibility antigen, DQ beta 1 chain (114-122)
VTDFYPAQI

SEQ ID NO: 23453 - protein, 9 aa, Artificial Sequence
  Protein dopey-2 (2274-2282)
VTDSPRILK

SEQ ID NO: 23454 - protein, 9 aa, Artificial Sequence
  Williams-Beuren syndrome chromosomal region 16 protein (318-326)
VTDSTQVNV

SEQ ID NO: 23455 - protein, 10 aa, Artificial Sequence
  Nebulin (5327-5336)
VTDTVSDVKY

SEQ ID NO: 23456 - protein, 17 aa, Artificial Sequence
  Cytochrome c oxidase subunit 6B1 (1-17)
VTDWDEQRAEGTFPGKI

SEQ ID NO: 23457 - protein, 9 aa, Artificial Sequence
  Insulin-like growth factor 1 receptor (683-691)
VTENPKTEV

SEQ ID NO: 23458 - protein, 9 aa, Artificial Sequence
  Ras association domain-containing protein 3 (64-72)
VTESPAKFA

SEQ ID NO: 23459 - protein, 10 aa, Artificial Sequence
  Large neutral amino acids transporter small subunit 2 (80-89)
VTFGEKLLGV

SEQ ID NO: 23460 - protein, 9 aa, Artificial Sequence
  Cadherin EGF LAG seven-pass G-type receptor 1 (634-642)
VTFSALLPG

SEQ ID NO: 23461 - protein, 21 aa, Artificial Sequence
  Heterogeneous nuclear ribonucleoprotein F (327-347)
VTGEADVEFATHEEAVAAMSK

SEQ ID NO: 23462 - protein, 12 aa, Artificial Sequence
  Mucin-19 (3971-3982)
VTGITGPSAGIT

SEQ ID NO: 23463 - protein, 24 aa, Artificial Sequence
  Splicing factor 3B subunit 4 (49-72)
VTGQHQGYGFVEFLSEEDADYAIK

SEQ ID NO: 23464 - protein, 9 aa, Artificial Sequence
  Melanotransferrin (119-127)
VTIDTLKGV

SEQ ID NO: 23465 - protein, 10 aa, Artificial Sequence
  Adhesion G protein-coupled receptor F5 (269-278)
VTINESNFFV

SEQ ID NO: 23466 - protein, 9 aa, Artificial Sequence
  Maltase-glucoamylase (886-894)
VTITDLQGL

SEQ ID NO: 23467 - protein, 12 aa, Artificial Sequence
  Annexin A2 (54-65)
VTIVNILTNRSN

SEQ ID NO: 23468 - protein, 14 aa, Artificial Sequence
  Annexin A2 (54-67)
VTIVNILTNRSNAQ

SEQ ID NO: 23469 - protein, 19 aa, Artificial Sequence
  Prelamin-A/C (346-364)
VTIWAAGAGATHSPPTDLV

SEQ ID NO: 23470 - protein, 13 aa, Artificial Sequence
  Laminin subunit gamma-1 (671-683)
VTLASARPGPGVP

SEQ ID NO: 23471 - protein, 11 aa, Artificial Sequence
  Heat shock transcription factor, X-linked (369-379)
VTLVAAGAAQP

SEQ ID NO: 23472 - protein, 9 aa, Artificial Sequence
  Trafficking protein particle complex subunit 2-like protein (73-81)
VTNSKVKFV

SEQ ID NO: 23473 - protein, 9 aa, Artificial Sequence
  Solute carrier family 26 member 10 (164-172)
VTPDQLFVS

SEQ ID NO: 23474 - protein, 10 aa, Artificial Sequence
  Treacle protein (248-257)
VTPQVKGGAL

SEQ ID NO: 23475 - protein, 15 aa, Artificial Sequence
  Desmoglein-2 (901-915)
VTQEIVTERSVSSRQ

SEQ ID NO: 23476 - protein, 16 aa, Artificial Sequence
  Desmoglein-2 (901-916)
VTQEIVTERSVSSRQA

SEQ ID NO: 23477 - protein, 16 aa, Artificial Sequence
  Voltage-dependent anion-selective channel protein 1 (164-179)
VTQSNFAVGYKTDEFQ

SEQ ID NO: 23478 - protein, 9 aa, Artificial Sequence
  Bifunctional glutamate/proline-tRNA ligase (1104-1112)
VTRSGKTEL

SEQ ID NO: 23479 - protein, 11 aa, Artificial Sequence
  HMG domain-containing protein 4 (358-368)
VTSGPPPSIPY

SEQ ID NO: 23480 - protein, 13 aa, Artificial Sequence
  Vimentin (31-43)
VTTSTRTYSLGSA

SEQ ID NO: 23481 - protein, 9 aa, Artificial Sequence
  Low-density lipoprotein receptor-related protein 2 (584-592)
VTYDGIQRK

SEQ ID NO: 23482 - protein, 9 aa, Artificial Sequence
  Unconventional myosin-Ic (1036-1044)
VVAPRLNSR

SEQ ID NO: 23483 - protein, 10 aa, Artificial Sequence
  Echinoderm microtubule-associated protein-like 3 (378-387)
VVDDSNEHML

SEQ ID NO: 23484 - protein, 9 aa, Artificial Sequence
  Helicase with zinc finger domain 2 (2588-2596)
VVDPNQVNV

SEQ ID NO: 23485 - protein, 9 aa, Artificial Sequence
  Catenin alpha-1 (33-41)
VVEDGILKL

SEQ ID NO: 23486 - protein, 14 aa, Artificial Sequence
  Beta-hexosaminidase subunit alpha (397-410)
VVEPLAFEGTPEQK

SEQ ID NO: 23487 - protein, 13 aa, Artificial Sequence
  Glyceraldehyde-3-phosphate dehydrogenase (95-107)
VVESTGVFTTMEK

SEQ ID NO: 23488 - protein, 15 aa, Artificial Sequence
  Glyceraldehyde-3-phosphate dehydrogenase (95-109)
VVESTGVFTTMEKAG

SEQ ID NO: 23489 - protein, 16 aa, Artificial Sequence
  Glyceraldehyde-3-phosphate dehydrogenase (95-110)
VVESTGVFTTMEKAGA

SEQ ID NO: 23490 - protein, 9 aa, Artificial Sequence
  Thioredoxin-interacting protein (12-20)
VVFNDPEKV

SEQ ID NO: 23491 - protein, 9 aa, Artificial Sequence
  Ribosomal RNA-processing protein 7 homolog A (119-127)
VVFQKPSGV

SEQ ID NO: 23492 - protein, 9 aa, Artificial Sequence
  F-box only protein 7 (293-301)
VVLPLELKL

SEQ ID NO: 23493 - protein, 9 aa, Artificial Sequence
  ABCB9 protein (422-430)
VVQVSILYY

SEQ ID NO: 23494 - protein, 8 aa, Artificial Sequence
  Unconventional myosin-Ic (251-258)
VVRKALTV

SEQ ID NO: 23495 - protein, 9 aa, Artificial Sequence
  Cancer/testis antigen 55 (63-71)
VVTGNVPLK

SEQ ID NO: 23496 - protein, 8 aa, Artificial Sequence
  Protein FAM65B (860-867)
VVTVFQYY

SEQ ID NO: 23497 - protein, 9 aa, Artificial Sequence
  Leucine-rich repeat LGI family member 4 (16-24)
VVVAWRPPK

SEQ ID NO: 23498 - protein, 12 aa, Artificial Sequence
  Glutamate receptor ionotropic, kainate 2 (174-185)
VVYDDSTGLIRL

SEQ ID NO: 23499 - protein, 15 aa, Artificial Sequence
  Calcium-binding mitochondrial carrier protein SCaMC-1 (444-458)
VVYENMKQTLGVTQK

SEQ ID NO: 23500 - protein, 11 aa, Artificial Sequence
  N-acetyllactosaminide beta-1,6-N-acetylglucosaminyl-transferase, isoform A (159-169)
VVYGGISRLQA

SEQ ID NO: 23501 - protein, 12 aa, Artificial Sequence
  m7GpppX diphosphatase (131-142)
VVYPATEKHLQK

SEQ ID NO: 23502 - protein, 9 aa, Artificial Sequence
  Melanoma-derived growth regulatory protein (69-77)
VVYVFSKLK

SEQ ID NO: 23503 - protein, 10 aa, Artificial Sequence
  2-hydroxyacylsphingosine 1-beta-galactosyltransferase (258-267)
VVYVGGILTK

SEQ ID NO: 23504 - protein, 9 aa, Artificial Sequence
  N-acylglucosamine 2-epimerase (48-56)
VYDDLKYVW

SEQ ID NO: 23505 - protein, 10 aa, Artificial Sequence
  Cleft lip and palate transmembrane protein 1 (470-479)
VYDDMAFRYL

SEQ ID NO: 23506 - protein, 12 aa, Artificial Sequence
  Protein phosphatase 1A (58-69)
VYDGHAGSQVAK

SEQ ID NO: 23507 - protein, 9 aa, Artificial Sequence
  Melanoma-associated antigen 4 (231-239)
VYDGREHTV

SEQ ID NO: 23508 - protein, 10 aa, Artificial Sequence
  Nuclear pore complex protein Nup160 (1114-1123)
VYDRPGASPK

SEQ ID NO: 23509 - protein, 8 aa, Artificial Sequence
  Retinoic acid receptor alpha (49-56)
VYETDVFV

SEQ ID NO: 23510 - protein, 9 aa, Artificial Sequence
  Origin recognition complex subunit 3 (436-444)
VYFSAAHAL

SEQ ID NO: 23511 - protein, 9 aa, Artificial Sequence
  Melanoma-associated antigen C2 (266-274)
VYGEPRELL

SEQ ID NO: 23512 - protein, 9 aa, Artificial Sequence
  UBX domain-containing protein 6 (214-222)
VYGFVREAL

SEQ ID NO: 23513 - protein, 9 aa, Artificial Sequence
  Tripartite motif-containing protein 55 (92-100)
VYGLQRNLL

SEQ ID NO: 23514 - protein, 9 aa, Artificial Sequence
  Sulfate transporter (138-146)
VYGLYTSFF

SEQ ID NO: 23515 - protein, 8 aa, Artificial Sequence
  Filamin-A (747-754)
VYGPGVAK

SEQ ID NO: 23516 - protein, 8 aa, Artificial Sequence
  Serine palmitoyltransferase 2 (238-245)
VYGQPRTR

SEQ ID NO: 23517 - protein, 9 aa, Artificial Sequence
  Rho-related BTB domain-containing protein 3 (463-471)
VYGVSKETF

SEQ ID NO: 23518 - protein, 9 aa, Artificial Sequence
  Beta-galactoside alpha-2,6-sialyltransferase 1 (260-268)
VYHSDIPKW

SEQ ID NO: 23519 - protein, 9 aa, Artificial Sequence
  Heterogeneous nuclear ribonucleoprotein L-like (131-139)
VYIAGQQAF

SEQ ID NO: 23520 - protein, 9 aa, Artificial Sequence
  Kinesin-like protein KIF3C (175-183)
VYIKDLSSF

SEQ ID NO: 23521 - protein, 9 aa, Artificial Sequence
  Ubiquitin carboxyl-terminal hydrolase 40 (308-316)
VYIKDVDHL

SEQ ID NO: 23522 - protein, 8 aa, Artificial Sequence
  26S proteasome non-ATPase regulatory subunit 8 (131-138)
VYIKHPVS

SEQ ID NO: 23523 - protein, 10 aa, Artificial Sequence
  Protocadherin gamma-A11 (898-907)
VYIPGSNATL

SEQ ID NO: 23524 - protein, 10 aa, Artificial Sequence
  Myotubularin (63-72)
VYITNYRLYL

SEQ ID NO: 23525 - protein, 9 aa, Artificial Sequence
  Polycystic kidney disease 2-like 1 protein (265-273)
VYNANINLF

SEQ ID NO: 23526 - protein, 9 aa, Artificial Sequence
  Intron-binding protein aquarius (344-352)
VYNMYMHLI

SEQ ID NO: 23527 - protein, 9 aa, Artificial Sequence
  Unconventional myosin-X (213-221)
VYNNNSSRF

SEQ ID NO: 23528 - protein, 9 aa, Artificial Sequence
  Exocyst complex component 6B (535-543)
VYNQIKEFI

SEQ ID NO: 23529 - protein, 9 aa, Artificial Sequence
  HLA class II histocompatibility antigen, DR beta 5 chain (96-104)
VYPARTQTL

SEQ ID NO: 23530 - protein, 9 aa, Artificial Sequence
  HLA class II histocompatibility antigen, DO beta chain (127-135)
VYPERTPLL

SEQ ID NO: 23531 - protein, 9 aa, Artificial Sequence
  tRNA-splicing endonuclease subunit Sen34 (246-254)
VYPGDPLRF

SEQ ID NO: 23532 - protein, 9 aa, Artificial Sequence
  Cullin-associated NEDD8-dissociated protein 1 (651-659)
VYPSSLSKI

SEQ ID NO: 23533 - protein, 10 aa, Artificial Sequence
  Zinc finger protein 529 (226-235)
VYQKIHNEKF

SEQ ID NO: 23534 - protein, 9 aa, Artificial Sequence
  DNA-directed RNA polymerase I subunit RPA1 (1314-1322)
VYQLRFQFL

SEQ ID NO: 23535 - protein, 9 aa, Artificial Sequence
  Protein CDV3 homolog (66-74)
VYRPPGARL

SEQ ID NO: 23536 - protein, 9 aa, Artificial Sequence
  Polynucleotide 5'-hydroxyl-kinase NOL9 (499-507)
VYTDFAFRI

SEQ ID NO: 23537 - protein, 9 aa, Artificial Sequence
  HEAT repeat-containing protein 5A (1098-1106)
VYTDRFHLI

SEQ ID NO: 23538 - protein, 9 aa, Artificial Sequence
  Ral GTPase-activating protein subunit beta (89-97)
VYTDWIMAL

SEQ ID NO: 23539 - protein, 9 aa, Artificial Sequence
  Kidney mitochondrial carrier protein 1 (125-133)
VYTHFLSSF

SEQ ID NO: 23540 - protein, 9 aa, Artificial Sequence
  Uncharacterized protein C18orf8 (400-408)
VYTHVLSAF

SEQ ID NO: 23541 - protein, 9 aa, Artificial Sequence
  Sprouty-related, EVH1 domain-containing protein 2 (80-88)
VYTKANPTF

SEQ ID NO: 23542 - protein, 9 aa, Artificial Sequence
  2'-5'-oligoadenylate synthase 3 (909-917)
VYVDLIHSY

SEQ ID NO: 23543 - protein, 8 aa, Artificial Sequence
  Melanoma-derived growth regulatory protein (70-77)
VYVFSKLK

SEQ ID NO: 23544 - protein, 10 aa, Artificial Sequence
  Long-chain fatty acid transport protein 1 (34-43)
VYVGSGGWRF

SEQ ID NO: 23545 - protein, 9 aa, Artificial Sequence
  Hemicentin-1 (4343-4351)
VYVKEPPVF

SEQ ID NO: 23546 - protein, 9 aa, Artificial Sequence
  AP-3 complex subunit mu-2 (274-282)
VYVKHNISF

SEQ ID NO: 23547 - protein, 10 aa, Artificial Sequence
  Large neutral amino acids transporter small subunit 1 (22-31)
VYVLTNLAYF

SEQ ID NO: 23548 - protein, 8 aa, Artificial Sequence
  Histone H2B type 2-F (40-47)
VYVYKVLK

SEQ ID NO: 23549 - protein, 9 aa, Artificial Sequence
  Leptin receptor gene-related protein (27-35)
VYWPLFVLI

SEQ ID NO: 23550 - protein, 9 aa, Artificial Sequence
  GDP-fucose protein O-fucosyltransferase 1 (6-14)
WARPLSVSF

SEQ ID NO: 23551 - protein, 22 aa, Artificial Sequence
  Modulator of apoptosis 1 (9-30)
WCRGMDMNPRKALLIAGISQSC

SEQ ID NO: 23552 - protein, 12 aa, Artificial Sequence
  Puromycin-sensitive aminopeptidase (479-490)
WESLENASGKPI

SEQ ID NO: 23553 - protein, 14 aa, Artificial Sequence
  Protein CREG1 (68-81)
WGALATISTLEAVR

SEQ ID NO: 23554 - protein, 15 aa, Artificial Sequence
  Protein CREG1 (68-82)
WGALATISTLEAVRG

SEQ ID NO: 23555 - protein, 6 aa, Artificial Sequence
  Dedicator of cytokinesis protein 9 (121-126)
WHLVNY

SEQ ID NO: 23556 - protein, 6 aa, Artificial Sequence
  Dedicator of cytokinesis protein 10 (114-119)
WHVVNY

SEQ ID NO: 23557 - protein, 6 aa, Artificial Sequence
  Forkhead box protein N2 (51-56)
WILDHF

SEQ ID NO: 23558 - protein, 9 aa, Artificial Sequence
  Neutral amino acid transporter A (155-163)
WIVDRTTTV

SEQ ID NO: 23559 - protein, 9 aa, Artificial Sequence
  Bifunctional glutamate/proline-tRNA ligase (616-624)
WLAETTHAL

SEQ ID NO: 23560 - protein, 10 aa, Artificial Sequence
  60S ribosomal protein L19 (4-13)
WLDPNETNEI

SEQ ID NO: 23561 - protein, 10 aa, Artificial Sequence
  Solute carrier family 12 member 2 (1012-1021)
WLFDDGGLTL

SEQ ID NO: 23562 - protein, 6 aa, Artificial Sequence
  Serine/arginine-rich splicing factor 6 (107-112)
WLFHTL

SEQ ID NO: 23563 - protein, 9 aa, Artificial Sequence
  Nuclear migration protein nudC (184-192)
WLIEDGKVV

SEQ ID NO: 23564 - protein, 6 aa, Artificial Sequence
  ATP-dependent RNA helicase DHX36 (885-890)
WLIYHL

SEQ ID NO: 23565 - protein, 11 aa, Artificial Sequence
  Liprin-beta-1 (649-659)
WLMEQGLGSYL

SEQ ID NO: 23566 - protein, 10 aa, Artificial Sequence
  Tuberin (56-65)
WLVGNKLVTV

SEQ ID NO: 23567 - protein, 9 aa, Artificial Sequence
  Vacuole membrane protein 1 (366-374)
WMFEKLVVV

SEQ ID NO: 23568 - protein, 9 aa, Artificial Sequence
  Hemicentin-1 (236-244)
WRIPFDPSL

SEQ ID NO: 23569 - protein, 9 aa, Artificial Sequence
  Hemicentin-2 (233-241)
WRLPFDPSL

SEQ ID NO: 23570 - protein, 47 aa, Artificial Sequence
  ATP synthase subunit epsilon, mitochondrial (5-51)
WRQAGLSYIRYSQICAKAVRDALKTEFKANAEKTSGSNVKIVKVKKE

SEQ ID NO: 23571 - protein, 9 aa, Artificial Sequence
  Pleckstrin homology domain-containing family B member 2 (27-35)
WSDGHLIYY

SEQ ID NO: 23572 - protein, 8 aa, Artificial Sequence
  Low-density lipoprotein receptor-related protein 2 (440-447)
WTDTVQNK

SEQ ID NO: 23573 - protein, 6 aa, Artificial Sequence
  Importin-7 (450-455)
WVLHYF

SEQ ID NO: 23574 - protein, 9 aa, Artificial Sequence
  Vimentin (290-298)
WYKSKFADL

SEQ ID NO: 23575 - protein, 8 aa, Artificial Sequence
  Suppressor of SWI4 1 homolog (25-32)
YAANPHSF

SEQ ID NO: 23576 - protein, 10 aa, Artificial Sequence
  Putative eukaryotic translation initiation factor 2 subunit 3-like protein (330-339)
YAAPGGLIGV

SEQ ID NO: 23577 - protein, 8 aa, Artificial Sequence
  A-kinase anchor protein 9 (284-291)
YADEKTLF

SEQ ID NO: 23578 - protein, 8 aa, Artificial Sequence
  E3 SUMO-protein ligase RanBP2 (3010-3017)
YADGEAKV

SEQ ID NO: 23579 - protein, 8 aa, Artificial Sequence
  Proteasome subunit beta type-4 (160-167)
YADGESFL

SEQ ID NO: 23580 - protein, 9 aa, Artificial Sequence
  ATP-binding cassette sub-family A member 2 (14-22)
YADKPAGTY

SEQ ID NO: 23581 - protein, 9 aa, Artificial Sequence
  Ankyrin repeat domain-containing protein 17 (1180-1188)
YAEVGRVLL

SEQ ID NO: 23582 - protein, 9 aa, Artificial Sequence
  Protein FAM208B (753-761)
YAFSLDSKY

SEQ ID NO: 23583 - protein, 10 aa, Artificial Sequence
  Heterogeneous nuclear ribonucleoprotein L (250-259)
YAKPTRLNVF

SEQ ID NO: 23584 - protein, 10 aa, Artificial Sequence
  Rho GTPase-activating protein 5 (623-632)
YALDGKIYEL

SEQ ID NO: 23585 - protein, 23 aa, Artificial Sequence
  Keratin, type I cytoskeletal 18 (273-295)
YALQMEQLNGILLHLESELAQTR

SEQ ID NO: 23586 - protein, 11 aa, Artificial Sequence
  NAD(P)H dehydrogenase (quinone) 1 (43-53)
YAMNFNPIISR

SEQ ID NO: 23587 - protein, 10 aa, Artificial Sequence
  Protein FAM73A (152-161)
YANGGLFSKY

SEQ ID NO: 23588 - protein, 9 aa, Artificial Sequence
  Coiled-coil domain-containing protein 34 (296-304)
YANGKLTGF

SEQ ID NO: 23589 - protein, 8 aa, Artificial Sequence
  Tubulin alpha-1C chain (173-180)
YARGHYTI

SEQ ID NO: 23590 - protein, 11 aa, Artificial Sequence
  Synaptojanin-2 (4-14)
YASGPAPPAGT

SEQ ID NO: 23591 - protein, 10 aa, Artificial Sequence
  Destrin (117-126)
YASSKDAIKK

SEQ ID NO: 23592 - protein, 9 aa, Artificial Sequence
  Tetratricopeptide repeat protein 14 (351-359)
YATKGSLNK

SEQ ID NO: 23593 - protein, 7 aa, Artificial Sequence
  Serine/threonine-protein kinase LATS1 (731-737)
YATKTLR

SEQ ID NO: 23594 - protein, 8 aa, Artificial Sequence
  MAGUK p55 subfamily member 5 (117-124)
YAVKILEI

SEQ ID NO: 23595 - protein, 9 aa, Artificial Sequence
  60S ribosomal protein L4 (52-60)
YAVSELAGH

SEQ ID NO: 23596 - protein, 8 aa, Artificial Sequence
  Melanoma-associated antigen 4 (232-239)
YDGREHTV

SEQ ID NO: 23597 - protein, 9 aa, Artificial Sequence
  Neurobeachin-like protein 1 (2364-2372)
YDRNISNYF

SEQ ID NO: 23598 - protein, 7 aa, Artificial Sequence
  Signal recognition particle subunit SRP68 (455-461)
YDRVLKY

SEQ ID NO: 23599 - protein, 9 aa, Artificial Sequence
  DNA topoisomerase 2-alpha (1082-1090)
YDSDPVKAW

SEQ ID NO: 23600 - protein, 9 aa, Artificial Sequence
  Seizure 6-like protein 2 (844-852)
YEAGDTREY

SEQ ID NO: 23601 - protein, 9 aa, Artificial Sequence
  Protein SSX5 (55-63)
YEAMTKLGF

SEQ ID NO: 23602 - protein, 9 aa, Artificial Sequence
  ATP-binding cassette sub-family C member 8 (1326-1334)
YEGLLAPSL

SEQ ID NO: 23603 - protein, 7 aa, Artificial Sequence
  L-dopachrome tautomerase (303-309)
YEGLLRR

SEQ ID NO: 23604 - protein, 8 aa, Artificial Sequence
  Melanophilin (122-129)
YEHVKARF

SEQ ID NO: 23605 - protein, 7 aa, Artificial Sequence
  Annexin A5 (94-100)
YELKHAL

SEQ ID NO: 23606 - protein, 9 aa, Artificial Sequence
  Gamma-secretase C-terminal fragment 59 (647-655)
YENPTYKFF

SEQ ID NO: 23607 - protein, 7 aa, Artificial Sequence
  39S ribosomal protein L20, mitochondrial (108-114)
YEPKTFK

SEQ ID NO: 23608 - protein, 9 aa, Artificial Sequence
  Migration stimulation factor FN70 (392-400)
YEQDQKYSF

SEQ ID NO: 23609 - protein, 12 aa, Artificial Sequence
  Spectrin beta chain, non-erythrocytic 5 (750-761)
YFADAAEAASWL

SEQ ID NO: 23610 - protein, 7 aa, Artificial Sequence
  Glia-derived nexin (200-206)
YFKGLWK

SEQ ID NO: 23611 - protein, 9 aa, Artificial Sequence
  Serine-tRNA ligase, cytoplasmic (194-202)
YFLKGVLVF

SEQ ID NO: 23612 - protein, 10 aa, Artificial Sequence
  Tyrosine-protein kinase receptor (124-133)
YGAAGGKGAK

SEQ ID NO: 23613 - protein, 10 aa, Artificial Sequence
  Hemoglobin subunit alpha (25-34)
YGAEALERMF

SEQ ID NO: 23614 - protein, 17 aa, Artificial Sequence
  Hemoglobin subunit alpha (25-41)
YGAEALERMFLSFPTTK

SEQ ID NO: 23615 - protein, 8 aa, Artificial Sequence
  Tubulin beta-6 chain (157-164)
YGDLNHLV

SEQ ID NO: 23616 - protein, 8 aa, Artificial Sequence
  WD repeat-containing protein 3 (588-595)
YGHKLPVI

SEQ ID NO: 23617 - protein, 9 aa, Artificial Sequence
  Translocating chain-associated membrane protein 1 (75-83)
YGIKDLATV

SEQ ID NO: 23618 - protein, 7 aa, Artificial Sequence
  U2 small nuclear ribonucleoprotein B'' (75-81)
YGKPMRI

SEQ ID NO: 23619 - protein, 7 aa, Artificial Sequence
  Nucleoporin NUP53 (179-185)
YGNILKH

SEQ ID NO: 23620 - protein, 9 aa, Artificial Sequence
  Filamin-A (1844-1852)
YGPGLTHGV

SEQ ID NO: 23621 - protein, 7 aa, Artificial Sequence
  Vacuolar protein sorting-associated protein 51 homolog (123-129)
YGQAVRY

SEQ ID NO: 23622 - protein, 7 aa, Artificial Sequence
  Serine palmitoyltransferase 3 (290-296)
YGQPRTR

SEQ ID NO: 23623 - protein, 7 aa, Artificial Sequence
  Tyrosine-protein kinase Fyn (385-391)
YGRFTIK

SEQ ID NO: 23624 - protein, 16 aa, Artificial Sequence
  Annexin A2 (24-39)
YGSVKAYTNFDAERDA

SEQ ID NO: 23625 - protein, 8 aa, Artificial Sequence
  Band 4.1-like protein 3 (187-194)
YGVDLHHA

SEQ ID NO: 23626 - protein, 7 aa, Artificial Sequence
  Parafibromin (315-321)
YHGMTLK

SEQ ID NO: 23627 - protein, 6 aa, Artificial Sequence
  Fibronectin type III domain-containing protein 3B (351-356)
YHVRVY

SEQ ID NO: 23628 - protein, 11 aa, Artificial Sequence
  cAMP-responsive element modulator (185-195)
YIAIAQGGTIQ

SEQ ID NO: 23629 - protein, 9 aa, Artificial Sequence
  HEAT repeat-containing protein 1 (1013-1021)
YIAKDLMKV

SEQ ID NO: 23630 - protein, 9 aa, Artificial Sequence
  Gamma-tubulin complex component 6 (1683-1691)
YIANQILHV

SEQ ID NO: 23631 - protein, 9 aa, Artificial Sequence
  CAAX prenyl protease 1 homolog (218-226)
YIAPLFDKF

SEQ ID NO: 23632 - protein, 12 aa, Artificial Sequence
  Serum albumin (287-298)
YICENQDSISSK

SEQ ID NO: 23633 - protein, 9 aa, Artificial Sequence
  Ankyrin-2 (1793-1801)
YIDEHGHTV

SEQ ID NO: 23634 - protein, 6 aa, Artificial Sequence
  E3 ubiquitin-protein ligase RNF216 (59-64)
YIDFKF

SEQ ID NO: 23635 - protein, 9 aa, Artificial Sequence
  Ribonuclease 3 (577-585)
YIDKDLEYV

SEQ ID NO: 23636 - protein, 9 aa, Artificial Sequence
  Eukaryotic translation initiation factor 3 subunit L (522-530)
YIDKDMIHI

SEQ ID NO: 23637 - protein, 8 aa, Artificial Sequence
  Receptor tyrosine-protein kinase erbB-3 (148-155)
YIEKNDKL

SEQ ID NO: 23638 - protein, 9 aa, Artificial Sequence
  Laminin subunit beta-1 (396-404)
YIEKVVYTV

SEQ ID NO: 23639 - protein, 8 aa, Artificial Sequence
  26S proteasome non-ATPase regulatory subunit 8 (132-139)
YIKHPVSL

SEQ ID NO: 23640 - protein, 8 aa, Artificial Sequence
  Retinoblastoma-like protein 2 (1013-1020)
YIKQIKTF

SEQ ID NO: 23641 - protein, 9 aa, Artificial Sequence
  Exostosin-2 (348-356)
YILPFSEVL

SEQ ID NO: 23642 - protein, 10 aa, Artificial Sequence
  E3 ubiquitin-protein ligase RNF114 (116-125)
YIMEGVKATI

SEQ ID NO: 23643 - protein, 9 aa, Artificial Sequence
  Cytoplasmic dynein 1 heavy chain 1 (2489-2497)
YIQRYLVYA

SEQ ID NO: 23644 - protein, 9 aa, Artificial Sequence
  Ceramide synthase 2 (78-86)
YIRAGTLIM

SEQ ID NO: 23645 - protein, 9 aa, Artificial Sequence
  Kinesin-like protein KIF11 (399-407)
YISEENFRV

SEQ ID NO: 23646 - protein, 8 aa, Artificial Sequence
  Cleft lip and palate transmembrane protein 1 (108-115)
YISEHEHF

SEQ ID NO: 23647 - protein, 9 aa, Artificial Sequence
  V-type proton ATPase subunit B, brain isoform (266-274)
YITEGQIYV

SEQ ID NO: 23648 - protein, 10 aa, Artificial Sequence
  E3 ubiquitin-protein ligase HERC2 (1123-1132)
YIVEGDFTGV

SEQ ID NO: 23649 - protein, 10 aa, Artificial Sequence
  Dedicator of cytokinesis protein 7 (457-466)
YIYPQSLNFA

SEQ ID NO: 23650 - protein, 7 aa, Artificial Sequence
  Eukaryotic peptide chain release factor GTP-binding subunit ERF3A (309-315)
YKDMGTV

SEQ ID NO: 23651 - protein, 7 aa, Artificial Sequence
  Store-operated calcium entry-associated regulatory factor (105-111)
YKFGKTV

SEQ ID NO: 23652 - protein, 7 aa, Artificial Sequence
  Ras-related protein Rab-20 (158-164)
YKKILKY

SEQ ID NO: 23653 - protein, 10 aa, Artificial Sequence
  Cytochrome c oxidase subunit 5B, mitochondrial (120-129)
YKLVPQQLAH

SEQ ID NO: 23654 - protein, 8 aa, Artificial Sequence
  Alpha-2-macroglobulin (163-170)
YKPGQTVK

SEQ ID NO: 23655 - protein, 8 aa, Artificial Sequence
  Fanconi anemia group I protein (1039-1046)
YKSPVILL

SEQ ID NO: 23656 - protein, 9 aa, Artificial Sequence
  Thioredoxin-interacting protein (221-229)
YLANGQTKV

SEQ ID NO: 23657 - protein, 10 aa, Artificial Sequence
  Laminin subunit gamma-1 (667-676)
YLDDVTLASA

SEQ ID NO: 23658 - protein, 9 aa, Artificial Sequence
  Dedicator of cytokinesis protein 7 (628-636)
YLDKFFALV

SEQ ID NO: 23659 - protein, 9 aa, Artificial Sequence
  Dedicator of cytokinesis protein 6 (723-731)
YLDKFFTLV

SEQ ID NO: 23660 - protein, 9 aa, Artificial Sequence
  Zinc finger protein 573 (42-50)
YLDPNQRDL

SEQ ID NO: 23661 - protein, 9 aa, Artificial Sequence
  Kinesin-like protein KIF13B (1105-1113)
YLDQQLQKL

SEQ ID NO: 23662 - protein, 8 aa, Artificial Sequence
  ATP-binding cassette sub-family E member 1 (491-498)
YLDSEQRL

SEQ ID NO: 23663 - protein, 9 aa, Artificial Sequence
  Laminin subunit beta-1 (1753-1761)
YLEDKAQEL

SEQ ID NO: 23664 - protein, 9 aa, Artificial Sequence
  Enhancer of mRNA-decapping protein 4 (906-914)
YLEEAVMHL

SEQ ID NO: 23665 - protein, 9 aa, Artificial Sequence
  Inositol-trisphosphate 3-kinase A (270-278)
YLEEELTKA

SEQ ID NO: 23666 - protein, 8 aa, Artificial Sequence
  Ubiquitin carboxyl-terminal hydrolase 7 (1093-1100)
YLEKAIKI

SEQ ID NO: 23667 - protein, 8 aa, Artificial Sequence
  Plectin (1070-1077)
YLEKLKTI

SEQ ID NO: 23668 - protein, 9 aa, Artificial Sequence
  Heparan-sulfate 6-O-sulfotransferase 2 (442-450)
YLFEKTFNM

SEQ ID NO: 23669 - protein, 9 aa, Artificial Sequence
  Thioredoxin domain-containing protein 16 (103-111)
YLFKGNILL

SEQ ID NO: 23670 - protein, 9 aa, Artificial Sequence
  Bax inhibitor 1 (186-194)
YLFLGGILM

SEQ ID NO: 23671 - protein, 9 aa, Artificial Sequence
  T-box transcription factor TBX3 (251-259)
YLFPETEFI

SEQ ID NO: 23672 - protein, 9 aa, Artificial Sequence
  Cyclin-dependent kinase 2 (107-115)
YLFQLLQGL

SEQ ID NO: 23673 - protein, 9 aa, Artificial Sequence
  Electroneutral sodium bicarbonate exchanger 1 (1036-1044)
YLGASNYRT

SEQ ID NO: 23674 - protein, 9 aa, Artificial Sequence
  Hexokinase-1 (749-757)
YLGEIVRNI

SEQ ID NO: 23675 - protein, 8 aa, Artificial Sequence
  Clustered mitochondria protein homolog (510-517)
YLGKVLEL

SEQ ID NO: 23676 - protein, 9 aa, Artificial Sequence
  Putative ATP-dependent RNA helicase DHX33 (179-187)
YLHAALVSV

SEQ ID NO: 23677 - protein, 7 aa, Artificial Sequence
  Rho-related BTB domain-containing protein 3 (560-566)
YLIFSQK

SEQ ID NO: 23678 - protein, 9 aa, Artificial Sequence
  E3 ubiquitin-protein ligase TRIM36 (266-274)
YLIGKESQV

SEQ ID NO: 23679 - protein, 9 aa, Artificial Sequence
  ER membrane protein complex subunit 4 (136-144)
YLIGNLMGL

SEQ ID NO: 23680 - protein, 9 aa, Artificial Sequence
  F-box only protein 21 (364-372)
YLIGQHVTA

SEQ ID NO: 23681 - protein, 9 aa, Artificial Sequence
  Dolichyl-diphosphooligosaccharide-proteinosyltransferase subunit 2 (343-351)
YLIIGDATL

SEQ ID NO: 23682 - protein, 10 aa, Artificial Sequence
  Nuclear export mediator factor NEMF (539-548)
YLIIGGRDQQ

SEQ ID NO: 23683 - protein, 9 aa, Artificial Sequence
  60S ribosomal protein L3 (286-294)
YLIKDGKLI

SEQ ID NO: 23684 - protein, 9 aa, Artificial Sequence
  WD repeat-containing protein 6 (703-711)
YLKDGDVML

SEQ ID NO: 23685 - protein, 7 aa, Artificial Sequence
  SFRS17A protein (23-29)
YLKPITK

SEQ ID NO: 23686 - protein, 10 aa, Artificial Sequence
  TRPM8 channel-associated factor 2 (446-455)
YLLEGQNAEV

SEQ ID NO: 23687 - protein, 9 aa, Artificial Sequence
  Maestro heat-like repeat-containing protein family member 7 (965-973)
YLLIPLLER

SEQ ID NO: 23688 - protein, 10 aa, Artificial Sequence
  Translocating chain-associated membrane protein 1 (211-220)
YLLNLNHLGL

SEQ ID NO: 23689 - protein, 10 aa, Artificial Sequence
  Synemin (706-715)
YLLSKDIKEV

SEQ ID NO: 23690 - protein, 11 aa, Artificial Sequence
  E3 ubiquitin-protein ligase RNF213 (2078-2088)
YLMDINGKMWL

SEQ ID NO: 23691 - protein, 9 aa, Artificial Sequence
  Nesprin-1 (1560-1568)
YLMEARYSL

SEQ ID NO: 23692 - protein, 9 aa, Artificial Sequence
  Leucine-rich repeat and calponin homology domain-containing protein 1 (147-155)
YLNLSRNQL

SEQ ID NO: 23693 - protein, 9 aa, Artificial Sequence
  Kinesin-like protein KIF13B (1450-1458)
YLNPVKSFV

SEQ ID NO: 23694 - protein, 9 aa, Artificial Sequence
  Inactive ubiquitin carboxyl-terminal hydrolase 53 (271-279)
YLPGLFYRV

SEQ ID NO: 23695 - protein, 9 aa, Artificial Sequence
  Sterol regulatory element-binding protein 1 (1096-1104)
YLPPGFLSA

SEQ ID NO: 23696 - protein, 9 aa, Artificial Sequence
  La-related protein 4 (424-432)
YLQKETSTL

SEQ ID NO: 23697 - protein, 10 aa, Artificial Sequence
  Calcium/calmodulin-dependent 3',5'-cyclic nucleotide phosphodiesterase 1C (18-27)
YLQPEQIEKI

SEQ ID NO: 23698 - protein, 6 aa, Artificial Sequence
  Tyrosine-protein phosphatase non-receptor type 23 (30-35)
YLREHF

SEQ ID NO: 23699 - protein, 10 aa, Artificial Sequence
  Ubiquitin-like modifier-activating enzyme 7 (247-256)
YLRGGAITEV

SEQ ID NO: 23700 - protein, 11 aa, Artificial Sequence
  Protein dopey-1 (743-753)
YLSAFLAACQL

SEQ ID NO: 23701 - protein, 10 aa, Artificial Sequence
  2-hydroxyacylsphingosine 1-beta-galactosyltransferase (299-308)
YLSEDIANKL

SEQ ID NO: 23702 - protein, 9 aa, Artificial Sequence
  Trafficking kinesin-binding protein 2 (496-504)
YLSEKQFFA

SEQ ID NO: 23703 - protein, 9 aa, Artificial Sequence
  Coatomer subunit beta' (490-498)
YLSEKVLAA

SEQ ID NO: 23704 - protein, 9 aa, Artificial Sequence
  Rho GTPase-activating protein 1 (214-222)
YLSELSEHV

SEQ ID NO: 23705 - protein, 8 aa, Artificial Sequence
  Polyadenylate-binding protein-interacting protein 1 (112-119)
YLSHHLTI

SEQ ID NO: 23706 - protein, 9 aa, Artificial Sequence
  Alpha-N-acetylglucosaminidase (583-591)
YLSKELASL

SEQ ID NO: 23707 - protein, 9 aa, Artificial Sequence
  Cytoplasmic dynein 1 heavy chain 1 (3552-3560)
YLSNADERL

SEQ ID NO: 23708 - protein, 9 aa, Artificial Sequence
  Serine/threonine-protein kinase A-Raf (529-537)
YLSPDLSKI

SEQ ID NO: 23709 - protein, 9 aa, Artificial Sequence
  UDP-glucose:glycoprotein glucosyltransferase 2 (1269-1277)
YLSPTFKEV

SEQ ID NO: 23710 - protein, 9 aa, Artificial Sequence
  Cathepsin D (150-158)
YLSQDTVSV

SEQ ID NO: 23711 - protein, 9 aa, Artificial Sequence
  Plexin-B3 (1418-1426)
YLTDIMRTL

SEQ ID NO: 23712 - protein, 14 aa, Artificial Sequence
  Plexin-B3 (1418-1431)
YLTDIMRTLLGDLA

SEQ ID NO: 23713 - protein, 9 aa, Artificial Sequence
  Alpha-1,3-mannosyl-glycoprotein 4-beta-N-acetylglucosaminyltransferase B (56-64)
YLTDTLHSL

SEQ ID NO: 23714 - protein, 9 aa, Artificial Sequence
  Apoptosis-associated speck-like protein containing a CARD (184-192)
YLVEDLERS

SEQ ID NO: 23715 - protein, 9 aa, Artificial Sequence
  Probable ATP-dependent RNA helicase DDX47 (248-256)
YLVYILNEL

SEQ ID NO: 23716 - protein, 7 aa, Artificial Sequence
  Serum albumin (162-168)
YLYEIAR

SEQ ID NO: 23717 - protein, 9 aa, Artificial Sequence
  Protein sel-1 homolog 1 (457-465)
YLYGRGVQV

SEQ ID NO: 23718 - protein, 10 aa, Artificial Sequence
  Probable G-protein coupled receptor 158 (82-91)
YLYTGDSHQL

SEQ ID NO: 23719 - protein, 9 aa, Artificial Sequence
  Cytochrome c oxidase subunit 7A-related protein, mitochondrial (106-114)
YMASQPKNK

SEQ ID NO: 23720 - protein, 9 aa, Artificial Sequence
  Hemicentin-2 (2923-2931)
YMCVAENQA

SEQ ID NO: 23721 - protein, 9 aa, Artificial Sequence
  Protein shisa-5 (129-137)
YMDAPKAAL

SEQ ID NO: 23722 - protein, 10 aa, Artificial Sequence
  Lysosomal-trafficking regulator (1891-1900)
YMNENGEFKL

SEQ ID NO: 23723 - protein, 9 aa, Artificial Sequence
  Phosphatidylinositol N-acetylglucosaminyltransferase subunit H (129-137)
YMQKVIYYL

SEQ ID NO: 23724 - protein, 8 aa, Artificial Sequence
  Transmembraneoprotein NMB (37-44)
YMREHNQL

SEQ ID NO: 23725 - protein, 6 aa, Artificial Sequence
  Histone-lysine N-methyltransferase ASH1L (2260-2265)
YNFHSF

SEQ ID NO: 23726 - protein, 9 aa, Artificial Sequence
  Actin-related protein 2 (225-233)
YNIEQEQKL

SEQ ID NO: 23727 - protein, 8 aa, Artificial Sequence
  26S proteasome non-ATPase regulatory subunit 8 (148-155)
YNKVFLAK

SEQ ID NO: 23728 - protein, 8 aa, Artificial Sequence
  Serine-protein kinase ATM (1148-1155)
YNRKSVLL

SEQ ID NO: 23729 - protein, 24 aa, Artificial Sequence
  Alanine-tRNA ligase, cytoplasmic (487-510)
YNYHLDSSGSYVFENTVATVMALR

SEQ ID NO: 23730 - protein, 8 aa, Artificial Sequence
  PHD finger protein 20 (103-110)
YPAKVTAV

SEQ ID NO: 23731 - protein, 9 aa, Artificial Sequence
  Supervillin (1594-1602)
YPARAPSVV

SEQ ID NO: 23732 - protein, 10 aa, Artificial Sequence
  Ras GTPase-activating protein nGAP (628-637)
YPDDRTSRTL

SEQ ID NO: 23733 - protein, 8 aa, Artificial Sequence
  Splicing factor 3B subunit 3 (520-527)
YPDGIRHI

SEQ ID NO: 23734 - protein, 9 aa, Artificial Sequence
  Vacuolar protein sorting-associated protein 13B (2316-2324)
YPEPRVLTL

SEQ ID NO: 23735 - protein, 8 aa, Artificial Sequence
  Constitutive coactivator of peroxisome proliferator-activated receptor gamma (665-672)
YPGNPLRH

SEQ ID NO: 23736 - protein, 7 aa, Artificial Sequence
  Heterogeneous nuclear ribonucleoprotein U-like protein 1 (369-375)
YPHVLVK

SEQ ID NO: 23737 - protein, 9 aa, Artificial Sequence
  Actin, cytoplasmic 2 (69-77)
YPIEHGIVT

SEQ ID NO: 23738 - protein, 9 aa, Artificial Sequence
  Isoleucine-tRNA ligase, cytoplasmic (845-853)
YPLKEIVVI

SEQ ID NO: 23739 - protein, 9 aa, Artificial Sequence
  Transmembrane protein 98 (147-155)
YPPLDPKLL

SEQ ID NO: 23740 - protein, 9 aa, Artificial Sequence
  Fatty aldehyde dehydrogenase (440-448)
YPPNSQSKV

SEQ ID NO: 23741 - protein, 11 aa, Artificial Sequence
  All-trans-retinol 13,14-reductase (15-25)
YPRGGSSEIAF

SEQ ID NO: 23742 - protein, 8 aa, Artificial Sequence
  Syntenin-1 (46-53)
YPRLYPEL

SEQ ID NO: 23743 - protein, 9 aa, Artificial Sequence
  Protocadherin gamma-C3 (569-577)
YPRPGGSSV

SEQ ID NO: 23744 - protein, 10 aa, Artificial Sequence
  Phosphatidylcholine translocator ABCB4 (403-412)
YPSRANVKIL

SEQ ID NO: 23745 - protein, 10 aa, Artificial Sequence
  AT-rich interactive domain-containing protein 1A (921-930)
YPYGGPYDRV

SEQ ID NO: 23746 - protein, 9 aa, Artificial Sequence
  Ataxin-2-like protein (1021-1029)
YPYIGHPQV

SEQ ID NO: 23747 - protein, 9 aa, Artificial Sequence
  Desmin (387-395)
YQDLLNVKM

SEQ ID NO: 23748 - protein, 9 aa, Artificial Sequence
  Laminin subunit beta-1 (934-942)
YQDPVTLQL

SEQ ID NO: 23749 - protein, 8 aa, Artificial Sequence
  Vimentin (358-365)
YQDTIGRL

SEQ ID NO: 23750 - protein, 12 aa, Artificial Sequence
  Regulator of nonsense transcripts 1 (154-165)
YQHGGVTGLSQY

SEQ ID NO: 23751 - protein, 8 aa, Artificial Sequence
  AP-5 complex subunit zeta-1 (389-396)
YQHLFTRI

SEQ ID NO: 23752 - protein, 7 aa, Artificial Sequence
  Cytoplasmic dynein 1 heavy chain 1 (2959-2965)
YQIKVHR

SEQ ID NO: 23753 - protein, 8 aa, Artificial Sequence
  Bardet-Biedl syndrome 4 protein (46-53)
YQKAFEHL

SEQ ID NO: 23754 - protein, 9 aa, Artificial Sequence
  Remodeling and spacing factor 1 (52-60)
YQLDQDHNV

SEQ ID NO: 23755 - protein, 9 aa, Artificial Sequence
  Exportin-7 (341-349)
YQLGELVKV

SEQ ID NO: 23756 - protein, 9 aa, Artificial Sequence
  T-box transcription factor TBX3 (264-272)
YQNDKITQL

SEQ ID NO: 23757 - protein, 8 aa, Artificial Sequence
  Rho GTPase-activating protein 5 (414-421)
YQNHVQHL

SEQ ID NO: 23758 - protein, 8 aa, Artificial Sequence
  Zinc finger MYM-type protein 4 (345-352)
YQNVVHKL

SEQ ID NO: 23759 - protein, 8 aa, Artificial Sequence
  Signal transducer and activator of transcription 6 (88-95)
YQRDPLKL

SEQ ID NO: 23760 - protein, 9 aa, Artificial Sequence
  TBC1 domain family member 16 (260-268)
YQTDYFHLF

SEQ ID NO: 23761 - protein, 10 aa, Artificial Sequence
  Fatty acid synthase (959-968)
YQWDDPDPRL

SEQ ID NO: 23762 - protein, 8 aa, Artificial Sequence
  Homeodomain-interacting protein kinase 4 (181-188)
YRAPEILL

SEQ ID NO: 23763 - protein, 8 aa, Artificial Sequence
  Glycogen synthase kinase-3 beta (222-229)
YRAPELIF

SEQ ID NO: 23764 - protein, 9 aa, Artificial Sequence
  Protocadherin gamma-C3 (727-735)
YRAPVSSLY

SEQ ID NO: 23765 - protein, 9 aa, Artificial Sequence
  Proteasome subunit beta type-4 (223-231)
YRDARSYNR

SEQ ID NO: 23766 - protein, 8 aa, Artificial Sequence
  Pyruvate kinase PKM (392-399)
YRGIFPVL

SEQ ID NO: 23767 - protein, 12 aa, Artificial Sequence
  Alpha-enolase (33-44)
YRHIADLAGNSE

SEQ ID NO: 23768 - protein, 11 aa, Artificial Sequence
  Chondroitin sulfate proteoglycan 4 (1979-1989)
YRLIQGPQYGH

SEQ ID NO: 23769 - protein, 9 aa, Artificial Sequence
  SLIT and NTRK-like protein 2 (712-720)
YRNLQEFSY

SEQ ID NO: 23770 - protein, 8 aa, Artificial Sequence
  HIG1 domain family member 2A, mitochondrial (29-36)
YRNPESFK

SEQ ID NO: 23771 - protein, 9 aa, Artificial Sequence
  Glycogen phosphorylase, brain form (792-800)
YRNPKEWTK

SEQ ID NO: 23772 - protein, 8 aa, Artificial Sequence
  Dual specificity protein kinase CLK3 (317-324)
YRPPEVIL

SEQ ID NO: 23773 - protein, 7 aa, Artificial Sequence
  Chromodomain-helicase-DNA-binding protein 4 (169-175)
YRTLTNY

SEQ ID NO: 23774 - protein, 9 aa, Artificial Sequence
  ATP-dependent RNA helicase DDX3X (243-251)
YSDGPGEAL

SEQ ID NO: 23775 - protein, 10 aa, Artificial Sequence
  Transcription factor SOX-10 (402-411)
YSDHQPSGPY

SEQ ID NO: 23776 - protein, 11 aa, Artificial Sequence
  Transcription factor SOX-10 (402-412)
YSDHQPSGPYY

SEQ ID NO: 23777 - protein, 9 aa, Artificial Sequence
  Rab3 effector-like (158-166)
YSDPFVKVY

SEQ ID NO: 23778 - protein, 12 aa, Artificial Sequence
  Lysosomal-trafficking regulator (864-875)
YSDSPQSLSKFY

SEQ ID NO: 23779 - protein, 9 aa, Artificial Sequence
  Unconventional myosin-XVIIIa (454-462)
YSEKVMHMF

SEQ ID NO: 23780 - protein, 9 aa, Artificial Sequence
  DNA polymerase alpha catalytic subunit (732-740)
YSESSQLLY

SEQ ID NO: 23781 - protein, 10 aa, Artificial Sequence
  AF4/FMR2 family member 4 (970-979)
YSETVDLIKY

SEQ ID NO: 23782 - protein, 8 aa, Artificial Sequence
  CDK5 regulatory subunit-associated protein 3 (494-501)
YSGRPVNL

SEQ ID NO: 23783 - protein, 7 aa, Artificial Sequence
  SAM and SH3 domain-containing protein 1 (307-313)
YSGVHKK

SEQ ID NO: 23784 - protein, 9 aa, Artificial Sequence
  Nucleolar pre-ribosomal-associated protein 1 (1469-1477)
YSHLEGARF

SEQ ID NO: 23785 - protein, 8 aa, Artificial Sequence
  Inositol 1,4,5-trisphosphate receptor type 3 (2259-2266)
YSIRPLIV

SEQ ID NO: 23786 - protein, 7 aa, Artificial Sequence
  Rho-associated protein kinase 1 (287-293)
YSKIMNH

SEQ ID NO: 23787 - protein, 7 aa, Artificial Sequence
  Proteasome activator complex subunit 4 (40-46)
YSKTEHL

SEQ ID NO: 23788 - protein, 9 aa, Artificial Sequence
  Melanoma-associated antigen D2 (326-334)
YSLEKVFGI

SEQ ID NO: 23789 - protein, 16 aa, Artificial Sequence
  PERQ amino acid-rich with GYF domain-containing protein 1 (739-754)
YSLHGSSGEIESVDDY

SEQ ID NO: 23790 - protein, 8 aa, Artificial Sequence
  60S ribosomal protein L6 (63-70)
YSRKAMYK

SEQ ID NO: 23791 - protein, 8 aa, Artificial Sequence
  BTB/POZ domain-containing protein KCTD20 (143-150)
YSSKLYRF

SEQ ID NO: 23792 - protein, 14 aa, Artificial Sequence
  Eukaryotic translation initiation factor 3 subunit D (59-72)
YSSQFGGGSQYAYF

SEQ ID NO: 23793 - protein, 9 aa, Artificial Sequence
  Bromo adjacent homology domain-containing 1 protein (744-752)
YSTPPHRTV

SEQ ID NO: 23794 - protein, 23 aa, Artificial Sequence
  Actin, gamma-enteric smooth muscle (295-317)
YSVWIGGSILASLSTFQQMWISK

SEQ ID NO: 23795 - protein, 36 aa, Artificial Sequence
  Actin, cytoplasmic 2 (337-372)
YSVWIGGSILASLSTFQQMWISKQEYDESGPSIVHR

SEQ ID NO: 23796 - protein, 9 aa, Artificial Sequence
  Uncharacterized protein C5orf34 (326-334)
YSYPELVKM

SEQ ID NO: 23797 - protein, 9 aa, Artificial Sequence
  Citrate synthase, mitochondrial (189-197)
YTDHQFTEL

SEQ ID NO: 23798 - protein, 8 aa, Artificial Sequence
  Guanine nucleotide-binding protein subunit beta-2-like 1 (302-309)
YTDNLVRV

SEQ ID NO: 23799 - protein, 10 aa, Artificial Sequence
  Transcription factor SOX-10 (369-378)
YTDQPSTSQI

SEQ ID NO: 23800 - protein, 8 aa, Artificial Sequence
  WD repeat-containing protein 1 (54-61)
YTEHAHQV

SEQ ID NO: 23801 - protein, 7 aa, Artificial Sequence
  Protocadherin Fat 2 (2518-2524)
YTIINKL

SEQ ID NO: 23802 - protein, 8 aa, Artificial Sequence
  1,2-dihydroxy-3-keto-5-methylthiopentene dioxygenase (142-149)
YTKAMRLF

SEQ ID NO: 23803 - protein, 13 aa, Artificial Sequence
  Syndecan-3 (419-431)
YTLEEPKQASVTY

SEQ ID NO: 23804 - protein, 9 aa, Artificial Sequence
  Trophinin (94-102)
YTLEKMFRV

SEQ ID NO: 23805 - protein, 9 aa, Artificial Sequence
  Zinc finger E-box-binding homeobox 2 (504-512)
YTLEKVNEA

SEQ ID NO: 23806 - protein, 10 aa, Artificial Sequence
  Probable ATP-dependent RNA helicase DDX5 (540-549)
YTNGSFGSNF

SEQ ID NO: 23807 - protein, 22 aa, Artificial Sequence
  Fructose-bisphosphate aldolase A (397-418)
YTPSGQAGAAASESLFVSNHAY

SEQ ID NO: 23808 - protein, 9 aa, Artificial Sequence
  DNA replication licensing factor MCM3 (251-259)
YTSGTFRTV

SEQ ID NO: 23809 - protein, 14 aa, Artificial Sequence
  Melanocyte protein PMEL (265-278)
YTWDFGDSSGTLIS

SEQ ID NO: 23810 - protein, 17 aa, Artificial Sequence
  Melanocyte protein PMEL (265-281)
YTWDFGDSSGTLISRAL

SEQ ID NO: 23811 - protein, 10 aa, Artificial Sequence
  Adenylate cyclase type 6 (111-120)
YVACALLVFC

SEQ ID NO: 23812 - protein, 10 aa, Artificial Sequence
  Lysine-specific histone demethylase 1A (121-130)
YVADLGAMVV

SEQ ID NO: 23813 - protein, 8 aa, Artificial Sequence
  HLA class I histocompatibility antigen, B-49 alpha chain (51-58)
YVDDTLFV

SEQ ID NO: 23814 - protein, 8 aa, Artificial Sequence
  HLA class I histocompatibility antigen, B-13 alpha chain (26-33)
YVDDTQFV

SEQ ID NO: 23815 - protein, 10 aa, Artificial Sequence
  HLA class I histocompatibility antigen, Cw-5 alpha chain (51-60)
YVDDTQFVQF

SEQ ID NO: 23816 - protein, 11 aa, Artificial Sequence
  HLA class I histocompatibility antigen, B-13 alpha chain (26-36)
YVDDTQFVRFD

SEQ ID NO: 23817 - protein, 12 aa, Artificial Sequence
  HLA class I histocompatibility antigen, B-13 alpha chain (26-37)
YVDDTQFVRFDS

SEQ ID NO: 23818 - protein, 10 aa, Artificial Sequence
  Helicase SKI2W (1066-1075)
YVDEAGTVKL

SEQ ID NO: 23819 - protein, 10 aa, Artificial Sequence
  40S ribosomal protein S16 (98-107)
YVDEASKKEI

SEQ ID NO: 23820 - protein, 8 aa, Artificial Sequence
  Angiomotin-like protein 1 (605-612)
YVEKVEKL

SEQ ID NO: 23821 - protein, 8 aa, Artificial Sequence
  Angiomotin-like protein 2 (482-489)
YVEKVERL

SEQ ID NO: 23822 - protein, 7 aa, Artificial Sequence
  Melanoma-derived growth regulatory protein (71-77)
YVFSKLK

SEQ ID NO: 23823 - protein, 9 aa, Artificial Sequence
  Glutamine-tRNA ligase (632-640)
YVIELQHVV

SEQ ID NO: 23824 - protein, 10 aa, Artificial Sequence
  E3 ubiquitin-protein ligase Arkadia (683-692)
YVIPHPVHAF

SEQ ID NO: 23825 - protein, 9 aa, Artificial Sequence
  Apoptosis-resistant E3 ubiquitin protein ligase 1 (356-364)
YVSPKQFSV

SEQ ID NO: 23826 - protein, 8 aa, Artificial Sequence
  Signal transducer and activator of transcription 2 (829-836)
YVSRPSHF

SEQ ID NO: 23827 - protein, 9 aa, Artificial Sequence
  Serine/threonine-protein kinase SMG1 (424-432)
YVTDVLYRV

SEQ ID NO: 23828 - protein, 12 aa, Artificial Sequence
  Filamin-A (2047-2058)
YVTEIDQDKYAV

SEQ ID NO: 23829 - protein, 9 aa, Artificial Sequence
  Fructose-bisphosphate aldolase A (258-266)
YVTEKVLAA

SEQ ID NO: 23830 - protein, 9 aa, Artificial Sequence
  Tensin-1 (17-25)
YVTERIIAV

SEQ ID NO: 23831 - protein, 9 aa, Artificial Sequence
  Membrane-associated transporter protein (55-63)
YVTPVLLSV

SEQ ID NO: 23832 - protein, 10 aa, Artificial Sequence
  Attractin (187-196)
YVYDGDSIYA

SEQ ID NO: 23833 - protein, 7 aa, Artificial Sequence
  Histone H2B type 2-F (41-47)
YVYKVLK

SEQ ID NO: 23834 - protein, 7 aa, Artificial Sequence
  40S ribosomal protein S29 (7-13)
YWSHPRK

SEQ ID NO: 23835 - protein, 32 aa, Artificial Sequence
  Keratin, type I cytoskeletal 18 (212-243)
YWSQQIEESTTVVTTQSAEVGAAETTLTELRR

SEQ ID NO: 23836 - protein, 9 aa, Artificial Sequence
  Dual specificity tyrosine-phosphorylation-regulated kinase 1A (471-479)
YYALQHSFF

SEQ ID NO: 23837 - protein, 9 aa, Artificial Sequence
  Cap-specific mRNAucleoside-2'-O-)-methyltransferase 1 (795-803)
YYGRLFWEW

SEQ ID NO: 23838 - protein, 9 aa, Artificial Sequence
  Motile sperm domain-containing protein 2 (174-182)
YYPKYLSKI

SEQ ID NO: 23839 - protein, 9 aa, Artificial Sequence
  Procollagen-lysine,2-oxoglutarate 5-dioxygenase 2 (114-122)
YYTKGFALL

SEQ ID NO: 23840 - protein, 9 aa, Artificial Sequence
  Receptor-type protein tyrosine phosphatase beta (1197-1205)
YYTVRNFTL

SEQ ID NO: 23841 - protein, 9 aa, Artificial Sequence
  CASP8 and FADD-like apoptosis regulator (367-375)
YYVWLQHTL

SEQ ID NO: 23842 - protein, 9 aa, Artificial Sequence
  Tyrosine-protein kinase JAK1 (67-75)
ALYDENTKL

SEQ ID NO: 23843 - protein, 9 aa, Artificial Sequence
  RNA-binding protein 4 (259-267)
AMASHLTST

SEQ ID NO: 23844 - protein, 9 aa, Artificial Sequence
  Neuroligin-3 (389-397)
EGLKFVEGV

SEQ ID NO: 23845 - protein, 9 aa, Artificial Sequence
  StAR-related lipid transfer protein 7, mitochondrial (235-243)
GMPDFLEKL

SEQ ID NO: 23846 - protein, 9 aa, Artificial Sequence
  Katanin p60 ATPase-containing subunit A1 (77-85)
KLDSTPLKA

SEQ ID NO: 23847 - protein, 9 aa, Artificial Sequence
  YrdC domain-containing protein, mitochondrial (184-192)
QMFEGPLAL

SEQ ID NO: 23848 - protein, 9 aa, Artificial Sequence
  Protein FAM72C (114-122)
RLDSTGVNV

SEQ ID NO: 23849 - protein, 11 aa, Artificial Sequence
  ATP-dependent RNA helicase DHX36 (643-653)
RLMDPPSNEAV

SEQ ID NO: 23850 - protein, 9 aa, Artificial Sequence
  Serine/arginine repetitive matrix protein 2 (2370-2378)
RMAPALSGA

SEQ ID NO: 23851 - protein, 9 aa, Artificial Sequence
  Nuclear receptor coactivator 1 (835-843)
RMDGAVTSV

SEQ ID NO: 23852 - protein, 9 aa, Artificial Sequence
  Ethanolamine kinase 1 (232-240)
RQLAKIHAI

SEQ ID NO: 23853 - protein, 9 aa, Artificial Sequence
  Clathrin heavy chain 1 (1039-1047)
RVMEYINRL

SEQ ID NO: 23854 - protein, 9 aa, Artificial Sequence
  Large proline-rich protein BAG6 (530-538)
SLAQMVSGL

SEQ ID NO: 23855 - protein, 9 aa, Artificial Sequence
  Mediator of RNA polymerase II transcription subunit 8 (11-19)
SLDALLSQV

SEQ ID NO: 23856 - protein, 11 aa, Artificial Sequence
  Cathepsin L1 (247-257)
VAIDAGHESFL

SEQ ID NO: 23857 - protein, 9 aa, Artificial Sequence
  UDP-glucose:glycoprotein glucosyltransferase 2 (187-195)
YAEMGTRTF

SEQ ID NO: 23858 - protein, 10 aa, Artificial Sequence
  Alkyldihydroxyacetonephosphate synthase, peroxisomal (308-317)
STVGGWVSTR

SEQ ID NO: 23859 - protein, 18 aa, Artificial Sequence
  Paired box protein Pax-2 (160-177)
APGHTIVPSTASPPVSSA

SEQ ID NO: 23860 - protein, 15 aa, Artificial Sequence
  Glutamyl aminopeptidase (290-304)
AVHQFDSVKRISNSG

SEQ ID NO: 23861 - protein, 8 aa, Artificial Sequence
  Inositol 1,4,5-trisphosphate receptor type 3 (333-340)
DILIRTEL

SEQ ID NO: 23862 - protein, 9 aa, Artificial Sequence
  Fatty acid synthase (1644-1652)
EAASVPVVY

SEQ ID NO: 23863 - protein, 12 aa, Artificial Sequence
  POTE ankyrin domain family member E (1064-1075)
ESGPSIVHRKCF

SEQ ID NO: 23864 - protein, 9 aa, Artificial Sequence
  Beta-1-syntrophin (163-171)
LADPENRQL

SEQ ID NO: 23865 - protein, 9 aa, Artificial Sequence
  Egl nine homolog 3 (194-202)
NPHEVQPSY

SEQ ID NO: 23866 - protein, 8 aa, Artificial Sequence
  GRB2-related adapter protein (34-41)
QNWYKAEL

SEQ ID NO: 23867 - protein, 9 aa, Artificial Sequence
  Protein-lysine 6-oxidase (86-94)
QPRTPILLI

SEQ ID NO: 23868 - protein, 8 aa, Artificial Sequence
  Adenomatous polyposis coli protein (222-229)
QQIEKDIL

SEQ ID NO: 23869 - protein, 9 aa, Artificial Sequence
  Insulin-like growth factor-binding protein 3 (5-13)
RPTLWAAAL

SEQ ID NO: 23870 - protein, 14 aa, Artificial Sequence
  Thrombospondin-1 (56-69)
SPAFRIEDANLIPP

SEQ ID NO: 23871 - protein, 10 aa, Artificial Sequence
  Epidermal growth factor receptor (1026-1035)
SPSTSRTPLL

SEQ ID NO: 23872 - protein, 16 aa, Artificial Sequence
  Thrombospondin-2 (96-111)
SRGTLLALEGPGLSQR

SEQ ID NO: 23873 - protein, 9 aa, Artificial Sequence
  Transforming growth factor beta-1 (263-271)
TPLERAQHL

SEQ ID NO: 23874 - protein, 17 aa, Artificial Sequence
  Transforming growth factor-beta-induced protein ig-h3 (579-595)
VSGGIGALVRLKSLQGD

SEQ ID NO: 23875 - protein, 10 aa, Artificial Sequence
  Matrilysin (167-176)
YPFDGPGNTL

SEQ ID NO: 23876 - protein, 10 aa, Artificial Sequence
  Cytochrome b-c1 complex subunit Rieske, mitochondrial (82-91)
DIKVPDFSEY

SEQ ID NO: 23877 - protein, 12 aa, Artificial Sequence
  Thioredoxin-related transmembrane protein 4 (92-103)
DVIQEPGLSGRF

SEQ ID NO: 23878 - protein, 12 aa, Artificial Sequence
  Keratin, type I cytoskeletal 9 (29-40)
EEANNDLENKIQ

SEQ ID NO: 23879 - protein, 14 aa, Artificial Sequence
  POTE ankyrin domain family member E (805-818)
LTEAPLNPKANREK

SEQ ID NO: 23880 - protein, 17 aa, Artificial Sequence
  POTE ankyrin domain family member E (805-821)
LTEAPLNPKANREKMTQ

SEQ ID NO: 23881 - protein, 12 aa, Artificial Sequence
  40S ribosomal protein S21 (35-46)
NVAEVDKVTGRF

SEQ ID NO: 23882 - protein, 9 aa, Artificial Sequence
  Keratin, type II cytoskeletal 2 epidermal (170-178)
NVKVDPEIQ

SEQ ID NO: 23883 - protein, 18 aa, Artificial Sequence
  Heat shock protein beta-1 (188-205)
RAQLGGPEAAKSDETAAK

SEQ ID NO: 23884 - protein, 11 aa, Artificial Sequence
  Actin, alpha skeletal muscle (2-12)
REIVRDIKEKL

SEQ ID NO: 23885 - protein, 14 aa, Artificial Sequence
  ATP synthase subunit gamma, mitochondrial (176-189)
SGYEFDEGSIIFNK

SEQ ID NO: 23886 - protein, 12 aa, Artificial Sequence
  Fibronectin (1340-1351)
SVYEQHESTPLR

SEQ ID NO: 23887 - protein, 16 aa, Artificial Sequence
  Vimentin (38-53)
YSLGSALRPSTSRSLY

SEQ ID NO: 23888 - protein, 9 aa, Artificial Sequence
  Guanylate kinase (10-18)
AAAALGRAP

SEQ ID NO: 23889 - protein, 9 aa, Artificial Sequence
  T-box transcription factor TBX2 (59-67)
AAAEAGLHV

SEQ ID NO: 23890 - protein, 12 aa, Artificial Sequence
  Heterogeneous nuclear ribonucleoprotein L (36-47)
AAAGGGGGGGRY

SEQ ID NO: 23891 - protein, 13 aa, Artificial Sequence
  Heterogeneous nuclear ribonucleoprotein L (36-48)
AAAGGGGGGGRYY

SEQ ID NO: 23892 - protein, 8 aa, Artificial Sequence
  Exocyst complex component 4 (16-23)
AAAHSVVL

SEQ ID NO: 23893 - protein, 9 aa, Artificial Sequence
  Fumarate hydratase, mitochondrial (155-163)
AAAIEVHEV

SEQ ID NO: 23894 - protein, 9 aa, Artificial Sequence
  Calcium-binding mitochondrial carrier protein Aralar2 (2-10)
AAAKVALTK

SEQ ID NO: 23895 - protein, 9 aa, Artificial Sequence
  ATP-binding cassette sub-family B member 10, mitochondrial (226-234)
AAANAIRVY

SEQ ID NO: 23896 - protein, 11 aa, Artificial Sequence
  Iroquois-class homeodomain protein IRX-2 (414-424)
AAAPGEALHTA

SEQ ID NO: 23897 - protein, 8 aa, Artificial Sequence
  Bcl-2-binding component 3 (195-202)
AAAPPLTL

SEQ ID NO: 23898 - protein, 9 aa, Artificial Sequence
  Polyadenylate-binding protein 4 (547-555)
AAAPPQEQK

SEQ ID NO: 23899 - protein, 9 aa, Artificial Sequence
  Protein Shroom2 (289-297)
AAAQHFTAL

SEQ ID NO: 23900 - protein, 9 aa, Artificial Sequence
  LRRN4 C-terminal-like protein (230-238)
AAARAAGAL

SEQ ID NO: 23901 - protein, 10 aa, Artificial Sequence
  Pyridoxal-dependent decarboxylase domain-containing protein 1 (179-188)
AAARPGLGQY

SEQ ID NO: 23902 - protein, 9 aa, Artificial Sequence
  T-complex protein 1 subunit alpha (24-32)
AAASIANIV

SEQ ID NO: 23903 - protein, 9 aa, Artificial Sequence
  Neuronal pentraxin receptor (38-46)
AAASPGPQR

SEQ ID NO: 23904 - protein, 9 aa, Artificial Sequence
  Disco-interacting protein 2 homolog C (25-33)
AAAVDVRTW

SEQ ID NO: 23905 - protein, 11 aa, Artificial Sequence
  Tubulin beta-4B chain (10-20)
AACDPRHGRYL

SEQ ID NO: 23906 - protein, 9 aa, Artificial Sequence
  Cartilage-associated protein (245-253)
AACEGSREI

SEQ ID NO: 23907 - protein, 9 aa, Artificial Sequence
  Phenylalanine-tRNA ligase alpha subunit (118-126)
AADGPRVFR

SEQ ID NO: 23908 - protein, 9 aa, Artificial Sequence
  Importin-4 (48-56)
AADPQIRQF

SEQ ID NO: 23909 - protein, 8 aa, Artificial Sequence
  UBA-like domain-containing protein 1 (24-31)
AADQAKQL

SEQ ID NO: 23910 - protein, 11 aa, Artificial Sequence
  Melanoma antigen preferentially expressed in tumors (59-69)
AAFDGRHSQTL

SEQ ID NO: 23911 - protein, 9 aa, Artificial Sequence
  Cleavage and polyadenylation specificity factor subunit 2 (121-129)
AAFDKIQQL

SEQ ID NO: 23912 - protein, 9 aa, Artificial Sequence
  Splicing factor 3B subunit 1 (744-752)
AAFLKAIGY

SEQ ID NO: 23913 - protein, 9 aa, Artificial Sequence
  V-type proton ATPase subunit H (287-295)
AAFRNFLEK

SEQ ID NO: 23914 - protein, 9 aa, Artificial Sequence
  Macrophage-capping protein (134-142)
AAIKKLYQV

SEQ ID NO: 23915 - protein, 9 aa, Artificial Sequence
  Ferritin heavy chain (81-89)
AAINRQINL

SEQ ID NO: 23916 - protein, 9 aa, Artificial Sequence
  Growth arrest-specific protein 8 (268-276)
AAIQEVQQK

SEQ ID NO: 23917 - protein, 9 aa, Artificial Sequence
  Malate dehydrogenase, cytoplasmic (114-122)
AALDKYAKK

SEQ ID NO: 23918 - protein, 11 aa, Artificial Sequence
  Numb-like protein (541-551)
AALEGKATVEK

SEQ ID NO: 23919 - protein, 9 aa, Artificial Sequence
  Leucine-rich repeat-containing protein 41 (525-533)
AAMKGNSTL

SEQ ID NO: 23920 - protein, 10 aa, Artificial Sequence
  Alkyldihydroxyacetonephosphate synthase, peroxisomal (76-85)
AAQESGTIPK

SEQ ID NO: 23921 - protein, 9 aa, Artificial Sequence
  HEAT repeat-containing protein 5B (541-549)
AAQNSRLSL

SEQ ID NO: 23922 - protein, 9 aa, Artificial Sequence
  cAMP-dependent protein kinase type I-alpha regulatory subunit (7-15)
AASEEARSL

SEQ ID NO: 23923 - protein, 9 aa, Artificial Sequence
  WD repeat-containing protein 54 (75-83)
AASGHFICV

SEQ ID NO: 23924 - protein, 9 aa, Artificial Sequence
  Sterol regulatory element-binding protein 2 (104-112)
AASPQAPTL

SEQ ID NO: 23925 - protein, 9 aa, Artificial Sequence
  Vesicle transport through interaction with t-SNAREs homolog 1B (5-13)
AASSEHFEK

SEQ ID NO: 23926 - protein, 9 aa, Artificial Sequence
  Actin, cytoplasmic 2 (21-29)
AASSSSLEK

SEQ ID NO: 23927 - protein, 9 aa, Artificial Sequence
  Talin-1 (770-778)
AATAVTQAL

SEQ ID NO: 23928 - protein, 9 aa, Artificial Sequence
  Serine/threonine-protein phosphatase 4 regulatory subunit 3B (382-390)
AATDIFSYL

SEQ ID NO: 23929 - protein, 9 aa, Artificial Sequence
  Long-chain fatty acid transport protein 1 (241-249)
AAVADPHSL

SEQ ID NO: 23930 - protein, 9 aa, Artificial Sequence
  Bifunctional apoptosis regulator (156-164)
AAVNPGRSL

SEQ ID NO: 23931 - protein, 11 aa, Artificial Sequence
  Ligand-dependent nuclear receptor-interacting factor 1 (176-186)
AAYEQSHFFNK

SEQ ID NO: 23932 - protein, 9 aa, Artificial Sequence
  Drebrin (97-105)
ACASHVAKV

SEQ ID NO: 23933 - protein, 9 aa, Artificial Sequence
  WASH complex subunit strumpellin (384-392)
ACDPNNKRL

SEQ ID NO: 23934 - protein, 9 aa, Artificial Sequence
  Zinc finger protein 106 (941-949)
ACLDKFVRV

SEQ ID NO: 23935 - protein, 11 aa, Artificial Sequence
  Fructose-bisphosphate aldolase A (33-43)
ADESTGSIAKR

SEQ ID NO: 23936 - protein, 11 aa, Artificial Sequence
  Selenoprotein N (53-63)
AEAQAAARQEL

SEQ ID NO: 23937 - protein, 11 aa, Artificial Sequence
  Myosin-11 (2-12)
AEAREKETKAL

SEQ ID NO: 23938 - protein, 9 aa, Artificial Sequence
  Tetratricopeptide repeat protein 37 (1248-1256)
AEDEKNTAL

SEQ ID NO: 23939 - protein, 9 aa, Artificial Sequence
  Heat shock factor protein 1 (137-145)
AEDPTISLL

SEQ ID NO: 23940 - protein, 10 aa, Artificial Sequence
  Melanoma antigen recognized by T-cells 1 (24-33)
AEEAAGIGIL

SEQ ID NO: 23941 - protein, 9 aa, Artificial Sequence
  Protein SFI1 homolog (356-364)
AEEPHALEL

SEQ ID NO: 23942 - protein, 11 aa, Artificial Sequence
  Metalloproteinase inhibitor 2 (114-124)
AEGDGKMHITL

SEQ ID NO: 23943 - protein, 9 aa, Artificial Sequence
  T-complex protein 1 subunit zeta (326-334)
AEHSESGQL

SEQ ID NO: 23944 - protein, 11 aa, Artificial Sequence
  ALK tyrosine kinase receptor (403-413)
AEIKTTNEVVL

SEQ ID NO: 23945 - protein, 11 aa, Artificial Sequence
  Junction plakoglobin (137-147)
AELATRALPEL

SEQ ID NO: 23946 - protein, 9 aa, Artificial Sequence
  E3 ubiquitin-protein ligase BRE1A (672-680)
AELEDLRQR

SEQ ID NO: 23947 - protein, 10 aa, Artificial Sequence
  Disheveled-associated activator of morphogenesis 2 (875-884)
AELEKEVGNL

SEQ ID NO: 23948 - protein, 10 aa, Artificial Sequence
  MAD2L1-binding protein (129-138)
AELESVLSHL

SEQ ID NO: 23949 - protein, 10 aa, Artificial Sequence
  Inactive ubiquitin carboxyl-terminal hydrolase 54 (1171-1180)
AEPDIYQEKL

SEQ ID NO: 23950 - protein, 11 aa, Artificial Sequence
  Stathmin-3 (108-118)
AERREHEREVL

SEQ ID NO: 23951 - protein, 8 aa, Artificial Sequence
  Cytoplasmic dynein 1 light intermediate chain 2 (86-93)
AESLPETL

SEQ ID NO: 23952 - protein, 10 aa, Artificial Sequence
  Neurosecretory protein VGF (183-192)
AETETRTHTL

SEQ ID NO: 23953 - protein, 9 aa, Artificial Sequence
  Gamma-interferon-inducible protein 16 (79-87)
AETLKKEKL

SEQ ID NO: 23954 - protein, 10 aa, Artificial Sequence
  Formin-binding protein 1-like (452-461)
AETMNNIDRL

SEQ ID NO: 23955 - protein, 10 aa, Artificial Sequence
  Tumor susceptibility gene 101 protein (282-291)
AEVDKNIELL

SEQ ID NO: 23956 - protein, 9 aa, Artificial Sequence
  Consortin (611-619)
AEVVPTEGL

SEQ ID NO: 23957 - protein, 9 aa, Artificial Sequence
  Nuclear mitotic apparatus protein 1 (857-865)
AGIESHSEL

SEQ ID NO: 23958 - protein, 9 aa, Artificial Sequence
  Nuclear receptor corepressor 2 (1168-1176)
AGPPESLGV

SEQ ID NO: 23959 - protein, 11 aa, Artificial Sequence
  Hermansky-Pudlak syndrome 5 protein (284-294)
AGSSQSLSFPK

SEQ ID NO: 23960 - protein, 9 aa, Artificial Sequence
  Actin-related protein 2/3 complex subunit 1B (24-32)
AICPNNHEV

SEQ ID NO: 23961 - protein, 14 aa, Artificial Sequence
  Syndecan-3 (292-305)
AIDSGSSAAQLPQK

SEQ ID NO: 23962 - protein, 9 aa, Artificial Sequence
  Ewing's tumor-associated antigen 1 (284-292)
AIFDGSTQK

SEQ ID NO: 23963 - protein, 11 aa, Artificial Sequence
  Tectonic-3 (478-488)
AIFGNADPAQK

SEQ ID NO: 23964 - protein, 9 aa, Artificial Sequence
  Kinesin-like protein KIF20B (640-648)
AIFKDLVGK

SEQ ID NO: 23965 - protein, 9 aa, Artificial Sequence
  Rho-related GTP-binding protein RhoQ (186-194)
AIIAILTPK

SEQ ID NO: 23966 - protein, 9 aa, Artificial Sequence
  Protein wntless homolog (4-12)
AIIENMSTK

SEQ ID NO: 23967 - protein, 9 aa, Artificial Sequence
  Eukaryotic translation initiation factor 3 subunit C-like protein (482-490)
AIIERVQRY

SEQ ID NO: 23968 - protein, 11 aa, Artificial Sequence
  40S ribosomal protein S17 (39-49)
AIIPSKKLRNK

SEQ ID NO: 23969 - protein, 10 aa, Artificial Sequence
  Ribulose-phosphate 3-epimerase (118-127)
AIKPGTSVEY

SEQ ID NO: 23970 - protein, 11 aa, Artificial Sequence
  Serine/threonine-protein kinase Sgk1 (47-57)
AIKPPLKAFMK

SEQ ID NO: 23971 - protein, 9 aa, Artificial Sequence
  NF-kappa-B inhibitor beta (102-110)
AILGETSTV

SEQ ID NO: 23972 - protein, 10 aa, Artificial Sequence
  GTP-binding protein Rheb (10-19)
AILGYRSVGK

SEQ ID NO: 23973 - protein, 11 aa, Artificial Sequence
  Fibroblast growth factor 14 isoform 6 (201-211)
AIMNGGKPVNK

SEQ ID NO: 23974 - protein, 9 aa, Artificial Sequence
  Puratrophin-1 (1020-1028)
AINDRTVNY

SEQ ID NO: 23975 - protein, 9 aa, Artificial Sequence
  Mitotic spindle assembly checkpoint protein MAD2A (123-131)
AIQDEIRSV

SEQ ID NO: 23976 - protein, 9 aa, Artificial Sequence
  Radixin (19-27)
AIQPNTTGK

SEQ ID NO: 23977 - protein, 11 aa, Artificial Sequence
  ATP-dependent 6-phosphofructokinase, platelet type (229-239)
AIYDGFDGFAK

SEQ ID NO: 23978 - protein, 13 aa, Artificial Sequence
  Cytochrome b-c1 complex subunit 9 (42-54)
AIYDHINEGKLWK

SEQ ID NO: 23979 - protein, 12 aa, Artificial Sequence
  Transcription initiation factor IIB (257-268)
AIYMASQASAEK

SEQ ID NO: 23980 - protein, 9 aa, Artificial Sequence
  Serine dehydratase-like (282-290)
AIYSGLLRR

SEQ ID NO: 23981 - protein, 13 aa, Artificial Sequence
  Keratin, type II cytoskeletal 1 (303-315)
AKLDNLQQEIDFL

SEQ ID NO: 23982 - protein, 8 aa, Artificial Sequence
  Kv channel-interacting protein 2 (72-79)
ALAAPASL

SEQ ID NO: 23983 - protein, 9 aa, Artificial Sequence
  GPI ethanolamine phosphate transferase 3 (917-925)
ALAASILRR

SEQ ID NO: 23984 - protein, 11 aa, Artificial Sequence
  Core histone macro-H2A.1 (296-306)
ALADDKKLKSI

SEQ ID NO: 23985 - protein, 11 aa, Artificial Sequence
  Phosphatidylinositol 3-kinase regulatory subunit beta (169-179)
ALADGIKSFLL

SEQ ID NO: 23986 - protein, 11 aa, Artificial Sequence
  Basement membrane-specific heparan sulfate proteoglycan core protein (1484-1494)
ALADLDELLIR

SEQ ID NO: 23987 - protein, 11 aa, Artificial Sequence
  Protein SHQ1 homolog (400-410)
ALAEALKEVSL

SEQ ID NO: 23988 - protein, 11 aa, Artificial Sequence
  Tropomodulin-1 (243-253)
ALAEMLKENKV

SEQ ID NO: 23989 - protein, 10 aa, Artificial Sequence
  Beta-1,4-glucuronyltransferase 1 (66-75)
ALASGGVLDA

SEQ ID NO: 23990 - protein, 9 aa, Artificial Sequence
  Zinc finger FYVE domain-containing protein 16 (1461-1469)
ALCPHLKTL

SEQ ID NO: 23991 - protein, 9 aa, Artificial Sequence
  V-type proton ATPase subunit F (77-85)
ALDAHQQSI

SEQ ID NO: 23992 - protein, 9 aa, Artificial Sequence
  17-beta-hydroxysteroid dehydrogenase 14 (169-177)
ALDESPYGV

SEQ ID NO: 23993 - protein, 11 aa, Artificial Sequence
  17-beta-hydroxysteroid dehydrogenase 14 (169-179)
ALDESPYGVRV

SEQ ID NO: 23994 - protein, 9 aa, Artificial Sequence
  Arf-GAP with SH3 domain, ANK repeat and PH domain-containing protein 1 (493-501)
ALDIAKRLK

SEQ ID NO: 23995 - protein, 9 aa, Artificial Sequence
  TATA box-binding protein-like protein 1 (8-16)
ALDILITNV

SEQ ID NO: 23996 - protein, 9 aa, Artificial Sequence
  Glutaminyl-peptide cyclotransferase (173-181)
ALDKKLLSL

SEQ ID NO: 23997 - protein, 11 aa, Artificial Sequence
  Pre-mRNA-processing factor 17 (138-148)
ALDPSLDNHQV

SEQ ID NO: 23998 - protein, 11 aa, Artificial Sequence
  60S ribosomal protein L7a (86-96)
ALDRQTATQLL

SEQ ID NO: 23999 - protein, 11 aa, Artificial Sequence
  Chromodomain-helicase-DNA-binding protein 1-like (822-832)
ALEEGLKKIFL

SEQ ID NO: 24000 - protein, 10 aa, Artificial Sequence
  Keratin, type I cytoskeletal 10 (217-226)
ALEEQLQQIR

SEQ ID NO: 24001 - protein, 9 aa, Artificial Sequence
  Ribonuclease pancreatic (2-10)
ALEKSLVRL

SEQ ID NO: 24002 - protein, 11 aa, Artificial Sequence
  Ribonuclease pancreatic (2-12)
ALEKSLVRLLL

SEQ ID NO: 24003 - protein, 13 aa, Artificial Sequence
  NADPH oxidase 5 (49-61)
ALFDSDRSGTITL

SEQ ID NO: 24004 - protein, 11 aa, Artificial Sequence
  Ankyrin repeat and SAM domain-containing protein 1A (255-265)
ALFGKTDVVQI

SEQ ID NO: 24005 - protein, 12 aa, Artificial Sequence
  Alpha-1,6-mannosylglycoprotein 6-beta-N-acetylglucosaminyltransferase A (2-13)
ALFTPWKLSSQK

SEQ ID NO: 24006 - protein, 11 aa, Artificial Sequence
  Cell division cycle protein 16 homolog (22-32)
ALFWADKVASL

SEQ ID NO: 24007 - protein, 9 aa, Artificial Sequence
  Cleft lip and palate transmembrane protein 1 (123-131)
ALFWEQHDL

SEQ ID NO: 24008 - protein, 12 aa, Artificial Sequence
  Ras-related protein Rab-27A (14-25)
ALGDSGVGKTSV

SEQ ID NO: 24009 - protein, 9 aa, Artificial Sequence
  Membrane-associated transporter protein (129-137)
ALIANPRRK

SEQ ID NO: 24010 - protein, 12 aa, Artificial Sequence
  E3 ubiquitin-protein ligase CBL-B (341-352)
ALIDGSREGFYL

SEQ ID NO: 24011 - protein, 10 aa, Artificial Sequence
  Polypyrimidine tract-binding protein 1 (173-182)
ALIDLHNHDL

SEQ ID NO: 24012 - protein, 9 aa, Artificial Sequence
  Protein S100-B (10-18)
ALIDVFHQY

SEQ ID NO: 24013 - protein, 11 aa, Artificial Sequence
  Melanoma-associated antigen C2 (196-206)
ALIEVGPDHFC

SEQ ID NO: 24014 - protein, 10 aa, Artificial Sequence
  Coatomer subunit zeta-1 (3-12)
ALILEPSLYT

SEQ ID NO: 24015 - protein, 9 aa, Artificial Sequence
  S-adenosylmethionine synthase isoform type-2 (221-229)
ALKEKVIKA

SEQ ID NO: 24016 - protein, 10 aa, Artificial Sequence
  Zinc finger protein 318 (262-271)
ALKEPQGNLY

SEQ ID NO: 24017 - protein, 9 aa, Artificial Sequence
  Spliceosome-associated protein CWC15 homolog (128-136)
ALLAELEKI

SEQ ID NO: 24018 - protein, 7 aa, Artificial Sequence
  Protein DGCR6L (54-60)
ALLDGTV

SEQ ID NO: 24019 - protein, 12 aa, Artificial Sequence
  Eukaryotic translation initiation factor 3 subunit C-like protein (633-644)
ALLDIQSSGRAK

SEQ ID NO: 24020 - protein, 12 aa, Artificial Sequence
  Neural Wiskott-Aldrich syndrome protein (408-419)
ALLDQIREGAQL

SEQ ID NO: 24021 - protein, 12 aa, Artificial Sequence
  Wiskott-Aldrich syndrome protein (433-444)
ALLDQIRQGIQL

SEQ ID NO: 24022 - protein, 11 aa, Artificial Sequence
  Serine/threonine-protein kinase PRP4 homolog (104-114)
ALLEDLEKQRA

SEQ ID NO: 24023 - protein, 10 aa, Artificial Sequence
  Melanoma antigen preferentially expressed in tumors (371-380)
ALLERASATL

SEQ ID NO: 24024 - protein, 10 aa, Artificial Sequence
  Cleft lip and palate transmembrane protein 1 (348-357)
ALLETNPYLL

SEQ ID NO: 24025 - protein, 15 aa, Artificial Sequence
  Proteasome subunit alpha type-7 (194-208)
ALLEVVQSGGKNIEL

SEQ ID NO: 24026 - protein, 10 aa, Artificial Sequence
  Ankyrin repeat domain-containing protein 17 (368-377)
ALLIERGASL

SEQ ID NO: 24027 - protein, 9 aa, Artificial Sequence
  Down syndrome critical region protein 3 (171-179)
ALLPKFLLR

SEQ ID NO: 24028 - protein, 9 aa, Artificial Sequence
  Melanoma antigen preferentially expressed in tumors (397-405)
ALLPSLSHC

SEQ ID NO: 24029 - protein, 9 aa, Artificial Sequence
  Neuronal membraneoprotein M6-b (96-104)
ALLSEVIQL

SEQ ID NO: 24030 - protein, 9 aa, Artificial Sequence
  Ragulator complex protein LAMTOR1 (52-60)
ALLSSILAK

SEQ ID NO: 24031 - protein, 9 aa, Artificial Sequence
  Sulfate transporter (523-531)
ALLSTEIGL

SEQ ID NO: 24032 - protein, 10 aa, Artificial Sequence
  Activator of 90 kDa heat shock protein ATPase homolog 1 (58-67)
ALMKEEGVKL

SEQ ID NO: 24033 - protein, 9 aa, Artificial Sequence
  rRNA 2'-O-methyltransferase fibrillarin (244-252)
ALNAHTFLR

SEQ ID NO: 24034 - protein, 11 aa, Artificial Sequence
  Catenin alpha-1 (363-373)
ALNSAIDKMTK

SEQ ID NO: 24035 - protein, 9 aa, Artificial Sequence
  Cytoglobin (88-96)
ALNTVVENL

SEQ ID NO: 24036 - protein, 9 aa, Artificial Sequence
  Growth/differentiation factor 15 (96-104)
ALPEGLPEA

SEQ ID NO: 24037 - protein, 9 aa, Artificial Sequence
  Homer protein homolog 3 (191-199)
ALQDSNNKL

SEQ ID NO: 24038 - protein, 11 aa, Artificial Sequence
  Metastasis suppressor protein 1 (165-175)
ALQDVNDKYLL

SEQ ID NO: 24039 - protein, 9 aa, Artificial Sequence
  1-acyl-sn-glycerol-3-phosphate acyltransferase gamma (283-291)
ALQEIYNQK

SEQ ID NO: 24040 - protein, 10 aa, Artificial Sequence
  Neuralized-like protein 4 (559-568)
ALRDGEVFQV

SEQ ID NO: 24041 - protein, 9 aa, Artificial Sequence
  Neurosecretory protein VGF (3-11)
ALRLSASAL

SEQ ID NO: 24042 - protein, 9 aa, Artificial Sequence
  Dystonin (375-383)
ALRPEVERL

SEQ ID NO: 24043 - protein, 12 aa, Artificial Sequence
  Vimentin (308-319)
ALRQAKQESTEY

SEQ ID NO: 24044 - protein, 9 aa, Artificial Sequence
  Coiled-coil domain-containing protein 154 (502-510)
ALRQELATL

SEQ ID NO: 24045 - protein, 15 aa, Artificial Sequence
  60S ribosomal protein L36 (2-16)
ALRYPMAVGLNKGHK

SEQ ID NO: 24046 - protein, 10 aa, Artificial Sequence
  Integrin alpha-V (893-902)
ALSEGDIHTL

SEQ ID NO: 24047 - protein, 9 aa, Artificial Sequence
  Kinesin-like protein KIF20B (1148-1156)
ALSELTQGV

SEQ ID NO: 24048 - protein, 9 aa, Artificial Sequence
  Ankycorbin (690-698)
ALSEMKSQY

SEQ ID NO: 24049 - protein, 9 aa, Artificial Sequence
  Lysine-specific demethylase 5A (119-127)
ALSKIVASK

SEQ ID NO: 24050 - protein, 9 aa, Artificial Sequence
  Probable phospholipid-transporting ATPase IIA (685-693)
ALSQFVIHR

SEQ ID NO: 24051 - protein, 9 aa, Artificial Sequence
  Chondroitin sulfate proteoglycan 4 (45-53)
ALTDIDLQL

SEQ ID NO: 24052 - protein, 9 aa, Artificial Sequence
  HRAS-like suppressor 3 (84-92)
ALTDKAIVK

SEQ ID NO: 24053 - protein, 9 aa, Artificial Sequence
  Neuroblastoma breakpoint family member 6 (396-404)
ALVDKIKKD

SEQ ID NO: 24054 - protein, 10 aa, Artificial Sequence
  Glycosylphosphatidylinositol anchor attachment 1 protein (38-47)
ALVFPPLTQR

SEQ ID NO: 24055 - protein, 12 aa, Artificial Sequence
  Nuclear nucleic acid-binding protein C1D (121-132)
ALWEPKSKNASK

SEQ ID NO: 24056 - protein, 9 aa, Artificial Sequence
  Separin (752-760)
ALWKELLTK

SEQ ID NO: 24057 - protein, 9 aa, Artificial Sequence
  Fucose mutarotase (91-99)
ALYGNLILR

SEQ ID NO: 24058 - protein, 9 aa, Artificial Sequence
  Proteasome subunit beta type-4 (6-14)
ALYRGPITR

SEQ ID NO: 24059 - protein, 9 aa, Artificial Sequence
  Mitofusin-2 (433-441)
AMAEEIRRL

SEQ ID NO: 24060 - protein, 11 aa, Artificial Sequence
  Methionine synthase (1208-1218)
AMAPASAVSGL

SEQ ID NO: 24061 - protein, 9 aa, Artificial Sequence
  Basement membrane-specific heparan sulfate proteoglycan core protein (3206-3214)
AMAPGAPQV

SEQ ID NO: 24062 - protein, 10 aa, Artificial Sequence
  Unconventional myosin-IXa (1913-1922)
AMDDGKSIRY

SEQ ID NO: 24063 - protein, 11 aa, Artificial Sequence
  Ubiquitin carboxyl-terminal hydrolase 4 (692-702)
AMDWDSETRRL

SEQ ID NO: 24064 - protein, 10 aa, Artificial Sequence
  Myosin regulatory light polypeptide 9 (24-33)
AMFDQSQIQE

SEQ ID NO: 24065 - protein, 12 aa, Artificial Sequence
  Eukaryotic translation initiation factor 3 subunit K (2-13)
AMFEQMRANVGK

SEQ ID NO: 24066 - protein, 12 aa, Artificial Sequence
  Exportin-4 (248-259)
AMFESSQNVLLK

SEQ ID NO: 24067 - protein, 9 aa, Artificial Sequence
  Ankyrin repeat domain-containing protein SOWAHC (349-357)
AMHGHVEVV

SEQ ID NO: 24068 - protein, 9 aa, Artificial Sequence
  Calpain-7 (409-417)
AMHSDSQTF

SEQ ID NO: 24069 - protein, 9 aa, Artificial Sequence
  Cytoplasmic FMR1-interacting protein 1 (490-498)
AMIKGLQVL

SEQ ID NO: 24070 - protein, 9 aa, Artificial Sequence
  DNA repair protein RAD50 (657-665)
AMLAGATAV

SEQ ID NO: 24071 - protein, 12 aa, Artificial Sequence
  Melanocyte protein PMEL (184-195)
AMLGTHTMEVTV

SEQ ID NO: 24072 - protein, 8 aa, Artificial Sequence
  Protein AAR2 homolog (287-294)
AMMKHHTL

SEQ ID NO: 24073 - protein, 11 aa, Artificial Sequence
  Atherin (156-166)
AMNKEGGTASV

SEQ ID NO: 24074 - protein, 10 aa, Artificial Sequence
  Guanine nucleotide-binding protein G(s) subunit alpha isoforms short (95-104)
AMSNLVPPVE

SEQ ID NO: 24075 - protein, 10 aa, Artificial Sequence
  Ubiquitin-conjugating enzyme E2 H (97-106)
AMYLHRPEEY

SEQ ID NO: 24076 - protein, 12 aa, Artificial Sequence
  Copine-1 (72-83)
AQAAHQGTASQY

SEQ ID NO: 24077 - protein, 11 aa, Artificial Sequence
  Copine-1 (403-413)
AQAAHQGTASY

SEQ ID NO: 24078 - protein, 10 aa, Artificial Sequence
  Fatty acid synthase (1283-1292)
AQAELQQHDV

SEQ ID NO: 24079 - protein, 9 aa, Artificial Sequence
  Catenin beta-1 (702-710)
AQGEPLGYR

SEQ ID NO: 24080 - protein, 9 aa, Artificial Sequence
  Protein tyrosine phosphatase type IVA 1 (36-44)
AQHDLYADK

SEQ ID NO: 24081 - protein, 8 aa, Artificial Sequence
  Glutathione S-transferase A4 (32-39)
AQKAIIRY

SEQ ID NO: 24082 - protein, 9 aa, Artificial Sequence
  Patatin-like phospholipase domain-containing protein 7 (872-880)
AQKQLILLH

SEQ ID NO: 24083 - protein, 9 aa, Artificial Sequence
  Vigilin (548-556)
AQKSDIVQL

SEQ ID NO: 24084 - protein, 8 aa, Artificial Sequence
  CD276 antigen (61-68)
AQLNLIWQ

SEQ ID NO: 24085 - protein, 10 aa, Artificial Sequence
  Zinc finger protein 507 (116-125)
AQNEGKAMSY

SEQ ID NO: 24086 - protein, 9 aa, Artificial Sequence
  Hemicentin-1 (4060-4068)
AQNPAGTAL

SEQ ID NO: 24087 - protein, 9 aa, Artificial Sequence
  NAD(P) transhydrogenase, mitochondrial (158-166)
AQNPELLNK

SEQ ID NO: 24088 - protein, 9 aa, Artificial Sequence
  Elongator complex protein 2 (42-50)
AQQNDQFQK

SEQ ID NO: 24089 - protein, 9 aa, Artificial Sequence
  Microphthalmia-associated transcription factor (118-126)
AQRQQVKQY

SEQ ID NO: 24090 - protein, 9 aa, Artificial Sequence
  Cytoplasmic polyadenylation element-binding protein 1 (45-53)
AQSSTHSVL

SEQ ID NO: 24091 - protein, 9 aa, Artificial Sequence
  GMP synthase (glutamine-hydrolyzing) (130-138)
AQYGKVIDR

SEQ ID NO: 24092 - protein, 9 aa, Artificial Sequence
  1,2-dihydroxy-3-keto-5-methylthiopentene dioxygenase (181-189)
ARGQYVKFL

SEQ ID NO: 24093 - protein, 9 aa, Artificial Sequence
  Ankyrin repeat and LEM domain-containing protein 2 (211-219)
ARNERIYVY

SEQ ID NO: 24094 - protein, 9 aa, Artificial Sequence
  Dolichyl-diphosphooligosaccharide-proteinosyltransferase subunit 2 (256-264)
ASAAAVLSH

SEQ ID NO: 24095 - protein, 10 aa, Artificial Sequence
  Probable RNA-binding protein 19 (488-497)
ASALGSSSYK

SEQ ID NO: 24096 - protein, 9 aa, Artificial Sequence
  E3 ubiquitin-protein ligase MSL2 (294-302)
ASAPVTVKR

SEQ ID NO: 24097 - protein, 9 aa, Artificial Sequence
  Gelsolin (362-370)
ASDFITKMD

SEQ ID NO: 24098 - protein, 11 aa, Artificial Sequence
  Transient receptor potential cation channel subfamily M member 1 (215-225)
ASDILSFAHKY

SEQ ID NO: 24099 - protein, 10 aa, Artificial Sequence
  Suppressor of IKBKE 1 (58-67)
ASDMKDMSKY

SEQ ID NO: 24100 - protein, 10 aa, Artificial Sequence
  FERM domain-containing protein 4A (516-525)
ASDPNVSKKL

SEQ ID NO: 24101 - protein, 11 aa, Artificial Sequence
  FERM domain-containing protein 4A (483-493)
ASDPNVSKKLK

SEQ ID NO: 24102 - protein, 10 aa, Artificial Sequence
  Centrosomal protein of 68 kDa (12-21)
ASEDTKAQSY

SEQ ID NO: 24103 - protein, 10 aa, Artificial Sequence
  Nucleoside diphosphate kinase (158-167)
ASEEHLKQHY

SEQ ID NO: 24104 - protein, 12 aa, Artificial Sequence
  Unconventional myosin-Ic (842-853)
ASEIFKGKKDNY

SEQ ID NO: 24105 - protein, 11 aa, Artificial Sequence
  Amino-terminal enhancer of split (51-61)
ASEKSEMQRHY

SEQ ID NO: 24106 - protein, 9 aa, Artificial Sequence
  Retinal dehydrogenase 1 (82-90)
ASERGRLLY

SEQ ID NO: 24107 - protein, 10 aa, Artificial Sequence
  Macrophage metalloelastase (13-22)
ASGALPLNSS

SEQ ID NO: 24108 - protein, 11 aa, Artificial Sequence
  Nuclear factor interleukin-3-regulated protein (14-24)
ASLDASSNVDK

SEQ ID NO: 24109 - protein, 11 aa, Artificial Sequence
  Melanocyte protein PMEL (619-629)
ASLIYRRRLMK

SEQ ID NO: 24110 - protein, 11 aa, Artificial Sequence
  SH2B adapter protein 3 (209-219)
ASMDSGARWQR

SEQ ID NO: 24111 - protein, 10 aa, Artificial Sequence
  Protein argonaute-1 (168-177)
ASMRYTPVGR

SEQ ID NO: 24112 - protein, 9 aa, Artificial Sequence
  5'-3' exoribonuclease 2 (454-462)
ASNPRQAAY

SEQ ID NO: 24113 - protein, 15 aa, Artificial Sequence
  PERQ amino acid-rich with GYF domain-containing protein 2 (1277-1291)
ASSERLNMGEIETLD

SEQ ID NO: 24114 - protein, 16 aa, Artificial Sequence
  PERQ amino acid-rich with GYF domain-containing protein 2 (1277-1292)
ASSERLNMGEIETLDD

SEQ ID NO: 24115 - protein, 17 aa, Artificial Sequence
  PERQ amino acid-rich with GYF domain-containing protein 2 (1277-1293)
ASSERLNMGEIETLDDY

SEQ ID NO: 24116 - protein, 18 aa, Artificial Sequence
  Vimentin (54-71)
ASSPGGVYATRSSAVRLR

SEQ ID NO: 24117 - protein, 14 aa, Artificial Sequence
  Chondroitin sulfate proteoglycan 4 (1607-1620)
ASSSAGTDPQLLLY

SEQ ID NO: 24118 - protein, 9 aa, Artificial Sequence
  Contactin-associated protein-like 3B (2-10)
ASVAWAVLK

SEQ ID NO: 24119 - protein, 9 aa, Artificial Sequence
  Sister chromatid cohesion protein PDS5 homolog B (520-528)
ASVKAIFSK

SEQ ID NO: 24120 - protein, 15 aa, Artificial Sequence
  RNA-binding protein 14 (526-540)
ASYAAQQHPQAAASY

SEQ ID NO: 24121 - protein, 11 aa, Artificial Sequence
  N6-adenosine-methyltransferase subunit METTL14 (53-63)
ASYDTSAPNAK

SEQ ID NO: 24122 - protein, 10 aa, Artificial Sequence
  Origin recognition complex subunit 5 (316-325)
ASYNPARTDK

SEQ ID NO: 24123 - protein, 12 aa, Artificial Sequence
  SPRY domain-containing SOCS box protein 1 (216-227)
ATADAPLHSVGY

SEQ ID NO: 24124 - protein, 9 aa, Artificial Sequence
  Laminin subunit beta-2 (265-273)
ATADLALGR

SEQ ID NO: 24125 - protein, 10 aa, Artificial Sequence
  Oxidative stress-induced growth inhibitor 1 (253-262)
ATAGDIAHYY

SEQ ID NO: 24126 - protein, 9 aa, Artificial Sequence
  Uncharacterized protein KIAA0355 (675-683)
ATAMVTEQK

SEQ ID NO: 24127 - protein, 9 aa, Artificial Sequence
  E1A-binding protein p400 (1093-1101)
ATAQVVQQK

SEQ ID NO: 24128 - protein, 11 aa, Artificial Sequence
  Huntingtin-interacting protein 1 (499-509)
ATARIEEMLSK

SEQ ID NO: 24129 - protein, 12 aa, Artificial Sequence
  Coatomer subunit beta' (703-714)
ATASGNANMVNK

SEQ ID NO: 24130 - protein, 10 aa, Artificial Sequence
  Vacuolar protein sorting-associated protein 18 homolog (854-863)
ATCDFPLLNR

SEQ ID NO: 24131 - protein, 8 aa, Artificial Sequence
  PH domain leucine-rich repeat-containing protein phosphatase 1 (536-543)
ATDAPLRK

SEQ ID NO: 24132 - protein, 9 aa, Artificial Sequence
  Myomegalin (2167-2175)
ATDGSFANK

SEQ ID NO: 24133 - protein, 11 aa, Artificial Sequence
  Slit homolog 3 protein (1187-1197)
ATDKDNGILLY

SEQ ID NO: 24134 - protein, 11 aa, Artificial Sequence
  Protocadherin Fat 2 (739-749)
ATDPDAGFNGK

SEQ ID NO: 24135 - protein, 11 aa, Artificial Sequence
  DNA-dependent protein kinase catalytic subunit (4080-4090)
ATDPNILGRTW

SEQ ID NO: 24136 - protein, 10 aa, Artificial Sequence
  Apolipoprotein D (122-131)
ATDYENYALV

SEQ ID NO: 24137 - protein, 11 aa, Artificial Sequence
  Apolipoprotein D (122-132)
ATDYENYALVY

SEQ ID NO: 24138 - protein, 9 aa, Artificial Sequence
  Semaphorin-5A (423-431)
ATDYGTIKK

SEQ ID NO: 24139 - protein, 7 aa, Artificial Sequence
  Fibronectin type III domain-containing protein 3B (348-354)
ATDYHVR

SEQ ID NO: 24140 - protein, 11 aa, Artificial Sequence
  Zinc finger MYM-type protein 3 (76-86)
ATELLGLGGLL

SEQ ID NO: 24141 - protein, 9 aa, Artificial Sequence
  B-cell CLL/lymphoma 9 protein (163-171)
ATEPTPAQK

SEQ ID NO: 24142 - protein, 11 aa, Artificial Sequence
  Ribosome-binding protein 1 (277-287)
ATEQEDAAVAK

SEQ ID NO: 24143 - protein, 13 aa, Artificial Sequence
  Centrosome-associated protein 350 (621-633)
ATEQKNKRLQELY

SEQ ID NO: 24144 - protein, 11 aa, Artificial Sequence
  Uncharacterized aarF domain-containing protein kinase 2 (137-147)
ATETSGPTYIK

SEQ ID NO: 24145 - protein, 12 aa, Artificial Sequence
  Protein Tob1 (180-191)
ATFAATKFGSTK

SEQ ID NO: 24146 - protein, 10 aa, Artificial Sequence
  FAST kinase domain-containing protein 2 (426-435)
ATFDIWKFRK

SEQ ID NO: 24147 - protein, 11 aa, Artificial Sequence
  Nephrocystin-3 (43-53)
ATFEHDRDKVK

SEQ ID NO: 24148 - protein, 10 aa, Artificial Sequence
  Calcium-binding protein 39 (186-195)
ATFKDLLTRH

SEQ ID NO: 24149 - protein, 9 aa, Artificial Sequence
  cAMP-specific 3',5'-cyclic phosphodiesterase 4B (107-115)
ATFPGHSQR

SEQ ID NO: 24150 - protein, 9 aa, Artificial Sequence
  Kynurenine-oxoglutarate transaminase 3 (99-107)
ATFPGMWER

SEQ ID NO: 24151 - protein, 9 aa, Artificial Sequence
  Pleckstrin homology domain-containing family H member 1 (733-741)
ATGPPALLR

SEQ ID NO: 24152 - protein, 11 aa, Artificial Sequence
  von Willebrand factor A domain-containing protein 5A (184-194)
ATIDSQHGIEK

SEQ ID NO: 24153 - protein, 11 aa, Artificial Sequence
  General transcription factor IIH subunit 2 (32-42)
ATIEDILFKAK

SEQ ID NO: 24154 - protein, 9 aa, Artificial Sequence
  F-BAR domain only protein 2 (41-49)
ATIEEAYSR

SEQ ID NO: 24155 - protein, 13 aa, Artificial Sequence
  DNA-binding protein RFX7 (683-695)
ATIEGQKQGSVKK

SEQ ID NO: 24156 - protein, 9 aa, Artificial Sequence
  Mitochondrial Rho GTPase 2 (88-96)
ATIEKIRTK

SEQ ID NO: 24157 - protein, 11 aa, Artificial Sequence
  Transformation/transcription domain-associated protein (1416-1426)
ATIEVDQIHTH

SEQ ID NO: 24158 - protein, 12 aa, Artificial Sequence
  Vacuolar-sorting protein SNF8 (73-84)
ATIGVDPLASGK

SEQ ID NO: 24159 - protein, 9 aa, Artificial Sequence
  Inhibitor of Bruton tyrosine kinase (45-53)
ATIKDVFGR

SEQ ID NO: 24160 - protein, 11 aa, Artificial Sequence
  Probable ATP-dependent RNA helicase DDX60-like (899-909)
ATINNPNLLTK

SEQ ID NO: 24161 - protein, 10 aa, Artificial Sequence
  Ankyrin repeat domain-containing protein 17 (1306-1315)
ATITDKEMLK

SEQ ID NO: 24162 - protein, 9 aa, Artificial Sequence
  Signal recognition particle 54 kDa protein (152-160)
ATKARIPFY

SEQ ID NO: 24163 - protein, 9 aa, Artificial Sequence
  Fanconi anemia group I protein (138-146)
ATKKENLAY

SEQ ID NO: 24164 - protein, 10 aa, Artificial Sequence
  Gephyrin (610-619)
ATLDIDGVRK

SEQ ID NO: 24165 - protein, 9 aa, Artificial Sequence
  Histone deacetylase 10 (469-477)
ATLDVAVRR

SEQ ID NO: 24166 - protein, 10 aa, Artificial Sequence
  MOB kinase activator 1A (76-85)
ATLGSGNLRQ

SEQ ID NO: 24167 - protein, 9 aa, Artificial Sequence
  ADP-ribosylation factor-like protein 2 (118-126)
ATLLIFANK

SEQ ID NO: 24168 - protein, 11 aa, Artificial Sequence
  Telomerase protein component 1 (53-63)
ATLPDLKTMEK

SEQ ID NO: 24169 - protein, 9 aa, Artificial Sequence
  Septin-4 (109-117)
ATLPNQVHR

SEQ ID NO: 24170 - protein, 10 aa, Artificial Sequence
  Glycogen phosphorylase, muscle form (303-312)
ATLQDIIRRF

SEQ ID NO: 24171 - protein, 11 aa, Artificial Sequence
  PH domain leucine-rich repeat-containing protein phosphatase 1 (228-238)
ATLSEETNSIL

SEQ ID NO: 24172 - protein, 9 aa, Artificial Sequence
  Kazrin (140-148)
ATLTKDVPK

SEQ ID NO: 24173 - protein, 11 aa, Artificial Sequence
  BUB3-interacting and GLEBS motif-containing protein ZNF207 (352-362)
ATLTTTSATSK

SEQ ID NO: 24174 - protein, 10 aa, Artificial Sequence
  Eukaryotic initiation factor 4A-III (5-14)
ATMATSGSAR

SEQ ID NO: 24175 - protein, 13 aa, Artificial Sequence
  Eukaryotic translation initiation factor 3 subunit J (234-246)
ATMKDDLADYGGY

SEQ ID NO: 24176 - protein, 16 aa, Artificial Sequence
  Eukaryotic translation initiation factor 3 subunit J (234-249)
ATMKDDLADYGGYDGG

SEQ ID NO: 24177 - protein, 10 aa, Artificial Sequence
  Growth hormone-inducible transmembrane protein (334-343)
ATMLATGGNR

SEQ ID NO: 24178 - protein, 12 aa, Artificial Sequence
  Growth hormone-inducible transmembrane protein (334-345)
ATMLATGGNRKK

SEQ ID NO: 24179 - protein, 11 aa, Artificial Sequence
  Signal recognition particle subunit SRP68 (260-270)
ATMSEVEWRGR

SEQ ID NO: 24180 - protein, 11 aa, Artificial Sequence
  Protein phosphatase 1G (149-159)
ATMTIEELLTR

SEQ ID NO: 24181 - protein, 9 aa, Artificial Sequence
  E3 ubiquitin-protein ligase HECTD1 (175-183)
ATNNMNLSR

SEQ ID NO: 24182 - protein, 10 aa, Artificial Sequence
  X-ray repair cross-complementing protein 6 (454-463)
ATPEQVGKMK

SEQ ID NO: 24183 - protein, 10 aa, Artificial Sequence
  Cytoplasmic dynein 1 heavy chain 1 (3980-3989)
ATPIGQAIHR

SEQ ID NO: 24184 - protein, 9 aa, Artificial Sequence
  Estradiol 17-beta-dehydrogenase 11 (131-139)
ATQDPQIEK

SEQ ID NO: 24185 - protein, 15 aa, Artificial Sequence
  Calsyntenin-1 (947-961)
ATRQQQLEWDDSTLS

SEQ ID NO: 24186 - protein, 16 aa, Artificial Sequence
  Calsyntenin-1 (947-962)
ATRQQQLEWDDSTLSY

SEQ ID NO: 24187 - protein, 9 aa, Artificial Sequence
  Intron-binding protein aquarius (1477-1485)
ATSAPEETK

SEQ ID NO: 24188 - protein, 9 aa, Artificial Sequence
  Kelch repeat and BTB domain-containing protein 4 (535-543)
ATSAVTVTR

SEQ ID NO: 24189 - protein, 11 aa, Artificial Sequence
  Basement membrane-specific heparan sulfate proteoglycan core protein (2027-2037)
ATSPAGTAQAR

SEQ ID NO: 24190 - protein, 9 aa, Artificial Sequence
  Neural cell adhesion molecule L1 (1237-1245)
ATSPINPAV

SEQ ID NO: 24191 - protein, 9 aa, Artificial Sequence
  G-protein coupled receptor 143 (61-69)
ATSPPASVR

SEQ ID NO: 24192 - protein, 10 aa, Artificial Sequence
  Melanoma-associated antigen D1 (132-141)
ATTGELAANK

SEQ ID NO: 24193 - protein, 11 aa, Artificial Sequence
  Sterol regulatory element-binding protein 1 (957-967)
ATTPASSSIDK

SEQ ID NO: 24194 - protein, 9 aa, Artificial Sequence
  Helicase SKI2W (127-135)
ATTSLSLRR

SEQ ID NO: 24195 - protein, 9 aa, Artificial Sequence
  E3 ubiquitin-protein ligase RING1 (290-298)
ATVDHLSKY

SEQ ID NO: 24196 - protein, 11 aa, Artificial Sequence
  ATP-dependent RNA helicase DHX29 (735-745)
ATVDSEKFSTY

SEQ ID NO: 24197 - protein, 9 aa, Artificial Sequence
  Multidrug resistance-associated protein 4 (364-372)
ATVLFGIAR

SEQ ID NO: 24198 - protein, 9 aa, Artificial Sequence
  FACT complex subunit SPT16 (415-423)
ATVLTSVKK

SEQ ID NO: 24199 - protein, 10 aa, Artificial Sequence
  Putative phospholipase B-like 2 (360-369)
ATWADIFKRF

SEQ ID NO: 24200 - protein, 9 aa, Artificial Sequence
  Arf-GAP with GTPase, ANK repeat and PH domain-containing protein 3 (232-240)
ATYGLNVER

SEQ ID NO: 24201 - protein, 9 aa, Artificial Sequence
  Histone acetyltransferase p300 (1189-1197)
ATYYSYQNR

SEQ ID NO: 24202 - protein, 9 aa, Artificial Sequence
  Girdin (155-163)
AVAAHIQEV

SEQ ID NO: 24203 - protein, 13 aa, Artificial Sequence
  Sodium/potassium-transporting ATPase subunit alpha-1 (249-261)
AVAGDASESALLK

SEQ ID NO: 24204 - protein, 12 aa, Artificial Sequence
  RanBP-type and C3HC4-type zinc finger-containing protein 1 (18-29)
AVAGGDEQVAMK

SEQ ID NO: 24205 - protein, 11 aa, Artificial Sequence
  Mitochondrial import inner membrane translocase subunit Tim13 (31-41)
AVANAQELLQR

SEQ ID NO: 24206 - protein, 11 aa, Artificial Sequence
  cDNA FLJ78342 (66-76)
AVAQMDFIKLY

SEQ ID NO: 24207 - protein, 10 aa, Artificial Sequence
  Serine/threonine-protein kinase ATR (1642-1651)
AVASFRSKAY

SEQ ID NO: 24208 - protein, 9 aa, Artificial Sequence
  G-protein coupled receptor 143 (219-227)
AVASLLKGR

SEQ ID NO: 24209 - protein, 9 aa, Artificial Sequence
  Cadherin EGF LAG seven-pass G-type receptor 2 (2176-2184)
AVASVIIYR

SEQ ID NO: 24210 - protein, 9 aa, Artificial Sequence
  Signal peptidase complex catalytic subunit SEC11A (119-127)
AVDDRGLYK

SEQ ID NO: 24211 - protein, 11 aa, Artificial Sequence
  MICOS complex subunit MIC60 (276-286)
AVDEAADALLK

SEQ ID NO: 24212 - protein, 10 aa, Artificial Sequence
  Multivesicular body subunit 12A (118-127)
AVFDVRLSGK

SEQ ID NO: 24213 - protein, 9 aa, Artificial Sequence
  Peroxisomal multifunctional enzyme type 2 (271-279)
AVFEWHITK

SEQ ID NO: 24214 - protein, 16 aa, Artificial Sequence
  Peroxisomal multifunctional enzyme type 2 (648-663)
AVFEWHITKGGNIGAK

SEQ ID NO: 24215 - protein, 10 aa, Artificial Sequence
  Transmembraneoprotein NMB (550-559)
AVFFPGNQEK

SEQ ID NO: 24216 - protein, 9 aa, Artificial Sequence
  Transmembrane protein 50A (132-140)
AVFFQNAFI

SEQ ID NO: 24217 - protein, 9 aa, Artificial Sequence
  tRNA-splicing endonuclease subunit Sen2 (4-12)
AVFHAPKRK

SEQ ID NO: 24218 - protein, 9 aa, Artificial Sequence
  Kinesin-like protein KIF13B (224-232)
AVFKITLTH

SEQ ID NO: 24219 - protein, 10 aa, Artificial Sequence
  Kinesin-like protein KIF1B (252-261)
AVFTIVFTQK

SEQ ID NO: 24220 - protein, 11 aa, Artificial Sequence
  GMP synthase (glutamine-hydrolyzing) (400-410)
AVHIDNGFMRK

SEQ ID NO: 24221 - protein, 9 aa, Artificial Sequence
  Lysosomal-trafficking regulator (2018-2026)
AVHPPTNTY

SEQ ID NO: 24222 - protein, 9 aa, Artificial Sequence
  Disintegrin and metalloproteinase domain-containing protein 10 (184-192)
AVIAQISSH

SEQ ID NO: 24223 - protein, 12 aa, Artificial Sequence
  UDP-N-acetylglucosamine-peptide N-acetylglucosaminyltransferase 110 kDa subunit (593-604)
AVIDFKSNGHIY

SEQ ID NO: 24224 - protein, 10 aa, Artificial Sequence
  Armadillo repeat-containing X-linked protein 5 (128-137)
AVIEANIRSY

SEQ ID NO: 24225 - protein, 10 aa, Artificial Sequence
  Cytoplasmic dynein 1 heavy chain 1 (3288-3297)
AVIEAQNAVK

SEQ ID NO: 24226 - protein, 10 aa, Artificial Sequence
  Tyrosine-protein phosphatase non-receptor type 1 (109-118)
AVIEGAKFIM

SEQ ID NO: 24227 - protein, 9 aa, Artificial Sequence
  Adenosine 3'-phospho 5'-phosphosulfate transporter 2 (240-248)
AVIGNVQEK

SEQ ID NO: 24228 - protein, 10 aa, Artificial Sequence
  Protocadherin Fat 4 (1541-1550)
AVIGSVLTTI

SEQ ID NO: 24229 - protein, 10 aa, Artificial Sequence
  Kinesin-like protein KIF1B (391-400)
AVINEDPNAK

SEQ ID NO: 24230 - protein, 13 aa, Artificial Sequence
  RING finger protein 37 (351-363)
AVIPSSIVLPSQK

SEQ ID NO: 24231 - protein, 9 aa, Artificial Sequence
  DNA repair protein SWI5 homolog isoform 2 (175-183)
AVIRGVTTK

SEQ ID NO: 24232 - protein, 10 aa, Artificial Sequence
  Zinc finger protein 28 homolog (116-125)
AVITERLTSY

SEQ ID NO: 24233 - protein, 10 aa, Artificial Sequence
  Eukaryotic translation initiation factor 3 subunit E (260-269)
AVITNKDVRK

SEQ ID NO: 24234 - protein, 10 aa, Artificial Sequence
  Proline-rich protein 13 (52-61)
AVIVDKKMQK

SEQ ID NO: 24235 - protein, 9 aa, Artificial Sequence
  Heat shock 70 kDa protein 4 (349-357)
AVKEKISKF

SEQ ID NO: 24236 - protein, 9 aa, Artificial Sequence
  Very long-chain specific acyl-CoA dehydrogenase, mitochondrial (252-260)
AVKEKITAF

SEQ ID NO: 24237 - protein, 9 aa, Artificial Sequence
  Heat shock protein 105 kDa (349-357)
AVKERIAKF

SEQ ID NO: 24238 - protein, 9 aa, Artificial Sequence
  Hermansky-Pudlak syndrome 5 protein (25-33)
AVKESVSSF

SEQ ID NO: 24239 - protein, 11 aa, Artificial Sequence
  Interleukin-1 receptor accessory protein (505-515)
AVKETKVKELK

SEQ ID NO: 24240 - protein, 10 aa, Artificial Sequence
  Actin-related protein 2/3 complex subunit 4 (75-84)
AVKQADEIEK

SEQ ID NO: 24241 - protein, 9 aa, Artificial Sequence
  Phosphatidylinositol 4,5-bisphosphate 3-kinase catalytic subunit beta isoform (406-414)
AVLDKVKTK

SEQ ID NO: 24242 - protein, 9 aa, Artificial Sequence
  Periodic tryptophan protein 1 homolog (46-54)
AVLDLSWNK

SEQ ID NO: 24243 - protein, 9 aa, Artificial Sequence
  Glutamate receptor ionotropic, NMDA 2A (236-244)
AVLILSEAR

SEQ ID NO: 24244 - protein, 9 aa, Artificial Sequence
  ADP-ribosylation factor 5 (119-127)
AVLLVFANK

SEQ ID NO: 24245 - protein, 11 aa, Artificial Sequence
  Casein kinase II subunit alpha' (340-350)
AVLSSGLTAAR

SEQ ID NO: 24246 - protein, 12 aa, Artificial Sequence
  COP9 signalosome complex subunit 8 (4-15)
AVMAESAFSFKK

SEQ ID NO: 24247 - protein, 10 aa, Artificial Sequence
  FACT complex subunit SPT16 (328-337)
AVMDVVKKQK

SEQ ID NO: 24248 - protein, 9 aa, Artificial Sequence
  Prefoldin subunit 5 (143-151)
AVMEMMSQK

SEQ ID NO: 24249 - protein, 11 aa, Artificial Sequence
  DNA-directed RNA polymerase I subunit RPA1 (330-340)
AVMKDVVLIRK

SEQ ID NO: 24250 - protein, 9 aa, Artificial Sequence
  Pleckstrin homology domain-containing family A member 1 (203-211)
AVMKNWKRR

SEQ ID NO: 24251 - protein, 9 aa, Artificial Sequence
  Catenin beta-1 (172-180)
AVMVHQLSK

SEQ ID NO: 24252 - protein, 10 aa, Artificial Sequence
  Galectin-3 (212-221)
AVNDAHLLQY

SEQ ID NO: 24253 - protein, 9 aa, Artificial Sequence
  CDC42 small effector protein 1 (56-64)
AVQEQMRSK

SEQ ID NO: 24254 - protein, 10 aa, Artificial Sequence
  Transforming growth factor-beta-induced protein ig-h3 (50-59)
AVQKVIGTNR

SEQ ID NO: 24255 - protein, 10 aa, Artificial Sequence
  26S proteasome non-ATPase regulatory subunit 6 (44-53)
AVRDNNMAPY

SEQ ID NO: 24256 - protein, 9 aa, Artificial Sequence
  Amidophosphoribosyltransferase (196-204)
AVRDPYGNR

SEQ ID NO: 24257 - protein, 10 aa, Artificial Sequence
  WD repeat-containing protein 63 (83-92)
AVSDFHPVKK

SEQ ID NO: 24258 - protein, 9 aa, Artificial Sequence
  GRAM domain-containing protein 4 (475-483)
AVSTPSTQK

SEQ ID NO: 24259 - protein, 9 aa, Artificial Sequence
  Hyaluronidase-2 (16-24)
AVSWAMELK

SEQ ID NO: 24260 - protein, 12 aa, Artificial Sequence
  72 kDa type IV collagenase (603-614)
AVVDLQGGGHSY

SEQ ID NO: 24261 - protein, 9 aa, Artificial Sequence
  Folliculin-interacting protein 1 (548-556)
AVVDQITRH

SEQ ID NO: 24262 - protein, 10 aa, Artificial Sequence
  Calcineurin subunit B type 1 (155-164)
AVVGGLDIHK

SEQ ID NO: 24263 - protein, 11 aa, Artificial Sequence
  Calcineurin subunit B type 1 (155-165)
AVVGGLDIHKK

SEQ ID NO: 24264 - protein, 9 aa, Artificial Sequence
  Dolichyl-diphosphooligosaccharide-proteinosyltransferase subunit STT3A (152-160)
AVVPGYISR

SEQ ID NO: 24265 - protein, 11 aa, Artificial Sequence
  Nodal modulator 3 (366-376)
AVVSGESCPGK

SEQ ID NO: 24266 - protein, 10 aa, Artificial Sequence
  Protein phosphatase 1B (57-66)
AVYDGHAGSR

SEQ ID NO: 24267 - protein, 11 aa, Artificial Sequence
  Biotinidase (61-71)
AVYEHPSILSL

SEQ ID NO: 24268 - protein, 10 aa, Artificial Sequence
  Protein-lysine N-methyltransferase METTL10 (40-49)
AVYERELQTF

SEQ ID NO: 24269 - protein, 11 aa, Artificial Sequence
  Carbonic anhydrase 14 (307-317)
AVYFIARKIRK

SEQ ID NO: 24270 - protein, 9 aa, Artificial Sequence
  TBC1 domain family member 16 (146-154)
AVYNPAVGY

SEQ ID NO: 24271 - protein, 9 aa, Artificial Sequence
  Tetraspanin-4 (42-50)
AYTDKIDRY

SEQ ID NO: 24272 - protein, 11 aa, Artificial Sequence
  Protein HIRA (749-759)
CVACEKRMLSV

SEQ ID NO: 24273 - protein, 11 aa, Artificial Sequence
  Heterogeneous nuclear ribonucleoprotein A0 (150-160)
DAADKAAVVKF

SEQ ID NO: 24274 - protein, 11 aa, Artificial Sequence
  Gelsolin (291-301)
DAANRKLAKLY

SEQ ID NO: 24275 - protein, 11 aa, Artificial Sequence
  Thimet oligopeptidase (401-411)
DAASGEVVGKF

SEQ ID NO: 24276 - protein, 9 aa, Artificial Sequence
  WD repeat-containing protein 61 (85-93)
DAHIRLWDL

SEQ ID NO: 24277 - protein, 9 aa, Artificial Sequence
  Delta-1-pyrroline-5-carboxylate synthase (648-656)
DAIDHIHKY

SEQ ID NO: 24278 - protein, 9 aa, Artificial Sequence
  Serine/arginine-rich splicing factor 9 (67-75)
DAIYGRNGY

SEQ ID NO: 24279 - protein, 11 aa, Artificial Sequence
  DNA-directed RNA polymerases I, II, and III subunit RPABC5 (33-43)
DALDALGLKRY

SEQ ID NO: 24280 - protein, 11 aa, Artificial Sequence
  Cell division cycle protein 16 homolog (140-150)
DALDNRTLATY

SEQ ID NO: 24281 - protein, 9 aa, Artificial Sequence
  Mitogen-activated protein kinase kinase kinase 1 (693-701)
DANSRTSQL

SEQ ID NO: 24282 - protein, 9 aa, Artificial Sequence
  28S ribosomal protein S22, mitochondrial (296-304)
DATNLVQLY

SEQ ID NO: 24283 - protein, 10 aa, Artificial Sequence
  Kinase D-interacting substrate of 220 kDa (264-273)
DAYREYIAQM

SEQ ID NO: 24284 - protein, 11 aa, Artificial Sequence
  Actin, aortic smooth muscle (58-68)
DEAQSKRGILT

SEQ ID NO: 24285 - protein, 9 aa, Artificial Sequence
  Remodeling and spacing factor 1 (1413-1421)
DELLRVTDL

SEQ ID NO: 24286 - protein, 9 aa, Artificial Sequence
  28S ribosomal protein S14, mitochondrial (49-57)
DERLRINSL

SEQ ID NO: 24287 - protein, 9 aa, Artificial Sequence
  Kinesin-like protein KIF15 (1289-1297)
DEVERTQTL

SEQ ID NO: 24288 - protein, 9 aa, Artificial Sequence
  CAP-Gly domain-containing linker protein 1 (519-527)
DHQREITSL

SEQ ID NO: 24289 - protein, 9 aa, Artificial Sequence
  Peroxisome proliferator-activated receptor gamma coactivator-related protein 1 (1261-1269)
DHYQRQRVL

SEQ ID NO: 24290 - protein, 9 aa, Artificial Sequence
  Poly (ADP-ribose) polymerase 1 (993-1001)
DIAQVNLKY

SEQ ID NO: 24291 - protein, 10 aa, Artificial Sequence
  RILP-like protein 1 (29-38)
DIASLVGHEF

SEQ ID NO: 24292 - protein, 10 aa, Artificial Sequence
  Probable ATP-dependent RNA helicase DDX58 (896-905)
DIATGVQTLY

SEQ ID NO: 24293 - protein, 9 aa, Artificial Sequence
  RNA-binding protein 8A (72-80)
DIHDKFAEY

SEQ ID NO: 24294 - protein, 10 aa, Artificial Sequence
  Filamin-A (897-906)
DIIDHHDNTY

SEQ ID NO: 24295 - protein, 12 aa, Artificial Sequence
  SURP and G-patch domain-containing protein 2 (265-276)
DIIDKSDVFSRF

SEQ ID NO: 24296 - protein, 9 aa, Artificial Sequence
  Lymphocyte cytosolic protein 2 (500-508)
DIIDYFRKM

SEQ ID NO: 24297 - protein, 10 aa, Artificial Sequence
  Cytoplasmic dynein 2 heavy chain 1 (253-262)
DIIGGSFGRF

SEQ ID NO: 24298 - protein, 11 aa, Artificial Sequence
  Protein farnesyltransferase subunit beta (120-130)
DIINREKLLQY

SEQ ID NO: 24299 - protein, 13 aa, Artificial Sequence
  Delta(24)-sterol reductase (252-264)
DIIPFGNNPIFRY

SEQ ID NO: 24300 - protein, 13 aa, Artificial Sequence
  Putative annexin A2-like protein (158-170)
DIISDTSGDFRKL

SEQ ID NO: 24301 - protein, 9 aa, Artificial Sequence
  Nucleophosmin (246-254)
DIKAKMQAS

SEQ ID NO: 24302 - protein, 9 aa, Artificial Sequence
  Actin, alpha skeletal muscle (7-15)
DIKEKLCYV

SEQ ID NO: 24303 - protein, 9 aa, Artificial Sequence
  Ubiquitin fusion degradation protein 1 homolog (289-297)
DIKRGIPNY

SEQ ID NO: 24304 - protein, 10 aa, Artificial Sequence
  POZ-, AT hook-, and zinc finger-containing protein 1 (116-125)
DILDFAYTSR

SEQ ID NO: 24305 - protein, 9 aa, Artificial Sequence
  Pre-mRNA-processing-splicing factor 8 (298-306)
DINKIIIRQ

SEQ ID NO: 24306 - protein, 9 aa, Artificial Sequence
  Trimethyllysine dioxygenase, mitochondrial (352-360)
DIPERILTY

SEQ ID NO: 24307 - protein, 10 aa, Artificial Sequence
  5'-nucleotidase domain-containing protein 1 (161-170)
DIVAAIQHNY

SEQ ID NO: 24308 - protein, 9 aa, Artificial Sequence
  Integrin-linked protein kinase (81-89)
DIVQKLLQY

SEQ ID NO: 24309 - protein, 10 aa, Artificial Sequence
  Calcium/calmodulin-dependent protein kinase type 1 (83-92)
DIYESGGHLY

SEQ ID NO: 24310 - protein, 10 aa, Artificial Sequence
  Pantothenate kinase 2, mitochondrial (45-54)
DIYGGDYERF

SEQ ID NO: 24311 - protein, 10 aa, Artificial Sequence
  F-box only protein 11 (39-48)
DIYNHMYSGV

SEQ ID NO: 24312 - protein, 9 aa, Artificial Sequence
  Translin-associated protein X (51-59)
DKYERLVKL

SEQ ID NO: 24313 - protein, 9 aa, Artificial Sequence
  R3H and coiled-coil domain-containing protein 1 (315-323)
DLAHVVEIY

SEQ ID NO: 24314 - protein, 9 aa, Artificial Sequence
  CUGBP Elav-like family member 5 (41-49)
DLDAIKLFV

SEQ ID NO: 24315 - protein, 12 aa, Artificial Sequence
  Lanosterol 14-alpha demethylase (473-484)
DLIDGYFPTVNY

SEQ ID NO: 24316 - protein, 9 aa, Artificial Sequence
  Heterogeneous nuclear ribonucleoprotein A0 (113-121)
DLIEHFSQF

SEQ ID NO: 24317 - protein, 9 aa, Artificial Sequence
  DNA polymerase zeta catalytic subunit (2457-2465)
DLIGKTSEM

SEQ ID NO: 24318 - protein, 11 aa, Artificial Sequence
  Probable fibrosin-1 (455-465)
DLIGQDLNSRY

SEQ ID NO: 24319 - protein, 12 aa, Artificial Sequence
  DNA repair endonuclease XPF (720-731)
DLIGSLNNGRLY

SEQ ID NO: 24320 - protein, 9 aa, Artificial Sequence
  Alpha-catulin (622-630)
DLIHQLEVF

SEQ ID NO: 24321 - protein, 9 aa, Artificial Sequence
  Spermidine synthase (215-223)
DLIKEMRQF

SEQ ID NO: 24322 - protein, 9 aa, Artificial Sequence
  Reticulon-4 (494-502)
DLIKETKLS

SEQ ID NO: 24323 - protein, 11 aa, Artificial Sequence
  Rho guanine nucleotide exchange factor 1 (77-87)
DLISEDVQRRF

SEQ ID NO: 24324 - protein, 10 aa, Artificial Sequence
  Microtubule-associated serine/threonine-protein kinase 4 (1003-1012)
DLITHINGEP

SEQ ID NO: 24325 - protein, 9 aa, Artificial Sequence
  Calcium/calmodulin-dependent protein kinase kinase 2 (186-194)
DLKDLITRM

SEQ ID NO: 24326 - protein, 9 aa, Artificial Sequence
  Heterogeneous nuclear ribonucleoprotein A/B (85-93)
DLKDYFTKF

SEQ ID NO: 24327 - protein, 9 aa, Artificial Sequence
  Mediator of RNA polymerase II transcription subunit 8 (21-29)
DLKNSLGSF

SEQ ID NO: 24328 - protein, 9 aa, Artificial Sequence
  CASP8 and FADD-like apoptosis regulator (163-171)
DLKTKIQKY

SEQ ID NO: 24329 - protein, 11 aa, Artificial Sequence
  Glycogen (starch) synthase, muscle (593-603)
DLLDWKYLGRY

SEQ ID NO: 24330 - protein, 10 aa, Artificial Sequence
  Fez family zinc finger protein 1 isoform 2 (119-128)
DLLNCALSLK

SEQ ID NO: 24331 - protein, 9 aa, Artificial Sequence
  EPM2A-interacting protein 1 (205-213)
DLLTIINLT

SEQ ID NO: 24332 - protein, 10 aa, Artificial Sequence
  Sorting nexin-17 (151-160)
DLPDDLIGYF

SEQ ID NO: 24333 - protein, 9 aa, Artificial Sequence
  UBAP1-MVB12-associated (UMA)-domain containing protein 1 isoform b (71-79)
DLPDHLLSY

SEQ ID NO: 24334 - protein, 10 aa, Artificial Sequence
  Rap guanine nucleotide exchange factor 2 (604-613)
DLPDQVLRVF

SEQ ID NO: 24335 - protein, 11 aa, Artificial Sequence
  Class E basic helix-loop-helix protein 40 (21-31)
DLPGMYPAHMY

SEQ ID NO: 24336 - protein, 9 aa, Artificial Sequence
  Coiled-coil domain-containing protein 22 (96-104)
DLRDLLLFL

SEQ ID NO: 24337 - protein, 11 aa, Artificial Sequence
  Transient receptor potential cation channel subfamily M member 1 (109-119)
DLVGKDVTRVY

SEQ ID NO: 24338 - protein, 10 aa, Artificial Sequence
  Regulatory-associated protein of mTOR (292-301)
DLVKDNGHKY

SEQ ID NO: 24339 - protein, 10 aa, Artificial Sequence
  Holliday junction recognition protein (177-186)
DLYAGMLHSM

SEQ ID NO: 24340 - protein, 9 aa, Artificial Sequence
  Zinc finger protein 1 homolog (74-82)
DLYEKTLKY

SEQ ID NO: 24341 - protein, 9 aa, Artificial Sequence
  Cytoplasmic FMR1-interacting protein 1 (703-711)
DLYNDSAHY

SEQ ID NO: 24342 - protein, 10 aa, Artificial Sequence
  DNA (cytosine-5)-methyltransferase 1 (862-871)
DLYPEHYRKY

SEQ ID NO: 24343 - protein, 9 aa, Artificial Sequence
  Phosphoglycerate kinase 1 (52-60)
DNGAKSVVL

SEQ ID NO: 24344 - protein, 9 aa, Artificial Sequence
  60S ribosomal protein L23 (30-38)
DNTGAKNLY

SEQ ID NO: 24345 - protein, 9 aa, Artificial Sequence
  Nuclear pore complex protein Nup88 (194-202)
DNVIRIYSL

SEQ ID NO: 24346 - protein, 12 aa, Artificial Sequence
  KAT8 regulatory NSL complex subunit 2 (176-187)
DQEDPLKHAGVY

SEQ ID NO: 24347 - protein, 12 aa, Artificial Sequence
  EH domain-containing protein 1 (222-233)
DQIETQQLMRVY

SEQ ID NO: 24348 - protein, 13 aa, Artificial Sequence
  Eukaryotic translation initiation factor 3 subunit C-like protein (888-900)
DQKDGYRKNEGYM

SEQ ID NO: 24349 - protein, 9 aa, Artificial Sequence
  Isoleucine-tRNA ligase, cytoplasmic (424-432)
DQLLRNNDL

SEQ ID NO: 24350 - protein, 9 aa, Artificial Sequence
  V-type proton ATPase subunit H (445-453)
DQQVRYNAL

SEQ ID NO: 24351 - protein, 9 aa, Artificial Sequence
  Neuroblastoma-amplified sequence (1664-1672)
DQYKRETIL

SEQ ID NO: 24352 - protein, 10 aa, Artificial Sequence
  GTPase KRas (69-78)
DQYMRTGEGF

SEQ ID NO: 24353 - protein, 9 aa, Artificial Sequence
  Vigilin (368-376)
DRALRSFKL

SEQ ID NO: 24354 - protein, 9 aa, Artificial Sequence
  Tyrosine-protein kinase BAZ1B (189-197)
DREDKRSAL

SEQ ID NO: 24355 - protein, 9 aa, Artificial Sequence
  Clathrin heavy chain 1 (779-787)
DRFDFVHDL

SEQ ID NO: 24356 - protein, 9 aa, Artificial Sequence
  KxDL motif-containing protein 1 (43-51)
DRFEKTNEM

SEQ ID NO: 24357 - protein, 9 aa, Artificial Sequence
  PAB-dependent poly(A)-specific ribonuclease subunit PAN2 (264-272)
DRFLKVYDL

SEQ ID NO: 24358 - protein, 9 aa, Artificial Sequence
  Monofunctional C1-tetrahydrofolate synthase, mitochondrial (503-511)
DRFLRKITI

SEQ ID NO: 24359 - protein, 9 aa, Artificial Sequence
  Cyclin-G1 (81-89)
DRFLSKMKV

SEQ ID NO: 24360 - protein, 9 aa, Artificial Sequence
  Lanosterol synthase (287-295)
DRFTKSISI

SEQ ID NO: 24361 - protein, 9 aa, Artificial Sequence
  Vacuolar protein sorting-associated protein 51 homolog (86-94)
DRHERITKL

SEQ ID NO: 24362 - protein, 9 aa, Artificial Sequence
  Endoplasmin (716-724)
DRIERMLRL

SEQ ID NO: 24363 - protein, 9 aa, Artificial Sequence
  Transcription elongation factor SPT5 (314-322)
DRIKARMSL

SEQ ID NO: 24364 - protein, 9 aa, Artificial Sequence
  Regulator of nonsense transcripts 3B (254-262)
DRIPERDKL

SEQ ID NO: 24365 - protein, 10 aa, Artificial Sequence
  Coatomer subunit epsilon (160-169)
DRLDLARKEL

SEQ ID NO: 24366 - protein, 9 aa, Artificial Sequence
  DNA-dependent protein kinase catalytic subunit (2537-2545)
DRLLALNSL

SEQ ID NO: 24367 - protein, 9 aa, Artificial Sequence
  DNA replication complex GINS protein PSF1 (82-90)
DRLLRIRAL

SEQ ID NO: 24368 - protein, 9 aa, Artificial Sequence
  Telomerase-binding protein EST1A (484-492)
DRNLRVKAL

SEQ ID NO: 24369 - protein, 9 aa, Artificial Sequence
  SUMO-activating enzyme subunit 1 (20-28)
DRQIRLWGL

SEQ ID NO: 24370 - protein, 9 aa, Artificial Sequence
  Phenylalanine-tRNA ligase alpha subunit (353-361)
DRVFRNETL

SEQ ID NO: 24371 - protein, 9 aa, Artificial Sequence
  T-complex protein 1 subunit zeta (127-135)
DRVKKIIEL

SEQ ID NO: 24372 - protein, 9 aa, Artificial Sequence
  39S ribosomal protein L20, mitochondrial (16-24)
DRYFRIQEV

SEQ ID NO: 24373 - protein, 9 aa, Artificial Sequence
  Spectrin alpha chain, non-erythrocytic 1 (24-32)
DRYHRFKEL

SEQ ID NO: 24374 - protein, 9 aa, Artificial Sequence
  Small nuclear ribonucleoprotein Sm D2 (93-101)
DRYISKMFL

SEQ ID NO: 24375 - protein, 9 aa, Artificial Sequence
  Nuclear factor of activated T-cells, cytoplasmic 3 (487-495)
DRYLRPHAF

SEQ ID NO: 24376 - protein, 9 aa, Artificial Sequence
  60S ribosomal protein L27 (47-55)
DRYPRKVTA

SEQ ID NO: 24377 - protein, 9 aa, Artificial Sequence
  Ubiquitin carboxyl-terminal hydrolase 45 (410-418)
DRYSGNVTI

SEQ ID NO: 24378 - protein, 9 aa, Artificial Sequence
  Major prion protein (147-155)
DRYYRENMH

SEQ ID NO: 24379 - protein, 10 aa, Artificial Sequence
  Nucleolar protein 4-like (309-318)
DSAAITHSTY

SEQ ID NO: 24380 - protein, 10 aa, Artificial Sequence
  Splicing factor U2AF 65 kDa subunit (293-302)
DSATGLSKGY

SEQ ID NO: 24381 - protein, 10 aa, Artificial Sequence
  Eukaryotic translation initiation factor 4 gamma 3 (1501-1510)
DSDTEKELQA

SEQ ID NO: 24382 - protein, 10 aa, Artificial Sequence
  Gamma-glutamylaminecyclotransferase (138-147)
DSEGPHGLRY

SEQ ID NO: 24383 - protein, 12 aa, Artificial Sequence
  Bromodomain and WD repeat-containing protein 1 (1792-1803)
DSEPGRSGGRKY

SEQ ID NO: 24384 - protein, 10 aa, Artificial Sequence
  RNA-binding protein 39 (262-271)
DSETGRSKGY

SEQ ID NO: 24385 - protein, 9 aa, Artificial Sequence
  Bcl-2-like protein 12 (183-191)
DSFARLVEL

SEQ ID NO: 24386 - protein, 9 aa, Artificial Sequence
  Melanophilin (443-451)
DSFDRKSVY

SEQ ID NO: 24387 - protein, 9 aa, Artificial Sequence
  TBC1 domain family member 4 (590-598)
DSFERSNSL

SEQ ID NO: 24388 - protein, 10 aa, Artificial Sequence
  Signal transducer and activator of transcription 1-alpha/beta (24-33)
DSFPMEIRQY

SEQ ID NO: 24389 - protein, 11 aa, Artificial Sequence
  Signal transducer and activator of transcription 1-alpha/beta (24-34)
DSFPMEIRQYL

SEQ ID NO: 24390 - protein, 10 aa, Artificial Sequence
  Signal transducer and activator of transcription 3 (24-33)
DSFPMELRQF

SEQ ID NO: 24391 - protein, 12 aa, Artificial Sequence
  Syndecan-3 (294-305)
DSGSSAAQLPQK

SEQ ID NO: 24392 - protein, 10 aa, Artificial Sequence
  Protein MON2 homolog (1214-1223)
DSIGEKLGRY

SEQ ID NO: 24393 - protein, 9 aa, Artificial Sequence
  Disco-interacting protein 2 homolog A (882-890)
DSIHQVGVY

SEQ ID NO: 24394 - protein, 9 aa, Artificial Sequence
  ATP-dependent RNA helicase DDX54 (547-555)
DSIKNYRSR

SEQ ID NO: 24395 - protein, 9 aa, Artificial Sequence
  Peptidyl-prolyl cis-trans isomerase FKBP9 (369-377)
DSISITSHY

SEQ ID NO: 24396 - protein, 9 aa, Artificial Sequence
  Methyltransferase-like protein 13 (209-217)
DSKDPTLGM

SEQ ID NO: 24397 - protein, 9 aa, Artificial Sequence
  Protein AHNAK2 (672-680)
DSKFKMPKF

SEQ ID NO: 24398 - protein, 10 aa, Artificial Sequence
  Arf-GAP with SH3 domain, ANK repeat and PH domain-containing protein 2 (284-293)
DSQIRQSTAY

SEQ ID NO: 24399 - protein, 9 aa, Artificial Sequence
  RNA-binding protein 3 (119-127)
DSRPGGYGY

SEQ ID NO: 24400 - protein, 9 aa, Artificial Sequence
  T-complex protein 1 subunit alpha (459-467)
DSTDLVAKL

SEQ ID NO: 24401 - protein, 9 aa, Artificial Sequence
  Signal-induced proliferation-associated 1-like protein 2 (438-446)
DSTGTHSLY

SEQ ID NO: 24402 - protein, 11 aa, Artificial Sequence
  Heterogeneous nuclear ribonucleoprotein A1-like 2 (4-14)
DSVDKIVIQKY

SEQ ID NO: 24403 - protein, 11 aa, Artificial Sequence
  Mitochondrial import inner membrane translocase subunit TIM50 (212-222)
DSVDPHGFISY

SEQ ID NO: 24404 - protein, 9 aa, Artificial Sequence
  Basement membrane-specific heparan sulfate proteoglycan core protein (608-616)
DSYGGSLRY

SEQ ID NO: 24405 - protein, 9 aa, Artificial Sequence
  Transmembrane and TPR repeat-containing protein 1 (529-537)
DTAEAKMYY

SEQ ID NO: 24406 - protein, 9 aa, Artificial Sequence
  Methylthioribose-1-phosphate isomerase (208-216)
DTANKVGTY

SEQ ID NO: 24407 - protein, 10 aa, Artificial Sequence
  Apoptogenic protein 1, mitochondrial (36-45)
DTAPSGVSRF

SEQ ID NO: 24408 - protein, 13 aa, Artificial Sequence
  Solute carrier family 35 member B1 (75-87)
DTARVDRTRSWLY

SEQ ID NO: 24409 - protein, 14 aa, Artificial Sequence
  Heterogeneous nuclear ribonucleoproteins A2/B1 (110-123)
DTEEHHLRDYFEEY

SEQ ID NO: 24410 - protein, 14 aa, Artificial Sequence
  Heat shock 70 kDa protein 1-like (48-61)
DTERLIGDAAKNQV

SEQ ID NO: 24411 - protein, 9 aa, Artificial Sequence
  N-acetylglucosamine-1-phosphotransferase subunits alpha/beta (929-937)
DTFADSLRY

SEQ ID NO: 24412 - protein, 9 aa, Artificial Sequence
  AT-rich interactive domain-containing protein 5B (227-235)
DTFDHPTLI

SEQ ID NO: 24413 - protein, 11 aa, Artificial Sequence
  Transcription factor SOX-6 (351-361)
DTFEHGGGHSY

SEQ ID NO: 24414 - protein, 9 aa, Artificial Sequence
  Triple functional domain protein (2621-2629)
DTFETPTSY

SEQ ID NO: 24415 - protein, 11 aa, Artificial Sequence
  Dolichyl-diphosphooligosaccharide-proteinosyltransferase subunit 1 (402-412)
DTFGRPVIVAY

SEQ ID NO: 24416 - protein, 11 aa, Artificial Sequence
  CTTNBP2 N-terminal-like protein (57-67)
DTFIEERYGKY

SEQ ID NO: 24417 - protein, 10 aa, Artificial Sequence
  UTP-glucose-1-phosphate uridylyltransferase (237-246)
DTFIGEGKEY

SEQ ID NO: 24418 - protein, 13 aa, Artificial Sequence
  Interferon-related developmental regulator 1 (375-387)
DTFKEVLGSGMQY

SEQ ID NO: 24419 - protein, 10 aa, Artificial Sequence
  H2.0-like homeobox protein (254-263)
DTFPGPYAVL

SEQ ID NO: 24420 - protein, 9 aa, Artificial Sequence
  G-protein coupled receptor 126 (533-541)
DTFSHSTKF

SEQ ID NO: 24421 - protein, 9 aa, Artificial Sequence
  Rhophilin-2 (261-269)
DTFTHTPSY

SEQ ID NO: 24422 - protein, 9 aa, Artificial Sequence
  40S ribosomal protein S14 (39-47)
DTFVHVTDL

SEQ ID NO: 24423 - protein, 10 aa, Artificial Sequence
  Lysosomal glucocerebrosidase precursor (428-437)
DTFYKQPMFY

SEQ ID NO: 24424 - protein, 9 aa, Artificial Sequence
  Zinc finger CCCH-type with G patch domain-containing protein (515-523)
DTHKKMTEF

SEQ ID NO: 24425 - protein, 9 aa, Artificial Sequence
  Utrophin (3189-3197)
DTHSRIEQY

SEQ ID NO: 24426 - protein, 10 aa, Artificial Sequence
  C2 domain-containing protein 5 (611-620)
DTIAKNKELY

SEQ ID NO: 24427 - protein, 12 aa, Artificial Sequence
  Polyadenylate-binding protein 4 (303-314)
DTIDDEKLRKEF

SEQ ID NO: 24428 - protein, 11 aa, Artificial Sequence
  Plastin-3 (116-126)
DTIDERAINKK

SEQ ID NO: 24429 - protein, 9 aa, Artificial Sequence
  Kin of IRRE-like protein 1 (277-285)
DTIDTREEY

SEQ ID NO: 24430 - protein, 14 aa, Artificial Sequence
  Small ubiquitin-related modifier 2 isoform b precursor (58-71)
DTIDVFQQQTGGVY

SEQ ID NO: 24431 - protein, 12 aa, Artificial Sequence
  SUMO-activating enzyme subunit 2 (50-61)
DTIDVSNLNRQF

SEQ ID NO: 24432 - protein, 9 aa, Artificial Sequence
  Tryptophan-tRNA ligase, cytoplasmic (382-390)
DTIEEHRQF

SEQ ID NO: 24433 - protein, 13 aa, Artificial Sequence
  Heterogeneous nuclear ribonucleoproteins A2/B1 (127-139)
DTIEIITDRQSGK

SEQ ID NO: 24434 - protein, 9 aa, Artificial Sequence
  Unconventional myosin-Id (61-69)
DTIEQYKGR

SEQ ID NO: 24435 - protein, 12 aa, Artificial Sequence
  Ubiquitin-like protein 5 (22-33)
DTIGDLKKLIAA

SEQ ID NO: 24436 - protein, 10 aa, Artificial Sequence
  Trifunctional purine biosynthetic protein adenosine-3 (45-54)
DTIGQDLVAM

SEQ ID NO: 24437 - protein, 9 aa, Artificial Sequence
  Cytoplasmic polyadenylation element-binding protein 4 (17-25)
DTIKGRLNY

SEQ ID NO: 24438 - protein, 9 aa, Artificial Sequence
  Mitochondrial dynamics protein MID51 (222-230)
DTIMNVPGF

SEQ ID NO: 24439 - protein, 11 aa, Artificial Sequence
  UPF0489 protein C5orf22 (148-158)
DTIQEKVLNML

SEQ ID NO: 24440 - protein, 10 aa, Artificial Sequence
  Coiled-coil and C2 domain-containing protein 2A (426-435)
DTIQKTINEY

SEQ ID NO: 24441 - protein, 9 aa, Artificial Sequence
  Interferon-induced helicase C domain-containing protein 1 (615-623)
DTIRMIDAY

SEQ ID NO: 24442 - protein, 9 aa, Artificial Sequence
  Zinc finger protein 143 (92-100)
DTISALEQY

SEQ ID NO: 24443 - protein, 10 aa, Artificial Sequence
  Gamma-interferon-inducible protein 16 (447-456)
DTISKMNDFM

SEQ ID NO: 24444 - protein, 12 aa, Artificial Sequence
  Gamma-interferon-inducible protein 16 (447-458)
DTISKMNDFMRM

SEQ ID NO: 24445 - protein, 9 aa, Artificial Sequence
  Sphingolipid delta(4)-desaturase DES1 (268-276)
DTISPYSRM

SEQ ID NO: 24446 - protein, 11 aa, Artificial Sequence
  Pre-mRNA-splicing factor RBM22 (241-251)
DTITETDLRNH

SEQ ID NO: 24447 - protein, 12 aa, Artificial Sequence
  Pre-mRNA-splicing factor RBM22 (241-252)
DTITETDLRNHF

SEQ ID NO: 24448 - protein, 13 aa, Artificial Sequence
  Pre-mRNA-splicing factor RBM22 (241-253)
DTITETDLRNHFY

SEQ ID NO: 24449 - protein, 11 aa, Artificial Sequence
  Intermediate filament family orphan 1 (232-242)
DTITPEIRALY

SEQ ID NO: 24450 - protein, 10 aa, Artificial Sequence
  Condensin complex subunit 1 (61-70)
DTIYSILHHF

SEQ ID NO: 24451 - protein, 9 aa, Artificial Sequence
  Protein SCO1 homolog, mitochondrial (97-105)
DTKEAIANY

SEQ ID NO: 24452 - protein, 9 aa, Artificial Sequence
  Amyloid beta A4 protein (64-72)
DTKEGILQY

SEQ ID NO: 24453 - protein, 9 aa, Artificial Sequence
  Intraflagellar transport protein 74 homolog (328-336)
DTKEKINQF

SEQ ID NO: 24454 - protein, 9 aa, Artificial Sequence
  Charged multivesicular body protein 5 (21-29)
DTKTTVDAM

SEQ ID NO: 24455 - protein, 9 aa, Artificial Sequence
  DNA-directed RNA polymerase II subunit RPB2 (738-746)
DTLAHVLYY

SEQ ID NO: 24456 - protein, 9 aa, Artificial Sequence
  Presenilin-2 (439-447)
DTLASHQLY

SEQ ID NO: 24457 - protein, 9 aa, Artificial Sequence
  Acidic fibroblast growth factor intracellular-binding protein (55-63)
DTMDHYRTF

SEQ ID NO: 24458 - protein, 9 aa, Artificial Sequence
  Parafibromin (134-142)
DTMGTYHGM

SEQ ID NO: 24459 - protein, 10 aa, Artificial Sequence
  Dual specificity protein phosphatase 10 (341-350)
DTMQRLNIGY

SEQ ID NO: 24460 - protein, 9 aa, Artificial Sequence
  FRAS1-related extracellular matrix protein 2 (1562-1570)
DTPDKLLKF

SEQ ID NO: 24461 - protein, 9 aa, Artificial Sequence
  Translin-associated protein X (212-220)
DTPFEVSQF

SEQ ID NO: 24462 - protein, 10 aa, Artificial Sequence
  Translation factor GUF1, mitochondrial (140-149)
DTPGHVDFSY

SEQ ID NO: 24463 - protein, 9 aa, Artificial Sequence
  Protein KIAA0100 (293-301)
DTPPFALGF

SEQ ID NO: 24464 - protein, 9 aa, Artificial Sequence
  Nuclear receptor subfamily 4 group A member 2 (395-403)
DTQHIQQFY

SEQ ID NO: 24465 - protein, 9 aa, Artificial Sequence
  Nuclear protein localization protein 4 homolog (319-327)
DTRKGTVRY

SEQ ID NO: 24466 - protein, 9 aa, Artificial Sequence
  Nuclear pore complex protein Nup205 (1075-1083)
DTSGPTMRY

SEQ ID NO: 24467 - protein, 9 aa, Artificial Sequence
  Disintegrin and metalloproteinase domain-containing protein 10 (98-106)
DTSHIYTGH

SEQ ID NO: 24468 - protein, 10 aa, Artificial Sequence
  Protein YIF1B (38-47)
DTSSAQSRGY

SEQ ID NO: 24469 - protein, 9 aa, Artificial Sequence
  NHS-like protein 1 (768-776)
DTSSVKSEY

SEQ ID NO: 24470 - protein, 9 aa, Artificial Sequence
  Peptidyl-glycine alpha-amidating monooxygenase (99-107)
DTVHHMLLF

SEQ ID NO: 24471 - protein, 9 aa, Artificial Sequence
  E3 SUMO-protein ligase RanBP2 (3197-3205)
DTVKKIESF

SEQ ID NO: 24472 - protein, 9 aa, Artificial Sequence
  Nodal modulator 3 (6-14)
DTVKQMNKY

SEQ ID NO: 24473 - protein, 9 aa, Artificial Sequence
  Rho GTPase-activating protein 31 (892-900)
DTVTDIAQH

SEQ ID NO: 24474 - protein, 11 aa, Artificial Sequence
  E3 ubiquitin-protein ligase MYLIP (278-288)
DTVTSAVMMQY

SEQ ID NO: 24475 - protein, 11 aa, Artificial Sequence
  Eukaryotic translation initiation factor 4H (5-15)
DTYDDRAYSSF

SEQ ID NO: 24476 - protein, 11 aa, Artificial Sequence
  Vacuolar fusion protein CCZ1 homolog (308-318)
DTYEELHLIVY

SEQ ID NO: 24477 - protein, 12 aa, Artificial Sequence
  Ethanolamine-phosphate cytidylyltransferase (124-135)
DTYEEVKQAGRY

SEQ ID NO: 24478 - protein, 12 aa, Artificial Sequence
  Beta-secretase 2 (127-138)
DTYFDTERSSTY

SEQ ID NO: 24479 - protein, 10 aa, Artificial Sequence
  Glycoprotein endo-alpha-1,2-mannosidase-like protein (245-254)
DTYGSHGAFY

SEQ ID NO: 24480 - protein, 10 aa, Artificial Sequence
  Mid1-interacting protein 1 (5-14)
DTYNQKHSLF

SEQ ID NO: 24481 - protein, 10 aa, Artificial Sequence
  Tetratricopeptide repeat protein 37 (1017-1026)
DTYNVAIRNY

SEQ ID NO: 24482 - protein, 10 aa, Artificial Sequence
  Zinc finger CCCH domain-containing protein 13 (520-529)
DTYPEESRSY

SEQ ID NO: 24483 - protein, 11 aa, Artificial Sequence
  Cartilage acidic protein 1 (17-27)
DVAAEAGVSKY

SEQ ID NO: 24484 - protein, 11 aa, Artificial Sequence
  Putative GTP-binding protein 6 (258-268)
DVAHSDLILHV

SEQ ID NO: 24485 - protein, 9 aa, Artificial Sequence
  Polynucleotide 5'-hydroxyl-kinase NOL9 (563-571)
DVAPTHILY

SEQ ID NO: 24486 - protein, 12 aa, Artificial Sequence
  Hsc70-interacting protein (337-348)
DVAQNPANMSKY

SEQ ID NO: 24487 - protein, 11 aa, Artificial Sequence
  WD repeat domain-containing protein 83 (95-105)
DVASGQVVRKF

SEQ ID NO: 24488 - protein, 9 aa, Artificial Sequence
  Protein S100-B (13-21)
DVFHQYSGR

SEQ ID NO: 24489 - protein, 10 aa, Artificial Sequence
  Sentrin-specific protease 5 (531-540)
DVFNEDFSNR

SEQ ID NO: 24490 - protein, 10 aa, Artificial Sequence
  Nicotinamide phosphoribosyltransferase (94-103)
DVFNEKGWNY

SEQ ID NO: 24491 - protein, 10 aa, Artificial Sequence
  DNA excision repair protein ERCC-8 (78-87)
DVFNFEETVY

SEQ ID NO: 24492 - protein, 11 aa, Artificial Sequence
  Phosphomannomutase 1 (190-200)
DVFPEGWDKRY

SEQ ID NO: 24493 - protein, 10 aa, Artificial Sequence
  Serine/threonine-protein kinase N3 (654-663)
DVFPEPQARF

SEQ ID NO: 24494 - protein, 10 aa, Artificial Sequence
  Solute carrier family 23 member 2 (334-343)
DVFPPDSTKY

SEQ ID NO: 24495 - protein, 13 aa, Artificial Sequence
  Solute carrier family 23 member 2 (334-346)
DVFPPDSTKYGFY

SEQ ID NO: 24496 - protein, 11 aa, Artificial Sequence
  MOB kinase activator 2 (126-136)
DVFPTKYGREF

SEQ ID NO: 24497 - protein, 10 aa, Artificial Sequence
  U4/U6.U5 tri-snRNP-associated protein 2 (186-195)
DVFQGSMRIF

SEQ ID NO: 24498 - protein, 9 aa, Artificial Sequence
  Ankyrin repeat and BTB/POZ domain-containing protein 1 (59-67)
DVFTHVLYY

SEQ ID NO: 24499 - protein, 13 aa, Artificial Sequence
  General transcription factor II-I (53-65)
DVFVVGTERGRAF

SEQ ID NO: 24500 - protein, 12 aa, Artificial Sequence
  HLA class I histocompatibility antigen, A-1 alpha chain (101-112)
DVGPDGRFLRGY

SEQ ID NO: 24501 - protein, 10 aa, Artificial Sequence
  Histone deacetylase 6 (104-113)
DVHHGQGTQF

SEQ ID NO: 24502 - protein, 10 aa, Artificial Sequence
  Kaptin (205-214)
DVHNFPGTSR

SEQ ID NO: 24503 - protein, 10 aa, Artificial Sequence
  Neutral alpha-glucosidase AB (329-338)
DVHNIYGLYV

SEQ ID NO: 24504 - protein, 9 aa, Artificial Sequence
  Speriolin-like protein (115-123)
DVHPAFSEF

SEQ ID NO: 24505 - protein, 12 aa, Artificial Sequence
  Caveolin-1 (5-16)
DVIAEPEGTHSF

SEQ ID NO: 24506 - protein, 11 aa, Artificial Sequence
  Death effector domain-containing protein (51-61)
DVIDDHERGLI

SEQ ID NO: 24507 - protein, 9 aa, Artificial Sequence
  Protein LDOC1L (24-32)
DVIDTLTSL

SEQ ID NO: 24508 - protein, 9 aa, Artificial Sequence
  Uncharacterized protein C20orf194 (832-840)
DVIDVVQAL

SEQ ID NO: 24509 - protein, 9 aa, Artificial Sequence
  ATP-dependent RNA helicase DHX36 (400-408)
DVIEKIRYV

SEQ ID NO: 24510 - protein, 11 aa, Artificial Sequence
  E3 ubiquitin-protein ligase RNF213 (1304-1314)
DVIFKDFVNKY

SEQ ID NO: 24511 - protein, 9 aa, Artificial Sequence
  60S ribosomal protein L3 (213-221)
DVIGVTKGK

SEQ ID NO: 24512 - protein, 11 aa, Artificial Sequence
  60S ribosomal protein L3 (213-223)
DVIGVTKGKGY

SEQ ID NO: 24513 - protein, 12 aa, Artificial Sequence
  Triple functional domain protein (785-796)
DVIHQGQDLLQY

SEQ ID NO: 24514 - protein, 9 aa, Artificial Sequence
  Ran GTPase-activating protein 1 (40-48)
DVIKEIEDF

SEQ ID NO: 24515 - protein, 9 aa, Artificial Sequence
  Spindle and kinetochore-associated protein 1 (163-171)
DVIKEINKA

SEQ ID NO: 24516 - protein, 10 aa, Artificial Sequence
  Cytoplasmic dynein 2 heavy chain 1 (2609-2618)
DVIKKGLIHY

SEQ ID NO: 24517 - protein, 9 aa, Artificial Sequence
  Fanconi anemia group D2 protein (348-356)
DVIKSAIRY

SEQ ID NO: 24518 - protein, 9 aa, Artificial Sequence
  Elongation factor G, mitochondrial (730-738)
DVINKYLEA

SEQ ID NO: 24519 - protein, 13 aa, Artificial Sequence
  Thioredoxin-related transmembrane protein 4 (92-104)
DVIQEPGLSGRFF

SEQ ID NO: 24520 - protein, 9 aa, Artificial Sequence
  WD repeat-containing protein 26 (126-134)
DVIRLIGQH

SEQ ID NO: 24521 - protein, 9 aa, Artificial Sequence
  Coenzyme Q-binding protein COQ10 homolog B, mitochondrial (62-70)
DVISKRSGY

SEQ ID NO: 24522 - protein, 9 aa, Artificial Sequence
  Mediator of RNA polymerase II transcription subunit 27 (126-134)
DVISRIDRM

SEQ ID NO: 24523 - protein, 10 aa, Artificial Sequence
  Antigen KI-67 (86-95)
DVITIIDRSF

SEQ ID NO: 24524 - protein, 12 aa, Artificial Sequence
  Antigen KI-67 (86-97)
DVITIIDRSFRY

SEQ ID NO: 24525 - protein, 12 aa, Artificial Sequence
  ER membrane protein complex subunit 1 (96-107)
DVITVSNGGRIM

SEQ ID NO: 24526 - protein, 10 aa, Artificial Sequence
  40S ribosomal protein S18 (89-98)
DVKDGKYSQV

SEQ ID NO: 24527 - protein, 9 aa, Artificial Sequence
  Cell cycle progression protein 1 (703-711)
DVKDYLRNM

SEQ ID NO: 24528 - protein, 9 aa, Artificial Sequence
  Transmembrane protein 168 (117-125)
DVKEESTKY

SEQ ID NO: 24529 - protein, 9 aa, Artificial Sequence
  Nuclear pore complex protein Nup107 (812-820)
DVKEKMYNV

SEQ ID NO: 24530 - protein, 10 aa, Artificial Sequence
  UTP-glucose-1-phosphate uridylyltransferase (289-298)
DVKGGTLTQY

SEQ ID NO: 24531 - protein, 9 aa, Artificial Sequence
  Lon protease homolog, mitochondrial (277-285)
DVKKRILEF

SEQ ID NO: 24532 - protein, 9 aa, Artificial Sequence
  DDB1- and CUL4-associated factor 4 (130-138)
DVKVGGSKY

SEQ ID NO: 24533 - protein, 13 aa, Artificial Sequence
  Lon protease homolog, mitochondrial (129-141)
DVLEETNIPKRLY

SEQ ID NO: 24534 - protein, 9 aa, Artificial Sequence
  AP-2 complex subunit mu (176-184)
DVLESVNLL

SEQ ID NO: 24535 - protein, 17 aa, Artificial Sequence
  PRKR-interacting protein 1 (66-82)
DVMGSSAGAGSGEFHVY

SEQ ID NO: 24536 - protein, 9 aa, Artificial Sequence
  Rho-associated protein kinase 2 (99-107)
DVPEKWAKF

SEQ ID NO: 24537 - protein, 9 aa, Artificial Sequence
  Rho-associated protein kinase 1 (169-177)
DVPEKWARF

SEQ ID NO: 24538 - protein, 9 aa, Artificial Sequence
  Protein diaphanous homolog 2 (54-62)
DVRDRITSF

SEQ ID NO: 24539 - protein, 9 aa, Artificial Sequence
  RIB43A-like with coiled-coils protein 2 (62-70)
DVRNTISGM

SEQ ID NO: 24540 - protein, 9 aa, Artificial Sequence
  Dipeptidyl peptidase 1 (107-115)
DVTDFISHL

SEQ ID NO: 24541 - protein, 9 aa, Artificial Sequence
  RANBP2-like and GRIP domain-containing protein 2 (107-115)
DVTDGRAKY

SEQ ID NO: 24542 - protein, 9 aa, Artificial Sequence
  TATA box-binding protein-associated factor RNA polymerase I subunit C (102-110)
DVTEQISRF

SEQ ID NO: 24543 - protein, 10 aa, Artificial Sequence
  Zinc finger protein 552 (41-50)
DVTLENLALM

SEQ ID NO: 24544 - protein, 9 aa, Artificial Sequence
  Bromodomain adjacent to zinc finger domain protein 1A (531-539)
DVTSANAKY

SEQ ID NO: 24545 - protein, 10 aa, Artificial Sequence
  Trafficking protein particle complex subunit 2-like protein (7-16)
DVVDEKISAM

SEQ ID NO: 24546 - protein, 9 aa, Artificial Sequence
  Sorting nexin-8 (312-320)
DVVEKLNLF

SEQ ID NO: 24547 - protein, 11 aa, Artificial Sequence
  DCN1-like protein 4 (58-68)
DVVGPEGMEKF

SEQ ID NO: 24548 - protein, 9 aa, Artificial Sequence
  Inositol-trisphosphate 3-kinase B (718-726)
DVVKDGERY

SEQ ID NO: 24549 - protein, 9 aa, Artificial Sequence
  Cold shock domain-containing protein E1 (173-181)
DVVKEIFFH

SEQ ID NO: 24550 - protein, 10 aa, Artificial Sequence
  Cold shock domain-containing protein E1 (173-182)
DVVKEIFFHY

SEQ ID NO: 24551 - protein, 13 aa, Artificial Sequence
  Peptidyl-prolyl cis-trans isomerase H (34-46)
DVVPKTAENFRQF

SEQ ID NO: 24552 - protein, 9 aa, Artificial Sequence
  Glypican-1 (232-240)
DVVRKVAQV

SEQ ID NO: 24553 - protein, 10 aa, Artificial Sequence
  F-box only protein 31 (25-34)
DVYAKLLHRY

SEQ ID NO: 24554 - protein, 11 aa, Artificial Sequence
  26S proteasome non-ATPase regulatory subunit 1 (492-502)
DVYDLLKTNLY

SEQ ID NO: 24555 - protein, 11 aa, Artificial Sequence
  RNA polymerase II-associated factor 1 homolog (252-262)
DVYDYKIAREY

SEQ ID NO: 24556 - protein, 11 aa, Artificial Sequence
  Cat eye syndrome critical region protein 5 (318-328)
DVYGANLFHQY

SEQ ID NO: 24557 - protein, 9 aa, Artificial Sequence
  Cystathionine gamma-lyase (112-120)
DVYGGTNRY

SEQ ID NO: 24558 - protein, 10 aa, Artificial Sequence
  Cystathionine gamma-lyase (112-121)
DVYGGTNRYF

SEQ ID NO: 24559 - protein, 10 aa, Artificial Sequence
  Transcription elongation factor SPT6 (339-348)
DVYNHFLLYY

SEQ ID NO: 24560 - protein, 10 aa, Artificial Sequence
  Inactive tyrosine-protein kinase 7 (954-963)
DVYNSEYYHF

SEQ ID NO: 24561 - protein, 10 aa, Artificial Sequence
  Melanoma-associated antigen D1 (507-516)
DVYPEIIERA

SEQ ID NO: 24562 - protein, 12 aa, Artificial Sequence
  Melanoma-associated antigen D2 (315-326)
DVYPEIIERAGY

SEQ ID NO: 24563 - protein, 11 aa, Artificial Sequence
  ATP synthase mitochondrial F1 complex assembly factor 1 (232-242)
EAAASQLILYH

SEQ ID NO: 24564 - protein, 11 aa, Artificial Sequence
  Uncharacterized protein C20orf194 (141-151)
EAAEEFKITSF

SEQ ID NO: 24565 - protein, 12 aa, Artificial Sequence
  Calpain small subunit 1 (199-210)
EAAGFHLNEHLY

SEQ ID NO: 24566 - protein, 9 aa, Artificial Sequence
  Protein GREB1 (686-694)
EAAPDIMHY

SEQ ID NO: 24567 - protein, 11 aa, Artificial Sequence
  ATP-dependent DNA helicase Q4 (32-42)
EAAPEETRALY

SEQ ID NO: 24568 - protein, 11 aa, Artificial Sequence
  Metal transporter CNNM3 (26-36)
EAAPGPRVLGF

SEQ ID NO: 24569 - protein, 11 aa, Artificial Sequence
  Nucleoside diphosphate kinase, mitochondrial (131-141)
EAAPGTIRGDF

SEQ ID NO: 24570 - protein, 9 aa, Artificial Sequence
  3-hydroxy-3-methylglutaryl-coenzyme A reductase (567-575)
EAFDSTSRF

SEQ ID NO: 24571 - protein, 10 aa, Artificial Sequence
  Isovaleryl-CoA dehydrogenase, mitochondrial (310-319)
EAFGQKIGHF

SEQ ID NO: 24572 - protein, 11 aa, Artificial Sequence
  Proteasome activator complex subunit 3 (94-104)
EAFQGTKVFVM

SEQ ID NO: 24573 - protein, 10 aa, Artificial Sequence
  Proteasome activator complex subunit 2 (158-167)
EAFQTTISKY

SEQ ID NO: 24574 - protein, 9 aa, Artificial Sequence
  Chloride intracellular channel protein 1 (201-209)
EAFRGVHRY

SEQ ID NO: 24575 - protein, 10 aa, Artificial Sequence
  Growth arrest-specific protein 8 (145-154)
EAFTDIKNYY

SEQ ID NO: 24576 - protein, 9 aa, Artificial Sequence
  Ras-related protein Rab-27A (147-155)
EAIALAEKY

SEQ ID NO: 24577 - protein, 10 aa, Artificial Sequence
  Alpha-actinin-4 (524-533)
EAIDQLHLEY

SEQ ID NO: 24578 - protein, 10 aa, Artificial Sequence
  Small integral membrane protein 8 (79-88)
EAIDSEGHSY

SEQ ID NO: 24579 - protein, 11 aa, Artificial Sequence
  Small integral membrane protein 8 (79-89)
EAIDSEGHSYM

SEQ ID NO: 24580 - protein, 11 aa, Artificial Sequence
  Condensin complex subunit 1 (636-646)
EAIGIISKMMY

SEQ ID NO: 24581 - protein, 11 aa, Artificial Sequence
  Nuclear pore complex protein Nup133 (332-342)
EAIKEGVNIRY

SEQ ID NO: 24582 - protein, 10 aa, Artificial Sequence
  Synergin gamma (170-179)
EAIKGNLDGF

SEQ ID NO: 24583 - protein, 9 aa, Artificial Sequence
  N-lysine methyltransferase SMYD2 (289-297)
EAIRDMVRY

SEQ ID NO: 24584 - protein, 11 aa, Artificial Sequence
  Trabeculin-alpha (3748-3758)
EAISLLNSERY

SEQ ID NO: 24585 - protein, 10 aa, Artificial Sequence
  KN motif and ankyrin repeat domain-containing protein 1 (1144-1153)
EAISPDVLRY

SEQ ID NO: 24586 - protein, 13 aa, Artificial Sequence
  E3 ubiquitin-protein ligase Praja-1 (266-278)
EAISYVDPQFLTY

SEQ ID NO: 24587 - protein, 9 aa, Artificial Sequence
  DNA replication licensing factor MCM5 (614-622)
EAIVRIAEA

SEQ ID NO: 24588 - protein, 10 aa, Artificial Sequence
  Nucleoporin Nup43 (370-379)
EAIYVTRHLF

SEQ ID NO: 24589 - protein, 11 aa, Artificial Sequence
  UDP-glucose 6-dehydrogenase (76-86)
EALNLPEVARY

SEQ ID NO: 24590 - protein, 9 aa, Artificial Sequence
  Centromere protein F (1214-1222)
EAMLRNKEL

SEQ ID NO: 24591 - protein, 9 aa, Artificial Sequence
  Heme-binding protein 1 (57-65)
EAMPKVAKY

SEQ ID NO: 24592 - protein, 10 aa, Artificial Sequence
  Cytoskeleton-associated protein 5 (1575-1584)
EAMSGHIDQF

SEQ ID NO: 24593 - protein, 9 aa, Artificial Sequence
  Pre-mRNA-processing-splicing factor 8 (1105-1113)
EARDLIQRY

SEQ ID NO: 24594 - protein, 13 aa, Artificial Sequence
  Syntenin-1 (34-46)
EASAPIPHDGNLY

SEQ ID NO: 24595 - protein, 9 aa, Artificial Sequence
  Lysine-specific demethylase 7A (449-457)
EATSPYHSR

SEQ ID NO: 24596 - protein, 11 aa, Artificial Sequence
  TNF receptor-associated factor 5 (400-410)
EAVDGHTVSIF

SEQ ID NO: 24597 - protein, 12 aa, Artificial Sequence
  Mitochondrial-processing peptidase subunit alpha (283-294)
EAVDIDRSVAQY

SEQ ID NO: 24598 - protein, 9 aa, Artificial Sequence
  Transcriptional enhancer factor TEF-3 (263-271)
EAVDIRQIY

SEQ ID NO: 24599 - protein, 10 aa, Artificial Sequence
  LIX1-like protein (28-37)
EAVEAVVRSF

SEQ ID NO: 24600 - protein, 10 aa, Artificial Sequence
  Integrin alpha-7 (432-441)
EAVGIKSFGY

SEQ ID NO: 24601 - protein, 10 aa, Artificial Sequence
  Phosphatidylinositol 3-kinase regulatory subunit alpha (173-182)
EAVGKKLHEY

SEQ ID NO: 24602 - protein, 10 aa, Artificial Sequence
  26S protease regulatory subunit 7 (411-420)
EAVNKVIKSY

SEQ ID NO: 24603 - protein, 9 aa, Artificial Sequence
  Methyltransferase-like protein 13 (244-252)
EAVQERQQY

SEQ ID NO: 24604 - protein, 9 aa, Artificial Sequence
  Renalase (186-194)
EAVSYSSRY

SEQ ID NO: 24605 - protein, 10 aa, Artificial Sequence
  Poly (ADP-ribose) polymerase 4 (695-704)
EAVTQGHGAY

SEQ ID NO: 24606 - protein, 9 aa, Artificial Sequence
  Importin subunit alpha-1 (396-404)
EAVWAVTNY

SEQ ID NO: 24607 - protein, 10 aa, Artificial Sequence
  DNA replication licensing factor MCM4 (656-665)
EAYDRRLAHH

SEQ ID NO: 24608 - protein, 9 aa, Artificial Sequence
  Trafficking protein particle complex subunit 12 (300-308)
EAYHSVIKY

SEQ ID NO: 24609 - protein, 10 aa, Artificial Sequence
  Leucine-rich PPR motif-containing protein, mitochondrial (1198-1207)
EAYNSLMKSY

SEQ ID NO: 24610 - protein, 9 aa, Artificial Sequence
  Protein mago nashi homolog 2 (5-13)
EAYVHKSVM

SEQ ID NO: 24611 - protein, 9 aa, Artificial Sequence
  Coatomer subunit beta (79-87)
EAYVHVNQY

SEQ ID NO: 24612 - protein, 11 aa, Artificial Sequence
  Sorting and assembly machinery component 50 homolog (365-375)
EAYWAGGLHLY

SEQ ID NO: 24613 - protein, 9 aa, Artificial Sequence
  Superkiller viralicidic activity 2-like 2 (938-946)
ECAKRIAKV

SEQ ID NO: 24614 - protein, 10 aa, Artificial Sequence
  Vimentin (180-189)
EDIMRLREKL

SEQ ID NO: 24615 - protein, 9 aa, Artificial Sequence
  U3 small nucleolar ribonucleoprotein protein IMP3 (43-51)
EDYTRYNQL

SEQ ID NO: 24616 - protein, 9 aa, Artificial Sequence
  Ataxin-10 (298-306)
EEALATIRL

SEQ ID NO: 24617 - protein, 10 aa, Artificial Sequence
  Transmembrane protein 150C (126-135)
EEIHNVGTSL

SEQ ID NO: 24618 - protein, 9 aa, Artificial Sequence
  Zinc finger FYVE domain-containing protein 16 (415-423)
EEIQNSVVL

SEQ ID NO: 24619 - protein, 9 aa, Artificial Sequence
  Cofilin-1 (141-149)
EEVKDRCTL

SEQ ID NO: 24620 - protein, 14 aa, Artificial Sequence
  Phosphoglycerate kinase 1 (404-417)
EGKVLPGVDALSNI

SEQ ID NO: 24621 - protein, 9 aa, Artificial Sequence
  NADH dehydrogenase (ubiquinone) 1 alpha subcomplex subunit 11 (51-59)
EGVAKVGQY

SEQ ID NO: 24622 - protein, 9 aa, Artificial Sequence
  (Pyruvate dehydrogenase (acetyl-transferring)) kinase isozyme 4, mitochondrial (229-237)
EHQENQPSL

SEQ ID NO: 24623 - protein, 10 aa, Artificial Sequence
  Intraflagellar transport protein 172 homolog (6-15)
EIADQVSREY

SEQ ID NO: 24624 - protein, 9 aa, Artificial Sequence
  Alpha- and gamma-adaptin-binding protein p34 (72-80)
EIAESVQAF

SEQ ID NO: 24625 - protein, 9 aa, Artificial Sequence
  Cleavage and polyadenylation specificity factor subunit 3 (29-37)
EIAGVKLLY

SEQ ID NO: 24626 - protein, 10 aa, Artificial Sequence
  Carbohydrate sulfotransferase 10 (216-225)
EIAPGIIRKY

SEQ ID NO: 24627 - protein, 10 aa, Artificial Sequence
  Fatty acid synthase (760-769)
EIAPHALLQA

SEQ ID NO: 24628 - protein, 10 aa, Artificial Sequence
  Cullin-7 (1259-1268)
EIATTFEHYY

SEQ ID NO: 24629 - protein, 10 aa, Artificial Sequence
  Exportin-2 (752-761)
EIFDGIQPKM

SEQ ID NO: 24630 - protein, 11 aa, Artificial Sequence
  Exportin-2 (752-762)
EIFDGIQPKMF

SEQ ID NO: 24631 - protein, 9 aa, Artificial Sequence
  Utrophin (1655-1663)
EIFDGNVAH

SEQ ID NO: 24632 - protein, 9 aa, Artificial Sequence
  Cold shock domain-containing protein E1 (177-185)
EIFFHYSEF

SEQ ID NO: 24633 - protein, 11 aa, Artificial Sequence
  Neuron navigator 2 (2237-2247)
EIFNGLLNCKY

SEQ ID NO: 24634 - protein, 10 aa, Artificial Sequence
  F-box only protein 25 (53-62)
EIFNNEEHEY

SEQ ID NO: 24635 - protein, 10 aa, Artificial Sequence
  Ubiquitin-protein ligase E3A (558-567)
EIFNPDIGMF

SEQ ID NO: 24636 - protein, 10 aa, Artificial Sequence
  Exportin-4 (988-997)
EIFPEKIPQL

SEQ ID NO: 24637 - protein, 9 aa, Artificial Sequence
  Interferon-induced GTP-binding protein Mx1 (576-584)
EIFQHLMAY

SEQ ID NO: 24638 - protein, 9 aa, Artificial Sequence
  Zinc finger CCCH-type antiviral protein 1 (57-65)
EIHHLHPEY

SEQ ID NO: 24639 - protein, 13 aa, Artificial Sequence
  Nuclear pore complex protein Nup205 (794-806)
EIIAYKPPGFSLM

SEQ ID NO: 24640 - protein, 10 aa, Artificial Sequence
  Caseinolytic peptidase B protein homolog (651-660)
EIIDKDSKTR

SEQ ID NO: 24641 - protein, 10 aa, Artificial Sequence
  Mitogen-activated protein kinase kinase kinase 6 (286-295)
EIIDQGPRGY

SEQ ID NO: 24642 - protein, 9 aa, Artificial Sequence
  Leucine-rich repeat and coiled-coil domain-containing protein 1 (237-245)
EIIDRMPVI

SEQ ID NO: 24643 - protein, 10 aa, Artificial Sequence
  Brefeldin A-inhibited guanine nucleotide-exchange protein 2 (645-654)
EIIEHGIELF

SEQ ID NO: 24644 - protein, 9 aa, Artificial Sequence
  Nuclear envelope integral membrane protein 1 (143-151)
EIIEKDTKY

SEQ ID NO: 24645 - protein, 9 aa, Artificial Sequence
  Complex I assembly factor TMEM126B, mitochondrial (25-33)
EIIEKNFDY

SEQ ID NO: 24646 - protein, 9 aa, Artificial Sequence
  MAGUK p55 subfamily member 5 (623-631)
EIIEKTREM

SEQ ID NO: 24647 - protein, 10 aa, Artificial Sequence
  Nucleolar pre-ribosomal-associated protein 1 (606-615)
EIIGGERSVF

SEQ ID NO: 24648 - protein, 11 aa, Artificial Sequence
  Ribosome-releasing factor 2, mitochondrial (541-551)
EIIHDRIKREY

SEQ ID NO: 24649 - protein, 12 aa, Artificial Sequence
  ATP-dependent RNA helicase DDX3X (189-200)
EIIMGNIELTRY

SEQ ID NO: 24650 - protein, 10 aa, Artificial Sequence
  Bifunctional 3'-phosphoadenosine 5'-phosphosulfate synthase 2 (546-555)
EIIPFRVAAY

SEQ ID NO: 24651 - protein, 10 aa, Artificial Sequence
  Zinc finger protein 322 (34-43)
EIIQIDGHIY

SEQ ID NO: 24652 - protein, 11 aa, Artificial Sequence
  Tuftelin-interacting protein 11 (334-344)
EIIQNDRQLQY

SEQ ID NO: 24653 - protein, 9 aa, Artificial Sequence
  Polyadenylate-binding protein-interacting protein 1 (232-240)
EIIQRIENV

SEQ ID NO: 24654 - protein, 9 aa, Artificial Sequence
  AF4/FMR2 family member 3 (304-312)
EIIREMTWL

SEQ ID NO: 24655 - protein, 12 aa, Artificial Sequence
  Centrosomal protein of 95 kDa (16-27)
EIIRLGDTAHTF

SEQ ID NO: 24656 - protein, 11 aa, Artificial Sequence
  Plectin (3616-3626)
EIIRQQGLASY

SEQ ID NO: 24657 - protein, 10 aa, Artificial Sequence
  Shugoshin-like 2 (621-630)
EIISGMNHMY

SEQ ID NO: 24658 - protein, 9 aa, Artificial Sequence
  Serine/threonine-protein phosphatase 2A 55 kDa regulatory subunit B alpha isoform (283-291)
EIISSISDV

SEQ ID NO: 24659 - protein, 10 aa, Artificial Sequence
  Mitochondrial-processing peptidase subunit alpha (407-416)
EIITKEFILM

SEQ ID NO: 24660 - protein, 10 aa, Artificial Sequence
  NEDD4-binding protein 1 (737-746)
EIITKRLLQY

SEQ ID NO: 24661 - protein, 9 aa, Artificial Sequence
  Arf-GAP with Rho-GAP domain, ANK repeat and PH domain-containing protein 2 (579-587)
EIITPYRSF

SEQ ID NO: 24662 - protein, 9 aa, Artificial Sequence
  40S ribosomal protein S16 (106-114)
EIKDILIQY

SEQ ID NO: 24663 - protein, 9 aa, Artificial Sequence
  Peroxisomal NADH pyrophosphatase NUDT12 (204-212)
EIKDKLLNY

SEQ ID NO: 24664 - protein, 9 aa, Artificial Sequence
  Double-stranded RNA-specific adenosine deaminase (298-306)
EIKEKICDY

SEQ ID NO: 24665 - protein, 9 aa, Artificial Sequence
  Ras association domain-containing protein 3 (53-61)
EIKEKVHKY

SEQ ID NO: 24666 - protein, 9 aa, Artificial Sequence
  Hsc70-interacting protein (246-254)
EIKERIERV

SEQ ID NO: 24667 - protein, 9 aa, Artificial Sequence
  Mixed lineage kinase domain-like protein (171-179)
EIKETLRQY

SEQ ID NO: 24668 - protein, 10 aa, Artificial Sequence
  Radixin (207-216)
EIKNKKGTEL

SEQ ID NO: 24669 - protein, 10 aa, Artificial Sequence
  40S ribosomal protein S15 (106-115)
EIKPEMIGHY

SEQ ID NO: 24670 - protein, 9 aa, Artificial Sequence
  G1/S-specific cyclin-D3 (51-59)
EIKPHMRKM

SEQ ID NO: 24671 - protein, 9 aa, Artificial Sequence
  Coiled-coil domain-containing protein 93 (285-293)
EIKQIVSEY

SEQ ID NO: 24672 - protein, 9 aa, Artificial Sequence
  Ras association domain-containing protein 5 (16-24)
EIKQKIDSY

SEQ ID NO: 24673 - protein, 10 aa, Artificial Sequence
  Heterogeneous nuclear ribonucleoprotein Q (352-361)
EILEKAFSQF

SEQ ID NO: 24674 - protein, 10 aa, Artificial Sequence
  Heterogeneous nuclear ribonucleoprotein R (257-266)
EILEKSFSEF

SEQ ID NO: 24675 - protein, 12 aa, Artificial Sequence
  MRG/MORF4L-binding protein (94-105)
EILPFPNPERNF

SEQ ID NO: 24676 - protein, 10 aa, Artificial Sequence
  Vacuolar protein sorting-associated protein 13A (700-709)
EIMDRAYDSF

SEQ ID NO: 24677 - protein, 10 aa, Artificial Sequence
  Structural maintenance of chromosomes protein 6 (921-930)
EIMEHRFKTY

SEQ ID NO: 24678 - protein, 11 aa, Artificial Sequence
  Tyrosine-protein phosphatase non-receptor type 3 (704-714)
EIPAANLVNKY

SEQ ID NO: 24679 - protein, 12 aa, Artificial Sequence
  Transmembrane emp24 domain-containing protein 4 (45-56)
EIPDETMVIGNY

SEQ ID NO: 24680 - protein, 10 aa, Artificial Sequence
  Prostacyclin synthase (472-481)
EIPEFDLSRY

SEQ ID NO: 24681 - protein, 9 aa, Artificial Sequence
  5,6-dihydroxyindole-2-carboxylic acid oxidase (465-473)
EIQWPSREF

SEQ ID NO: 24682 - protein, 11 aa, Artificial Sequence
  Fibronectin type III domain-containing protein 3B (823-833)
EIRDLLPAAQY

SEQ ID NO: 24683 - protein, 9 aa, Artificial Sequence
  Elongation factor Tu, mitochondrial (198-206)
EIRELLTEF

SEQ ID NO: 24684 - protein, 10 aa, Artificial Sequence
  Protein FAM46D (230-239)
EIRGGGLLKY

SEQ ID NO: 24685 - protein, 10 aa, Artificial Sequence
  Transcriptional repressor NF-X1 (64-73)
EISAVHQHSY

SEQ ID NO: 24686 - protein, 9 aa, Artificial Sequence
  DNA replication licensing factor MCM3 (496-504)
EISDHVLRM

SEQ ID NO: 24687 - protein, 9 aa, Artificial Sequence
  Phospholipase D2 (660-668)
EIVDRILKA

SEQ ID NO: 24688 - protein, 9 aa, Artificial Sequence
  DNA-directed RNA polymerase III subunit RPC3 (19-27)
EIVEKIGVH

SEQ ID NO: 24689 - protein, 10 aa, Artificial Sequence
  BRCA1-associated protein (136-145)
EIVHGIMHLY

SEQ ID NO: 24690 - protein, 9 aa, Artificial Sequence
  DNA mismatch repair protein Msh2 (580-588)
EIVNISSGY

SEQ ID NO: 24691 - protein, 9 aa, Artificial Sequence
  DNA-directed RNA polymerase III subunit RPC3 (265-273)
EIVRTMLRM

SEQ ID NO: 24692 - protein, 10 aa, Artificial Sequence
  Nuclear pore complex protein Nup160 (917-926)
EIVSTPRLQY

SEQ ID NO: 24693 - protein, 10 aa, Artificial Sequence
  Alpha-soluble NSF attachment protein (43-52)
EIYARAANMF

SEQ ID NO: 24694 - protein, 10 aa, Artificial Sequence
  Isocitrate dehydrogenase (NADP) cytoplasmic (130-139)
EIYDKQYKSQ

SEQ ID NO: 24695 - protein, 10 aa, Artificial Sequence
  Oligodendrocyte transcription factor 2 (209-218)
EIYGGHHAGF

SEQ ID NO: 24696 - protein, 13 aa, Artificial Sequence
  Splicing factor 3B subunit 1 (42-54)
EIYGGSDSRFAGY

SEQ ID NO: 24697 - protein, 9 aa, Artificial Sequence
  Plexin-C1 (1523-1531)
EIYKYIVKY

SEQ ID NO: 24698 - protein, 10 aa, Artificial Sequence
  Kinesin-like protein KIF2C (403-412)
EIYNGKLFDL

SEQ ID NO: 24699 - protein, 10 aa, Artificial Sequence
  Cyclin E variant ex7del (18-27)
EIYPPKLHQF

SEQ ID NO: 24700 - protein, 9 aa, Artificial Sequence
  Coatomer subunit beta' (352-360)
EIYPQTIQH

SEQ ID NO: 24701 - protein, 9 aa, Artificial Sequence
  Replication factor C subunit 2 (159-167)
EIYSKTTRF

SEQ ID NO: 24702 - protein, 9 aa, Artificial Sequence
  Alpha-soluble NSF attachment protein (109-117)
EIYTDMGRF

SEQ ID NO: 24703 - protein, 9 aa, Artificial Sequence
  FYVE and coiled-coil domain-containing protein 1 (1096-1104)
EKATTKIQE

SEQ ID NO: 24704 - protein, 9 aa, Artificial Sequence
  Tripartite motif-containing protein 42 (167-175)
EKCLRQLQK

SEQ ID NO: 24705 - protein, 10 aa, Artificial Sequence
  Protein Mis18-beta (196-205)
EKIAELKEKI

SEQ ID NO: 24706 - protein, 10 aa, Artificial Sequence
  E3 ubiquitin-protein ligase TRIM13 (190-199)
EKLQHTLDQK

SEQ ID NO: 24707 - protein, 9 aa, Artificial Sequence
  AP-2 complex subunit alpha-1 (36-44)
ELANIRSKF

SEQ ID NO: 24708 - protein, 11 aa, Artificial Sequence
  L-dopachrome tautomerase (109-119)
ELAPIGHNRMY

SEQ ID NO: 24709 - protein, 9 aa, Artificial Sequence
  Prelamin-A/C (122-130)
ELDFQKNIY

SEQ ID NO: 24710 - protein, 11 aa, Artificial Sequence
  Unconventional myosin-Va (1068-1078)
ELDLNDERLRY

SEQ ID NO: 24711 - protein, 10 aa, Artificial Sequence
  Centrosomal protein of 112 kDa (922-931)
ELEDTISSLK

SEQ ID NO: 24712 - protein, 10 aa, Artificial Sequence
  Coatomer subunit epsilon (18-27)
ELFDVKNAFY

SEQ ID NO: 24713 - protein, 10 aa, Artificial Sequence
  Histone H2A deubiquitinase MYSM1 (25-34)
ELFEQGLAKF

SEQ ID NO: 24714 - protein, 10 aa, Artificial Sequence
  General transcription factor II-I (326-335)
ELFERKYAQA

SEQ ID NO: 24715 - protein, 10 aa, Artificial Sequence
  Vacuolar protein sorting-associated protein 13A (890-899)
ELFHKDIEAF

SEQ ID NO: 24716 - protein, 12 aa, Artificial Sequence
  THO complex subunit 3 (40-51)
ELFRGHSKTREF

SEQ ID NO: 24717 - protein, 9 aa, Artificial Sequence
  Integrator complex subunit 8 (283-291)
ELIAEIGSL

SEQ ID NO: 24718 - protein, 11 aa, Artificial Sequence
  Influenza virus NS1A-binding protein (345-355)
ELIEKPMSPMQ

SEQ ID NO: 24719 - protein, 11 aa, Artificial Sequence
  Switch-associated protein 70 (177-187)
ELIELIGNGQF

SEQ ID NO: 24720 - protein, 9 aa, Artificial Sequence
  Uncharacterized protein C20orf96 (128-136)
ELIETIQEM

SEQ ID NO: 24721 - protein, 11 aa, Artificial Sequence
  Derlin-1 (173-183)
ELIGNLVGHLY

SEQ ID NO: 24722 - protein, 11 aa, Artificial Sequence
  Endoplasmin (169-179)
ELIGQFGVGFY

SEQ ID NO: 24723 - protein, 10 aa, Artificial Sequence
  High affinity cationic amino acid transporter 1 (138-147)
ELIGRPIGEF

SEQ ID NO: 24724 - protein, 9 aa, Artificial Sequence
  F-BAR domain only protein 2 (94-102)
ELIKEVQKY

SEQ ID NO: 24725 - protein, 9 aa, Artificial Sequence
  Regulatory-associated protein of mTOR (80-88)
ELINNIKYY

SEQ ID NO: 24726 - protein, 9 aa, Artificial Sequence
  Heat shock protein HSP 90-alpha (498-506)
ELIPEYLNF

SEQ ID NO: 24727 - protein, 8 aa, Artificial Sequence
  ATP-dependent DNA helicase Q1 (34-41)
ELIQKKKV

SEQ ID NO: 24728 - protein, 9 aa, Artificial Sequence
  LisH domain-containing protein FOPNL (55-63)
ELIREYLEF

SEQ ID NO: 24729 - protein, 9 aa, Artificial Sequence
  Condensin complex subunit 1 (994-1002)
ELIRGICEM

SEQ ID NO: 24730 - protein, 9 aa, Artificial Sequence
  Inositol-tetrakisphosphate 1-kinase (111-119)
ELIRKIEAY

SEQ ID NO: 24731 - protein, 9 aa, Artificial Sequence
  Probable ubiquitin carboxyl-terminal hydrolase FAF-X (1964-1972)
ELIRYISEL

SEQ ID NO: 24732 - protein, 9 aa, Artificial Sequence
  Cyclin-dependent kinase 17 (448-456)
ELITKFLQY

SEQ ID NO: 24733 - protein, 11 aa, Artificial Sequence
  AP-1 complex subunit sigma-1A (76-86)
ELITLELIHRY

SEQ ID NO: 24734 - protein, 9 aa, Artificial Sequence
  Ras GTPase-activating protein-binding protein 1 (355-363)
ELKDFFQSY

SEQ ID NO: 24735 - protein, 9 aa, Artificial Sequence
  Polypeptide N-acetylgalactosaminyltransferase 18 (200-208)
ELKEKLTEY

SEQ ID NO: 24736 - protein, 9 aa, Artificial Sequence
  Zinc finger CCCH domain-containing protein 13 (909-917)
ELKEKVSSV

SEQ ID NO: 24737 - protein, 9 aa, Artificial Sequence
  Ankyrin repeat and LEM domain-containing protein 2 (463-471)
ELKERIREY

SEQ ID NO: 24738 - protein, 9 aa, Artificial Sequence
  Histone-lysine N-methyltransferase SUV420H1 (136-144)
ELKEVIERF

SEQ ID NO: 24739 - protein, 9 aa, Artificial Sequence
  Glyceraldehyde-3-phosphate dehydrogenase, testis-specific (295-303)
ELKGKLTGM

SEQ ID NO: 24740 - protein, 9 aa, Artificial Sequence
  Periphilin-1 (355-363)
ELKHFIAEY

SEQ ID NO: 24741 - protein, 9 aa, Artificial Sequence
  Probable ATP-dependent RNA helicase DDX46 (184-192)
ELKKEIEEM

SEQ ID NO: 24742 - protein, 9 aa, Artificial Sequence
  Serine/threonine-protein kinase Nek2 (90-98)
ELKLKEIQL

SEQ ID NO: 24743 - protein, 9 aa, Artificial Sequence
  Golgin subfamily A member 4 (1075-1083)
ELKQKILLF

SEQ ID NO: 24744 - protein, 9 aa, Artificial Sequence
  CAP-Gly domain-containing linker protein 1 (612-620)
ELKTQIEKM

SEQ ID NO: 24745 - protein, 12 aa, Artificial Sequence
  Stromal cell-derived factor 2 (200-211)
ELLKAEAHHAEL

SEQ ID NO: 24746 - protein, 8 aa, Artificial Sequence
  Heat shock protein 105 kDa (312-319)
ELLQKIEV

SEQ ID NO: 24747 - protein, 11 aa, Artificial Sequence
  26S proteasome non-ATPase regulatory subunit 6 (212-222)
ELMDYKTFVTY

SEQ ID NO: 24748 - protein, 10 aa, Artificial Sequence
  Centrosomal protein CEP57L1 (4-13)
ELMHSIVGSY

SEQ ID NO: 24749 - protein, 10 aa, Artificial Sequence
  ATP-dependent RNA helicase DDX18 (213-222)
ELMTHHVHTY

SEQ ID NO: 24750 - protein, 10 aa, Artificial Sequence
  Puromycin-sensitive aminopeptidase (151-160)
ELNDKMKGFY

SEQ ID NO: 24751 - protein, 9 aa, Artificial Sequence
  Vimentin (109-117)
ELNDRFANY

SEQ ID NO: 24752 - protein, 9 aa, Artificial Sequence
  Serine/threonine-protein kinase Nek2 (28-36)
ELNEIITRM

SEQ ID NO: 24753 - protein, 9 aa, Artificial Sequence
  Semaphorin-4C (385-393)
ELPDNILNF

SEQ ID NO: 24754 - protein, 9 aa, Artificial Sequence
  RNA polymerase II elongation factor ELL2 (524-532)
ELPDYLIKY

SEQ ID NO: 24755 - protein, 8 aa, Artificial Sequence
  Zinc finger CCCH domain-containing protein 4 (417-424)
ELPKKREL

SEQ ID NO: 24756 - protein, 9 aa, Artificial Sequence
  Nuclear pore complex protein Nup205 (523-531)
ELQGHIGRF

SEQ ID NO: 24757 - protein, 10 aa, Artificial Sequence
  Alpha-enolase (15-24)
ELRDNDKTRY

SEQ ID NO: 24758 - protein, 9 aa, Artificial Sequence
  TAR DNA-binding protein 43 (206-214)
ELREFFSQY

SEQ ID NO: 24759 - protein, 9 aa, Artificial Sequence
  Serine/threonine-protein kinase TAO3 (456-464)
ELREQMSGY

SEQ ID NO: 24760 - protein, 9 aa, Artificial Sequence
  Rho guanine nucleotide exchange factor 2 (258-266)
ELSDIHTRF

SEQ ID NO: 24761 - protein, 9 aa, Artificial Sequence
  dCTP pyrophosphatase 1 (95-103)
ELSDVLIYL

SEQ ID NO: 24762 - protein, 9 aa, Artificial Sequence
  Protein phosphatase 1 regulatory subunit 12A (956-964)
ELTDLKLQL

SEQ ID NO: 24763 - protein, 11 aa, Artificial Sequence
  Clustered mitochondria protein homolog (607-617)
ELVDAFVEHRY

SEQ ID NO: 24764 - protein, 9 aa, Artificial Sequence
  Splicing factor 3B subunit 2 (26-34)
ELVERLQSY

SEQ ID NO: 24765 - protein, 12 aa, Artificial Sequence
  F-box only protein 34 (410-421)
ELVGLPFSSHTY

SEQ ID NO: 24766 - protein, 9 aa, Artificial Sequence
  Inositol-tetrakisphosphate 1-kinase (76-84)
ELVHRFQEY

SEQ ID NO: 24767 - protein, 9 aa, Artificial Sequence
  Protein DEK (174-182)
ELVKRILNF

SEQ ID NO: 24768 - protein, 10 aa, Artificial Sequence
  Sorting nexin-4 (344-353)
ELVTGTVRTF

SEQ ID NO: 24769 - protein, 9 aa, Artificial Sequence
  DNA replication complex GINS protein PSF2 (13-21)
ELVTIIPNF

SEQ ID NO: 24770 - protein, 10 aa, Artificial Sequence
  U3 small nucleolar RNA-associated protein 15 homolog (362-371)
ELYDRDLKHF

SEQ ID NO: 24771 - protein, 10 aa, Artificial Sequence
  Pumilio homolog 3 (274-283)
ELYGNTFQLY

SEQ ID NO: 24772 - protein, 9 aa, Artificial Sequence
  TELO2-interacting protein 1 homolog (510-518)
ELYHQSVVY

SEQ ID NO: 24773 - protein, 10 aa, Artificial Sequence
  Protein RRP5 homolog (1712-1721)
ELYNRMLKRF

SEQ ID NO: 24774 - protein, 10 aa, Artificial Sequence
  Tetratricopeptide repeat protein 37 (950-959)
ELYQYNILQM

SEQ ID NO: 24775 - protein, 9 aa, Artificial Sequence
  Vacuolar fusion protein CCZ1 homolog (448-456)
ELYVILNQK

SEQ ID NO: 24776 - protein, 10 aa, Artificial Sequence
  Clathrin heavy chain 1 (1402-1411)
ELYYRAIQFY

SEQ ID NO: 24777 - protein, 9 aa, Artificial Sequence
  Dedicator of cytokinesis protein 7 (167-175)
EMKDRITYF

SEQ ID NO: 24778 - protein, 9 aa, Artificial Sequence
  Kinetochore-associated protein DSN1 homolog (194-202)
EMKEYITKF

SEQ ID NO: 24779 - protein, 9 aa, Artificial Sequence
  Actin-related protein 5 (513-521)
EMRPFRSSF

SEQ ID NO: 24780 - protein, 11 aa, Artificial Sequence
  5,6-dihydroxyindole-2-carboxylic acid oxidase (428-438)
ENAPIGHNRQY

SEQ ID NO: 24781 - protein, 11 aa, Artificial Sequence
  Eukaryotic translation initiation factor 3 subunit L (295-305)
ENIELNKKSMY

SEQ ID NO: 24782 - protein, 9 aa, Artificial Sequence
  Inositol-3-phosphate synthase 1 (246-254)
ENLLRTIEL

SEQ ID NO: 24783 - protein, 9 aa, Artificial Sequence
  15-hydroxyprostaglandin dehydrogenase (NAD(+)) (198-206)
ENMGQYIEY

SEQ ID NO: 24784 - protein, 9 aa, Artificial Sequence
  Mitogen-activated protein kinase 8 (261-269)
ENRPKYAGY

SEQ ID NO: 24785 - protein, 9 aa, Artificial Sequence
  THO complex subunit 1 (70-78)
ENVLAIISL

SEQ ID NO: 24786 - protein, 10 aa, Artificial Sequence
  Protein-methionine sulfoxide oxidase MICAL1 (261-270)
EQHPGDGHFY

SEQ ID NO: 24787 - protein, 9 aa, Artificial Sequence
  Gamma-tubulin complex component 2 (486-494)
EQIEKAFNY

SEQ ID NO: 24788 - protein, 9 aa, Artificial Sequence
  Dual specificity protein phosphatase 19 (169-177)
EQTSFTSAF

SEQ ID NO: 24789 - protein, 9 aa, Artificial Sequence
  Semaphorin-4C (402-410)
EQVGPRWSR

SEQ ID NO: 24790 - protein, 9 aa, Artificial Sequence
  Eukaryotic translation initiation factor 3 subunit A (577-585)
ERKERLESL

SEQ ID NO: 24791 - protein, 9 aa, Artificial Sequence
  Protein enabled homolog (159-167)
ERLERQERL

SEQ ID NO: 24792 - protein, 8 aa, Artificial Sequence
  Endoplasmin (719-726)
ERMLRLSL

SEQ ID NO: 24793 - protein, 9 aa, Artificial Sequence
  Nuclear factor NF-kappa-B p100 subunit (588-596)
ERQGGRTAL

SEQ ID NO: 24794 - protein, 9 aa, Artificial Sequence
  Dual specificity protein phosphatase 4 (110-118)
ERSPRAESL

SEQ ID NO: 24795 - protein, 9 aa, Artificial Sequence
  Zinc finger protein 264 (382-390)
ESAALIHHY

SEQ ID NO: 24796 - protein, 9 aa, Artificial Sequence
  Histone acetyltransferase p300 (621-629)
ESANNRAEY

SEQ ID NO: 24797 - protein, 11 aa, Artificial Sequence
  Glutamine and serine-rich protein 1 (139-149)
ESAPHLLQPQF

SEQ ID NO: 24798 - protein, 10 aa, Artificial Sequence
  Chromodomain-helicase-DNA-binding protein 9 (1356-1365)
ESAYILQGGY

SEQ ID NO: 24799 - protein, 10 aa, Artificial Sequence
  Protein fem-1 homolog B (29-38)
ESDIRYLLGY

SEQ ID NO: 24800 - protein, 11 aa, Artificial Sequence
  ER membrane protein complex subunit 1 (169-179)
ESDSIHYQMVY

SEQ ID NO: 24801 - protein, 10 aa, Artificial Sequence
  Prolyl endopeptidase FAP (88-97)
ESDYSKLWRY

SEQ ID NO: 24802 - protein, 10 aa, Artificial Sequence
  28S ribosomal protein S18b, mitochondrial (60-69)
ESEEYQERYG

SEQ ID NO: 24803 - protein, 12 aa, Artificial Sequence
  CD109 antigen (1076-1087)
ESEFSRGISDNY

SEQ ID NO: 24804 - protein, 8 aa, Artificial Sequence
  Asparagine synthetase (glutamine-hydrolyzing) (389-396)
ESERLLRE

SEQ ID NO: 24805 - protein, 10 aa, Artificial Sequence
  Serine/threonine-protein kinase Nek3 (67-76)
ESFEAEGHLY

SEQ ID NO: 24806 - protein, 9 aa, Artificial Sequence
  Sestrin-3 (9-17)
ESFLRSQFY

SEQ ID NO: 24807 - protein, 11 aa, Artificial Sequence
  Torsin-1A-interacting protein 2 (368-378)
ESFPAGSTLIF

SEQ ID NO: 24808 - protein, 12 aa, Artificial Sequence
  Torsin-1A-interacting protein 2 (368-379)
ESFPAGSTLIFY

SEQ ID NO: 24809 - protein, 10 aa, Artificial Sequence
  Cell division cycle-associated protein 7 (137-146)
ESFPGSFRGR

SEQ ID NO: 24810 - protein, 12 aa, Artificial Sequence
  Putative elongation factor 1-alpha-like 3 (413-424)
ESFSDYPPLGRF

SEQ ID NO: 24811 - protein, 10 aa, Artificial Sequence
  Dual specificity protein kinase TTK (197-206)
ESFSGSLGHL

SEQ ID NO: 24812 - protein, 9 aa, Artificial Sequence
  ER degradation-enhancing alpha-mannosidase-like protein 2 (361-369)
ESIEKISKV

SEQ ID NO: 24813 - protein, 11 aa, Artificial Sequence
  E3 ubiquitin-protein ligase HECTD1 (531-541)
ESIERLPLHLY

SEQ ID NO: 24814 - protein, 9 aa, Artificial Sequence
  Zinc-binding alcohol dehydrogenase domain-containing protein 2 (347-355)
ESIFRAVNY

SEQ ID NO: 24815 - protein, 10 aa, Artificial Sequence
  GATA zinc finger domain-containing protein 1 (140-149)
ESIFYKGVYY

SEQ ID NO: 24816 - protein, 9 aa, Artificial Sequence
  Abnormal spindle-like microcephaly-associated protein (62-70)
ESILTIQKY

SEQ ID NO: 24817 - protein, 13 aa, Artificial Sequence
  Ceramide synthase 4 (291-303)
ESISNRGPFFGYY

SEQ ID NO: 24818 - protein, 13 aa, Artificial Sequence
  Leucine-rich repeat-containing protein 9 (566-578)
ESISQSNYPMVNS

SEQ ID NO: 24819 - protein, 10 aa, Artificial Sequence
  Cytochrome b5 domain-containing protein 1 (157-166)
ESIWEILHRY

SEQ ID NO: 24820 - protein, 9 aa, Artificial Sequence
  Poly (ADP-ribose) polymerase 9 (164-172)
ESKQFVARY

SEQ ID NO: 24821 - protein, 9 aa, Artificial Sequence
  Coiled-coil domain-containing protein 158 (458-466)
ESLEKVSSL

SEQ ID NO: 24822 - protein, 11 aa, Artificial Sequence
  Leucine-rich repeat-containing protein 57 (51-61)
ESLPPLLIGKF

SEQ ID NO: 24823 - protein, 10 aa, Artificial Sequence
  N-acetylglucosamine-1-phosphotransferase subunits alpha/beta (1173-1182)
ESMFPIPSQF

SEQ ID NO: 24824 - protein, 11 aa, Artificial Sequence
  Protein disulfide-isomerase A3 (36-46)
ESRISDTGSAG

SEQ ID NO: 24825 - protein, 9 aa, Artificial Sequence
  BRCA1-A complex subunit BRE (134-142)
ESSRLMFEY

SEQ ID NO: 24826 - protein, 9 aa, Artificial Sequence
  Protein FAM135A (825-833)
ESTSAISEI

SEQ ID NO: 24827 - protein, 9 aa, Artificial Sequence
  Transcriptional enhancer factor TEF-1 (240-248)
ESVDIRQIY

SEQ ID NO: 24828 - protein, 10 aa, Artificial Sequence
  OTU domain-containing protein 7B (579-588)
ESVGNGGSKY

SEQ ID NO: 24829 - protein, 9 aa, Artificial Sequence
  Scm-like with four MBT domains protein 1 (492-500)
ESVMINGKY

SEQ ID NO: 24830 - protein, 9 aa, Artificial Sequence
  Tensin-1 (839-847)
ESVPPGRSY

SEQ ID NO: 24831 - protein, 10 aa, Artificial Sequence
  Zinc transporter ZIP6 (242-251)
ESVSEPRKGF

SEQ ID NO: 24832 - protein, 10 aa, Artificial Sequence
  26S proteasome non-ATPase regulatory subunit 6 (309-318)
ESYRSLTLGY

SEQ ID NO: 24833 - protein, 10 aa, Artificial Sequence
  Exonuclease 1 (584-593)
ESYSFESSKF

SEQ ID NO: 24834 - protein, 8 aa, Artificial Sequence
  Lactosylceramide alpha-2,3-sialyltransferase (260-267)
ETAFDILQ

SEQ ID NO: 24835 - protein, 11 aa, Artificial Sequence
  Transcription factor SOX-10 (359-369)
ETAGPQGPPHY

SEQ ID NO: 24836 - protein, 9 aa, Artificial Sequence
  DNA-directed RNA polymerases I, II, and III subunit RPABC1 (198-206)
ETAGRYITY

SEQ ID NO: 24837 - protein, 12 aa, Artificial Sequence
  HLA class I histocompatibility antigen, A-66 alpha chain (147-158)
ETAHEAEQWRAY

SEQ ID NO: 24838 - protein, 10 aa, Artificial Sequence
  Actin-related protein 3 (171-180)
ETAKAVKERY

SEQ ID NO: 24839 - protein, 11 aa, Artificial Sequence
  Protein S100-A1 (6-16)
ETAMETLINVF

SEQ ID NO: 24840 - protein, 11 aa, Artificial Sequence
  ATP-binding cassette sub-family E member 1 (335-345)
ETANEEEVKKM

SEQ ID NO: 24841 - protein, 10 aa, Artificial Sequence
  YLP motif-containing protein 1 (228-237)
ETAPRHMMRL

SEQ ID NO: 24842 - protein, 11 aa, Artificial Sequence
  Ataxin-10 (40-50)
ETAPRTIFQRV

SEQ ID NO: 24843 - protein, 9 aa, Artificial Sequence
  Protein cordon-bleu (683-691)
ETAPRVTSF

SEQ ID NO: 24844 - protein, 9 aa, Artificial Sequence
  Alpha-1,3-mannosyl-glycoprotein 2-beta-N-acetylglucosaminyltransferase (147-155)
ETAQAIASY

SEQ ID NO: 24845 - protein, 9 aa, Artificial Sequence
  Exocyst complex component 8 (72-80)
ETAREISYL

SEQ ID NO: 24846 - protein, 9 aa, Artificial Sequence
  Tudor domain-containing protein 7 (5-13)
ETARIAQLV

SEQ ID NO: 24847 - protein, 10 aa, Artificial Sequence
  Spectrin beta chain, non-erythrocytic 1 (1262-1271)
ETASELLMRL

SEQ ID NO: 24848 - protein, 10 aa, Artificial Sequence
  E3 ubiquitin-protein ligase RNF213 (3983-3992)
ETASKTLSRF

SEQ ID NO: 24849 - protein, 11 aa, Artificial Sequence
  Kinesin-like protein KIF2C (317-327)
ETASNEVVYRF

SEQ ID NO: 24850 - protein, 9 aa, Artificial Sequence
  Protein furry homolog-like (371-379)
ETASRIAKV

SEQ ID NO: 24851 - protein, 9 aa, Artificial Sequence
  Endoplasmin (698-706)
ETATLRSGY

SEQ ID NO: 24852 - protein, 11 aa, Artificial Sequence
  2'-5'-oligoadenylate synthase 1 (355-365)
ETDDPRRYQKY

SEQ ID NO: 24853 - protein, 9 aa, Artificial Sequence
  Putative pre-mRNA-splicing factor ATP-dependent RNA helicase DHX32 (324-332)
ETEKRCQVY

SEQ ID NO: 24854 - protein, 14 aa, Artificial Sequence
  Sorting nexin-17 (7-20)
ETESRSGDSGGSAY

SEQ ID NO: 24855 - protein, 11 aa, Artificial Sequence
  Caldesmon (164-174)
ETETVTKSYQK

SEQ ID NO: 24856 - protein, 10 aa, Artificial Sequence
  Deoxyhypusine synthase (353-362)
ETFAQKMDAF

SEQ ID NO: 24857 - protein, 10 aa, Artificial Sequence
  Cytoplasmic dynein 1 heavy chain 1 (1934-1943)
ETFDFQAMGR

SEQ ID NO: 24858 - protein, 11 aa, Artificial Sequence
  Protein FAM127B (29-39)
ETFDGDTDRLP

SEQ ID NO: 24859 - protein, 13 aa, Artificial Sequence
  Nicastrin (333-345)
ETFDYIGSSRMVY

SEQ ID NO: 24860 - protein, 9 aa, Artificial Sequence
  CAAX prenyl protease 1 homolog (62-70)
ETFEKSRLY

SEQ ID NO: 24861 - protein, 11 aa, Artificial Sequence
  Ceramide glucosyltransferase (71-81)
ETFFELDYPKY

SEQ ID NO: 24862 - protein, 10 aa, Artificial Sequence
  Mediator of RNA polymerase II transcription subunit 13-like (1814-1823)
ETFGEASQKY

SEQ ID NO: 24863 - protein, 9 aa, Artificial Sequence
  Eukaryotic peptide chain release factor GTP-binding subunit ERF3A (465-473)
ETFKDFPQM

SEQ ID NO: 24864 - protein, 12 aa, Artificial Sequence
  Eukaryotic peptide chain release factor GTP-binding subunit ERF3A (465-476)
ETFKDFPQMGRF

SEQ ID NO: 24865 - protein, 10 aa, Artificial Sequence
  Kv channel-interacting protein 4 isoform 5 (81-90)
ETFKEIYSQF

SEQ ID NO: 24866 - protein, 10 aa, Artificial Sequence
  Dephospho-CoA kinase domain-containing protein (98-107)
ETFKYFLRGY

SEQ ID NO: 24867 - protein, 11 aa, Artificial Sequence
  Proteasome-associated protein ECM29 homolog (349-359)
ETFPANIQVVY

SEQ ID NO: 24868 - protein, 10 aa, Artificial Sequence
  Telomeric repeat-binding factor 2 (175-184)
ETFQQKMLRF

SEQ ID NO: 24869 - protein, 9 aa, Artificial Sequence
  E3 ubiquitin-protein ligase RNF213 (2162-2170)
ETFQRPYQY

SEQ ID NO: 24870 - protein, 10 aa, Artificial Sequence
  Uncharacterized protein C7orf43 (200-209)
ETFRGEQSAF

SEQ ID NO: 24871 - protein, 10 aa, Artificial Sequence
  40S ribosomal protein S7 (169-178)
ETFSGVYKKL

SEQ ID NO: 24872 - protein, 9 aa, Artificial Sequence
  Protein SGT1 homolog (78-86)
ETFTEGQKL

SEQ ID NO: 24873 - protein, 9 aa, Artificial Sequence
  Mitotic spindle assembly checkpoint protein MAD2A (41-49)
ETFTRVQKY

SEQ ID NO: 24874 - protein, 10 aa, Artificial Sequence
  Src substrate cortactin (75-84)
ETGPKASHGY

SEQ ID NO: 24875 - protein, 11 aa, Artificial Sequence
  Tetratricopeptide repeat protein 17 (861-871)
ETGQIENGHRY

SEQ ID NO: 24876 - protein, 9 aa, Artificial Sequence
  Inositol 1,4,5-trisphosphate receptor type 2 (1301-1309)
ETHGRHVEY

SEQ ID NO: 24877 - protein, 9 aa, Artificial Sequence
  L-dopachrome tautomerase (196-204)
ETHLSSKRY

SEQ ID NO: 24878 - protein, 11 aa, Artificial Sequence
  Nucleoside diphosphate kinase homolog 5 (107-117)
ETHPDSLRAIY

SEQ ID NO: 24879 - protein, 10 aa, Artificial Sequence
  Conserved oligomeric Golgi complex subunit 4 (61-70)
ETHQPIVETY

SEQ ID NO: 24880 - protein, 10 aa, Artificial Sequence
  Nuclear autoantigenic sperm protein (246-255)
ETHYQLGLAY

SEQ ID NO: 24881 - protein, 9 aa, Artificial Sequence
  Glutamine-fructose-6-phosphate aminotransferase (isomerizing) 1 (27-35)
ETIAKLVKY

SEQ ID NO: 24882 - protein, 12 aa, Artificial Sequence
  Splicing factor 3A subunit 2 (36-47)
ETIDINKDPYFM

SEQ ID NO: 24883 - protein, 9 aa, Artificial Sequence
  Alpha-aminoadipic semialdehyde synthase, mitochondrial (614-622)
ETIDKAKEV

SEQ ID NO: 24884 - protein, 10 aa, Artificial Sequence
  HEAT repeat-containing protein 5B (1515-1524)
ETIDTARLHY

SEQ ID NO: 24885 - protein, 11 aa, Artificial Sequence
  Methylsterol monooxygenase 1 (92-102)
ETIDVHSGYDI

SEQ ID NO: 24886 - protein, 9 aa, Artificial Sequence
  Threonine-tRNA ligase, cytoplasmic (692-700)
ETIERLQQL

SEQ ID NO: 24887 - protein, 9 aa, Artificial Sequence
  TBC1 domain family member 10A (329-337)
ETIERLRSL

SEQ ID NO: 24888 - protein, 13 aa, Artificial Sequence
  GRIP and coiled-coil domain-containing protein 1 (19-31)
ETIETQKKQLLQY

SEQ ID NO: 24889 - protein, 9 aa, Artificial Sequence
  DNA-directed RNA polymerase III subunit RPC3 (517-525)
ETIFLLESY

SEQ ID NO: 24890 - protein, 9 aa, Artificial Sequence
  Dynamin-like 120 kDa protein, mitochondrial (435-443)
ETIFSISKA

SEQ ID NO: 24891 - protein, 11 aa, Artificial Sequence
  Regulatory-associated protein of mTOR (100-110)
ETIGANLQKQY

SEQ ID NO: 24892 - protein, 9 aa, Artificial Sequence
  Heterogeneous nuclear ribonucleoprotein K (95-103)
ETIGEILKK

SEQ ID NO: 24893 - protein, 9 aa, Artificial Sequence
  X-ray repair cross-complementing protein 5 (17-25)
ETIGKKFEK

SEQ ID NO: 24894 - protein, 12 aa, Artificial Sequence
  Superkiller viralicidic activity 2-like 2 (269-280)
ETIILLPDNVHY

SEQ ID NO: 24895 - protein, 11 aa, Artificial Sequence
  Golgi-specific brefeldin A-resistance guanine nucleotide exchange factor 1 (948-958)
ETIIQKAISGF

SEQ ID NO: 24896 - protein, 10 aa, Artificial Sequence
  Inositol polyphosphate multikinase (205-214)
ETIKDGVSRF

SEQ ID NO: 24897 - protein, 10 aa, Artificial Sequence
  Cyclin-dependent kinase 4 (41-50)
ETIKDLMRQF

SEQ ID NO: 24898 - protein, 12 aa, Artificial Sequence
  Ral GTPase-activating protein subunit beta (590-601)
ETILPDRELSKF

SEQ ID NO: 24899 - protein, 10 aa, Artificial Sequence
  Mitochondrial Rho GTPase 1 (129-138)
ETILPIMNQY

SEQ ID NO: 24900 - protein, 9 aa, Artificial Sequence
  Sodium-dependent neutral amino acid transporter B(0)AT2 (81-89)
ETIMKFLKM

SEQ ID NO: 24901 - protein, 9 aa, Artificial Sequence
  Rab GDP dissociation inhibitor beta (124-132)
ETINRIKLY

SEQ ID NO: 24902 - protein, 9 aa, Artificial Sequence
  cAMP-specific 3',5'-cyclic phosphodiesterase 4B (104-112)
ETIQTYRSV

SEQ ID NO: 24903 - protein, 10 aa, Artificial Sequence
  Platelet-derived growth factor D (54-63)
ETIQVKGNGY

SEQ ID NO: 24904 - protein, 9 aa, Artificial Sequence
  Vacuolar protein-sorting-associated protein 36 (204-212)
ETIRFKSYL

SEQ ID NO: 24905 - protein, 9 aa, Artificial Sequence
  Transmembrane protein 260 (666-674)
ETIRHFRLY

SEQ ID NO: 24906 - protein, 10 aa, Artificial Sequence
  Probable ATP-dependent RNA helicase DDX41 (307-316)
ETIRHGVHMM

SEQ ID NO: 24907 - protein, 9 aa, Artificial Sequence
  Lysophospholipid acyltransferase 7 (297-305)
ETIRNIDCY

SEQ ID NO: 24908 - protein, 9 aa, Artificial Sequence
  HAUS augmin-like complex subunit 2 (20-28)
ETIRNIPHL

SEQ ID NO: 24909 - protein, 10 aa, Artificial Sequence
  Dynamin-2 (654-663)
ETIRNLVDSY

SEQ ID NO: 24910 - protein, 9 aa, Artificial Sequence
  Basic leucine zipper and W2 domain-containing protein 2 (106-114)
ETIRNYAQV

SEQ ID NO: 24911 - protein, 9 aa, Artificial Sequence
  T-complex protein 1 subunit alpha (15-23)
ETIRSQNVM

SEQ ID NO: 24912 - protein, 9 aa, Artificial Sequence
  Zinc finger FYVE domain-containing protein 16 (802-810)
ETISKAQAF

SEQ ID NO: 24913 - protein, 9 aa, Artificial Sequence
  dTDP-D-glucose 4,6-dehydratase (30-38)
ETISNKQNY

SEQ ID NO: 24914 - protein, 12 aa, Artificial Sequence
  Lysosomal glucocerebrosidase (500-511)
ETISPGYSIHTY

SEQ ID NO: 24915 - protein, 9 aa, Artificial Sequence
  Delta(14)-sterol reductase (327-335)
ETISTATGR

SEQ ID NO: 24916 - protein, 11 aa, Artificial Sequence
  UDP-N-acetylhexosamine pyrophosphorylase (460-470)
ETITADVNHNL

SEQ ID NO: 24917 - protein, 9 aa, Artificial Sequence
  THO complex subunit 2 (857-865)
ETITKFLQL

SEQ ID NO: 24918 - protein, 11 aa, Artificial Sequence
  S-phase kinase-associated protein 2 (283-293)
ETITQLNLSGY

SEQ ID NO: 24919 - protein, 11 aa, Artificial Sequence
  Minor histocompatibility antigen H13 (68-78)
ETITSRDAARF

SEQ ID NO: 24920 - protein, 9 aa, Artificial Sequence
  DNA repair protein complementing XP-A cells (180-188)
ETIVHQHEY

SEQ ID NO: 24921 - protein, 9 aa, Artificial Sequence
  Disco-interacting protein 2 homolog B (143-151)
ETIVNVLDF

SEQ ID NO: 24922 - protein, 10 aa, Artificial Sequence
  Tumor suppressor candidate 2 (66-75)
ETIVTKNGQK

SEQ ID NO: 24923 - protein, 10 aa, Artificial Sequence
  RuvB-like 2 (169-178)
ETIYDLGTKM

SEQ ID NO: 24924 - protein, 11 aa, Artificial Sequence
  Mediator of RNA polymerase II transcription subunit 23 (553-563)
ETIYGNGIMRI

SEQ ID NO: 24925 - protein, 9 aa, Artificial Sequence
  Peroxisome biogenesis factor 1 (491-499)
ETKDGLKEF

SEQ ID NO: 24926 - protein, 9 aa, Artificial Sequence
  F-box only protein 38 (25-33)
ETKDYMNQL

SEQ ID NO: 24927 - protein, 11 aa, Artificial Sequence
  Destrin (90-100)
ETKESRKEELM

SEQ ID NO: 24928 - protein, 9 aa, Artificial Sequence
  Dynein light chain 1, cytoplasmic (69-77)
ETKHFIYFY

SEQ ID NO: 24929 - protein, 9 aa, Artificial Sequence
  ATP-dependent RNA helicase DDX50 (83-91)
ETKKNVTEM

SEQ ID NO: 24930 - protein, 9 aa, Artificial Sequence
  Protein LTV1 homolog (235-243)
ETKSRFTEY

SEQ ID NO: 24931 - protein, 9 aa, Artificial Sequence
  UPF0462 protein C4orf33 (111-119)
ETKWEGKAY

SEQ ID NO: 24932 - protein, 10 aa, Artificial Sequence
  Alpha-centractin (232-241)
ETLETEKAQY

SEQ ID NO: 24933 - protein, 11 aa, Artificial Sequence
  Alpha-centractin (232-242)
ETLETEKAQYY

SEQ ID NO: 24934 - protein, 9 aa, Artificial Sequence
  Heterogeneous nuclear ribonucleoprotein L (557-565)
ETLGFLNHY

SEQ ID NO: 24935 - protein, 10 aa, Artificial Sequence
  Truncated extracellular matrix protein 1 (208-217)
ETLNFLEIGY

SEQ ID NO: 24936 - protein, 11 aa, Artificial Sequence
  HEAT repeat-containing protein 1 (1769-1779)
ETLPHFISPYL

SEQ ID NO: 24937 - protein, 9 aa, Artificial Sequence
  Neuron navigator 2 (931-939)
ETLQRNTSL

SEQ ID NO: 24938 - protein, 10 aa, Artificial Sequence
  LIM domain-binding protein 3 (205-214)
ETLREMAQMY

SEQ ID NO: 24939 - protein, 10 aa, Artificial Sequence
  Transient receptor potential cation channel subfamily M member 7 (239-248)
ETMAMKLLTY

SEQ ID NO: 24940 - protein, 13 aa, Artificial Sequence
  Nucleoporin NUP188 homolog (30-42)
ETMDPFVDRIGYF

SEQ ID NO: 24941 - protein, 13 aa, Artificial Sequence
  Aldehyde dehydrogenase family 1 member A3 (118-130)
ETMDTGKPFLHAF

SEQ ID NO: 24942 - protein, 11 aa, Artificial Sequence
  Myosin-10 (328-338)
ETMEAMHIMGF

SEQ ID NO: 24943 - protein, 10 aa, Artificial Sequence
  Heterogeneous nuclear ribonucleoprotein H (76-85)
ETMGHRYVEV

SEQ ID NO: 24944 - protein, 9 aa, Artificial Sequence
  ETS-related transcription factor Elf-2 (173-181)
ETMGRALRY

SEQ ID NO: 24945 - protein, 9 aa, Artificial Sequence
  Serine/threonine-protein phosphatase 4 regulatory subunit 2 (37-45)
ETMIQWSQF

SEQ ID NO: 24946 - protein, 9 aa, Artificial Sequence
  Apolipoprotein E (84-92)
ETMKELKAY

SEQ ID NO: 24947 - protein, 9 aa, Artificial Sequence
  Ribosome-recycling factor, mitochondrial (153-161)
ETMKQIKQY

SEQ ID NO: 24948 - protein, 10 aa, Artificial Sequence
  Interferon-induced protein with tetratricopeptide repeats 1 (375-384)
ETMQDIHFHY

SEQ ID NO: 24949 - protein, 11 aa, Artificial Sequence
  Inositol 1,4,5-trisphosphate receptor type 3 (1262-1272)
ETMQHIFLNNY

SEQ ID NO: 24950 - protein, 10 aa, Artificial Sequence
  TRPM8 channel-associated factor 1 (132-141)
ETMTEKLVKF

SEQ ID NO: 24951 - protein, 10 aa, Artificial Sequence
  Carnitine O-acetyltransferase (515-524)
ETNAARLAHY

SEQ ID NO: 24952 - protein, 9 aa, Artificial Sequence
  Trafficking kinesin-binding protein 2 (258-266)
ETNAQMSRM

SEQ ID NO: 24953 - protein, 9 aa, Artificial Sequence
  BTB/POZ domain-containing protein 3 (304-312)
ETNDIFLWY

SEQ ID NO: 24954 - protein, 9 aa, Artificial Sequence
  Myotubularin (266-274)
ETNKQISKL

SEQ ID NO: 24955 - protein, 12 aa, Artificial Sequence
  Serine-tRNA ligase, mitochondrial (334-345)
ETNTGQEPRGLY

SEQ ID NO: 24956 - protein, 9 aa, Artificial Sequence
  E3 ubiquitin-protein ligase RFWD3 (353-361)
ETNTVVQTY

SEQ ID NO: 24957 - protein, 10 aa, Artificial Sequence
  Protein bicaudal D homolog 2 (309-318)
ETPNRVMLDY

SEQ ID NO: 24958 - protein, 9 aa, Artificial Sequence
  Splicing factor, proline- and glutamine-rich (475-483)
ETPPRFAQH

SEQ ID NO: 24959 - protein, 10 aa, Artificial Sequence
  Histone-lysine N-methyltransferase 2C (4271-4280)
ETPSKAFHQY

SEQ ID NO: 24960 - protein, 11 aa, Artificial Sequence
  Tetratricopeptide repeat protein 4 (310-320)
ETPSWDLEQKY

SEQ ID NO: 24961 - protein, 9 aa, Artificial Sequence
  T-complex protein 1 subunit eta (146-154)
ETQIGGERY

SEQ ID NO: 24962 - protein, 9 aa, Artificial Sequence
  Proteasome subunit alpha type-5 (37-45)
ETQNHWFTY

SEQ ID NO: 24963 - protein, 10 aa, Artificial Sequence
  Zinc finger MIZ domain-containing protein 1 (308-317)
ETQNKDINQY

SEQ ID NO: 24964 - protein, 9 aa, Artificial Sequence
  Histone-lysine N-methyltransferase NSD3 (50-58)
ETQTKYQSY

SEQ ID NO: 24965 - protein, 9 aa, Artificial Sequence
  Elongation factor 1-gamma (326-334)
ETQTLVREY

SEQ ID NO: 24966 - protein, 10 aa, Artificial Sequence
  Calcipressin-1 (27-36)
ETRAKFESLF

SEQ ID NO: 24967 - protein, 9 aa, Artificial Sequence
  Protein FAM184A (53-61)
ETREKILQY

SEQ ID NO: 24968 - protein, 11 aa, Artificial Sequence
  Zinc finger protein 428 (46-56)
ETREPAETGGY

SEQ ID NO: 24969 - protein, 11 aa, Artificial Sequence
  Rho GTPase-activating protein 26 (401-411)
ETRGINEQGLY

SEQ ID NO: 24970 - protein, 12 aa, Artificial Sequence
  A-kinase anchor protein 2 (904-915)
ETRPEGSYFSKY

SEQ ID NO: 24971 - protein, 9 aa, Artificial Sequence
  Pre-mRNA-splicing regulator WTAP (228-236)
ETRQQLAQY

SEQ ID NO: 24972 - protein, 9 aa, Artificial Sequence
  F-box/WD repeat-containing protein 11 (431-439)
ETRSPSRTY

SEQ ID NO: 24973 - protein, 11 aa, Artificial Sequence
  F-box/WD repeat-containing protein 11 (431-441)
ETRSPSRTYTY

SEQ ID NO: 24974 - protein, 9 aa, Artificial Sequence
  Zinc finger CCCH domain-containing protein 13 (597-605)
ETRSSYPER

SEQ ID NO: 24975 - protein, 12 aa, Artificial Sequence
  Zinc finger CCCH domain-containing protein 13 (597-608)
ETRSSYPERDRY

SEQ ID NO: 24976 - protein, 9 aa, Artificial Sequence
  Serine/threonine-protein kinase TBK1 (301-309)
ETSDILHRM

SEQ ID NO: 24977 - protein, 10 aa, Artificial Sequence
  Vimentin (457-466)
ETSQHHDDLE

SEQ ID NO: 24978 - protein, 9 aa, Artificial Sequence
  Centromere protein F (880-888)
ETSQRISKL

SEQ ID NO: 24979 - protein, 11 aa, Artificial Sequence
  Peptidyl-glycine alpha-amidating monooxygenase (904-914)
ETSSGRVLGRF

SEQ ID NO: 24980 - protein, 11 aa, Artificial Sequence
  Heterogeneous nuclear ribonucleoprotein A1 (24-34)
ETTDESLRSHF

SEQ ID NO: 24981 - protein, 9 aa, Artificial Sequence
  Exportin-7 (20-28)
ETTDTTTRL

SEQ ID NO: 24982 - protein, 9 aa, Artificial Sequence
  Poly (ADP-ribose) polymerase 4 (422-430)
ETTEFLSKL

SEQ ID NO: 24983 - protein, 10 aa, Artificial Sequence
  Flap endonuclease 1 (59-68)
ETTSHLMGMF

SEQ ID NO: 24984 - protein, 11 aa, Artificial Sequence
  Flap endonuclease 1 (59-69)
ETTSHLMGMFY

SEQ ID NO: 24985 - protein, 9 aa, Artificial Sequence
  Zinc finger MYM-type protein 3 (161-169)
ETTSIATAR

SEQ ID NO: 24986 - protein, 9 aa, Artificial Sequence
  Transcription initiation factor TFIID subunit 4B (139-147)
ETTSNITSR

SEQ ID NO: 24987 - protein, 9 aa, Artificial Sequence
  Uncharacterized protein C1orf112 (237-245)
ETTTRISLL

SEQ ID NO: 24988 - protein, 9 aa, Artificial Sequence
  TM2 domain-containing protein 2 isoform b (68-76)
ETTTWERKY

SEQ ID NO: 24989 - protein, 9 aa, Artificial Sequence
  Ubiquitin-like protein FUBI (19-27)
ETVAQIKAH

SEQ ID NO: 24990 - protein, 9 aa, Artificial Sequence
  Dynactin subunit 1 (38-46)
ETVGDLEAM

SEQ ID NO: 24991 - protein, 11 aa, Artificial Sequence
  Interferon-induced GTP-binding protein Mx1 (394-404)
ETVGEEDIRLF

SEQ ID NO: 24992 - protein, 9 aa, Artificial Sequence
  Glycerol-3-phosphate acyltransferase 1, mitochondrial (479-487)
ETVGKFIQY

SEQ ID NO: 24993 - protein, 9 aa, Artificial Sequence
  28S ribosomal protein S23, mitochondrial (7-15)
ETVGSIFSR

SEQ ID NO: 24994 - protein, 10 aa, Artificial Sequence
  Structural maintenance of chromosomes flexible hinge domain-containing protein 1 (89-98)
ETVKDGVTLY

SEQ ID NO: 24995 - protein, 9 aa, Artificial Sequence
  Phosphoprotein associated withosphingolipid-enriched microdomains 1 (182-190)
ETVKEIKEV

SEQ ID NO: 24996 - protein, 10 aa, Artificial Sequence
  Developmentally-regulated GTP-binding protein 1 (203-212)
ETVKSILAEY

SEQ ID NO: 24997 - protein, 9 aa, Artificial Sequence
  Ribosomal RNA small subunit methyltransferase NEP1 (48-56)
ETVKVGKTY

SEQ ID NO: 24998 - protein, 9 aa, Artificial Sequence
  ADP-ribosylation factor GTPase-activating protein 3 (388-396)
ETVLKTTGY

SEQ ID NO: 24999 - protein, 10 aa, Artificial Sequence
  Zinc finger protein 574 (7-16)
ETVLYIEHRY

SEQ ID NO: 25000 - protein, 11 aa, Artificial Sequence
  Ankyrin repeat and LEM domain-containing protein 2 (291-301)
ETVNKERANSY

SEQ ID NO: 25001 - protein, 10 aa, Artificial Sequence
  Absent in melanoma 1 protein (1522-1531)
ETVNLRSLGF

SEQ ID NO: 25002 - protein, 9 aa, Artificial Sequence
  Rab GDP dissociation inhibitor alpha (74-82)
ETVNRIKLY

SEQ ID NO: 25003 - protein, 9 aa, Artificial Sequence
  Tumor susceptibility gene 101 protein (24-32)
ETVNVITLY

SEQ ID NO: 25004 - protein, 9 aa, Artificial Sequence
  Peroxisome proliferator-activated receptor delta (255-263)
ETVRELTEF

SEQ ID NO: 25005 - protein, 9 aa, Artificial Sequence
  Trafficking kinesin-binding protein 1 (346-354)
ETVRNINQV

SEQ ID NO: 25006 - protein, 9 aa, Artificial Sequence
  T-complex protein 1 subunit delta (524-532)
ETVRSILKI

SEQ ID NO: 25007 - protein, 10 aa, Artificial Sequence
  Golgin subfamily A member 7 (45-54)
ETVRTLNNLY

SEQ ID NO: 25008 - protein, 9 aa, Artificial Sequence
  Nuclear receptor 2C2-associated protein (9-17)
ETVSRVSSV

SEQ ID NO: 25009 - protein, 9 aa, Artificial Sequence
  Transitional endoplasmic reticulum ATPase (94-102)
ETVVEVPQV

SEQ ID NO: 25010 - protein, 9 aa, Artificial Sequence
  Exportin-T (504-512)
ETVVRYEKF

SEQ ID NO: 25011 - protein, 9 aa, Artificial Sequence
  HLA class II histocompatibility antigen, DP alpha 1 chain (71-79)
ETVWHLEEF

SEQ ID NO: 25012 - protein, 12 aa, Artificial Sequence
  28S ribosomal protein S33, mitochondrial (47-58)
ETYDWYPNHHTY

SEQ ID NO: 25013 - protein, 10 aa, Artificial Sequence
  Dedicator of cytokinesis protein 1 (40-49)
ETYEGWYRGY

SEQ ID NO: 25014 - protein, 9 aa, Artificial Sequence
  Pre-mRNA-processing factor 6 (444-452)
ETYENARKV

SEQ ID NO: 25015 - protein, 9 aa, Artificial Sequence
  Transcription elongation factor SPT6 (938-946)
ETYEWARKM

SEQ ID NO: 25016 - protein, 10 aa, Artificial Sequence
  Exocyst complex component 7 (575-584)
ETYGAFLQKF

SEQ ID NO: 25017 - protein, 9 aa, Artificial Sequence
  C-C motif chemokine 28 (119-127)
ETYGHKTPY

SEQ ID NO: 25018 - protein, 9 aa, Artificial Sequence
  Myotonin-protein kinase (311-319)
ETYGKIVHY

SEQ ID NO: 25019 - protein, 9 aa, Artificial Sequence
  Quinone oxidoreductase (51-59)
ETYIRSGTY

SEQ ID NO: 25020 - protein, 10 aa, Artificial Sequence
  RNA-binding protein 8A (106-115)
ETYKEAQAAM

SEQ ID NO: 25021 - protein, 9 aa, Artificial Sequence
  Aurora kinase A (336-344)
ETYKRISRV

SEQ ID NO: 25022 - protein, 9 aa, Artificial Sequence
  60 kDa SS-A/Ro ribonucleoprotein (329-337)
ETYKTGHGL

SEQ ID NO: 25023 - protein, 10 aa, Artificial Sequence
  U6 snRNA-associated Sm-like protein LSm4 (23-32)
ETYNGHLVSC

SEQ ID NO: 25024 - protein, 10 aa, Artificial Sequence
  Centromere protein J (230-239)
ETYPSNILSH

SEQ ID NO: 25025 - protein, 10 aa, Artificial Sequence
  Arf-GAP with coiled-coil, ANK repeat and PH domain-containing protein 2 (748-757)
ETYQDIFRDF

SEQ ID NO: 25026 - protein, 9 aa, Artificial Sequence
  Bifunctional coenzyme A synthase (290-298)
ETYRGGMAI

SEQ ID NO: 25027 - protein, 12 aa, Artificial Sequence
  Vacuolar protein sorting-associated protein 13B (522-533)
ETYTEIAGMQRF

SEQ ID NO: 25028 - protein, 9 aa, Artificial Sequence
  CD81 antigen (34-42)
EVAAGIWGF

SEQ ID NO: 25029 - protein, 12 aa, Artificial Sequence
  Transforming acidic coiled-coil-containing protein 3 (321-332)
EVAAGQMASSSR

SEQ ID NO: 25030 - protein, 11 aa, Artificial Sequence
  Condensin complex subunit 2 (680-690)
EVADEKMLSGL

SEQ ID NO: 25031 - protein, 10 aa, Artificial Sequence
  Rootletin (1797-1806)
EVADLELQRV

SEQ ID NO: 25032 - protein, 9 aa, Artificial Sequence
  KN motif and ankyrin repeat domain-containing protein 2 (488-496)
EVADPTAHR

SEQ ID NO: 25033 - protein, 9 aa, Artificial Sequence
  Protein phosphatase 1H (361-369)
EVAEAITQF

SEQ ID NO: 25034 - protein, 9 aa, Artificial Sequence
  Geminin (143-151)
EVAEHVQYM

SEQ ID NO: 25035 - protein, 9 aa, Artificial Sequence
  Tankyrase-2 (672-680)
EVAELLVKH

SEQ ID NO: 25036 - protein, 10 aa, Artificial Sequence
  Abnormal spindle-like microcephaly-associated protein (73-82)
EVAEVKISHF

SEQ ID NO: 25037 - protein, 9 aa, Artificial Sequence
  Tankyrase-1 (618-626)
EVAEYLLEH

SEQ ID NO: 25038 - protein, 11 aa, Artificial Sequence
  HRAS-like suppressor 3 (72-82)
EVAGAGAASVM

SEQ ID NO: 25039 - protein, 9 aa, Artificial Sequence
  CAD protein (1287-1295)
EVAGFGESR

SEQ ID NO: 25040 - protein, 9 aa, Artificial Sequence
  5'-nucleotidase (100-108)
EVAHFMNAL

SEQ ID NO: 25041 - protein, 11 aa, Artificial Sequence
  5'-nucleotidase (100-110)
EVAHFMNALRY

SEQ ID NO: 25042 - protein, 9 aa, Artificial Sequence
  Protein disulfide-isomerase A4 (440-448)
EVAKDFPEY

SEQ ID NO: 25043 - protein, 11 aa, Artificial Sequence
  Eukaryotic translation initiation factor 2-alpha kinase 1 (153-163)
EVALEAQTSRY

SEQ ID NO: 25044 - protein, 9 aa, Artificial Sequence
  Amyloid protein-binding protein 2 (469-477)
EVALSVGHL

SEQ ID NO: 25045 - protein, 11 aa, Artificial Sequence
  Microtubule-associated protein 4 (341-351)
EVAPAKDVTLL

SEQ ID NO: 25046 - protein, 9 aa, Artificial Sequence
  Striatin (575-583)
EVAPALSVF

SEQ ID NO: 25047 - protein, 11 aa, Artificial Sequence
  cDNA FLJ60317, highly similar to Aminoacylase-1 (EC 3.5.1.14) (143-153)
EVAPGYVVTVL

SEQ ID NO: 25048 - protein, 9 aa, Artificial Sequence
  E3 ubiquitin-protein ligase TRIM63 (155-163)
EVAPLQSVF

SEQ ID NO: 25049 - protein, 11 aa, Artificial Sequence
  Kelch-like protein 21 (364-374)
EVAPMLKAREY

SEQ ID NO: 25050 - protein, 10 aa, Artificial Sequence
  Endophilin-B2 (59-68)
EVAPPASGTR

SEQ ID NO: 25051 - protein, 11 aa, Artificial Sequence
  Niemann-Pick C1 protein (730-740)
EVAPSMFLSSF

SEQ ID NO: 25052 - protein, 9 aa, Artificial Sequence
  E3 ubiquitin-protein ligase Topors (578-586)
EVAQPSREF

SEQ ID NO: 25053 - protein, 11 aa, Artificial Sequence
  Zinc finger protein 131 (41-51)
EVASAKQSVKY

SEQ ID NO: 25054 - protein, 9 aa, Artificial Sequence
  Autophagy-related protein 9A (160-168)
EVASALRSF

SEQ ID NO: 25055 - protein, 9 aa, Artificial Sequence
  Methyltransferase-like protein 13 (163-171)
EVATQWFGF

SEQ ID NO: 25056 - protein, 9 aa, Artificial Sequence
  D-3-phosphoglycerate dehydrogenase (159-167)
EVATRMQSF

SEQ ID NO: 25057 - protein, 9 aa, Artificial Sequence
  DNA-dependent protein kinase catalytic subunit (713-721)
EVAVKMKQY

SEQ ID NO: 25058 - protein, 11 aa, Artificial Sequence
  Ribonuclease H2 subunit C (72-82)
EVAVPPGLVGY

SEQ ID NO: 25059 - protein, 11 aa, Artificial Sequence
  Endoplasmic reticulum lectin 1 (124-134)
EVCHGKHIRQY

SEQ ID NO: 25060 - protein, 9 aa, Artificial Sequence
  Serine/threonine-protein phosphatase 4 regulatory subunit 2 (20-28)
EVCPVLDQF

SEQ ID NO: 25061 - protein, 9 aa, Artificial Sequence
  FRAS1-related extracellular matrix protein 1 (1345-1353)
EVDLNLLRY

SEQ ID NO: 25062 - protein, 11 aa, Artificial Sequence
  Melanoma-associated antigen 3 (168-178)
EVDPIGHLYIF

SEQ ID NO: 25063 - protein, 9 aa, Artificial Sequence
  SET domain-containing protein 5 (26-34)
EVEAPYLSR

SEQ ID NO: 25064 - protein, 10 aa, Artificial Sequence
  DENN domain-containing protein 5A (179-188)
EVFANRFTQM

SEQ ID NO: 25065 - protein, 10 aa, Artificial Sequence
  Nck-associated protein 1 (479-488)
EVFDFRGMRL

SEQ ID NO: 25066 - protein, 10 aa, Artificial Sequence
  Probable ubiquitin carboxyl-terminal hydrolase FAF-X (1928-1937)
EVFDHMMKRM

SEQ ID NO: 25067 - protein, 10 aa, Artificial Sequence
  Disheveled-associated activator of morphogenesis 2 (1033-1042)
EVFDKDLCKL

SEQ ID NO: 25068 - protein, 10 aa, Artificial Sequence
  Ribosomal RNA processing protein 36 homolog (132-141)
EVFDKTYQFL

SEQ ID NO: 25069 - protein, 12 aa, Artificial Sequence
  FAST kinase domain-containing protein 5 (107-118)
EVFDSFENMRVF

SEQ ID NO: 25070 - protein, 11 aa, Artificial Sequence
  Melanoma-associated antigen 2 (229-239)
EVFEGREDSVF

SEQ ID NO: 25071 - protein, 10 aa, Artificial Sequence
  Protein arginine N-methyltransferase 5 (308-317)
EVFEKDPIKY

SEQ ID NO: 25072 - protein, 10 aa, Artificial Sequence
  Presenilin-2 (337-346)
EVFEPPLTGY

SEQ ID NO: 25073 - protein, 10 aa, Artificial Sequence
  GMP reductase 1 (254-263)
EVFERNGRKL

SEQ ID NO: 25074 - protein, 9 aa, Artificial Sequence
  Lanosterol synthase (479-487)
EVFGDIMID

SEQ ID NO: 25075 - protein, 10 aa, Artificial Sequence
  Monocarboxylate transporter 7 (340-349)
EVFGRIGAGF

SEQ ID NO: 25076 - protein, 9 aa, Artificial Sequence
  Zinc finger protein ZIC 2 (187-195)
EVFGRSEQY

SEQ ID NO: 25077 - protein, 9 aa, Artificial Sequence
  Nesprin-2 (6334-6342)
EVFGRVSRF

SEQ ID NO: 25078 - protein, 9 aa, Artificial Sequence
  Trifunctional purine biosynthetic protein adenosine-3 (10-18)
EVFHAGTAL

SEQ ID NO: 25079 - protein, 10 aa, Artificial Sequence
  Ribosomal protein S6 kinase alpha-5 (267-276)
EVFHDQLHTF

SEQ ID NO: 25080 - protein, 10 aa, Artificial Sequence
  Non-POU domain-containing octamer-binding protein (13-22)
EVFIHKDKGF

SEQ ID NO: 25081 - protein, 9 aa, Artificial Sequence
  DNA-directed RNA polymerase II subunit RPB4 (59-67)
EVFMKTLNY

SEQ ID NO: 25082 - protein, 10 aa, Artificial Sequence
  Quinone oxidoreductase (196-205)
EVFNHREVNY

SEQ ID NO: 25083 - protein, 10 aa, Artificial Sequence
  FACT complex subunit SPT16 (192-201)
EVFNKFFKER

SEQ ID NO: 25084 - protein, 10 aa, Artificial Sequence
  UDP-N-acetylglucosamine-peptide N-acetylglucosaminyltransferase 110 kDa subunit (229-238)
EVFPEFAAAH

SEQ ID NO: 25085 - protein, 10 aa, Artificial Sequence
  Serine/threonine-protein kinase LATS2 (719-728)
EVFPEHLARF

SEQ ID NO: 25086 - protein, 11 aa, Artificial Sequence
  Serine/threonine-protein phosphatase 6 regulatory ankyrin repeat subunit A (779-789)
EVFQKTEGNAF

SEQ ID NO: 25087 - protein, 11 aa, Artificial Sequence
  Replication protein A 70 kDa DNA-binding subunit (560-570)
EVFQNANFRSF

SEQ ID NO: 25088 - protein, 10 aa, Artificial Sequence
  F-box/LRR-repeat protein 5 (115-124)
EVFQPMLMEY

SEQ ID NO: 25089 - protein, 10 aa, Artificial Sequence
  Histone-lysine N-methyltransferase SETD2 (2472-2481)
EVFRKEMSQF

SEQ ID NO: 25090 - protein, 10 aa, Artificial Sequence
  Zinc finger and SCAN domain-containing protein 30 (45-54)
EVFRQKFRQF

SEQ ID NO: 25091 - protein, 10 aa, Artificial Sequence
  WD repeat and FYVE domain-containing protein 3 (667-676)
EVFSGDGRNY

SEQ ID NO: 25092 - protein, 10 aa, Artificial Sequence
  Coiled-coil domain-containing protein 136 (105-114)
EVFTKQIQQL

SEQ ID NO: 25093 - protein, 10 aa, Artificial Sequence
  RCC1 and BTB domain-containing protein 2 (124-133)
EVFTWGHNAY

SEQ ID NO: 25094 - protein, 11 aa, Artificial Sequence
  Pre-mRNA-splicing factor ATP-dependent RNA helicase DHX15 (379-389)
EVGDIKIIPLY

SEQ ID NO: 25095 - protein, 9 aa, Artificial Sequence
  Protein AAR2 homolog (40-48)
EVGPKFRGV

SEQ ID NO: 25096 - protein, 10 aa, Artificial Sequence
  Adipocyte plasma membrane-associated protein (403-412)
EVHEHDGHLY

SEQ ID NO: 25097 - protein, 11 aa, Artificial Sequence
  Adipocyte plasma membrane-associated protein (403-413)
EVHEHDGHLYL

SEQ ID NO: 25098 - protein, 12 aa, Artificial Sequence
  Phosphatase and actin regulator 1 (636-647)
EVHELSRHLTRF

SEQ ID NO: 25099 - protein, 10 aa, Artificial Sequence
  GPI transamidase component PIG-T (291-300)
EVHPPPTTTY

SEQ ID NO: 25100 - protein, 11 aa, Artificial Sequence
  Aryl hydrocarbon receptor nuclear translocator 2 (438-448)
EVHQRDGLSSY

SEQ ID NO: 25101 - protein, 10 aa, Artificial Sequence
  Uncharacterized protein C1orf131 (173-182)
EVHRFGITGY

SEQ ID NO: 25102 - protein, 12 aa, Artificial Sequence
  2-methoxy-6-polyprenyl-1,4-benzoquinol methylase, mitochondrial (272-283)
EVIAGDWKSYQY

SEQ ID NO: 25103 - protein, 9 aa, Artificial Sequence
  DNA mismatch repair protein Msh2 (914-922)
EVIAKNNSF

SEQ ID NO: 25104 - protein, 12 aa, Artificial Sequence
  Protein CutA (104-115)
EVIALPVEQGNF

SEQ ID NO: 25105 - protein, 11 aa, Artificial Sequence
  Drebrin-like protein (403-413)
EVIDEGWWRGY

SEQ ID NO: 25106 - protein, 11 aa, Artificial Sequence
  Alpha/beta hydrolase domain-containing protein 17B (236-246)
EVIDFSHGLAL

SEQ ID NO: 25107 - protein, 12 aa, Artificial Sequence
  Alpha/beta hydrolase domain-containing protein 17A (256-267)
EVIDFSHGLALY

SEQ ID NO: 25108 - protein, 11 aa, Artificial Sequence
  Alpha/beta hydrolase domain-containing protein 17C (277-287)
EVIDFSHGLAM

SEQ ID NO: 25109 - protein, 12 aa, Artificial Sequence
  Alpha/beta hydrolase domain-containing protein 17C (277-288)
EVIDFSHGLAMY

SEQ ID NO: 25110 - protein, 12 aa, Artificial Sequence
  SH3 and PX domain-containing protein 2A (332-343)
EVIDKNSGGWWY

SEQ ID NO: 25111 - protein, 9 aa, Artificial Sequence
  XK-related protein 9 (123-131)
EVIDRVTDL

SEQ ID NO: 25112 - protein, 10 aa, Artificial Sequence
  Histidine-tRNA ligase, cytoplasmic (90-99)
EVIDTPVFEL

SEQ ID NO: 25113 - protein, 9 aa, Artificial Sequence
  SNF-related serine/threonine-protein kinase (80-88)
EVIDTQTKL

SEQ ID NO: 25114 - protein, 9 aa, Artificial Sequence
  Mitochondrial ribonuclease P protein 3 (193-201)
EVIDVFEIM

SEQ ID NO: 25115 - protein, 11 aa, Artificial Sequence
  Mitochondrial ribonuclease P protein 3 (193-203)
EVIDVFEIMKA

SEQ ID NO: 25116 - protein, 10 aa, Artificial Sequence
  N-terminal Xaa-Pro-Lys N-methyltransferase 1 (4-13)
EVIEDEKQFY

SEQ ID NO: 25117 - protein, 9 aa, Artificial Sequence
  T-complex protein 1 subunit theta (127-135)
EVIEGYEIA

SEQ ID NO: 25118 - protein, 10 aa, Artificial Sequence
  Phosphatidate phosphatase LPIN1 (766-775)
EVIEKKPEKF

SEQ ID NO: 25119 - protein, 10 aa, Artificial Sequence
  SH3 and PX domain-containing protein 2B (396-405)
EVIEKNLSGW

SEQ ID NO: 25120 - protein, 10 aa, Artificial Sequence
  Dynamin-1-like protein (634-643)
EVIERLIKSY

SEQ ID NO: 25121 - protein, 9 aa, Artificial Sequence
  Asparagine synthetase (glutamine-hydrolyzing) (326-334)
EVIFSLETY

SEQ ID NO: 25122 - protein, 10 aa, Artificial Sequence
  Dynamin-like 120 kDa protein, mitochondrial (156-165)
EVIGASDLLL

SEQ ID NO: 25123 - protein, 11 aa, Artificial Sequence
  Dynamin-like 120 kDa protein, mitochondrial (156-166)
EVIGASDLLLL

SEQ ID NO: 25124 - protein, 9 aa, Artificial Sequence
  Protein phosphatase 1 regulatory subunit 37 (75-83)
EVIGAYKQA

SEQ ID NO: 25125 - protein, 11 aa, Artificial Sequence
  Protein TMEPAI (199-209)
EVIGHYPGSSF

SEQ ID NO: 25126 - protein, 12 aa, Artificial Sequence
  Mitogen-activated protein kinase kinase kinase 11 (121-132)
EVIGIGGFGKVY

SEQ ID NO: 25127 - protein, 11 aa, Artificial Sequence
  Ropporin-1B (190-200)
EVIGPDGLITV

SEQ ID NO: 25128 - protein, 12 aa, Artificial Sequence
  Hepatocyte growth factor receptor (215-226)
EVIGRGHFGCVY

SEQ ID NO: 25129 - protein, 11 aa, Artificial Sequence
  Inositol-trisphosphate 3-kinase B (875-885)
EVIGSSLLFIH

SEQ ID NO: 25130 - protein, 11 aa, Artificial Sequence
  Protein furry homolog-like(141-151)
EVIGVLAQSKF

SEQ ID NO: 25131 - protein, 10 aa, Artificial Sequence
  Transportin-3 (359-368)
EVIHGIFKAY

SEQ ID NO: 25132 - protein, 9 aa, Artificial Sequence
  ELAV-like protein 1 (101-109)
EVIKDANLY

SEQ ID NO: 25133 - protein, 12 aa, Artificial Sequence
  Exocyst complex component 3 (390-401)
EVIKLTDPSLLY

SEQ ID NO: 25134 - protein, 10 aa, Artificial Sequence
  Eukaryotic translation initiation factor 3 subunit L (50-59)
EVIKNFIQYF

SEQ ID NO: 25135 - protein, 10 aa, Artificial Sequence
  Ribosome maturation protein SBDS (156-165)
EVIKQLKEKM

SEQ ID NO: 25136 - protein, 9 aa, Artificial Sequence
  Myosin-10 (1642-1650)
EVIKQLRKL

SEQ ID NO: 25137 - protein, 9 aa, Artificial Sequence
  Exosome complex component RRP43 (268-276)
EVIKSMKPK

SEQ ID NO: 25138 - protein, 9 aa, Artificial Sequence
  Cofilin-2 (10-18)
EVIKVFNDM

SEQ ID NO: 25139 - protein, 9 aa, Artificial Sequence
  T-complex protein 1 subunit beta (512-520)
EVILRVDNI

SEQ ID NO: 25140 - protein, 10 aa, Artificial Sequence
  E3 ubiquitin-protein ligase TRIM63 (81-90)
EVIMDRHGVY

SEQ ID NO: 25141 - protein, 11 aa, Artificial Sequence
  Nucleosome-remodeling factor subunit BPTF (564-574)
EVIMKGNINNY

SEQ ID NO: 25142 - protein, 9 aa, Artificial Sequence
  Gamma-interferon-inducible protein 16 (15-23)
EVINDYHFR

SEQ ID NO: 25143 - protein, 11 aa, Artificial Sequence
  Rho guanine nucleotide exchange factor 12 (790-800)
EVINELFYTER

SEQ ID NO: 25144 - protein, 10 aa, Artificial Sequence
  Eukaryotic translation initiation factor 3 subunit G (58-67)
EVINGNIKTV

SEQ ID NO: 25145 - protein, 9 aa, Artificial Sequence
  Isoleucine-tRNA ligase, cytoplasmic (989-997)
EVINRIQKL

SEQ ID NO: 25146 - protein, 9 aa, Artificial Sequence
  Trafficking protein particle complex subunit 9 (680-688)
EVIPALPRL

SEQ ID NO: 25147 - protein, 10 aa, Artificial Sequence
  Dynactin subunit 6 (135-144)
EVIPENTVIY

SEQ ID NO: 25148 - protein, 9 aa, Artificial Sequence
  Transcriptional adapter 1 (289-297)
EVIPTHTVY

SEQ ID NO: 25149 - protein, 11 aa, Artificial Sequence
  Heme oxygenase 1 (103-113)
EVIPYTPAMQR

SEQ ID NO: 25150 - protein, 12 aa, Artificial Sequence
  Heme oxygenase 1 (103-114)
EVIPYTPAMQRY

SEQ ID NO: 25151 - protein, 13 aa, Artificial Sequence
  MAX gene-associated protein (214-226)
EVIQLNGPGVHTF

SEQ ID NO: 25152 - protein, 12 aa, Artificial Sequence
  Kalirin (827-838)
EVIQQGQDLHQY

SEQ ID NO: 25153 - protein, 9 aa, Artificial Sequence
  Cyclin-I (47-55)
EVIQWLAKL

SEQ ID NO: 25154 - protein, 9 aa, Artificial Sequence
  Protein dopey-2 (236-244)
EVIRAFYSY

SEQ ID NO: 25155 - protein, 9 aa, Artificial Sequence
  Inositol-tetrakisphosphate 1-kinase (260-268)
EVIRELSRA

SEQ ID NO: 25156 - protein, 10 aa, Artificial Sequence
  Serine/threonine-protein kinase ICK (67-76)
EVIRENDHLY

SEQ ID NO: 25157 - protein, 13 aa, Artificial Sequence
  Peptidyl-prolyl cis-trans isomerase FKBP1A (55-67)
EVIRGWEEGVAQM

SEQ ID NO: 25158 - protein, 9 aa, Artificial Sequence
  BCL2/adenovirus E1B 19 kDa protein-interacting protein 2 (170-178)
EVIRKGSIT

SEQ ID NO: 25159 - protein, 11 aa, Artificial Sequence
  BCL2/adenovirus E1B 19 kDa protein-interacting protein 2 (170-180)
EVIRKGSITEY

SEQ ID NO: 25160 - protein, 11 aa, Artificial Sequence
  General vesicular transport factor p115 (180-190)
EVIRNDGVLLL

SEQ ID NO: 25161 - protein, 12 aa, Artificial Sequence
  Mitogen-activated protein kinase kinase kinase 3 (568-579)
EVISGEGYGRKA

SEQ ID NO: 25162 - protein, 10 aa, Artificial Sequence
  Protein FRA10AC1 (165-174)
EVISGKGQFF

SEQ ID NO: 25163 - protein, 10 aa, Artificial Sequence
  Ectonucleoside triphosphate diphosphohydrolase 4 (216-225)
EVISGKQEGV

SEQ ID NO: 25164 - protein, 11 aa, Artificial Sequence
  Ectonucleoside triphosphate diphosphohydrolase 4 (216-226)
EVISGKQEGVY

SEQ ID NO: 25165 - protein, 12 aa, Artificial Sequence
  Protein CIP2A (34-45)
EVISGQKLTRLF

SEQ ID NO: 25166 - protein, 9 aa, Artificial Sequence
  Syntaxin-18 (55-63)
EVISHIGKL

SEQ ID NO: 25167 - protein, 9 aa, Artificial Sequence
  CREB3 regulatory factor (131-139)
EVISKTPTL

SEQ ID NO: 25168 - protein, 9 aa, Artificial Sequence
  Cullin-9 (584-592)
EVISKYEKA

SEQ ID NO: 25169 - protein, 9 aa, Artificial Sequence
  FAS-associated factor 2 (195-203)
EVISLINTR

SEQ ID NO: 25170 - protein, 10 aa, Artificial Sequence
  Pseudopodium-enriched atypical kinase 1 (20-29)
EVISNEGGRF

SEQ ID NO: 25171 - protein, 10 aa, Artificial Sequence
  Alpha-1,3-mannosyl-glycoprotein 4-beta-N-acetylglucosaminyltransferase B (111-120)
EVISPSPHFY

SEQ ID NO: 25172 - protein, 9 aa, Artificial Sequence
  ATP-binding cassette sub-family A member 5 (1411-1419)
EVISRITHA

SEQ ID NO: 25173 - protein, 12 aa, Artificial Sequence
  Importin subunit alpha-5 (120-131)
EVISTPGVVARF

SEQ ID NO: 25174 - protein, 9 aa, Artificial Sequence
  Ankycorbin (933-941)
EVISVYRMH

SEQ ID NO: 25175 - protein, 9 aa, Artificial Sequence
  Ataxin-2 (291-299)
EVISWGSGR

SEQ ID NO: 25176 - protein, 11 aa, Artificial Sequence
  Unconventional myosin-X (308-318)
EVITAMDVMQF

SEQ ID NO: 25177 - protein, 11 aa, Artificial Sequence
  Ras GTPase-activating protein 3 (134-144)
EVITDTGVVCH

SEQ ID NO: 25178 - protein, 10 aa, Artificial Sequence
  Nuclear export mediator factor NEMF (306-315)
EVITHELQDF

SEQ ID NO: 25179 - protein, 11 aa, Artificial Sequence
  Phospholipid scramblase 2 (86-96)
EVITLERPLRC

SEQ ID NO: 25180 - protein, 10 aa, Artificial Sequence
  A-kinase anchor protein 9 (1601-1610)
EVITNRPKGF

SEQ ID NO: 25181 - protein, 12 aa, Artificial Sequence
  Translation initiation factor eIF-2B subunit gamma (272-283)
EVIVGNDQLMEI

SEQ ID NO: 25182 - protein, 9 aa, Artificial Sequence
  Methylmalonyl-CoA mutase, mitochondrial (484-492)
EVIVGVNKY

SEQ ID NO: 25183 - protein, 9 aa, Artificial Sequence
  Insulin-like growth factor 2 mRNA-binding protein 2 (555-563)
EVIVRIIGH

SEQ ID NO: 25184 - protein, 9 aa, Artificial Sequence
  Dynactin subunit 4 (424-432)
EVIWLTQHV

SEQ ID NO: 25185 - protein, 11 aa, Artificial Sequence
  Actin-related protein 8 (209-219)
EVIWSHAIQKY

SEQ ID NO: 25186 - protein, 9 aa, Artificial Sequence
  BTB/POZ domain-containing protein 10 (398-406)
EVIYNYVQR

SEQ ID NO: 25187 - protein, 9 aa, Artificial Sequence
  Ras GTPase-activating-like protein IQGAP1 (1602-1610)
EVKAKFMGV

SEQ ID NO: 25188 - protein, 9 aa, Artificial Sequence
  E3 ubiquitin-protein ligase CBL-B (290-298)
EVKARLQKY

SEQ ID NO: 25189 - protein, 11 aa, Artificial Sequence
  F-box only protein 22 (380-390)
EVKDDDLFHSY

SEQ ID NO: 25190 - protein, 11 aa, Artificial Sequence
  Cation-independent mannose-6-phosphate receptor (1228-1238)
EVKDPRHGNLY

SEQ ID NO: 25191 - protein, 10 aa, Artificial Sequence
  Centromere protein F (1197-1206)
EVKEISLDSY

SEQ ID NO: 25192 - protein, 9 aa, Artificial Sequence
  Apolipoprotein E (249-257)
EVKEQVAEV

SEQ ID NO: 25193 - protein, 9 aa, Artificial Sequence
  Ras association domain-containing protein 8 (290-298)
EVKGKIGKV

SEQ ID NO: 25194 - protein, 10 aa, Artificial Sequence
  Prolyl endopeptidase-like (114-123)
EVKHGGFVYY

SEQ ID NO: 25195 - protein, 9 aa, Artificial Sequence
  Ras association domain-containing protein 2 (297-305)
EVKKLMRKY

SEQ ID NO: 25196 - protein, 9 aa, Artificial Sequence
  Ethylmalonyl-CoA decarboxylase (36-44)
EVKKTLQQF

SEQ ID NO: 25197 - protein, 9 aa, Artificial Sequence
  Proteasome activator complex subunit 3 (10-18)
EVKLKVDSF

SEQ ID NO: 25198 - protein, 9 aa, Artificial Sequence
  Integrator complex subunit 11 (350-358)
EVKMQVEYM

SEQ ID NO: 25199 - protein, 9 aa, Artificial Sequence
  Elongator complex protein 1 (50-58)
EVKNEVSLV

SEQ ID NO: 25200 - protein, 15 aa, Artificial Sequence
  Delta-1-pyrroline-5-carboxylate synthase (320-334)
EVKPAGPTVEQQGEM

SEQ ID NO: 25201 - protein, 16 aa, Artificial Sequence
  Delta-1-pyrroline-5-carboxylate synthase (320-335)
EVKPAGPTVEQQGEMA

SEQ ID NO: 25202 - protein, 9 aa, Artificial Sequence
  Ras-related GTP-binding protein D (60-68)
EVKPRILLM

SEQ ID NO: 25203 - protein, 9 aa, Artificial Sequence
  Histone deacetylase 9 (142-150)
EVKQKLQEF

SEQ ID NO: 25204 - protein, 9 aa, Artificial Sequence
  Periodic tryptophan protein 1 homolog (31-39)
EVKRLIAEA

SEQ ID NO: 25205 - protein, 9 aa, Artificial Sequence
  Pachytene checkpoint protein 2 homolog (146-154)
EVKSHLLDY

SEQ ID NO: 25206 - protein, 9 aa, Artificial Sequence
  Apoptosis-inducing factor 1, mitochondrial (276-284)
EVKSRTTLF

SEQ ID NO: 25207 - protein, 9 aa, Artificial Sequence
  Chloride intracellular channel protein 4 (83-91)
EVKTDVNKI

SEQ ID NO: 25208 - protein, 9 aa, Artificial Sequence
  Kinetochore-associated protein DSN1 homolog (235-243)
EVKVEPMTY

SEQ ID NO: 25209 - protein, 9 aa, Artificial Sequence
  Glycerol-3-phosphate dehydrogenase, mitochondrial (410-418)
EVKYGIKEY

SEQ ID NO: 25210 - protein, 9 aa, Artificial Sequence
  Bifunctional coenzyme A synthase (63-71)
EVLDFITHL

SEQ ID NO: 25211 - protein, 10 aa, Artificial Sequence
  Insulin-like growth factor 2 mRNA-binding protein 2 (95-104)
EVLDGLLAQY

SEQ ID NO: 25212 - protein, 10 aa, Artificial Sequence
  Serine/threonine-protein kinase PRP4 homolog (170-179)
EVLDKRYNVY

SEQ ID NO: 25213 - protein, 11 aa, Artificial Sequence
  Estradiol 17-beta-dehydrogenase 1 (203-213)
EVLDRTDIHTF

SEQ ID NO: 25214 - protein, 10 aa, Artificial Sequence
  Receptor-type protein tyrosine phosphatase beta (1332-1341)
EVLDSHIHAY

SEQ ID NO: 25215 - protein, 10 aa, Artificial Sequence
  Insulin-like growth factor 2 mRNA-binding protein 3 (95-104)
EVLDSLLVQY

SEQ ID NO: 25216 - protein, 9 aa, Artificial Sequence
  StAR-related lipid transfer protein 7, mitochondrial (136-144)
EVLHWVTHF

SEQ ID NO: 25217 - protein, 10 aa, Artificial Sequence
  Ubiquitin-associated protein 1-like (34-43)
EVLLGSMHDF

SEQ ID NO: 25218 - protein, 10 aa, Artificial Sequence
  Mitofusin-2 (308-317)
EVLNARIQKA

SEQ ID NO: 25219 - protein, 10 aa, Artificial Sequence
  Exportin-6 (272-281)
EVLNRIQFRY

SEQ ID NO: 25220 - protein, 10 aa, Artificial Sequence
  Ancient ubiquitous protein 1 (306-315)
EVLPHVPLGV

SEQ ID NO: 25221 - protein, 10 aa, Artificial Sequence
  Spectrin alpha chain, non-erythrocytic 1 (185-194)
EVLQKKFEEF

SEQ ID NO: 25222 - protein, 9 aa, Artificial Sequence
  Importin-7 (378-386)
EVLQKTMGF

SEQ ID NO: 25223 - protein, 9 aa, Artificial Sequence
  Class E basic helix-loop-helix protein 41 (141-149)
EVLQYLSRF

SEQ ID NO: 25224 - protein, 9 aa, Artificial Sequence
  MAGEC3 protein (192-200)
EVLSAIGVC

SEQ ID NO: 25225 - protein, 11 aa, Artificial Sequence
  Serine/threonine-protein kinase Nek2 (9-19)
EVLYTIGTGSY

SEQ ID NO: 25226 - protein, 11 aa, Artificial Sequence
  Ly6/PLAUR domain-containing protein 1 isoform c (73-83)
EVMEQSAGIMY

SEQ ID NO: 25227 - protein, 10 aa, Artificial Sequence
  Protein FAM118A (215-224)
EVMEVLQNLY

SEQ ID NO: 25228 - protein, 12 aa, Artificial Sequence
  Proteasome maturation protein (125-136)
EVMGEPHLMVEY

SEQ ID NO: 25229 - protein, 10 aa, Artificial Sequence
  Isoprenoid synthase domain-containing protein isoform X7 (103-112)
EVMKSIIQKY

SEQ ID NO: 25230 - protein, 10 aa, Artificial Sequence
  Alkyldihydroxyacetonephosphate synthase, peroxisomal (89-98)
EVMKWNGWGY

SEQ ID NO: 25231 - protein, 11 aa, Artificial Sequence
  Protein-L-isoaspartate(D-aspartate) O-methyltransferase (30-40)
EVMLATDRSHY

SEQ ID NO: 25232 - protein, 10 aa, Artificial Sequence
  Prolyl 3-hydroxylase 1 (335-344)
EVMNQNLAYY

SEQ ID NO: 25233 - protein, 9 aa, Artificial Sequence
  tRNA-dihydrouridine(20) synthase (NAD(P)+)-like (227-235)
EVMQKYIRY

SEQ ID NO: 25234 - protein, 10 aa, Artificial Sequence
  Actin-related protein 2/3 complex subunit 3 (127-136)
EVMRAYLQQL

SEQ ID NO: 25235 - protein, 9 aa, Artificial Sequence
  Transcription factor SOX-10 (284-292)
EVMSNMETF

SEQ ID NO: 25236 - protein, 10 aa, Artificial Sequence
  Mitofusin-2 (23-32)
EVNASPLKHF

SEQ ID NO: 25237 - protein, 11 aa, Artificial Sequence
  Procollagen C-endopeptidase enhancer 2 (220-230)
EVNDARRIGKY

SEQ ID NO: 25238 - protein, 9 aa, Artificial Sequence
  Ankycorbin (840-848)
EVNELLQKF

SEQ ID NO: 25239 - protein, 9 aa, Artificial Sequence
  mRNA turnover protein 4 homolog (111-119)
EVNEWFTKY

SEQ ID NO: 25240 - protein, 10 aa, Artificial Sequence
  Ethanolamine-phosphate cytidylyltransferase (254-263)
EVNHYKGKNY

SEQ ID NO: 25241 - protein, 9 aa, Artificial Sequence
  Long-chain-fatty-acid-CoA ligase 4 (89-97)
EVNRRVNNF

SEQ ID NO: 25242 - protein, 9 aa, Artificial Sequence
  Serpin B8 (76-84)
EVNRTGTQY

SEQ ID NO: 25243 - protein, 9 aa, Artificial Sequence
  T-complex protein 1 subunit zeta (101-109)
EVNSGFFYK

SEQ ID NO: 25244 - protein, 9 aa, Artificial Sequence
  Sodium/potassium/calcium exchanger 5 (372-380)
EVNSRGLTY

SEQ ID NO: 25245 - protein, 10 aa, Artificial Sequence
  Putative PIP5K1A and PSMD4-like protein (632-641)
EVNTEKLTAF

SEQ ID NO: 25246 - protein, 11 aa, Artificial Sequence
  FAST kinase domain-containing protein 1 (204-214)
EVNVAKSIAKF

SEQ ID NO: 25247 - protein, 9 aa, Artificial Sequence
  Protein NATD1 (59-67)
EVPDAYRGR

SEQ ID NO: 25248 - protein, 9 aa, Artificial Sequence
  Thioredoxin-like protein 4A (65-73)
EVPDFNKMY

SEQ ID NO: 25249 - protein, 12 aa, Artificial Sequence
  Cyclin-A2 (174-185)
EVPDYHEDIHTY

SEQ ID NO: 25250 - protein, 10 aa, Artificial Sequence
  Protein FAM135B (80-89)
EVPINDAVVF

SEQ ID NO: 25251 - protein, 9 aa, Artificial Sequence
  Serine/threonine-protein kinase 36 (1232-1240)
EVPQRLLEM

SEQ ID NO: 25252 - protein, 10 aa, Artificial Sequence
  La-related protein 1 (262-271)
EVPREKLASR

SEQ ID NO: 25253 - protein, 10 aa, Artificial Sequence
  Meckel syndrome type 1 protein (150-159)
EVPSFLVERM

SEQ ID NO: 25254 - protein, 10 aa, Artificial Sequence
  Copine-1 (173-182)
EVPTQLVSYF

SEQ ID NO: 25255 - protein, 13 aa, Artificial Sequence
  Macrophage-capping protein (97-109)
EVQGNESDLFMSY

SEQ ID NO: 25256 - protein, 9 aa, Artificial Sequence
  26S protease regulatory subunit 8 (142-150)
EVQRTMLEL

SEQ ID NO: 25257 - protein, 9 aa, Artificial Sequence
  Coatomer subunit gamma-2 (523-531)
EVRDRATFY

SEQ ID NO: 25258 - protein, 10 aa, Artificial Sequence
  Ubiquitin-protein ligase E3C (567-576)
EVREEYITAF

SEQ ID NO: 25259 - protein, 10 aa, Artificial Sequence
  Lactadherin (36-45)
EVRGDVFPSY

SEQ ID NO: 25260 - protein, 9 aa, Artificial Sequence
  Spindle and kinetochore-associated protein 1 (243-251)
EVRGGGLTR

SEQ ID NO: 25261 - protein, 10 aa, Artificial Sequence
  Spindle and kinetochore-associated protein 1 (243-252)
EVRGGGLTRY

SEQ ID NO: 25262 - protein, 10 aa, Artificial Sequence
  GTP-binding protein 1 (445-454)
EVRGGQTASF

SEQ ID NO: 25263 - protein, 9 aa, Artificial Sequence
  Glutaredoxin-3 (140-148)
EVRQGLKAY

SEQ ID NO: 25264 - protein, 10 aa, Artificial Sequence
  Fatty acid synthase (674-683)
EVRTGGMAFH

SEQ ID NO: 25265 - protein, 9 aa, Artificial Sequence
  Putative butyrophilin subfamily 2 member A3 (62-70)
EVRWFQSQF

SEQ ID NO: 25266 - protein, 9 aa, Artificial Sequence
  Butyrophilin subfamily 2 member A1 (63-71)
EVRWFRSQF

SEQ ID NO: 25267 - protein, 10 aa, Artificial Sequence
  Interleukin-1 receptor-associated kinase 4 (159-168)
EVSDTRFHSF

SEQ ID NO: 25268 - protein, 9 aa, Artificial Sequence
  E3 ubiquitin-protein ligase UBR5 (24-32)
EVSEKLNKY

SEQ ID NO: 25269 - protein, 9 aa, Artificial Sequence
  Protein FAM111B (228-236)
EVSGKVLEM

SEQ ID NO: 25270 - protein, 11 aa, Artificial Sequence
  Cytosolic carboxypeptidase 1 (764-774)
EVSGMRPGVAY

SEQ ID NO: 25271 - protein, 9 aa, Artificial Sequence
  Alpha-actinin-1 (574-582)
EVSKIVQTY

SEQ ID NO: 25272 - protein, 9 aa, Artificial Sequence
  cGMP-inhibited 3',5'-cyclic phosphodiesterase B (656-664)
EVSLDLILV

SEQ ID NO: 25273 - protein, 11 aa, Artificial Sequence
  Growth hormone-inducible transmembrane protein (303-313)
EVSPMYGVQKY

SEQ ID NO: 25274 - protein, 9 aa, Artificial Sequence
  NADH-ubiquinone oxidoreductase 75 kDa subunit, mitochondrial (537-545)
EVSPNLVRY

SEQ ID NO: 25275 - protein, 10 aa, Artificial Sequence
  Proton myo-inositol cotransporter (179-188)
EVSPPNLRGR

SEQ ID NO: 25276 - protein, 9 aa, Artificial Sequence
  Abnormal spindle-like microcephaly-associated protein (322-330)
EVSPRIPEC

SEQ ID NO: 25277 - protein, 10 aa, Artificial Sequence
  AP-1 complex subunit beta-1 (934-943)
EVSQHVYQAY

SEQ ID NO: 25278 - protein, 9 aa, Artificial Sequence
  Transcription factor TFIIIB component B'' homolog (1376-1384)
EVSSHFSHF

SEQ ID NO: 25279 - protein, 10 aa, Artificial Sequence
  Retinoblastoma-like protein 1 (130-139)
EVSTVIFKKY

SEQ ID NO: 25280 - protein, 11 aa, Artificial Sequence
  Xenotropic and polytropic retrovirus receptor 1 (40-50)
EVTDEDTVKRY

SEQ ID NO: 25281 - protein, 10 aa, Artificial Sequence
  U3 small nucleolar ribonucleoprotein protein IMP3 (22-31)
EVTDHNLHEL

SEQ ID NO: 25282 - protein, 9 aa, Artificial Sequence
  Ankyrin repeat domain-containing protein 54 (279-287)
EVTDLLASF

SEQ ID NO: 25283 - protein, 12 aa, Artificial Sequence
  Protein SET (111-122)
EVTEFEDIKSGY

SEQ ID NO: 25284 - protein, 9 aa, Artificial Sequence
  Prostaglandin E synthase 2 (201-209)
EVTEFGNKY

SEQ ID NO: 25285 - protein, 9 aa, Artificial Sequence
  Zinc finger CCHC domain-containing protein 14 (136-144)
EVTEFISKL

SEQ ID NO: 25286 - protein, 9 aa, Artificial Sequence
  Beta-parvin (274-282)
EVTELETQF

SEQ ID NO: 25287 - protein, 9 aa, Artificial Sequence
  Tankyrase-2 (358-366)
EVTELLVKH

SEQ ID NO: 25288 - protein, 9 aa, Artificial Sequence
  RNA-binding protein 26 (806-814)
EVTELRRKY

SEQ ID NO: 25289 - protein, 9 aa, Artificial Sequence
  Ribonucleoprotein PTB-binding 2 (177-185)
EVTGHSKGY

SEQ ID NO: 25290 - protein, 10 aa, Artificial Sequence
  Integrin alpha-X (448-457)
EVTGTQIGSY

SEQ ID NO: 25291 - protein, 9 aa, Artificial Sequence
  Catalase (10-18)
EVTHDITKY

SEQ ID NO: 25292 - protein, 9 aa, Artificial Sequence
  Plectin (3906-3914)
EVTKNLQKF

SEQ ID NO: 25293 - protein, 9 aa, Artificial Sequence
  EH domain-binding protein 1 (186-194)
EVTKNYRGV

SEQ ID NO: 25294 - protein, 9 aa, Artificial Sequence
  Apoptosis-inducing factor 2 (169-177)
EVTLIHSQV

SEQ ID NO: 25295 - protein, 11 aa, Artificial Sequence
  Ankyrin repeat and KH domain-containing protein 1 (1670-1680)
EVTPNSLSTSY

SEQ ID NO: 25296 - protein, 10 aa, Artificial Sequence
  Teneurin-4 (87-96)
EVTPPHGTLY

SEQ ID NO: 25297 - protein, 9 aa, Artificial Sequence
  Translocon-associated protein subunit gamma (99-107)
EVTRKLSEA

SEQ ID NO: 25298 - protein, 9 aa, Artificial Sequence
  FAD synthase (63-71)
EVTSFSNRF

SEQ ID NO: 25299 - protein, 9 aa, Artificial Sequence
  Probable ATP-dependent RNA helicase DDX5 (30-38)
EVTTARSQF

SEQ ID NO: 25300 - protein, 9 aa, Artificial Sequence
  EH domain-binding protein 1-like protein 1 (1049-1057)
EVTTGYRGV

SEQ ID NO: 25301 - protein, 9 aa, Artificial Sequence
  Formin-binding protein 4 (242-250)
EVTWELPQY

SEQ ID NO: 25302 - protein, 9 aa, Artificial Sequence
  NGFI-A-binding protein 1 (307-315)
EVTYKYTYR

SEQ ID NO: 25303 - protein, 10 aa, Artificial Sequence
  Serine/threonine-protein kinase TAO2 (52-61)
EVVAIKKMSY

SEQ ID NO: 25304 - protein, 10 aa, Artificial Sequence
  Phosphatidate phosphatase LPIN1 (844-853)
EVVDHVFPLL

SEQ ID NO: 25305 - protein, 9 aa, Artificial Sequence
  Glutamate decarboxylase 1 (118-126)
EVVDILLNY

SEQ ID NO: 25306 - protein, 10 aa, Artificial Sequence
  Nardilysin (988-997)
EVVDKKIEEF

SEQ ID NO: 25307 - protein, 9 aa, Artificial Sequence
  Lethal(3)malignant brain tumor-like protein 3 (457-465)
EVVDKRNPM

SEQ ID NO: 25308 - protein, 13 aa, Artificial Sequence
  Contactin-associated protein-like 4 (182-194)
EVVDLDGKSSLLY

SEQ ID NO: 25309 - protein, 9 aa, Artificial Sequence
  Translation initiation factor eIF-2B subunit gamma (116-124)
EVVDLFRAY

SEQ ID NO: 25310 - protein, 11 aa, Artificial Sequence
  Translation initiation factor eIF-2B subunit gamma (116-126)
EVVDLFRAYDA

SEQ ID NO: 25311 - protein, 9 aa, Artificial Sequence
  Collagen triple helix repeat-containing protein 1 (46-54)
EVVDLYNGM

SEQ ID NO: 25312 - protein, 11 aa, Artificial Sequence
  Unconventional myosin-X (2025-2035)
EVVDVAKLMKA

SEQ ID NO: 25313 - protein, 12 aa, Artificial Sequence
  Unconventional myosin-X (2025-2036)
EVVDVAKLMKAY

SEQ ID NO: 25314 - protein, 11 aa, Artificial Sequence
  Gephyrin (726-736)
EVVDVMVIGRL

SEQ ID NO: 25315 - protein, 9 aa, Artificial Sequence
  Guanine nucleotide-binding protein-like 3-like protein (181-189)
EVVEKWLDY

SEQ ID NO: 25316 - protein, 9 aa, Artificial Sequence
  Kinetochore protein Nuf2 (271-279)
EVVEKYEIY

SEQ ID NO: 25317 - protein, 9 aa, Artificial Sequence
  TBC1 domain family member 13 (209-217)
EVVERILFI

SEQ ID NO: 25318 - protein, 11 aa, Artificial Sequence
  Putative ATP-dependent RNA helicase TDRD9 (906-916)
EVVEVGHFWGY

SEQ ID NO: 25319 - protein, 10 aa, Artificial Sequence
  Cytosolic non-specific dipeptidase (351-360)
EVVGEQVTSY

SEQ ID NO: 25320 - protein, 9 aa, Artificial Sequence
  Nuclear pore complex protein Nup160 (1025-1033)
EVVGIIESR

SEQ ID NO: 25321 - protein, 9 aa, Artificial Sequence
  Pseudopodium-enriched atypical kinase 1 (303-311)
EVVGKIRSL

SEQ ID NO: 25322 - protein, 11 aa, Artificial Sequence
  DCN1-like protein 5 (65-75)
EVVGPEGMEKF

SEQ ID NO: 25323 - protein, 10 aa, Artificial Sequence
  3 beta-hydroxysteroid dehydrogenase type 7 (131-140)
EVVGPNTKGH

SEQ ID NO: 25324 - protein, 9 aa, Artificial Sequence
  Tetratricopeptide repeat protein 5 (59-67)
EVVGSVQGK

SEQ ID NO: 25325 - protein, 11 aa, Artificial Sequence
  Diacylglycerol kinase theta (848-858)
EVVGVTGVVHM

SEQ ID NO: 25326 - protein, 9 aa, Artificial Sequence
  WD repeat-containing protein 35 (735-743)
EVVGYFGRF

SEQ ID NO: 25327 - protein, 9 aa, Artificial Sequence
  Signal transducer and activator of transcription 1-alpha/beta (212-220)
EVVHKIIEL

SEQ ID NO: 25328 - protein, 9 aa, Artificial Sequence
  Hemicentin-1 (5-13)
EVVHTVFLF

SEQ ID NO: 25329 - protein, 12 aa, Artificial Sequence
  Midasin (1181-1192)
EVVKAHPRFMLF

SEQ ID NO: 25330 - protein, 9 aa, Artificial Sequence
  Heat shock protein HSP 90-beta (126-134)
EVVKKHSQF

SEQ ID NO: 25331 - protein, 9 aa, Artificial Sequence
  Peroxisomal multifunctional enzyme type 2 (641-649)
EVVKKVNAV

SEQ ID NO: 25332 - protein, 9 aa, Artificial Sequence
  39S ribosomal protein L21, mitochondrial (78-86)
EVVKKVNEM

SEQ ID NO: 25333 - protein, 9 aa, Artificial Sequence
  Non-canonical poly(A) RNA polymerase PAPD7 (53-61)
EVVKRIETV

SEQ ID NO: 25334 - protein, 13 aa, Artificial Sequence
  Radial spoke head 10 homolog B2 (158-170)
EVVNGMRNGFGMF

SEQ ID NO: 25335 - protein, 11 aa, Artificial Sequence
  DNA replication licensing factor MCM7 (92-102)
EVVNKDVLDVY

SEQ ID NO: 25336 - protein, 9 aa, Artificial Sequence
  Unconventional myosin-Ib (290-298)
EVVNKINRA

SEQ ID NO: 25337 - protein, 14 aa, Artificial Sequence
  Protein ELYS (55-68)
EVVNSITGERLSAY

SEQ ID NO: 25338 - protein, 9 aa, Artificial Sequence
  Transcription factor SOX-13 (110-118)
EVVPAIEKL

SEQ ID NO: 25339 - protein, 9 aa, Artificial Sequence
  Cathepsin K (85-93)
EVVQKMTGL

SEQ ID NO: 25340 - protein, 9 aa, Artificial Sequence
  Protein C12orf4 (366-374)
EVVQQVVLY

SEQ ID NO: 25341 - protein, 9 aa, Artificial Sequence
  Peptidylprolyl isomerase domain and WD repeat-containing protein 1 (616-624)
EVVQRISNV

SEQ ID NO: 25342 - protein, 15 aa, Artificial Sequence
  Proteasome subunit alpha type-7 (197-211)
EVVQSGGKNIELAVM

SEQ ID NO: 25343 - protein, 9 aa, Artificial Sequence
  E3 ubiquitin-protein ligase BRE1B (40-48)
EVVRETGEY

SEQ ID NO: 25344 - protein, 9 aa, Artificial Sequence
  Melanoma-associated antigen 12 (168-176)
EVVRIGHLY

SEQ ID NO: 25345 - protein, 9 aa, Artificial Sequence
  Unconventional myosin-IXb (955-963)
EVVRKILLL

SEQ ID NO: 25346 - protein, 10 aa, Artificial Sequence
  Cytoskeleton-associated protein 5 (88-97)
EVVSGVVSKV

SEQ ID NO: 25347 - protein, 9 aa, Artificial Sequence
  Ubiquitin-conjugating enzyme E2 variant 3 (232-240)
EVVSHTSQV

SEQ ID NO: 25348 - protein, 11 aa, Artificial Sequence
  RNA demethylase ALKBH5 (109-119)
EVVSRAEKGLY

SEQ ID NO: 25349 - protein, 10 aa, Artificial Sequence
  Integrator complex subunit 1 (1714-1723)
EVVSSTVRAV

SEQ ID NO: 25350 - protein, 11 aa, Artificial Sequence
  Cullin-3 (55-65)
EVVTEHLINKV

SEQ ID NO: 25351 - protein, 11 aa, Artificial Sequence
  Ankyrin repeat and zinc finger domain-containing protein 1 (16-26)
EVVTHKTFHRY

SEQ ID NO: 25352 - protein, 10 aa, Artificial Sequence
  Cyclin-dependent kinase 2 (224-233)
EVVWPGVTSM

SEQ ID NO: 25353 - protein, 13 aa, Artificial Sequence
  Contactin-associated protein-like 3B (182-194)
EVVYFDGQSALLY

SEQ ID NO: 25354 - protein, 9 aa, Artificial Sequence
  DDB1- and CUL4-associated factor 7 (176-184)
EVYDIAFSR

SEQ ID NO: 25355 - protein, 10 aa, Artificial Sequence
  DDB1- and CUL4-associated factor 7 (176-185)
EVYDIAFSRA

SEQ ID NO: 25356 - protein, 12 aa, Artificial Sequence
  Melanotransferrin (97-108)
EVYDQEVGTSYY

SEQ ID NO: 25357 - protein, 10 aa, Artificial Sequence
  Nuclear pore complex protein Nup155 (1301-1310)
EVYDQLFKSR

SEQ ID NO: 25358 - protein, 9 aa, Artificial Sequence
  Protein polybromo-1 (670-678)
EVYEAVKNY

SEQ ID NO: 25359 - protein, 10 aa, Artificial Sequence
  DNA-directed RNA polymerase, mitochondrial (459-468)
EVYEGRFSLY

SEQ ID NO: 25360 - protein, 11 aa, Artificial Sequence
  DNA-directed RNA polymerase, mitochondrial (459-469)
EVYEGRFSLYP

SEQ ID NO: 25361 - protein, 10 aa, Artificial Sequence
  Tyrosine-protein kinase ABL1 (255-264)
EVYEGVWKKY

SEQ ID NO: 25362 - protein, 10 aa, Artificial Sequence
  Protein lin-7 homolog C (52-61)
EVYEHVYETV

SEQ ID NO: 25363 - protein, 9 aa, Artificial Sequence
  Zinc finger protein 292 (337-345)
EVYEKVVDY

SEQ ID NO: 25364 - protein, 11 aa, Artificial Sequence
  Muscular LMNA-interacting protein (350-360)
EVYEPNPFSKY

SEQ ID NO: 25365 - protein, 9 aa, Artificial Sequence
  rRNA methyltransferase 2, mitochondrial (229-237)
EVYFLATQY

SEQ ID NO: 25366 - protein, 10 aa, Artificial Sequence
  Large neutral amino acids transporter small subunit 1 (122-131)
EVYGSLPAFL

SEQ ID NO: 25367 - protein, 12 aa, Artificial Sequence
  Procollagen-lysine,2-oxoglutarate 5-dioxygenase 2 (336-347)
EVYHEKDIKVFF

SEQ ID NO: 25368 - protein, 10 aa, Artificial Sequence
  Nucleoside diphosphate kinase 7 (250-259)
EVYKGVVTEY

SEQ ID NO: 25369 - protein, 11 aa, Artificial Sequence
  Ras GTPase-activating-like protein IQGAP3 (1166-1176)
EVYKVVGNLLY

SEQ ID NO: 25370 - protein, 10 aa, Artificial Sequence
  Kinesin-like protein KIF14 (5-14)
EVYNEKIHDL

SEQ ID NO: 25371 - protein, 10 aa, Artificial Sequence
  Kinesin-like protein KIF18B (166-175)
EVYNEQIHDL

SEQ ID NO: 25372 - protein, 10 aa, Artificial Sequence
  Kinesin-like protein KIF18A (161-170)
EVYNEQIRDL

SEQ ID NO: 25373 - protein, 9 aa, Artificial Sequence
  F-box only protein 32 (44-52)
EVYNKENLF

SEQ ID NO: 25374 - protein, 13 aa, Artificial Sequence
  Tyrosinase (409-421)
EVYPEANAPIGHN

SEQ ID NO: 25375 - protein, 12 aa, Artificial Sequence
  Ubiquitin carboxyl-terminal hydrolase 11 (150-161)
EVYPVELLLVRH

SEQ ID NO: 25376 - protein, 9 aa, Artificial Sequence
  E3 ubiquitin-protein ligase UBR2 (37-45)
EVYQHLAHY

SEQ ID NO: 25377 - protein, 10 aa, Artificial Sequence
  Small nuclear ribonucleoprotein Sm D3 (26-35)
EVYRGKLIEA

SEQ ID NO: 25378 - protein, 10 aa, Artificial Sequence
  Transmembrane protein 201 (151-160)
EVYRHHLEQM

SEQ ID NO: 25379 - protein, 11 aa, Artificial Sequence
  Pre-mRNA-processing-splicing factor 8 (2324-2334)
EVYSADREDLY

SEQ ID NO: 25380 - protein, 11 aa, Artificial Sequence
  Semaphorin-7A (114-124)
EVYSTIRKQEY

SEQ ID NO: 25381 - protein, 11 aa, Artificial Sequence
  cAMP-dependent protein kinase type I-alpha regulatory subunit (103-113)
EVYTEEDAASY

SEQ ID NO: 25382 - protein, 10 aa, Artificial Sequence
  Arf-GAP with Rho-GAP domain, ANK repeat and PH domain-containing protein 1 (574-583)
EVYTEGERLY

SEQ ID NO: 25383 - protein, 10 aa, Artificial Sequence
  DNA repair endonuclease XPF (99-108)
EVYTQGGVIF

SEQ ID NO: 25384 - protein, 10 aa, Artificial Sequence
  Signal transducer and activator of transcription 2 (831-840)
EVYVSRPSHF

SEQ ID NO: 25385 - protein, 11 aa, Artificial Sequence
  Signal transducer and activator of transcription 2 (831-841)
EVYVSRPSHFY

SEQ ID NO: 25386 - protein, 9 aa, Artificial Sequence
  Phospholipase A-2-activating protein (168-176)
EVYYGHTNY

SEQ ID NO: 25387 - protein, 11 aa, Artificial Sequence
  Phospholipase A-2-activating protein (168-178)
EVYYGHTNYIY

SEQ ID NO: 25388 - protein, 9 aa, Artificial Sequence
  Protein virilizer homolog (485-493)
FADHVSSSL

SEQ ID NO: 25389 - protein, 9 aa, Artificial Sequence
  CLIP-associating protein 1 (877-885)
FADPHSKRV

SEQ ID NO: 25390 - protein, 10 aa, Artificial Sequence
  CLIP-associating protein 1 (877-886)
FADPHSKRVF

SEQ ID NO: 25391 - protein, 9 aa, Artificial Sequence
  Calmodulin-regulated spectrin-associated protein 2 (673-681)
FAEQKFRKL

SEQ ID NO: 25392 - protein, 10 aa, Artificial Sequence
  Sorting nexin-17 (460-469)
FAFEGIGDED

SEQ ID NO: 25393 - protein, 9 aa, Artificial Sequence
  Melanoma-associated antigen C1 (1035-1043)
FAFGEPREL

SEQ ID NO: 25394 - protein, 16 aa, Artificial Sequence
  POTE ankyrin domain family member F (721-736)
FAGDDAPRAVFPSIVG

SEQ ID NO: 25395 - protein, 11 aa, Artificial Sequence
  Up-regulator of cell proliferation (600-610)
FAHFPGLASEL

SEQ ID NO: 25396 - protein, 9 aa, Artificial Sequence
  Glycerol-3-phosphate dehydrogenase, mitochondrial (27-35)
FAHYRRKQM

SEQ ID NO: 25397 - protein, 8 aa, Artificial Sequence
  Alpha-catulin (24-31)
FALDSGLE

SEQ ID NO: 25398 - protein, 11 aa, Artificial Sequence
  Melanocyte protein PMEL (247-257)
FALQLHDPSGY

SEQ ID NO: 25399 - protein, 10 aa, Artificial Sequence
  Eukaryotic translation initiation factor 3 subunit E (53-62)
FAMDVYKNLY

SEQ ID NO: 25400 - protein, 9 aa, Artificial Sequence
  NHL repeat-containing protein 2 (407-415)
FAQPSGLSL

SEQ ID NO: 25401 - protein, 9 aa, Artificial Sequence
  Dynactin subunit 1 (1206-1214)
FATFPSSAF

SEQ ID NO: 25402 - protein, 8 aa, Artificial Sequence
  Translocon-associated protein subunit gamma (75-82)
FAYKNVKF

SEQ ID NO: 25403 - protein, 12 aa, Artificial Sequence
  Protein disulfide-isomerase A3 (160-171)
FDDSFSEAHSEF

SEQ ID NO: 25404 - protein, 9 aa, Artificial Sequence
  Phosphatidylinositol 3,4,5-trisphosphate 3-phosphatase and dual-specificity protein phosphatase PTEN (90-98)
FEDHNPPQL

SEQ ID NO: 25405 - protein, 15 aa, Artificial Sequence
  Keratin, type I cytoskeletal 9 (465-479)
FESSGAGKIGLGGRG

SEQ ID NO: 25406 - protein, 16 aa, Artificial Sequence
  Keratin, type I cytoskeletal 9 (465-480)
FESSGAGKIGLGGRGG

SEQ ID NO: 25407 - protein, 12 aa, Artificial Sequence
  Interleukin enhancer-binding factor 3 (693-704)
FFTDCYGYHDFG

SEQ ID NO: 25408 - protein, 14 aa, Artificial Sequence
  Interleukin enhancer-binding factor 3 (693-706)
FFTDCYGYHDFGSS

SEQ ID NO: 25409 - protein, 10 aa, Artificial Sequence
  Apolipoprotein B-100 (2396-2405)
FIDDAVKKLN

SEQ ID NO: 25410 - protein, 9 aa, Artificial Sequence
  Probable tRNA (uracil-O(2)-)-methyltransferase (608-616)
FIDQVVLQV

SEQ ID NO: 25411 - protein, 11 aa, Artificial Sequence
  Plexin-A2 (789-799)
FIIDNPQDLKV

SEQ ID NO: 25412 - protein, 13 aa, Artificial Sequence
  Filamin-A (2041-2053)
FIIDTRDAGYGGL

SEQ ID NO: 25413 - protein, 15 aa, Artificial Sequence
  Filamin-A (2041-2055)
FIIDTRDAGYGGLSL

SEQ ID NO: 25414 - protein, 9 aa, Artificial Sequence
  Uncharacterized protein CXorf57 (552-560)
FILFFYGSD

SEQ ID NO: 25415 - protein, 11 aa, Artificial Sequence
  Sorting nexin-14 (234-244)
FLADPDTVNHL

SEQ ID NO: 25416 - protein, 12 aa, Artificial Sequence
  Protein YIF1B (69-80)
FLADPVSNMAMA

SEQ ID NO: 25417 - protein, 10 aa, Artificial Sequence
  Class E basic helix-loop-helix protein 41 (366-375)
FLDKSGLEKY

SEQ ID NO: 25418 - protein, 12 aa, Artificial Sequence
  Class E basic helix-loop-helix protein 41 (366-377)
FLDKSGLEKYLY

SEQ ID NO: 25419 - protein, 10 aa, Artificial Sequence
  Ceramide synthase 1 (207-216)
FLHDISDVQL

SEQ ID NO: 25420 - protein, 9 aa, Artificial Sequence
  Exostosin-2 (253-261)
FLLSSQVGL

SEQ ID NO: 25421 - protein, 11 aa, Artificial Sequence
  Uncharacterized protein C15orf61 (147-157)
FLNKEDEGAMY

SEQ ID NO: 25422 - protein, 9 aa, Artificial Sequence
  Spatacsin (617-625)
FLNNQIKEL

SEQ ID NO: 25423 - protein, 9 aa, Artificial Sequence
  2',3'-cyclic-nucleotide 3'-phosphodiesterase (12-20)
FLPKIFFRK

SEQ ID NO: 25424 - protein, 11 aa, Artificial Sequence
  Polyphosphoinositide phosphatase (404-414)
FLPPEHTIVYI

SEQ ID NO: 25425 - protein, 10 aa, Artificial Sequence
  Alpha/beta hydrolase domain-containing protein 17C (35-44)
FLPPEPTYTV

SEQ ID NO: 25426 - protein, 11 aa, Artificial Sequence
  Zinc finger protein with KRAB and SCAN domains 1 (104-114)
FLSILPKELQV

SEQ ID NO: 25427 - protein, 10 aa, Artificial Sequence
  Presenilin-2 (437-446)
FMDTLASHQL

SEQ ID NO: 25428 - protein, 11 aa, Artificial Sequence
  Presenilin-2 (437-447)
FMDTLASHQLY

SEQ ID NO: 25429 - protein, 12 aa, Artificial Sequence
  Presenilin-2 (437-448)
FMDTLASHQLYI

SEQ ID NO: 25430 - protein, 11 aa, Artificial Sequence
  Protein tyrosine phosphatase type IVA 1 (23-33)
FMEFLKGSGDY

SEQ ID NO: 25431 - protein, 9 aa, Artificial Sequence
  SHC-transforming protein 4 (33-41)
FRNESITSL

SEQ ID NO: 25432 - protein, 10 aa, Artificial Sequence
  Caprin-1 (656-665)
FSAPRDYSGY

SEQ ID NO: 25433 - protein, 9 aa, Artificial Sequence
  Uncharacterized protein CXorf23 (6-14)
FSDGRTQKY

SEQ ID NO: 25434 - protein, 12 aa, Artificial Sequence
  DNA-directed RNA polymerase I subunit RPA2 (493-504)
FSDHNQSPRNMY

SEQ ID NO: 25435 - protein, 11 aa, Artificial Sequence
  Serine/threonine-protein kinase RIO2 (416-426)
FSEEKNRTENY

SEQ ID NO: 25436 - protein, 10 aa, Artificial Sequence
  Tubulin alpha-1C chain (18-27)
FSETGAGKHV

SEQ ID NO: 25437 - protein, 8 aa, Artificial Sequence
  Nucleosome assembly protein 1-like 1 (245-252)
FSFDGPEI

SEQ ID NO: 25438 - protein, 10 aa, Artificial Sequence
  RNA-binding protein EWS (285-294)
FSGPGENRSM

SEQ ID NO: 25439 - protein, 9 aa, Artificial Sequence
  40S ribosomal protein S27 (111-119)
FSHAQTVVL

SEQ ID NO: 25440 - protein, 9 aa, Artificial Sequence
  ADP-ribose pyrophosphatase, mitochondrial (257-265)
FSQDHLVIY

SEQ ID NO: 25441 - protein, 17 aa, Artificial Sequence
  PERQ amino acid-rich with GYF domain-containing protein 2 (1273-1289)
FSVNASSERLNMGEIET

SEQ ID NO: 25442 - protein, 11 aa, Artificial Sequence
  Serine/threonine-protein kinase Sgk1 (516-526)
FSYAPPTDSFL

SEQ ID NO: 25443 - protein, 11 aa, Artificial Sequence
  Transcription factor SOX-10 (425-435)
FSYMGPSQRPL

SEQ ID NO: 25444 - protein, 11 aa, Artificial Sequence
  Protein argonaute-3 (775-785)
FTADELQLLTY

SEQ ID NO: 25445 - protein, 9 aa, Artificial Sequence
  Protein FAM102B (9-17)
FTAESSREV

SEQ ID NO: 25446 - protein, 9 aa, Artificial Sequence
  Dipeptidyl peptidase 2 (373-381)
FTDELRQRY

SEQ ID NO: 25447 - protein, 9 aa, Artificial Sequence
  Membrane-associated transporter protein (338-346)
FTDFMGQIV

SEQ ID NO: 25448 - protein, 10 aa, Artificial Sequence
  Membrane-associated transporter protein (338-347)
FTDFMGQIVY

SEQ ID NO: 25449 - protein, 8 aa, Artificial Sequence
  Probable guanine nucleotide exchange factor MCF2L2 (62-69)
FTDIGIKY

SEQ ID NO: 25450 - protein, 10 aa, Artificial Sequence
  Testis-expressed sequence 10 protein (107-116)
FTDKDANVRL

SEQ ID NO: 25451 - protein, 9 aa, Artificial Sequence
  Semaphorin-5A (1065-1073)
FTDLNNYDE

SEQ ID NO: 25452 - protein, 10 aa, Artificial Sequence
  Semaphorin-5A (1065-1074)
FTDLNNYDEY

SEQ ID NO: 25453 - protein, 9 aa, Artificial Sequence
  Tubulin polyglutamylase complex subunit 1 (17-25)
FTDSGRQSV

SEQ ID NO: 25454 - protein, 11 aa, Artificial Sequence
  Leucine-rich repeat-containing protein 42 (128-138)
FTEPGAGLRAL

SEQ ID NO: 25455 - protein, 9 aa, Artificial Sequence
  AF4/FMR2 family member 1 (3-11)
FTERVNSSG

SEQ ID NO: 25456 - protein, 7 aa, Artificial Sequence
  von Willebrand factor A domain-containing protein 9 (129-135)
FTIDGPL

SEQ ID NO: 25457 - protein, 9 aa, Artificial Sequence
  Elongator complex protein 1 (934-942)
FTIDKYLKR

SEQ ID NO: 25458 - protein, 17 aa, Artificial Sequence
  Melanocyte protein PMEL (214-230)
FTITDQVPFSVSVSQLR

SEQ ID NO: 25459 - protein, 11 aa, Artificial Sequence
  Hypoxia-inducible factor 1-alpha (295-305)
FTKGQVTTGQY

SEQ ID NO: 25460 - protein, 9 aa, Artificial Sequence
  Ropporin-1B (203-211)
FTQNPRVWL

SEQ ID NO: 25461 - protein, 8 aa, Artificial Sequence
  Nephrocystin-4 (1264-1271)
FTSHPQEL

SEQ ID NO: 25462 - protein, 9 aa, Artificial Sequence
  Very-long-chain enoyl-CoA reductase (119-127)
FTSSRHTVV

SEQ ID NO: 25463 - protein, 9 aa, Artificial Sequence
  Cytoplasmic dynein 2 heavy chain 1 (2484-2492)
FTVDDYSHY

SEQ ID NO: 25464 - protein, 15 aa, Artificial Sequence
  Cleft lip and palate transmembrane protein 1-like protein (157-171)
FVFDGSSLPADVHRY

SEQ ID NO: 25465 - protein, 11 aa, Artificial Sequence
  TNF receptor-associated factor 4 (202-212)
FVFDTIQSHQY

SEQ ID NO: 25466 - protein, 9 aa, Artificial Sequence
  NADH dehydrogenase (ubiquinone) 1 beta subcomplex subunit 1 (32-40)
FVIGCYLDR

SEQ ID NO: 25467 - protein, 11 aa, Artificial Sequence
  FAD-dependent oxidoreductase domain-containing protein 2 (493-503)
FVINMEYGRNF

SEQ ID NO: 25468 - protein, 9 aa, Artificial Sequence
  Ran GTPase-activating protein 1 (562-570)
FVTKPNSAL

SEQ ID NO: 25469 - protein, 9 aa, Artificial Sequence
  Long-chain-fatty-acid-CoA ligase 3 (624-632)
FVVPNQKEL

SEQ ID NO: 25470 - protein, 10 aa, Artificial Sequence
  Mitochondrial folate transporter/carrier (297-306)
FVVYENVSHF

SEQ ID NO: 25471 - protein, 10 aa, Artificial Sequence
  F-box only protein 21 (602-611)
FVYETVQNIY

SEQ ID NO: 25472 - protein, 11 aa, Artificial Sequence
  Transmembrane protein 181 (554-564)
FVYSPSKNALY

SEQ ID NO: 25473 - protein, 9 aa, Artificial Sequence
  GDP-fucose protein O-fucosyltransferase 1 (2-10)
GAAAWARPL

SEQ ID NO: 25474 - protein, 9 aa, Artificial Sequence
  Zinc finger and BTB domain-containing protein 7A (137-145)
GADAGQLDL

SEQ ID NO: 25475 - protein, 10 aa, Artificial Sequence
  3'(2'),5'-bisphosphate nucleotidase 1 (176-185)
GAFGFQLKEV

SEQ ID NO: 25476 - protein, 9 aa, Artificial Sequence
  X-ray repair cross-complementing protein 5 (469-477)
GAHFSVSSL

SEQ ID NO: 25477 - protein, 9 aa, Artificial Sequence
  Replication protein A 70 kDa DNA-binding subunit (8-16)
GAIAAIMQK

SEQ ID NO: 25478 - protein, 9 aa, Artificial Sequence
  WD repeat-containing protein 89 (351-359)
GAIEKTFTK

SEQ ID NO: 25479 - protein, 11 aa, Artificial Sequence
  Elongation factor 2 (190-200)
GALCEENMRGV

SEQ ID NO: 25480 - protein, 9 aa, Artificial Sequence
  NHP2-like protein 1 (38-46)
GANEATKTL

SEQ ID NO: 25481 - protein, 13 aa, Artificial Sequence
  Nestin (515-527)
GAPVHLGQGQFLK

SEQ ID NO: 25482 - protein, 17 aa, Artificial Sequence
  Galectin-1 (66-82)
GAWGTEQREAVFPFQPG

SEQ ID NO: 25483 - protein, 9 aa, Artificial Sequence
  Calcium-transporting ATPase type 2C member 1 (481-489)
GAYEQVIKY

SEQ ID NO: 25484 - protein, 9 aa, Artificial Sequence
  Delta(24)-sterol reductase (349-357)
GAYGEPRVK

SEQ ID NO: 25485 - protein, 9 aa, Artificial Sequence
  Ribosomal protein S6 kinase alpha-5 (58-66)
GAYGKVFLV

SEQ ID NO: 25486 - protein, 15 aa, Artificial Sequence
  Heterogeneous nuclear ribonucleoprotein F (26-40)
GAYSSQVMQGMGVSA

SEQ ID NO: 25487 - protein, 9 aa, Artificial Sequence
  Complement factor H-related protein 2 (34-42)
GDITSFLLS

SEQ ID NO: 25488 - protein, 9 aa, Artificial Sequence
  Protein SMG8 (168-176)
GEAGGGLSL

SEQ ID NO: 25489 - protein, 12 aa, Artificial Sequence
  Cytoplasmic dynein 1 heavy chain 1 (2969-2980)
GEDFDEDLRTVL

SEQ ID NO: 25490 - protein, 10 aa, Artificial Sequence
  Cytoplasmic dynein 1 light intermediate chain 1 (74-83)
GEDGAGKTSL

SEQ ID NO: 25491 - protein, 9 aa, Artificial Sequence
  Neural cell adhesion molecule L1 (1050-1058)
GEEKGGASL

SEQ ID NO: 25492 - protein, 9 aa, Artificial Sequence
  HEAT repeat-containing protein 5B (1966-1974)
GEEQNRVQL

SEQ ID NO: 25493 - protein, 11 aa, Artificial Sequence
  Rho guanine nucleotide exchange factor 2 (798-808)
GEERATEAGSL

SEQ ID NO: 25494 - protein, 9 aa, Artificial Sequence
  Chondroitin sulfate synthase 2 (169-177)
GEERPIGHL

SEQ ID NO: 25495 - protein, 10 aa, Artificial Sequence
  CD276 antigen (290-299)
GEGEGSKTAL

SEQ ID NO: 25496 - protein, 9 aa, Artificial Sequence
  Ras GTPase-activating-like protein IQGAP1 (1300-1308)
GEIINTHTL

SEQ ID NO: 25497 - protein, 9 aa, Artificial Sequence
  Bifunctional 3'-phosphoadenosine 5'-phosphosulfate synthase 2 (170-178)
GEIKGFTGI

SEQ ID NO: 25498 - protein, 11 aa, Artificial Sequence
  Serine/threonine-protein kinase TBK1 (496-506)
GEISDIHTKLL

SEQ ID NO: 25499 - protein, 10 aa, Artificial Sequence
  Leucine zipper putative tumor suppressor 2 (448-457)
GEISLLKQQL

SEQ ID NO: 25500 - protein, 11 aa, Artificial Sequence
  DNA-directed RNA polymerase III subunit RPC3 (18-28)
GEIVEKIGVHL

SEQ ID NO: 25501 - protein, 9 aa, Artificial Sequence
  Coatomer subunit beta' (652-660)
GELKIAYQL

SEQ ID NO: 25502 - protein, 9 aa, Artificial Sequence
  DNA topoisomerase 3-beta-1 (168-176)
GEPDHNEAL

SEQ ID NO: 25503 - protein, 12 aa, Artificial Sequence
  Ras-related protein Rab-5A (27-38)
GESAVGKSSLVL

SEQ ID NO: 25504 - protein, 9 aa, Artificial Sequence
  Hemicentin-1 (1905-1913)
GETQQHIQL

SEQ ID NO: 25505 - protein, 9 aa, Artificial Sequence
  NF-kappa-B inhibitor beta (105-113)
GETSTVEKL

SEQ ID NO: 25506 - protein, 9 aa, Artificial Sequence
  Probable N-acetyltransferase 16 (116-124)
GETVLVEGL

SEQ ID NO: 25507 - protein, 13 aa, Artificial Sequence
  5,6-dihydroxyindole-2-carboxylic acid oxidase (209-221)
GEVDFSHEGPAFL

SEQ ID NO: 25508 - protein, 11 aa, Artificial Sequence
  Unconventional myosin-X (1723-1733)
GEVVEKLIRGL

SEQ ID NO: 25509 - protein, 10 aa, Artificial Sequence
  Ornithine aminotransferase, mitochondrial (121-130)
GEYEEYITKL

SEQ ID NO: 25510 - protein, 9 aa, Artificial Sequence
  Carbonic anhydrase-related protein (45-53)
GEYQSPINL

SEQ ID NO: 25511 - protein, 17 aa, Artificial Sequence
  Peptidyl-prolyl cis-trans isomerase A (64-80)
GGDFTRHNGTGGKSIYG

SEQ ID NO: 25512 - protein, 14 aa, Artificial Sequence
  NEDD8-conjugating enzyme Ubc12 (170-183)
GGYIGSTYFERCLK

SEQ ID NO: 25513 - protein, 10 aa, Artificial Sequence
  Fibrocystin-L (2531-2540)
GIEHGNILQY

SEQ ID NO: 25514 - protein, 9 aa, Artificial Sequence
  Polypeptide N-acetylgalactosaminyltransferase 16 (295-303)
GIFVIDKSW

SEQ ID NO: 25515 - protein, 10 aa, Artificial Sequence
  2'-5'-oligoadenylate synthase-like protein (493-502)
GIQDSDTLIL

SEQ ID NO: 25516 - protein, 9 aa, Artificial Sequence
  60S ribosomal protein L37a (8-16)
GIVGKYGTR

SEQ ID NO: 25517 - protein, 9 aa, Artificial Sequence
  Intraflagellar transport protein 172 homolog (129-137)
GLAEGKVRL

SEQ ID NO: 25518 - protein, 9 aa, Artificial Sequence
  Pre-B-cell leukemia transcription factor-interacting protein 1 (428-436)
GLAELGHRL

SEQ ID NO: 25519 - protein, 9 aa, Artificial Sequence
  NADH dehydrogenase (ubiquinone) 1 alpha subcomplex subunit 1 (20-28)
GLATAYIHR

SEQ ID NO: 25520 - protein, 9 aa, Artificial Sequence
  Selenocysteine insertion sequence-binding protein 2-like (751-759)
GLDEALYNV

SEQ ID NO: 25521 - protein, 9 aa, Artificial Sequence
  Solute carrier family 25 member 33 (93-101)
GLGPNLVGV

SEQ ID NO: 25522 - protein, 8 aa, Artificial Sequence
  Lysine-specific demethylase 3A (124-131)
GLGSITSV

SEQ ID NO: 25523 - protein, 9 aa, Artificial Sequence
  Membrane-associated transporter protein (409-417)
GLGTGFIGL

SEQ ID NO: 25524 - protein, 9 aa, Artificial Sequence
  Plectin (546-554)
GLHQSIEEF

SEQ ID NO: 25525 - protein, 9 aa, Artificial Sequence
  Filamin-A (1300-1308)
GLHSVDVTY

SEQ ID NO: 25526 - protein, 12 aa, Artificial Sequence
  Ubiquitin-conjugating enzyme E2 G1 (28-39)
GLIDDNDLYRWE

SEQ ID NO: 25527 - protein, 9 aa, Artificial Sequence
  Dedicator of cytokinesis protein 11 (1172-1180)
GLLLENIQR

SEQ ID NO: 25528 - protein, 11 aa, Artificial Sequence
  ATP-dependent RNA helicase DDX1 (121-131)
GLMKGKHYYEV

SEQ ID NO: 25529 - protein, 9 aa, Artificial Sequence
  U7 snRNA-associated Sm-like protein LSm10 (23-31)
GLQGRVTTV

SEQ ID NO: 25530 - protein, 9 aa, Artificial Sequence
  Mortality factor 4-like protein 1 (100-108)
GLQQKNVEV

SEQ ID NO: 25531 - protein, 7 aa, Artificial Sequence
  Microtubule-associated protein 1B (225-231)
GLSEFTE

SEQ ID NO: 25532 - protein, 9 aa, Artificial Sequence
  Pterin-4-alpha-carbinolamine dehydratase (12-20)
GLSERDINL

SEQ ID NO: 25533 - protein, 9 aa, Artificial Sequence
  Protein-methionine sulfoxide oxidase MICAL3 (1054-1062)
GLSEVLVQI

SEQ ID NO: 25534 - protein, 9 aa, Artificial Sequence
  Probable E3 ubiquitin-protein ligase HERC1 (3214-3222)
GLTDIRTLV

SEQ ID NO: 25535 - protein, 11 aa, Artificial Sequence
  Zinc transporter ZIP14 (20-30)
GLWRTTPEAHA

SEQ ID NO: 25536 - protein, 11 aa, Artificial Sequence
  Prolyl 3-hydroxylase 2 (87-97)
GLYEAIADHYM

SEQ ID NO: 25537 - protein, 10 aa, Artificial Sequence
  Guanine nucleotide-binding protein-like 3-like protein (377-386)
GLYSQEQAAK

SEQ ID NO: 25538 - protein, 9 aa, Artificial Sequence
  Tuberin (1302-1310)
GMDRRTDAY

SEQ ID NO: 25539 - protein, 11 aa, Artificial Sequence
  Unconventional myosin-Va (1628-1638)
GMLEHETIQGV

SEQ ID NO: 25540 - protein, 17 aa, Artificial Sequence
  Spectrin alpha chain, non-erythrocytic 1 (367-383)
GMMPRDETDSKTASPWK

SEQ ID NO: 25541 - protein, 9 aa, Artificial Sequence
  Solute carrier family 35 member E1 (21-29)
GMMTAILGV

SEQ ID NO: 25542 - protein, 9 aa, Artificial Sequence
  Catenin beta-1 (106-114)
GMQIPSTQF

SEQ ID NO: 25543 - protein, 17 aa, Artificial Sequence
  Autophagy-related protein 2 homolog A (1914-1930)
GMRNQIVPDAHKDHALK

SEQ ID NO: 25544 - protein, 9 aa, Artificial Sequence
  Synaptic vesicle membrane protein VAT-1 homolog (137-145)
GMWQEEVTV

SEQ ID NO: 25545 - protein, 12 aa, Artificial Sequence
  BMP and activin membrane-bound inhibitor homolog (249-260)
GMYSGHGKLEFV

SEQ ID NO: 25546 - protein, 10 aa, Artificial Sequence
  Bifunctional lysine-specific demethylase and histidyl-hydroxylase MINA (93-102)
GMYYGRDVNV

SEQ ID NO: 25547 - protein, 17 aa, Artificial Sequence
  Heterogeneous nuclear ribonucleoprotein A1-like 2 (126-142)
GNFGGRSSGPYGGGGQY

SEQ ID NO: 25548 - protein, 9 aa, Artificial Sequence
  Uncharacterized protein KIAA1841 (80-88)
GNVISILIS

SEQ ID NO: 25549 - protein, 16 aa, Artificial Sequence
  Vimentin (17-32)
GPGTASRPSSSRSYVT

SEQ ID NO: 25550 - protein, 17 aa, Artificial Sequence
  Vimentin (17-33)
GPGTASRPSSSRSYVTT

SEQ ID NO: 25551 - protein, 14 aa, Artificial Sequence
  Stromal membrane-associated protein 2 (336-349)
GQAANQTLSPQMWK

SEQ ID NO: 25552 - protein, 11 aa, Artificial Sequence
  Integrin beta-3 (297-307)
GQCHVGSDNHY

SEQ ID NO: 25553 - protein, 10 aa, Artificial Sequence
  Anaphase-promoting complex subunit 7 (149-158)
GQERPSVTSY

SEQ ID NO: 25554 - protein, 9 aa, Artificial Sequence
  Protein FAM98A (492-500)
GQFEQHFQH

SEQ ID NO: 25555 - protein, 10 aa, Artificial Sequence
  UPF0428 protein CXorf56 (123-132)
GQGFGKTNIY

SEQ ID NO: 25556 - protein, 9 aa, Artificial Sequence
  Melanoma antigen preferentially expressed in tumors (89-97)
GQHLHLETF

SEQ ID NO: 25557 - protein, 9 aa, Artificial Sequence
  Sodium-dependent neutral amino acid transporter B(0)AT2 (281-289)
GQITHNTSF

SEQ ID NO: 25558 - protein, 9 aa, Artificial Sequence
  Class E basic helix-loop-helix protein 41 (208-216)
GQKLEPLAY

SEQ ID NO: 25559 - protein, 14 aa, Artificial Sequence
  Heterogeneous nuclear ribonucleoprotein U (692-705)
GQKPWSQHYHQGYY

SEQ ID NO: 25560 - protein, 9 aa, Artificial Sequence
  CAP-Gly domain-containing linker protein 3 (317-325)
GQKQGIVRF

SEQ ID NO: 25561 - protein, 10 aa, Artificial Sequence
  Protein SCAI (271-280)
GQLSLADALI

SEQ ID NO: 25562 - protein, 11 aa, Artificial Sequence
  Ras GTPase-activating protein-binding protein 2 (102-112)
GQPERKFMQTF

SEQ ID NO: 25563 - protein, 9 aa, Artificial Sequence
  Clathrin heavy chain 1 (26-34)
GQPQPGFGY

SEQ ID NO: 25564 - protein, 9 aa, Artificial Sequence
  Kinesin-like protein KIF3C (89-97)
GQTGTGKTY

SEQ ID NO: 25565 - protein, 10 aa, Artificial Sequence
  F-box only protein 7 (137-146)
GQVPHSLETL

SEQ ID NO: 25566 - protein, 9 aa, Artificial Sequence
  Protein FAM13A (81-89)
GRDKGLINK

SEQ ID NO: 25567 - protein, 19 aa, Artificial Sequence
  Nucleolar and spindle-associated protein 1 (253-271)
GRSCGPASQSTLGLKGSLK

SEQ ID NO: 25568 - protein, 9 aa, Artificial Sequence
  Phosphatidylinositide phosphatase SAC2 (738-746)
GSDLPIIEK

SEQ ID NO: 25569 - protein, 11 aa, Artificial Sequence
  Anoctamin-4 (845-855)
GSEFSGTPLKY

SEQ ID NO: 25570 - protein, 14 aa, Artificial Sequence
  Keratin, type II cytoskeletal 1 (603-616)
GSGGGSSGGSIGGR

SEQ ID NO: 25571 - protein, 9 aa, Artificial Sequence
  HLA class I histocompatibility antigen, B-50 alpha chain (25-33)
GSHSMRYFH

SEQ ID NO: 25572 - protein, 9 aa, Artificial Sequence
  LIM and calponin homology domains-containing protein 1 (610-618)
GSIEINIKK

SEQ ID NO: 25573 - protein, 12 aa, Artificial Sequence
  Poly(rC)-binding protein 1 (26-37)
GSIIGKKGESVK

SEQ ID NO: 25574 - protein, 13 aa, Artificial Sequence
  Poly(rC)-binding protein 2 (26-38)
GSIIGKKGESVKK

SEQ ID NO: 25575 - protein, 9 aa, Artificial Sequence
  Parkinson disease 7 domain-containing protein 1 (55-63)
GSLARILQH

SEQ ID NO: 25576 - protein, 9 aa, Artificial Sequence
  Integrator complex subunit 4 (30-38)
GSLEKSVTK

SEQ ID NO: 25577 - protein, 10 aa, Artificial Sequence
  Phytanoyl-CoA dioxygenase, peroxisomal (117-126)
GSLKPHDYPK

SEQ ID NO: 25578 - protein, 9 aa, Artificial Sequence
  Signal peptidase complex catalytic subunit SEC11A (55-63)
GSMEPAFHR

SEQ ID NO: 25579 - protein, 9 aa, Artificial Sequence
  ER membrane protein complex subunit 1 (351-359)
GSMGSFSEK

SEQ ID NO: 25580 - protein, 11 aa, Artificial Sequence
  SLAIN motif-containing protein 2 (286-296)
GSMKDDSWKDG

SEQ ID NO: 25581 - protein, 9 aa, Artificial Sequence
  Dynein heavy chain 14, axonemal (154-162)
GSSKIAIQK

SEQ ID NO: 25582 - protein, 11 aa, Artificial Sequence
  Dyslexia-associated protein KIAA0319-like protein (680-690)
GSVPNGQTPLK

SEQ ID NO: 25583 - protein, 13 aa, Artificial Sequence
  28S ribosomal protein S16, mitochondrial (52-64)
GSYDPLPNSHGEK

SEQ ID NO: 25584 - protein, 9 aa, Artificial Sequence
  Transcription factor SOX-10 (199-207)
GTAAIQAHY

SEQ ID NO: 25585 - protein, 10 aa, Artificial Sequence
  5,6-dihydroxyindole-2-carboxylic acid oxidase (495-504)
GTASYLIRAR

SEQ ID NO: 25586 - protein, 8 aa, Artificial Sequence
  FRAS1-related extracellular matrix protein 1 (1422-1429)
GTDKPEEL

SEQ ID NO: 25587 - protein, 9 aa, Artificial Sequence
  Retinol dehydrogenase 8 (207-215)
GTDPETLHY

SEQ ID NO: 25588 - protein, 9 aa, Artificial Sequence
  Receptor-type tyrosine-protein phosphatase gamma isoform X5 (1086-1094)
GTDYINASY

SEQ ID NO: 25589 - protein, 9 aa, Artificial Sequence
  Fibronectin (331-339)
GTDYKIYLY

SEQ ID NO: 25590 - protein, 9 aa, Artificial Sequence
  Myelin proteolipid protein (42-50)
GTEKLIETY

SEQ ID NO: 25591 - protein, 12 aa, Artificial Sequence
  Fructose-bisphosphate aldolase A (48-59)
GTENTEENRRFY

SEQ ID NO: 25592 - protein, 12 aa, Artificial Sequence
  Activating signal cointegrator 1 complex subunit 3 (1388-1399)
GTEYYDGKTRRY

SEQ ID NO: 25593 - protein, 10 aa, Artificial Sequence
  39S ribosomal protein L41, mitochondrial (18-27)
GTFDPDNLEK

SEQ ID NO: 25594 - protein, 12 aa, Artificial Sequence
  Fibronectin (567-578)
GTFYQIGDSWEK

SEQ ID NO: 25595 - protein, 9 aa, Artificial Sequence
  NHS-like protein 1 (375-383)
GTGTLLRPK

SEQ ID NO: 25596 - protein, 10 aa, Artificial Sequence
  Receptor-interacting serine/threonine-protein kinase 4 (183-192)
GTIAYLPPER

SEQ ID NO: 25597 - protein, 10 aa, Artificial Sequence
  Centromere protein F (3155-3164)
GTILREPTTK

SEQ ID NO: 25598 - protein, 9 aa, Artificial Sequence
  SWI/SNF-related matrix-associated actin-dependent regulator of chromatin subfamily E member 1-related (80-88)
GTLDFYMAR

SEQ ID NO: 25599 - protein, 12 aa, Artificial Sequence
  Translocating chain-associated membrane protein 1 (356-367)
GTLTSNVADSPR

SEQ ID NO: 25600 - protein, 10 aa, Artificial Sequence
  Anaphase-promoting complex subunit 1 (1218-1227)
GTMDMSITRL

SEQ ID NO: 25601 - protein, 11 aa, Artificial Sequence
  F-actin-capping protein subunit beta (211-221)
GTMNLGGSLTR

SEQ ID NO: 25602 - protein, 10 aa, Artificial Sequence
  Mitochondrial intermediate peptidase (222-231)
GTNFPNKIEK

SEQ ID NO: 25603 - protein, 9 aa, Artificial Sequence
  Synaptobrevin homolog YKT6 (178-186)
GTQSKAFYK

SEQ ID NO: 25604 - protein, 9 aa, Artificial Sequence
  Protein FAM83D (419-427)
GTQTAVITR

SEQ ID NO: 25605 - protein, 9 aa, Artificial Sequence
  Neuron navigator 2 (769-777)
GTQVTHSTL

SEQ ID NO: 25606 - protein, 9 aa, Artificial Sequence
  MpV17 transgene, murine homolog, glomerulosclerosis, isoform CRA_f (79-87)
GTTKVDALK

SEQ ID NO: 25607 - protein, 10 aa, Artificial Sequence
  Sorcin (118-127)
GTVDPQELQK

SEQ ID NO: 25608 - protein, 12 aa, Artificial Sequence
  Galectin-3 (136-147)
GTVKPNANRIAL

SEQ ID NO: 25609 - protein, 11 aa, Artificial Sequence
  Putative germ cell-less protein-like 1-like (82-92)
GTYGLDSVKKK

SEQ ID NO: 25610 - protein, 16 aa, Artificial Sequence
  Chromobox protein homolog 6 (397-412)
GVAGAAGGGGSIGASK

SEQ ID NO: 25611 - protein, 9 aa, Artificial Sequence
  WD repeat-containing protein 1 (324-332)
GVDGNVRLY

SEQ ID NO: 25612 - protein, 9 aa, Artificial Sequence
  Zinc finger protein 106 (750-758)
GVFEGHTSK

SEQ ID NO: 25613 - protein, 10 aa, Artificial Sequence
  Scavenger receptor class B member 1 (291-300)
GVFEGIPTYR

SEQ ID NO: 25614 - protein, 10 aa, Artificial Sequence
  Vacuolar-sorting protein SNF8 (5-14)
GVGAGAIAKK

SEQ ID NO: 25615 - protein, 14 aa, Artificial Sequence
  Dedicator of cytokinesis protein 4 (591-604)
GVIDAAVNGGVSRY

SEQ ID NO: 25616 - protein, 9 aa, Artificial Sequence
  Ribosomal protein S6 kinase delta-1 (332-340)
GVIDKVLLV

SEQ ID NO: 25617 - protein, 9 aa, Artificial Sequence
  Disabled homolog 2 (110-118)
GVIEHEHPV

SEQ ID NO: 25618 - protein, 11 aa, Artificial Sequence
  Probable ATP-dependent RNA helicase DDX58 (746-756)
GVIEKEQINMY

SEQ ID NO: 25619 - protein, 11 aa, Artificial Sequence
  Regulator of chromosome condensation (182-192)
GVIGLLEPMKK

SEQ ID NO: 25620 - protein, 10 aa, Artificial Sequence
  Interleukin enhancer-binding factor 3 (91-100)
GVMRVGLVAK

SEQ ID NO: 25621 - protein, 9 aa, Artificial Sequence
  Chromodomain-helicase-DNA-binding protein 4 (1522-1530)
GVMSLIRKK

SEQ ID NO: 25622 - protein, 9 aa, Artificial Sequence
  Non-structural maintenance of chromosomes element 1 homolog (3-11)
GVMTDVHRR

SEQ ID NO: 25623 - protein, 12 aa, Artificial Sequence
  POTE ankyrin domain family member I (75-86)
GVTHTVPIYEGY

SEQ ID NO: 25624 - protein, 10 aa, Artificial Sequence
  Protein-glutamine gamma-glutamyltransferase 6 (232-241)
GVVQGQWQGK

SEQ ID NO: 25625 - protein, 12 aa, Artificial Sequence
  Copine-3 (78-89)
GVYDIDNKTIEL

SEQ ID NO: 25626 - protein, 10 aa, Artificial Sequence
  Hyccin (107-116)
GVYNLEIVDK

SEQ ID NO: 25627 - protein, 11 aa, Artificial Sequence
  Alpha-actinin-4 (5-15)
HAANQSYQYGP

SEQ ID NO: 25628 - protein, 16 aa, Artificial Sequence
  Alpha-actinin-4 (5-20)
HAANQSYQYGPSSAGN

SEQ ID NO: 25629 - protein, 9 aa, Artificial Sequence
  Transforming growth factor-beta receptor-associated protein 1 (725-733)
HAGPTAHEL

SEQ ID NO: 25630 - protein, 10 aa, Artificial Sequence
  Leucine-rich repeat-containing protein 1 (515-524)
HAIDRVTTSV

SEQ ID NO: 25631 - protein, 9 aa, Artificial Sequence
  Coatomer subunit beta (447-455)
HAIKSVKIY

SEQ ID NO: 25632 - protein, 9 aa, Artificial Sequence
  G-protein coupled receptor 143 (190-198)
HAIPHYVTM

SEQ ID NO: 25633 - protein, 9 aa, Artificial Sequence
  ATP-dependent RNA helicase DDX3X (209-217)
HAIPIIKEK

SEQ ID NO: 25634 - protein, 9 aa, Artificial Sequence
  Protein Smaug homolog 2 (682-690)
HALGGEHFL

SEQ ID NO: 25635 - protein, 9 aa, Artificial Sequence
  Protein GREB1 (566-574)
HAMDGASHL

SEQ ID NO: 25636 - protein, 9 aa, Artificial Sequence
  Mothers against decapentaplegic homolog 4 (405-413)
HAVFVQSYY

SEQ ID NO: 25637 - protein, 9 aa, Artificial Sequence
  U4/U6.U5 tri-snRNP-associated protein 2 (151-159)
HAYIHSVQF

SEQ ID NO: 25638 - protein, 9 aa, Artificial Sequence
  Helicase SRCAP (102-110)
HEAEIETRI

SEQ ID NO: 25639 - protein, 10 aa, Artificial Sequence
  Zinc finger FYVE domain-containing protein 16 (414-423)
HEEIQNSVVL

SEQ ID NO: 25640 - protein, 15 aa, Artificial Sequence
  Phospholipid hydroperoxide glutathione peroxidase, mitochondrial (42-56)
HEFSAKDIDGHMVNL

SEQ ID NO: 25641 - protein, 10 aa, Artificial Sequence
  Activin receptor type-1B isoform X3 (285-294)
HEHGSLFDYL

SEQ ID NO: 25642 - protein, 9 aa, Artificial Sequence
  Sex comb on midleg-like protein 4 (131-139)
HEIDGNALL

SEQ ID NO: 25643 - protein, 13 aa, Artificial Sequence
  Insulin-like growth factor-binding protein 7 (270-282)
HEIPVKKGEGAEL

SEQ ID NO: 25644 - protein, 9 aa, Artificial Sequence
  Major facilitator superfamily domain-containing protein 12 (161-169)
HEKVELTAL

SEQ ID NO: 25645 - protein, 10 aa, Artificial Sequence
  Putative RNA-binding protein Luc7-like 1 (110-119)
HELNEEIGKL

SEQ ID NO: 25646 - protein, 9 aa, Artificial Sequence
  Alpha-parvin (245-253)
HERDAFDTL

SEQ ID NO: 25647 - protein, 8 aa, Artificial Sequence
  Monocarboxylate transporter 5 (168-175)
HETEESTI

SEQ ID NO: 25648 - protein, 10 aa, Artificial Sequence
  Cadherin-19 (309-318)
HETQEGIVIL

SEQ ID NO: 25649 - protein, 10 aa, Artificial Sequence
  Liprin-alpha-1 (69-78)
HEVGHERDSL

SEQ ID NO: 25650 - protein, 10 aa, Artificial Sequence
  60S ribosomal protein L36a-like (90-99)
HFELGGDKKR

SEQ ID NO: 25651 - protein, 12 aa, Artificial Sequence
  60S ribosomal protein L36a-like (90-101)
HFELGGDKKRKG

SEQ ID NO: 25652 - protein, 13 aa, Artificial Sequence
  60S ribosomal protein L36a-like (90-102)
HFELGGDKKRKGQ

SEQ ID NO: 25653 - protein, 17 aa, Artificial Sequence
  60S ribosomal protein L36a-like (90-106)
HFELGGDKKRKGQVIQF

SEQ ID NO: 25654 - protein, 13 aa, Artificial Sequence
  Interleukin enhancer-binding factor 3 (666-678)
HGGYMNAGAGYGS

SEQ ID NO: 25655 - protein, 9 aa, Artificial Sequence
  Tubulin beta-2A chain (21-29)
HGIDPTGSY

SEQ ID NO: 25656 - protein, 13 aa, Artificial Sequence
  Dyslexia-associated protein KIAA0319-like protein (676-688)
HGQNGSVPNGQTP

SEQ ID NO: 25657 - protein, 10 aa, Artificial Sequence
  Putative heat shock protein HSP 90-beta-3 (6-15)
HHGEEEVETF

SEQ ID NO: 25658 - protein, 16 aa, Artificial Sequence
  G protein-coupled receptor kinase 5 (575-590)
HHINSNHVSSNSTGSS

SEQ ID NO: 25659 - protein, 17 aa, Artificial Sequence
  Non-POU domain-containing octamer-binding protein (28-44)
HHQQQQQQPPPPPIPAN

SEQ ID NO: 25660 - protein, 9 aa, Artificial Sequence
  F-box/WD repeat-containing protein 11 (32-40)
HIAENILSY

SEQ ID NO: 25661 - protein, 9 aa, Artificial Sequence
  60S ribosomal protein L8 (172-180)
HIGKPSTIR

SEQ ID NO: 25662 - protein, 9 aa, Artificial Sequence
  Retinol dehydrogenase 14 (257-265)
HIHIPLLVK

SEQ ID NO: 25663 - protein, 9 aa, Artificial Sequence
  HMG box-containing protein 1 (138-146)
HIIATSKSL

SEQ ID NO: 25664 - protein, 10 aa, Artificial Sequence
  NADH-ubiquinone oxidoreductase chain 5 (394-403)
HIIETANMSY

SEQ ID NO: 25665 - protein, 9 aa, Artificial Sequence
  UBX domain-containing protein 2A (198-206)
HIKDFIEKY

SEQ ID NO: 25666 - protein, 10 aa, Artificial Sequence
  Tyrosine-protein kinase JAK1 (584-593)
HIYSGTLMDY

SEQ ID NO: 25667 - protein, 10 aa, Artificial Sequence
  Disintegrin and metalloproteinase domain-containing protein 10 (101-110)
HIYTGHIYDY

SEQ ID NO: 25668 - protein, 9 aa, Artificial Sequence
  Cyclin-L2 (129-137)
HLASKIEEA

SEQ ID NO: 25669 - protein, 9 aa, Artificial Sequence
  Nesprin-1 (1108-1116)
HLDEDQQEL

SEQ ID NO: 25670 - protein, 7 aa, Artificial Sequence
  UDP-N-acetylglucosamine-dolichyl-phosphate N-acetylglucosaminephosphotransferase (55-61)
HLDLGIL

SEQ ID NO: 25671 - protein, 8 aa, Artificial Sequence
  UDP-N-acetylglucosamine-dolichyl-phosphate N-acetylglucosaminephosphotransferase (55-62)
HLDLGILY

SEQ ID NO: 25672 - protein, 8 aa, Artificial Sequence
  Histone H3-like centromeric protein A (104-111)
HLFEDAYL

SEQ ID NO: 25673 - protein, 9 aa, Artificial Sequence
  Histone H3-like centromeric protein A (104-112)
HLFEDAYLL

SEQ ID NO: 25674 - protein, 10 aa, Artificial Sequence
  WD repeat-containing protein 43 (142-151)
HLFEHILNGY

SEQ ID NO: 25675 - protein, 9 aa, Artificial Sequence
  UPF0536 protein C12orf66 (239-247)
HLFGGQSQK

SEQ ID NO: 25676 - protein, 10 aa, Artificial Sequence
  Protein Shroom4 (1371-1380)
HLFVGDLDKV

SEQ ID NO: 25677 - protein, 10 aa, Artificial Sequence
  cDNA FLJ60317, highly similar to Aminoacylase-1 (EC 3.5.1.14) (332-341)
HLKEGSVTSV

SEQ ID NO: 25678 - protein, 11 aa, Artificial Sequence
  Homeodomain-interacting protein kinase 2 (531-541)
HLLDFPHSTHV

SEQ ID NO: 25679 - protein, 9 aa, Artificial Sequence
  Pre-mRNA-processing-splicing factor 8 (1875-1883)
HLLDFPNIV

SEQ ID NO: 25680 - protein, 11 aa, Artificial Sequence
  Adenylosuccinate lyase (442-452)
HLLDPSSFTGR

SEQ ID NO: 25681 - protein, 11 aa, Artificial Sequence
  Mitotic checkpoint serine/threonine-protein kinase BUB1 (791-801)
HLLGEGAFAQV

SEQ ID NO: 25682 - protein, 9 aa, Artificial Sequence
  Superkiller viralicidic activity 2-like 2 (735-743)
HLLSAISSV

SEQ ID NO: 25683 - protein, 9 aa, Artificial Sequence
  Glutamine synthetase (8-16)
HLNKGIKQV

SEQ ID NO: 25684 - protein, 9 aa, Artificial Sequence
  Integrator complex subunit 11 (516-524)
HLPDGSVTV

SEQ ID NO: 25685 - protein, 9 aa, Artificial Sequence
  Putative ATP-dependent RNA helicase TDRD12 (984-992)
HLPEHFHTL

SEQ ID NO: 25686 - protein, 9 aa, Artificial Sequence
  Unconventional myosin-Id (220-228)
HLQKSLSSY

SEQ ID NO: 25687 - protein, 9 aa, Artificial Sequence
  Testis-expressed sequence 10 protein (95-103)
HLSNILSEV

SEQ ID NO: 25688 - protein, 9 aa, Artificial Sequence
  NADH-ubiquinone oxidoreductase chain 4 (83-91)
HLSSEPLSR

SEQ ID NO: 25689 - protein, 9 aa, Artificial Sequence
  RAD50-interacting protein 1 (429-437)
HLVDEVLLF

SEQ ID NO: 25690 - protein, 9 aa, Artificial Sequence
  Thiamin pyrophosphokinase 1 (34-42)
HLWNKALLR

SEQ ID NO: 25691 - protein, 10 aa, Artificial Sequence
  Proline-rich nuclear receptor coactivator 1 (204-213)
HLYEQPKINR

SEQ ID NO: 25692 - protein, 9 aa, Artificial Sequence
  60S ribosomal protein L19 (99-107)
HMYHSLYLK

SEQ ID NO: 25693 - protein, 9 aa, Artificial Sequence
  COP9 signalosome complex subunit 8 (47-55)
HNDMNNARY

SEQ ID NO: 25694 - protein, 12 aa, Artificial Sequence
  Probable ATP-dependent RNA helicase DDX5 (585-596)
HNGMNQQAYAYP

SEQ ID NO: 25695 - protein, 8 aa, Artificial Sequence
  Ankycorbin (931-938)
HQEVISVY

SEQ ID NO: 25696 - protein, 14 aa, Artificial Sequence
  Protein FAM98A (489-502)
HQGGQFEQHFQHGG

SEQ ID NO: 25697 - protein, 8 aa, Artificial Sequence
  WD repeat-containing protein 70 (230-237)
HQIKSLQY

SEQ ID NO: 25698 - protein, 10 aa, Artificial Sequence
  Sulfotransferase 1C2 (198-207)
HQILFLFYED

SEQ ID NO: 25699 - protein, 11 aa, Artificial Sequence
  Melanocyte protein PMEL (562-572)
HQILKGGSGTY

SEQ ID NO: 25700 - protein, 8 aa, Artificial Sequence
  Kinesin-1 heavy chain (712-719)
HQKQISSL

SEQ ID NO: 25701 - protein, 9 aa, Artificial Sequence
  Zinc finger SWIM domain-containing protein 3 (499-507)
HQSGSELAY

SEQ ID NO: 25702 - protein, 10 aa, Artificial Sequence
  Catenin delta-2 (274-283)
HRPPASEYTM

SEQ ID NO: 25703 - protein, 13 aa, Artificial Sequence
  RNMT-activating mini protein (94-106)
HRQEPYYPQQYGH

SEQ ID NO: 25704 - protein, 9 aa, Artificial Sequence
  Biorientation of chromosomes in cell division protein 1-like 1 (75-83)
HSALPNQSL

SEQ ID NO: 25705 - protein, 10 aa, Artificial Sequence
  Monoacylglycerol lipase ABHD12 (365-374)
HSDLGYRHKY

SEQ ID NO: 25706 - protein, 11 aa, Artificial Sequence
  Transient receptor potential cation channel subfamily A member 1 (758-768)
HSEILDTTNSY

SEQ ID NO: 25707 - protein, 9 aa, Artificial Sequence
  Alstrom syndrome protein 1 (958-966)
HSEKSSVFY

SEQ ID NO: 25708 - protein, 9 aa, Artificial Sequence
  Glycine dehydrogenase (decarboxylating), mitochondrial (529-537)
HSETNIVRY

SEQ ID NO: 25709 - protein, 10 aa, Artificial Sequence
  Dedicator of cytokinesis protein 9 (1147-1156)
HSFDDRYASR

SEQ ID NO: 25710 - protein, 11 aa, Artificial Sequence
  Tubulin alpha-3C/D chain (138-148)
HSFGGGTGSGF

SEQ ID NO: 25711 - protein, 12 aa, Artificial Sequence
  Tubulin alpha-1C chain (104-115)
HSFGGGTGSGFT

SEQ ID NO: 25712 - protein, 8 aa, Artificial Sequence
  E3 ubiquitin-protein ligase TRIM33 (605-612)
HSGPQYSM

SEQ ID NO: 25713 - protein, 14 aa, Artificial Sequence
  Tubulin gamma-1 chain (139-152)
HSIAGGTGSGLGSY

SEQ ID NO: 25714 - protein, 12 aa, Artificial Sequence
  Macrophage migration inhibitory factor (61-72)
HSIGKIGGAQNR

SEQ ID NO: 25715 - protein, 11 aa, Artificial Sequence
  Rho-related BTB domain-containing protein 3 (176-186)
HSLDDFYIGKY

SEQ ID NO: 25716 - protein, 11 aa, Artificial Sequence
  Copper transport protein ATOX1 (46-56)
HSMDTLLATLK

SEQ ID NO: 25717 - protein, 8 aa, Artificial Sequence
  40S ribosomal protein S20 (92-99)
HSPSEIVK

SEQ ID NO: 25718 - protein, 12 aa, Artificial Sequence
  Transcriptional regulator Kaiso (573-584)
HSQDPSGDSKLY

SEQ ID NO: 25719 - protein, 10 aa, Artificial Sequence
  FERM domain-containing protein 4A (823-832)
HSQSQPSSQY

SEQ ID NO: 25720 - protein, 9 aa, Artificial Sequence
  Nipped-B-like protein (134-142)
HSSPASSNY

SEQ ID NO: 25721 - protein, 10 aa, Artificial Sequence
  Melanocyte protein PMEL (639-648)
HSSSHWLRLP

SEQ ID NO: 25722 - protein, 9 aa, Artificial Sequence
  Transformation/transcription domain-associated protein (3009-3017)
HSSSIVTAY

SEQ ID NO: 25723 - protein, 11 aa, Artificial Sequence
  PERQ amino acid-rich with GYF domain-containing protein 2 (1230-1240)
HSTLHSVFQTN

SEQ ID NO: 25724 - protein, 15 aa, Artificial Sequence
  PERQ amino acid-rich with GYF domain-containing protein 2 (1230-1244)
HSTLHSVFQTNQSNN

SEQ ID NO: 25725 - protein, 9 aa, Artificial Sequence
  Ribosome maturation protein SBDS (54-62)
HSVFVNVSK

SEQ ID NO: 25726 - protein, 8 aa, Artificial Sequence
  Proteasome assembly chaperone 2 (85-92)
HSYQRNDL

SEQ ID NO: 25727 - protein, 9 aa, Artificial Sequence
  Adenine DNAosylase (479-487)
HTAAVSTAM

SEQ ID NO: 25728 - protein, 9 aa, Artificial Sequence
  Protein archease (38-46)
HTADVHGLY

SEQ ID NO: 25729 - protein, 10 aa, Artificial Sequence
  Protein archease (38-47)
HTADVHGLYY

SEQ ID NO: 25730 - protein, 10 aa, Artificial Sequence
  Protein O-linked-mannose beta-1,2-N-acetylglucosaminyltransferase 1 (410-419)
HTAEDPALLY

SEQ ID NO: 25731 - protein, 9 aa, Artificial Sequence
  Proton myo-inositol cotransporter (546-554)
HTAEYLTYY

SEQ ID NO: 25732 - protein, 9 aa, Artificial Sequence
  Hydroxyacylglutathione hydrolase-like protein (110-118)
HTAGHMSYF

SEQ ID NO: 25733 - protein, 9 aa, Artificial Sequence
  Tensin-1 (628-636)
HTAPMRPSY

SEQ ID NO: 25734 - protein, 9 aa, Artificial Sequence
  CD63 antigen (131-139)
HTASILDRM

SEQ ID NO: 25735 - protein, 9 aa, Artificial Sequence
  Alanine-tRNA ligase, cytoplasmic (605-613)
HTATHILNF

SEQ ID NO: 25736 - protein, 8 aa, Artificial Sequence
  U3 small nucleolar RNA-associated protein 6 homolog (267-274)
HTDDPLTW

SEQ ID NO: 25737 - protein, 8 aa, Artificial Sequence
  Mitochondrial enolase superfamily member 1 (29-36)
HTDPDYSA

SEQ ID NO: 25738 - protein, 10 aa, Artificial Sequence
  Ras GTPase-activating protein 3 (501-510)
HTDPQTSRTL

SEQ ID NO: 25739 - protein, 10 aa, Artificial Sequence
  Zinc finger protein DZIP1 (221-230)
HTEENSHFEY

SEQ ID NO: 25740 - protein, 9 aa, Artificial Sequence
  Protein FAM214A (1013-1021)
HTEERLLRY

SEQ ID NO: 25741 - protein, 12 aa, Artificial Sequence
  Melanophilin (469-480)
HTFAKPVVAHQS

SEQ ID NO: 25742 - protein, 11 aa, Artificial Sequence
  Cytochrome c oxidase subunit 1 (503-513)
HTFEEPVYMKS

SEQ ID NO: 25743 - protein, 13 aa, Artificial Sequence
  Protein tyrosine phosphatase type IVA 1 (21-33)
HTFMEFLKGSGDY

SEQ ID NO: 25744 - protein, 10 aa, Artificial Sequence
  GRB2-associated-binding protein 2 (554-563)
HTFNSSSSQY

SEQ ID NO: 25745 - protein, 9 aa, Artificial Sequence
  Discoidin, CUB and LCCL domain-containing protein 1 (613-621)
HTFSAQSGY

SEQ ID NO: 25746 - protein, 9 aa, Artificial Sequence
  Importin-8 (408-416)
HTIDTILTV

SEQ ID NO: 25747 - protein, 11 aa, Artificial Sequence
  Protein pelota homolog (100-110)
HTIELEPNRQF

SEQ ID NO: 25748 - protein, 9 aa, Artificial Sequence
  Tubulin polyglutamylase TTLL5 (968-976)
HTIGPFSSF

SEQ ID NO: 25749 - protein, 10 aa, Artificial Sequence
  Nuclear pore complex protein Nup107 (862-871)
HTILHSTGQY

SEQ ID NO: 25750 - protein, 10 aa, Artificial Sequence
  S-methyl-5'-thioadenosine phosphorylase (65-74)
HTIMPSKVNY

SEQ ID NO: 25751 - protein, 9 aa, Artificial Sequence
  Serologically defined colon cancer antigen 8 (120-128)
HTINDQSQY

SEQ ID NO: 25752 - protein, 9 aa, Artificial Sequence
  Minor histocompatibility antigen H13 (119-127)
HTISPFMNK

SEQ ID NO: 25753 - protein, 14 aa, Artificial Sequence
  Tyrosinase (143-156)
HTISSDYVIPIGTY

SEQ ID NO: 25754 - protein, 9 aa, Artificial Sequence
  Cytoskeleton-associated protein 2 (499-507)
HTIVDILTM

SEQ ID NO: 25755 - protein, 10 aa, Artificial Sequence
  Cytoplasmic protein NCK2 (351-360)
HTMDELVEHY

SEQ ID NO: 25756 - protein, 12 aa, Artificial Sequence
  U3 small nucleolar RNA-associated protein 18 homolog (362-373)
HTMDFSPRSGYF

SEQ ID NO: 25757 - protein, 11 aa, Artificial Sequence
  Queuine tRNA-ribosyltransferase subunit QTRTD1 (26-36)
HTMDIPGCLLY

SEQ ID NO: 25758 - protein, 9 aa, Artificial Sequence
  Syntaxin-18 (80-88)
HTMSEYGRM

SEQ ID NO: 25759 - protein, 10 aa, Artificial Sequence
  Histone-lysine N-methyltransferase setd3 (279-288)
HTNGLITTGY

SEQ ID NO: 25760 - protein, 11 aa, Artificial Sequence
  Alpha-adducin (241-251)
HTPAGAAVSAM

SEQ ID NO: 25761 - protein, 10 aa, Artificial Sequence
  Alpha-1,6-mannosylglycoprotein 6-beta-N-acetylglucosaminyltransferase B (424-433)
HTPDNSFMGF

SEQ ID NO: 25762 - protein, 10 aa, Artificial Sequence
  Lanosterol 14-alpha demethylase (489-498)
HTPENPVIRY

SEQ ID NO: 25763 - protein, 11 aa, Artificial Sequence
  Iroquois-class homeodomain protein IRX-5 (89-99)
HTPGMAGSLGY

SEQ ID NO: 25764 - protein, 9 aa, Artificial Sequence
  Ligand of Numb protein X 2 (443-451)
HTPPPYYSR

SEQ ID NO: 25765 - protein, 11 aa, Artificial Sequence
  Tensin-1 (410-420)
HTQGPLDGSLY

SEQ ID NO: 25766 - protein, 10 aa, Artificial Sequence
  Succinate dehydrogenase (ubiquinone) flavoprotein subunit, mitochondrial (270-279)
HTSTGDGTAM

SEQ ID NO: 25767 - protein, 9 aa, Artificial Sequence
  Very-long-chain (3R)-3-hydroxyacyl-CoA dehydratase 3 (185-193)
HTVADMMYF

SEQ ID NO: 25768 - protein, 9 aa, Artificial Sequence
  Tetratricopeptide repeat protein 38 (218-226)
HTVAHIHEM

SEQ ID NO: 25769 - protein, 10 aa, Artificial Sequence
  U3 small nucleolar RNA-associated protein 15 homolog (126-135)
HTVDFTADKY

SEQ ID NO: 25770 - protein, 11 aa, Artificial Sequence
  Aprataxin (170-180)
HTVGEKVIVDF

SEQ ID NO: 25771 - protein, 10 aa, Artificial Sequence
  Sodium-dependent phosphate transporter 1 (379-388)
HTVHKDSGLY

SEQ ID NO: 25772 - protein, 10 aa, Artificial Sequence
  Heterogeneous nuclear ribonucleoprotein A1-like 2 (15-24)
HTVNGHNCEV

SEQ ID NO: 25773 - protein, 12 aa, Artificial Sequence
  Melanocyte protein PMEL (285-296)
HTYLEPGPVTAQ

SEQ ID NO: 25774 - protein, 10 aa, Artificial Sequence
  Oxidoreductase-like domain-containing protein 1 (115-124)
HVADENLKAF

SEQ ID NO: 25775 - protein, 10 aa, Artificial Sequence
  Condensin complex subunit 2 (196-205)
HVADGSATEM

SEQ ID NO: 25776 - protein, 10 aa, Artificial Sequence
  1-phosphatidylinositol 4,5-bisphosphate phosphodiesterase beta-4 (428-437)
HVAEERNIHY

SEQ ID NO: 25777 - protein, 10 aa, Artificial Sequence
  Protein FAN (292-301)
HVAEHTAESY

SEQ ID NO: 25778 - protein, 9 aa, Artificial Sequence
  GPI-anchor transamidase (62-70)
HVANTLSVY

SEQ ID NO: 25779 - protein, 10 aa, Artificial Sequence
  RNA polymerase-associated protein CTR9 homolog (745-754)
HVAPSDTVLM

SEQ ID NO: 25780 - protein, 11 aa, Artificial Sequence
  RNA polymerase-associated protein CTR9 homolog (745-755)
HVAPSDTVLMF

SEQ ID NO: 25781 - protein, 9 aa, Artificial Sequence
  40S ribosomal protein S16 (76-84)
HVAQIYAIR

SEQ ID NO: 25782 - protein, 9 aa, Artificial Sequence
  F-box only protein 31 (181-189)
HVDDPMRFK

SEQ ID NO: 25783 - protein, 9 aa, Artificial Sequence
  tRNA wybutosine-synthesizing protein 2 homolog (192-200)
HVDNGIRYK

SEQ ID NO: 25784 - protein, 8 aa, Artificial Sequence
  P protein (222-229)
HVDSTLLQ

SEQ ID NO: 25785 - protein, 9 aa, Artificial Sequence
  P protein (222-230)
HVDSTLLQV

SEQ ID NO: 25786 - protein, 10 aa, Artificial Sequence
  PRELI domain containing protein 3B (8-17)
HVFDHPWETV

SEQ ID NO: 25787 - protein, 10 aa, Artificial Sequence
  RNA polymerase II subunit A C-terminal domain phosphatase (243-252)
HVFTFGSRLY

SEQ ID NO: 25788 - protein, 9 aa, Artificial Sequence
  Neuropilin-2 (221-229)
HVGPLIGKY

SEQ ID NO: 25789 - protein, 9 aa, Artificial Sequence
  Filamin-A (138-146)
HVGSRLYSV

SEQ ID NO: 25790 - protein, 9 aa, Artificial Sequence
  Endoribonuclease Dicer (1769-1777)
HVIDDFVQF

SEQ ID NO: 25791 - protein, 11 aa, Artificial Sequence
  TRAF2 and NCK-interacting protein kinase (370-380)
HVIDVDSGNSY

SEQ ID NO: 25792 - protein, 11 aa, Artificial Sequence
  Activity-dependent neuroprotector homeobox protein (210-220)
HVIEDHERIGY

SEQ ID NO: 25793 - protein, 9 aa, Artificial Sequence
  Interferon-induced helicase C domain-containing protein 1 (921-929)
HVIEKMHHV

SEQ ID NO: 25794 - protein, 11 aa, Artificial Sequence
  Cytochrome b-c1 complex subunit 2, mitochondrial (172-182)
HVIENLHAAAY

SEQ ID NO: 25795 - protein, 9 aa, Artificial Sequence
  Myomegalin (2179-2187)
HVIGHIDDY

SEQ ID NO: 25796 - protein, 11 aa, Artificial Sequence
  Protein bicaudal C homolog 1 (746-756)
HVIGKGGNNIK

SEQ ID NO: 25797 - protein, 10 aa, Artificial Sequence
  116 kDa U5 small nuclear ribonucleoprotein component (627-636)
HVILGTGELY

SEQ ID NO: 25798 - protein, 10 aa, Artificial Sequence
  Voltage-gated potassium channel subunit beta-1 (216-225)
HVINQGMAMY

SEQ ID NO: 25799 - protein, 9 aa, Artificial Sequence
  Regulator of telomere elongation helicase 1 (740-748)
HVIRDVAQF

SEQ ID NO: 25800 - protein, 10 aa, Artificial Sequence
  BTB/POZ domain-containing protein KCTD1 (197-206)
HVIRFPLNGY

SEQ ID NO: 25801 - protein, 12 aa, Artificial Sequence
  DNA-directed RNA polymerase II subunit RPB1 (1384-1395)
HVISFDGSYVNY

SEQ ID NO: 25802 - protein, 10 aa, Artificial Sequence
  Disco-interacting protein 2 homolog C (561-570)
HVISIPYSLM

SEQ ID NO: 25803 - protein, 9 aa, Artificial Sequence
  E3 SUMO-protein ligase RanBP2 (2985-2993)
HVITKTMEL

SEQ ID NO: 25804 - protein, 10 aa, Artificial Sequence
  40S ribosomal protein S4, Y isoform 1 (208-217)
HVKDANGNSF

SEQ ID NO: 25805 - protein, 10 aa, Artificial Sequence
  Nodal modulator 3 (252-261)
HVLGTITTDK

SEQ ID NO: 25806 - protein, 10 aa, Artificial Sequence
  Pecanex-like protein 1 (113-122)
HVMDDGTNEY

SEQ ID NO: 25807 - protein, 10 aa, Artificial Sequence
  Pleckstrin homology domain-containing family G member 3 (497-506)
HVMDSHVSER

SEQ ID NO: 25808 - protein, 11 aa, Artificial Sequence
  Elongation factor G, mitochondrial (445-455)
HVPDPVISIAM

SEQ ID NO: 25809 - protein, 9 aa, Artificial Sequence
  Probable phospholipid-transporting ATPase IIB (501-509)
HVRDSYSQM

SEQ ID NO: 25810 - protein, 9 aa, Artificial Sequence
  Sideroflexin-1 (171-179)
HVSPLIGRF

SEQ ID NO: 25811 - protein, 9 aa, Artificial Sequence
  Long-chain-fatty-acid-CoA ligase 3 (4-12)
HVSSKPSTM

SEQ ID NO: 25812 - protein, 11 aa, Artificial Sequence
  Zinc finger protein 451 (549-559)
HVTEFHNGHRY

SEQ ID NO: 25813 - protein, 9 aa, Artificial Sequence
  Deoxyribose-phosphate aldolase (322-330)
HVTGRYAAY

SEQ ID NO: 25814 - protein, 9 aa, Artificial Sequence
  Phosphoribosylformylglycinamidine synthase (342-350)
HVVAGTAGY

SEQ ID NO: 25815 - protein, 10 aa, Artificial Sequence
  Jouberin (369-378)
HVVDEHTGQY

SEQ ID NO: 25816 - protein, 9 aa, Artificial Sequence
  Nephrocystin-4 (1128-1136)
HVVDQVFRF

SEQ ID NO: 25817 - protein, 11 aa, Artificial Sequence
  Tetratricopeptide repeat protein 39B (542-552)
HVVESEKLLKY

SEQ ID NO: 25818 - protein, 10 aa, Artificial Sequence
  Dedicator of cytokinesis protein 10 (121-130)
HVVNYKYEQY

SEQ ID NO: 25819 - protein, 9 aa, Artificial Sequence
  Large proline-rich protein BAG6 (350-358)
HVVRPMSHY

SEQ ID NO: 25820 - protein, 9 aa, Artificial Sequence
  HEAT repeat-containing protein 5A (373-381)
HVVSSVSSF

SEQ ID NO: 25821 - protein, 12 aa, Artificial Sequence
  WD repeat-containing protein 74 (10-21)
HVWVGTETGILK

SEQ ID NO: 25822 - protein, 11 aa, Artificial Sequence
  Vesicle-associated membrane protein 7 (159-169)
HVYEEPQAHYY

SEQ ID NO: 25823 - protein, 10 aa, Artificial Sequence
  Regulator of chromosome condensation (291-300)
HVYGFGLSNY

SEQ ID NO: 25824 - protein, 9 aa, Artificial Sequence
  Transmembrane protein 209 (513-521)
HVYNLPKGR

SEQ ID NO: 25825 - protein, 10 aa, Artificial Sequence
  Bcl-2 homologous antagonist/killer (141-150)
HVYQHGLTGF

SEQ ID NO: 25826 - protein, 9 aa, Artificial Sequence
  Little elongation complex subunit 1 (1936-1944)
HVYVGNISK

SEQ ID NO: 25827 - protein, 10 aa, Artificial Sequence
  Neutral amino acid transporter B(0) (523-532)
HYRGPAGDAT

SEQ ID NO: 25828 - protein, 10 aa, Artificial Sequence
  UPF0568 protein C14orf166 (230-239)
IADPKTDHRL

SEQ ID NO: 25829 - protein, 9 aa, Artificial Sequence
  Endoplasmin (212-220)
IADPRGNTL

SEQ ID NO: 25830 - protein, 12 aa, Artificial Sequence
  40S ribosomal protein S19 (134-145)
IAGQVAAANKKH

SEQ ID NO: 25831 - protein, 9 aa, Artificial Sequence
  Tensin-1 (1325-1333)
IASPGSPSL

SEQ ID NO: 25832 - protein, 9 aa, Artificial Sequence
  Hemicentin-1 (4090-4098)
IAVDKPITL

SEQ ID NO: 25833 - protein, 9 aa, Artificial Sequence
  Uncharacterized protein KIAA1210 (412-420)
IAVERVISV

SEQ ID NO: 25834 - protein, 9 aa, Artificial Sequence
  Protein SDE2 homolog (286-294)
IDKETIDLL

SEQ ID NO: 25835 - protein, 13 aa, Artificial Sequence
  Syndecan-3 (293-305)
IDSGSSAAQLPQK

SEQ ID NO: 25836 - protein, 10 aa, Artificial Sequence
  Cullin-3 (721-730)
IEGLIEREYL

SEQ ID NO: 25837 - protein, 8 aa, Artificial Sequence
  Dolichyl-diphosphooligosaccharide-proteinosyltransferase subunit 1 (381-388)
IEIDSPYE

SEQ ID NO: 25838 - protein, 11 aa, Artificial Sequence
  Complex I assembly factor TMEM126B, mitochondrial (24-34)
IEIIEKNFDYL

SEQ ID NO: 25839 - protein, 10 aa, Artificial Sequence
  Copper transport protein ATOX1 (42-51)
IESEHSMDTL

SEQ ID NO: 25840 - protein, 11 aa, Artificial Sequence
  Copper transport protein ATOX1 (42-52)
IESEHSMDTLL

SEQ ID NO: 25841 - protein, 8 aa, Artificial Sequence
  N-acyl-aromatic-L-amino acid amidohydrolase (carboxylate-forming) (191-198)
IFSRMRTL

SEQ ID NO: 25842 - protein, 10 aa, Artificial Sequence
  Cadherin-19 (91-100)
IIDERTGDIY

SEQ ID NO: 25843 - protein, 9 aa, Artificial Sequence
  40S ribosomal protein S17 (95-103)
IIEVDPDTK

SEQ ID NO: 25844 - protein, 10 aa, Artificial Sequence
  FACT complex subunit SSRP1 (30-39)
IIFKNSKTGK

SEQ ID NO: 25845 - protein, 9 aa, Artificial Sequence
  Neuron navigator 2 (2224-2232)
IILDNLHHV

SEQ ID NO: 25846 - protein, 14 aa, Artificial Sequence
  Putative heat shock 70 kDa protein 7 (30-43)
ILANDQGNRTTPSY

SEQ ID NO: 25847 - protein, 10 aa, Artificial Sequence
  Fer-1-like protein 5 (1201-1210)
ILASCELILQ

SEQ ID NO: 25848 - protein, 10 aa, Artificial Sequence
  U6 snRNA-associated Sm-like protein LSm8 (16-25)
ILDESHERVF

SEQ ID NO: 25849 - protein, 10 aa, Artificial Sequence
  Cleft lip and palate transmembrane protein 1 (410-419)
ILDNETNFVV

SEQ ID NO: 25850 - protein, 9 aa, Artificial Sequence
  Vesicle transport protein USE1 (249-257)
ILFIRIMPK

SEQ ID NO: 25851 - protein, 10 aa, Artificial Sequence
  TELO2-interacting protein 1 homolog (52-61)
ILFPLRFTLK

SEQ ID NO: 25852 - protein, 17 aa, Artificial Sequence
  Transforming growth factor beta receptor type 3 (374-390)
ILLDPGALPALQNPPIR

SEQ ID NO: 25853 - protein, 11 aa, Artificial Sequence
  Serine/threonine-protein kinase Sgk1 (323-333)
ILLDSQGHIVL

SEQ ID NO: 25854 - protein, 11 aa, Artificial Sequence
  Eukaryotic translation initiation factor 3 subunit A (542-552)
ILQEKEEQHQL

SEQ ID NO: 25855 - protein, 9 aa, Artificial Sequence
  Inositol-trisphosphate 3-kinase B (133-141)
ILQRELQNV

SEQ ID NO: 25856 - protein, 10 aa, Artificial Sequence
  Myotubularin-related protein 6 isoform X4 (104-113)
ILTKELLHSV

SEQ ID NO: 25857 - protein, 13 aa, Artificial Sequence
  Sodium/potassium/calcium exchanger 5 (18-30)
ILWATAHLPLSGT

SEQ ID NO: 25858 - protein, 11 aa, Artificial Sequence
  Chromosome transmission fidelity protein 8 homolog (58-68)
ILYGKIIHLEK

SEQ ID NO: 25859 - protein, 10 aa, Artificial Sequence
  40S ribosomal protein S3 (188-197)
IMLPWDPTGK

SEQ ID NO: 25860 - protein, 8 aa, Artificial Sequence
  Vimentin (182-189)
IMRLREKL

SEQ ID NO: 25861 - protein, 12 aa, Artificial Sequence
  MAGUK p55 subfamily member 2 (395-406)
IMWDPDRYGTTV

SEQ ID NO: 25862 - protein, 9 aa, Artificial Sequence
  Bromodomain adjacent to zinc finger domain protein 1A (730-738)
INCVTREPL

SEQ ID NO: 25863 - protein, 9 aa, Artificial Sequence
  Sarcospan (117-125)
IQFSMKLLY

SEQ ID NO: 25864 - protein, 10 aa, Artificial Sequence
  Catalase (347-356)
IQYSGEVRRF

SEQ ID NO: 25865 - protein, 17 aa, Artificial Sequence
  Calmodulin (126-142)
IREADIDGDGQVNYEEF

SEQ ID NO: 25866 - protein, 9 aa, Artificial Sequence
  60S ribosomal protein L32 (21-29)
IRHQSDRYV

SEQ ID NO: 25867 - protein, 9 aa, Artificial Sequence
  ATP-citrate synthase (6-14)
ISEQTGKEL

SEQ ID NO: 25868 - protein, 9 aa, Artificial Sequence
  XAGE1D protein (105-113)
ISQTPGINL

SEQ ID NO: 25869 - protein, 8 aa, Artificial Sequence
  Metalloproteinase inhibitor 4 (52-59)
ISSEKVVP

SEQ ID NO: 25870 - protein, 12 aa, Artificial Sequence
  Transmembraneoprotein NMB (483-494)
ISVPDRDPASPL

SEQ ID NO: 25871 - protein, 11 aa, Artificial Sequence
  40S ribosomal protein S18 (30-40)
ITAIKGVGRRY

SEQ ID NO: 25872 - protein, 9 aa, Artificial Sequence
  Melanoma-associated antigen D4 (549-557)
ITDDFVKQK

SEQ ID NO: 25873 - protein, 15 aa, Artificial Sequence
  Melanocyte protein PMEL (216-230)
ITDQVPFSVSVSQLR

SEQ ID NO: 25874 - protein, 11 aa, Artificial Sequence
  Voltage-dependent L-type calcium channel subunit alpha-1C (1300-1310)
ITENAEENSRI

SEQ ID NO: 25875 - protein, 10 aa, Artificial Sequence
  Beta-adrenergic receptor kinase 2 (53-62)
ITFDKIFNQK

SEQ ID NO: 25876 - protein, 13 aa, Artificial Sequence
  Galectin-3 (132-144)
ITILGTVKPNANR

SEQ ID NO: 25877 - protein, 15 aa, Artificial Sequence
  Galectin-3 (132-146)
ITILGTVKPNANRIA

SEQ ID NO: 25878 - protein, 9 aa, Artificial Sequence
  Catalase (42-50)
ITVGPRGPL

SEQ ID NO: 25879 - protein, 9 aa, Artificial Sequence
  Dipeptidyl peptidase 4 (185-193)
ITWTGKEDI

SEQ ID NO: 25880 - protein, 11 aa, Artificial Sequence
  Galectin-8 (91-101)
ITYDTPFKREK

SEQ ID NO: 25881 - protein, 12 aa, Artificial Sequence
  Proteasome subunit alpha type-7 (133-144)
IVGFDFDGTPRL

SEQ ID NO: 25882 - protein, 9 aa, Artificial Sequence
  F-box only protein 11 (19-27)
IVHTNFVEK

SEQ ID NO: 25883 - protein, 9 aa, Artificial Sequence
  Protein SMG5 (881-889)
IVIIPRTVI

SEQ ID NO: 25884 - protein, 13 aa, Artificial Sequence
  Zinc finger CCHC domain-containing protein 10 (33-45)
IVIRDSVAQAGLK

SEQ ID NO: 25885 - protein, 10 aa, Artificial Sequence
  Teneurin-4 (347-356)
IVISATLVIL

SEQ ID NO: 25886 - protein, 9 aa, Artificial Sequence
  U4/U6 small nuclear ribonucleoprotein Prp31 (462-470)
IVNPQAAEK

SEQ ID NO: 25887 - protein, 9 aa, Artificial Sequence
  P antigen family member 5 (47-55)
IVQQPTEEK

SEQ ID NO: 25888 - protein, 10 aa, Artificial Sequence
  Carbohydrate sulfotransferase 9 (266-275)
IYTRLNTYTK

SEQ ID NO: 25889 - protein, 13 aa, Artificial Sequence
  Cap-specific mRNAucleoside-2'-O-)-methyltransferase 1 (72-84)
KADSLVEGTSSRY

SEQ ID NO: 25890 - protein, 9 aa, Artificial Sequence
  Antigen KI-67 (793-801)
KADVEEEFL

SEQ ID NO: 25891 - protein, 10 aa, Artificial Sequence
  Coatomer subunit zeta-1 (19-28)
KAFEKNIFNK

SEQ ID NO: 25892 - protein, 11 aa, Artificial Sequence
  Zinc finger and SCAN domain-containing protein 21 (278-288)
KAFGQSSDLLK

SEQ ID NO: 25893 - protein, 9 aa, Artificial Sequence
  Estradiol 17-beta-dehydrogenase 11 (153-161)
KAFLPAMTK

SEQ ID NO: 25894 - protein, 10 aa, Artificial Sequence
  Antigen KI-67 (828-837)
KAFMGTPVQK

SEQ ID NO: 25895 - protein, 9 aa, Artificial Sequence
  Zinc finger protein 7 (98-106)
KAFSQSSSL

SEQ ID NO: 25896 - protein, 11 aa, Artificial Sequence
  Zinc finger protein 430 (519-529)
KAFSQSSTLTK

SEQ ID NO: 25897 - protein, 10 aa, Artificial Sequence
  Xaa-Pro dipeptidase (484-493)
KAFTPFSGPK

SEQ ID NO: 25898 - protein, 11 aa, Artificial Sequence
  Zinc finger protein 721 (184-194)
KAFTSSTTLTK

SEQ ID NO: 25899 - protein, 9 aa, Artificial Sequence
  Dynactin subunit 1 (141-149)
KAHAKAIEM

SEQ ID NO: 25900 - protein, 9 aa, Artificial Sequence
  Histone-binding protein RBBP7 (263-271)
KAIFTGHSA

SEQ ID NO: 25901 - protein, 9 aa, Artificial Sequence
  Protein ECT2 (595-603)
KAIGSLKEV

SEQ ID NO: 25902 - protein, 9 aa, Artificial Sequence
  Nitrogen permease regulator 3-like protein (253-261)
KAIRPYHAL

SEQ ID NO: 25903 - protein, 9 aa, Artificial Sequence
  Elongation factor 1-gamma (193-201)
KAKDPFAHL

SEQ ID NO: 25904 - protein, 11 aa, Artificial Sequence
  Dynamin-like 120 kDa protein, mitochondrial (154-164)
KALPSSEDLVK

SEQ ID NO: 25905 - protein, 10 aa, Artificial Sequence
  Annexin A1 (98-107)
KALTGHLEEV

SEQ ID NO: 25906 - protein, 9 aa, Artificial Sequence
  Phosphoinositide 3-kinase regulatory subunit 4 (572-580)
KANDVLLSH

SEQ ID NO: 25907 - protein, 9 aa, Artificial Sequence
  UDP-glucose:glycoprotein glucosyltransferase 2 (1135-1143)
KANPGAWIL

SEQ ID NO: 25908 - protein, 9 aa, Artificial Sequence
  Importin subunit alpha-1 (486-494)
KASLSLIEK

SEQ ID NO: 25909 - protein, 9 aa, Artificial Sequence
  Ectonucleoside triphosphate diphosphohydrolase 6 (156-164)
KATPLVLKA

SEQ ID NO: 25910 - protein, 9 aa, Artificial Sequence
  Protein FAM161A (564-572)
KAYDSHQSL

SEQ ID NO: 25911 - protein, 11 aa, Artificial Sequence
  Gamma-soluble NSF attachment protein (76-86)
KAYEQAGMMLK

SEQ ID NO: 25912 - protein, 9 aa, Artificial Sequence
  Cell division cycle protein 23 homolog (85-93)
KAYFDVKEY

SEQ ID NO: 25913 - protein, 11 aa, Artificial Sequence
  28S ribosomal protein S29, mitochondrial (321-331)
KAYLPQELLGK

SEQ ID NO: 25914 - protein, 9 aa, Artificial Sequence
  NF-kappa-B inhibitor zeta (545-553)
KAYNGNTAL

SEQ ID NO: 25915 - protein, 9 aa, Artificial Sequence
  Protein phosphatase Slingshot homolog 1 (418-426)
KAYNYVKQK

SEQ ID NO: 25916 - protein, 9 aa, Artificial Sequence
  Integrator complex subunit 11 (122-130)
KAYYAGHVL

SEQ ID NO: 25917 - protein, 9 aa, Artificial Sequence
  Switch-associated protein 70 (278-286)
KCFDKTFEI

SEQ ID NO: 25918 - protein, 10 aa, Artificial Sequence
  Zinc finger protein 860 (39-48)
KCLDPTQRAL

SEQ ID NO: 25919 - protein, 10 aa, Artificial Sequence
  Keratin, type II cytoskeletal 1 (289-298)
KDVDGAYMTK

SEQ ID NO: 25920 - protein, 10 aa, Artificial Sequence
  Little elongation complex subunit 1 (521-530)
KEAAPGKSEL

SEQ ID NO: 25921 - protein, 10 aa, Artificial Sequence
  Rho guanine nucleotide exchange factor 40 (405-414)
KEDASHQEAL

SEQ ID NO: 25922 - protein, 9 aa, Artificial Sequence
  Ras-related protein Ral-A (118-126)
KEDENVPFL

SEQ ID NO: 25923 - protein, 9 aa, Artificial Sequence
  DNA ligase 3 (389-397)
KEDEQQQAL

SEQ ID NO: 25924 - protein, 9 aa, Artificial Sequence
  Protein SOGA1 (625-633)
KEDQQRALL

SEQ ID NO: 25925 - protein, 9 aa, Artificial Sequence
  Dolichyl-diphosphooligosaccharide-proteinosyltransferase subunit 2 (229-237)
KEDQVIQLM

SEQ ID NO: 25926 - protein, 10 aa, Artificial Sequence
  DNA replication licensing factor MCM7 (259-268)
KEDVNEAIRL

SEQ ID NO: 25927 - protein, 10 aa, Artificial Sequence
  Spermine synthase (169-178)
KEDYTGKDVL

SEQ ID NO: 25928 - protein, 9 aa, Artificial Sequence
  Integrin alpha-7 (1092-1100)
KEEKTGTIL

SEQ ID NO: 25929 - protein, 9 aa, Artificial Sequence
  Eukaryotic translation initiation factor 3 subunit A (105-113)
KEESQQMVL

SEQ ID NO: 25930 - protein, 13 aa, Artificial Sequence
  Solute carrier family 43 member 3 (268-280)
KEETPGAGQKQEL

SEQ ID NO: 25931 - protein, 9 aa, Artificial Sequence
  Ras-related protein Rab-17 (148-156)
KEFADSQKL

SEQ ID NO: 25932 - protein, 12 aa, Artificial Sequence
  Exportin-1 (1023-1034)
KEFAGEDTSDLF

SEQ ID NO: 25933 - protein, 8 aa, Artificial Sequence
  Heat shock protein HSP 90-alpha (656-663)
KEFEGKTL

SEQ ID NO: 25934 - protein, 9 aa, Artificial Sequence
  Protein phosphatase Slingshot homolog 1 (292-300)
KEFIDNEML

SEQ ID NO: 25935 - protein, 10 aa, Artificial Sequence
  Oxidative stress-induced growth inhibitor 1 (196-205)
KEHAIPHVVL

SEQ ID NO: 25936 - protein, 9 aa, Artificial Sequence
  Trophinin (105-113)
KEIDKQSSL

SEQ ID NO: 25937 - protein, 10 aa, Artificial Sequence
  Heat shock 70 kDa protein 4 (766-775)
KEIEAKIKEL

SEQ ID NO: 25938 - protein, 9 aa, Artificial Sequence
  WASH complex subunit 7 (678-686)
KEIEKDLRL

SEQ ID NO: 25939 - protein, 10 aa, Artificial Sequence
  THO complex subunit 5 homolog (217-226)
KEIEVKKEYL

SEQ ID NO: 25940 - protein, 10 aa, Artificial Sequence
  Calcium/calmodulin-dependent protein kinase type IV (135-144)
KEIFETPTEI

SEQ ID NO: 25941 - protein, 11 aa, Artificial Sequence
  Kinesin-like protein KIF2C (653-663)
KEIIQQGPDWL

SEQ ID NO: 25942 - protein, 10 aa, Artificial Sequence
  Spectrin beta chain, non-erythrocytic 1 (924-933)
KEIKAQQDKL

SEQ ID NO: 25943 - protein, 9 aa, Artificial Sequence
  Eukaryotic translation initiation factor 3 subunit E (29-37)
KEIYNEKEL

SEQ ID NO: 25944 - protein, 9 aa, Artificial Sequence
  Telomere-associated protein RIF1 (519-527)
KEKPGSEVL

SEQ ID NO: 25945 - protein, 10 aa, Artificial Sequence
  Beclin-1 (185-194)
KELALEEERL

SEQ ID NO: 25946 - protein, 9 aa, Artificial Sequence
  Ras and Rab interactor 1 (172-180)
KELEAISHL

SEQ ID NO: 25947 - protein, 9 aa, Artificial Sequence
  Liprin-beta-1 (682-690)
KELGIKHSL

SEQ ID NO: 25948 - protein, 11 aa, Artificial Sequence
  Protein S100-A1 (32-42)
KELKELLQTEL

SEQ ID NO: 25949 - protein, 9 aa, Artificial Sequence
  L-dopachrome tautomerase (418-426)
KELPSLHVL

SEQ ID NO: 25950 - protein, 10 aa, Artificial Sequence
  Loss of heterozygosity 12 chromosomal region 1 protein (119-128)
KEMDLSVETL

SEQ ID NO: 25951 - protein, 9 aa, Artificial Sequence
  Disabled homolog 2 (652-660)
KEMFKDFQL

SEQ ID NO: 25952 - protein, 12 aa, Artificial Sequence
  T-complex protein 1 subunit epsilon (113-124)
KEMNPALGIDCL

SEQ ID NO: 25953 - protein, 11 aa, Artificial Sequence
  Ras-related protein Rab-13 (99-109)
KENASAGVERL

SEQ ID NO: 25954 - protein, 10 aa, Artificial Sequence
  Ras-related protein Rab-34 (152-161)
KENDPSSVLL

SEQ ID NO: 25955 - protein, 10 aa, Artificial Sequence
  AN1-type zinc finger protein 5 (200-209)
KENPVVVAEK

SEQ ID NO: 25956 - protein, 9 aa, Artificial Sequence
  Hypoxia-inducible factor 1-alpha (392-400)
KEPDALTLL

SEQ ID NO: 25957 - protein, 9 aa, Artificial Sequence
  P protein (539-547)
KEPSEIVEL

SEQ ID NO: 25958 - protein, 11 aa, Artificial Sequence
  Zinc finger protein 36, C3H1 type-like 2 (102-112)
KEPSGGGGTAL

SEQ ID NO: 25959 - protein, 9 aa, Artificial Sequence
  V-type proton ATPase subunit H (86-94)
KEQTVQYIL

SEQ ID NO: 25960 - protein, 11 aa, Artificial Sequence
  Filamin A-interacting protein 1-like (562-572)
KERDDLKNKLK

SEQ ID NO: 25961 - protein, 10 aa, Artificial Sequence
  Transcription factor 7-like 2 (348-357)
KESAAINQIL

SEQ ID NO: 25962 - protein, 9 aa, Artificial Sequence
  Dynactin subunit 2 (127-135)
KESATEEKL

SEQ ID NO: 25963 - protein, 9 aa, Artificial Sequence
  Cullin-1 (229-237)
KESFESQFL

SEQ ID NO: 25964 - protein, 10 aa, Artificial Sequence
  Lysine-specific histone demethylase 1B (522-531)
KESGIQFSEL

SEQ ID NO: 25965 - protein, 9 aa, Artificial Sequence
  Ras-related GTP-binding protein D (313-321)
KESTAIIKL

SEQ ID NO: 25966 - protein, 9 aa, Artificial Sequence
  Ras-related protein Rab-7a (48-56)
KEVMVDDRL

SEQ ID NO: 25967 - protein, 9 aa, Artificial Sequence
  Cold shock domain-containing protein E1 (675-683)
KEVQDGIEL

SEQ ID NO: 25968 - protein, 8 aa, Artificial Sequence
  Band 4.1-like protein 2 (195-202)
KEVQTNEL

SEQ ID NO: 25969 - protein, 9 aa, Artificial Sequence
  Nuclear receptor subfamily 4 group A member 3 (320-328)
KEVVRTDSL

SEQ ID NO: 25970 - protein, 11 aa, Artificial Sequence
  RuvB-like 1 (68-78)
KEVYEGEVTEL

SEQ ID NO: 25971 - protein, 9 aa, Artificial Sequence
  F-box only protein 32 (43-51)
KEVYNKENL

SEQ ID NO: 25972 - protein, 9 aa, Artificial Sequence
  Armadillo repeat-containing X-linked protein 1 (379-387)
KEWDREILL

SEQ ID NO: 25973 - protein, 9 aa, Artificial Sequence
  Sentrin-specific protease 6 (154-162)
KEYPPHVQK

SEQ ID NO: 25974 - protein, 11 aa, Artificial Sequence
  Iron-responsive element-binding protein 2 (24-34)
KFFDVSKLGTK

SEQ ID NO: 25975 - protein, 9 aa, Artificial Sequence
  Nucleolin (110-118)
KGATPGKAL

SEQ ID NO: 25976 - protein, 9 aa, Artificial Sequence
  PRELI domain-containing protein 1, mitochondrial (160-168)
KGFEYILAK

SEQ ID NO: 25977 - protein, 10 aa, Artificial Sequence
  CD302 antigen (84-93)
KGPDDILLGM

SEQ ID NO: 25978 - protein, 9 aa, Artificial Sequence
  Epithelial discoidin domain-containing receptor 1 (781-789)
KIADFGMSR

SEQ ID NO: 25979 - protein, 11 aa, Artificial Sequence
  Merlin (209-219)
KIAQDLEMYGV

SEQ ID NO: 25980 - protein, 9 aa, Artificial Sequence
  Afadin (742-750)
KIDDVLHTL

SEQ ID NO: 25981 - protein, 9 aa, Artificial Sequence
  Leucine-rich repeat-containing protein 9 (112-120)
KIENLEKLI

SEQ ID NO: 25982 - protein, 9 aa, Artificial Sequence
  Gamma-interferon-inducible protein 16 (67-75)
KIFEDIPTL

SEQ ID NO: 25983 - protein, 10 aa, Artificial Sequence
  Palladin (13-22)
KIFEGMPVTF

SEQ ID NO: 25984 - protein, 10 aa, Artificial Sequence
  Cytochrome c oxidase subunit 2 (217-226)
KIFEMGPVFT

SEQ ID NO: 25985 - protein, 9 aa, Artificial Sequence
  Small subunit processome component 20 homolog (391-399)
KIFESRFEK

SEQ ID NO: 25986 - protein, 11 aa, Artificial Sequence
  Zinc finger protein 141 (290-300)
KIFTSSSNFAK

SEQ ID NO: 25987 - protein, 9 aa, Artificial Sequence
  Tudor domain-containing protein 3 (524-532)
KIFYNSGPK

SEQ ID NO: 25988 - protein, 9 aa, Artificial Sequence
  Cytoskeleton-associated protein 5 (868-876)
KIGDKNWKI

SEQ ID NO: 25989 - protein, 9 aa, Artificial Sequence
  Neuron navigator 2 (2313-2321)
KIIDWIPKV

SEQ ID NO: 25990 - protein, 12 aa, Artificial Sequence
  RanBP2-like and GRIP domain-containing protein 3 (721-732)
KILDDSDSNLSV

SEQ ID NO: 25991 - protein, 10 aa, Artificial Sequence
  Creatine kinase S-type, mitochondrial (344-353)
KILENLRLQK

SEQ ID NO: 25992 - protein, 9 aa, Artificial Sequence
  Ankyrin repeat and KH domain-containing protein 1 (866-874)
KILKELQKV

SEQ ID NO: 25993 - protein, 9 aa, Artificial Sequence
  Protein phosphatase 1 regulatory subunit 21 (355-363)
KILPYQLKR

SEQ ID NO: 25994 - protein, 10 aa, Artificial Sequence
  Cytoglobin (125-134)
KILSGVILEV

SEQ ID NO: 25995 - protein, 9 aa, Artificial Sequence
  Trimethylguanosine synthase (510-518)
KILSKVEKF

SEQ ID NO: 25996 - protein, 11 aa, Artificial Sequence
  X-ray repair cross-complementing protein 6 (451-461)
KIMATPEQVGK

SEQ ID NO: 25997 - protein, 9 aa, Artificial Sequence
  Syntaxin-binding protein 1 (13-21)
KIMHDVIKK

SEQ ID NO: 25998 - protein, 9 aa, Artificial Sequence
  Protein S100-A10 (54-62)
KIMKDLDQC

SEQ ID NO: 25999 - protein, 9 aa, Artificial Sequence
  60S ribosomal protein L26 (28-36)
KIMSSPLSK

SEQ ID NO: 26000 - protein, 9 aa, Artificial Sequence
  Inversin (350-358)
KINPNVQDY

SEQ ID NO: 26001 - protein, 11 aa, Artificial Sequence
  E3 SUMO-protein ligase NSE2 (96-106)
KIPDLKLLVEK

SEQ ID NO: 26002 - protein, 9 aa, Artificial Sequence
  Arrestin domain-containing protein 4 (273-281)
KIPPVTPSI

SEQ ID NO: 26003 - protein, 9 aa, Artificial Sequence
  Utrophin (2159-2167)
KISESLRTV

SEQ ID NO: 26004 - protein, 10 aa, Artificial Sequence
  Nucleolar protein 58 (40-49)
KIVKLKHFEK

SEQ ID NO: 26005 - protein, 12 aa, Artificial Sequence
  ATP synthase subunit g, mitochondrial (55-66)
KIVNSAQTGSFK

SEQ ID NO: 26006 - protein, 12 aa, Artificial Sequence
  Pre-mRNA-processing factor 19 (375-386)
KIWDLKERTNVA

SEQ ID NO: 26007 - protein, 10 aa, Artificial Sequence
  Melanoma-associated antigen 12 (220-229)
KIWEELSVLE

SEQ ID NO: 26008 - protein, 9 aa, Artificial Sequence
  60S ribosomal protein L3 (278-286)
KIYKIGQGY

SEQ ID NO: 26009 - protein, 11 aa, Artificial Sequence
  SWI/SNF-related matrix-associated actin-dependent regulator of chromatin subfamily A member 5 (411-421)
KIYVGLSKMQR

SEQ ID NO: 26010 - protein, 9 aa, Artificial Sequence
  Dynein heavy chain 5, axonemal (1406-1414)
KKQLNLLQK

SEQ ID NO: 26011 - protein, 9 aa, Artificial Sequence
  Tubulin alpha-1C chain (89-97)
KLADQCTGL

SEQ ID NO: 26012 - protein, 9 aa, Artificial Sequence
  Protein TANC1 (1398-1406)
KLCPTNQEV

SEQ ID NO: 26013 - protein, 10 aa, Artificial Sequence
  Golgi-associated PDZ and coiled-coil motif-containing protein (449-458)
KLDDLHTLYH

SEQ ID NO: 26014 - protein, 9 aa, Artificial Sequence
  Dystonin (4697-4705)
KLDDMLSEL

SEQ ID NO: 26015 - protein, 9 aa, Artificial Sequence
  Prefoldin subunit 3 (21-29)
KLDEQYQKY

SEQ ID NO: 26016 - protein, 10 aa, Artificial Sequence
  DNA topoisomerase 2-alpha (278-287)
KLDETGNSLK

SEQ ID NO: 26017 - protein, 10 aa, Artificial Sequence
  Cysteine-tRNA ligase, cytoplasmic (716-725)
KLFEAQEKLY

SEQ ID NO: 26018 - protein, 11 aa, Artificial Sequence
  Pleckstrin homology-like domain family B member 1 (803-813)
KLFEDLEFQQL

SEQ ID NO: 26019 - protein, 9 aa, Artificial Sequence
  Protein CASP (544-552)
KLFEKIKFL

SEQ ID NO: 26020 - protein, 10 aa, Artificial Sequence
  Integrator complex subunit 11 (251-260)
KLFIPWTNQK

SEQ ID NO: 26021 - protein, 9 aa, Artificial Sequence
  Lathosterol oxidase (289-297)
KLFNGEFTK

SEQ ID NO: 26022 - protein, 11 aa, Artificial Sequence
  Cytochrome c oxidase subunit 7A2, mitochondrial (33-43)
KLFQEDDEIPL

SEQ ID NO: 26023 - protein, 10 aa, Artificial Sequence
  Ubiquitin carboxyl-terminal hydrolase 1 (428-437)
KLFQGQLVLR

SEQ ID NO: 26024 - protein, 11 aa, Artificial Sequence
  Coatomer subunit gamma-1 (75-85)
KLFQSNDPTLR

SEQ ID NO: 26025 - protein, 8 aa, Artificial Sequence
  Probable U3 small nucleolar RNA-associated protein 11 (142-149)
KLFVIAQK

SEQ ID NO: 26026 - protein, 12 aa, Artificial Sequence
  Thyroid hormone receptor-associated protein 3 (547-558)
KLGAKGDFPTGK

SEQ ID NO: 26027 - protein, 9 aa, Artificial Sequence
  F-box only protein 7 (249-257)
KLGENVANI

SEQ ID NO: 26028 - protein, 9 aa, Artificial Sequence
  Vam6/Vps39-like protein (271-279)
KLGTDPTHV

SEQ ID NO: 26029 - protein, 9 aa, Artificial Sequence
  Zinc finger protein 106 (287-295)
KLGTVATYR

SEQ ID NO: 26030 - protein, 10 aa, Artificial Sequence
  Large subunit GTPase 1 homolog (102-111)
KLHEENKQFL

SEQ ID NO: 26031 - protein, 9 aa, Artificial Sequence
  Serine/threonine-protein kinase RIO2 (60-68)
KLIAWERTK

SEQ ID NO: 26032 - protein, 12 aa, Artificial Sequence
  Inter-alpha-trypsin inhibitor heavy chain H5 (795-806)
KLIDGEYKDYLA

SEQ ID NO: 26033 - protein, 9 aa, Artificial Sequence
  Elongation of very long chain fatty acids protein 5 (120-128)
KLIEFMDTF

SEQ ID NO: 26034 - protein, 9 aa, Artificial Sequence
  Transcription factor E2F4 (96-104)
KLIELKAEI

SEQ ID NO: 26035 - protein, 9 aa, Artificial Sequence
  Dedicator of cytokinesis protein 9 (1738-1746)
KLIIPIYEK

SEQ ID NO: 26036 - protein, 9 aa, Artificial Sequence
  Amyloid-like protein 2 (10-18)
KLKDLAFLK

SEQ ID NO: 26037 - protein, 9 aa, Artificial Sequence
  Kinesin-like protein KIF20B (1224-1232)
KLKEEITQL

SEQ ID NO: 26038 - protein, 9 aa, Artificial Sequence
  Dystonin (2863-2871)
KLKESLEKA

SEQ ID NO: 26039 - protein, 9 aa, Artificial Sequence
  Heat shock 70 kDa protein 4 (124-132)
KLKETAESV

SEQ ID NO: 26040 - protein, 9 aa, Artificial Sequence
  Lon protease homolog 2, peroxisomal (304-312)
KLKKRVLEY

SEQ ID NO: 26041 - protein, 9 aa, Artificial Sequence
  Cytoplasmic dynein 1 heavy chain 1 (681-689)
KLKQDGDSF

SEQ ID NO: 26042 - protein, 11 aa, Artificial Sequence
  E3 ubiquitin-protein ligase UBR3 (1192-1202)
KLLAEFASRQK

SEQ ID NO: 26043 - protein, 10 aa, Artificial Sequence
  Cytoplasmic dynein 1 heavy chain 1 (1715-1724)
KLLAESVTEV

SEQ ID NO: 26044 - protein, 9 aa, Artificial Sequence
  WD repeat and HMG-box DNA-binding protein 1 (77-85)
KLLAIPVEK

SEQ ID NO: 26045 - protein, 12 aa, Artificial Sequence
  Tight junction-associated protein 1 (150-161)
KLLDAKNTINKL

SEQ ID NO: 26046 - protein, 10 aa, Artificial Sequence
  Protein FAM32A (36-45)
KLLEAMGTSK

SEQ ID NO: 26047 - protein, 10 aa, Artificial Sequence
  SEC14 domain and spectrin repeat-containing protein 1 (418-427)
KLLEEKLKSV

SEQ ID NO: 26048 - protein, 9 aa, Artificial Sequence
  Probable dimethyladenosine transferase (73-81)
KLLEKAKKV

SEQ ID NO: 26049 - protein, 9 aa, Artificial Sequence
  Polymerase I and transcript release factor (109-117)
KLLEKVRKV

SEQ ID NO: 26050 - protein, 9 aa, Artificial Sequence
  Retinaldehyde-binding protein 1 (261-269)
KLLERVFVH

SEQ ID NO: 26051 - protein, 9 aa, Artificial Sequence
  Ubiquitin-conjugating enzyme E2 Q1 (46-54)
KLLESIFHR

SEQ ID NO: 26052 - protein, 9 aa, Artificial Sequence
  S-adenosylmethionine decarboxylase proenzyme (12-20)
KLLEVWFSR

SEQ ID NO: 26053 - protein, 10 aa, Artificial Sequence
  General transcription factor 3C polypeptide 1 (82-91)
KLLKEFKRND

SEQ ID NO: 26054 - protein, 10 aa, Artificial Sequence
  Enhancer of mRNA-decapping protein 4 (1087-1096)
KLLKSKNLTD

SEQ ID NO: 26055 - protein, 12 aa, Artificial Sequence
  Growth arrest and DNA damage-inducible protein GADD45 alpha (45-56)
KLLNVDPDNVVL

SEQ ID NO: 26056 - protein, 10 aa, Artificial Sequence
  Box C/D snoRNA protein 1 (321-330)
KLLPNGFTKR

SEQ ID NO: 26057 - protein, 9 aa, Artificial Sequence
  HMG box-containing protein 1 (263-271)
KLLSHEESV

SEQ ID NO: 26058 - protein, 12 aa, Artificial Sequence
  Ubiquitin-conjugating enzyme E2 E1 (43-54)
KLLSTSAKRIQK

SEQ ID NO: 26059 - protein, 11 aa, Artificial Sequence
  Junction plakoglobin (325-335)
KLLWTTSRVLK

SEQ ID NO: 26060 - protein, 9 aa, Artificial Sequence
  Mitogen-activated protein kinase 6 (549-557)
KLNDLNSSV

SEQ ID NO: 26061 - protein, 9 aa, Artificial Sequence
  Platelet-activating factor acetylhydrolase IB subunit alpha (71-79)
KLNEAKEEF

SEQ ID NO: 26062 - protein, 9 aa, Artificial Sequence
  Structural maintenance of chromosomes protein 1A (1009-1017)
KLNEQQSVL

SEQ ID NO: 26063 - protein, 11 aa, Artificial Sequence
  60S ribosomal protein L4 (327-337)
KLNPYAKTMRR

SEQ ID NO: 26064 - protein, 9 aa, Artificial Sequence
  Pleckstrin homology domain-containing family A member 5 (187-195)
KLNSLPSEY

SEQ ID NO: 26065 - protein, 9 aa, Artificial Sequence
  RUN and FYVE domain-containing protein 2 (250-258)
KLQEENHQL

SEQ ID NO: 26066 - protein, 9 aa, Artificial Sequence
  Bardet-Biedl syndrome 5 protein (242-250)
KLQESVKEI

SEQ ID NO: 26067 - protein, 10 aa, Artificial Sequence
  Calponin-3 (64-73)
KLQPGSVKKV

SEQ ID NO: 26068 - protein, 10 aa, Artificial Sequence
  AP-1 complex subunit beta-1 (876-885)
KLQSSNIFTV

SEQ ID NO: 26069 - protein, 9 aa, Artificial Sequence
  RuvB-like 1 (214-222)
KLRGEINKV

SEQ ID NO: 26070 - protein, 10 aa, Artificial Sequence
  Integrin beta-1 (331-340)
KLSEGVTISY

SEQ ID NO: 26071 - protein, 11 aa, Artificial Sequence
  3-hydroxy-3-methylglutaryl-coenzyme A reductase (502-512)
KLSEPSSLQYL

SEQ ID NO: 26072 - protein, 9 aa, Artificial Sequence
  DNA topoisomerase 1 (248-256)
KLSPKAEEV

SEQ ID NO: 26073 - protein, 10 aa, Artificial Sequence
  Neuron navigator 2 (616-625)
KLSSGLPQQK

SEQ ID NO: 26074 - protein, 11 aa, Artificial Sequence
  Coatomer subunit alpha (619-629)
KLVGQSIIAYL

SEQ ID NO: 26075 - protein, 9 aa, Artificial Sequence
  Proteasome activator complex subunit 3 (201-209)
KLVSKIAKY

SEQ ID NO: 26076 - protein, 10 aa, Artificial Sequence
  Coatomer subunit beta' (124-133)
KLWDWDKKWS

SEQ ID NO: 26077 - protein, 11 aa, Artificial Sequence
  Treslin (218-228)
KLWESPDHLGY

SEQ ID NO: 26078 - protein, 10 aa, Artificial Sequence
  Lambda-crystallin homolog (33-42)
KLYDIEQQQI

SEQ ID NO: 26079 - protein, 11 aa, Artificial Sequence
  26S proteasome non-ATPase regulatory subunit 11 (325-335)
KLYDNLLEQNL

SEQ ID NO: 26080 - protein, 9 aa, Artificial Sequence
  Calpain-1 catalytic subunit (654-662)
KLYELIITR

SEQ ID NO: 26081 - protein, 10 aa, Artificial Sequence
  Calpain-1 catalytic subunit (654-663)
KLYELIITRY

SEQ ID NO: 26082 - protein, 9 aa, Artificial Sequence
  Signal recognition particle 9 kDa protein (16-24)
KLYLADPMK

SEQ ID NO: 26083 - protein, 9 aa, Artificial Sequence
  Gap junction alpha-3 protein (313-321)
KLYNGHHHL

SEQ ID NO: 26084 - protein, 9 aa, Artificial Sequence
  Dedicator of cytokinesis protein 5 (1299-1307)
KLYQEIISY

SEQ ID NO: 26085 - protein, 10 aa, Artificial Sequence
  Rab GDP dissociation inhibitor beta (130-139)
KLYSESLARY

SEQ ID NO: 26086 - protein, 9 aa, Artificial Sequence
  2',3'-cyclic-nucleotide 3'-phosphodiesterase (351-359)
KLYSLGNGR

SEQ ID NO: 26087 - protein, 9 aa, Artificial Sequence
  Cytochrome b-c1 complex subunit 9 (9-17)
KLYSLLFRR

SEQ ID NO: 26088 - protein, 10 aa, Artificial Sequence
  Dual specificity tyrosine-phosphorylation-regulated kinase 3 (365-374)
KLYTYIQSRF

SEQ ID NO: 26089 - protein, 11 aa, Artificial Sequence
  Something about silencing protein 10 (134-144)
KLYYDTDYGSK

SEQ ID NO: 26090 - protein, 9 aa, Artificial Sequence
  Stathmin (95-103)
KMAEEKLTH

SEQ ID NO: 26091 - protein, 11 aa, Artificial Sequence
  Stathmin (95-105)
KMAEEKLTHKM

SEQ ID NO: 26092 - protein, 11 aa, Artificial Sequence
  Eukaryotic peptide chain release factor GTP-binding subunit ERF3B (350-360)
KMDDPTVNWSI

SEQ ID NO: 26093 - protein, 9 aa, Artificial Sequence
  Dihydropyrimidinase-related protein 1 (341-349)
KMDENQFVA

SEQ ID NO: 26094 - protein, 9 aa, Artificial Sequence
  Interferon regulatory factor 9 (369-377)
KMEQAFARY

SEQ ID NO: 26095 - protein, 9 aa, Artificial Sequence
  Guanine nucleotide-binding protein G(i) subunit alpha-1 (197-205)
KMFDVGGQR

SEQ ID NO: 26096 - protein, 13 aa, Artificial Sequence
  Transketolase (516-528)
KMFGIDRDAIAQA

SEQ ID NO: 26097 - protein, 11 aa, Artificial Sequence
  Zinc finger FYVE domain-containing protein 16 (254-264)
KMFHAKDKLQH

SEQ ID NO: 26098 - protein, 8 aa, Artificial Sequence
  Ubiquitin-associated domain-containing protein 2 (83-90)
KMFQVHQV

SEQ ID NO: 26099 - protein, 11 aa, Artificial Sequence
  Intraflagellar transport protein 88 homolog (227-237)
KMFSNAGILKM

SEQ ID NO: 26100 - protein, 9 aa, Artificial Sequence
  Integrin alpha-7 (1061-1069)
KMGFFKRAK

SEQ ID NO: 26101 - protein, 9 aa, Artificial Sequence
  FACT complex subunit SPT16 (120-128)
KMIEAIKES

SEQ ID NO: 26102 - protein, 10 aa, Artificial Sequence
  BRISC and BRCA1-A complex member 1 (126-135)
KMIEMFVRTK

SEQ ID NO: 26103 - protein, 9 aa, Artificial Sequence
  Spartin (80-88)
KMKETLQNV

SEQ ID NO: 26104 - protein, 10 aa, Artificial Sequence
  DNA topoisomerase 1 (262-271)
KMLDHEYTTK

SEQ ID NO: 26105 - protein, 10 aa, Artificial Sequence
  Tropomodulin-3 (307-316)
KMLEENTNIL

SEQ ID NO: 26106 - protein, 10 aa, Artificial Sequence
  Enhancer of mRNA-decapping protein 3 (373-382)
KMLESITNEL

SEQ ID NO: 26107 - protein, 9 aa, Artificial Sequence
  Transient receptor potential cation channel subfamily M member 2 (1336-1344)
KMLEVLVVK

SEQ ID NO: 26108 - protein, 9 aa, Artificial Sequence
  MICAL-like protein 1 (843-851)
KMLKLLGNK

SEQ ID NO: 26109 - protein, 10 aa, Artificial Sequence
  Cofilin-1 (73-82)
KMLPDKDCRY

SEQ ID NO: 26110 - protein, 11 aa, Artificial Sequence
  Cofilin-1 (73-83)
KMLPDKDCRYA

SEQ ID NO: 26111 - protein, 9 aa, Artificial Sequence
  Leucine-rich repeat-containing protein 40 (539-547)
KMMENLTTL

SEQ ID NO: 26112 - protein, 9 aa, Artificial Sequence
  U3 small nucleolar ribonucleoprotein protein MPP10 (357-365)
KMNEKIASL

SEQ ID NO: 26113 - protein, 9 aa, Artificial Sequence
  Unconventional myosin-X (643-651)
KMPDQFDQA

SEQ ID NO: 26114 - protein, 9 aa, Artificial Sequence
  Voltage-dependent calcium channel subunit alpha-2/delta-1 (39-47)
KMQEDLVTL

SEQ ID NO: 26115 - protein, 12 aa, Artificial Sequence
  Gamma-secretase C-terminal fragment 59 (620-631)
KMQQNGYENPTY

SEQ ID NO: 26116 - protein, 11 aa, Artificial Sequence
  U2 small nuclear ribonucleoprotein B'' (47-57)
KMRGQAFVIFK

SEQ ID NO: 26117 - protein, 9 aa, Artificial Sequence
  Aryl hydrocarbon receptor nuclear translocator (104-112)
KMTAYITEL

SEQ ID NO: 26118 - protein, 9 aa, Artificial Sequence
  Uncharacterized protein C20orf194 (424-432)
KMTFHIHAV

SEQ ID NO: 26119 - protein, 9 aa, Artificial Sequence
  Aryl hydrocarbon receptor nuclear translocator 2 (67-75)
KMTQYITEL

SEQ ID NO: 26120 - protein, 9 aa, Artificial Sequence
  Dual specificity mitogen-activated protein kinase kinase 7 (221-229)
KMTVAIVKA

SEQ ID NO: 26121 - protein, 12 aa, Artificial Sequence
  A-kinase anchor protein 11 (898-909)
KMVDERTDYLTK

SEQ ID NO: 26122 - protein, 11 aa, Artificial Sequence
  5-demethoxyubiquinone hydroxylase, mitochondrial (1-11)
KMWDQEKDHLK

SEQ ID NO: 26123 - protein, 12 aa, Artificial Sequence
  5-demethoxyubiquinone hydroxylase, mitochondrial (1-12)
KMWDQEKDHLKK

SEQ ID NO: 26124 - protein, 15 aa, Artificial Sequence
  Neuroblast differentiation-associated protein AHNAK (5087-5101)
KMYFPDVEFDIKSPK

SEQ ID NO: 26125 - protein, 11 aa, Artificial Sequence
  General transcription factor 3C polypeptide 3 (166-176)
KMYGYVDTLLT

SEQ ID NO: 26126 - protein, 10 aa, Artificial Sequence
  Round spermatid basic protein 1 (272-281)
KMYNKEVQTV

SEQ ID NO: 26127 - protein, 11 aa, Artificial Sequence
  116 kDa U5 small nuclear ribonucleoprotein component (480-490)
KMYSTDDGVQF

SEQ ID NO: 26128 - protein, 9 aa, Artificial Sequence
  60S ribosomal protein L17 (96-104)
KNAESNAEL

SEQ ID NO: 26129 - protein, 9 aa, Artificial Sequence
  Ras GTPase-activating-like protein IQGAP2 (729-737)
KNDLLSELL

SEQ ID NO: 26130 - protein, 9 aa, Artificial Sequence
  FACT complex subunit SPT16 (53-61)
KNFDMVIVY

SEQ ID NO: 26131 - protein, 8 aa, Artificial Sequence
  Glutathione S-transferase theta-2B (23-30)
KNGIPLEL

SEQ ID NO: 26132 - protein, 15 aa, Artificial Sequence
  Stromal cell-derived factor 2 (197-211)
KPSELLKAEAHHAEL

SEQ ID NO: 26133 - protein, 12 aa, Artificial Sequence
  Spectrin beta chain, non-erythrocytic 1 (1179-1190)
KQAEAFLNNQEY

SEQ ID NO: 26134 - protein, 9 aa, Artificial Sequence
  Melanocyte protein PMEL (629-637)
KQDFSVPQL

SEQ ID NO: 26135 - protein, 8 aa, Artificial Sequence
  EF-hand calcium-binding domain-containing protein 14 (264-271)
KQDILYLH

SEQ ID NO: 26136 - protein, 9 aa, Artificial Sequence
  Syntaxin-binding protein 6 (78-86)
KQFEGSTSF

SEQ ID NO: 26137 - protein, 9 aa, Artificial Sequence
  E3 ubiquitin-protein ligase makorin-1 (320-328)
KQFESKIIK

SEQ ID NO: 26138 - protein, 9 aa, Artificial Sequence
  Nucleoside diphosphate-linked moiety X motif 19 (337-345)
KQFHRIVTY

SEQ ID NO: 26139 - protein, 10 aa, Artificial Sequence
  ADP-ribosylation factor GTPase-activating protein 2 (453-462)
KQGVKSVAGK

SEQ ID NO: 26140 - protein, 9 aa, Artificial Sequence
  Lanosterol 14-alpha demethylase (169-177)
KQHVSIIEK

SEQ ID NO: 26141 - protein, 10 aa, Artificial Sequence
  60 kDa SS-A/Ro ribonucleoprotein (14-23)
KQIANSQDGY

SEQ ID NO: 26142 - protein, 9 aa, Artificial Sequence
  Cytoplasmic dynein 1 heavy chain 1 (3819-3827)
KQIHFLYQY

SEQ ID NO: 26143 - protein, 10 aa, Artificial Sequence
  Catenin alpha-1 (287-296)
KQIIVDPLSF

SEQ ID NO: 26144 - protein, 10 aa, Artificial Sequence
  Cytoplasmic dynein 1 heavy chain 1 (1464-1473)
KQIREVWNTY

SEQ ID NO: 26145 - protein, 11 aa, Artificial Sequence
  Proteasome subunit alpha type-4 (158-168)
KQKEVEQLIKK

SEQ ID NO: 26146 - protein, 11 aa, Artificial Sequence
  Tyrosinase (505-515)
KQLPEEKQPLL

SEQ ID NO: 26147 - protein, 10 aa, Artificial Sequence
  Guanine nucleotide-binding protein G(s) subunit alpha isoforms short (28-37)
KQLQKDKQVY

SEQ ID NO: 26148 - protein, 9 aa, Artificial Sequence
  Small kinetochore-associated protein (228-236)
KQMEELQAL

SEQ ID NO: 26149 - protein, 9 aa, Artificial Sequence
  DnaJ homolog subfamily C member 4 (151-159)
KQNKQVLGY

SEQ ID NO: 26150 - protein, 9 aa, Artificial Sequence
  Cytoplasmic dynein 1 heavy chain 1 (3266-3274)
KQQEVIADK

SEQ ID NO: 26151 - protein, 9 aa, Artificial Sequence
  Pyridoxal kinase (29-37)
KQQNPRLVY

SEQ ID NO: 26152 - protein, 9 aa, Artificial Sequence
  PRELI domain-containing protein 1, mitochondrial (211-219)
KQQQQQQFV

SEQ ID NO: 26153 - protein, 9 aa, Artificial Sequence
  Mitochondrial import receptor subunit TOM7 homolog (9-17)
KQRLQQLFK

SEQ ID NO: 26154 - protein, 9 aa, Artificial Sequence
  Protein Simiate (164-172)
KQYEEVMVK

SEQ ID NO: 26155 - protein, 9 aa, Artificial Sequence
  60S ribosomal protein L35a (45-53)
KRCAYVYKA

SEQ ID NO: 26156 - protein, 9 aa, Artificial Sequence
  Fructose-bisphosphate aldolase A (82-90)
KRCQYVTEK

SEQ ID NO: 26157 - protein, 9 aa, Artificial Sequence
  Trafficking kinesin-binding protein 2 (839-847)
KRLGIARVV

SEQ ID NO: 26158 - protein, 9 aa, Artificial Sequence
  Chitinase domain-containing protein 1 (226-234)
KRVGLIHML

SEQ ID NO: 26159 - protein, 11 aa, Artificial Sequence
  Myc proto-oncogene protein (324-334)
KRVKLDSVRVL

SEQ ID NO: 26160 - protein, 9 aa, Artificial Sequence
  Msx2-interacting protein (27-35)
KRYGRVESV

SEQ ID NO: 26161 - protein, 11 aa, Artificial Sequence
  DmX-like protein 2 (1150-1160)
KSDALLSKDRY

SEQ ID NO: 26162 - protein, 11 aa, Artificial Sequence
  Mitochondrial Rho GTPase 1 (528-538)
KSDLHEVKQEY

SEQ ID NO: 26163 - protein, 14 aa, Artificial Sequence
  LON peptidase N-terminal domain and RING finger protein 2 (360-373)
KSDMLGNTNSSVLY

SEQ ID NO: 26164 - protein, 9 aa, Artificial Sequence
  Transmembrane protein 70, mitochondrial (84-92)
KSEDGRLIY

SEQ ID NO: 26165 - protein, 11 aa, Artificial Sequence
  Coiled-coil domain-containing protein 50 (470-480)
KSESSHKGFHY

SEQ ID NO: 26166 - protein, 10 aa, Artificial Sequence
  26S proteasome non-ATPase regulatory subunit 2 (545-554)
KSETELKDTY

SEQ ID NO: 26167 - protein, 8 aa, Artificial Sequence
  Clathrin heavy chain 1 (706-713)
KSFEGLFY

SEQ ID NO: 26168 - protein, 9 aa, Artificial Sequence
  Formin-1 (1326-1334)
KSFETTVRY

SEQ ID NO: 26169 - protein, 9 aa, Artificial Sequence
  Ubiquitin-like modifier-activating enzyme 6 (628-636)
KSFPAAIEH

SEQ ID NO: 26170 - protein, 10 aa, Artificial Sequence
  Probable cation-transporting ATPase 13A3 (833-842)
KSFSVILEHF

SEQ ID NO: 26171 - protein, 10 aa, Artificial Sequence
  Glutamate-rich WD repeat-containing protein 1 (341-350)
KSGSPVATFK

SEQ ID NO: 26172 - protein, 11 aa, Artificial Sequence
  Bifunctional UDP-N-acetylglucosamine 2-epimerase/N-acetylmannosamine kinase (375-385)
KSIDLQEPLQK

SEQ ID NO: 26173 - protein, 9 aa, Artificial Sequence
  Retinoblastoma-like protein 1 (69-77)
KSIIPTVGK

SEQ ID NO: 26174 - protein, 10 aa, Artificial Sequence
  NAD(P)H dehydrogenase (quinone) 1 (259-268)
KSIPTDNQIK

SEQ ID NO: 26175 - protein, 9 aa, Artificial Sequence
  Small kinetochore-associated protein (70-78)
KSLLPVRSK

SEQ ID NO: 26176 - protein, 11 aa, Artificial Sequence
  Leucine-rich repeat-containing protein 40 (210-220)
KSLPAEINRMK

SEQ ID NO: 26177 - protein, 9 aa, Artificial Sequence
  Putative ATP-dependent RNA helicase DHX57 (635-643)
KSSATRLLY

SEQ ID NO: 26178 - protein, 9 aa, Artificial Sequence
  Ankycorbin (402-410)
KSSPSVLIH

SEQ ID NO: 26179 - protein, 10 aa, Artificial Sequence
  Alternative protein MKKS (31-40)
KSSPVFQIPK

SEQ ID NO: 26180 - protein, 9 aa, Artificial Sequence
  ATP synthase F(0) complex subunit C2, mitochondrial (31-39)
KSTSQLLSR

SEQ ID NO: 26181 - protein, 9 aa, Artificial Sequence
  Clathrin heavy chain 1 (468-476)
KSVDPTLAL

SEQ ID NO: 26182 - protein, 10 aa, Artificial Sequence
  Programmed cell death 6-interacting protein (574-583)
KSVNFDMTSK

SEQ ID NO: 26183 - protein, 11 aa, Artificial Sequence
  Sodium/potassium-transporting ATPase subunit beta-3 (33-43)
KSWGSQYVVGK

SEQ ID NO: 26184 - protein, 9 aa, Artificial Sequence
  Arf-GAP with SH3 domain, ANK repeat and PH domain-containing protein 1 (73-81)
KTADKLKQY

SEQ ID NO: 26185 - protein, 10 aa, Artificial Sequence
  DNA-directed RNA polymerase II subunit RPB1 (853-862)
KTAETGYIQR

SEQ ID NO: 26186 - protein, 10 aa, Artificial Sequence
  DNA-directed RNA polymerase III subunit RPC1 (133-142)
KTAETGYMQR

SEQ ID NO: 26187 - protein, 9 aa, Artificial Sequence
  Chromodomain-helicase-DNA-binding protein 9 (992-1000)
KTDDSLEKY

SEQ ID NO: 26188 - protein, 9 aa, Artificial Sequence
  TBC1 domain family member 15 (379-387)
KTDEYFRMK

SEQ ID NO: 26189 - protein, 9 aa, Artificial Sequence
  Elongator complex protein 6 (28-36)
KTDGSFLVH

SEQ ID NO: 26190 - protein, 9 aa, Artificial Sequence
  PHD finger-like domain-containing protein 5A (95-103)
KTDLFYERK

SEQ ID NO: 26191 - protein, 10 aa, Artificial Sequence
  EF-hand calcium-binding domain-containing protein 7 (222-231)
KTDPETFLNK

SEQ ID NO: 26192 - protein, 11 aa, Artificial Sequence
  A-kinase anchor protein 13 (287-297)
KTDSKSIMRMK

SEQ ID NO: 26193 - protein, 10 aa, Artificial Sequence
  Tumor necrosis factor receptor superfamily member 14 (17-26)
KTDVLRLVLY

SEQ ID NO: 26194 - protein, 9 aa, Artificial Sequence
  Poly (ADP-ribose) polymerase 14 (1027-1035)
KTDVVVNSV

SEQ ID NO: 26195 - protein, 10 aa, Artificial Sequence
  Uncharacterized protein C19orf43 (137-146)
KTEDEVLTSK

SEQ ID NO: 26196 - protein, 9 aa, Artificial Sequence
  M-phase phosphoprotein 8 (68-76)
KTEGGKVLY

SEQ ID NO: 26197 - protein, 11 aa, Artificial Sequence
  Protein PRR5-ARHGAP8 (76-86)
KTELGSFFTEY

SEQ ID NO: 26198 - protein, 11 aa, Artificial Sequence
  Switch-associated protein 70 (282-292)
KTFEISASDKK

SEQ ID NO: 26199 - protein, 10 aa, Artificial Sequence
  Cytoplasmic dynein 1 heavy chain 1 (872-881)
KTFSEILNRV

SEQ ID NO: 26200 - protein, 10 aa, Artificial Sequence
  N-acetylglucosamine-6-sulfatase (191-200)
KTIDPELLGK

SEQ ID NO: 26201 - protein, 11 aa, Artificial Sequence
  DNA/RNA-binding protein KIN17 (231-241)
KTIGSSASVKR

SEQ ID NO: 26202 - protein, 11 aa, Artificial Sequence
  FH2 domain-containing protein 1 (90-100)
KTIPEEQVRGK

SEQ ID NO: 26203 - protein, 9 aa, Artificial Sequence
  Nck-associated protein 1 (635-643)
KTISQAVNK

SEQ ID NO: 26204 - protein, 9 aa, Artificial Sequence
  Endoplasmic reticulum-Golgi intermediate compartment protein 3 (4-12)
KTLEDFRVK

SEQ ID NO: 26205 - protein, 10 aa, Artificial Sequence
  Mitochondrial inner membrane protease ATP23 homolog (100-109)
KTLETNPYVK

SEQ ID NO: 26206 - protein, 12 aa, Artificial Sequence
  cAMP-dependent protein kinase type I-alpha regulatory subunit (123-134)
KTMAALAKAIEK

SEQ ID NO: 26207 - protein, 10 aa, Artificial Sequence
  Arfaptin-2 (216-225)
KTMEDTLMTV

SEQ ID NO: 26208 - protein, 11 aa, Artificial Sequence
  Telomere-associated protein RIF1 (1915-1925)
KTMELNVGNEA

SEQ ID NO: 26209 - protein, 11 aa, Artificial Sequence
  Protein GREB1 (304-314)
KTMTSTEQSLY

SEQ ID NO: 26210 - protein, 12 aa, Artificial Sequence
  Protein GREB1 (304-315)
KTMTSTEQSLYY

SEQ ID NO: 26211 - protein, 9 aa, Artificial Sequence
  U3 small nucleolar RNA-associated protein 18 homolog (120-128)
KTNPKIQSI

SEQ ID NO: 26212 - protein, 9 aa, Artificial Sequence
  Huntingtin-interacting protein 1-related protein (29-37)
KTQAISISK

SEQ ID NO: 26213 - protein, 9 aa, Artificial Sequence
  Proteasome subunit alpha type-1 (121-129)
KTQIPTQRY

SEQ ID NO: 26214 - protein, 9 aa, Artificial Sequence
  F-box only protein 32 (74-82)
KTQYFHQEK

SEQ ID NO: 26215 - protein, 11 aa, Artificial Sequence
  Oxysterol-binding protein-related protein 1 (153-163)
KTTELTALLNR

SEQ ID NO: 26216 - protein, 11 aa, Artificial Sequence
  G patch domain and KOW motifs-containing protein (49-59)
KTVEGRELQSV

SEQ ID NO: 26217 - protein, 9 aa, Artificial Sequence
  Melanocyte protein PMEL (154-162)
KTWDQVPFS

SEQ ID NO: 26218 - protein, 12 aa, Artificial Sequence
  Melanocyte protein PMEL (154-165)
KTWDQVPFSVSV

SEQ ID NO: 26219 - protein, 8 aa, Artificial Sequence
  Melanocyte protein PMEL (154-161)
KTWGQYWQ

SEQ ID NO: 26220 - protein, 9 aa, Artificial Sequence
  UDP-glucose 4-epimerase (176-184)
KTWNAVLLR

SEQ ID NO: 26221 - protein, 10 aa, Artificial Sequence
  UDP-glucose 4-epimerase (176-185)
KTWNAVLLRY

SEQ ID NO: 26222 - protein, 9 aa, Artificial Sequence
  Transcription factor IIIA (198-206)
KTWTELLKH

SEQ ID NO: 26223 - protein, 11 aa, Artificial Sequence
  A-kinase anchor protein 8-like (264-274)
KTWTTADFRTK

SEQ ID NO: 26224 - protein, 11 aa, Artificial Sequence
  Nuclear pore complex protein Nup107 (574-584)
KTYIQLLIREK

SEQ ID NO: 26225 - protein, 9 aa, Artificial Sequence
  Poly(A)-specific ribonuclease PARN-like domain-containing protein 1 (364-372)
KVAHLLLQK

SEQ ID NO: 26226 - protein, 11 aa, Artificial Sequence
  Mesoderm development candidate 1 (236-246)
KVAPSELARSR

SEQ ID NO: 26227 - protein, 11 aa, Artificial Sequence
  Calponin-3 (251-261)
KVASQKGMSVY

SEQ ID NO: 26228 - protein, 9 aa, Artificial Sequence
  Trafficking protein particle complex subunit 11 (134-142)
KVAVVLIQK

SEQ ID NO: 26229 - protein, 9 aa, Artificial Sequence
  Poly(A) polymerase gamma (590-598)
KVDSTVKTV

SEQ ID NO: 26230 - protein, 12 aa, Artificial Sequence
  Actin-related protein 2/3 complex subunit 3 (147-158)
KVFDPQNDKPSK

SEQ ID NO: 26231 - protein, 12 aa, Artificial Sequence
  Myosin regulatory light chain 10 (142-153)
KVFDTEGKGFVK

SEQ ID NO: 26232 - protein, 9 aa, Artificial Sequence
  AP-2 complex subunit mu (405-413)
KVFEPKLNY

SEQ ID NO: 26233 - protein, 9 aa, Artificial Sequence
  Lysine-specific histone demethylase 1A (228-236)
KVFLFIRNR

SEQ ID NO: 26234 - protein, 9 aa, Artificial Sequence
  Serine/threonine-protein phosphatase 2A activator (141-149)
KVFNRYLEV

SEQ ID NO: 26235 - protein, 9 aa, Artificial Sequence
  Long-chain-fatty-acid-CoA ligase 3 (90-98)
KVFTYAKNK

SEQ ID NO: 26236 - protein, 9 aa, Artificial Sequence
  Caspase-2 (77-85)
KVGSFSQNV

SEQ ID NO: 26237 - protein, 9 aa, Artificial Sequence
  Syntaxin-binding protein 1 (125-133)
KVIKTLTEI

SEQ ID NO: 26238 - protein, 11 aa, Artificial Sequence
  Zinc finger protein 721 (244-254)
KVISSSSSFAK

SEQ ID NO: 26239 - protein, 10 aa, Artificial Sequence
  Protein kinase C delta type (353-362)
KVLGKGSFGK

SEQ ID NO: 26240 - protein, 12 aa, Artificial Sequence
  Inositol 1,4,5-trisphosphate receptor type 1 (451-462)
KVLGSIAGKLEK

SEQ ID NO: 26241 - protein, 11 aa, Artificial Sequence
  Nuclease-sensitive element-binding protein 1 (58-68)
KVLGTVKWFNV

SEQ ID NO: 26242 - protein, 9 aa, Artificial Sequence
  SLIT-ROBO Rho GTPase-activating protein 1 (156-164)
KVLNELYTV

SEQ ID NO: 26243 - protein, 11 aa, Artificial Sequence
  Trafficking protein particle complex subunit 11 (54-64)
KVLPGDHEYPK

SEQ ID NO: 26244 - protein, 11 aa, Artificial Sequence
  B-cell CLL/lymphoma 7 protein family member B (20-30)
KVMAAIEKVRK

SEQ ID NO: 26245 - protein, 9 aa, Artificial Sequence
  Uncharacterized protein C10orf88 (295-303)
KVMPQNHSF

SEQ ID NO: 26246 - protein, 9 aa, Artificial Sequence
  Max-like protein X (158-166)
KVNYEQIVK

SEQ ID NO: 26247 - protein, 9 aa, Artificial Sequence
  Mitochondrial antiviral-signaling protein (311-319)
KVPANPASV

SEQ ID NO: 26248 - protein, 10 aa, Artificial Sequence
  Guanine nucleotide-binding protein G(s) subunit alpha isoforms short (77-86)
KVQDIKNNLK

SEQ ID NO: 26249 - protein, 10 aa, Artificial Sequence
  Kinectin (324-333)
KVQELQNLLK

SEQ ID NO: 26250 - protein, 9 aa, Artificial Sequence
  Centromere protein F (2787-2795)
KVREEIAEY

SEQ ID NO: 26251 - protein, 9 aa, Artificial Sequence
  Transcription elongation factor SPT6 (191-199)
KVSDGIYQH

SEQ ID NO: 26252 - protein, 9 aa, Artificial Sequence
  Peptidyl-prolyl cis-trans isomerase FKBP3 (80-88)
KVSEQVKNV

SEQ ID NO: 26253 - protein, 9 aa, Artificial Sequence
  Exocyst complex component 7 (506-514)
KVTDYIAEK

SEQ ID NO: 26254 - protein, 9 aa, Artificial Sequence
  39S ribosomal protein L51, mitochondrial (1-9)
KVVDRWNEK

SEQ ID NO: 26255 - protein, 9 aa, Artificial Sequence
  Zinc finger CCHC-type and RNA-binding motif-containing protein 1 (35-43)
KVVKVTIMK

SEQ ID NO: 26256 - protein, 9 aa, Artificial Sequence
  Liprin-beta-1 (756-764)
KVVSVLHHL

SEQ ID NO: 26257 - protein, 9 aa, Artificial Sequence
  Pre-mRNA-splicing factor SPF27 (136-144)
KVYNENLVH

SEQ ID NO: 26258 - protein, 9 aa, Artificial Sequence
  Extended synaptotagmin-2 (225-233)
KVYTENVDK

SEQ ID NO: 26259 - protein, 9 aa, Artificial Sequence
  DNA helicase MCM8 (563-571)
KYIGYARQY

SEQ ID NO: 26260 - protein, 9 aa, Artificial Sequence
  Ubiquitin-associated protein 2-like (970-978)
KYPPPYKHF

SEQ ID NO: 26261 - protein, 9 aa, Artificial Sequence
  Fc receptor-like protein 3 (587-595)
LAAAAALLH

SEQ ID NO: 26262 - protein, 10 aa, Artificial Sequence
  Nucleosome assembly protein 1-like 1 (320-329)
LAADFEIGHF

SEQ ID NO: 26263 - protein, 9 aa, Artificial Sequence
  Lanosterol 14-alpha demethylase (46-54)
LAAGHLVQL

SEQ ID NO: 26264 - protein, 8 aa, Artificial Sequence
  KIAA1751 protein (14-21)
LADALLLE

SEQ ID NO: 26265 - protein, 9 aa, Artificial Sequence
  Tripartite motif-containing protein 35 (187-195)
LADEKMKQL

SEQ ID NO: 26266 - protein, 9 aa, Artificial Sequence
  Rho GTPase-activating protein 11B (163-171)
LADHTVHVL

SEQ ID NO: 26267 - protein, 10 aa, Artificial Sequence
  Annexin A1 (198-207)
LADSDARALY

SEQ ID NO: 26268 - protein, 11 aa, Artificial Sequence
  Macrophage migration inhibitory factor (82-92)
LAERLRISPDR

SEQ ID NO: 26269 - protein, 9 aa, Artificial Sequence
  MICOS complex subunit MIC10 (43-51)
LAFGSGMGL

SEQ ID NO: 26270 - protein, 9 aa, Artificial Sequence
  Dedicator of cytokinesis protein 11 (1003-1011)
LAIIPHVTI

SEQ ID NO: 26271 - protein, 11 aa, Artificial Sequence
  Thioredoxin domain-containing protein 15 (243-253)
LALDASQHSSL

SEQ ID NO: 26272 - protein, 9 aa, Artificial Sequence
  Ribosomal protein S6 kinase alpha-2 (72-80)
LALDHLHSL

SEQ ID NO: 26273 - protein, 9 aa, Artificial Sequence
  Breast cancer type 2 susceptibility protein (901-909)
LALGNTKEL

SEQ ID NO: 26274 - protein, 9 aa, Artificial Sequence
  Dual specificity protein phosphatase 3 (113-121)
LAQKNGRVL

SEQ ID NO: 26275 - protein, 9 aa, Artificial Sequence
  Transmembrane protein 8A (26-34)
LARPPPASA

SEQ ID NO: 26276 - protein, 12 aa, Artificial Sequence
  Serine protease 56 (350-361)
LAWDPPQELQAD

SEQ ID NO: 26277 - protein, 10 aa, Artificial Sequence
  Vacuolar protein sorting-associated protein 13B (3150-3159)
LDASLLQKQI

SEQ ID NO: 26278 - protein, 13 aa, Artificial Sequence
  Zinc finger protein castor homolog 1 (1616-1628)
LDGSLSLGAEPGS

SEQ ID NO: 26279 - protein, 9 aa, Artificial Sequence
  Connector enhancer of kinase suppressor of ras 3 (161-169)
LDLTTTVQK

SEQ ID NO: 26280 - protein, 10 aa, Artificial Sequence
  Coiled-coil domain-containing protein 66 (308-317)
LDQSRETVLL

SEQ ID NO: 26281 - protein, 11 aa, Artificial Sequence
  Protein S100-A9 (66-76)
LDTNADKQLSF

SEQ ID NO: 26282 - protein, 9 aa, Artificial Sequence
  Uveal autoantigen with coiled-coil domains and ankyrin repeats (769-777)
LDVTQKYTE

SEQ ID NO: 26283 - protein, 9 aa, Artificial Sequence
  Actin-binding LIM protein 1 (304-312)
LDYKDLAAI

SEQ ID NO: 26284 - protein, 10 aa, Artificial Sequence
  Uncharacterized protein (163-172)
LEEYNKILLD

SEQ ID NO: 26285 - protein, 10 aa, Artificial Sequence
  Tyrosinase (279-288)
LEEYNSHQSL

SEQ ID NO: 26286 - protein, 10 aa, Artificial Sequence
  Vimentin (404-413)
LEGEESRISL

SEQ ID NO: 26287 - protein, 17 aa, Artificial Sequence
  Keratin, type I cytoskeletal 10 (257-273)
LEGEGSSGGGGRGGGSF

SEQ ID NO: 26288 - protein, 10 aa, Artificial Sequence
  Eukaryotic translation initiation factor 3 subunit M (232-241)
LEGELIHDLL

SEQ ID NO: 26289 - protein, 9 aa, Artificial Sequence
  Nestin (589-597)
LEKENKELL

SEQ ID NO: 26290 - protein, 11 aa, Artificial Sequence
  Protein FAM167B (131-141)
LELEPGAGLAL

SEQ ID NO: 26291 - protein, 9 aa, Artificial Sequence
  Nestin (560-568)
LENQSHETL

SEQ ID NO: 26292 - protein, 10 aa, Artificial Sequence
  Alpha-actinin-4 (707-716)
LEQQHQLIQE

SEQ ID NO: 26293 - protein, 11 aa, Artificial Sequence
  Ribosomal protein S6 kinase delta-1 (1025-1035)
LERLGAGVAGV

SEQ ID NO: 26294 - protein, 9 aa, Artificial Sequence
  Coiled-coil domain-containing protein 77 (409-417)
LERRRILEV

SEQ ID NO: 26295 - protein, 9 aa, Artificial Sequence
  Hydrocephalus-inducing protein homolog (151-159)
LFDHVTERE

SEQ ID NO: 26296 - protein, 7 aa, Artificial Sequence
  Nucleoredoxin (9-15)
LGEKLVT

SEQ ID NO: 26297 - protein, 13 aa, Artificial Sequence
  Protein S100-A9 (26-38)
LGHPDTLNQGEFK

SEQ ID NO: 26298 - protein, 9 aa, Artificial Sequence
  Serine beta-lactamase-like protein LACTB, mitochondrial (52-60)
LGVKLAGGL

SEQ ID NO: 26299 - protein, 11 aa, Artificial Sequence
  Galectin-1 (43-53)
LHFNPRFNAHG

SEQ ID NO: 26300 - protein, 10 aa, Artificial Sequence
  Translocon-associated protein subunit gamma (176-185)
LIALLSTGSK

SEQ ID NO: 26301 - protein, 10 aa, Artificial Sequence
  Alpha-actinin-4 (718-727)
LIFDNKHTNY

SEQ ID NO: 26302 - protein, 10 aa, Artificial Sequence
  Solute carrier family 40 member 1 (135-144)
LIITIANIAN

SEQ ID NO: 26303 - protein, 11 aa, Artificial Sequence
  Prohibitin (163-173)
LILDDVSLTHL

SEQ ID NO: 26304 - protein, 10 aa, Artificial Sequence
  Lysosomal-associated transmembrane protein 4B (214-223)
LIYPNSIQEY

SEQ ID NO: 26305 - protein, 9 aa, Artificial Sequence
  Desmoplakin (486-494)
LKEQAIKIT

SEQ ID NO: 26306 - protein, 9 aa, Artificial Sequence
  Histone deacetylase complex subunit SAP30L (60-68)
LKLDIDKSL

SEQ ID NO: 26307 - protein, 10 aa, Artificial Sequence
  Lipoxygenase homology domain-containing protein 1 (933-942)
LKSSKTNSDK

SEQ ID NO: 26308 - protein, 9 aa, Artificial Sequence
  Alpha-1-antichymotrypsin (12-20)
LLAAGFCPA

SEQ ID NO: 26309 - protein, 11 aa, Artificial Sequence
  Granulocyte-macrophage colony-stimulating factor receptor subunit alpha (9-19)
LLCELPHPAFL

SEQ ID NO: 26310 - protein, 9 aa, Artificial Sequence
  Probable serine carboxypeptidase CPVL (258-266)
LLDEKQKKY

SEQ ID NO: 26311 - protein, 9 aa, Artificial Sequence
  Teashirt homolog 3 (435-443)
LLDEKVQSV

SEQ ID NO: 26312 - protein, 9 aa, Artificial Sequence
  Alpha-aminoadipic semialdehyde synthase, mitochondrial (668-676)
LLDGKVVNV

SEQ ID NO: 26313 - protein, 9 aa, Artificial Sequence
  Catenin delta-1 (315-323)
LLDHPKKEV

SEQ ID NO: 26314 - protein, 9 aa, Artificial Sequence
  Interleukin-13 receptor subunit alpha-2 (164-172)
LLDTNYNLF

SEQ ID NO: 26315 - protein, 10 aa, Artificial Sequence
  Interleukin-13 receptor subunit alpha-2 (164-173)
LLDTNYNLFY

SEQ ID NO: 26316 - protein, 10 aa, Artificial Sequence
  RAD50-interacting protein 1 (435-444)
LLFERELHSV

SEQ ID NO: 26317 - protein, 13 aa, Artificial Sequence
  Sorting nexin-21 (131-143)
LLFEVTSANVVKD

SEQ ID NO: 26318 - protein, 9 aa, Artificial Sequence
  Complement decay-accelerating factor (14-22)
LLGELPRLL

SEQ ID NO: 26319 - protein, 9 aa, Artificial Sequence
  Torsin-1A-interacting protein 2, isoform IFRG15 (90-98)
LLGPPLVRK

SEQ ID NO: 26320 - protein, 11 aa, Artificial Sequence
  Collagen alpha-1(IV) chain (17-27)
LLHEEHSRAAA

SEQ ID NO: 26321 - protein, 9 aa, Artificial Sequence
  Pescadillo homolog (73-81)
LLHEPIVNK

SEQ ID NO: 26322 - protein, 8 aa, Artificial Sequence
  DST protein (851-858)
LLKDKLDE

SEQ ID NO: 26323 - protein, 9 aa, Artificial Sequence
  Inverted formin-2 (76-84)
LLLEALARL

SEQ ID NO: 26324 - protein, 11 aa, Artificial Sequence
  Metastasis suppressor protein 1 (174-184)
LLLEETEKQAV

SEQ ID NO: 26325 - protein, 11 aa, Artificial Sequence
  Signal transducer and activator of transcription 6 (550-560)
LLLNEPDGTFL

SEQ ID NO: 26326 - protein, 9 aa, Artificial Sequence
  Carboxypeptidase N catalytic chain (379-387)
LLLPGIYTV

SEQ ID NO: 26327 - protein, 9 aa, Artificial Sequence
  KATNB1-like protein 1 (135-143)
LLRNIQILK

SEQ ID NO: 26328 - protein, 9 aa, Artificial Sequence
  Zinc finger protein ubi-d4 (122-130)
LLRTDPLEK

SEQ ID NO: 26329 - protein, 11 aa, Artificial Sequence
  Cytoplasmic dynein 1 heavy chain 1 (2160-2170)
LLSDVFPGVQY

SEQ ID NO: 26330 - protein, 11 aa, Artificial Sequence
  Aspartate beta-hydroxylase domain-containing protein 1 (342-352)
LLVDDSFLHTV

SEQ ID NO: 26331 - protein, 11 aa, Artificial Sequence
  Lon protease homolog 2, peroxisomal (173-183)
LLVRQIEGLKL

SEQ ID NO: 26332 - protein, 10 aa, Artificial Sequence
  Growth hormone-inducible transmembrane protein (291-300)
LLYDTQKVIK

SEQ ID NO: 26333 - protein, 9 aa, Artificial Sequence
  Integrin alpha-7 (875-883)
LLYPMQVEL

SEQ ID NO: 26334 - protein, 11 aa, Artificial Sequence
  Protein FAM69B (179-189)
LMADFNKDNRV

SEQ ID NO: 26335 - protein, 9 aa, Artificial Sequence
  Pre-mRNA-processing factor 6 (250-258)
LMDMRLSQV

SEQ ID NO: 26336 - protein, 9 aa, Artificial Sequence
  L-dopachrome tautomerase (194-202)
LMETHLSSK

SEQ ID NO: 26337 - protein, 9 aa, Artificial Sequence
  Hippocampus abundant transcript-like protein 1 (59-67)
LMNGLIQGV

SEQ ID NO: 26338 - protein, 12 aa, Artificial Sequence
  Vimentin (413-424)
LPLPNFSSLNLR

SEQ ID NO: 26339 - protein, 10 aa, Artificial Sequence
  Vimentin (431-440)
LPLVDTHSKR

SEQ ID NO: 26340 - protein, 9 aa, Artificial Sequence
  Ectonucleotide pyrophosphatase/phosphodiesterase family member 1 (605-613)
LPYGRPRVL

SEQ ID NO: 26341 - protein, 10 aa, Artificial Sequence
  Eukaryotic translation initiation factor 5A-1 (102-111)
LQDSGEVRED

SEQ ID NO: 26342 - protein, 9 aa, Artificial Sequence
  Coiled-coil domain-containing protein 13 (338-346)
LQRELEELK

SEQ ID NO: 26343 - protein, 9 aa, Artificial Sequence
  Zinc finger protein 703 (534-542)
LRNPHTLGL

SEQ ID NO: 26344 - protein, 10 aa, Artificial Sequence
  ATP-binding cassette sub-family A member 13 (39-48)
LSAIQGVTLA

SEQ ID NO: 26345 - protein, 11 aa, Artificial Sequence
  GPI-anchor transamidase (151-161)
LSDDRSNILIY

SEQ ID NO: 26346 - protein, 9 aa, Artificial Sequence
  General transcription factor 3C polypeptide 2 (596-604)
LSDGSLKLY

SEQ ID NO: 26347 - protein, 9 aa, Artificial Sequence
  Myotubularin-related protein 5 (501-509)
LSDPFYRTL

SEQ ID NO: 26348 - protein, 9 aa, Artificial Sequence
  Low affinity immunoglobulin gamma Fc region receptor II-b (113-121)
LSDPVHLTV

SEQ ID NO: 26349 - protein, 9 aa, Artificial Sequence
  Tyrosine-protein kinase JAK1 (30-38)
LSDREPLRL

SEQ ID NO: 26350 - protein, 9 aa, Artificial Sequence
  Exportin-5 (689-697)
LSDVDAFIA

SEQ ID NO: 26351 - protein, 11 aa, Artificial Sequence
  DNA polymerase zeta catalytic subunit (2423-2433)
LSDWFDNKTDL

SEQ ID NO: 26352 - protein, 9 aa, Artificial Sequence
  Little elongation complex subunit 1 (1975-1983)
LSELKIQKI

SEQ ID NO: 26353 - protein, 11 aa, Artificial Sequence
  Cell surfaceoprotein MUC18 (332-342)
LSEPQELLVNY

SEQ ID NO: 26354 - protein, 9 aa, Artificial Sequence
  Putative stereocilin-like protein (36-44)
LSFLKSLLS

SEQ ID NO: 26355 - protein, 9 aa, Artificial Sequence
  Melanocyte protein PMEL (177-185)
LSIGTGRAM

SEQ ID NO: 26356 - protein, 9 aa, Artificial Sequence
  Cytoplasmic dynein 1 heavy chain 1 (746-754)
LSKEVRNLK

SEQ ID NO: 26357 - protein, 9 aa, Artificial Sequence
  Exophilin-5 (986-994)
LSKTESISV

SEQ ID NO: 26358 - protein, 10 aa, Artificial Sequence
  EF-hand calcium-binding domain-containing protein 6 (344-353)
LSLPTQELRP

SEQ ID NO: 26359 - protein, 9 aa, Artificial Sequence
  Methylcrotonoyl-CoA carboxylase subunit alpha, mitochondrial (108-116)
LSMEKIIQV

SEQ ID NO: 26360 - protein, 11 aa, Artificial Sequence
  Zinc finger and BTB domain-containing protein 34 (63-73)
LSTMSGLSISV

SEQ ID NO: 26361 - protein, 9 aa, Artificial Sequence
  Vacuolar protein sorting-associated protein 13B (1713-1721)
LSVAQVQLL

SEQ ID NO: 26362 - protein, 9 aa, Artificial Sequence
  PERQ amino acid-rich with GYF domain-containing protein 1 (92-100)
LSVNSVAVL

SEQ ID NO: 26363 - protein, 11 aa, Artificial Sequence
  Mitogen-activated protein kinase 14 (122-132)
LTDDHVQFLIY

SEQ ID NO: 26364 - protein, 11 aa, Artificial Sequence
  FAST kinase domain-containing protein 5 (625-635)
LTDDLMNKLLK

SEQ ID NO: 26365 - protein, 11 aa, Artificial Sequence
  Vacuolar protein sorting-associated protein VTA1 homolog (134-144)
LTDENVKHRKY

SEQ ID NO: 26366 - protein, 10 aa, Artificial Sequence
  Ectonucleoside triphosphate diphosphohydrolase 4 (199-208)
LTDIPVHFDF

SEQ ID NO: 26367 - protein, 7 aa, Artificial Sequence
  39S ribosomal protein L52, mitochondrial (43-49)
LTELPDW

SEQ ID NO: 26368 - protein, 10 aa, Artificial Sequence
  Glutathione S-transferase theta-1 (64-73)
LTESVAILLY

SEQ ID NO: 26369 - protein, 9 aa, Artificial Sequence
  AFG3-like protein 2 (346-354)
LTGPPGTGK

SEQ ID NO: 26370 - protein, 7 aa, Artificial Sequence
  Keratin, type I cytoskeletal 9 (86-92)
LTKTLND

SEQ ID NO: 26371 - protein, 11 aa, Artificial Sequence
  Amphoterin-induced protein 1 (187-197)
LTLLDLSSNKL

SEQ ID NO: 26372 - protein, 9 aa, Artificial Sequence
  Delta and Notch-like epidermal growth factor-related receptor (632-640)
LTNMPRHSL

SEQ ID NO: 26373 - protein, 12 aa, Artificial Sequence
  Synaptosomal-associated protein 23 (156-167)
LTQVGSILGNLK

SEQ ID NO: 26374 - protein, 11 aa, Artificial Sequence
  Inactive rhomboid protein 2 (165-175)
LTSFTSVRSGY

SEQ ID NO: 26375 - protein, 9 aa, Artificial Sequence
  Tubulin beta-4B chain (273-281)
LTSRGSQQY

SEQ ID NO: 26376 - protein, 9 aa, Artificial Sequence
  Tectonic-3 (319-327)
LTVEPGASL

SEQ ID NO: 26377 - protein, 10 aa, Artificial Sequence
  LON peptidase N-terminal domain and RING finger protein 1 (764-773)
LTYFSRDQSK

SEQ ID NO: 26378 - protein, 15 aa, Artificial Sequence
  60S ribosomal protein L34 (5-19)
LTYRRRLSYNTASNK

SEQ ID NO: 26379 - protein, 10 aa, Artificial Sequence
  Aspartate beta-hydroxylase domain-containing protein 1 (343-352)
LVDDSFLHTV

SEQ ID NO: 26380 - protein, 8 aa, Artificial Sequence
  Cytosolic non-specific dipeptidase (250-257)
LVDKRGNI

SEQ ID NO: 26381 - protein, 10 aa, Artificial Sequence
  Thymidine phosphorylase (223-232)
LVEGLSALVV

SEQ ID NO: 26382 - protein, 9 aa, Artificial Sequence
  Matrin-3 (461-469)
LVFGKPVRV

SEQ ID NO: 26383 - protein, 11 aa, Artificial Sequence
  POTE ankyrin domain family member F (708-718)
LVIDNGSGMCK

SEQ ID NO: 26384 - protein, 11 aa, Artificial Sequence
  Phospholipid hydroperoxide glutathione peroxidase, mitochondrial (187-197)
LVIEKDLPHYF

SEQ ID NO: 26385 - protein, 11 aa, Artificial Sequence
  Roquin-2 (100-110)
LVIESIPVLGT

SEQ ID NO: 26386 - protein, 9 aa, Artificial Sequence
  Probable ATP-dependent RNA helicase DDX17 (248-256)
LVLAPTREL

SEQ ID NO: 26387 - protein, 9 aa, Artificial Sequence
  Melanocyte protein PMEL (10-18)
LVLKRCLLH

SEQ ID NO: 26388 - protein, 13 aa, Artificial Sequence
  Beta-actin-like protein 2 (9-21)
LVVDNGSGMCKAG

SEQ ID NO: 26389 - protein, 9 aa, Artificial Sequence
  DNA mismatch repair protein Msh6 (111-119)
LYSQAGLLA

SEQ ID NO: 26390 - protein, 11 aa, Artificial Sequence
  Olfactory receptor 4M2 (122-132)
LYTAICRPLHY

SEQ ID NO: 26391 - protein, 13 aa, Artificial Sequence
  Heterogeneous nuclear ribonucleoprotein L (35-47)
MAAAGGGGGGGRY

SEQ ID NO: 26392 - protein, 10 aa, Artificial Sequence
  Exocyst complex component 4 (1-10)
MAAEAAGGKY

SEQ ID NO: 26393 - protein, 9 aa, Artificial Sequence
  Liprin-alpha-1 (538-546)
MADGHTDSY

SEQ ID NO: 26394 - protein, 9 aa, Artificial Sequence
  Cystatin-C (1-9)
MAGPLRAPL

SEQ ID NO: 26395 - protein, 10 aa, Artificial Sequence
  WD repeat-containing protein 7 (1479-1488)
MAHDGKEHRF

SEQ ID NO: 26396 - protein, 11 aa, Artificial Sequence
  WD repeat-containing protein 7 (1479-1489)
MAHDGKEHRFM

SEQ ID NO: 26397 - protein, 9 aa, Artificial Sequence
  Tubulin polyglutamylase complex subunit 2 (33-41)
MAINSISKL

SEQ ID NO: 26398 - protein, 11 aa, Artificial Sequence
  Intron-binding protein aquarius (867-877)
MALDIDERHLL

SEQ ID NO: 26399 - protein, 11 aa, Artificial Sequence
  Ribonuclease pancreatic (1-11)
MALEKSLVRLL

SEQ ID NO: 26400 - protein, 12 aa, Artificial Sequence
  Actin, cytoplasmic 2 (18-29)
MATAASSSSLEK

SEQ ID NO: 26401 - protein, 9 aa, Artificial Sequence
  STE20-related kinase adapter protein alpha (113-121)
MAYGSAKDL

SEQ ID NO: 26402 - protein, 10 aa, Artificial Sequence
  High mobility group protein 20A (131-140)
MEFEERNAAL

SEQ ID NO: 26403 - protein, 11 aa, Artificial Sequence
  Squalene synthase (112-122)
MESKEKDRQVL

SEQ ID NO: 26404 - protein, 9 aa, Artificial Sequence
  A-kinase anchor protein 11 (545-553)
MIKDSIQKF

SEQ ID NO: 26405 - protein, 9 aa, Artificial Sequence
  Protein mago nashi homolog (45-53)
MIRKEELEI

SEQ ID NO: 26406 - protein, 10 aa, Artificial Sequence
  Hypoxia-inducible factor 1-alpha (109-118)
MIYISDNVNK

SEQ ID NO: 26407 - protein, 11 aa, Artificial Sequence
  Nidogen-1 (1-11)
MLASSSRIRAA

SEQ ID NO: 26408 - protein, 11 aa, Artificial Sequence
  Spectrin beta chain, non-erythrocytic 1 (1424-1434)
MLENQMEVRKK

SEQ ID NO: 26409 - protein, 11 aa, Artificial Sequence
  Prostate tumor-overexpressed gene 1 protein (184-194)
MLFPHISPCEV

SEQ ID NO: 26410 - protein, 9 aa, Artificial Sequence
  Melanoma-associated antigen D2 (305-313)
MLKDIIKEY

SEQ ID NO: 26411 - protein, 11 aa, Artificial Sequence
  DNA-directed RNA polymerases I, II, and III subunit RPABC5 (48-58)
MLLAHVDLIEK

SEQ ID NO: 26412 - protein, 10 aa, Artificial Sequence
  Coatomer subunit gamma-1 (404-413)
MLREEGGFEY

SEQ ID NO: 26413 - protein, 9 aa, Artificial Sequence
  G-protein coupled receptor 143 (175-183)
MLYYPSVSR

SEQ ID NO: 26414 - protein, 18 aa, Artificial Sequence
  G-protein coupled receptor 143 (175-192)
MLYYPSVSRKLLEYIEEI

SEQ ID NO: 26415 - protein, 12 aa, Artificial Sequence
  LIM domain and actin-binding protein 1 (101-112)
MMFEKGEPTQTK

SEQ ID NO: 26416 - protein, 8 aa, Artificial Sequence
  T-complex protein 1 subunit eta (172-179)
MMLDDLLQ

SEQ ID NO: 26417 - protein, 9 aa, Artificial Sequence
  Neuroblast differentiation-associated protein AHNAK (2771-2779)
MPKISMPGF

SEQ ID NO: 26418 - protein, 9 aa, Artificial Sequence
  Neuroblast differentiation-associated protein AHNAK (749-757)
MPKMKMPKF

SEQ ID NO: 26419 - protein, 9 aa, Artificial Sequence
  Neuroblast differentiation-associated protein AHNAK (1382-1390)
MPKVKMPKF

SEQ ID NO: 26420 - protein, 8 aa, Artificial Sequence
  ATP-dependent RNA helicase DDX24 (584-591)
MQYPGRSL

SEQ ID NO: 26421 - protein, 13 aa, Artificial Sequence
  Leucine zipper putative tumor suppressor 1 (179-191)
MSSLPTHSTSSSY

SEQ ID NO: 26422 - protein, 9 aa, Artificial Sequence
  Liprin-alpha-1 (1170-1178)
MSSPSMQPK

SEQ ID NO: 26423 - protein, 11 aa, Artificial Sequence
  Vimentin (1-11)
MSTRSVSSSSY

SEQ ID NO: 26424 - protein, 9 aa, Artificial Sequence
  ADP-ribosylation factor-like protein 5B (133-141)
MTAAEISKY

SEQ ID NO: 26425 - protein, 13 aa, Artificial Sequence
  CD44 antigen (412-424)
MTADETRNLQNVD

SEQ ID NO: 26426 - protein, 9 aa, Artificial Sequence
  RNA-binding protein 14 (266-274)
MTAQAASYR

SEQ ID NO: 26427 - protein, 14 aa, Artificial Sequence
  TBC1 domain family member 7 (1-14)
MTEDSQRNFRSVYY

SEQ ID NO: 26428 - protein, 7 aa, Artificial Sequence
  E3 ubiquitin-protein ligase UBR5 (2723-2729)
MTERQDL

SEQ ID NO: 26429 - protein, 10 aa, Artificial Sequence
  SEC14-like protein 2 (333-342)
MTEVLPNQRY

SEQ ID NO: 26430 - protein, 9 aa, Artificial Sequence
  Cleavage and polyadenylation specificity factor subunit 3 (99-107)
MTHATKAIY

SEQ ID NO: 26431 - protein, 10 aa, Artificial Sequence
  Protein phosphatase 1G (151-160)
MTIEELLTRY

SEQ ID NO: 26432 - protein, 13 aa, Artificial Sequence
  E3 ubiquitin-protein ligase RNF13 (5-17)
MTSLAWDPTTLRY

SEQ ID NO: 26433 - protein, 9 aa, Artificial Sequence
  L-dopachrome tautomerase (30-38)
MTVDSLVNK

SEQ ID NO: 26434 - protein, 17 aa, Artificial Sequence
  2-oxoisovalerate dehydrogenase subunit alpha, mitochondrial (262-278)
MTYRIGHHSTSDDSSAY

SEQ ID NO: 26435 - protein, 10 aa, Artificial Sequence
  Ubiquitin carboxyl-terminal hydrolase 11 (498-507)
MVADVFSHRF

SEQ ID NO: 26436 - protein, 10 aa, Artificial Sequence
  DnaJ homolog subfamily C member 3 (1-10)
MVAPGSVTSR

SEQ ID NO: 26437 - protein, 14 aa, Artificial Sequence
  Proteasome subunit beta type-4 (84-97)
MVIDEELLGDGHSY

SEQ ID NO: 26438 - protein, 8 aa, Artificial Sequence
  Adenylate kinase 9 (1518-1525)
MVIFELSV

SEQ ID NO: 26439 - protein, 11 aa, Artificial Sequence
  Zinc transporter ZIP6 (217-227)
MVIMGDGLHNF

SEQ ID NO: 26440 - protein, 9 aa, Artificial Sequence
  Vigilin (427-435)
MVKDLINRM

SEQ ID NO: 26441 - protein, 9 aa, Artificial Sequence
  Helicase with zinc finger domain 2 (1524-1532)
MVKEYMIQF

SEQ ID NO: 26442 - protein, 9 aa, Artificial Sequence
  Major centromere autoantigen B (13-21)
MVKRYLTSF

SEQ ID NO: 26443 - protein, 17 aa, Artificial Sequence
  ATP synthase subunit e, mitochondrial (1-17)
MVPPVQVSPLIKLGRYS

SEQ ID NO: 26444 - protein, 10 aa, Artificial Sequence
  UV excision repair protein RAD23 homolog B (172-181)
MVTEIMSMGY

SEQ ID NO: 26445 - protein, 10 aa, Artificial Sequence
  NGFI-A-binding protein 2 (244-253)
MVVESVERIF

SEQ ID NO: 26446 - protein, 13 aa, Artificial Sequence
  Peptidase inhibitor 15 (91-103)
MVWDENLAKSAEA

SEQ ID NO: 26447 - protein, 9 aa, Artificial Sequence
  AT-rich interactive domain-containing protein 2 (84-92)
NAAFALKQY

SEQ ID NO: 26448 - protein, 9 aa, Artificial Sequence
  Sphingomyelin phosphodiesterase 4 (248-256)
NADPASHEI

SEQ ID NO: 26449 - protein, 8 aa, Artificial Sequence
  60S ribosomal protein L17 (97-104)
NAESNAEL

SEQ ID NO: 26450 - protein, 9 aa, Artificial Sequence
  Ethylmalonyl-CoA decarboxylase (70-78)
NAFSGVMML

SEQ ID NO: 26451 - protein, 15 aa, Artificial Sequence
  Syndecan-3 (291-305)
NAIDSGSSAAQLPQK

SEQ ID NO: 26452 - protein, 9 aa, Artificial Sequence
  Importin subunit alpha-5 (231-239)
NAVWALSNL

SEQ ID NO: 26453 - protein, 10 aa, Artificial Sequence
  EGF domain-specific O-linked N-acetylglucosamine transferase (20-29)
NEAPPNTHSI

SEQ ID NO: 26454 - protein, 9 aa, Artificial Sequence
  Coatomer subunit beta (113-121)
NEFIRGSTL

SEQ ID NO: 26455 - protein, 11 aa, Artificial Sequence
  Prefoldin subunit 2 (68-78)
NEFREKHNIRL

SEQ ID NO: 26456 - protein, 9 aa, Artificial Sequence
  GCN1 general control of amino-acid synthesis 1-like 1 (1511-1519)
NEFVRDTAL

SEQ ID NO: 26457 - protein, 10 aa, Artificial Sequence
  Dynamin-like 120 kDa protein, mitochondrial (618-627)
NEILDEVISL

SEQ ID NO: 26458 - protein, 9 aa, Artificial Sequence
  Vimentin (102-110)
NEKVELQEL

SEQ ID NO: 26459 - protein, 12 aa, Artificial Sequence
  Keratin, type I cytoskeletal 10 (90-101)
NHEEEMKDLRNV

SEQ ID NO: 26460 - protein, 12 aa, Artificial Sequence
  Calponin-3 (250-261)
NKVASQKGMSVY

SEQ ID NO: 26461 - protein, 11 aa, Artificial Sequence
  Guanine nucleotide-binding protein-like 3-like protein (343-353)
NLEEISNYYGV

SEQ ID NO: 26462 - protein, 11 aa, Artificial Sequence
  Peroxisomal acyl-coenzyme A oxidase 1 (631-641)
NLFEWAKNSPL

SEQ ID NO: 26463 - protein, 9 aa, Artificial Sequence
  Galectin-1 (33-41)
NLGKDSNNL

SEQ ID NO: 26464 - protein, 11 aa, Artificial Sequence
  Glycogenin-2 (64-74)
NLIDSADYIHL

SEQ ID NO: 26465 - protein, 12 aa, Artificial Sequence
  Putative ATP-dependent RNA helicase DDX11-like protein 8 (397-408)
NLIDTITGMHSV

SEQ ID NO: 26466 - protein, 9 aa, Artificial Sequence
  Glutathione S-transferase Mu 2 (180-188)
NLKDFISRF

SEQ ID NO: 26467 - protein, 9 aa, Artificial Sequence
  SAM and SH3 domain-containing protein 1 (646-654)
NLKEHMPTF

SEQ ID NO: 26468 - protein, 9 aa, Artificial Sequence
  Abelson tyrosine-protein kinase 2 (353-361)
NLLDYLREC

SEQ ID NO: 26469 - protein, 13 aa, Artificial Sequence
  Multidrug resistance-associated protein 7 (339-351)
NLLGTDSERLLNF

SEQ ID NO: 26470 - protein, 10 aa, Artificial Sequence
  Catenin alpha-1 (815-824)
NLMNAVVQTV

SEQ ID NO: 26471 - protein, 11 aa, Artificial Sequence
  Small glutamine-rich tetratricopeptide repeat-containing protein alpha (236-246)
NLMNNPQIQQL

SEQ ID NO: 26472 - protein, 8 aa, Artificial Sequence
  Leucine-rich repeat-containing protein 4C (125-132)
NLNTLELF

SEQ ID NO: 26473 - protein, 9 aa, Artificial Sequence
  N-terminal Xaa-Pro-Lys N-methyltransferase 1 (210-218)
NLPDEIYHV

SEQ ID NO: 26474 - protein, 10 aa, Artificial Sequence
  N-terminal Xaa-Pro-Lys N-methyltransferase 1 (210-219)
NLPDEIYHVY

SEQ ID NO: 26475 - protein, 9 aa, Artificial Sequence
  DNA repair protein RAD51 homolog 3 (205-213)
NLRDLEILL

SEQ ID NO: 26476 - protein, 9 aa, Artificial Sequence
  MIT domain-containing protein 1 (60-68)
NLREKISKY

SEQ ID NO: 26477 - protein, 9 aa, Artificial Sequence
  Negative regulator of reactive oxygen species (622-630)
NLSSKIIRV

SEQ ID NO: 26478 - protein, 11 aa, Artificial Sequence
  Galectin-3-binding protein (51-61)
NLWDLTDASVV

SEQ ID NO: 26479 - protein, 9 aa, Artificial Sequence
  2'-5'-oligoadenylate synthase 3 (990-998)
NMAEGFRTV

SEQ ID NO: 26480 - protein, 9 aa, Artificial Sequence
  X-ray repair cross-complementing protein 5 (410-418)
NMLNPPAEV

SEQ ID NO: 26481 - protein, 9 aa, Artificial Sequence
  Heterogeneous nuclear ribonucleoprotein H (351-359)
NMQHRYVEL

SEQ ID NO: 26482 - protein, 9 aa, Artificial Sequence
  Monocarboxylate transporter 7 (86-94)
NRFGHRLVV

SEQ ID NO: 26483 - protein, 9 aa, Artificial Sequence
  Leucine-rich repeat-containing protein C10orf11 (190-198)
NRFIRDDQL

SEQ ID NO: 26484 - protein, 8 aa, Artificial Sequence
  Proteasome subunit beta type-4 (230-237)
NRFQIATV

SEQ ID NO: 26485 - protein, 9 aa, Artificial Sequence
  Vacuolar protein sorting-associated protein 16 homolog (30-38)
NRGDFFMTL

SEQ ID NO: 26486 - protein, 9 aa, Artificial Sequence
  Transcription factor MafF (38-46)
NRHLRGLSA

SEQ ID NO: 26487 - protein, 9 aa, Artificial Sequence
  RNA polymerase-associated protein RTF1 homolog (202-210)
NRIEKREVL

SEQ ID NO: 26488 - protein, 8 aa, Artificial Sequence
  Catenin beta-1 (586-593)
NRIVIRGL

SEQ ID NO: 26489 - protein, 9 aa, Artificial Sequence
  Zinc finger and BTB domain-containing protein 38 (384-392)
NRLDRHEQI

SEQ ID NO: 26490 - protein, 9 aa, Artificial Sequence
  40S ribosomal protein S24 (15-23)
NRLLQRKQM

SEQ ID NO: 26491 - protein, 8 aa, Artificial Sequence
  Cytoplasmic FMR1-interacting protein 1 (839-846)
NRMTHKLL

SEQ ID NO: 26492 - protein, 9 aa, Artificial Sequence
  Transcription initiation factor IIA subunit 2 (54-62)
NRVNFRGSL

SEQ ID NO: 26493 - protein, 9 aa, Artificial Sequence
  Pseudouridine-5'-phosphatase (35-43)
NRYDKKYSW

SEQ ID NO: 26494 - protein, 13 aa, Artificial Sequence
  Ribonucleoside-diphosphate reductase large subunit (35-47)
NSAIIYDRDFSYN

SEQ ID NO: 26495 - protein, 9 aa, Artificial Sequence
  Rho-related BTB domain-containing protein 3 (241-249)
NSDLNNLLF

SEQ ID NO: 26496 - protein, 12 aa, Artificial Sequence
  SAM and SH3 domain-containing protein 1 (424-435)
NSDPMGKEGDFV

SEQ ID NO: 26497 - protein, 13 aa, Artificial Sequence
  SAM and SH3 domain-containing protein 1 (424-436)
NSDPMGKEGDFVY

SEQ ID NO: 26498 - protein, 10 aa, Artificial Sequence
  Schlafen family member 5 (601-610)
NSDRKAQSVY

SEQ ID NO: 26499 - protein, 11 aa, Artificial Sequence
  RELT-like protein 1 (113-123)
NSDTVGQIVHY

SEQ ID NO: 26500 - protein, 11 aa, Artificial Sequence
  Peptidyl-prolyl cis-trans isomerase FKBP9 (143-153)
NSEDQVQIHTY

SEQ ID NO: 26501 - protein, 11 aa, Artificial Sequence
  Zinc finger protein 583 (85-95)
NSEFSSKQETY

SEQ ID NO: 26502 - protein, 7 aa, Artificial Sequence
  Thymidylate synthase (205-211)
NSELSCQ

SEQ ID NO: 26503 - protein, 9 aa, Artificial Sequence
  Zinc finger protein 280D (611-619)
NTALRNLRY

SEQ ID NO: 26504 - protein, 9 aa, Artificial Sequence
  DNA-directed RNA polymerase III subunit RPC10 (26-34)
NTCPYVHNI

SEQ ID NO: 26505 - protein, 11 aa, Artificial Sequence
  Heterogeneous nuclear ribonucleoprotein L-like (153-163)
NTDDPSGGNKV

SEQ ID NO: 26506 - protein, 10 aa, Artificial Sequence
  Ubiquitin-like protein 5 (19-28)
NTDDTIGDLK

SEQ ID NO: 26507 - protein, 9 aa, Artificial Sequence
  Lysosomal-trafficking regulator (2269-2277)
NTDDWENFA

SEQ ID NO: 26508 - protein, 9 aa, Artificial Sequence
  Serine/threonine-protein kinase 4 (95-103)
NTDLWIVME

SEQ ID NO: 26509 - protein, 18 aa, Artificial Sequence
  Selenoprotein O (185-202)
NTDNMSILGLTIDYGPFG

SEQ ID NO: 26510 - protein, 10 aa, Artificial Sequence
  DNA-binding protein inhibitor ID-4 (141-150)
NTDPAGAVNK

SEQ ID NO: 26511 - protein, 10 aa, Artificial Sequence
  ADP-ribosylation factor-binding protein GGA2 (54-63)
NTDPNGPTHA

SEQ ID NO: 26512 - protein, 9 aa, Artificial Sequence
  Phenylalanine-tRNA ligase beta subunit (486-494)
NTDVGAKNY

SEQ ID NO: 26513 - protein, 9 aa, Artificial Sequence
  Fructose-bisphosphate aldolase A (51-59)
NTEENRRFY

SEQ ID NO: 26514 - protein, 9 aa, Artificial Sequence
  Fructose-bisphosphate aldolase C (85-93)
NTEENRRLY

SEQ ID NO: 26515 - protein, 11 aa, Artificial Sequence
  Dynamin-1 (590-600)
NTEQRNVYKDY

SEQ ID NO: 26516 - protein, 9 aa, Artificial Sequence
  Neuron navigator 2 (838-846)
NTESGRYVY

SEQ ID NO: 26517 - protein, 9 aa, Artificial Sequence
  WW domain-binding protein 2 (24-32)
NTESILMSY

SEQ ID NO: 26518 - protein, 11 aa, Artificial Sequence
  Short/branched chain specific acyl-CoA dehydrogenase, mitochondrial (422-432)
NTIAKHIDAEY

SEQ ID NO: 26519 - protein, 12 aa, Artificial Sequence
  Mothers against decapentaplegic homolog 2 (91-102)
NTIDQWDTTGLY

SEQ ID NO: 26520 - protein, 12 aa, Artificial Sequence
  CDK5 and ABL1 enzyme substrate 1 (7-18)
NTIDSTSSFSQF

SEQ ID NO: 26521 - protein, 9 aa, Artificial Sequence
  H(+)/Cl(-) exchange transporter 5 (18-26)
NTIDWVREK

SEQ ID NO: 26522 - protein, 9 aa, Artificial Sequence
  Coiled-coil domain-containing protein 93 (523-531)
NTLDDKKVY

SEQ ID NO: 26523 - protein, 9 aa, Artificial Sequence
  COP9 signalosome complex subunit 6 (300-308)
NTMNQFVNK

SEQ ID NO: 26524 - protein, 9 aa, Artificial Sequence
  Protein FAM50A (156-164)
NTMQQFLQK

SEQ ID NO: 26525 - protein, 9 aa, Artificial Sequence
  26S proteasome non-ATPase regulatory subunit 8 (201-209)
NTPKKMTDY

SEQ ID NO: 26526 - protein, 9 aa, Artificial Sequence
  G-protein coupled receptor 98 (3795-3803)
NTTTLQLQI

SEQ ID NO: 26527 - protein, 10 aa, Artificial Sequence
  Calsyntenin-1 (464-473)
NVEFPSVTLY

SEQ ID NO: 26528 - protein, 12 aa, Artificial Sequence
  39S ribosomal protein L2, mitochondrial (195-206)
NVESEPGRGAQY

SEQ ID NO: 26529 - protein, 11 aa, Artificial Sequence
  Geranylgeranyl transferase type-2 subunit beta (112-122)
NVIDVNKVVEY

SEQ ID NO: 26530 - protein, 11 aa, Artificial Sequence
  Zinc finger protein 638 (207-217)
NVIDYGHASKY

SEQ ID NO: 26531 - protein, 10 aa, Artificial Sequence
  Neuropathy target esterase (1252-1261)
NVIEKMLTDR

SEQ ID NO: 26532 - protein, 10 aa, Artificial Sequence
  Protein MMS22-like (799-808)
NVIEQYIGRF

SEQ ID NO: 26533 - protein, 9 aa, Artificial Sequence
  Syndetin (606-614)
NVIRLVGKY

SEQ ID NO: 26534 - protein, 9 aa, Artificial Sequence
  tRNA (guanine(37)-N1)-methyltransferase (163-171)
NVSPQISKY

SEQ ID NO: 26535 - protein, 11 aa, Artificial Sequence
  Probable crossover junction endonuclease EME2 (356-366)
PDLSRRICLFL

SEQ ID NO: 26536 - protein, 11 aa, Artificial Sequence
  Neuronal acetylcholine receptor subunit alpha-3 (433-443)
PEIKEAIQSVK

SEQ ID NO: 26537 - protein, 9 aa, Artificial Sequence
  Ribosomal L1 domain-containing protein 1 (244-252)
PEKWESVKL

SEQ ID NO: 26538 - protein, 9 aa, Artificial Sequence
  Galectin-3 (191-199)
PFESGKPFK

SEQ ID NO: 26539 - protein, 11 aa, Artificial Sequence
  40S ribosomal protein S19 (2-12)
PGVTVKDVNQQ

SEQ ID NO: 26540 - protein, 8 aa, Artificial Sequence
  Carbohydrate sulfotransferase 5 (259-266)
PHLRLIRE

SEQ ID NO: 26541 - protein, 10 aa, Artificial Sequence
  Myosin regulatory light chain 12A (152-161)
PIDKKGNFNY

SEQ ID NO: 26542 - protein, 11 aa, Artificial Sequence
  A-kinase anchor protein 11 (107-117)
PLDISSDPLNQ

SEQ ID NO: 26543 - protein, 9 aa, Artificial Sequence
  SYTL2 protein (325-333)
PLRMLLIAK

SEQ ID NO: 26544 - protein, 11 aa, Artificial Sequence
  Titin (13404-13414)
PPVEEREIEKY

SEQ ID NO: 26545 - protein, 9 aa, Artificial Sequence
  Translation initiation factor eIF-2B subunit delta (205-213)
PQYSRQNSL

SEQ ID NO: 26546 - protein, 9 aa, Artificial Sequence
  Ubiquitin-associated protein 2-like (957-965)
PSGYGSHGY

SEQ ID NO: 26547 - protein, 12 aa, Artificial Sequence
  Enhancer of filamentation 1 (121-132)
PTGHGTQEQEVY

SEQ ID NO: 26548 - protein, 12 aa, Artificial Sequence
  Phosphatidylethanolamine-binding protein 1 (2-13)
PVDLSKWSGPLS

SEQ ID NO: 26549 - protein, 9 aa, Artificial Sequence
  DNA ligase 3 (547-555)
QAFPGGHSM

SEQ ID NO: 26550 - protein, 9 aa, Artificial Sequence
  E3 ubiquitin-protein ligase BRE1B (135-143)
QAGPINREM

SEQ ID NO: 26551 - protein, 9 aa, Artificial Sequence
  Tyrosine-protein phosphatase non-receptor type 20 (25-33)
QALSPLLSV

SEQ ID NO: 26552 - protein, 9 aa, Artificial Sequence
  Importin subunit beta-1 (408-416)
QAMPTLIEL

SEQ ID NO: 26553 - protein, 10 aa, Artificial Sequence
  UBX domain-containing protein 6 (85-94)
QEDPEEFYVL

SEQ ID NO: 26554 - protein, 8 aa, Artificial Sequence
  Spectrin beta chain, non-erythrocytic 5 (1672-1679)
QEELAIYW

SEQ ID NO: 26555 - protein, 13 aa, Artificial Sequence
  Growth/differentiation factor 15 (4-16)
QELRTVNGSQMLL

SEQ ID NO: 26556 - protein, 10 aa, Artificial Sequence
  Ethanolamine kinase 1 (326-335)
QFIDYEYSGY

SEQ ID NO: 26557 - protein, 10 aa, Artificial Sequence
  Leucine-rich repeat-containing protein 15 (122-131)
QGLDSLESLL

SEQ ID NO: 26558 - protein, 10 aa, Artificial Sequence
  Methyltransferase-like protein 25 (467-476)
QGLPTESLFY

SEQ ID NO: 26559 - protein, 9 aa, Artificial Sequence
  Nuclear migration protein nudC (20-28)
QHEGGVQEL

SEQ ID NO: 26560 - protein, 9 aa, Artificial Sequence
  Threonine-tRNA ligase, cytoplasmic (535-543)
QIKDAIGRY

SEQ ID NO: 26561 - protein, 9 aa, Artificial Sequence
  Cytoplasmic dynein 1 heavy chain 1 (2212-2220)
QITQINHGL

SEQ ID NO: 26562 - protein, 12 aa, Artificial Sequence
  Importin-8 (185-196)
QIVQLLPDSSYY

SEQ ID NO: 26563 - protein, 10 aa, Artificial Sequence
  Histone-lysine N-methyltransferase SUV39H1 (268-277)
QIYDRQGATY

SEQ ID NO: 26564 - protein, 9 aa, Artificial Sequence
  PH and SEC7 domain-containing protein 3 (214-222)
QKDLTALLT

SEQ ID NO: 26565 - protein, 9 aa, Artificial Sequence
  Zinc finger and BTB domain-containing protein 37 (95-103)
QLADIISYL

SEQ ID NO: 26566 - protein, 9 aa, Artificial Sequence
  Protein FAM98B (139-147)
QLDKNSEVY

SEQ ID NO: 26567 - protein, 10 aa, Artificial Sequence
  Calsyntenin-1 (952-961)
QLEWDDSTLS

SEQ ID NO: 26568 - protein, 9 aa, Artificial Sequence
  Poly (ADP-ribose) polymerase 4 (351-359)
QLIRDMVNV

SEQ ID NO: 26569 - protein, 9 aa, Artificial Sequence
  Rap guanine nucleotide exchange factor 6 (270-278)
QLLEFMHQL

SEQ ID NO: 26570 - protein, 9 aa, Artificial Sequence
  Probable dimethyladenosine transferase (249-257)
QLLEKNYRI

SEQ ID NO: 26571 - protein, 11 aa, Artificial Sequence
  26S proteasome non-ATPase regulatory subunit 6 (306-316)
QLLESYRSLTL

SEQ ID NO: 26572 - protein, 9 aa, Artificial Sequence
  Chromosome-associated kinesin KIF4A (982-990)
QLLRENEII

SEQ ID NO: 26573 - protein, 11 aa, Artificial Sequence
  Voltage-gated potassium channel subunit beta-2 (329-339)
QLMENIGAIQV

SEQ ID NO: 26574 - protein, 9 aa, Artificial Sequence
  Chromatin assembly factor 1 subunit B (113-121)
QLNKENWTV

SEQ ID NO: 26575 - protein, 9 aa, Artificial Sequence
  Transcription activator BRG1 (179-187)
QLRAQIMAY

SEQ ID NO: 26576 - protein, 9 aa, Artificial Sequence
  Nuclear factor erythroid 2-related factor 1 (321-329)
QLSEAQLSL

SEQ ID NO: 26577 - protein, 9 aa, Artificial Sequence
  Protein AHNAK2 (5375-5383)
QLWEDSVLT

SEQ ID NO: 26578 - protein, 9 aa, Artificial Sequence
  Alpha-2-macroglobulin receptor-associated protein (61-69)
QLWEKAQRL

SEQ ID NO: 26579 - protein, 9 aa, Artificial Sequence
  Lysine-specific histone demethylase 1A (239-247)
QLWLDNPKI

SEQ ID NO: 26580 - protein, 10 aa, Artificial Sequence
  YrdC domain-containing protein, mitochondrial (184-193)
QMFEGPLALT

SEQ ID NO: 26581 - protein, 9 aa, Artificial Sequence
  U3 small nucleolar RNA-associated protein 14 homolog A (505-513)
QMIDLQNLL

SEQ ID NO: 26582 - protein, 9 aa, Artificial Sequence
  Sodium/myo-inositol cotransporter (686-694)
QMLEETRQV

SEQ ID NO: 26583 - protein, 11 aa, Artificial Sequence
  Neuroblastoma-amplified sequence (2232-2242)
QMLPAEGVKEL

SEQ ID NO: 26584 - protein, 9 aa, Artificial Sequence
  Vimentin (343-351)
QMREMEENF

SEQ ID NO: 26585 - protein, 9 aa, Artificial Sequence
  Transmembrane emp24 domain-containing protein 4 (59-67)
QMWDKQKEV

SEQ ID NO: 26586 - protein, 9 aa, Artificial Sequence
  G protein-coupled receptor SNSR1 (285-293)
QNLKLVLQK

SEQ ID NO: 26587 - protein, 9 aa, Artificial Sequence
  DNA-directed RNA polymerase I subunit RPA2 (30-38)
QQKAALQEL

SEQ ID NO: 26588 - protein, 9 aa, Artificial Sequence
  Histone-lysine N-methyltransferase 2C (1225-1233)
QQQQQQQQF

SEQ ID NO: 26589 - protein, 9 aa, Artificial Sequence
  Synaptosomal-associated protein 29 (42-50)
QQYLRQEVL

SEQ ID NO: 26590 - protein, 12 aa, Artificial Sequence
  Vimentin (195-206)
QREEAENTLQSF

SEQ ID NO: 26591 - protein, 9 aa, Artificial Sequence
  Very long-chain specific acyl-CoA dehydrogenase, mitochondrial (600-608)
QSDPWQQEL

SEQ ID NO: 26592 - protein, 10 aa, Artificial Sequence
  Neuropilin-2 (690-699)
QSDSQREGQY

SEQ ID NO: 26593 - protein, 9 aa, Artificial Sequence
  Kelch-like protein 42 (26-34)
QSDYFRALY

SEQ ID NO: 26594 - protein, 11 aa, Artificial Sequence
  HLA class I histocompatibility antigen, B-8 alpha chain (111-121)
QSEAGSHTLQS

SEQ ID NO: 26595 - protein, 13 aa, Artificial Sequence
  HLA class I histocompatibility antigen, A-66 alpha chain (86-98)
QSEDGSHTIQRMY

SEQ ID NO: 26596 - protein, 14 aa, Artificial Sequence
  Cold-inducible RNA-binding protein (147-160)
QSGGYSDRSSGGSY

SEQ ID NO: 26597 - protein, 13 aa, Artificial Sequence
  Caprin-1 (653-665)
QSQFSAPRDYSGY

SEQ ID NO: 26598 - protein, 10 aa, Artificial Sequence
  Zinc finger and BTB domain-containing protein 17 (685-694)
QTDADFYQQY

SEQ ID NO: 26599 - protein, 9 aa, Artificial Sequence
  RNA polymerase-associated protein CTR9 homolog (424-432)
QTDIQGALS

SEQ ID NO: 26600 - protein, 10 aa, Artificial Sequence
  Glia-derived nexin (301-310)
QTDLKEPLKV

SEQ ID NO: 26601 - protein, 11 aa, Artificial Sequence
  Calreticulin (119-129)
QTDMHGDSEYN

SEQ ID NO: 26602 - protein, 9 aa, Artificial Sequence
  Intraflagellar transport protein 172 homolog (85-93)
QTDNIIYVY

SEQ ID NO: 26603 - protein, 10 aa, Artificial Sequence
  Putative E3 ubiquitin-protein ligase UNKL (18-27)
QTEKPTHYRY

SEQ ID NO: 26604 - protein, 10 aa, Artificial Sequence
  Zinc finger protein 217 (667-676)
QTETAADCRY

SEQ ID NO: 26605 - protein, 9 aa, Artificial Sequence
  Interleukin-13 receptor subunit alpha-1 (268-276)
QTETHNVFY

SEQ ID NO: 26606 - protein, 9 aa, Artificial Sequence
  Centrosomal protein of 295 kDa (745-753)
QTETQQRDY

SEQ ID NO: 26607 - protein, 9 aa, Artificial Sequence
  Basic leucine zipper and W2 domain-containing protein 1 (165-173)
QTIGARKEL

SEQ ID NO: 26608 - protein, 9 aa, Artificial Sequence
  Ubiquitin carboxyl-terminal hydrolase 32 (111-119)
QTIKEIHEY

SEQ ID NO: 26609 - protein, 10 aa, Artificial Sequence
  Zinc fingers and homeoboxes protein 3 (607-616)
QTPDFTPTKY

SEQ ID NO: 26610 - protein, 11 aa, Artificial Sequence
  Glycerol-3-phosphate dehydrogenase 1-like protein (226-236)
QTSAEVYRILK

SEQ ID NO: 26611 - protein, 9 aa, Artificial Sequence
  Probable ATP-dependent RNA helicase DDX47 (228-236)
QTVEKLQQY

SEQ ID NO: 26612 - protein, 10 aa, Artificial Sequence
  WD repeat-containing protein 62 (147-156)
QVAEMLGHKY

SEQ ID NO: 26613 - protein, 10 aa, Artificial Sequence
  Ran GTPase-activating protein 1 (17-26)
QVAGGQLSFK

SEQ ID NO: 26614 - protein, 9 aa, Artificial Sequence
  Pre-mRNA-processing factor 19 (209-217)
QVASHVGLH

SEQ ID NO: 26615 - protein, 11 aa, Artificial Sequence
  Rootletin (1601-1611)
QVATLERSLQA

SEQ ID NO: 26616 - protein, 12 aa, Artificial Sequence
  Tripartite motif-containing protein 2 (694-705)
QVFDGSGSFLSY

SEQ ID NO: 26617 - protein, 10 aa, Artificial Sequence
  Basic leucine zipper and W2 domain-containing protein 2 (113-122)
QVFNKLIRRY

SEQ ID NO: 26618 - protein, 10 aa, Artificial Sequence
  Sec1 family domain-containing protein 2 (210-219)
QVIAADLANY

SEQ ID NO: 26619 - protein, 11 aa, Artificial Sequence
  Putative Polycomb group protein ASXL1 (36-46)
QVIEAEGLKEM

SEQ ID NO: 26620 - protein, 11 aa, Artificial Sequence
  SURP and G-patch domain-containing protein 2 (69-79)
QVIGHRKLGHF

SEQ ID NO: 26621 - protein, 9 aa, Artificial Sequence
  Vimentin (453-461)
QVINETSQH

SEQ ID NO: 26622 - protein, 10 aa, Artificial Sequence
  Vimentin (453-462)
QVINETSQHH

SEQ ID NO: 26623 - protein, 12 aa, Artificial Sequence
  Vimentin (453-464)
QVINETSQHHDD

SEQ ID NO: 26624 - protein, 9 aa, Artificial Sequence
  Splicing factor U2AF 65 kDa subunit (274-282)
QVKELLTSF

SEQ ID NO: 26625 - protein, 9 aa, Artificial Sequence
  Glutathione-specific gamma-glutamylcyclotransferase 1 (98-106)
QVQGEQVSK

SEQ ID NO: 26626 - protein, 10 aa, Artificial Sequence
  tRNA-splicing ligase RtcB homolog (232-241)
QVVDEIFNEY

SEQ ID NO: 26627 - protein, 10 aa, Artificial Sequence
  Xylulose kinase (511-520)
QVYEALLPQY

SEQ ID NO: 26628 - protein, 10 aa, Artificial Sequence
  2'-5'-oligoadenylate synthase 3 (908-917)
QVYVDLIHSY

SEQ ID NO: 26629 - protein, 9 aa, Artificial Sequence
  FERM domain-containing protein 8 (28-36)
RAADVLVYL

SEQ ID NO: 26630 - protein, 9 aa, Artificial Sequence
  Non-canonical poly(A) RNA polymerase PAPD7 (152-160)
RAAEFIKNY

SEQ ID NO: 26631 - protein, 9 aa, Artificial Sequence
  Nuclear export mediator factor NEMF (136-144)
RAAEPLLTL

SEQ ID NO: 26632 - protein, 13 aa, Artificial Sequence
  Non-POU domain-containing octamer-binding protein (367-379)
RAAPGAEFAPNKR

SEQ ID NO: 26633 - protein, 11 aa, Artificial Sequence
  Fatty acid synthase (2275-2285)
RAAPLDSIHSL

SEQ ID NO: 26634 - protein, 10 aa, Artificial Sequence
  Sodium/potassium-transporting ATPase subunit alpha-3 (42-51)
RAAVPDAVGK

SEQ ID NO: 26635 - protein, 9 aa, Artificial Sequence
  Nuclear pore complex protein Nup205 (413-421)
RADEDARMI

SEQ ID NO: 26636 - protein, 9 aa, Artificial Sequence
  Uncharacterized protein KIAA0930 (312-320)
RADGNFLLY

SEQ ID NO: 26637 - protein, 9 aa, Artificial Sequence
  Cytochrome b-c1 complex subunit 9 (34-42)
RAFDQGADA

SEQ ID NO: 26638 - protein, 11 aa, Artificial Sequence
  E3 ubiquitin-protein ligase DTX3L (679-689)
RAFDQKLIFTV

SEQ ID NO: 26639 - protein, 9 aa, Artificial Sequence
  Protein transport protein Sec16A (1122-1130)
RAFPGPLAK

SEQ ID NO: 26640 - protein, 10 aa, Artificial Sequence
  Protein ECT2 (107-116)
RAFSFSKTPK

SEQ ID NO: 26641 - protein, 9 aa, Artificial Sequence
  Rho GTPase-activating protein 11B (16-24)
RAFYGIKVK

SEQ ID NO: 26642 - protein, 11 aa, Artificial Sequence
  Glutaminyl-peptide cyclotransferase (172-182)
RALDKKLLSLK

SEQ ID NO: 26643 - protein, 9 aa, Artificial Sequence
  Clathrin heavy chain 1 (625-633)
RALEHFTDL

SEQ ID NO: 26644 - protein, 9 aa, Artificial Sequence
  Guanine nucleotide exchange factor DBS (926-934)
RALEQSQSL

SEQ ID NO: 26645 - protein, 9 aa, Artificial Sequence
  ALX homeobox protein 1 (94-102)
RAMDNCNSL

SEQ ID NO: 26646 - protein, 10 aa, Artificial Sequence
  Inositol hexakisphosphate kinase 2 (6-15)
RAMDVEPRAK

SEQ ID NO: 26647 - protein, 9 aa, Artificial Sequence
  Hsp70-binding protein 1 (283-291)
RAMQQQVQK

SEQ ID NO: 26648 - protein, 9 aa, Artificial Sequence
  Ankyrin-2 (388-396)
RANPNARAL

SEQ ID NO: 26649 - protein, 13 aa, Artificial Sequence
  N-terminal kinase-like protein (673-685)
RASQSPTGAAGKL

SEQ ID NO: 26650 - protein, 9 aa, Artificial Sequence
  Retinoic acid receptor alpha (15-23)
RATSSTQSL

SEQ ID NO: 26651 - protein, 9 aa, Artificial Sequence
  Coiled-coil domain-containing protein 124 (215-223)
RAVPFNAPK

SEQ ID NO: 26652 - protein, 9 aa, Artificial Sequence
  Eukaryotic peptide chain release factor GTP-binding subunit ERF3A (143-151)
RAYFETEKK

SEQ ID NO: 26653 - protein, 10 aa, Artificial Sequence
  CCR4-NOT transcription complex subunit 1 (1694-1703)
RAYGSPWCNK

SEQ ID NO: 26654 - protein, 9 aa, Artificial Sequence
  E3 ubiquitin-protein ligase UBR5 (1124-1132)
RAYPAAITI

SEQ ID NO: 26655 - protein, 10 aa, Artificial Sequence
  SWI/SNF-related matrix-associated actin-dependent regulator of chromatin subfamily E member 1-related (135-144)
RAYQQSEAYK

SEQ ID NO: 26656 - protein, 9 aa, Artificial Sequence
  Hermansky-Pudlak syndrome 3 protein (89-97)
RAYVNWRNK

SEQ ID NO: 26657 - protein, 9 aa, Artificial Sequence
  60S ribosomal protein L37 (21-29)
RCGSKAYHL

SEQ ID NO: 26658 - protein, 14 aa, Artificial Sequence
  PEST proteolytic signal-containing nuclear protein (112-125)
RDTPTSAGPNSFNK

SEQ ID NO: 26659 - protein, 10 aa, Artificial Sequence
  Nuclear mitotic apparatus protein 1 (76-85)
REAEQMGNEL

SEQ ID NO: 26660 - protein, 10 aa, Artificial Sequence
  Melanotransferrin (44-53)
REAGIQPSLL

SEQ ID NO: 26661 - protein, 10 aa, Artificial Sequence
  Kinesin-like protein (353-362)
REAGNINQSL

SEQ ID NO: 26662 - protein, 9 aa, Artificial Sequence
  Vacuolar protein sorting-associated protein 72 homolog (174-182)
REAKITEEL

SEQ ID NO: 26663 - protein, 9 aa, Artificial Sequence
  Src substrate cortactin (417-425)
REASSQQGL

SEQ ID NO: 26664 - protein, 11 aa, Artificial Sequence
  Cullin-4B (258-268)
REDSLDSVLFL

SEQ ID NO: 26665 - protein, 10 aa, Artificial Sequence
  Beta-citrylglutamate synthase B (18-27)
REDYPQKEIL

SEQ ID NO: 26666 - protein, 10 aa, Artificial Sequence
  RE1-silencing transcription factor (872-881)
REEASGDQKL

SEQ ID NO: 26667 - protein, 12 aa, Artificial Sequence
  39S ribosomal protein L37, mitochondrial (242-253)
REEIEATKNHVL

SEQ ID NO: 26668 - protein, 9 aa, Artificial Sequence
  ATP-dependent RNA helicase DHX36 (91-99)
REEQIVQLL

SEQ ID NO: 26669 - protein, 9 aa, Artificial Sequence
  60S ribosomal protein L3-like (69-77)
REEVEAVTI

SEQ ID NO: 26670 - protein, 10 aa, Artificial Sequence
  Colorectal mutant cancer protein (584-593)
REFEVETERL

SEQ ID NO: 26671 - protein, 11 aa, Artificial Sequence
  Proteasome subunit alpha type-7 (169-179)
REFLEKNYTDE

SEQ ID NO: 26672 - protein, 9 aa, Artificial Sequence
  TBC1 domain family member 16 (242-250)
REFPEAEAL

SEQ ID NO: 26673 - protein, 9 aa, Artificial Sequence
  Leucine-rich repeat and calponin homology domain-containing protein 3 (427-435)
REFQKTEDM

SEQ ID NO: 26674 - protein, 9 aa, Artificial Sequence
  5,6-dihydroxyindole-2-carboxylic acid oxidase (471-479)
REFSVPEII

SEQ ID NO: 26675 - protein, 9 aa, Artificial Sequence
  Rhophilin-2 (553-561)
REGDYIVSI

SEQ ID NO: 26676 - protein, 11 aa, Artificial Sequence
  Contactin-associated protein-like 3B (224-234)
REGQHGNHITL

SEQ ID NO: 26677 - protein, 12 aa, Artificial Sequence
  Colorectal mutant cancer protein (255-266)
REHEDVQERTTL

SEQ ID NO: 26678 - protein, 9 aa, Artificial Sequence
  Protein orai-2 (155-163)
REIEELHKL

SEQ ID NO: 26679 - protein, 9 aa, Artificial Sequence
  Pyridoxal-dependent decarboxylase domain-containing protein 1 (596-604)
REIEENSRL

SEQ ID NO: 26680 - protein, 9 aa, Artificial Sequence
  Zinc finger FYVE domain-containing protein 16 (199-207)
REIGGIKEL

SEQ ID NO: 26681 - protein, 11 aa, Artificial Sequence
  Cathepsin K (225-235)
REIPEGNEKAL

SEQ ID NO: 26682 - protein, 9 aa, Artificial Sequence
  Calcineurin-binding protein cabin-1 (253-261)
REKEPDLKL

SEQ ID NO: 26683 - protein, 9 aa, Artificial Sequence
  B-cell lymphoma 3 protein (77-85)
RELDIYNNL

SEQ ID NO: 26684 - protein, 9 aa, Artificial Sequence
  Serine/threonine-protein kinase Nek9 (195-203)
REMEEKVTL

SEQ ID NO: 26685 - protein, 9 aa, Artificial Sequence
  Vimentin (345-353)
REMEENFAV

SEQ ID NO: 26686 - protein, 9 aa, Artificial Sequence
  Mitogen-activated protein kinase kinase kinase 1 (162-170)
REMENKETL

SEQ ID NO: 26687 - protein, 10 aa, Artificial Sequence
  Protein lin-9 homolog (312-321)
REMNTEAEKL

SEQ ID NO: 26688 - protein, 10 aa, Artificial Sequence
  KN motif and ankyrin repeat domain-containing protein 1 (483-492)
REMTKLKQEL

SEQ ID NO: 26689 - protein, 10 aa, Artificial Sequence
  Sorting nexin-29 (92-101)
RENEVLKVQL

SEQ ID NO: 26690 - protein, 9 aa, Artificial Sequence
  RNA-binding protein 27 (502-510)
RENNEQPTL

SEQ ID NO: 26691 - protein, 11 aa, Artificial Sequence
  N-alpha-acetyltransferase 11 (175-185)
RENQETQGSTL

SEQ ID NO: 26692 - protein, 10 aa, Artificial Sequence
  Heterogeneous nuclear ribonucleoprotein K (171-180)
RENTQTTIKL

SEQ ID NO: 26693 - protein, 11 aa, Artificial Sequence
  Probable ATP-dependent RNA helicase DDX5 (511-521)
RENYDRGYSSL

SEQ ID NO: 26694 - protein, 12 aa, Artificial Sequence
  Probable ATP-dependent RNA helicase DDX5 (511-522)
RENYDRGYSSLL

SEQ ID NO: 26695 - protein, 10 aa, Artificial Sequence
  Hsp70-binding protein 1 (357-366)
REPELGLEEL

SEQ ID NO: 26696 - protein, 10 aa, Artificial Sequence
  Tripartite motif-containing protein 65 (51-60)
REPFPDGAEL

SEQ ID NO: 26697 - protein, 10 aa, Artificial Sequence
  Melanoma-associated antigen 2 (155-164)
REPVTKAEML

SEQ ID NO: 26698 - protein, 9 aa, Artificial Sequence
  FAS-associated factor 1 (349-357)
REQDEAYRL

SEQ ID NO: 26699 - protein, 9 aa, Artificial Sequence
  Intersectin-2 (475-483)
REQEEIVRL

SEQ ID NO: 26700 - protein, 10 aa, Artificial Sequence
  L-dopachrome tautomerase (138-147)
REQFLGALDL

SEQ ID NO: 26701 - protein, 11 aa, Artificial Sequence
  Ras-responsive element-binding protein 1 (361-371)
REQPSEGATEL

SEQ ID NO: 26702 - protein, 9 aa, Artificial Sequence
  Microtubule-actin cross-linking factor 1, isoforms 1/2/3/5 (4309-4317)
REQQLQSTL

SEQ ID NO: 26703 - protein, 9 aa, Artificial Sequence
  V-type proton ATPase subunit D (194-202)
REREEFYRL

SEQ ID NO: 26704 - protein, 9 aa, Artificial Sequence
  Eukaryotic translation initiation factor 4B (372-380)
REREVEERL

SEQ ID NO: 26705 - protein, 11 aa, Artificial Sequence
  Proteasome activator complex subunit 3 (19-29)
RERITSEAEDL

SEQ ID NO: 26706 - protein, 9 aa, Artificial Sequence
  Lysosomal-trafficking regulator (1440-1448)
RESFPHRLL

SEQ ID NO: 26707 - protein, 10 aa, Artificial Sequence
  Cytoplasmic dynein 1 intermediate chain 1 (57-66)
RETEALLQSI

SEQ ID NO: 26708 - protein, 10 aa, Artificial Sequence
  Annexin A5 (227-236)
RETSGNLEQL

SEQ ID NO: 26709 - protein, 11 aa, Artificial Sequence
  Dexamethasone-induced Ras-related protein 1 (153-163)
REVDQREIEQL

SEQ ID NO: 26710 - protein, 13 aa, Artificial Sequence
  Dual specificity protein phosphatase 10 (294-306)
REVGGGASAASSL

SEQ ID NO: 26711 - protein, 11 aa, Artificial Sequence
  Transmembrane channel-like protein 6 (57-67)
REVTGSSQQTL

SEQ ID NO: 26712 - protein, 10 aa, Artificial Sequence
  Sarcoplasmic/endoplasmic reticulum calcium ATPase 2 (549-558)
REWGSGSDTL

SEQ ID NO: 26713 - protein, 10 aa, Artificial Sequence
  GPN-loop GTPase 1 (251-260)
REYRPEYERL

SEQ ID NO: 26714 - protein, 9 aa, Artificial Sequence
  Rab-like protein 3 (198-206)
RFFDKVIEK

SEQ ID NO: 26715 - protein, 10 aa, Artificial Sequence
  DNA mismatch repair protein Msh3 (26-35)
RFFQSTGSLK

SEQ ID NO: 26716 - protein, 18 aa, Artificial Sequence
  Transgelin-2 (182-199)
RGASQAGMTGYGMPRQIL

SEQ ID NO: 26717 - protein, 11 aa, Artificial Sequence
  F-box/LRR-repeat protein 4 (358-368)
RGFISVAGFSR

SEQ ID NO: 26718 - protein, 11 aa, Artificial Sequence
  Isocitrate dehydrogenase (NAD) subunit alpha, mitochondrial (25-35)
RGFTGGINFAK

SEQ ID NO: 26719 - protein, 9 aa, Artificial Sequence
  POM121 and ZP3 fusion protein (9-17)
RIAPPDRRF

SEQ ID NO: 26720 - protein, 11 aa, Artificial Sequence
  Histone H2B type 1-A (74-84)
RIASEASRLAH

SEQ ID NO: 26721 - protein, 9 aa, Artificial Sequence
  Cell division cycle 5-like protein (33-41)
RIASLLHRK

SEQ ID NO: 26722 - protein, 10 aa, Artificial Sequence
  Transmembrane protein 230 (98-107)
RIAYYASKGY

SEQ ID NO: 26723 - protein, 9 aa, Artificial Sequence
  Galectin-3-binding protein (216-224)
RIDITLSSV

SEQ ID NO: 26724 - protein, 9 aa, Artificial Sequence
  Nuclear pore complex protein Nup88 (356-364)
RIDLIPSLY

SEQ ID NO: 26725 - protein, 11 aa, Artificial Sequence
  Dolichyl-diphosphooligosaccharide-proteinosyltransferase 48 kDa subunit (359-369)
RIDPFVRTFLK

SEQ ID NO: 26726 - protein, 11 aa, Artificial Sequence
  78 kDa glucose-regulated protein (540-550)
RIDTRNELESY

SEQ ID NO: 26727 - protein, 9 aa, Artificial Sequence
  Tuftelin-interacting protein 11 (402-410)
RIFETLQDK

SEQ ID NO: 26728 - protein, 9 aa, Artificial Sequence
  DNA-directed RNA polymerase III subunit RPC3 (364-372)
RIFRLVLQK

SEQ ID NO: 26729 - protein, 9 aa, Artificial Sequence
  Serine/threonine-protein phosphatase 2A regulatory subunit B'' subunit beta (354-362)
RIFSGAVTR

SEQ ID NO: 26730 - protein, 13 aa, Artificial Sequence
  Interleukin enhancer-binding factor 3 (5-17)
RIFVNDDRHVMAK

SEQ ID NO: 26731 - protein, 9 aa, Artificial Sequence
  Peroxisome biogenesis factor 10 (83-91)
RIHVPSSLR

SEQ ID NO: 26732 - protein, 9 aa, Artificial Sequence
  A-kinase anchor protein 13 (58-66)
RIIDSKFLK

SEQ ID NO: 26733 - protein, 9 aa, Artificial Sequence
  Oligoribonuclease, mitochondrial (133-141)
RIIDVSTVK

SEQ ID NO: 26734 - protein, 9 aa, Artificial Sequence
  Actin filament-associated protein 1-like 1 (363-371)
RIIGFSKKK

SEQ ID NO: 26735 - protein, 11 aa, Artificial Sequence
  Choline kinase alpha (244-254)
RIKFTEESRIK

SEQ ID NO: 26736 - protein, 9 aa, Artificial Sequence
  Endothelin B receptor (208-216)
RIKGIGVPK

SEQ ID NO: 26737 - protein, 10 aa, Artificial Sequence
  Uncharacterized protein C1orf21 (35-44)
RIKPVEEVKY

SEQ ID NO: 26738 - protein, 9 aa, Artificial Sequence
  Chromodomain-helicase-DNA-binding protein 8 (579-587)
RILDESHSI

SEQ ID NO: 26739 - protein, 10 aa, Artificial Sequence
  SH3 domain-binding glutamic acid-rich-like protein 3 (159-168)
RILDGKRIQY

SEQ ID NO: 26740 - protein, 12 aa, Artificial Sequence
  Ubiquitin conjugation factor E4 B (856-867)
RILDPAYPDITL

SEQ ID NO: 26741 - protein, 9 aa, Artificial Sequence
  Shugoshin-like 2 (1098-1106)
RILDSVQGK

SEQ ID NO: 26742 - protein, 11 aa, Artificial Sequence
  Serine/threonine-protein phosphatase 6 regulatory subunit 3 (385-395)
RILEAWEMNEK

SEQ ID NO: 26743 - protein, 11 aa, Artificial Sequence
  60S ribosomal protein L19 (117-127)
RILMEHIHKLK

SEQ ID NO: 26744 - protein, 11 aa, Artificial Sequence
  Eukaryotic translation initiation factor 3 subunit A (623-633)
RILQEHEQIKK

SEQ ID NO: 26745 - protein, 10 aa, Artificial Sequence
  Pre-mRNA-splicing factor ATP-dependent RNA helicase DHX15 (666-675)
RIMDRFNLPR

SEQ ID NO: 26746 - protein, 11 aa, Artificial Sequence
  Cell differentiation protein RCD1 homolog (169-179)
RIMESGSELSK

SEQ ID NO: 26747 - protein, 11 aa, Artificial Sequence
  Elongation factor 2 (428-438)
RIMGPNYTPGK

SEQ ID NO: 26748 - protein, 11 aa, Artificial Sequence
  Calcineurin binding protein 1, isoform CRA_c (308-318)
RIMSETYMLIK

SEQ ID NO: 26749 - protein, 9 aa, Artificial Sequence
  Synaptonemal complex central element protein 1 (59-67)
RINEVQQAK

SEQ ID NO: 26750 - protein, 10 aa, Artificial Sequence
  Ninein (1240-1249)
RIPEASPKYK

SEQ ID NO: 26751 - protein, 10 aa, Artificial Sequence
  Ribosomal protein 63, mitochondrial (11-20)
RIPGRQWIGK

SEQ ID NO: 26752 - protein, 11 aa, Artificial Sequence
  Cullin-1 (328-338)
RIQDGLGELKK

SEQ ID NO: 26753 - protein, 11 aa, Artificial Sequence
  Malate dehydrogenase, mitochondrial (229-239)
RIQEAGTEVVK

SEQ ID NO: 26754 - protein, 9 aa, Artificial Sequence
  Spectrin beta chain, non-erythrocytic 1 (1245-1253)
RIQEKVDSI

SEQ ID NO: 26755 - protein, 10 aa, Artificial Sequence
  Thyroid adenoma-associated protein (692-701)
RIQESSQVLY

SEQ ID NO: 26756 - protein, 9 aa, Artificial Sequence
  DNA replication licensing factor MCM6 (207-215)
RIQETQAEL

SEQ ID NO: 26757 - protein, 9 aa, Artificial Sequence
  Antigen KI-67 (38-46)
RIQLPVVSK

SEQ ID NO: 26758 - protein, 9 aa, Artificial Sequence
  RNA-binding E3 ubiquitin-protein ligase MEX3C (156-164)
RIQQQTHTY

SEQ ID NO: 26759 - protein, 11 aa, Artificial Sequence
  Tubulin beta chain (18-28)
RISEQFTAMFR

SEQ ID NO: 26760 - protein, 9 aa, Artificial Sequence
  Zinc finger protein 529 (330-338)
RISSQLIEH

SEQ ID NO: 26761 - protein, 9 aa, Artificial Sequence
  Lysine-specific histone demethylase 1B (473-481)
RITDPTIDK

SEQ ID NO: 26762 - protein, 10 aa, Artificial Sequence
  Cleavage stimulation factor subunit 2 (179-188)
RIVDPEIALK

SEQ ID NO: 26763 - protein, 9 aa, Artificial Sequence
  Unconventional myosin-X (239-247)
RIVDYLLEK

SEQ ID NO: 26764 - protein, 9 aa, Artificial Sequence
  CDP-diacylglycerol-glycerol-3-phosphate 3-phosphatidyltransferase, mitochondrial (76-84)
RIWSLQFSR

SEQ ID NO: 26765 - protein, 9 aa, Artificial Sequence
  Dynein heavy chain 6, axonemal (191-199)
RIYAATFEK

SEQ ID NO: 26766 - protein, 10 aa, Artificial Sequence
  DNA-directed RNA polymerase II subunit RPB2 (409-418)
RIYAQKFIDR

SEQ ID NO: 26767 - protein, 9 aa, Artificial Sequence
  U4/U6 small nuclear ribonucleoprotein Prp31 (203-211)
RIYEYVESR

SEQ ID NO: 26768 - protein, 9 aa, Artificial Sequence
  Long-chain-fatty-acid-CoA ligase 4 (339-347)
RIYKNVMSK

SEQ ID NO: 26769 - protein, 9 aa, Artificial Sequence
  28S ribosomal protein S21, mitochondrial (50-58)
RIYNMEMAR

SEQ ID NO: 26770 - protein, 9 aa, Artificial Sequence
  Ankyrin repeat and SOCS box protein 4 (318-326)
RIYPPQFHK

SEQ ID NO: 26771 - protein, 9 aa, Artificial Sequence
  Transformation/transcription domain-associated protein (296-304)
RIYQELVTK

SEQ ID NO: 26772 - protein, 10 aa, Artificial Sequence
  Semaphorin-5A (736-745)
RLADPNLLEV

SEQ ID NO: 26773 - protein, 9 aa, Artificial Sequence
  Long-chain fatty acid transport protein 3 (117-125)
RLAELAQQR

SEQ ID NO: 26774 - protein, 11 aa, Artificial Sequence
  E3 ubiquitin-protein ligase TRIM56 (291-301)
RLAELEGREQV

SEQ ID NO: 26775 - protein, 9 aa, Artificial Sequence
  Catenin beta-1 (124-132)
RLAEPSQML

SEQ ID NO: 26776 - protein, 9 aa, Artificial Sequence
  14-3-3 protein eta (12-20)
RLAEQAERY

SEQ ID NO: 26777 - protein, 9 aa, Artificial Sequence
  Syntaxin-binding protein 1 (171-179)
RLAEQIATL

SEQ ID NO: 26778 - protein, 9 aa, Artificial Sequence
  GPALPP motifs-containing protein 1 (89-97)
RLAEQVSSY

SEQ ID NO: 26779 - protein, 10 aa, Artificial Sequence
  Ubiquitin carboxyl-terminal hydrolase 19 (897-906)
RLAEVIKNRF

SEQ ID NO: 26780 - protein, 11 aa, Artificial Sequence
  Receptor tyrosine-protein kinase erbB-3 (916-926)
RLAEVPDLLEK

SEQ ID NO: 26781 - protein, 11 aa, Artificial Sequence
  Catenin beta-1 (274-284)
RLAGGLQKMVA

SEQ ID NO: 26782 - protein, 9 aa, Artificial Sequence
  Echinoderm microtubule-associated protein-like 3 (815-823)
RLAPRLAGR

SEQ ID NO: 26783 - protein, 9 aa, Artificial Sequence
  Nucleolar protein 56 (212-220)
RLAQFIGNR

SEQ ID NO: 26784 - protein, 9 aa, Artificial Sequence
  Sorting nexin-17 (261-269)
RLAQTLRHY

SEQ ID NO: 26785 - protein, 12 aa, Artificial Sequence
  Microtubule-associated protein 4 (922-933)
RLATNTSAPDLK

SEQ ID NO: 26786 - protein, 9 aa, Artificial Sequence
  P2X purinoceptor 7 (277-285)
RLDDKTTNV

SEQ ID NO: 26787 - protein, 11 aa, Artificial Sequence
  Nuclear RNA export factor 1 (219-229)
RLDDMSSIVQK

SEQ ID NO: 26788 - protein, 10 aa, Artificial Sequence
  Potassium voltage-gated channel subfamily G member 3 (115-124)
RLDDRMSDTY

SEQ ID NO: 26789 - protein, 10 aa, Artificial Sequence
  FERM domain-containing protein 6 (225-234)
RLDDVAVHYY

SEQ ID NO: 26790 - protein, 9 aa, Artificial Sequence
  Dolichyl-diphosphooligosaccharide-proteinosyltransferase subunit 2 (190-198)
RLDELGGVY

SEQ ID NO: 26791 - protein, 9 aa, Artificial Sequence
  Activating signal cointegrator 1 (224-232)
RLDETIQAI

SEQ ID NO: 26792 - protein, 9 aa, Artificial Sequence
  Helicase-like transcription factor (880-888)
RLDGSMAQK

SEQ ID NO: 26793 - protein, 9 aa, Artificial Sequence
  Tubulin alpha-1C chain (355-363)
RLDHKFDLM

SEQ ID NO: 26794 - protein, 9 aa, Artificial Sequence
  Protein kinase C and casein kinase substrate in neurons protein 2 (427-435)
RLDNGQVGL

SEQ ID NO: 26795 - protein, 9 aa, Artificial Sequence
  Coiled-coil domain-containing protein 138 (306-314)
RLDNLQRKY

SEQ ID NO: 26796 - protein, 9 aa, Artificial Sequence
  Melanoma antigen preferentially expressed in tumors (312-320)
RLDQLLRHV

SEQ ID NO: 26797 - protein, 9 aa, Artificial Sequence
  Coiled-coil domain-containing protein 91 (405-413)
RLDQVIRQR

SEQ ID NO: 26798 - protein, 11 aa, Artificial Sequence
  Nicastrin (281-291)
RLDSRSFFWNV

SEQ ID NO: 26799 - protein, 9 aa, Artificial Sequence
  C-Jun-amino-terminal kinase-interacting protein 4 (1097-1105)
RLDSTLRLY

SEQ ID NO: 26800 - protein, 9 aa, Artificial Sequence
  Cyclin-dependent kinase 2 (36-44)
RLDTETEGV

SEQ ID NO: 26801 - protein, 9 aa, Artificial Sequence
  Uncharacterized protein C19orf60 (50-58)
RLEEGHRQY

SEQ ID NO: 26802 - protein, 10 aa, Artificial Sequence
  Cap-specific mRNAucleoside-2'-O-)-methyltransferase 1 (708-717)
RLEEMEKIFV

SEQ ID NO: 26803 - protein, 11 aa, Artificial Sequence
  Pre-mRNA-processing factor 6 (317-327)
RLEEVTGKLQV

SEQ ID NO: 26804 - protein, 10 aa, Artificial Sequence
  Armadillo repeat-containing protein 8 (27-36)
RLFDPDPQKV

SEQ ID NO: 26805 - protein, 10 aa, Artificial Sequence
  Receptor-interacting serine/threonine-protein kinase 4 (198-207)
RLFDTKHDVY

SEQ ID NO: 26806 - protein, 10 aa, Artificial Sequence
  Phosphatidylinositol 4-kinase beta (132-141)
RLFESKLFDI

SEQ ID NO: 26807 - protein, 10 aa, Artificial Sequence
  Cartilage-associated protein (107-116)
RLFGGLLRRA

SEQ ID NO: 26808 - protein, 10 aa, Artificial Sequence
  Synaptonemal complex protein SC65 (104-113)
RLFGRVLERA

SEQ ID NO: 26809 - protein, 12 aa, Artificial Sequence
  Diamine acetyltransferase 1 (155-166)
RLFKIDKEYLLK

SEQ ID NO: 26810 - protein, 11 aa, Artificial Sequence
  Dol-P-Man:Man(5)GlcNAc(2)-PP-Dol alpha-1,3-mannosyltransferase (123-133)
RLFNDPVAMVL

SEQ ID NO: 26811 - protein, 9 aa, Artificial Sequence
  Membralin (58-66)
RLFPPAFRR

SEQ ID NO: 26812 - protein, 9 aa, Artificial Sequence
  DNA primase small subunit (19-27)
RLFPYSQYY

SEQ ID NO: 26813 - protein, 9 aa, Artificial Sequence
  Homeobox protein cut-like 1 (640-648)
RLFQEVPKR

SEQ ID NO: 26814 - protein, 11 aa, Artificial Sequence
  Coatomer subunit gamma-2 (75-85)
RLFQSNDQTLR

SEQ ID NO: 26815 - protein, 9 aa, Artificial Sequence
  28S ribosomal protein S2, mitochondrial (251-259)
RLFQTAITR

SEQ ID NO: 26816 - protein, 9 aa, Artificial Sequence
  Armadillo repeat-containing protein 2 (134-142)
RLFRAASQR

SEQ ID NO: 26817 - protein, 10 aa, Artificial Sequence
  Nicalin (40-49)
RLFSRLYTYK

SEQ ID NO: 26818 - protein, 12 aa, Artificial Sequence
  C-Jun-amino-terminal kinase-interacting protein 4 (548-559)
RLFSSSSNTTKK

SEQ ID NO: 26819 - protein, 10 aa, Artificial Sequence
  40S ribosomal protein S17 (23-32)
RLGNDFHTNK

SEQ ID NO: 26820 - protein, 10 aa, Artificial Sequence
  Thrombospondin-2 (245-254)
RLGPHVTTEY

SEQ ID NO: 26821 - protein, 9 aa, Artificial Sequence
  Ankyrin repeat domain-containing protein 54 (100-108)
RLGPTGKEV

SEQ ID NO: 26822 - protein, 10 aa, Artificial Sequence
  Protein fantom (56-65)
RLHDENILLK

SEQ ID NO: 26823 - protein, 13 aa, Artificial Sequence
  40S ribosomal protein S20 (87-99)
RLIDLHSPSEIVK

SEQ ID NO: 26824 - protein, 11 aa, Artificial Sequence
  28S ribosomal protein S5, mitochondrial (246-256)
RLIGIKDMYAK

SEQ ID NO: 26825 - protein, 9 aa, Artificial Sequence
  Abnormal spindle-like microcephaly-associated protein (521-529)
RLIQTTWRK

SEQ ID NO: 26826 - protein, 9 aa, Artificial Sequence
  Calcineurin-binding protein cabin-1 (136-144)
RLIRIPLAR

SEQ ID NO: 26827 - protein, 11 aa, Artificial Sequence
  Chromatin assembly factor 1 subunit A (782-792)
RLISENSVYEK

SEQ ID NO: 26828 - protein, 9 aa, Artificial Sequence
  Rho guanine nucleotide exchange factor 39 (185-193)
RLISETAQR

SEQ ID NO: 26829 - protein, 12 aa, Artificial Sequence
  DCN1-like protein 5 (40-51)
RLISGEEHFSSK

SEQ ID NO: 26830 - protein, 12 aa, Artificial Sequence
  40S ribosomal protein S4, X isoform (81-92)
RLIYDTKGRFAV

SEQ ID NO: 26831 - protein, 9 aa, Artificial Sequence
  Protein PRRC2A (2074-2082)
RLKATPSTY

SEQ ID NO: 26832 - protein, 9 aa, Artificial Sequence
  Nuclear migration protein nudC (143-151)
RLKGKDMVV

SEQ ID NO: 26833 - protein, 11 aa, Artificial Sequence
  tRNA-splicing endonuclease subunit Sen34 (58-68)
RLLAEIGAVTL

SEQ ID NO: 26834 - protein, 9 aa, Artificial Sequence
  Transcription factor SPT20 homolog (262-270)
RLLDFLQKR

SEQ ID NO: 26835 - protein, 9 aa, Artificial Sequence
  Mitogen-activated protein kinase-binding protein 1 (92-100)
RLLDKWVEL

SEQ ID NO: 26836 - protein, 9 aa, Artificial Sequence
  E3 ubiquitin-protein ligase RNF14 (373-381)
RLLDQRYGK

SEQ ID NO: 26837 - protein, 11 aa, Artificial Sequence
  Lysine-specific histone demethylase 1A (408-418)
RLLEATSYLSH

SEQ ID NO: 26838 - protein, 9 aa, Artificial Sequence
  39S ribosomal protein L37, mitochondrial (112-120)
RLLEGVKQA

SEQ ID NO: 26839 - protein, 9 aa, Artificial Sequence
  Transient receptor potential cation channel subfamily M member 1 (158-166)
RLLEKHISL

SEQ ID NO: 26840 - protein, 9 aa, Artificial Sequence
  DNA-directed RNA polymerase III subunit RPC3 (458-466)
RLLEKSQRV

SEQ ID NO: 26841 - protein, 9 aa, Artificial Sequence
  citron Rho-interacting kinase isoform X13 (384-392)
RLLELETRL

SEQ ID NO: 26842 - protein, 9 aa, Artificial Sequence
  Clathrin heavy chain 1 (583-591)
RLLEMNLMH

SEQ ID NO: 26843 - protein, 11 aa, Artificial Sequence
  Unconventional myosin-Va (137-147)
RLLESQLQSQK

SEQ ID NO: 26844 - protein, 11 aa, Artificial Sequence
  Glycogen synthase kinase-3 beta (319-329)
RLLEYTPTARL

SEQ ID NO: 26845 - protein, 17 aa, Artificial Sequence
  Oxidation resistance protein 1 (21-37)
RLLGFGGGGEARQTLAK

SEQ ID NO: 26846 - protein, 8 aa, Artificial Sequence
  Membrane-associated transporter protein (209-216)
RLLGTEFQ

SEQ ID NO: 26847 - protein, 9 aa, Artificial Sequence
  Microsomal glutathione S-transferase 1 (147-155)
RLLKSKLYL

SEQ ID NO: 26848 - protein, 9 aa, Artificial Sequence
  Actin-binding protein anillin (762-770)
RLLLIATGK

SEQ ID NO: 26849 - protein, 10 aa, Artificial Sequence
  DNA replication licensing factor MCM6 (11-20)
RLLNKSIIRV

SEQ ID NO: 26850 - protein, 11 aa, Artificial Sequence
  Activating signal cointegrator 1 complex subunit 3 (832-842)
RLLNLSKVIDK

SEQ ID NO: 26851 - protein, 11 aa, Artificial Sequence
  Glioma tumor suppressor candidate region gene 2 protein (165-175)
RLLNPSATRAK

SEQ ID NO: 26852 - protein, 10 aa, Artificial Sequence
  Ectonucleoside triphosphate diphosphohydrolase 6 (169-178)
RLLPGEKAQK

SEQ ID NO: 26853 - protein, 11 aa, Artificial Sequence
  Myomegalin (2291-2301)
RLLQSTTEHLK

SEQ ID NO: 26854 - protein, 9 aa, Artificial Sequence
  Carbohydrate sulfotransferase 14 (180-188)
RLLSAYRNK

SEQ ID NO: 26855 - protein, 12 aa, Artificial Sequence
  GPI-anchor transamidase (149-160)
RLLSDDRSNILI

SEQ ID NO: 26856 - protein, 10 aa, Artificial Sequence
  Spermatogenesis-associated protein 20 (128-137)
RLLSEDFVSV

SEQ ID NO: 26857 - protein, 11 aa, Artificial Sequence
  Attractin (51-61)
RLLSPPLRPRL

SEQ ID NO: 26858 - protein, 12 aa, Artificial Sequence
  Attractin (51-62)
RLLSPPLRPRLL

SEQ ID NO: 26859 - protein, 9 aa, Artificial Sequence
  Actin-binding protein anillin (910-918)
RLLTSITTK

SEQ ID NO: 26860 - protein, 11 aa, Artificial Sequence
  Serine/threonine-protein kinase mTOR (2429-2439)
RLMDTNTKGNK

SEQ ID NO: 26861 - protein, 11 aa, Artificial Sequence
  Dehydrodolichyl diphosphate syntase complex subunit DHDDS (103-113)
RLMEEKEKLQK

SEQ ID NO: 26862 - protein, 9 aa, Artificial Sequence
  Dedicator of cytokinesis protein 4 (213-221)
RLMERLLDY

SEQ ID NO: 26863 - protein, 9 aa, Artificial Sequence
  Nuclear receptor-interacting protein 3 (4-12)
RLMETNLSK

SEQ ID NO: 26864 - protein, 12 aa, Artificial Sequence
  Heterogeneous nuclear ribonucleoprotein Q (192-203)
RLMMDPLTGLNR

SEQ ID NO: 26865 - protein, 11 aa, Artificial Sequence
  Heat shock protein 105 kDa (169-179)
RLMNDMTAVAL

SEQ ID NO: 26866 - protein, 9 aa, Artificial Sequence
  RILP-like protein 1 (52-60)
RLMPKVVRV

SEQ ID NO: 26867 - protein, 9 aa, Artificial Sequence
  U5 small nuclear ribonucleoprotein 200 kDa helicase (841-849)
RLMRAIFEI

SEQ ID NO: 26868 - protein, 9 aa, Artificial Sequence
  FYVE, RhoGEF and PH domain-containing protein 4 (32-40)
RLMSKNFTK

SEQ ID NO: 26869 - protein, 9 aa, Artificial Sequence
  Hyaluronan mediated motility receptor (119-127)
RLNAALREK

SEQ ID NO: 26870 - protein, 9 aa, Artificial Sequence
  Cytochrome c oxidase subunit 5A, mitochondrial (98-106)
RLNDFASTV

SEQ ID NO: 26871 - protein, 9 aa, Artificial Sequence
  Spectrin beta chain, non-erythrocytic 1 (2278-2286)
RLNDGNEYL

SEQ ID NO: 26872 - protein, 10 aa, Artificial Sequence
  V-type proton ATPase subunit H (382-391)
RLNEKNYELL

SEQ ID NO: 26873 - protein, 11 aa, Artificial Sequence
  Pyruvate kinase PKM (73-83)
RLNFSHGTHEY

SEQ ID NO: 26874 - protein, 12 aa, Artificial Sequence
  60S acidic ribosomal protein P2 (38-49)
RLNKVISELNGK

SEQ ID NO: 26875 - protein, 9 aa, Artificial Sequence
  Midasin (2183-2191)
RLNNKINSY

SEQ ID NO: 26876 - protein, 11 aa, Artificial Sequence
  RalBP1-associated Eps domain-containing protein 1 (712-722)
RLNSELQQQLK

SEQ ID NO: 26877 - protein, 10 aa, Artificial Sequence
  Testis-expressed sequence 10 protein (473-482)
RLNSKQLNRL

SEQ ID NO: 26878 - protein, 10 aa, Artificial Sequence
  Integrator complex subunit 8 (649-658)
RLPDIPLRQV

SEQ ID NO: 26879 - protein, 11 aa, Artificial Sequence
  Protrudin (48-58)
RLPDSELMRRK

SEQ ID NO: 26880 - protein, 11 aa, Artificial Sequence
  Beta-1,3-N-acetylglucosaminyltransferase radical fringe (267-277)
RLPPDTLLQQV

SEQ ID NO: 26881 - protein, 9 aa, Artificial Sequence
  F-actin-capping protein subunit beta (41-49)
RLPPQQIEK

SEQ ID NO: 26882 - protein, 13 aa, Artificial Sequence
  Transmembrane protein 51 (123-135)
RLPQGTMFPATRK

SEQ ID NO: 26883 - protein, 9 aa, Artificial Sequence
  Inactive tyrosine-protein kinase 7 (362-370)
RLPTHGRVY

SEQ ID NO: 26884 - protein, 9 aa, Artificial Sequence
  Bridging integrator 3 (137-145)
RLQAKVEKY

SEQ ID NO: 26885 - protein, 10 aa, Artificial Sequence
  Nck-associated protein 1 (492-501)
RLQAYTSVSK

SEQ ID NO: 26886 - protein, 9 aa, Artificial Sequence
  Scavenger receptor class A member 5 (244-252)
RLQDLRVLV

SEQ ID NO: 26887 - protein, 13 aa, Artificial Sequence
  Protein FAM167A (131-143)
RLQDQQLARQLMR

SEQ ID NO: 26888 - protein, 10 aa, Artificial Sequence
  KH domain-containing, RNA-binding, signal transduction-associated protein 1 (186-195)
RLQEETGAKI

SEQ ID NO: 26889 - protein, 9 aa, Artificial Sequence
  26S proteasome non-ATPase regulatory subunit 12 (39-47)
RLQEVIETL

SEQ ID NO: 26890 - protein, 11 aa, Artificial Sequence
  Sentrin-specific protease 6 (172-182)
RLQGVERIMKK

SEQ ID NO: 26891 - protein, 12 aa, Artificial Sequence
  60S ribosomal protein L10 (109-120)
RLQTGMRGAFGK

SEQ ID NO: 26892 - protein, 10 aa, Artificial Sequence
  Integrin beta-3 (117-126)
RLRPDDSKNF

SEQ ID NO: 26893 - protein, 10 aa, Artificial Sequence
  Protogenin (10-19)
RLRPPGMLLR

SEQ ID NO: 26894 - protein, 11 aa, Artificial Sequence
  DNA replication licensing factor MCM5 (573-583)
RLSAEAAEKLK

SEQ ID NO: 26895 - protein, 12 aa, Artificial Sequence
  EF-hand domain-containing protein D2 (176-187)
RLSEIDVSSEGV

SEQ ID NO: 26896 - protein, 9 aa, Artificial Sequence
  MICOS complex subunit MIC25 (29-37)
RLSENVVNR

SEQ ID NO: 26897 - protein, 9 aa, Artificial Sequence
  Neuron navigator 2 (2169-2177)
RLSEYIVLR

SEQ ID NO: 26898 - protein, 11 aa, Artificial Sequence
  Serine palmitoyltransferase 2 (212-222)
RLSGATIRIFK

SEQ ID NO: 26899 - protein, 9 aa, Artificial Sequence
  T-complex protein 1 subunit delta (435-443)
RLTEYSRTL

SEQ ID NO: 26900 - protein, 9 aa, Artificial Sequence
  60S ribosomal protein L36 (32-40)
RLTKHTKFV

SEQ ID NO: 26901 - protein, 9 aa, Artificial Sequence
  Centromere protein F (420-428)
RLTQELQQA

SEQ ID NO: 26902 - protein, 10 aa, Artificial Sequence
  Spectrin beta chain, non-erythrocytic 1 (2078-2087)
RLTTLELLEV

SEQ ID NO: 26903 - protein, 13 aa, Artificial Sequence
  Disintegrin and metalloproteinase domain-containing protein 10 (389-401)
RLVDADGPLARLK

SEQ ID NO: 26904 - protein, 11 aa, Artificial Sequence
  DNA mismatch repair protein Mlh1 (265-275)
RLVESTSLRKA

SEQ ID NO: 26905 - protein, 9 aa, Artificial Sequence
  Coiled-coil domain-containing protein 144A (749-757)
RLVKELRTV

SEQ ID NO: 26906 - protein, 13 aa, Artificial Sequence
  Sialidase-3 (111-123)
RLVSNSWTQAILK

SEQ ID NO: 26907 - protein, 9 aa, Artificial Sequence
  Uridine phosphorylase 1 (90-98)
RLVSYFIKK

SEQ ID NO: 26908 - protein, 9 aa, Artificial Sequence
  Cryptochrome-2 (155-163)
RLWDLYKKV

SEQ ID NO: 26909 - protein, 15 aa, Artificial Sequence
  Ribosome biogenesis protein WDR12 (322-336)
RLWDPRTKDGSLVSL

SEQ ID NO: 26910 - protein, 10 aa, Artificial Sequence
  Protein polybromo-1 (982-991)
RLWEDSAGEK

SEQ ID NO: 26911 - protein, 9 aa, Artificial Sequence
  ATP-dependent RNA helicase DDX24 (447-455)
RLWELIKEK

SEQ ID NO: 26912 - protein, 10 aa, Artificial Sequence
  DnaJ homolog subfamily C member 4 (11-20)
RLWPRNPPSR

SEQ ID NO: 26913 - protein, 12 aa, Artificial Sequence
  Multifunctional protein ADE2 (215-226)
RLWPSGDRSQQK

SEQ ID NO: 26914 - protein, 11 aa, Artificial Sequence
  39S ribosomal protein L37, mitochondrial (162-172)
RLWQTTEEIPK

SEQ ID NO: 26915 - protein, 10 aa, Artificial Sequence
  Protein phosphatase Slingshot homolog 1 (144-153)
RLWSDTKIHL

SEQ ID NO: 26916 - protein, 10 aa, Artificial Sequence
  Inositol 1,4,5-trisphosphate receptor type 1 (806-815)
RLWSEIPSEI

SEQ ID NO: 26917 - protein, 10 aa, Artificial Sequence
  E3 ubiquitin-protein ligase Mdm2 (71-80)
RLYDEKQQHI

SEQ ID NO: 26918 - protein, 12 aa, Artificial Sequence
  E3 ubiquitin-protein ligase Mdm2 (65-76)
RLYDEKQQHIVY

SEQ ID NO: 26919 - protein, 11 aa, Artificial Sequence
  ATP-binding cassette sub-family B member 10, mitochondrial (542-552)
RLYDPASGTIS

SEQ ID NO: 26920 - protein, 10 aa, Artificial Sequence
  MICOS complex subunit MIC26 (165-174)
RLYDWGLRGY

SEQ ID NO: 26921 - protein, 9 aa, Artificial Sequence
  ADP-ribosylation factor-like protein 4D (182-190)
RLYEMILKR

SEQ ID NO: 26922 - protein, 13 aa, Artificial Sequence
  Probable fibrosin-1 (306-318)
RLYGLEPAHPLLY

SEQ ID NO: 26923 - protein, 10 aa, Artificial Sequence
  Tubulin-specific chaperone C (217-226)
RLYGNPNTLR

SEQ ID NO: 26924 - protein, 9 aa, Artificial Sequence
  Tubulin polyglutamylase TTLL7 (399-407)
RLYGQNSIK

SEQ ID NO: 26925 - protein, 9 aa, Artificial Sequence
  Condensin-2 complex subunit G2 (329-337)
RLYKPILWR

SEQ ID NO: 26926 - protein, 9 aa, Artificial Sequence
  Partitioning defective 6 homolog beta (159-167)
RLYKYGTEK

SEQ ID NO: 26927 - protein, 10 aa, Artificial Sequence
  HCG2002594, isoform CRA_c (311-320)
RLYPWGIVEV

SEQ ID NO: 26928 - protein, 8 aa, Artificial Sequence
  Conserved oligomeric Golgi complex subunit 4 (121-128)
RLYQAIQR

SEQ ID NO: 26929 - protein, 11 aa, Artificial Sequence
  Proteasome subunit alpha type-7 (143-153)
RLYQTDPSGTY

SEQ ID NO: 26930 - protein, 9 aa, Artificial Sequence
  Coiled-coil domain-containing protein 77 (127-135)
RLYSENDRL

SEQ ID NO: 26931 - protein, 10 aa, Artificial Sequence
  39S ribosomal protein L17, mitochondrial (74-83)
RMADFWLTEK

SEQ ID NO: 26932 - protein, 13 aa, Artificial Sequence
  Coiled-coil-helix-coiled-coil-helix domain-containing protein 2 (11-23)
RMAPPASRAPQMR

SEQ ID NO: 26933 - protein, 9 aa, Artificial Sequence
  Exportin-1 (44-52)
RMAQEVLTH

SEQ ID NO: 26934 - protein, 10 aa, Artificial Sequence
  Lon protease homolog 2, peroxisomal (632-641)
RMDGEGQLTL

SEQ ID NO: 26935 - protein, 9 aa, Artificial Sequence
  DNA mismatch repair protein Msh3 (448-456)
RMDNIYFEY

SEQ ID NO: 26936 - protein, 12 aa, Artificial Sequence
  39S ribosomal protein L51, mitochondrial (101-112)
RMFADDLHNLNK

SEQ ID NO: 26937 - protein, 11 aa, Artificial Sequence
  60S ribosomal protein L4 (100-110)
RMFAPTKTWRR

SEQ ID NO: 26938 - protein, 9 aa, Artificial Sequence
  Zinc finger BED domain-containing protein 5 (228-236)
RMFDEQYSK

SEQ ID NO: 26939 - protein, 11 aa, Artificial Sequence
  HLA class II histocompatibility antigen, DP alpha 1 chain (6-16)
RMFHIRAVILR

SEQ ID NO: 26940 - protein, 10 aa, Artificial Sequence
  Protein Shroom2 (323-332)
RMFIGDLDKV

SEQ ID NO: 26941 - protein, 10 aa, Artificial Sequence
  Cullin-1 (506-515)
RMFQDIGVSK

SEQ ID NO: 26942 - protein, 12 aa, Artificial Sequence
  EPM2A-interacting protein 1 (249-260)
RMIGENSGLVSY

SEQ ID NO: 26943 - protein, 10 aa, Artificial Sequence
  Leucine-rich repeat and WD repeat-containing protein 1 (193-202)
RMISEELVAA

SEQ ID NO: 26944 - protein, 10 aa, Artificial Sequence
  Endoplasmin (509-518)
RMKEKQDKIY

SEQ ID NO: 26945 - protein, 11 aa, Artificial Sequence
  Heat shock protein HSP 90-alpha (605-615)
RMKENQKHIYY

SEQ ID NO: 26946 - protein, 10 aa, Artificial Sequence
  Heat shock protein HSP 90-beta (401-410)
RMKETQKSIY

SEQ ID NO: 26947 - protein, 11 aa, Artificial Sequence
  Heat shock protein HSP 90-beta (401-411)
RMKETQKSIYY

SEQ ID NO: 26948 - protein, 10 aa, Artificial Sequence
  60S ribosomal protein L39 (28-37)
RMKTGNKIRY

SEQ ID NO: 26949 - protein, 9 aa, Artificial Sequence
  Liprin-alpha-4 (339-347)
RMLDHLTKK

SEQ ID NO: 26950 - protein, 10 aa, Artificial Sequence
  Eukaryotic translation initiation factor 3 subunit A (752-761)
RMLEDRDLFV

SEQ ID NO: 26951 - protein, 9 aa, Artificial Sequence
  Proteasome subunit beta type-7 (103-111)
RMLKQMLFR

SEQ ID NO: 26952 - protein, 11 aa, Artificial Sequence
  cDNA FLJ78342 (112-122)
RMLQISESSFL

SEQ ID NO: 26953 - protein, 11 aa, Artificial Sequence
  rRNA-processing protein FCF1 homolog (15-25)
RMLSLRDQRLK

SEQ ID NO: 26954 - protein, 10 aa, Artificial Sequence
  Meiotic nuclear division protein 1 homolog (15-24)
RMMEIFSETK

SEQ ID NO: 26955 - protein, 11 aa, Artificial Sequence
  Zinc finger FYVE domain-containing protein 16 (812-822)
RMMSPTGSNLK

SEQ ID NO: 26956 - protein, 9 aa, Artificial Sequence
  DNA replication ATP-dependent helicase/nuclease DNA2 (828-836)
RMNSKIMSL

SEQ ID NO: 26957 - protein, 11 aa, Artificial Sequence
  WAS protein family homolog 1 (5-15)
RMQHSLAGQTY

SEQ ID NO: 26958 - protein, 9 aa, Artificial Sequence
  Neuron navigator 2 (1941-1949)
RMQSEIEKL

SEQ ID NO: 26959 - protein, 9 aa, Artificial Sequence
  28 kDa heat- and acid-stable phosphoprotein (173-181)
RMQSLSLNK

SEQ ID NO: 26960 - protein, 13 aa, Artificial Sequence
  cDNA FLJ57726, highly similar to Heterogeneous nuclear ribonucleoprotein H3 (32-44)
RMRDGRGMGGHGY

SEQ ID NO: 26961 - protein, 9 aa, Artificial Sequence
  Histone-lysine N-methyltransferase EHMT2 (42-50)
RMSDDVHSL

SEQ ID NO: 26962 - protein, 9 aa, Artificial Sequence
  La-related protein 4 (502-510)
RMSDVVKGV

SEQ ID NO: 26963 - protein, 16 aa, Artificial Sequence
  Casein kinase I isoform delta (394-409)
RMSTSQNSIPFEHHGK

SEQ ID NO: 26964 - protein, 9 aa, Artificial Sequence
  Nucleophosmin (277-285)
RMTDQEAIQ

SEQ ID NO: 26965 - protein, 10 aa, Artificial Sequence
  DNA mismatch repair protein Msh6 (302-311)
RMVTGNGSLK

SEQ ID NO: 26966 - protein, 11 aa, Artificial Sequence
  Mesencephalic astrocyte-derived neurotrophic factor (3-13)
RMWATQGLAVA

SEQ ID NO: 26967 - protein, 9 aa, Artificial Sequence
  Arginine/serine-rich coiled-coil protein 2 (170-178)
RNLDAQYEM

SEQ ID NO: 26968 - protein, 17 aa, Artificial Sequence
  Melanocyte protein PMEL (241-257)
RNQPLTFALQLHDPSGY

SEQ ID NO: 26969 - protein, 9 aa, Artificial Sequence
  Keratin, type I cytoskeletal 10 (99-107)
RNVSTGDVN

SEQ ID NO: 26970 - protein, 9 aa, Artificial Sequence
  Dystonin (4836-4844)
RQAEEFHSV

SEQ ID NO: 26971 - protein, 9 aa, Artificial Sequence
  Stathmin-3 (130-138)
RQAEEKLNY

SEQ ID NO: 26972 - protein, 9 aa, Artificial Sequence
  Elongation factor 1-gamma (99-107)
RQAFPNTNR

SEQ ID NO: 26973 - protein, 9 aa, Artificial Sequence
  A-kinase anchor protein 10, mitochondrial (481-489)
RQAWTTMEK

SEQ ID NO: 26974 - protein, 9 aa, Artificial Sequence
  Vimentin (207-215)
RQDVDNASL

SEQ ID NO: 26975 - protein, 9 aa, Artificial Sequence
  Acidic fibroblast growth factor intracellular-binding protein (136-144)
RQFDNFKRV

SEQ ID NO: 26976 - protein, 8 aa, Artificial Sequence
  Lysine-specific demethylase 5B (878-885)
RQFVTQLY

SEQ ID NO: 26977 - protein, 9 aa, Artificial Sequence
  Fibronectin type III domain-containing protein 3B (198-206)
RQIDRQNRL

SEQ ID NO: 26978 - protein, 10 aa, Artificial Sequence
  Cytochrome P450 2U1 (288-297)
RQIEKDITSF

SEQ ID NO: 26979 - protein, 8 aa, Artificial Sequence
  Interferon alpha-inducible protein 6 (2-9)
RQKAVSLF

SEQ ID NO: 26980 - protein, 9 aa, Artificial Sequence
  THAP domain-containing protein 1 (175-183)
RQLEKLKEV

SEQ ID NO: 26981 - protein, 11 aa, Artificial Sequence
  3-hydroxy-3-methylglutaryl-coenzyme A reductase (84-94)
RQLGSKYILGI

SEQ ID NO: 26982 - protein, 9 aa, Artificial Sequence
  Protein FAM32A (72-80)
RQMERILKK

SEQ ID NO: 26983 - protein, 9 aa, Artificial Sequence
  Splicing factor 3A subunit 1 (72-80)
RQNEINNPK

SEQ ID NO: 26984 - protein, 9 aa, Artificial Sequence
  Spectrin beta chain, non-erythrocytic 1 (1161-1169)
RQNLLSQSH

SEQ ID NO: 26985 - protein, 9 aa, Artificial Sequence
  Unconventional myosin-X (252-260)
RQNPGERNY

SEQ ID NO: 26986 - protein, 10 aa, Artificial Sequence
  Phosphatidylinositol-binding clathrin assembly protein (139-148)
RQVAFDFTKV

SEQ ID NO: 26987 - protein, 9 aa, Artificial Sequence
  Hom s 2 (98-106)
RQVTGVTRV

SEQ ID NO: 26988 - protein, 10 aa, Artificial Sequence
  Alpha-actinin-1 (672-681)
RQYEKSIVNY

SEQ ID NO: 26989 - protein, 9 aa, Artificial Sequence
  Protein CREG2 (251-259)
RQYEWFFMK

SEQ ID NO: 26990 - protein, 9 aa, Artificial Sequence
  Transmembrane emp24 domain-containing protein 4 (92-100)
RQYGSEGRF

SEQ ID NO: 26991 - protein, 9 aa, Artificial Sequence
  Bromodomain adjacent to zinc finger domain protein 2B (487-495)
RQYPEVIKY

SEQ ID NO: 26992 - protein, 9 aa, Artificial Sequence
  Myb-binding protein 1A (59-67)
RRDFQIRVL

SEQ ID NO: 26993 - protein, 9 aa, Artificial Sequence
  FLYWCH-type zinc finger-containing protein 1 (137-145)
RRGPGPLTL

SEQ ID NO: 26994 - protein, 9 aa, Artificial Sequence
  NEDD8 ultimate buster 1 (431-439)
RRLENIRFL

SEQ ID NO: 26995 - protein, 9 aa, Artificial Sequence
  Tribbles homolog 2 (31-39)
RSAEPSQSF

SEQ ID NO: 26996 - protein, 9 aa, Artificial Sequence
  Adenylate kinase 2, mitochondrial (175-183)
RSDDNEKAL

SEQ ID NO: 26997 - protein, 11 aa, Artificial Sequence
  Rhomboid-like protein (64-74)
RSDPGTSGEAY

SEQ ID NO: 26998 - protein, 11 aa, Artificial Sequence
  THO complex subunit 5 homolog (27-37)
RSDTEQEGKYY

SEQ ID NO: 26999 - protein, 9 aa, Artificial Sequence
  Serine/threonine-protein kinase VRK2 (112-120)
RSDVEILGY

SEQ ID NO: 27000 - protein, 13 aa, Artificial Sequence
  Eukaryotic translation initiation factor 3 subunit E (431-443)
RSEAPNWATQDSG

SEQ ID NO: 27001 - protein, 13 aa, Artificial Sequence
  Annexin A1 (303-315)
RSEIDMNDIKAFY

SEQ ID NO: 27002 - protein, 10 aa, Artificial Sequence
  Protein LAP2 (1012-1021)
RSESTENQSY

SEQ ID NO: 27003 - protein, 9 aa, Artificial Sequence
  Zinc finger and BTB domain-containing protein 17 (362-370)
RSFSDPTSK

SEQ ID NO: 27004 - protein, 11 aa, Artificial Sequence
  Acyl-coenzyme A thioesterase THEM4 (34-44)
RSFSSEEVILK

SEQ ID NO: 27005 - protein, 9 aa, Artificial Sequence
  Hypoxia-inducible factor 1-alpha (30-38)
RSKESEVFY

SEQ ID NO: 27006 - protein, 9 aa, Artificial Sequence
  Tubulin-tyrosine ligase-like protein 12 (425-433)
RSLDTHVTK

SEQ ID NO: 27007 - protein, 11 aa, Artificial Sequence
  UHRF1-binding protein 1 (558-568)
RSLEQFKAIYK

SEQ ID NO: 27008 - protein, 9 aa, Artificial Sequence
  EWS RNA-binding protein variant 6 (391-399)
RSLRYYYEK

SEQ ID NO: 27009 - protein, 11 aa, Artificial Sequence
  Transmembrane protein 131 (709-719)
RSLSEDVRFYY

SEQ ID NO: 27010 - protein, 9 aa, Artificial Sequence
  Solute carrier family 25 member 35 (270-278)
RSLYYTDTK

SEQ ID NO: 27011 - protein, 9 aa, Artificial Sequence
  Phospholipid hydroperoxide glutathione peroxidase, mitochondrial (39-47)
RSMHEFSAK

SEQ ID NO: 27012 - protein, 9 aa, Artificial Sequence
  Ubiquitin-like protein 7 (210-218)
RSMPSSSYR

SEQ ID NO: 27013 - protein, 9 aa, Artificial Sequence
  Baculoviral IAP repeat-containing protein 6 (3123-3131)
RSMVSTIMK

SEQ ID NO: 27014 - protein, 9 aa, Artificial Sequence
  Testis-specific Y-encoded protein 1 (206-214)
RSNPYFQNK

SEQ ID NO: 27015 - protein, 9 aa, Artificial Sequence
  Eukaryotic translation initiation factor 2 subunit 2 (285-293)
RSPDTILQK

SEQ ID NO: 27016 - protein, 12 aa, Artificial Sequence
  Myb-binding protein 1A (545-556)
RSPSLLQSGAKK

SEQ ID NO: 27017 - protein, 10 aa, Artificial Sequence
  Histone acetyltransferase KAT2A (279-288)
RSQAEDVATY

SEQ ID NO: 27018 - protein, 9 aa, Artificial Sequence
  Sorting nexin-17 (193-201)
RSQEYKIVL

SEQ ID NO: 27019 - protein, 16 aa, Artificial Sequence
  Cold-inducible RNA-binding protein (145-160)
RSQSGGYSDRSSGGSY

SEQ ID NO: 27020 - protein, 13 aa, Artificial Sequence
  Heterogeneous nuclear ribonucleoprotein A1-like 2 (131-143)
RSSGPYGGGGQYF

SEQ ID NO: 27021 - protein, 9 aa, Artificial Sequence
  Solute carrier family 22 member 18 (22-30)
RSSVILLTY

SEQ ID NO: 27022 - protein, 10 aa, Artificial Sequence
  Lysine-specific histone demethylase 1A (632-641)
RSTSQTFIYK

SEQ ID NO: 27023 - protein, 9 aa, Artificial Sequence
  Butyrophilin subfamily 2 member A2 (135-143)
RSYDEAILR

SEQ ID NO: 27024 - protein, 10 aa, Artificial Sequence
  Butyrophilin subfamily 2 member A2 (135-144)
RSYDEAILRL

SEQ ID NO: 27025 - protein, 9 aa, Artificial Sequence
  Vacuolar protein sorting-associated protein 52 homolog (301-309)
RSYLGRLMK

SEQ ID NO: 27026 - protein, 11 aa, Artificial Sequence
  CDKN2AIP N-terminal-like protein (28-38)
RSYSESEKQWK

SEQ ID NO: 27027 - protein, 12 aa, Artificial Sequence
  Vimentin (28-39)
RSYVTTSTRTYS

SEQ ID NO: 27028 - protein, 11 aa, Artificial Sequence
  Ribosome biogenesis protein BOP1 (9-19)
RTAAPSVRPEK

SEQ ID NO: 27029 - protein, 11 aa, Artificial Sequence
  Myelin basic protein (92-102)
RTAHYGSLPQK

SEQ ID NO: 27030 - protein, 17 aa, Artificial Sequence
  HIRA-interacting protein 3 (190-206)
RTAWNPLGEAAPPGELY

SEQ ID NO: 27031 - protein, 9 aa, Artificial Sequence
  WD repeat-containing protein 91 (7-15)
RTDELVREY

SEQ ID NO: 27032 - protein, 9 aa, Artificial Sequence
  Protein FAM199X (55-63)
RTDPLHRFH

SEQ ID NO: 27033 - protein, 13 aa, Artificial Sequence
  Sodium/potassium/calcium exchanger 5 (203-215)
RTDSGIFYEDSGY

SEQ ID NO: 27034 - protein, 12 aa, Artificial Sequence
  Multivesicular body subunit 12B (107-118)
RTDYEYQHSNLY

SEQ ID NO: 27035 - protein, 10 aa, Artificial Sequence
  Upstream stimulatory factor 1 (52-61)
RTENGGQVMY

SEQ ID NO: 27036 - protein, 11 aa, Artificial Sequence
  Upstream stimulatory factor 2 (69-79)
RTETNGGQVTY

SEQ ID NO: 27037 - protein, 12 aa, Artificial Sequence
  Plexin-C1 (1024-1035)
RTFFPESGGFTH

SEQ ID NO: 27038 - protein, 10 aa, Artificial Sequence
  Spatacsin (651-660)
RTFMIKFPWK

SEQ ID NO: 27039 - protein, 10 aa, Artificial Sequence
  Cytoplasmic dynein 1 heavy chain 1 (4159-4168)
RTFSSIPVSR

SEQ ID NO: 27040 - protein, 9 aa, Artificial Sequence
  Abhydrolase domain-containing protein 2 (144-152)
RTFVDYAQK

SEQ ID NO: 27041 - protein, 9 aa, Artificial Sequence
  Probable ATP-dependent RNA helicase DDX5 (559-567)
RTGNPTGTY

SEQ ID NO: 27042 - protein, 11 aa, Artificial Sequence
  Ras-related protein Rab-1B (48-58)
RTIELDGKTIK

SEQ ID NO: 27043 - protein, 14 aa, Artificial Sequence
  NADH dehydrogenase (ubiquinone) 1 beta subcomplex subunit 4 (72-85)
RTINVYPNFRPTPK

SEQ ID NO: 27044 - protein, 13 aa, Artificial Sequence
  S-adenosylmethionine decarboxylase proenzyme (33-45)
RTIPRSEWDILLK

SEQ ID NO: 27045 - protein, 9 aa, Artificial Sequence
  Midasin (1582-1590)
RTLFKFMKK

SEQ ID NO: 27046 - protein, 9 aa, Artificial Sequence
  DNA dC-dU-editing enzyme APOBEC-3B (183-191)
RTLKEILRY

SEQ ID NO: 27047 - protein, 11 aa, Artificial Sequence
  Disintegrin and metalloproteinase domain-containing protein 10 (147-157)
RTLPFHSVIYH

SEQ ID NO: 27048 - protein, 11 aa, Artificial Sequence
  BTB/POZ domain-containing adapter for CUL3-mediated RhoA degradation protein 1 (57-67)
RTLTGQDTMLK

SEQ ID NO: 27049 - protein, 14 aa, Artificial Sequence
  Heat shock protein HSP 90-beta (32-45)
RTLTLVDTGIGMTK

SEQ ID NO: 27050 - protein, 12 aa, Artificial Sequence
  UDP-N-acetylhexosamine pyrophosphorylase (169-180)
RTMESTKEFFTK

SEQ ID NO: 27051 - protein, 11 aa, Artificial Sequence
  Hypoxia-inducible factor 1-alpha (180-190)
RTMNIKSATWK

SEQ ID NO: 27052 - protein, 9 aa, Artificial Sequence
  Spindle and centriole-associated protein 1 (657-665)
RTNESLIQR

SEQ ID NO: 27053 - protein, 10 aa, Artificial Sequence
  COBW domain-containing protein 2 (353-362)
RTNRLVLLGR

SEQ ID NO: 27054 - protein, 10 aa, Artificial Sequence
  Alpha-adducin (193-202)
RTPSFLKKSK

SEQ ID NO: 27055 - protein, 9 aa, Artificial Sequence
  Programmed cell death 6-interacting protein (478-486)
RTPSNELYK

SEQ ID NO: 27056 - protein, 12 aa, Artificial Sequence
  Leucine zipper putative tumor suppressor 1 (432-443)
RTQDLEGALRTK

SEQ ID NO: 27057 - protein, 9 aa, Artificial Sequence
  Protein disulfide-isomerase A4 (155-163)
RTQEEIVAK

SEQ ID NO: 27058 - protein, 11 aa, Artificial Sequence
  Glycerol kinase (118-128)
RTQSTVESLSK

SEQ ID NO: 27059 - protein, 10 aa, Artificial Sequence
  E3 ubiquitin-protein ligase DZIP3 (287-296)
RTQYNEQINK

SEQ ID NO: 27060 - protein, 9 aa, Artificial Sequence
  SHC SH2 domain-binding protein 1 (434-442)
RTSAEFLMK

SEQ ID NO: 27061 - protein, 10 aa, Artificial Sequence
  Microtubule-associated protein 1B (1897-1906)
RTSDVGGYYY

SEQ ID NO: 27062 - protein, 9 aa, Artificial Sequence
  Phosphatidylinositol 3-kinase regulatory subunit beta (469-477)
RTSQELQMK

SEQ ID NO: 27063 - protein, 11 aa, Artificial Sequence
  Plakophilin-4 (455-465)
RTSSQRSTLTY

SEQ ID NO: 27064 - protein, 9 aa, Artificial Sequence
  E3-independent E2 ubiquitin-conjugating enzyme (103-111)
RTTDIVIRI

SEQ ID NO: 27065 - protein, 11 aa, Artificial Sequence
  Uncharacterized protein KIAA1211 (15-25)
RTTSWAKSKLF

SEQ ID NO: 27066 - protein, 9 aa, Artificial Sequence
  Eukaryotic translation initiation factor 3 subunit E (74-82)
RTTVVAQLK

SEQ ID NO: 27067 - protein, 11 aa, Artificial Sequence
  Dolichyl-diphosphooligosaccharide-proteinosyltransferase subunit 1 (38-48)
RTVDLSSHLAK

SEQ ID NO: 27068 - protein, 10 aa, Artificial Sequence
  28S ribosomal protein S24, mitochondrial (77-86)
RTVEDVFLRK

SEQ ID NO: 27069 - protein, 11 aa, Artificial Sequence
  Serpin B6 (125-135)
RTVEKELTYEK

SEQ ID NO: 27070 - protein, 10 aa, Artificial Sequence
  Ribosome biogenesis protein BOP1 (389-398)
RTVPVGGVVK

SEQ ID NO: 27071 - protein, 9 aa, Artificial Sequence
  Histone-lysine N-methyltransferase SETMAR (106-114)
RTVQWWFKK

SEQ ID NO: 27072 - protein, 10 aa, Artificial Sequence
  Kinesin-like protein KIF22 (23-32)
RTVTGAKPLK

SEQ ID NO: 27073 - protein, 9 aa, Artificial Sequence
  Ubiquitin-like-conjugating enzyme ATG3 (198-206)
RTYDLYITY

SEQ ID NO: 27074 - protein, 9 aa, Artificial Sequence
  Phosphatidylinositol 4-kinase alpha (889-897)
RTYDMIQYY

SEQ ID NO: 27075 - protein, 11 aa, Artificial Sequence
  Serine-protein kinase ATM (2034-2044)
RTYEHEAMWGK

SEQ ID NO: 27076 - protein, 10 aa, Artificial Sequence
  Vimentin (36-45)
RTYSLGSALR

SEQ ID NO: 27077 - protein, 11 aa, Artificial Sequence
  Protein-methionine sulfoxide oxidase MICAL3 (192-202)
RTYTEEELNAK

SEQ ID NO: 27078 - protein, 10 aa, Artificial Sequence
  Nucleolar and coiled-body phosphoprotein 1 (638-647)
RVADNSFDAK

SEQ ID NO: 27079 - protein, 9 aa, Artificial Sequence
  Arginine vasopressin-induced protein 1 (66-74)
RVAEALKRL

SEQ ID NO: 27080 - protein, 9 aa, Artificial Sequence
  Chondroitin sulfate synthase 3 (30-38)
RVAELSERK

SEQ ID NO: 27081 - protein, 9 aa, Artificial Sequence
  Caspase-9 (236-244)
RVANAVSVK

SEQ ID NO: 27082 - protein, 13 aa, Artificial Sequence
  Caspase-9 (236-248)
RVANAVSVKGIYK

SEQ ID NO: 27083 - protein, 11 aa, Artificial Sequence
  7-dehydrocholesterol reductase (339-349)
RVANHQKDLFR

SEQ ID NO: 27084 - protein, 11 aa, Artificial Sequence
  SHC-transforming protein 3 (55-65)
RVCEAVPGAKG

SEQ ID NO: 27085 - protein, 10 aa, Artificial Sequence
  Transmembrane protein 98 (138-147)
RVDDVVKSMY

SEQ ID NO: 27086 - protein, 10 aa, Artificial Sequence
  Protein OS-9 (16-25)
RVDEPLSCSY

SEQ ID NO: 27087 - protein, 9 aa, Artificial Sequence
  Eukaryotic peptide chain release factor subunit 1 (402-410)
RVDFQGMEY

SEQ ID NO: 27088 - protein, 11 aa, Artificial Sequence
  Nuclear fragile X mental retardation-interacting protein 2 (272-282)
RVDGSKPIWKY

SEQ ID NO: 27089 - protein, 10 aa, Artificial Sequence
  COP9 signalosome complex subunit 1 (484-493)
RVDSHSKILY

SEQ ID NO: 27090 - protein, 10 aa, Artificial Sequence
  Brefeldin A-inhibited guanine nucleotide-exchange protein 1 (1662-1671)
RVDTQDQGMY

SEQ ID NO: 27091 - protein, 9 aa, Artificial Sequence
  Coiled-coil domain-containing protein 127 (252-260)
RVEEAILEK

SEQ ID NO: 27092 - protein, 11 aa, Artificial Sequence
  Copine-1 (267-277)
RVETEYSFLDY

SEQ ID NO: 27093 - protein, 10 aa, Artificial Sequence
  Tumor protein D53 (48-57)
RVETTVTSLK

SEQ ID NO: 27094 - protein, 10 aa, Artificial Sequence
  Chromobox protein homolog 6 (9-18)
RVFAAESIIK

SEQ ID NO: 27095 - protein, 9 aa, Artificial Sequence
  Eukaryotic initiation factor 4A-III (166-174)
RVFDMIRRR

SEQ ID NO: 27096 - protein, 10 aa, Artificial Sequence
  DNA topoisomerase 3-beta-1 (263-272)
RVFDREIAQM

SEQ ID NO: 27097 - protein, 9 aa, Artificial Sequence
  Annexin A1 (235-243)
RVFQKYTKY

SEQ ID NO: 27098 - protein, 10 aa, Artificial Sequence
  Hermansky-Pudlak syndrome 5 protein (137-146)
RVFVGDHAGK

SEQ ID NO: 27099 - protein, 12 aa, Artificial Sequence
  Non-specific lipid-transfer protein (13-24)
RVFVVGVGMTKF

SEQ ID NO: 27100 - protein, 9 aa, Artificial Sequence
  Receptor activity-modifying protein 2 (18-26)
RVGRPAALR

SEQ ID NO: 27101 - protein, 12 aa, Artificial Sequence
  ATP-dependent RNA helicase DDX3X (407-418)
RVGSTSENITQK

SEQ ID NO: 27102 - protein, 9 aa, Artificial Sequence
  Dol-P-Man:Man(5)GlcNAc(2)-PP-Dol alpha-1,3-mannosyltransferase (115-123)
RVHSIFVLR

SEQ ID NO: 27103 - protein, 10 aa, Artificial Sequence
  Lon protease homolog 2, peroxisomal (197-206)
RVIAIRPIRR

SEQ ID NO: 27104 - protein, 9 aa, Artificial Sequence
  B-cell lymphoma 3 protein (267-275)
RVIDILRGK

SEQ ID NO: 27105 - protein, 12 aa, Artificial Sequence
  Serine/threonine-protein kinase TBK1 (143-154)
RVIGEDGQSVYK

SEQ ID NO: 27106 - protein, 13 aa, Artificial Sequence
  Stress-70 protein, mitochondrial (218-230)
RVINEPTAAALAY

SEQ ID NO: 27107 - protein, 11 aa, Artificial Sequence
  Synembryn-A (493-503)
RVIQPMGMSPR

SEQ ID NO: 27108 - protein, 11 aa, Artificial Sequence
  GDP-fucose protein O-fucosyltransferase 1 (101-111)
RVISLEDFMEK

SEQ ID NO: 27109 - protein, 12 aa, Artificial Sequence
  Creatine kinase M-type (236-247)
RVISMEKGGNMK

SEQ ID NO: 27110 - protein, 12 aa, Artificial Sequence
  COX assembly mitochondrial protein 2 homolog (63-74)
RVIVTHGSLKLK

SEQ ID NO: 27111 - protein, 9 aa, Artificial Sequence
  ENTH domain-containing protein 1 (376-384)
RVKEIVINK

SEQ ID NO: 27112 - protein, 12 aa, Artificial Sequence
  Epidermal growth factor receptor substrate 15 (33-44)
RVLASDAAAFLK

SEQ ID NO: 27113 - protein, 10 aa, Artificial Sequence
  Transient receptor potential cation channel subfamily M member 1 (871-880)
RVLDIFGVNK

SEQ ID NO: 27114 - protein, 11 aa, Artificial Sequence
  Anaphase-promoting complex subunit 2 (163-173)
RVLDPSMVILE

SEQ ID NO: 27115 - protein, 12 aa, Artificial Sequence
  Monofunctional C1-tetrahydrofolate synthase, mitochondrial (497-508)
RVLDTNDRFLRK

SEQ ID NO: 27116 - protein, 10 aa, Artificial Sequence
  Uncharacterized protein C19orf52 (162-171)
RVLDVGFVGR

SEQ ID NO: 27117 - protein, 9 aa, Artificial Sequence
  Paired amphipathic helix protein Sin3b (506-514)
RVLESVQKK

SEQ ID NO: 27118 - protein, 11 aa, Artificial Sequence
  Nipped-B-like protein (1779-1789)
RVLGENAIAVR

SEQ ID NO: 27119 - protein, 9 aa, Artificial Sequence
  Interferon-stimulated gene 20 kDa protein (131-139)
RVLSERLLH

SEQ ID NO: 27120 - protein, 10 aa, Artificial Sequence
  Interferon-stimulated gene 20 kDa protein (131-140)
RVLSERLLHK

SEQ ID NO: 27121 - protein, 9 aa, Artificial Sequence
  14-3-3 protein sigma (60-68)
RVLSSIEQK

SEQ ID NO: 27122 - protein, 11 aa, Artificial Sequence
  Guanine nucleotide-binding protein G(s) subunit alpha isoforms short (187-197)
RVLTSGIFETK

SEQ ID NO: 27123 - protein, 9 aa, Artificial Sequence
  T lymphocyte c-maf long form (21-29)
RVLTSVFTK

SEQ ID NO: 27124 - protein, 9 aa, Artificial Sequence
  Beta-parvin (351-359)
RVLYNLFTK

SEQ ID NO: 27125 - protein, 11 aa, Artificial Sequence
  B-cell CLL/lymphoma 7 protein family member A (20-30)
RVMAAIEKVRK

SEQ ID NO: 27126 - protein, 11 aa, Artificial Sequence
  Nuclear transcription factor Y subunit gamma (25-35)
RVMEEIRNLTV

SEQ ID NO: 27127 - protein, 11 aa, Artificial Sequence
  Poly (ADP-ribose) polymerase 4 (419-429)
RVNETTEFLSK

SEQ ID NO: 27128 - protein, 10 aa, Artificial Sequence
  Ceramide synthase 5 (379-388)
RVNGHMGGSY

SEQ ID NO: 27129 - protein, 9 aa, Artificial Sequence
  Cytoplasmic dynein 1 heavy chain 1 (759-767)
RVPLAIVNK

SEQ ID NO: 27130 - protein, 10 aa, Artificial Sequence
  Protein scribble homolog (161-170)
RVPQAEGPPK

SEQ ID NO: 27131 - protein, 11 aa, Artificial Sequence
  Phosphatidylinositol 3-kinase regulatory subunit gamma (209-219)
RVQAEDLLYGK

SEQ ID NO: 27132 - protein, 10 aa, Artificial Sequence
  Large neutral amino acids transporter small subunit 1 (195-204)
RVQDAFAAAK

SEQ ID NO: 27133 - protein, 12 aa, Artificial Sequence
  ATPase family AAA domain-containing protein 3A (605-616)
RVQDAVQQHQQK

SEQ ID NO: 27134 - protein, 11 aa, Artificial Sequence
  Fibronectin type III domain-containing protein 3B (271-281)
RVQDILSGIEK

SEQ ID NO: 27135 - protein, 9 aa, Artificial Sequence
  6-phosphofructo-2-kinase/fructose-2,6-bisphosphatase 2 (228-236)
RVQDYIQSK

SEQ ID NO: 27136 - protein, 11 aa, Artificial Sequence
  Probable ATP-dependent RNA helicase DHX37 (767-777)
RVQSEEMLEDK

SEQ ID NO: 27137 - protein, 10 aa, Artificial Sequence
  Charged multivesicular body protein 1b (75-84)
RVQTAVTMGK

SEQ ID NO: 27138 - protein, 14 aa, Artificial Sequence
  28S ribosomal protein S29, mitochondrial (232-245)
RVRNATDAVGIVLK

SEQ ID NO: 27139 - protein, 9 aa, Artificial Sequence
  F-box only protein 21 (77-85)
RVRWPSLMK

SEQ ID NO: 27140 - protein, 10 aa, Artificial Sequence
  Platelet-activating factor acetylhydrolase 2, cytoplasmic (188-197)
RVSECLRVLK

SEQ ID NO: 27141 - protein, 9 aa, Artificial Sequence
  ADP-ribosylation factor GTPase-activating protein 1 (148-156)
RVSGQPQSV

SEQ ID NO: 27142 - protein, 9 aa, Artificial Sequence
  DNA polymerase delta catalytic subunit (537-545)
RVTGVPLSY

SEQ ID NO: 27143 - protein, 10 aa, Artificial Sequence
  E3 ubiquitin-protein ligase MIB2 (258-267)
RVVDIRGWDV

SEQ ID NO: 27144 - protein, 9 aa, Artificial Sequence
  NADH dehydrogenase (ubiquinone) 1 alpha subcomplex subunit 6 (77-85)
RVVDLLVIK

SEQ ID NO: 27145 - protein, 11 aa, Artificial Sequence
  Lysine-specific histone demethylase 1B (420-430)
RVWDDKSFKGV

SEQ ID NO: 27146 - protein, 11 aa, Artificial Sequence
  Coatomer subunit alpha (160-170)
RVWDISGLRKK

SEQ ID NO: 27147 - protein, 13 aa, Artificial Sequence
  ATP-binding cassette sub-family B member 8, mitochondrial (669-681)
RVWEAGTHEELLK

SEQ ID NO: 27148 - protein, 10 aa, Artificial Sequence
  Methyltransferase-like protein 8 (334-343)
RVWIQGKFQK

SEQ ID NO: 27149 - protein, 10 aa, Artificial Sequence
  Charged multivesicular body protein 1a (46-55)
RVYAENAIRK

SEQ ID NO: 27150 - protein, 9 aa, Artificial Sequence
  Neuferricin (62-70)
RVYDVSSGR

SEQ ID NO: 27151 - protein, 9 aa, Artificial Sequence
  Formin-binding protein 1-like (96-104)
RVYGELMRY

SEQ ID NO: 27152 - protein, 10 aa, Artificial Sequence
  Actin filament-associated protein 1-like 2 (535-544)
RVYLDLTPVK

SEQ ID NO: 27153 - protein, 11 aa, Artificial Sequence
  Transcription termination factor 2 (414-424)
RVYLTTQLKQK

SEQ ID NO: 27154 - protein, 9 aa, Artificial Sequence
  Follistatin-related protein 5 (344-352)
RVYPESQAR

SEQ ID NO: 27155 - protein, 11 aa, Artificial Sequence
  Serine/threonine-protein kinase pim-1 (296-306)
RVYSPPEWIRY

SEQ ID NO: 27156 - protein, 10 aa, Artificial Sequence
  Epidermal growth factor receptor kinase substrate 8 (772-781)
RVYSQITVQK

SEQ ID NO: 27157 - protein, 11 aa, Artificial Sequence
  Bifunctional 3'-phosphoadenosine 5'-phosphosulfate synthase 1 (386-396)
RVYWNDGLDQY

SEQ ID NO: 27158 - protein, 9 aa, Artificial Sequence
  ATP-binding cassette sub-family B member 6, mitochondrial (144-152)
RYREAIIKY

SEQ ID NO: 27159 - protein, 9 aa, Artificial Sequence
  Melanoma inhibitory activity protein 3 (1397-1405)
SAAEEVKTY

SEQ ID NO: 27160 - protein, 9 aa, Artificial Sequence
  Transketolase (43-51)
SAAEIMAVL

SEQ ID NO: 27161 - protein, 9 aa, Artificial Sequence
  Kinesin-like protein KIFC3 (471-479)
SAAEIYNEV

SEQ ID NO: 27162 - protein, 9 aa, Artificial Sequence
  Protein fem-1 homolog C (91-99)
SAAGHLKVV

SEQ ID NO: 27163 - protein, 9 aa, Artificial Sequence
  E3 ubiquitin-protein ligase AMFR (606-614)
SADERQRML

SEQ ID NO: 27164 - protein, 11 aa, Artificial Sequence
  Laminin subunit beta-3 (706-716)
SADPSGAFRML

SEQ ID NO: 27165 - protein, 9 aa, Artificial Sequence
  GRIP and coiled-coil domain-containing protein 2 (1284-1292)
SAEQHQRTL

SEQ ID NO: 27166 - protein, 9 aa, Artificial Sequence
  Mortality factor 4-like protein 2 (280-288)
SAEYHRKAL

SEQ ID NO: 27167 - protein, 11 aa, Artificial Sequence
  Coiled-coil domain-containing protein 77 (190-200)
SAFKADPKISK

SEQ ID NO: 27168 - protein, 11 aa, Artificial Sequence
  Versican core protein (1221-1231)
SAFKPSSAITK

SEQ ID NO: 27169 - protein, 10 aa, Artificial Sequence
  Zinc finger protein 703 (400-409)
SAHDPAGPSL

SEQ ID NO: 27170 - protein, 9 aa, Artificial Sequence
  Transcription factor 20 (608-616)
SAHEPGGSL

SEQ ID NO: 27171 - protein, 12 aa, Artificial Sequence
  Probable cation-transporting ATPase 13A3 (802-813)
SAIDPEAIPVKL

SEQ ID NO: 27172 - protein, 9 aa, Artificial Sequence
  Protein AATF (141-149)
SAKTPGFSV

SEQ ID NO: 27173 - protein, 10 aa, Artificial Sequence
  Ras-specific guanine nucleotide-releasing factor 1 (254-263)
SALEIAEQLT

SEQ ID NO: 27174 - protein, 12 aa, Artificial Sequence
  Fc receptor-like A (117-128)
SALGPPGPNREF

SEQ ID NO: 27175 - protein, 11 aa, Artificial Sequence
  Vimentin (42-52)
SALRPSTSRSL

SEQ ID NO: 27176 - protein, 13 aa, Artificial Sequence
  Vimentin (42-54)
SALRPSTSRSLYA

SEQ ID NO: 27177 - protein, 11 aa, Artificial Sequence
  Actin-related protein 2/3 complex subunit 1A (298-308)
SAMERFRNMDK

SEQ ID NO: 27178 - protein, 9 aa, Artificial Sequence
  Fatty acid synthase (2039-2047)
SAMERICEK

SEQ ID NO: 27179 - protein, 10 aa, Artificial Sequence
  Cytoplasmic dynein 1 heavy chain 1 (1505-1514)
SAMKLSPYYK

SEQ ID NO: 27180 - protein, 10 aa, Artificial Sequence
  Syntenin-1 (23-32)
SANPANPAIL

SEQ ID NO: 27181 - protein, 10 aa, Artificial Sequence
  Vacuole membrane protein 1 isoform 8 (83-92)
SAQDFASRAK

SEQ ID NO: 27182 - protein, 10 aa, Artificial Sequence
  HLA class I histocompatibility antigen, alpha chain E (339-348)
SAQGSESHSL

SEQ ID NO: 27183 - protein, 9 aa, Artificial Sequence
  ATP-dependent RNA helicase DDX54 (145-153)
SAQTGARAL

SEQ ID NO: 27184 - protein, 9 aa, Artificial Sequence
  Poly(rC)-binding protein 2 (254-262)
SAQTTSHEL

SEQ ID NO: 27185 - protein, 9 aa, Artificial Sequence
  ADP-dependent glucokinase (213-221)
SASGPHSSL

SEQ ID NO: 27186 - protein, 10 aa, Artificial Sequence
  Nodal modulator 3 (166-175)
SAVEFRQTGY

SEQ ID NO: 27187 - protein, 10 aa, Artificial Sequence
  Histone acetyltransferase type B catalytic subunit (16-25)
SAVEKKLAEY

SEQ ID NO: 27188 - protein, 9 aa, Artificial Sequence
  ADP-ribosylation factor-binding protein GGA1 (288-296)
SAVPKVMKV

SEQ ID NO: 27189 - protein, 9 aa, Artificial Sequence
  Ankyrin repeat domain-containing protein 20B (272-280)
SAVSIFHEL

SEQ ID NO: 27190 - protein, 9 aa, Artificial Sequence
  Long-chain-fatty-acid-CoA ligase 3 (66-74)
SAYRSVNSL

SEQ ID NO: 27191 - protein, 11 aa, Artificial Sequence
  Ribulose-phosphate 3-epimerase (186-196)
SEDPRSVINLL

SEQ ID NO: 27192 - protein, 10 aa, Artificial Sequence
  WD repeat and FYVE domain-containing protein 1 (43-52)
SEDRTIRVWL

SEQ ID NO: 27193 - protein, 10 aa, Artificial Sequence
  Clathrin heavy chain 1 (825-834)
SEDVIKNLIL

SEQ ID NO: 27194 - protein, 10 aa, Artificial Sequence
  Microtubule-associated protein 4 (230-239)
SEERPPAQAL

SEQ ID NO: 27195 - protein, 10 aa, Artificial Sequence
  Cortactin-binding protein 2 (232-241)
SEFDTEREQL

SEQ ID NO: 27196 - protein, 9 aa, Artificial Sequence
  Ubiquitin carboxyl-terminal hydrolase 48 (254-262)
SEFLKEEKL

SEQ ID NO: 27197 - protein, 13 aa, Artificial Sequence
  55 kDa erythrocyte membrane protein (6-18)
SEGESGGSMHTAL

SEQ ID NO: 27198 - protein, 9 aa, Artificial Sequence
  Copper transport protein ATOX1 (44-52)
SEHSMDTLL

SEQ ID NO: 27199 - protein, 13 aa, Artificial Sequence
  Ventricular zone-expressed PH domain-containing protein homolog 1 (106-118)
SEIDPLGQGNDKL

SEQ ID NO: 27200 - protein, 9 aa, Artificial Sequence
  Prolyl 3-hydroxylase OGFOD1 (290-298)
SEILLKEFL

SEQ ID NO: 27201 - protein, 9 aa, Artificial Sequence
  Nucleolar protein 10 (225-233)
SEINSLPTI

SEQ ID NO: 27202 - protein, 11 aa, Artificial Sequence
  Leucine-rich repeat LGI family member 3 (77-87)
SEIQDGAFSHL

SEQ ID NO: 27203 - protein, 9 aa, Artificial Sequence
  Serine-protein kinase ATM (707-715)
SEITNSETL

SEQ ID NO: 27204 - protein, 10 aa, Artificial Sequence
  Nuclear pore complex protein Nup50 (255-264)
SEKKTDPSSL

SEQ ID NO: 27205 - protein, 8 aa, Artificial Sequence
  Talin-1 (1958-1965)
SEKVSHVL

SEQ ID NO: 27206 - protein, 10 aa, Artificial Sequence
  Protein strawberry notch homolog 1 (911-920)
SELDVPVEIL

SEQ ID NO: 27207 - protein, 11 aa, Artificial Sequence
  Protein S100-B (31-41)
SELKELINNEL

SEQ ID NO: 27208 - protein, 11 aa, Artificial Sequence
  U2 snRNP-associated SURP motif-containing protein (401-411)
SEMSEEKRAKL

SEQ ID NO: 27209 - protein, 9 aa, Artificial Sequence
  Protein piccolo (3378-3386)
SENSQHLEL

SEQ ID NO: 27210 - protein, 10 aa, Artificial Sequence
  Mitotic checkpoint serine/threonine-protein kinase BUB1 (159-168)
SEPLHNVQVL

SEQ ID NO: 27211 - protein, 11 aa, Artificial Sequence
  Gap junction beta-1 protein (253-263)
SEQDGSLKDIL

SEQ ID NO: 27212 - protein, 12 aa, Artificial Sequence
  Transformation/transcription domain-associated protein (434-445)
SEQESGNGRDVL

SEQ ID NO: 27213 - protein, 9 aa, Artificial Sequence
  Multidrug resistance-associated protein 4 (13-21)
SETPTLQGL

SEQ ID NO: 27214 - protein, 12 aa, Artificial Sequence
  Vitamin K epoxide reductase complex subunit 1 (44-55)
SFRKVQEPQGKA

SEQ ID NO: 27215 - protein, 9 aa, Artificial Sequence
  POTE ankyrin domain family member F (855-863)
SGDGVTHTV

SEQ ID NO: 27216 - protein, 9 aa, Artificial Sequence
  Disabled homolog 2 (538-546)
SGFSQPVIF

SEQ ID NO: 27217 - protein, 14 aa, Artificial Sequence
  Heterogeneous nuclear ribonucleoprotein U-like protein 1 (662-675)
SGGGGYSQNRWGNN

SEQ ID NO: 27218 - protein, 15 aa, Artificial Sequence
  Prelamin-A/C (483-497)
SGGGSFGDNLVTRSY

SEQ ID NO: 27219 - protein, 14 aa, Artificial Sequence
  Keratin, type II cytoskeletal 1 (604-617)
SGGGSSGGSIGGRG

SEQ ID NO: 27220 - protein, 13 aa, Artificial Sequence
  Cold-inducible RNA-binding protein (148-160)
SGGYSDRSSGGSY

SEQ ID NO: 27221 - protein, 15 aa, Artificial Sequence
  Serine/threonine-protein phosphatase PP1-beta catalytic subunit (311-325)
SGRPVTPPRTANPPK

SEQ ID NO: 27222 - protein, 10 aa, Artificial Sequence
  Frataxin, mitochondrial (81-90)
SGTLGHPGSL

SEQ ID NO: 27223 - protein, 13 aa, Artificial Sequence
  Caprin-1 (663-675)
SGYQRDGYQQNFK

SEQ ID NO: 27224 - protein, 9 aa, Artificial Sequence
  Protein kinase C delta-binding protein (70-78)
SHDTTSNTL

SEQ ID NO: 27225 - protein, 10 aa, Artificial Sequence
  E3 ubiquitin-protein ligase TRIM32 (566-575)
SHFFSENEDF

SEQ ID NO: 27226 - protein, 10 aa, Artificial Sequence
  ATP-dependent RNA helicase DDX42 (307-316)
SHVRPDRQTL

SEQ ID NO: 27227 - protein, 9 aa, Artificial Sequence
  Transmembrane protein 147 (87-95)
SIDSNISLV

SEQ ID NO: 27228 - protein, 9 aa, Artificial Sequence
  Neuron navigator 2 (1236-1244)
SIDSNISSK

SEQ ID NO: 27229 - protein, 12 aa, Artificial Sequence
  Fructose-bisphosphate aldolase A (46-57)
SIGTENTEENRR

SEQ ID NO: 27230 - protein, 9 aa, Artificial Sequence
  Septin-9 (321-329)
SIHFEAYRV

SEQ ID NO: 27231 - protein, 10 aa, Artificial Sequence
  Lanosterol 14-alpha demethylase (173-182)
SIIEKETKEY

SEQ ID NO: 27232 - protein, 9 aa, Artificial Sequence
  Heterogeneous nuclear ribonucleoprotein K (401-409)
SIIGKGGQR

SEQ ID NO: 27233 - protein, 11 aa, Artificial Sequence
  Interleukin-1 receptor accessory protein (317-327)
SIKKVTSEDLK

SEQ ID NO: 27234 - protein, 11 aa, Artificial Sequence
  Ubiquitin carboxyl-terminal hydrolase 11 (519-529)
SILDRDDIFVY

SEQ ID NO: 27235 - protein, 11 aa, Artificial Sequence
  Mortality factor 4-like protein 1 (192-202)
SILEDYANYKK

SEQ ID NO: 27236 - protein, 13 aa, Artificial Sequence
  Protein transport protein Sec31A (332-344)
SIMGGSTDGLRQK

SEQ ID NO: 27237 - protein, 9 aa, Artificial Sequence
  Casein kinase I isoform delta (401-409)
SIPFEHHGK

SEQ ID NO: 27238 - protein, 10 aa, Artificial Sequence
  Protein maestro (14-23)
SIPTSQPKQK

SEQ ID NO: 27239 - protein, 10 aa, Artificial Sequence
  Inosine-5'-monophosphate dehydrogenase 1 (531-540)
SIQDKGSIQK

SEQ ID NO: 27240 - protein, 10 aa, Artificial Sequence
  NHP2-like protein 1 (118-127)
SIQQSIERLL

SEQ ID NO: 27241 - protein, 13 aa, Artificial Sequence
  ATP synthase F(0) complex subunit B1, mitochondrial (226-238)
SISTQQEKETIAK

SEQ ID NO: 27242 - protein, 12 aa, Artificial Sequence
  StAR-related lipid transfer protein 13 (339-350)
SIYDNVPGSHLY

SEQ ID NO: 27243 - protein, 12 aa, Artificial Sequence
  Carboxypeptidase Q (211-222)
SIYSPHTGIQEY

SEQ ID NO: 27244 - protein, 13 aa, Artificial Sequence
  Keratin, type I cytoskeletal 10 (148-160)
SKELTTEIDNNIE

SEQ ID NO: 27245 - protein, 9 aa, Artificial Sequence
  Receptor-interacting serine/threonine-protein kinase 1 (376-384)
SKLQDEANY

SEQ ID NO: 27246 - protein, 13 aa, Artificial Sequence
  CDK5 regulatory subunit-associated protein 2 (133-145)
SLAEAGGSEIQRV

SEQ ID NO: 27247 - protein, 9 aa, Artificial Sequence
  MICAL-like protein 2 (22-30)
SLAEFSLLK

SEQ ID NO: 27248 - protein, 11 aa, Artificial Sequence
  Wiskott-Aldrich syndrome protein family member 2 (67-77)
SLAERVDRLQV

SEQ ID NO: 27249 - protein, 8 aa, Artificial Sequence
  Nucleolar protein 11 (286-293)
SLCPDLME

SEQ ID NO: 27250 - protein, 9 aa, Artificial Sequence
  Insulin-degrading enzyme (224-232)
SLDDLTNLV

SEQ ID NO: 27251 - protein, 9 aa, Artificial Sequence
  Signal peptidase complex subunit 2 (59-67)
SLDDSAKKV

SEQ ID NO: 27252 - protein, 11 aa, Artificial Sequence
  Signal peptidase complex subunit 2 (59-69)
SLDDSAKKVLL

SEQ ID NO: 27253 - protein, 9 aa, Artificial Sequence
  Sodium/potassium-transporting ATPase subunit alpha-1 (47-55)
SLDELHRKY

SEQ ID NO: 27254 - protein, 9 aa, Artificial Sequence
  Transmembrane protein 132B (241-249)
SLDEMVVSV

SEQ ID NO: 27255 - protein, 9 aa, Artificial Sequence
  GREB1-like protein (74-82)
SLDFSNNLT

SEQ ID NO: 27256 - protein, 9 aa, Artificial Sequence
  2'-5'-oligoadenylate synthase 2 (123-131)
SLDGFTIQV

SEQ ID NO: 27257 - protein, 9 aa, Artificial Sequence
  Angio-associated migratory cell protein (93-101)
SLDPKTNTL

SEQ ID NO: 27258 - protein, 7 aa, Artificial Sequence
  Eukaryotic translation initiation factor 3 subunit C-like protein (835-841)
SLDQPTQ

SEQ ID NO: 27259 - protein, 9 aa, Artificial Sequence
  Regulator of nonsense transcripts 2 (992-1000)
SLEESIRQV

SEQ ID NO: 27260 - protein, 12 aa, Artificial Sequence
  Heterogeneous nuclear ribonucleoprotein M (536-547)
SLERMGLERMGA

SEQ ID NO: 27261 - protein, 13 aa, Artificial Sequence
  Heterogeneous nuclear ribonucleoprotein M (536-548)
SLERMGLERMGAN

SEQ ID NO: 27262 - protein, 9 aa, Artificial Sequence
  ATP-sensitive inward rectifier potassium channel 10 (186-194)
SLFDQVVKV

SEQ ID NO: 27263 - protein, 12 aa, Artificial Sequence
  Inositol 1,4,5-trisphosphate receptor type 3 (365-376)
SLFELDPTTLQK

SEQ ID NO: 27264 - protein, 10 aa, Artificial Sequence
  Utrophin (249-258)
SLFEVLPQQV

SEQ ID NO: 27265 - protein, 9 aa, Artificial Sequence
  Microtubule-associated tumor suppressor 1 (694-702)
SLFLGSASK

SEQ ID NO: 27266 - protein, 9 aa, Artificial Sequence
  V-type proton ATPase 116 kDa subunit a isoform 1 (555-563)
SLFNHIYFK

SEQ ID NO: 27267 - protein, 9 aa, Artificial Sequence
  Ventricular zone-expressed PH domain-containing protein homolog 1 (252-260)
SLFPEPLSI

SEQ ID NO: 27268 - protein, 10 aa, Artificial Sequence
  Eukaryotic translation initiation factor 3 subunit E (218-227)
SLFVFFNHPK

SEQ ID NO: 27269 - protein, 9 aa, Artificial Sequence
  Metalloproteinase inhibitor 3 (15-23)
SLGDWGAEA

SEQ ID NO: 27270 - protein, 9 aa, Artificial Sequence
  Ran GTPase-activating protein 1 (102-110)
SLGEGLITA

SEQ ID NO: 27271 - protein, 10 aa, Artificial Sequence
  Homeobox protein SEBOX (201-210)
SLGSLSDLIY

SEQ ID NO: 27272 - protein, 9 aa, Artificial Sequence
  Nuclear receptor subfamily 4 group A member 1 (492-500)
SLHSLLVDV

SEQ ID NO: 27273 - protein, 9 aa, Artificial Sequence
  Carboxypeptidase M (303-311)
SLIEYIKQV

SEQ ID NO: 27274 - protein, 10 aa, Artificial Sequence
  Zinc finger FYVE domain-containing protein 16 (160-169)
SLIGLDLSSV

SEQ ID NO: 27275 - protein, 9 aa, Artificial Sequence
  Src kinase-associated phosphoprotein 2 (47-55)
SLIKKIKDV

SEQ ID NO: 27276 - protein, 9 aa, Artificial Sequence
  Small glutamine-rich tetratricopeptide repeat-containing protein beta (33-41)
SLINNPAFI

SEQ ID NO: 27277 - protein, 9 aa, Artificial Sequence
  Anoctamin-4 (154-162)
SLINSDIIF

SEQ ID NO: 27278 - protein, 10 aa, Artificial Sequence
  Anoctamin-4 (154-163)
SLINSDIIFV

SEQ ID NO: 27279 - protein, 11 aa, Artificial Sequence
  Serine/threonine-protein kinase Sgk1 (451-461)
SLINWDDLINK

SEQ ID NO: 27280 - protein, 11 aa, Artificial Sequence
  Probable global transcription activator SNF2L1 (137-147)
SLISAGDYRHR

SEQ ID NO: 27281 - protein, 9 aa, Artificial Sequence
  Lambda-crystallin homolog (73-81)
SLISGCPNI

SEQ ID NO: 27282 - protein, 10 aa, Artificial Sequence
  Alpha-aminoadipic semialdehyde dehydrogenase (196-205)
SLISVAVTKI

SEQ ID NO: 27283 - protein, 10 aa, Artificial Sequence
  Endonuclease G, mitochondrial (288-297)
SLKAITAGSK

SEQ ID NO: 27284 - protein, 9 aa, Artificial Sequence
  Cysteine protease ATG4C (177-185)
SLKETIGKY

SEQ ID NO: 27285 - protein, 9 aa, Artificial Sequence
  DNA-directed RNA polymerase II subunit RPB11-a (99-107)
SLLEERFRV

SEQ ID NO: 27286 - protein, 9 aa, Artificial Sequence
  Nuclear receptor subfamily 4 group A member 3 (230-238)
SLLGESPSL

SEQ ID NO: 27287 - protein, 9 aa, Artificial Sequence
  Protein naked cuticle homolog 1 (158-166)
SLLHTIYEV

SEQ ID NO: 27288 - protein, 10 aa, Artificial Sequence
  IL6ST nirs variant 1 (26-35)
SLLIAKQNVT

SEQ ID NO: 27289 - protein, 9 aa, Artificial Sequence
  Protein transport protein Sec23A (156-164)
SLLPPTALV

SEQ ID NO: 27290 - protein, 10 aa, Artificial Sequence
  E3 ubiquitin-protein ligase UBR1 (683-692)
SLMDPNKFLL

SEQ ID NO: 27291 - protein, 12 aa, Artificial Sequence
  Abhydrolase domain-containing protein 2 (299-310)
SLMQIDDNVMRK

SEQ ID NO: 27292 - protein, 9 aa, Artificial Sequence
  Fatty acid synthase (1570-1578)
SLNFRDIML

SEQ ID NO: 27293 - protein, 9 aa, Artificial Sequence
  Putative segment polarity protein dishevelled homolog DVL1P1 (246-254)
SLNIITVTL

SEQ ID NO: 27294 - protein, 15 aa, Artificial Sequence
  Integrin alpha-6 (599-613)
SLPEVLPILNSDEPK

SEQ ID NO: 27295 - protein, 12 aa, Artificial Sequence
  60S ribosomal protein L38 (59-70)
SLPPGLAVKELK

SEQ ID NO: 27296 - protein, 9 aa, Artificial Sequence
  Transcription cofactor HES-6 (44-52)
SLQELRLLL

SEQ ID NO: 27297 - protein, 10 aa, Artificial Sequence
  Anaphase-promoting complex subunit 1 (60-69)
SLQEVTIHEK

SEQ ID NO: 27298 - protein, 9 aa, Artificial Sequence
  Nestin (24-32)
SLQKENQEL

SEQ ID NO: 27299 - protein, 11 aa, Artificial Sequence
  Uncharacterized protein C17orf98 (105-115)
SLQQVTGHDHY

SEQ ID NO: 27300 - protein, 9 aa, Artificial Sequence
  RING finger protein 10 (254-262)
SLSEKTWSK

SEQ ID NO: 27301 - protein, 9 aa, Artificial Sequence
  Putative ATP-dependent RNA helicase TDRD12 (1100-1108)
SLSQTPPRV

SEQ ID NO: 27302 - protein, 10 aa, Artificial Sequence
  Alpha-crystallin B chain (129-138)
SLSSDGVLTV

SEQ ID NO: 27303 - protein, 9 aa, Artificial Sequence
  PWWP domain-containing protein MUM1 (280-288)
SLTAPPAPE

SEQ ID NO: 27304 - protein, 10 aa, Artificial Sequence
  Probable ATP-dependent RNA helicase DHX40 (351-360)
SLTIDGIRYV

SEQ ID NO: 27305 - protein, 11 aa, Artificial Sequence
  Integrator complex subunit 7 (196-206)
SLVDTPKQIQL

SEQ ID NO: 27306 - protein, 10 aa, Artificial Sequence
  Transcobalamin-1 (223-232)
SLVEKILSEK

SEQ ID NO: 27307 - protein, 11 aa, Artificial Sequence
  Vacuolar protein sorting-associated protein 41 homolog (618-628)
SLYAEYDRPNL

SEQ ID NO: 27308 - protein, 11 aa, Artificial Sequence
  Spermine synthase (309-319)
SLYEEQLGRLY

SEQ ID NO: 27309 - protein, 11 aa, Artificial Sequence
  General transcription factor 3C polypeptide 3 (259-269)
SLYEQMGDHKM

SEQ ID NO: 27310 - protein, 9 aa, Artificial Sequence
  COP9 signalosome complex subunit 3 (281-289)
SLYKKNIQR

SEQ ID NO: 27311 - protein, 10 aa, Artificial Sequence
  P2X purinoceptor 7 (286-295)
SLYPGYNFRY

SEQ ID NO: 27312 - protein, 9 aa, Artificial Sequence
  Death-inducer obliterator 1 (1135-1143)
SLYSYFSSR

SEQ ID NO: 27313 - protein, 10 aa, Artificial Sequence
  Protein prune homolog 2 (269-278)
SLYTEDMTQK

SEQ ID NO: 27314 - protein, 9 aa, Artificial Sequence
  Protein argonaute-2 (566-574)
SMDAHPNRY

SEQ ID NO: 27315 - protein, 9 aa, Artificial Sequence
  Protein argonaute-1 (615-623)
SMDAHPSRY

SEQ ID NO: 27316 - protein, 9 aa, Artificial Sequence
  5,6-dihydroxyindole-2-carboxylic acid oxidase (506-514)
SMDEANQPL

SEQ ID NO: 27317 - protein, 10 aa, Artificial Sequence
  Kinesin-like protein KIF13A (63-72)
SMDESNTTKY

SEQ ID NO: 27318 - protein, 9 aa, Artificial Sequence
  Protein argonaute-4 (609-617)
SMDGHPSRY

SEQ ID NO: 27319 - protein, 9 aa, Artificial Sequence
  Serine-protein kinase ATM (2549-2557)
SMDHPHHTL

SEQ ID NO: 27320 - protein, 9 aa, Artificial Sequence
  V-type proton ATPase 116 kDa subunit a isoform 3 (340-348)
SMEEGVSAV

SEQ ID NO: 27321 - protein, 12 aa, Artificial Sequence
  RNA-binding protein EWS (350-361)
SMFGSPGGLREA

SEQ ID NO: 27322 - protein, 11 aa, Artificial Sequence
  Ribosome-binding protein 1 (32-42)
SMKETSYEEAL

SEQ ID NO: 27323 - protein, 10 aa, Artificial Sequence
  Caprin-1 (376-385)
SMLDFENQTL

SEQ ID NO: 27324 - protein, 9 aa, Artificial Sequence
  Protein GREB1 (500-508)
SMLGEEIQL

SEQ ID NO: 27325 - protein, 9 aa, Artificial Sequence
  Cystine/glutamate transporter (330-338)
SMNGGVFAV

SEQ ID NO: 27326 - protein, 10 aa, Artificial Sequence
  Myosin-10 (371-380)
SMPENTVAQK

SEQ ID NO: 27327 - protein, 9 aa, Artificial Sequence
  T-complex protein 1 subunit alpha (155-163)
SMSSKIIGI

SEQ ID NO: 27328 - protein, 10 aa, Artificial Sequence
  Liprin-alpha-1 (1169-1178)
SMSSPSMQPK

SEQ ID NO: 27329 - protein, 9 aa, Artificial Sequence
  Protein PAT1 homolog 1 (499-507)
SMYDNLRGK

SEQ ID NO: 27330 - protein, 15 aa, Artificial Sequence
  Heterogeneous nuclear ribonucleoprotein A1-like 2 (99-113)
SNFGGGGSYNDFGNY

SEQ ID NO: 27331 - protein, 9 aa, Artificial Sequence
  Catenin beta-1 (605-613)
SPIENIQRV

SEQ ID NO: 27332 - protein, 9 aa, Artificial Sequence
  Pleckstrin homology-like domain family A member 2 (42-50)
SPRARPKEL

SEQ ID NO: 27333 - protein, 10 aa, Artificial Sequence
  Clathrin heavy chain 1 (1427-1436)
SPRLDHTRAV

SEQ ID NO: 27334 - protein, 13 aa, Artificial Sequence
  Arginine/serine-rich protein 1 (18-30)
SPSTSRSGGSSRL

SEQ ID NO: 27335 - protein, 9 aa, Artificial Sequence
  Disabled homolog 2 (471-479)
SPTGQPTAL

SEQ ID NO: 27336 - protein, 15 aa, Artificial Sequence
  Transgelin-2 (185-199)
SQAGMTGYGMPRQIL

SEQ ID NO: 27337 - protein, 9 aa, Artificial Sequence
  Transmembrane protein 8A (50-58)
SQAPQRLSF

SEQ ID NO: 27338 - protein, 9 aa, Artificial Sequence
  Serine/threonine-protein phosphatase 4 regulatory subunit 2 (5-13)
SQFKGYFIF

SEQ ID NO: 27339 - protein, 12 aa, Artificial Sequence
  Copine-8 (260-271)
SQFNVYEVVNPK

SEQ ID NO: 27340 - protein, 10 aa, Artificial Sequence
  Transmembrane protein 131 (402-411)
SQFSGKITVK

SEQ ID NO: 27341 - protein, 9 aa, Artificial Sequence
  Ragulator complex protein LAMTOR1 (73-81)
SQGMEQHEY

SEQ ID NO: 27342 - protein, 13 aa, Artificial Sequence
  Catenin alpha-1 (268-280)
SQHQGGGGGELAY

SEQ ID NO: 27343 - protein, 9 aa, Artificial Sequence
  Protein NPAT (417-425)
SQISTSIQK

SEQ ID NO: 27344 - protein, 9 aa, Artificial Sequence
  A-kinase anchor protein 9 (687-695)
SQKIETMQF

SEQ ID NO: 27345 - protein, 11 aa, Artificial Sequence
  TSC22 domain family protein 1 (1018-1028)
SQLEQENNLLK

SEQ ID NO: 27346 - protein, 9 aa, Artificial Sequence
  Tubulin-specific chaperone E (124-132)
SQLSKLQEV

SEQ ID NO: 27347 - protein, 10 aa, Artificial Sequence
  Phosphatidylinositol-binding clathrin assembly protein (520-529)
SQNQNLPVAK

SEQ ID NO: 27348 - protein, 10 aa, Artificial Sequence
  Heat shock protein HSP 90-alpha (575-584)
SQNRKKLSEL

SEQ ID NO: 27349 - protein, 9 aa, Artificial Sequence
  Clathrin interactor 1 (459-467)
SQNTDMVQK

SEQ ID NO: 27350 - protein, 9 aa, Artificial Sequence
  Rotatin (918-926)
SQQSSLLTV

SEQ ID NO: 27351 - protein, 15 aa, Artificial Sequence
  Cold-inducible RNA-binding protein (146-160)
SQSGGYSDRSSGGSY

SEQ ID NO: 27352 - protein, 8 aa, Artificial Sequence
  Neuron navigator 2 (999-1006)
SQVERNSL

SEQ ID NO: 27353 - protein, 10 aa, Artificial Sequence
  Microtubule-actin cross-linking factor 1 (2589-2598)
SQVQKELQSI

SEQ ID NO: 27354 - protein, 10 aa, Artificial Sequence
  Rho GTPase-activating protein 5 (922-931)
SQYHRQTEVF

SEQ ID NO: 27355 - protein, 10 aa, Artificial Sequence
  Histone-lysine N-methyltransferase setd3 (208-217)
SQYKNTARQY

SEQ ID NO: 27356 - protein, 9 aa, Artificial Sequence
  Protein unc-45 homolog A (578-586)
SRLEERSVL

SEQ ID NO: 27357 - protein, 17 aa, Artificial Sequence
  ELL-associated factor 1 (232-248)
SRPAVANGTSRPQGSNQ

SEQ ID NO: 27358 - protein, 17 aa, Artificial Sequence
  Cold-inducible RNA-binding protein (144-160)
SRSQSGGYSDRSSGGSY

SEQ ID NO: 27359 - protein, 9 aa, Artificial Sequence
  Phosphatase and actin regulator (216-224)
SSAKPGPAL

SEQ ID NO: 27360 - protein, 10 aa, Artificial Sequence
  LIM domain-binding protein 3 (265-274)
SSAPATHTSY

SEQ ID NO: 27361 - protein, 9 aa, Artificial Sequence
  Serine incorporator 5 (337-345)
SSDALQGRY

SEQ ID NO: 27362 - protein, 10 aa, Artificial Sequence
  F-box-like/WD repeat-containing protein TBL1XR1 (4-13)
SSDEVNFLVY

SEQ ID NO: 27363 - protein, 10 aa, Artificial Sequence
  Poly (ADP-ribose) polymerase 1 (4-13)
SSDKLYRVEY

SEQ ID NO: 27364 - protein, 9 aa, Artificial Sequence
  ATP-dependent RNA helicase DDX18 (602-610)
SSDSRQFSH

SEQ ID NO: 27365 - protein, 9 aa, Artificial Sequence
  Heterogeneous nuclear ribonucleoprotein H2 (441-449)
SSDYQSNLA

SEQ ID NO: 27366 - protein, 11 aa, Artificial Sequence
  Tyrosinase (146-156)
SSDYVIPIGTY

SEQ ID NO: 27367 - protein, 9 aa, Artificial Sequence
  Nesprin-2 (2105-2113)
SSEAPLVQK

SEQ ID NO: 27368 - protein, 11 aa, Artificial Sequence
  Osteopontin (26-36)
SSEEKQLYNKY

SEQ ID NO: 27369 - protein, 9 aa, Artificial Sequence
  Carbohydrate sulfotransferase 11 (323-331)
SSEHQTQLY

SEQ ID NO: 27370 - protein, 10 aa, Artificial Sequence
  Serine/threonine-protein kinase PLK2 (666-675)
SSELKNRMEY

SEQ ID NO: 27371 - protein, 9 aa, Artificial Sequence
  Neuron navigator 2 (1837-1845)
SSFKQAFGK

SEQ ID NO: 27372 - protein, 9 aa, Artificial Sequence
  Protein GREB1 (296-304)
SSFRPLLSK

SEQ ID NO: 27373 - protein, 14 aa, Artificial Sequence
  Keratin, type I cytoskeletal 10 (370-383)
SSGSVGESSSKGPR

SEQ ID NO: 27374 - protein, 8 aa, Artificial Sequence
  Olfactory receptor 52E1 (66-73)
SSIDPGLS

SEQ ID NO: 27375 - protein, 9 aa, Artificial Sequence
  E3 ubiquitin-protein ligase HUWE1 (114-122)
SSIEHLTTL

SEQ ID NO: 27376 - protein, 9 aa, Artificial Sequence
  Zinc finger FYVE domain-containing protein 16 (841-849)
SSIPSPATL

SEQ ID NO: 27377 - protein, 12 aa, Artificial Sequence
  HBS1-like protein (521-532)
SSKLGKNSNFAK

SEQ ID NO: 27378 - protein, 11 aa, Artificial Sequence
  Zinc finger protein 43 (404-414)
SSKLTEHKLTH

SEQ ID NO: 27379 - protein, 11 aa, Artificial Sequence
  RalBP1-associated Eps domain-containing protein 1 (509-519)
SSLDMNRTFTV

SEQ ID NO: 27380 - protein, 11 aa, Artificial Sequence
  Chromodomain-helicase-DNA-binding protein 9 (261-271)
SSLEENLLHQV

SEQ ID NO: 27381 - protein, 11 aa, Artificial Sequence
  Spectrin beta chain, non-erythrocytic 1 (1556-1566)
SSLSAEAIRQR

SEQ ID NO: 27382 - protein, 11 aa, Artificial Sequence
  Eukaryotic translation initiation factor 3 subunit C-like protein (15-25)
SSLSGEELVTK

SEQ ID NO: 27383 - protein, 10 aa, Artificial Sequence
  COMM domain-containing protein 10 (123-132)
SSMGQETVEK

SEQ ID NO: 27384 - protein, 11 aa, Artificial Sequence
  Liprin-alpha-1 (1168-1178)
SSMSSPSMQPK

SEQ ID NO: 27385 - protein, 9 aa, Artificial Sequence
  Exostosin-2 (52-60)
SSNDWNVEK

SEQ ID NO: 27386 - protein, 14 aa, Artificial Sequence
  Membrane magnesium transporter 1 (109-122)
SSNQDALSSNTSLK

SEQ ID NO: 27387 - protein, 17 aa, Artificial Sequence
  Vimentin (55-71)
SSPGGVYATRSSAVRLR

SEQ ID NO: 27388 - protein, 9 aa, Artificial Sequence
  Coatomer subunit gamma-1 (297-305)
SSPKAALRY

SEQ ID NO: 27389 - protein, 9 aa, Artificial Sequence
  RING finger protein 10 (486-494)
SSQQEPITK

SEQ ID NO: 27390 - protein, 9 aa, Artificial Sequence
  FERM domain-containing protein 4A (829-837)
SSQYRIKEY

SEQ ID NO: 27391 - protein, 13 aa, Artificial Sequence
  Chondroitin sulfate proteoglycan 4 (1608-1620)
SSSAGTDPQLLLY

SEQ ID NO: 27392 - protein, 9 aa, Artificial Sequence
  Ankyrin-2 (960-968)
SSSPIHSGF

SEQ ID NO: 27393 - protein, 12 aa, Artificial Sequence
  Reticulon-4 (429-440)
SSSPLEASSVNY

SEQ ID NO: 27394 - protein, 9 aa, Artificial Sequence
  Histone acetyltransferase KAT6A (999-1007)
SSSPPILTK

SEQ ID NO: 27395 - protein, 9 aa, Artificial Sequence
  Heterogeneous nuclear ribonucleoprotein U-like protein 1 (97-105)
SSSRPIVQK

SEQ ID NO: 27396 - protein, 14 aa, Artificial Sequence
  Retinoic acid-induced protein 1 (223-236)
SSSVQGGGQGAHSY

SEQ ID NO: 27397 - protein, 12 aa, Artificial Sequence
  Helicase-like transcription factor (446-457)
SSVPTTKKKMLK

SEQ ID NO: 27398 - protein, 9 aa, Artificial Sequence
  Loss of heterozygosity 12 chromosomal region 1 protein (18-26)
SSVTPSPAK

SEQ ID NO: 27399 - protein, 9 aa, Artificial Sequence
  Ral GTPase-activating protein subunit beta (647-655)
SSYDKPITF

SEQ ID NO: 27400 - protein, 9 aa, Artificial Sequence
  Protein kinase C and casein kinase substrate in neurons protein 2 (345-353)
SSYEKTQSY

SEQ ID NO: 27401 - protein, 9 aa, Artificial Sequence
  CD99 antigen-like protein 2 (60-68)
SSYISYQQK

SEQ ID NO: 27402 - protein, 9 aa, Artificial Sequence
  U4/U6 small nuclear ribonucleoprotein Prp31 (226-234)
STAAKIMGV

SEQ ID NO: 27403 - protein, 14 aa, Artificial Sequence
  Heterogeneous nuclear ribonucleoprotein H (363-376)
STAGASGGAYEHRY

SEQ ID NO: 27404 - protein, 13 aa, Artificial Sequence
  Heterogeneous nuclear ribonucleoprotein H (363-375)
STAGASGGAYGSQ

SEQ ID NO: 27405 - protein, 9 aa, Artificial Sequence
  Complement component 1 Q subcomponent-binding protein, mitochondrial (175-183)
STALEHQEY

SEQ ID NO: 27406 - protein, 10 aa, Artificial Sequence
  JmjC domain-containing protein 8 (89-98)
STANTYSYHK

SEQ ID NO: 27407 - protein, 12 aa, Artificial Sequence
  Transcription initiation factor TFIID subunit 6 (584-595)
STAPSGPGSVQK

SEQ ID NO: 27408 - protein, 10 aa, Artificial Sequence
  IQ motif and SEC7 domain-containing protein 2 (10-19)
STASHTLHQY

SEQ ID NO: 27409 - protein, 9 aa, Artificial Sequence
  116 kDa U5 small nuclear ribonucleoprotein component (483-491)
STDDGVQFH

SEQ ID NO: 27410 - protein, 8 aa, Artificial Sequence
  Neuropilin-2 (829-836)
STDKEKSW

SEQ ID NO: 27411 - protein, 10 aa, Artificial Sequence
  Immunoglobulin superfamily member 3 (124-133)
STDKQYFGSY

SEQ ID NO: 27412 - protein, 10 aa, Artificial Sequence
  Transcription initiation factor TFIID subunit 7-like (113-122)
STDPNIVRKK

SEQ ID NO: 27413 - protein, 11 aa, Artificial Sequence
  Transcription factor HES-1 (101-111)
STDPSVLGKYR

SEQ ID NO: 27414 - protein, 13 aa, Artificial Sequence
  RNA-binding protein FUS (44-56)
STDTSGYGQSSYS

SEQ ID NO: 27415 - protein, 10 aa, Artificial Sequence
  Latent-transforming growth factor beta-binding protein 2 (1572-1581)
STEDLPDHDI

SEQ ID NO: 27416 - protein, 11 aa, Artificial Sequence
  Baculoviral IAP repeat-containing protein 6 (2019-2029)
STEQLRTIIRY

SEQ ID NO: 27417 - protein, 9 aa, Artificial Sequence
  Cathepsin L1 (287-295)
STESDNNKY

SEQ ID NO: 27418 - protein, 14 aa, Artificial Sequence
  DNA-dependent protein kinase catalytic subunit (1861-1874)
STFDTQITKKMGYY

SEQ ID NO: 27419 - protein, 11 aa, Artificial Sequence
  Zinc finger protein 280B (174-184)
STFEVNSINPK

SEQ ID NO: 27420 - protein, 9 aa, Artificial Sequence
  Brain-specific angiogenesis inhibitor 1-associated protein 2-like protein 1 (460-468)
STFKAPASK

SEQ ID NO: 27421 - protein, 10 aa, Artificial Sequence
  Sex comb on midleg-like protein 4 (11-20)
STFNHRGSLH

SEQ ID NO: 27422 - protein, 9 aa, Artificial Sequence
  Transmembrane emp24 domain-containing protein 3 (107-115)
STFSHKTVY

SEQ ID NO: 27423 - protein, 9 aa, Artificial Sequence
  Alstrom syndrome protein 1 (1095-1103)
STFYSQREK

SEQ ID NO: 27424 - protein, 10 aa, Artificial Sequence
  Protein FAM91A1 (429-438)
STGEGEAQRY

SEQ ID NO: 27425 - protein, 9 aa, Artificial Sequence
  N-acetylglucosamine-1-phosphodiester alpha-N-acetylglucosaminidase (4-12)
STGRWLLLR

SEQ ID NO: 27426 - protein, 9 aa, Artificial Sequence
  Vacuolar protein sorting-associated protein 16 homolog (322-330)
STHEFLHEV

SEQ ID NO: 27427 - protein, 9 aa, Artificial Sequence
  Bifunctional lysine-specific demethylase and histidyl-hydroxylase MINA (251-259)
STHVTISTY

SEQ ID NO: 27428 - protein, 10 aa, Artificial Sequence
  Clathrin interactor 1 (210-219)
STIDDTISKF

SEQ ID NO: 27429 - protein, 9 aa, Artificial Sequence
  Prolyl 4-hydroxylase subunit alpha-1 (200-208)
STIDKVSVL

SEQ ID NO: 27430 - protein, 10 aa, Artificial Sequence
  EPB41 protein (372-381)
STIGFKLPSY

SEQ ID NO: 27431 - protein, 9 aa, Artificial Sequence
  Calcium-independent phospholipase A2-gamma (310-318)
STKQSIANF

SEQ ID NO: 27432 - protein, 9 aa, Artificial Sequence
  Kanadaptin (547-555)
STLDGVSRK

SEQ ID NO: 27433 - protein, 10 aa, Artificial Sequence
  Serologically defined colon cancer antigen 8 (8-17)
STLEEILGQY

SEQ ID NO: 27434 - protein, 9 aa, Artificial Sequence
  Serine-protein kinase ATM (934-942)
STLEPTKSL

SEQ ID NO: 27435 - protein, 11 aa, Artificial Sequence
  DNA-directed RNA polymerase I subunit RPA1 (376-386)
STLPGQSLIDK

SEQ ID NO: 27436 - protein, 9 aa, Artificial Sequence
  Myb-related protein B (600-608)
STLPKSLSL

SEQ ID NO: 27437 - protein, 10 aa, Artificial Sequence
  Zinc finger protein 212 (21-30)
STLPSQATEK

SEQ ID NO: 27438 - protein, 13 aa, Artificial Sequence
  Myelin basic protein (20-32)
STMDHARHGFLPR

SEQ ID NO: 27439 - protein, 9 aa, Artificial Sequence
  Coatomer subunit gamma-1 (134-142)
STMLQAIER

SEQ ID NO: 27440 - protein, 9 aa, Artificial Sequence
  SHC SH2 domain-binding protein 1 (299-307)
STMMAGLLR

SEQ ID NO: 27441 - protein, 9 aa, Artificial Sequence
  Forkhead box protein O1 (544-552)
STMPHTSGM

SEQ ID NO: 27442 - protein, 9 aa, Artificial Sequence
  Transmembrane protein 248 (87-95)
STMTSGQAR

SEQ ID NO: 27443 - protein, 9 aa, Artificial Sequence
  Calcium uptake protein 1, mitochondrial (122-130)
STPDKIFRY

SEQ ID NO: 27444 - protein, 10 aa, Artificial Sequence
  C-Jun-amino-terminal kinase-interacting protein 4 (350-359)
STPTKGIENK

SEQ ID NO: 27445 - protein, 9 aa, Artificial Sequence
  Transcription elongation factor A protein 1 (135-143)
STSDSVRLK

SEQ ID NO: 27446 - protein, 10 aa, Artificial Sequence
  LisH domain-containing protein ARMC9 (382-391)
STSDVVRQYM

SEQ ID NO: 27447 - protein, 11 aa, Artificial Sequence
  Endoplasmin (187-197)
STSELIGQFGV

SEQ ID NO: 27448 - protein, 9 aa, Artificial Sequence
  Enhancer of mRNA-decapping protein 4 (165-173)
STSERTLLK

SEQ ID NO: 27449 - protein, 9 aa, Artificial Sequence
  Versican core protein (1942-1950)
STVSHPIAK

SEQ ID NO: 27450 - protein, 9 aa, Artificial Sequence
  E3 ubiquitin-protein ligase ZNRF1 (95-103)
STYAHGNGY

SEQ ID NO: 27451 - protein, 13 aa, Artificial Sequence
  Epithelial discoidin domain-containing receptor 1 (213-225)
STYDGHTVGGLQY

SEQ ID NO: 27452 - protein, 10 aa, Artificial Sequence
  Regulator of microtubule dynamics protein 1 (239-248)
STYEKALGYF

SEQ ID NO: 27453 - protein, 9 aa, Artificial Sequence
  Zinc finger protein 627 (490-498)
STYFRVHEK

SEQ ID NO: 27454 - protein, 11 aa, Artificial Sequence
  Heat shock protein HSP 90-alpha (724-734)
STYGWTANMER

SEQ ID NO: 27455 - protein, 9 aa, Artificial Sequence
  Phosphomevalonate kinase (66-74)
STYKEAFRK

SEQ ID NO: 27456 - protein, 11 aa, Artificial Sequence
  Acid ceramidase (33-43)
STYPPSGPTYR

SEQ ID NO: 27457 - protein, 11 aa, Artificial Sequence
  Mitochondrial basic amino acids transporter (140-150)
STYPVDVVKSR

SEQ ID NO: 27458 - protein, 10 aa, Artificial Sequence
  Protein tweety homolog 2 (519-528)
SVADEHLRHY

SEQ ID NO: 27459 - protein, 11 aa, Artificial Sequence
  BMP-2-inducible protein kinase (599-609)
SVADKEAIANF

SEQ ID NO: 27460 - protein, 9 aa, Artificial Sequence
  Adenomatous polyposis coli protein 2 (774-782)
SVASKALQK

SEQ ID NO: 27461 - protein, 11 aa, Artificial Sequence
  Dolichyl-diphosphooligosaccharide-proteinosyltransferase subunit 2 (312-322)
SVASRATVLQK

SEQ ID NO: 27462 - protein, 10 aa, Artificial Sequence
  DNA-directed RNA polymerase III subunit RPC5 (347-356)
SVAVLRGIQK

SEQ ID NO: 27463 - protein, 9 aa, Artificial Sequence
  Epididymal secretory protein E1 (29-37)
SVDGVIKEV

SEQ ID NO: 27464 - protein, 11 aa, Artificial Sequence
  Chromodomain-helicase-DNA-binding protein 4 (628-638)
SVDKKGHVHYL

SEQ ID NO: 27465 - protein, 10 aa, Artificial Sequence
  U3 small nucleolar ribonucleoprotein protein MPP10 (594-603)
SVDQAGKYSK

SEQ ID NO: 27466 - protein, 10 aa, Artificial Sequence
  Nucleolar protein 11 (28-37)
SVDRKFISLM

SEQ ID NO: 27467 - protein, 10 aa, Artificial Sequence
  Peroxisomal multifunctional enzyme type 2 (75-84)
SVEEGEKVVK

SEQ ID NO: 27468 - protein, 11 aa, Artificial Sequence
  Cytochrome c oxidase subunit 7C, mitochondrial (30-40)
SVENKWSLLAK

SEQ ID NO: 27469 - protein, 11 aa, Artificial Sequence
  Histone acetyltransferase KAT7 (249-259)
SVFEVDGKKNK

SEQ ID NO: 27470 - protein, 12 aa, Artificial Sequence
  Receptor-type tyrosine-protein phosphatase zeta (1032-1043)
SVFGDDNKALSK

SEQ ID NO: 27471 - protein, 13 aa, Artificial Sequence
  Calcium-binding mitochondrial carrier protein SCaMC-2 (37-49)
SVFIPSQEFSTYR

SEQ ID NO: 27472 - protein, 10 aa, Artificial Sequence
  LIX1-like protein (121-130)
SVFNEHPSRR

SEQ ID NO: 27473 - protein, 9 aa, Artificial Sequence
  Ras-associated and pleckstrin homology domains-containing protein 1 (627-635)
SVFSEAWKR

SEQ ID NO: 27474 - protein, 12 aa, Artificial Sequence
  Formin-1 (1148-1159)
SVFSEGITSLHR

SEQ ID NO: 27475 - protein, 9 aa, Artificial Sequence
  Transcription activator BRG1 (1587-1595)
SVFTSVRQK

SEQ ID NO: 27476 - protein, 11 aa, Artificial Sequence
  Ras-related protein Rab-6B (23-33)
SVGKTSLITRF

SEQ ID NO: 27477 - protein, 9 aa, Artificial Sequence
  Rho guanine nucleotide exchange factor 17 (885-893)
SVIDTASKY

SEQ ID NO: 27478 - protein, 9 aa, Artificial Sequence
  Transmembrane emp24 domain-containing protein 7 (151-159)
SVIDYQTHF

SEQ ID NO: 27479 - protein, 10 aa, Artificial Sequence
  BTB/POZ domain-containing protein 9 (367-376)
SVIEGVSRSR

SEQ ID NO: 27480 - protein, 10 aa, Artificial Sequence
  Protein dopey-2 (19-28)
SVIEKALRNF

SEQ ID NO: 27481 - protein, 9 aa, Artificial Sequence
  Inactive phospholipase C-like protein 1 (372-380)
SVIEVINKF

SEQ ID NO: 27482 - protein, 9 aa, Artificial Sequence
  Carbohydrate sulfotransferase 10 (278-286)
SVIGHHETL

SEQ ID NO: 27483 - protein, 9 aa, Artificial Sequence
  E3 ubiquitin-protein ligase RBBP6 (1347-1355)
SVIKNVSTK

SEQ ID NO: 27484 - protein, 10 aa, Artificial Sequence
  FERM domain-containing protein 6 (60-69)
SVIQNNEHVY

SEQ ID NO: 27485 - protein, 10 aa, Artificial Sequence
  Vacuolar protein sorting-associated protein 11 homolog (769-778)
SVIRDYLVQK

SEQ ID NO: 27486 - protein, 10 aa, Artificial Sequence
  Choline kinase alpha (114-123)
SVIRGGLSNM

SEQ ID NO: 27487 - protein, 11 aa, Artificial Sequence
  Lipid phosphate phosphatase-related protein type 3 (109-119)
SVISDTTKLLK

SEQ ID NO: 27488 - protein, 10 aa, Artificial Sequence
  E3 ubiquitin-protein ligase MYCBP2 (613-622)
SVISKDGELY

SEQ ID NO: 27489 - protein, 11 aa, Artificial Sequence
  ATPase family AAA domain-containing protein 2 (1033-1043)
SVISKIDLHKY

SEQ ID NO: 27490 - protein, 9 aa, Artificial Sequence
  Pro-interleukin-16 (212-220)
SVISNIVLM

SEQ ID NO: 27491 - protein, 10 aa, Artificial Sequence
  Dolichyl-diphosphooligosaccharide-proteinosyltransferase subunit DAD1 (7-16)
SVISRFLEEY

SEQ ID NO: 27492 - protein, 10 aa, Artificial Sequence
  Fanconi anemia group A protein (283-292)
SVISTDPLKR

SEQ ID NO: 27493 - protein, 9 aa, Artificial Sequence
  Vacuolar protein sorting-associated protein 13C (3201-3209)
SVITRFNEY

SEQ ID NO: 27494 - protein, 9 aa, Artificial Sequence
  Acyl-CoA dehydrogenase family member 9, mitochondrial (237-245)
SVKDKITAF

SEQ ID NO: 27495 - protein, 14 aa, Artificial Sequence
  Ran-specific GTPase-activating protein (187-200)
SVKEETKEDAEEKQ

SEQ ID NO: 27496 - protein, 14 aa, Artificial Sequence
  39S ribosomal protein L48, mitochondrial (94-107)
SVKEHTEEDFKGRF

SEQ ID NO: 27497 - protein, 9 aa, Artificial Sequence
  CTP synthase 1 (225-233)
SVKEKISMF

SEQ ID NO: 27498 - protein, 9 aa, Artificial Sequence
  Amyloid protein-binding protein 2 (95-103)
SVLAYSFSR

SEQ ID NO: 27499 - protein, 11 aa, Artificial Sequence
  Cytoplasmic dynein 1 heavy chain 1 (2317-2327)
SVLDDNKLLTL

SEQ ID NO: 27500 - protein, 9 aa, Artificial Sequence
  Interferon-induced GTP-binding protein Mx1 (85-93)
SVLEALSGV

SEQ ID NO: 27501 - protein, 12 aa, Artificial Sequence
  Protein fem-1 homolog B (414-425)
SVLEIEQSMNRV

SEQ ID NO: 27502 - protein, 9 aa, Artificial Sequence
  Zinc finger MYM-type protein 6 (648-656)
SVLKGAVTK

SEQ ID NO: 27503 - protein, 9 aa, Artificial Sequence
  Pre-rRNA-processing protein TSR1 homolog (547-555)
SVLNMVVRR

SEQ ID NO: 27504 - protein, 10 aa, Artificial Sequence
  Protein tweety homolog 3 (286-295)
SVLSGDILQY

SEQ ID NO: 27505 - protein, 9 aa, Artificial Sequence
  Interleukin-1 receptor-associated kinase 1 (94-102)
SVLWPWINR

SEQ ID NO: 27506 - protein, 12 aa, Artificial Sequence
  Heat shock 70 kDa protein 14 (206-217)
SVMEVNSGIYRV

SEQ ID NO: 27507 - protein, 11 aa, Artificial Sequence
  Synaptonemal complex protein SC65 (327-337)
SVMQQNLVYYR

SEQ ID NO: 27508 - protein, 9 aa, Artificial Sequence
  DNA replication licensing factor MCM5 (417-425)
SVMRDPSSR

SEQ ID NO: 27509 - protein, 10 aa, Artificial Sequence
  V-type proton ATPase 16 kDa proteolipid subunit (45-54)
SVMRPEQIMK

SEQ ID NO: 27510 - protein, 9 aa, Artificial Sequence
  Propionyl-CoA carboxylase beta chain, mitochondrial (34-42)
SVNERIENK

SEQ ID NO: 27511 - protein, 12 aa, Artificial Sequence
  A-kinase-interacting protein 1 (106-117)
SVPEEGGATHVY

SEQ ID NO: 27512 - protein, 12 aa, Artificial Sequence
  Melanocyte protein PMEL (633-644)
SVPQLPHSSSHW

SEQ ID NO: 27513 - protein, 10 aa, Artificial Sequence
  Nuclear distribution protein nudE homolog 1 (211-220)
SVPSTPIAHR

SEQ ID NO: 27514 - protein, 10 aa, Artificial Sequence
  Krueppel-like factor 5 (213-222)
SVPTQQGHLY

SEQ ID NO: 27515 - protein, 12 aa, Artificial Sequence
  Retinoic acid-induced protein 1 (225-236)
SVQGGGQGAHSY

SEQ ID NO: 27516 - protein, 11 aa, Artificial Sequence
  Bcl-2-related protein A1 (43-53)
SVQKEVEKNLK

SEQ ID NO: 27517 - protein, 9 aa, Artificial Sequence
  UDP-glucose 4-epimerase (97-105)
SVQKPLDYY

SEQ ID NO: 27518 - protein, 9 aa, Artificial Sequence
  40S ribosomal protein S16 (9-17)
SVQVFGRKK

SEQ ID NO: 27519 - protein, 9 aa, Artificial Sequence
  Serine/threonine-protein kinase 4 (109-117)
SVSDIIRLR

SEQ ID NO: 27520 - protein, 9 aa, Artificial Sequence
  Zinc transporter ZIP6 (243-251)
SVSEPRKGF

SEQ ID NO: 27521 - protein, 10 aa, Artificial Sequence
  MICOS complex subunit MIC60 (113-122)
SVSEVMKESK

SEQ ID NO: 27522 - protein, 12 aa, Artificial Sequence
  CDC42 small effector protein 2 (51-62)
SVSSIQNQMQSK

SEQ ID NO: 27523 - protein, 9 aa, Artificial Sequence
  Vimentin (5-13)
SVSSSSYRR

SEQ ID NO: 27524 - protein, 9 aa, Artificial Sequence
  Shootin-1 (9-17)
SVTKTALNK

SEQ ID NO: 27525 - protein, 11 aa, Artificial Sequence
  LON peptidase N-terminal domain and RING finger protein 2 (607-617)
SVVDAIGISRF

SEQ ID NO: 27526 - protein, 9 aa, Artificial Sequence
  Phosphatidylinositol 3-kinase regulatory subunit beta (397-405)
SVVDLINHY

SEQ ID NO: 27527 - protein, 9 aa, Artificial Sequence
  GRAM domain-containing protein 1A (439-447)
SVVETQTLF

SEQ ID NO: 27528 - protein, 10 aa, Artificial Sequence
  Unconventional myosin-VI (74-83)
SVVGGFVSHY

SEQ ID NO: 27529 - protein, 11 aa, Artificial Sequence
  Elongator complex protein 1 (1171-1181)
SVVSGSEMSGK

SEQ ID NO: 27530 - protein, 11 aa, Artificial Sequence
  DNA dC-dU-editing enzyme APOBEC-3C (46-56)
SVVSWKTGVFR

SEQ ID NO: 27531 - protein, 9 aa, Artificial Sequence
  Centrosomal protein of 131 kDa (47-55)
SVVTGSEQK

SEQ ID NO: 27532 - protein, 9 aa, Artificial Sequence
  Discoidin domain-containing receptor 2 (215-223)
SVYDGAVGY

SEQ ID NO: 27533 - protein, 10 aa, Artificial Sequence
  Exocyst complex component 6B (39-48)
SVYDGEEHGR

SEQ ID NO: 27534 - protein, 13 aa, Artificial Sequence
  Serum paraoxonase/arylesterase 2 (334-346)
SVYDGKLLIGTLY

SEQ ID NO: 27535 - protein, 10 aa, Artificial Sequence
  DNA-binding protein RFX7 (1307-1316)
SVYEFQTPSY

SEQ ID NO: 27536 - protein, 10 aa, Artificial Sequence
  Far upstream element-binding protein 3 (77-86)
SVYGYGVQKR

SEQ ID NO: 27537 - protein, 11 aa, Artificial Sequence
  Nuclear cap-binding protein subunit 1 (280-290)
SVYPMPRVIFR

SEQ ID NO: 27538 - protein, 11 aa, Artificial Sequence
  Inositol hexakisphosphate and diphosphoinositol-pentakisphosphate kinase 2 (220-230)
SVYSPESNVRK

SEQ ID NO: 27539 - protein, 10 aa, Artificial Sequence
  Golgi resident protein GCP60 (519-528)
SVYYRVYYTR

SEQ ID NO: 27540 - protein, 9 aa, Artificial Sequence
  T-box transcription factor TBX2 (536-544)
TAAPFPFHL

SEQ ID NO: 27541 - protein, 11 aa, Artificial Sequence
  Transducin beta-like protein 3 (197-207)
TADHNLLLYEA

SEQ ID NO: 27542 - protein, 9 aa, Artificial Sequence
  Protein bicaudal D homolog 2 (465-473)
TAEVALANL

SEQ ID NO: 27543 - protein, 9 aa, Artificial Sequence
  Unconventional myosin-X (353-361)
TALGRSAEL

SEQ ID NO: 27544 - protein, 9 aa, Artificial Sequence
  Homeodomain-interacting protein kinase 3 (308-316)
TALKKLKSL

SEQ ID NO: 27545 - protein, 9 aa, Artificial Sequence
  Protein S100-A1 (7-15)
TAMETLINV

SEQ ID NO: 27546 - protein, 11 aa, Artificial Sequence
  Ankycorbin (72-82)
TAQDTTGHSAL

SEQ ID NO: 27547 - protein, 16 aa, Artificial Sequence
  Presequence protease, mitochondrial (707-722)
TAQELANGIPDSGHLY

SEQ ID NO: 27548 - protein, 7 aa, Artificial Sequence
  Nuclear pore complex-interacting protein (238-244)
TDNSLSL

SEQ ID NO: 27549 - protein, 10 aa, Artificial Sequence
  Interleukin-1 receptor accessory protein (307-316)
TEDETRTQIL

SEQ ID NO: 27550 - protein, 10 aa, Artificial Sequence
  Uncharacterized membrane protein C19orf24 (108-117)
TEDPTEMASL

SEQ ID NO: 27551 - protein, 9 aa, Artificial Sequence
  Quinone oxidoreductase (182-190)
TEEGQKIVL

SEQ ID NO: 27552 - protein, 10 aa, Artificial Sequence
  Proteasome activator complex subunit 3 (220-229)
TEIDEKEYIS

SEQ ID NO: 27553 - protein, 9 aa, Artificial Sequence
  Ventricular zone-expressed PH domain-containing protein homolog 1 (7-15)
TEIEFPEKL

SEQ ID NO: 27554 - protein, 9 aa, Artificial Sequence
  RNA-binding protein 12 (77-85)
TEMQNMIEL

SEQ ID NO: 27555 - protein, 9 aa, Artificial Sequence
  Pre-mRNA-processing-splicing factor 8 (945-953)
TEPPPLLVY

SEQ ID NO: 27556 - protein, 9 aa, Artificial Sequence
  Probable N-acetyltransferase 16 (59-67)
TEREFEEVL

SEQ ID NO: 27557 - protein, 9 aa, Artificial Sequence
  Major facilitator superfamily domain-containing protein 1 (327-335)
TGKNIIWVL

SEQ ID NO: 27558 - protein, 9 aa, Artificial Sequence
  DNA topoisomerase 2-alpha (1397-1405)
THFPDETEI

SEQ ID NO: 27559 - protein, 10 aa, Artificial Sequence
  Mothers against decapentaplegic homolog 2 (197-206)
THSIPENTNF

SEQ ID NO: 27560 - protein, 10 aa, Artificial Sequence
  Sorting nexin-18 (279-288)
TIDDPTKQTK

SEQ ID NO: 27561 - protein, 11 aa, Artificial Sequence
  Plastin-2 (117-127)
TIDERTINKKK

SEQ ID NO: 27562 - protein, 9 aa, Artificial Sequence
  MAM and LDL-receptor class A domain-containing protein 1 (1829-1837)
TIEESGLNI

SEQ ID NO: 27563 - protein, 10 aa, Artificial Sequence
  NADH-ubiquinone oxidoreductase chain 2 (12-21)
TIFAGTLITA

SEQ ID NO: 27564 - protein, 9 aa, Artificial Sequence
  DBH-like monooxygenase protein 1 (50-58)
TIIEFTREL

SEQ ID NO: 27565 - protein, 9 aa, Artificial Sequence
  Cytoskeleton-associated protein 5 (365-373)
TILEKFKEK

SEQ ID NO: 27566 - protein, 16 aa, Artificial Sequence
  Melanocyte protein PMEL (215-230)
TITDQVPFSVSVSQLR

SEQ ID NO: 27567 - protein, 13 aa, Artificial Sequence
  Ornithine aminotransferase, mitochondrial (30-42)
TKKTVQGPPTSDD

SEQ ID NO: 27568 - protein, 13 aa, Artificial Sequence
  Catenin delta-1 (790-802)
TKSLDNNYSTPNE

SEQ ID NO: 27569 - protein, 10 aa, Artificial Sequence
  Low-density lipoprotein receptor-related protein 1B (701-710)
TLDFHTNTLY

SEQ ID NO: 27570 - protein, 11 aa, Artificial Sequence
  KN motif and ankyrin repeat domain-containing protein 1 (702-712)
TLDKQTSTQTV

SEQ ID NO: 27571 - protein, 8 aa, Artificial Sequence
  PH and SEC7 domain-containing protein 3 (117-124)
TLDQSLRY

SEQ ID NO: 27572 - protein, 9 aa, Artificial Sequence
  Kinesin-like protein KIF20B (1134-1142)
TLDVQIQHV

SEQ ID NO: 27573 - protein, 11 aa, Artificial Sequence
  UPF0505 protein C16orf62 (625-635)
TLEDEKRMLSY

SEQ ID NO: 27574 - protein, 11 aa, Artificial Sequence
  Syndecan-3 (348-358)
TLEEPKQASVT

SEQ ID NO: 27575 - protein, 10 aa, Artificial Sequence
  Biliverdin reductase A (71-80)
TLEERKEDQY

SEQ ID NO: 27576 - protein, 9 aa, Artificial Sequence
  Rap guanine nucleotide exchange factor 6 (4-12)
TLFQKLFSK

SEQ ID NO: 27577 - protein, 10 aa, Artificial Sequence
  ATP-dependent RNA helicase DHX36 (503-512)
TLHDLLMSQV

SEQ ID NO: 27578 - protein, 10 aa, Artificial Sequence
  F-box/WD repeat-containing protein 11 (217-226)
TLIHHNEAVL

SEQ ID NO: 27579 - protein, 10 aa, Artificial Sequence
  Plexin-C1 (370-379)
TLIHSDLTSV

SEQ ID NO: 27580 - protein, 11 aa, Artificial Sequence
  Tetraspanin-14 (239-249)
TLISDIEAVKA

SEQ ID NO: 27581 - protein, 9 aa, Artificial Sequence
  Midasin (462-470)
TLLDKYWTK

SEQ ID NO: 27582 - protein, 11 aa, Artificial Sequence
  Inositol-tetrakisphosphate 1-kinase (102-112)
TLLDRSKSYEL

SEQ ID NO: 27583 - protein, 9 aa, Artificial Sequence
  Midasin (3030-3038)
TLLEVGQIA

SEQ ID NO: 27584 - protein, 12 aa, Artificial Sequence
  NADH-ubiquinone oxidoreductase chain 4L (39-50)
TLMTLNTHSLLA

SEQ ID NO: 27585 - protein, 10 aa, Artificial Sequence
  Serine/threonine-protein phosphatase 1 regulatory subunit 10 (169-178)
TLPERPLTEV

SEQ ID NO: 27586 - protein, 9 aa, Artificial Sequence
  Sorting nexin-9 (218-226)
TLQDKQNMV

SEQ ID NO: 27587 - protein, 10 aa, Artificial Sequence
  Olfactory receptor (79-88)
TLVGNFTIII

SEQ ID NO: 27588 - protein, 9 aa, Artificial Sequence
  tRNA-dihydrouridine(20) synthase (NAD(P)+)-like (378-386)
TLWDKSKKL

SEQ ID NO: 27589 - protein, 11 aa, Artificial Sequence
  Spatacsin (451-461)
TLWDLETQGMQ

SEQ ID NO: 27590 - protein, 9 aa, Artificial Sequence
  E3 SUMO-protein ligase PIAS1 (360-368)
TLYIQMNEK

SEQ ID NO: 27591 - protein, 14 aa, Artificial Sequence
  Eukaryotic translation initiation factor 3 subunit D (56-69)
TNKYSSQFGGGSQY

SEQ ID NO: 27592 - protein, 11 aa, Artificial Sequence
  ATP-dependent RNA helicase DDX42 (106-116)
TNLTPQQLIDL

SEQ ID NO: 27593 - protein, 9 aa, Artificial Sequence
  Calcium permeable stress-gated cation channel 1 (426-434)
TPAIIMNTI

SEQ ID NO: 27594 - protein, 9 aa, Artificial Sequence
  Neuron navigator 2 (981-989)
TPASSRKNL

SEQ ID NO: 27595 - protein, 16 aa, Artificial Sequence
  Nucleolin (121-136)
TPGKKGAAIPAKGAKN

SEQ ID NO: 27596 - protein, 19 aa, Artificial Sequence
  Nucleolin (121-139)
TPGKKGAAIPAKGAKNGKN

SEQ ID NO: 27597 - protein, 12 aa, Artificial Sequence
  Chondroitin sulfate proteoglycan 4 (2310-2321)
TPNPALKNGQYW

SEQ ID NO: 27598 - protein, 14 aa, Artificial Sequence
  Alpha-adducin (194-207)
TPSFLKKSKKKSDS

SEQ ID NO: 27599 - protein, 9 aa, Artificial Sequence
  GPI ethanolamine phosphate transferase 3 (274-282)
TQDLQAKEL

SEQ ID NO: 27600 - protein, 10 aa, Artificial Sequence
  Homer protein homolog 3 (100-109)
TQFAEKFQEV

SEQ ID NO: 27601 - protein, 11 aa, Artificial Sequence
  Hypoxia-inducible factor 1-alpha (123-133)
TQFELTGHSVF

SEQ ID NO: 27602 - protein, 11 aa, Artificial Sequence
  Serine-protein kinase ATM (2268-2278)
TQLPERAIFQI

SEQ ID NO: 27603 - protein, 12 aa, Artificial Sequence
  Proteasome subunit beta type-4 (15-26)
TQNPMVTGTSVL

SEQ ID NO: 27604 - protein, 11 aa, Artificial Sequence
  von Willebrand factor A domain-containing protein 9 (75-85)
TQNQRSESNRF

SEQ ID NO: 27605 - protein, 13 aa, Artificial Sequence
  Macrophage migration inhibitory factor (22-34)
TQQLAQATGKPPQ

SEQ ID NO: 27606 - protein, 9 aa, Artificial Sequence
  Gamma-interferon-inducible protein 16 (235-243)
TQTQFFHVK

SEQ ID NO: 27607 - protein, 9 aa, Artificial Sequence
  60S ribosomal protein L14 (89-97)
TRWAKKIEA

SEQ ID NO: 27608 - protein, 9 aa, Artificial Sequence
  Cadherin-19 (219-227)
TSAEIRSLY

SEQ ID NO: 27609 - protein, 10 aa, Artificial Sequence
  WW domain-containing adapter protein with coiled-coil (338-347)
TSDASSPRSY

SEQ ID NO: 27610 - protein, 9 aa, Artificial Sequence
  FAST kinase domain-containing protein 2 (547-555)
TSDDMKNAY

SEQ ID NO: 27611 - protein, 10 aa, Artificial Sequence
  Latent-transforming growth factor beta-binding protein 2 (1043-1052)
TSDEKGCQDV

SEQ ID NO: 27612 - protein, 11 aa, Artificial Sequence
  Trimethyllysine dioxygenase, mitochondrial (224-234)
TSDFSRGDTAY

SEQ ID NO: 27613 - protein, 11 aa, Artificial Sequence
  Cyclic AMP-dependent transcription factor ATF-6 alpha (429-439)
TSDGIIQKNSY

SEQ ID NO: 27614 - protein, 9 aa, Artificial Sequence
  L-dopachrome tautomerase (136-144)
TSDQLGYSY

SEQ ID NO: 27615 - protein, 9 aa, Artificial Sequence
  Poly (ADP-ribose) polymerase 11 (22-30)
TSDTQWGWF

SEQ ID NO: 27616 - protein, 11 aa, Artificial Sequence
  Endoplasmin (188-198)
TSELIGQFGVG

SEQ ID NO: 27617 - protein, 12 aa, Artificial Sequence
  Probable ATP-dependent RNA helicase DDX5 (556-567)
TSFRTGNPTGTY

SEQ ID NO: 27618 - protein, 10 aa, Artificial Sequence
  YTH domain-containing family protein 2 (706-715)
TSIFDDFSHY

SEQ ID NO: 27619 - protein, 9 aa, Artificial Sequence
  KN motif and ankyrin repeat domain-containing protein 4 (11-19)
TSLKSIMKK

SEQ ID NO: 27620 - protein, 11 aa, Artificial Sequence
  E3 ubiquitin-protein ligase RNF213 (1201-1211)
TSSNSQRATHY

SEQ ID NO: 27621 - protein, 17 aa, Artificial Sequence
  Nestin (511-527)
TSWAGAPVHLGQGQFLK

SEQ ID NO: 27622 - protein, 9 aa, Artificial Sequence
  Probable ATP-dependent RNA helicase YTHDC2 (1212-1220)
TTAERVLMK

SEQ ID NO: 27623 - protein, 8 aa, Artificial Sequence
  Junction plakoglobin (287-294)
TTDCLQLL

SEQ ID NO: 27624 - protein, 9 aa, Artificial Sequence
  Junction plakoglobin (287-295)
TTDCLQLLA

SEQ ID NO: 27625 - protein, 11 aa, Artificial Sequence
  Flavin reductaseADPH) (190-200)
TTDEYDGHSTY

SEQ ID NO: 27626 - protein, 9 aa, Artificial Sequence
  ATP-dependent 6-phosphofructokinase, platelet type (379-387)
TTDFIYQLY

SEQ ID NO: 27627 - protein, 8 aa, Artificial Sequence
  Probable ATP-dependent RNA helicase DDX60-like (990-997)
TTDIIEKY

SEQ ID NO: 27628 - protein, 11 aa, Artificial Sequence
  Methyl-CpG-binding domain protein 6 (678-688)
TTDPGASSLGK

SEQ ID NO: 27629 - protein, 10 aa, Artificial Sequence
  IQ domain-containing protein G (71-80)
TTDQLSILNY

SEQ ID NO: 27630 - protein, 9 aa, Artificial Sequence
  Glutamate receptor ionotropic, kainate 5 (78-86)
TTDTMCQIL

SEQ ID NO: 27631 - protein, 9 aa, Artificial Sequence
  Heterogeneous nuclear ribonucleoproteins A2/B1 (20-28)
TTEESLRNY

SEQ ID NO: 27632 - protein, 9 aa, Artificial Sequence
  Apoptosis-stimulating of p53 protein 1 (687-695)
TTEQIPSPV

SEQ ID NO: 27633 - protein, 13 aa, Artificial Sequence
  Transformer-2 protein homolog beta (29-41)
TTERDLREVFSKY

SEQ ID NO: 27634 - protein, 9 aa, Artificial Sequence
  Pre-mRNA-processing-splicing factor 8 (1254-1262)
TTFTKIVNK

SEQ ID NO: 27635 - protein, 11 aa, Artificial Sequence
  Suppressor of tumorigenicity 7 protein (228-238)
TTIAEAEKLFK

SEQ ID NO: 27636 - protein, 9 aa, Artificial Sequence
  Lysine-specific demethylase 6B (1272-1280)
TTIAKYAQY

SEQ ID NO: 27637 - protein, 12 aa, Artificial Sequence
  TOX high mobility group box family member 4 (142-153)
TTIDQSELSSQL

SEQ ID NO: 27638 - protein, 11 aa, Artificial Sequence
  Nucleolar protein 10 (56-66)
TTIKVSKDGQY

SEQ ID NO: 27639 - protein, 13 aa, Artificial Sequence
  V-type proton ATPase subunit F (43-55)
TTINEIEDTFRQF

SEQ ID NO: 27640 - protein, 10 aa, Artificial Sequence
  Large neutral amino acids transporter small subunit 1 (108-117)
TTISKSGGDY

SEQ ID NO: 27641 - protein, 9 aa, Artificial Sequence
  WD repeat-containing protein 3 (883-891)
TTISKVSQV

SEQ ID NO: 27642 - protein, 9 aa, Artificial Sequence
  Succinyl-CoA ligase (ADP/GDP-forming) subunit alpha, mitochondrial (321-329)
TTIYKEFEK

SEQ ID NO: 27643 - protein, 9 aa, Artificial Sequence
  Neurofilament light polypeptide (267-275)
TTKSEMARY

SEQ ID NO: 27644 - protein, 10 aa, Artificial Sequence
  Melanoma-associated antigen D1 (152-161)
TTKVGPNATY

SEQ ID NO: 27645 - protein, 11 aa, Artificial Sequence
  Glycosylphosphatidylinositol anchor attachment 1 protein (526-536)
TTMVPTAALAK

SEQ ID NO: 27646 - protein, 9 aa, Artificial Sequence
  Urocortin-2 (100-108)
TTNARILAR

SEQ ID NO: 27647 - protein, 9 aa, Artificial Sequence
  Reticulon-1 (204-212)
TTPVKITLT

SEQ ID NO: 27648 - protein, 11 aa, Artificial Sequence
  Probable E3 ubiquitin-protein ligase HERC1 (3302-3312)
TTVDDSIQRKF

SEQ ID NO: 27649 - protein, 12 aa, Artificial Sequence
  Ubiquitin carboxyl-terminal hydrolase 19 (1362-1373)
TTVDESQVVTRY

SEQ ID NO: 27650 - protein, 10 aa, Artificial Sequence
  40S ribosomal protein S6 (125-134)
TTVPRRLGPK

SEQ ID NO: 27651 - protein, 9 aa, Artificial Sequence
  Aminoacyl tRNA synthase complex-interacting multifunctional protein 2 (206-214)
TVADVVLWS

SEQ ID NO: 27652 - protein, 10 aa, Artificial Sequence
  Aminoacyl tRNA synthase complex-interacting multifunctional protein 2 (206-215)
TVADVVLWSV

SEQ ID NO: 27653 - protein, 10 aa, Artificial Sequence
  Protein FAM73B (18-27)
TVAEIPVFLY

SEQ ID NO: 27654 - protein, 10 aa, Artificial Sequence
  Carboxypeptidase Q (271-280)
TVAEITGSKY

SEQ ID NO: 27655 - protein, 9 aa, Artificial Sequence
  Dynein heavy chain 14, axonemal (3163-3171)
TVAEKQLLA

SEQ ID NO: 27656 - protein, 9 aa, Artificial Sequence
  Protein phosphatase 1K, mitochondrial (191-199)
TVALLRDGI

SEQ ID NO: 27657 - protein, 9 aa, Artificial Sequence
  Abl interactor 2 (96-104)
TVDIHKEKV

SEQ ID NO: 27658 - protein, 9 aa, Artificial Sequence
  Volume-regulated anion channel subunit LRRC8B (622-630)
TVEEIISFQ

SEQ ID NO: 27659 - protein, 11 aa, Artificial Sequence
  Vimentin (446-456)
TVETRDGQVIN

SEQ ID NO: 27660 - protein, 9 aa, Artificial Sequence
  Olfactory receptor 51G2 (211-219)
TVGIDSLLI

SEQ ID NO: 27661 - protein, 12 aa, Artificial Sequence
  Exocyst complex component 7 (401-412)
TVHELTSNAILF

SEQ ID NO: 27662 - protein, 9 aa, Artificial Sequence
  WD repeat-containing protein 70 (364-372)
TVHPKFHYK

SEQ ID NO: 27663 - protein, 9 aa, Artificial Sequence
  Eukaryotic translation initiation factor 3 subunit C-like protein (818-826)
TVHSIISKM

SEQ ID NO: 27664 - protein, 10 aa, Artificial Sequence
  Transmembrane emp24 domain-containing protein 3 (153-162)
TVIDSQTHYR

SEQ ID NO: 27665 - protein, 10 aa, Artificial Sequence
  60S ribosomal protein L7-like 1 (171-180)
TVIEEHLGKF

SEQ ID NO: 27666 - protein, 9 aa, Artificial Sequence
  Ubiquitin carboxyl-terminal hydrolase 24 (488-496)
TVIENIHTI

SEQ ID NO: 27667 - protein, 9 aa, Artificial Sequence
  Integrin alpha-2 (988-996)
TVIIHIPQY

SEQ ID NO: 27668 - protein, 11 aa, Artificial Sequence
  Actin filament-associated protein 1-like 1 (208-218)
TVIREDQLLCY

SEQ ID NO: 27669 - protein, 11 aa, Artificial Sequence
  Angiomotin (709-719)
TVISHSPNTSY

SEQ ID NO: 27670 - protein, 13 aa, Artificial Sequence
  Interferon-induced protein 44 (52-64)
TVIYSEDHIIGAY

SEQ ID NO: 27671 - protein, 9 aa, Artificial Sequence
  Structural maintenance of chromosomes flexible hinge domain-containing protein 1 (90-98)
TVKDGVTLY

SEQ ID NO: 27672 - protein, 9 aa, Artificial Sequence
  Microtubule-actin cross-linking factor 1 isoform X31 (4329-4337)
TVKDQLNEM

SEQ ID NO: 27673 - protein, 9 aa, Artificial Sequence
  DnaJ homolog subfamily B member 1 (332-340)
TVLEQVLPI

SEQ ID NO: 27674 - protein, 9 aa, Artificial Sequence
  Prostaglandin E2 receptor EP4 subtype (335-343)
TVLSKAIEK

SEQ ID NO: 27675 - protein, 10 aa, Artificial Sequence
  Carboxypeptidase Q (441-450)
TVMDPKQMNV

SEQ ID NO: 27676 - protein, 9 aa, Artificial Sequence
  Embryonic stem cell-specific 5-hydroxymethylcytosine-binding protein (101-109)
TVMEKRSFK

SEQ ID NO: 27677 - protein, 12 aa, Artificial Sequence
  MICOS complex subunit MIC13 (90-101)
TVMSALSVAPSK

SEQ ID NO: 27678 - protein, 9 aa, Artificial Sequence
  Zinc finger protein 3 (182-190)
TVNSNLISH

SEQ ID NO: 27679 - protein, 9 aa, Artificial Sequence
  Mucin-3A isoform (865-873)
TVQNTEISI

SEQ ID NO: 27680 - protein, 11 aa, Artificial Sequence
  Zinc finger BED domain-containing protein 4 (806-816)
TVTDNASIGKT

SEQ ID NO: 27681 - protein, 12 aa, Artificial Sequence
  Transmembrane protein 186 (82-93)
TVVALPPGYYLY

SEQ ID NO: 27682 - protein, 9 aa, Artificial Sequence
  RNA-binding protein Musashi homolog 2 (17-25)
TVVEDVKQY

SEQ ID NO: 27683 - protein, 12 aa, Artificial Sequence
  Serine/threonine-protein kinase A-Raf (31-42)
TVVTVRDGMSVY

SEQ ID NO: 27684 - protein, 9 aa, Artificial Sequence
  Putative oxidoreductase GLYR1 (235-243)
TVWNRTAEK

SEQ ID NO: 27685 - protein, 13 aa, Artificial Sequence
  RNA-binding protein 26 (673-685)
TVYNPAALKAAQK

SEQ ID NO: 27686 - protein, 11 aa, Artificial Sequence
  Junction plakoglobin (21-31)
TYDSGIHSGAN

SEQ ID NO: 27687 - protein, 16 aa, Artificial Sequence
  Caprin-1 (572-587)
TYHGSPDQSHQVTGNH

SEQ ID NO: 27688 - protein, 9 aa, Artificial Sequence
  Spartin (153-161)
VAAPASLSL

SEQ ID NO: 27689 - protein, 10 aa, Artificial Sequence
  Phosphatidylinositol 3,4,5-trisphosphate 5-phosphatase 2 (908-917)
VAAPPPKNSF

SEQ ID NO: 27690 - protein, 10 aa, Artificial Sequence
  Dolichyl-diphosphooligosaccharide-proteinosyltransferase subunit 2 (450-459)
VAEPDNKNVY

SEQ ID NO: 27691 - protein, 11 aa, Artificial Sequence
  Sodium/iodide cotransporter (484-494)
VALSVNASGLL

SEQ ID NO: 27692 - protein, 9 aa, Artificial Sequence
  Transcription elongation factor SPT5 (216-224)
VAPEHVKGY

SEQ ID NO: 27693 - protein, 10 aa, Artificial Sequence
  DNA-dependent protein kinase catalytic subunit (2797-2806)
VAQRDPIIAK

SEQ ID NO: 27694 - protein, 9 aa, Artificial Sequence
  Tetratricopeptide repeat protein 21B (25-33)
VASEGIKRY

SEQ ID NO: 27695 - protein, 9 aa, Artificial Sequence
  Probable E3 ubiquitin-protein ligase HERC1 (1139-1147)
VDLERTIAL

SEQ ID NO: 27696 - protein, 9 aa, Artificial Sequence
  Cytoplasmic dynein 1 heavy chain 1 (795-803)
VEERNTISL

SEQ ID NO: 27697 - protein, 11 aa, Artificial Sequence
  L-dopachrome tautomerase (152-162)
VEETPGWPTTL

SEQ ID NO: 27698 - protein, 9 aa, Artificial Sequence
  Glycogen phosphorylase, brain form (505-513)
VEKIGEEFL

SEQ ID NO: 27699 - protein, 11 aa, Artificial Sequence
  Receptor-type tyrosine-protein phosphatase delta (635-645)
VEKQNGIITEY

SEQ ID NO: 27700 - protein, 8 aa, Artificial Sequence
  Phosphatidylinositol 3,4,5-trisphosphate-dependent Rac exchanger 1 protein (160-167)
VELNKIPT

SEQ ID NO: 27701 - protein, 9 aa, Artificial Sequence
  Prosaposin (299-307)
VEPIKKHEV

SEQ ID NO: 27702 - protein, 10 aa, Artificial Sequence
  Coiled-coil domain-containing protein 13 (514-523)
VESALTRPSL

SEQ ID NO: 27703 - protein, 12 aa, Artificial Sequence
  Protein ZGRF1 (799-810)
VEVETAREGKQY

SEQ ID NO: 27704 - protein, 11 aa, Artificial Sequence
  Proteasome subunit alpha type-1 (104-114)
VFDRPLPVSRL

SEQ ID NO: 27705 - protein, 11 aa, Artificial Sequence
  ATP-dependent RNA helicase DDX3X (408-418)
VGSTSENITQK

SEQ ID NO: 27706 - protein, 9 aa, Artificial Sequence
  Protocadherin-18 (261-269)
VGTLLLDLN

SEQ ID NO: 27707 - protein, 10 aa, Artificial Sequence
  THO complex subunit 4 (113-122)
VHYDRSGRSL

SEQ ID NO: 27708 - protein, 12 aa, Artificial Sequence
  Butyrophilin subfamily 3 member A3 secreted isoform (174-185)
VILDPDTANAIL

SEQ ID NO: 27709 - protein, 7 aa, Artificial Sequence
  Trafficking protein particle complex subunit 8 (106-112)
VITAGDY

SEQ ID NO: 27710 - protein, 10 aa, Artificial Sequence
  P antigen family member 5 (46-55)
VIVQQPTEEK

SEQ ID NO: 27711 - protein, 14 aa, Artificial Sequence
  Myosin-10 (20-33)
VIYNPATQADWTAK

SEQ ID NO: 27712 - protein, 11 aa, Artificial Sequence
  Protein-methionine sulfoxide oxidase MICAL1 (432-442)
VLAERESLYQL

SEQ ID NO: 27713 - protein, 10 aa, Artificial Sequence
  Protocadherin alpha-1 (636-645)
VLDEADLSRY

SEQ ID NO: 27714 - protein, 9 aa, Artificial Sequence
  NF-kappa-B inhibitor epsilon (286-294)
VLDIQNNLY

SEQ ID NO: 27715 - protein, 11 aa, Artificial Sequence
  Peroxisomal trans-2-enoyl-CoA reductase (146-156)
VLETNLTGTFY

SEQ ID NO: 27716 - protein, 11 aa, Artificial Sequence
  Translocon-associated protein subunit alpha (19-29)
VLFRGGPRGLL

SEQ ID NO: 27717 - protein, 9 aa, Artificial Sequence
  ETS translocation variant 5 (79-87)
VLHAPPPTK

SEQ ID NO: 27718 - protein, 9 aa, Artificial Sequence
  Sorting nexin-14 (176-184)
VLIRRIHKV

SEQ ID NO: 27719 - protein, 12 aa, Artificial Sequence
  Transcription initiation factor IIE subunit beta (280-291)
VLKDYSDITSSK

SEQ ID NO: 27720 - protein, 11 aa, Artificial Sequence
  Adenosylhomocysteinase 2 (123-133)
VLLAEGRLLNL

SEQ ID NO: 27721 - protein, 11 aa, Artificial Sequence
  Splicing factor 3B subunit 2 (163-173)
VLLEQERQQEI

SEQ ID NO: 27722 - protein, 13 aa, Artificial Sequence
  Sodium-dependent phosphate transporter 1 (75-87)
VLLGAKVSETIRK

SEQ ID NO: 27723 - protein, 10 aa, Artificial Sequence
  HCG2043033, isoform CRA_b (11-20)
VLMGLPLAQA

SEQ ID NO: 27724 - protein, 10 aa, Artificial Sequence
  Armadillo repeat-containing X-linked protein 1 (210-219)
VLNILERTND

SEQ ID NO: 27725 - protein, 9 aa, Artificial Sequence
  Protein GPR108 (359-367)
VLSDKEKKV

SEQ ID NO: 27726 - protein, 10 aa, Artificial Sequence
  Leucine-rich repeat-containing protein 1 (295-304)
VLTENQLLTL

SEQ ID NO: 27727 - protein, 11 aa, Artificial Sequence
  2',3'-cyclic-nucleotide 3'-phosphodiesterase (126-136)
VLVEPKTAWRL

SEQ ID NO: 27728 - protein, 11 aa, Artificial Sequence
  Zinc finger CCHC domain-containing protein 14 (120-130)
VLWSDSSITSV

SEQ ID NO: 27729 - protein, 10 aa, Artificial Sequence
  ADP/ATP translocase 1 (288-297)
VLYDEIKKYV

SEQ ID NO: 27730 - protein, 12 aa, Artificial Sequence
  Sodium/potassium/calcium exchanger 5 (423-434)
VLYELGIIGNNK

SEQ ID NO: 27731 - protein, 11 aa, Artificial Sequence
  Cytoplasmic dynein 1 heavy chain 1 (3839-3849)
VLYENPNLKGV

SEQ ID NO: 27732 - protein, 15 aa, Artificial Sequence
  Dolichyl-diphosphooligosaccharide-proteinosyltransferase subunit 4 (23-37)
VLYHYVAVNNPKKQE

SEQ ID NO: 27733 - protein, 13 aa, Artificial Sequence
  Ras-related protein Rab-27A (25-37)
VLYQYTDGKFNSK

SEQ ID NO: 27734 - protein, 8 aa, Artificial Sequence
  HLA class I histocompatibility antigen, A-29 alpha chain (3-10)
VMAPRTLL

SEQ ID NO: 27735 - protein, 9 aa, Artificial Sequence
  Embryonic stem cell-specific 5-hydroxymethylcytosine-binding protein (102-110)
VMEKRSFKV

SEQ ID NO: 27736 - protein, 11 aa, Artificial Sequence
  Ribosomal protein S6 kinase alpha-2 (56-66)
VMFTEEDVKFY

SEQ ID NO: 27737 - protein, 9 aa, Artificial Sequence
  Antigen KI-67 (115-123)
VMHTPPVLK

SEQ ID NO: 27738 - protein, 13 aa, Artificial Sequence
  Transient receptor potential cation channel subfamily V member 2 (253-265)
VMISDNSAENIAL

SEQ ID NO: 27739 - protein, 9 aa, Artificial Sequence
  Signal transducer and activator of transcription 1-alpha/beta (134-142)
VMLDKQKEL

SEQ ID NO: 27740 - protein, 10 aa, Artificial Sequence
  Poly(U)-binding-splicing factor PUF60 (175-184)
VMLGGRNIKV

SEQ ID NO: 27741 - protein, 9 aa, Artificial Sequence
  Transcriptional coactivator YAP1 (72-80)
VMNPKTANV

SEQ ID NO: 27742 - protein, 9 aa, Artificial Sequence
  CD63 antigen (111-119)
VMSEFNNNF

SEQ ID NO: 27743 - protein, 10 aa, Artificial Sequence
  Ras-related C3 botulinum toxin substrate 1 (44-53)
VMVDGKPVNL

SEQ ID NO: 27744 - protein, 11 aa, Artificial Sequence
  Uncharacterized protein C4orf36 (5-15)
VPRKNTVKTIL

SEQ ID NO: 27745 - protein, 9 aa, Artificial Sequence
  Zinc finger protein ZFAT (1182-1190)
VQQASVELA

SEQ ID NO: 27746 - protein, 9 aa, Artificial Sequence
  tRNA wybutosine-synthesizing protein 4 (287-295)
VQWDGRLYH

SEQ ID NO: 27747 - protein, 9 aa, Artificial Sequence
  Pre-mRNA-processing-splicing factor 8 (1168-1176)
VQWENSFVS

SEQ ID NO: 27748 - protein, 11 aa, Artificial Sequence
  Unconventional myosin-X (553-563)
VQYDVRGILEK

SEQ ID NO: 27749 - protein, 18 aa, Artificial Sequence
  Probable ATP-dependent RNA helicase DDX5 (550-567)
VSAGIQTSFRTGNPTGTY

SEQ ID NO: 27750 - protein, 9 aa, Artificial Sequence
  60S ribosomal protein L24 (148-156)
VSAPRVGGK

SEQ ID NO: 27751 - protein, 9 aa, Artificial Sequence
  NADH dehydrogenase (ubiquinone) iron-sulfur protein 2, mitochondrial (8-16)
VSDGSSRPY

SEQ ID NO: 27752 - protein, 9 aa, Artificial Sequence
  Single Ig IL-1-related receptor (387-395)
VSDLGSRNY

SEQ ID NO: 27753 - protein, 9 aa, Artificial Sequence
  MAM domain-containingosylphosphatidylinositol anchor protein 1 (140-148)
VSDVRGNFY

SEQ ID NO: 27754 - protein, 11 aa, Artificial Sequence
  Protein eva-1 homolog A (27-37)
VSENPERAALY

SEQ ID NO: 27755 - protein, 9 aa, Artificial Sequence
  Clustered mitochondria protein homolog (512-520)
VSHPRYLEL

SEQ ID NO: 27756 - protein, 9 aa, Artificial Sequence
  ER degradation-enhancing alpha-mannosidase-like protein 2 (270-278)
VSMPVFQSL

SEQ ID NO: 27757 - protein, 11 aa, Artificial Sequence
  Transmembrane protein 50A (73-83)
VSNGQVRGDSY

SEQ ID NO: 27758 - protein, 12 aa, Artificial Sequence
  Natriuretic peptides A (87-98)
VSPAQRDGGALG

SEQ ID NO: 27759 - protein, 9 aa, Artificial Sequence
  Pre-mRNA-processing-splicing factor 8 (2131-2139)
VSPPDNPQV

SEQ ID NO: 27760 - protein, 11 aa, Artificial Sequence
  PRO2822 (92-102)
VSQDGLNLLTL

SEQ ID NO: 27761 - protein, 10 aa, Artificial Sequence
  PAB-dependent poly(A)-specific ribonuclease subunit PAN3 (183-192)
VSQTPSSGQV

SEQ ID NO: 27762 - protein, 10 aa, Artificial Sequence
  Heat shock cognate 71 kDa protein (536-545)
VSSKNSLESY

SEQ ID NO: 27763 - protein, 9 aa, Artificial Sequence
  Zinc finger protein with KRAB and SCAN domains 2 (134-142)
VSSPVHREK

SEQ ID NO: 27764 - protein, 11 aa, Artificial Sequence
  Complex I assembly factor TMEM126B, mitochondrial (46-56)
VTDKLFVIDAL

SEQ ID NO: 27765 - protein, 9 aa, Artificial Sequence
  Uncharacterized protein C11orf63 (295-303)
VTDKTSIQN

SEQ ID NO: 27766 - protein, 9 aa, Artificial Sequence
  Receptor-type tyrosine-protein phosphatase zeta (705-713)
VTDLEMPHY

SEQ ID NO: 27767 - protein, 8 aa, Artificial Sequence
  F-box/LRR-repeat protein 7 (316-323)
VTDVGIRY

SEQ ID NO: 27768 - protein, 11 aa, Artificial Sequence
  Heterogeneous nuclear ribonucleoprotein Q (266-276)
VTEGLTDVILY

SEQ ID NO: 27769 - protein, 8 aa, Artificial Sequence
  Filamin-A (2353-2360)
VTEIDQDK

SEQ ID NO: 27770 - protein, 10 aa, Artificial Sequence
  1-acyl-sn-glycerol-3-phosphate acyltransferase gamma (296-305)
VTEIEKGSSY

SEQ ID NO: 27771 - protein, 10 aa, Artificial Sequence
  Carbonic anhydrase-related protein (181-190)
VTEILQDIQY

SEQ ID NO: 27772 - protein, 10 aa, Artificial Sequence
  Short-chain-specific acyl-CoA dehydrogenase, mitochondrial (369-378)
VTEMPAERHY

SEQ ID NO: 27773 - protein, 9 aa, Artificial Sequence
  Tyrosine-protein kinase TXK (10-18)
VTENKITNL

SEQ ID NO: 27774 - protein, 7 aa, Artificial Sequence
  Integrin beta-3 (336-342)
VTENVVN

SEQ ID NO: 27775 - protein, 9 aa, Artificial Sequence
  Integrin beta-3 (336-344)
VTENVVNLY

SEQ ID NO: 27776 - protein, 12 aa, Artificial Sequence
  Integrin beta-3 (336-347)
VTENVVNLYQNY

SEQ ID NO: 27777 - protein, 10 aa, Artificial Sequence
  Myosin phosphatase Rho-interacting protein (65-74)
VTEYPVQRNY

SEQ ID NO: 27778 - protein, 9 aa, Artificial Sequence
  Lymphocyte antigen 6E (61-69)
VTFGHSLSK

SEQ ID NO: 27779 - protein, 9 aa, Artificial Sequence
  OX-2 membraneoprotein (76-84)
VTFSENHGV

SEQ ID NO: 27780 - protein, 10 aa, Artificial Sequence
  Annexin A9 (3-12)
VTGGKMAPSL

SEQ ID NO: 27781 - protein, 10 aa, Artificial Sequence
  Zinc finger FYVE domain-containing protein 16 (97-106)
VTGLDLLSSV

SEQ ID NO: 27782 - protein, 11 aa, Artificial Sequence
  Kinesin-like protein KIF6 (24-34)
VTIDDNKQILK

SEQ ID NO: 27783 - protein, 9 aa, Artificial Sequence
  RNA pseudouridylate synthase domain-containing protein 1 (112-120)
VTISHAIGR

SEQ ID NO: 27784 - protein, 9 aa, Artificial Sequence
  Endoribonuclease Dicer (827-835)
VTISIELKK

SEQ ID NO: 27785 - protein, 11 aa, Artificial Sequence
  FACT complex subunit SPT16 (3-13)
VTLDKDAYYRR

SEQ ID NO: 27786 - protein, 9 aa, Artificial Sequence
  Pappalysin-1 (689-697)
VTLEWFPPI

SEQ ID NO: 27787 - protein, 10 aa, Artificial Sequence
  Autophagy-related protein 9A (411-420)
VTLLGVTVTV

SEQ ID NO: 27788 - protein, 10 aa, Artificial Sequence
  WD repeat-containing protein 70 (23-32)
VTMGFTGFGK

SEQ ID NO: 27789 - protein, 11 aa, Artificial Sequence
  Small subunit processome component 20 homolog (830-840)
VTNPDIAAKKK

SEQ ID NO: 27790 - protein, 9 aa, Artificial Sequence
  DNA (cytosine-5)-methyltransferase 1 (1422-1430)
VTNPEPMGK

SEQ ID NO: 27791 - protein, 9 aa, Artificial Sequence
  Beta-parvin (138-146)
VTQSEIGQK

SEQ ID NO: 27792 - protein, 9 aa, Artificial Sequence
  Polymerase delta-interacting protein 3 (410-418)
VTTQPTEFK

SEQ ID NO: 27793 - protein, 10 aa, Artificial Sequence
  Polycystin-1 (1443-1452)
VTVTASNNIS

SEQ ID NO: 27794 - protein, 9 aa, Artificial Sequence
  LisH domain-containing protein ARMC9 (225-233)
VTYLKRYNK

SEQ ID NO: 27795 - protein, 11 aa, Artificial Sequence
  Trafficking protein particle complex subunit 2-like protein (8-18)
VVDEKISAMGK

SEQ ID NO: 27796 - protein, 10 aa, Artificial Sequence
  Beta-actin-like protein 2 (10-19)
VVDNGSGMCK

SEQ ID NO: 27797 - protein, 12 aa, Artificial Sequence
  Beta-actin-like protein 2 (10-21)
VVDNGSGMCKAG

SEQ ID NO: 27798 - protein, 9 aa, Artificial Sequence
  Cytosolic acyl coenzyme A thioester hydrolase (273-281)
VVDSSQKRY

SEQ ID NO: 27799 - protein, 10 aa, Artificial Sequence
  Catalase (55-64)
VVFTDEMAHF

SEQ ID NO: 27800 - protein, 11 aa, Artificial Sequence
  RAB6A-GEF complex partner protein 2 (239-249)
VVGTLNLGEGT

SEQ ID NO: 27801 - protein, 11 aa, Artificial Sequence
  Retroviral-like aspartic protease 1 (242-252)
VVKVANGAEMK

SEQ ID NO: 27802 - protein, 11 aa, Artificial Sequence
  Thiosulfate sulfurtransferase (97-107)
VVYDGEHLGSF

SEQ ID NO: 27803 - protein, 9 aa, Artificial Sequence
  Keratinocyte-associated transmembrane protein 2 (212-220)
VVYITYHNK

SEQ ID NO: 27804 - protein, 13 aa, Artificial Sequence
  HLA class I histocompatibility antigen, B-40 alpha chain (243-255)
WAAVVVPSGEEQR

SEQ ID NO: 27805 - protein, 9 aa, Artificial Sequence
  Glycerol kinase (156-164)
WLLDNVRKV

SEQ ID NO: 27806 - protein, 11 aa, Artificial Sequence
  Protein transport protein Sec61 subunit alpha isoform 1 (324-334)
WSDTSSGGPAR

SEQ ID NO: 27807 - protein, 10 aa, Artificial Sequence
  Ubiquitin carboxyl-terminal hydrolase 48 (533-542)
YAADIFYSRY

SEQ ID NO: 27808 - protein, 9 aa, Artificial Sequence
  RNA-binding protein 14 (528-536)
YAAQQHPQA

SEQ ID NO: 27809 - protein, 11 aa, Artificial Sequence
  Unconventional myosin-Va (62-72)
YADDPKKYQSY

SEQ ID NO: 27810 - protein, 10 aa, Artificial Sequence
  V-type proton ATPase subunit B, kidney isoform (384-393)
YAIGKDVQAM

SEQ ID NO: 27811 - protein, 9 aa, Artificial Sequence
  Junction plakoglobin (245-253)
YAITTLHNL

SEQ ID NO: 27812 - protein, 9 aa, Artificial Sequence
  Threonine-tRNA ligase, mitochondrial (546-554)
YAKEAQQSL

SEQ ID NO: 27813 - protein, 9 aa, Artificial Sequence
  G2/mitotic-specific cyclin-B2 (368-376)
YASSKLLKI

SEQ ID NO: 27814 - protein, 9 aa, Artificial Sequence
  Heterogeneous nuclear ribonucleoprotein L (430-438)
YAVDRAITH

SEQ ID NO: 27815 - protein, 11 aa, Artificial Sequence
  Protein-methionine sulfoxide oxidase MICAL3 (803-813)
YAYDIEDGKFY

SEQ ID NO: 27816 - protein, 9 aa, Artificial Sequence
  Hypoxia-inducible factor 1-alpha (254-262)
YCDERITEL

SEQ ID NO: 27817 - protein, 9 aa, Artificial Sequence
  Zinc finger protein 362 (287-295)
YCDKSFRQL

SEQ ID NO: 27818 - protein, 13 aa, Artificial Sequence
  Cofilin-1 (85-97)
YDATYETKESKKE

SEQ ID NO: 27819 - protein, 10 aa, Artificial Sequence
  Melanoma antigen preferentially expressed in tumors (448-457)
YEDIHGTLHL

SEQ ID NO: 27820 - protein, 9 aa, Artificial Sequence
  Transmembrane protein 9B (93-101)
YEERSSVTI

SEQ ID NO: 27821 - protein, 11 aa, Artificial Sequence
  Ubiquitin-like protein 5 (60-70)
YEIHDGMNLEL

SEQ ID NO: 27822 - protein, 12 aa, Artificial Sequence
  HLA class I histocompatibility antigen, alpha chain E (124-135)
YEQFAYDGKDYL

SEQ ID NO: 27823 - protein, 9 aa, Artificial Sequence
  Carbohydrate sulfotransferase 14 (199-207)
YGAEIVRRY

SEQ ID NO: 27824 - protein, 9 aa, Artificial Sequence
  RNA-binding protein 14 (474-482)
YGAQASMGL

SEQ ID NO: 27825 - protein, 11 aa, Artificial Sequence
  Transcription factor SOX-10 (412-422)
YGHSGQASGLY

SEQ ID NO: 27826 - protein, 12 aa, Artificial Sequence
  Heterogeneous nuclear ribonucleoproteins A2/B1 (243-254)
YGSGNYNDFGNY

SEQ ID NO: 27827 - protein, 10 aa, Artificial Sequence
  RNMT-activating mini protein (107-116)
YGYNQRPPYG

SEQ ID NO: 27828 - protein, 10 aa, Artificial Sequence
  Histone deacetylase complex subunit SAP130 (880-889)
YIDEEGVRYV

SEQ ID NO: 27829 - protein, 11 aa, Artificial Sequence
  Cleft lip and palate transmembrane protein 1 (409-419)
YILDNETNFVV

SEQ ID NO: 27830 - protein, 11 aa, Artificial Sequence
  Negative elongation factor C/D (47-57)
YIMEPSIFNTL

SEQ ID NO: 27831 - protein, 9 aa, Artificial Sequence
  Filamin-B (1580-1588)
YIPDKTGRY

SEQ ID NO: 27832 - protein, 9 aa, Artificial Sequence
  Beta-catenin-interacting protein 1 (15-23)
YIQQKVRVL

SEQ ID NO: 27833 - protein, 10 aa, Artificial Sequence
  Signal recognition particle 9 kDa protein (18-27)
YLADPMKARV

SEQ ID NO: 27834 - protein, 9 aa, Artificial Sequence
  S-phase kinase-associated protein 1 (33-41)
YLDIKGLLD

SEQ ID NO: 27835 - protein, 10 aa, Artificial Sequence
  Procollagen-lysine,2-oxoglutarate 5-dioxygenase 3 (199-208)
YLDPGLREKL

SEQ ID NO: 27836 - protein, 10 aa, Artificial Sequence
  Protein dpy-30 homolog (56-65)
YLDQTVVPIL

SEQ ID NO: 27837 - protein, 11 aa, Artificial Sequence
  Lysyl oxidase homolog 4 (547-557)
YLEDRPLSQLY

SEQ ID NO: 27838 - protein, 12 aa, Artificial Sequence
  Ectonucleotide pyrophosphatase/phosphodiesterase family member 1 (319-330)
YLEEPDSSGHSY

SEQ ID NO: 27839 - protein, 9 aa, Artificial Sequence
  HLA class I histocompatibility antigen, Cw-8 alpha chain (170-178)
YLENGKKTL

SEQ ID NO: 27840 - protein, 11 aa, Artificial Sequence
  Prolyl endopeptidase (353-363)
YLHDVKNILQL

SEQ ID NO: 27841 - protein, 11 aa, Artificial Sequence
  Unconventional myosin-Vb (79-89)
YLHEPAVLHNL

SEQ ID NO: 27842 - protein, 11 aa, Artificial Sequence
  Dystonin (981-991)
YLINEIDRIRA

SEQ ID NO: 27843 - protein, 11 aa, Artificial Sequence
  Tubulin polyglutamylase TTLL5 (191-201)
YLINNPNQISL

SEQ ID NO: 27844 - protein, 12 aa, Artificial Sequence
  Vacuolar protein sorting-associated protein 13C (2639-2650)
YLLEGTAETHEL

SEQ ID NO: 27845 - protein, 9 aa, Artificial Sequence
  Unconventional myosin-XIX (218-226)
YLLEKTRVA

SEQ ID NO: 27846 - protein, 10 aa, Artificial Sequence
  Transforming growth factor-beta receptor-associated protein 1 (431-440)
YLNEVRSTEV

SEQ ID NO: 27847 - protein, 11 aa, Artificial Sequence
  CD302 antigen (163-173)
YLSDNHILISA

SEQ ID NO: 27848 - protein, 11 aa, Artificial Sequence
  GPI inositol-deacylase (41-51)
YMFEYPEYQKI

SEQ ID NO: 27849 - protein, 11 aa, Artificial Sequence
  Methyl-CpG-binding domain protein 4 (530-540)
YPIELHGIGKY

SEQ ID NO: 27850 - protein, 9 aa, Artificial Sequence
  TRIO and F-actin-binding protein (394-402)
YQEELSREL

SEQ ID NO: 27851 - protein, 9 aa, Artificial Sequence
  ATP synthase-coupling factor 6, mitochondrial (75-83)
YQQELEREL

SEQ ID NO: 27852 - protein, 11 aa, Artificial Sequence
  Caprin-1 (665-675)
YQRDGYQQNFK

SEQ ID NO: 27853 - protein, 10 aa, Artificial Sequence
  Melanocyte protein PMEL (485-494)
YRYGSFSVTL

SEQ ID NO: 27854 - protein, 10 aa, Artificial Sequence
  PDZ and LIM domain protein 2 (315-324)
YSAPATLSSR

SEQ ID NO: 27855 - protein, 15 aa, Artificial Sequence
  Interleukin enhancer-binding factor 3 (690-704)
YSDFFTDCYGYHDFG

SEQ ID NO: 27856 - protein, 9 aa, Artificial Sequence
  Sphingosine-1-phosphate lyase 1 (366-374)
YSDKKYRNY

SEQ ID NO: 27857 - protein, 17 aa, Artificial Sequence
  Cold-inducible RNA-binding protein (151-167)
YSDRSSGGSYRDSYDSY

SEQ ID NO: 27858 - protein, 10 aa, Artificial Sequence
  AF4/FMR2 family member 2 (1092-1101)
YSETVELLRY

SEQ ID NO: 27859 - protein, 15 aa, Artificial Sequence
  Ribonucleoprotein PTB-binding 1 (601-615)
YSFDYPSDMGPRRLF

SEQ ID NO: 27860 - protein, 15 aa, Artificial Sequence
  Heterogeneous nuclear ribonucleoprotein A1 (260-274)
YSGGSRGYGSGGQGY

SEQ ID NO: 27861 - protein, 13 aa, Artificial Sequence
  Interleukin enhancer-binding factor 3 (624-636)
YSGSGGRSGGNSY

SEQ ID NO: 27862 - protein, 13 aa, Artificial Sequence
  Heterogeneous nuclear ribonucleoprotein D-like (222-234)
YSGYGGYDYTGYN

SEQ ID NO: 27863 - protein, 14 aa, Artificial Sequence
  Heterogeneous nuclear ribonucleoprotein D-like (222-235)
YSGYGGYDYTGYNY

SEQ ID NO: 27864 - protein, 14 aa, Artificial Sequence
  Caprin-1 (662-675)
YSGYQRDGYQQNFK

SEQ ID NO: 27865 - protein, 8 aa, Artificial Sequence
  Transmembrane protein 214 (171-178)
YSLVSREL

SEQ ID NO: 27866 - protein, 19 aa, Artificial Sequence
  Cold-inducible RNA-binding protein (142-160)
YSSRSQSGGYSDRSSGGSY

SEQ ID NO: 27867 - protein, 9 aa, Artificial Sequence
  Condensin complex subunit 2 (428-436)
YSYFSPRTM

SEQ ID NO: 27868 - protein, 8 aa, Artificial Sequence
  CBP80/20-dependent translation initiation factor (506-513)
YTCLRELL

SEQ ID NO: 27869 - protein, 12 aa, Artificial Sequence
  Transcription factor SOX-10 (369-380)
YTDQPSTSQIAY

SEQ ID NO: 27870 - protein, 14 aa, Artificial Sequence
  Sialidase-1 (400-413)
YTESISVAKISVYG

SEQ ID NO: 27871 - protein, 9 aa, Artificial Sequence
  Metalloproteinase inhibitor 3 (48-56)
YTIKQMKMY

SEQ ID NO: 27872 - protein, 9 aa, Artificial Sequence
  Nodal modulator 2 (59-67)
YTKHGTLKY

SEQ ID NO: 27873 - protein, 12 aa, Artificial Sequence
  Cyclin-dependent kinase 1 (4-15)
YTKIEKIGEGTY

SEQ ID NO: 27874 - protein, 11 aa, Artificial Sequence
  Syndecan-3 (347-357)
YTLEEPKQASV

SEQ ID NO: 27875 - protein, 9 aa, Artificial Sequence
  Nuclear receptor ROR-beta (229-237)
YTMEELHQL

SEQ ID NO: 27876 - protein, 15 aa, Artificial Sequence
  Caprin-1 (651-665)
YTQSQFSAPRDYSGY

SEQ ID NO: 27877 - protein, 9 aa, Artificial Sequence
  ATP-binding cassette sub-family B member 8, mitochondrial (162-170)
YTRDHVGSF

SEQ ID NO: 27878 - protein, 9 aa, Artificial Sequence
  ATP-dependent 6-phosphofructokinase, platelet type (378-386)
YTTDFIYQL

SEQ ID NO: 27879 - protein, 11 aa, Artificial Sequence
  Sulfhydryl oxidase 2 (323-333)
YTVDLESGLHY

SEQ ID NO: 27880 - protein, 9 aa, Artificial Sequence
  ER degradation-enhancing alpha-mannosidase-like protein 2 (322-330)
YTVEKREGY

SEQ ID NO: 27881 - protein, 11 aa, Artificial Sequence
  Membrane-associated transporter protein (439-449)
YTVPFNLITEY

SEQ ID NO: 27882 - protein, 9 aa, Artificial Sequence
  Dolichyl-diphosphooligosaccharide-proteinosyltransferase 48 kDa subunit (325-333)
YTVTDLVEY

SEQ ID NO: 27883 - protein, 12 aa, Artificial Sequence
  Sulfhydryl oxidase 1 (728-739)
YTYFQAKIRALK

SEQ ID NO: 27884 - protein, 10 aa, Artificial Sequence
  Eukaryotic translation initiation factor 3 subunit E (286-295)
YTYKDPITEF

SEQ ID NO: 27885 - protein, 11 aa, Artificial Sequence
  ATP-binding cassette sub-family A member 7 (1610-1620)
YVAPANLPALL

SEQ ID NO: 27886 - protein, 11 aa, Artificial Sequence
  General transcription factor 3C polypeptide 1 (627-637)
YVDDASWMRYI

SEQ ID NO: 27887 - protein, 9 aa, Artificial Sequence
  Spectrin alpha chain, non-erythrocytic 1 (2453-2461)
YVDGKGREL

SEQ ID NO: 27888 - protein, 11 aa, Artificial Sequence
  Tribbles homolog 1 (157-167)
YVFFEKDFGDM

SEQ ID NO: 27889 - protein, 9 aa, Artificial Sequence
  Kelch domain-containing protein 10 (220-228)
YVFGGTTGY

SEQ ID NO: 27890 - protein, 10 aa, Artificial Sequence
  Actin, aortic smooth muscle (55-64)
YVGDEAQSKR

SEQ ID NO: 27891 - protein, 11 aa, Artificial Sequence
  Actin, aortic smooth muscle (55-65)
YVGDEAQSKRG

SEQ ID NO: 27892 - protein, 11 aa, Artificial Sequence
  E3 ubiquitin-protein ligase HUWE1 (1115-1125)
YVGIATLIANY

SEQ ID NO: 27893 - protein, 10 aa, Artificial Sequence
  Ankyrin repeat and SAM domain-containing protein 1A (113-122)
YVHSFLSSGY

SEQ ID NO: 27894 - protein, 12 aa, Artificial Sequence
  Cytospin-A (477-488)
YVIDEDVKSGRY

SEQ ID NO: 27895 - protein, 13 aa, Artificial Sequence
  Cytospin-A (477-489)
YVIDEDVKSGRYM

SEQ ID NO: 27896 - protein, 9 aa, Artificial Sequence
  Kelch-like protein 42 (328-336)
YVIGGYTTR

SEQ ID NO: 27897 - protein, 9 aa, Artificial Sequence
  Lysosome-associated membraneoprotein 2 (396-404)
YVIGRRKSY

SEQ ID NO: 27898 - protein, 12 aa, Artificial Sequence
  Lysosome-associated membraneoprotein 2 (396-407)
YVIGRRKSYAGY

SEQ ID NO: 27899 - protein, 11 aa, Artificial Sequence
  Tyrosinase (149-159)
YVIPIGTYGQM

SEQ ID NO: 27900 - protein, 10 aa, Artificial Sequence
  Partner of Y14 and mago (5-14)
YVTDETGGKY

SEQ ID NO: 27901 - protein, 12 aa, Artificial Sequence
  Solute carrier family 25 member 33 (176-187)
YVYQTEGIRGFY

SEQ ID NO: 27902 - protein, 10 aa, Artificial Sequence
  Plexin-A1 (224-233)
YVYSFRSEQF

SEQ ID NO: 27903 - protein, 9 aa, Artificial Sequence
  L-dopachrome tautomerase (190-198)
YYSVRDTLL

SEQ ID NO: 27904 - protein, 10 aa, Artificial Sequence
  GTPase Kras (52-61) mod
LLDILDTAGL

SEQ ID NO: 27905 - protein, 9 aa, Artificial Sequence
  GTPase Kras (5-13) mod
KLVVVGAGV

SEQ ID NO: 27906 - protein, 10 aa, Artificial Sequence
  GTPase Kras (5-14) mod
KLVVVGAAGV

SEQ ID NO: 27907 - protein, 11 aa, Artificial Sequence
  GTPase Kras (51-61) mod
CLLDILDTAGL

SEQ ID NO: 27908 - protein, 9 aa, Artificial Sequence
  GTPase Kras (51-59)
CLLDILDTA

SEQ ID NO: 27909 - protein, 9 aa, Artificial Sequence
  GTPase Kras (5-13) mod
KLVVVGACV

SEQ ID NO: 27910 - protein, 10 aa, Artificial Sequence
  GTPase Kras (5-14)
KLVVVGAGGV

SEQ ID NO: 27911 - protein, 10 aa, Artificial Sequence
  GTPase Kras (5-14) mod
KLVVVGASGV

SEQ ID NO: 27912 - protein, 10 aa, Artificial Sequence
  GTPase Kras (5-14) mod
KLVVVGADGV

SEQ ID NO: 27913 - protein, 10 aa, Artificial Sequence
  GTPase Kras (5-14) mod
KLVVVGACGV

SEQ ID NO: 27914 - protein, 9 aa, Artificial Sequence
  GTPase Kras (1-9)
MTEYKLVVV

SEQ ID NO: 27915 - protein, 10 aa, Artificial Sequence
  GTPase Kras (5-14) mod
KLVVVGAVGV

SEQ ID NO: 27916 - protein, 32 aa, Artificial Sequence
  GTPase Kras (1-33) mod
MTEYKLVVVGAAGVGKSALTIQLIQNHFVDEY

SEQ ID NO: 27917 - protein, 32 aa, Artificial Sequence
  GTPase Kras (1-33) mod
MTEYKLVVVGASGVGKSALTIQLIQNHFVDEY

SEQ ID NO: 27918 - protein, 32 aa, Artificial Sequence
  GTPase Kras (1-33) mod
MTEYKLVVVGAGDVGKSALTIQLIQNHFVDEY

SEQ ID NO: 27919 - protein, 25 aa, Artificial Sequence
  GTPase Kras (1-26) mod
MTEYNLVVVGAGGVGKSALTIQLIQ

SEQ ID NO: 27920 - protein, 41 aa, Artificial Sequence
  GTPase Kras mod (3-43)
SYRKQVVIDGETCLLDILDTTGQEEYSAMRDQYMRTGEGFL

SEQ ID NO: 27921 - protein, 9 aa, Artificial Sequence
  BRAF (597-605) V600E
LATEKSRWS

SEQ ID NO: 27922 - protein, 10 aa, Artificial Sequence
  BRAF (597-606) V600E
LATEKSRWSG

SEQ ID NO: 27923 - protein, 10 aa, Artificial Sequence
  BRAF(597-606) V600M
LATMKSRWSG

SEQ ID NO: 27924 - protein, 9 aa, Artificial Sequence
  p53 wt (65-73)
RMPEAAPPV

SEQ ID NO: 27925 - protein, 9 aa, Artificial Sequence
  p53 wt (149-157)
STPPPGTRV

SEQ ID NO: 27926 - protein, 11 aa, Artificial Sequence
  p53 wt (187-197)
GLAPPQHLIRV

SEQ ID NO: 27927 - protein, 9 aa, Artificial Sequence
  p53 wt (217-225)
VVPYEPPEV

SEQ ID NO: 27928 - protein, 9 aa, Artificial Sequence
  p53 wt (264-272)
LLGRNSFEV

SEQ ID NO: 27929 - protein, 9 aa, Artificial Sequence
  p53 wt (125134)
TYPALNKMF

SEQ ID NO: 27930 - protein, 9 aa, Artificial Sequence
  p53 wt (161169)
AIYKQSQHM

SEQ ID NO: 27931 - protein, 9 aa, Artificial Sequence
  p53 wt (204212)
EYLDDRNTF

SEQ ID NO: 27932 - protein, 14 aa, Artificial Sequence
  p53 wt (108-122)
GFRLGFLHSGTASV

SEQ ID NO: 27933 - protein, 14 aa, Artificial Sequence
  p53 wt (110-124)
RLGFLHSGTASVTC

SEQ ID NO: 27934 - protein, 13 aa, Artificial Sequence
  p53 wt (25-35)
LWKLLPENNVLSP

SEQ ID NO: 27935 - protein, 15 aa, Artificial Sequence
  p53 wt (108-122)
GFRLGFLHSGTAKSV

SEQ ID NO: 27936 - protein, 14 aa, Artificial Sequence
  p53 wt (153-166)
PGTRVRAMAIYKQS

SEQ ID NO: 27937 - protein, 41 aa, Artificial Sequence
  BRAF (442-482)
GRRDSSDDWEIPDGQITVGQIIGSGSFGTVYKGKWHGDVAV

SEQ ID NO: 27938 - protein, 41 aa, Artificial Sequence
  BRAF (443-483)
RRDSSDDWEIPDGQITVGQRSGSGSFGTVYKGKWHGDVAVK

SEQ ID NO: 27939 - protein, 41 aa, Artificial Sequence
  BRAF (444-484)
RDSSDDWEIPDGQITVGQRIESGSFGTVYKGKWHGDVAVKM

SEQ ID NO: 27940 - protein, 41 aa, Artificial Sequence
  BRAF (581-621)
NIFLHEDLTVKIGDFGLATVESRWSGSHQFEQLSGSILWMA

SEQ ID NO: 27941 - protein, 41 aa, Artificial Sequence
  BRAF (446-486)
SSDDWEIPDGQITVGQRIGSVSFGTVYKGKWHGDVAVKMLN

SEQ ID NO: 27942 - protein, 41 aa, Artificial Sequence
  BRAF (577-617)
LKSNNIFLHEDLTVKIGDFGRATVKSRWSGSHQFEQLSGSI

SEQ ID NO: 27943 - protein, 41 aa, Artificial Sequence
  BRAF (449-489)
DWEIPDGQITVGQRIGSGSFATVYKGKWHGDVAVKMLNVTA

SEQ ID NO: 27944 - protein, 41 aa, Artificial Sequence
  BRAF (449-489)
DWEIPDGQITVGQRIGSGSFRTVYKGKWHGDVAVKMLNVTA

SEQ ID NO: 27945 - protein, 41 aa, Artificial Sequence
  BRAF (574-614)
HRDLKSNNIFLHEDLTVKIGGFGLATVKSRWSGSHQFEQLS

SEQ ID NO: 27946 - RNA, 27 nt, Artificial Sequence
  Melanoma antigen recognized by T-cells 1 (27-35)
gccgccggcaucgggauccugaccgug

SEQ ID NO: 27947 - RNA, 27 nt, Artificial Sequence
  Eukaryotic translation initiation factor 4 gamma 1 (1073-1081)
gccgcccgccccgcgaccagcacccug

SEQ ID NO: 27948 - RNA, 33 nt, Artificial Sequence
  Histone H1.2 (49-59)
gccgccagcaaggagcgcuccggcgugagccug

SEQ ID NO: 27949 - RNA, 30 nt, Artificial Sequence
  Cyclin-dependent kinase 4 (23-32)
gccugcgacccccacagcggccacuucgug

SEQ ID NO: 27950 - RNA, 30 nt, Artificial Sequence
  40S ribosomal protein S21 (37-46)
gccgagguggacaaggucaccggccgcuuc

SEQ ID NO: 27951 - RNA, 27 nt, Artificial Sequence
  DNA replication licensing factor MCM4 (694-702)
gcccacagcaccaucaugccccgccug

SEQ ID NO: 27952 - RNA, 27 nt, Artificial Sequence
  Actin, gamma-enteric smooth muscle (277-285)
gcccuggcccccagcaccaugaagauc

SEQ ID NO: 27953 - RNA, 30 nt, Artificial Sequence
  Melanocyte protein PMEL (231-240)
gcccuggacggcgggaacaagcacuuccuc

SEQ ID NO: 27954 - RNA, 27 nt, Artificial Sequence
  Phospholipid transfer protein (2-10)
gcccuguucggcgcccucuuccuggcg

SEQ ID NO: 27955 - RNA, 27 nt, Artificial Sequence
  Vimentin (332-340)
gcccugaagggcaccaacgagagccuc

SEQ ID NO: 27956 - RNA, 27 nt, Artificial Sequence
  Eukaryotic translation initiation factor 3 subunit D (439-447)
gcccugcucgccggcagcgaguaccug

SEQ ID NO: 27957 - RNA, 27 nt, Artificial Sequence
  Melanocyte protein PMEL (24-32)
gcccugcucgccgugggcgcgaccaag

SEQ ID NO: 27958 - RNA, 27 nt, Artificial Sequence
  Melanoma antigen recognized by T-cells 1 (56-64)
gcccugauggacaagagccuccacgug

SEQ ID NO: 27959 - RNA, 27 nt, Artificial Sequence
  Melanocyte protein PMEL (94-102)
gcccugaacuuccccggcagccagaag

SEQ ID NO: 27960 - RNA, 27 nt, Artificial Sequence
  Melanoma-associated antigen 1 (301-309)
gcccugcgcgaggaggaggagggcgug

SEQ ID NO: 27961 - RNA, 27 nt, Artificial Sequence
  Fructose-bisphosphate aldolase A (98-106)
gcccugagcgaccaccacaucuaccuc

SEQ ID NO: 27962 - RNA, 36 nt, Artificial Sequence
  Guanine nucleotide-binding protein G(I)/G(S)/G(T) subunit beta-2 (167-178)
gcccugugggacaucgagaccggccagcagaccgug

SEQ ID NO: 27963 - RNA, 27 nt, Artificial Sequence
  ER membrane protein complex subunit 7 (4-12)
gcccuguggggcuucuuccccgugcuc

SEQ ID NO: 27964 - RNA, 30 nt, Artificial Sequence
  Melanocyte protein PMEL (184-193)
gccaugcugggcacccacaccauggaggug

SEQ ID NO: 27965 - RNA, 27 nt, Artificial Sequence
  Actin, cytoplasmic 1 (14-22)
gcccccgaggagcacccggugcugcuc

SEQ ID NO: 27966 - RNA, 27 nt, Artificial Sequence
  High mobility group protein B1 (94-102)
gcccccaagcgcccgcccagcgccuuc

SEQ ID NO: 27967 - RNA, 27 nt, Artificial Sequence
  Coiled-coil-helix-coiled-coil-helix domain-containing protein 2 (49-57)
gccccccgccagccgggccugauggcc

SEQ ID NO: 27968 - RNA, 27 nt, Artificial Sequence
  HLA class II histocompatibility antigen, DP beta 1 chain (9-17)
gccccccgcaccguggcccugaccgcg

SEQ ID NO: 27969 - RNA, 27 nt, Artificial Sequence
  60S ribosomal protein L13 (189-197)
gcccgccuguucggcauccgggccaag

SEQ ID NO: 27970 - RNA, 27 nt, Artificial Sequence
  Thymosin beta-10 (16-24)
gccagcuucgacaaggccaagcugaag

SEQ ID NO: 27971 - RNA, 27 nt, Artificial Sequence
  Guanine nucleotide-binding protein G(s) subunit alpha isoforms short (239-247)
gccagcuccagcuacaacauggugauc

SEQ ID NO: 27972 - RNA, 24 nt, Artificial Sequence
  Guanine nucleotide-binding protein subunit beta-2-like 1 (251-258)
gccaccggccccagcaucaagauc

SEQ ID NO: 27973 - RNA, 27 nt, Artificial Sequence
  Bax inhibitor 1 (91-99)
gccuacgugcacauggucacccacuuc

SEQ ID NO: 27974 - RNA, 27 nt, Artificial Sequence
  Wilms tumor protein (235-243)
ugcaugaccuggaaccagaugaaccug

SEQ ID NO: 27975 - RNA, 27 nt, Artificial Sequence
  Melanocyte protein PMEL (647-655)
ugccccaucggcgagaacagcccgcug

SEQ ID NO: 27976 - RNA, 48 nt, Artificial Sequence
  Gamma-secretase C-terminal fragment 59 (562-577)
gacgccgaguuccgccacgacagcggcuacgaggugcaccaccagaag

SEQ ID NO: 27977 - RNA, 51 nt, Artificial Sequence
  Gamma-secretase C-terminal fragment 59 (562-578)
gacgccgaguuccgccacgacagcggcuacgaggugcaccaccagaagcug

SEQ ID NO: 27978 - RNA, 27 nt, Artificial Sequence
  Thymidylate synthase (254-262)
gacgcccacaucuaccugaaccacauc

SEQ ID NO: 27979 - RNA, 27 nt, Artificial Sequence
  60S ribosomal protein L10 (28-36)
gacgccaagauccgcaucuucgaccug

SEQ ID NO: 27980 - RNA, 27 nt, Artificial Sequence
  Lys-63-specific deubiquitinase BRCC36 (221-229)
gacgccuaccgccggauccacagccug

SEQ ID NO: 27981 - RNA, 27 nt, Artificial Sequence
  Myelin basic protein (109-117)
gacgagaaccccgugguccacuucuuc

SEQ ID NO: 27982 - RNA, 27 nt, Artificial Sequence
  Vimentin (219-227)
gaccuggagcgcaagguggagagccuc

SEQ ID NO: 27983 - RNA, 45 nt, Artificial Sequence
  HLA class I histocompatibility antigen, A-2 alpha chain (29-43)
gacacccaguucgugcgcuucgacagcgacgccgccucccagcgg

SEQ ID NO: 27984 - RNA, 54 nt, Artificial Sequence
  HLA class I histocompatibility antigen, A-2 alpha chain (29-46)
gacacccaguucgugcgcuucgacagcgacgccgccucccagcggauggagccc

SEQ ID NO: 27985 - RNA, 30 nt, Artificial Sequence
  Melanoma antigen recognized by T-cells 1 (26-35)
gaggccgccggcaucgggauccugaccgug

SEQ ID NO: 27986 - RNA, 27 nt, Artificial Sequence
  Melanoma-associated antigen 1 (161-169)
gaggccgaccccaccggccacagcuac

SEQ ID NO: 27987 - RNA, 27 nt, Artificial Sequence
  Ragulator complex protein LAMTOR5 (40-48)
gagcacgccggcgugaucagcguccug

SEQ ID NO: 27988 - RNA, 30 nt, Artificial Sequence
  Mart-1 (26-35)
gagcuggccggcaucgggauccucaccgug

SEQ ID NO: 27989 - RNA, 27 nt, Artificial Sequence
  40S ribosomal protein S25 (75-83)
gagcgccugaagauccggggcagccuc

SEQ ID NO: 27990 - RNA, 27 nt, Artificial Sequence
  Actin, cytoplasmic 1 (364-372)
gagagcggccccuccaucgugcaccgc

SEQ ID NO: 27991 - RNA, 27 nt, Artificial Sequence
  POTE ankyrin domain family member F (825-833)
gagaccuucaacacccccgccauguac

SEQ ID NO: 27992 - RNA, 30 nt, Artificial Sequence
  Mortality factor 4-like protein 1 (312-321)
gagguggcccccccggaguaccaccgcaag

SEQ ID NO: 27993 - RNA, 27 nt, Artificial Sequence
  Melanoma-associated antigen 3 (168-176)
gagguggaccccaucggccaccuguac

SEQ ID NO: 27994 - RNA, 27 nt, Artificial Sequence
  Heme oxygenase 1 (103-111)
gaggugauccccuacaccccggccaug

SEQ ID NO: 27995 - RNA, 27 nt, Artificial Sequence
  G2/mitotic-specific cyclin-B1 (18-26)
uucgccuucgugaccgacaacaccuac

SEQ ID NO: 27996 - RNA, 27 nt, Artificial Sequence
  Proteasome subunit alpha type-5 (154-162)
uuccacauggaccccagcggcaccuuc

SEQ ID NO: 27997 - RNA, 27 nt, Artificial Sequence
  Protein THEMIS2 (597-605)
uucaucaaggacggcagcuccaccuac

SEQ ID NO: 27998 - RNA, 30 nt, Artificial Sequence
  Vimentin (123-132)
uuccuggagcagcagaacaagauccuccug

SEQ ID NO: 27999 - RNA, 30 nt, Artificial Sequence
  Fatty acid synthase (2335-2344)
uuccuguucgacggcagccccaccuacgug

SEQ ID NO: 28000 - RNA, 33 nt, Artificial Sequence
  Fatty acid synthase (2335-2345)
uuccuguucgacggcagccccaccuacgugcuc

SEQ ID NO: 28001 - RNA, 27 nt, Artificial Sequence
  Mammaglobin-A (66-74)
uuccugaaccagaccgacgagacccuc

SEQ ID NO: 28002 - RNA, 27 nt, Artificial Sequence
  Melanoma-associated antigen 3 (271-279)
uuccuguggggcccccgcgcccucgug

SEQ ID NO: 28003 - RNA, 27 nt, Artificial Sequence
  Actin-related protein 2 (27-35)
uuccccgagcacaucuucccggcccug

SEQ ID NO: 28004 - RNA, 27 nt, Artificial Sequence
  60S ribosomal protein L28 (38-46)
uuccgcuacaacggccugauccaccgg

SEQ ID NO: 28005 - RNA, 27 nt, Artificial Sequence
  60S acidic ribosomal protein P0 (67-75)
ggccaccuggagaacaaccccgcccuc

SEQ ID NO: 28006 - RNA, 33 nt, Artificial Sequence
  Cellular tumor antigen p53 (62-72)
ggccuggcccccccgcagcaccucauccgcgug

SEQ ID NO: 28007 - RNA, 27 nt, Artificial Sequence
  Proteasome subunit beta type-3 (55-63)
ggccuggccaccgacgugcagaccguc

SEQ ID NO: 28008 - RNA, 27 nt, Artificial Sequence
  DNA (cytosine-5)-methyltransferase 1 (425-433)
ggccugaucgagaagaacaucgagcuc

SEQ ID NO: 28009 - RNA, 27 nt, Artificial Sequence
  Catenin beta-1 (400-408)
ggccugcucgggacccuggugcagcug

SEQ ID NO: 28010 - RNA, 27 nt, Artificial Sequence
  Myosin-9 (338-346)
ggccugcuccgcgugaucagcgggguc

SEQ ID NO: 28011 - RNA, 30 nt, Artificial Sequence
  Reticulocalbin-2 (4-13)
ggcccccgcaccgccgcccuggggcuccug

SEQ ID NO: 28012 - RNA, 30 nt, Artificial Sequence
  Heterogeneous nuclear ribonucleoprotein A1 (339-348)
ggccccuacgggggcgggggccaguacuuc

SEQ ID NO: 28013 - RNA, 27 nt, Artificial Sequence
  60S ribosomal protein L8 (127-135)
ggccgcaucgacaagcccauccugaag

SEQ ID NO: 28014 - RNA, 27 nt, Artificial Sequence
  Cellular tumor antigen p53 (5-13)
ggccgcaacagcuucgaggugcggguc

SEQ ID NO: 28015 - RNA, 30 nt, Artificial Sequence
  Ribonucleoside-diphosphate reductase subunit M2 (238-247)
ggcagcuucgccuccaucuucuggcugaag

SEQ ID NO: 28016 - RNA, 27 nt, Artificial Sequence
  Melanocyte protein PMEL (467-475)
ggcaccgccacccugcgccucgugaag

SEQ ID NO: 28017 - RNA, 30 nt, Artificial Sequence
  Melanoma-associated antigen B2 (231-240)
ggcguguacgacggggaggagcacagcguc

SEQ ID NO: 28018 - RNA, 27 nt, Artificial Sequence
  Protein SSX2 (17-25)
ggcuacgaccagaucaugcccaagaag

SEQ ID NO: 28019 - RNA, 27 nt, Artificial Sequence
  Proliferating cell nuclear antigen (241-249)
aucgccgacaugggccaccugaaguac

SEQ ID NO: 28020 - RNA, 27 nt, Artificial Sequence
  Receptor tyrosine-protein kinase erbB-2 (654-662)
aucaucagcgccguggucggcauccug

SEQ ID NO: 28021 - RNA, 27 nt, Artificial Sequence
  Heat shock protein HSP 90-beta (496-504)
auccuggacaagaagguggagaagguc

SEQ ID NO: 28022 - RNA, 27 nt, Artificial Sequence
  Ornithine decarboxylase (23-31)
auccuggaccagaagaucaacgaggug

SEQ ID NO: 28023 - RNA, 27 nt, Artificial Sequence
  Ubiquitin-conjugating enzyme E2 E3 (97-105)
auccugggccccccggggagcguguac

SEQ ID NO: 28024 - RNA, 27 nt, Artificial Sequence
  Vimentin (130-138)
auccugcucgccgagcuggagcagcug

SEQ ID NO: 28025 - RNA, 27 nt, Artificial Sequence
  60S ribosomal protein L19 (137-145)
auccugauggagcacauccacaagcuc

SEQ ID NO: 28026 - RNA, 27 nt, Artificial Sequence
  Small nuclear ribonucleoprotein-associated proteins B and B' (13-21)
auccugcaggacggccgcaucuucauc

SEQ ID NO: 28027 - RNA, 27 nt, Artificial Sequence
  Elongation factor 2 (161-169)
auccugaccgacaucaccaagggcgug

SEQ ID NO: 28028 - RNA, 27 nt, Artificial Sequence
  Melanoma antigen recognized by T-cells 1 (32-40)
auccugaccgugauccucggcguccug

SEQ ID NO: 28029 - RNA, 27 nt, Artificial Sequence
  Putative small nuclear ribonucleoprotein G-like protein 15 (68-76)
aucaugcuggaggcccucgagcgcgug

SEQ ID NO: 28030 - RNA, 27 nt, Artificial Sequence
  Serine-tRNA ligase, cytoplasmic (357-365)
auccccuaccacaucgugaacaucguc

SEQ ID NO: 28031 - RNA, 48 nt, Artificial Sequence
  Beta-2-microglobulin (21-36)
auccagcgcacccccaagauccagguguacagccggcacccggccgag

SEQ ID NO: 28032 - RNA, 27 nt, Artificial Sequence
  ADP/ATP translocase 2 (79-87)
auccgcuacuuccccacccaggcccug

SEQ ID NO: 28033 - RNA, 27 nt, Artificial Sequence
  Acyl-CoA desaturase (20-28)
aucaccgcccccccgagccgcgugcug

SEQ ID NO: 28034 - RNA, 27 nt, Artificial Sequence
  Melanocyte protein PMEL (216-224)
aucaccgaccaggugcccuucagcguc

SEQ ID NO: 28035 - RNA, 27 nt, Artificial Sequence
  Ubiquitin-60S ribosomal protein L40 (68-76)
aaggagagcacccugcaccucgugcug

SEQ ID NO: 28036 - RNA, 54 nt, Artificial Sequence
  Receptor tyrosine-protein kinase erbB-2 (369-386)
aagaucuucggcagccuggccuuccuccccgaguccuucgacggggacccggcc

SEQ ID NO: 28037 - RNA, 45 nt, Artificial Sequence
  Protein SSX2 (45-59)
aagaucuucuacguguacaugaagcgcaaguacgaggccaugacc

SEQ ID NO: 28038 - RNA, 30 nt, Artificial Sequence
  Vimentin (236-245)
aagcugcacgaggaggagauccaggagcuc

SEQ ID NO: 28039 - RNA, 27 nt, Artificial Sequence
  Myosin-9 (1843-1851)
aagcugaaggacgugcuccugcagguc

SEQ ID NO: 28040 - RNA, 30 nt, Artificial Sequence
  Prelamin-A/C (297-306)
aagcugcucgagggcgaggaggagcgccug

SEQ ID NO: 28041 - RNA, 27 nt, Artificial Sequence
  Mammaglobin-A (2-10)
aagcugcucauggugcugaugcuggcc

SEQ ID NO: 28042 - RNA, 27 nt, Artificial Sequence
  Heat shock cognate 71 kDa protein (126-134)
aagaugaaggagaucgccgaggccuac

SEQ ID NO: 28043 - RNA, 27 nt, Artificial Sequence
  Melanoma-associated antigen 2 (140-148)
aagaugguggagcugguccacuuccuc

SEQ ID NO: 28044 - RNA, 27 nt, Artificial Sequence
  Beta-adrenergic receptor kinase 1 (667-675)
aagccccgcagcccgguggucgagcug

SEQ ID NO: 28045 - RNA, 27 nt, Artificial Sequence
  Farnesyl pyrophosphate synthase (184-192)
aagcgcuacaagagcaucgugaaguac

SEQ ID NO: 28046 - RNA, 27 nt, Artificial Sequence
  Cellular tumor antigen p53 (139-147)
aagaccugccccgugcagcuguggguc

SEQ ID NO: 28047 - RNA, 27 nt, Artificial Sequence
  40S ribosomal protein S8 (75-83)
aagacccgcaucaucgacguggucuac

SEQ ID NO: 28048 - RNA, 27 nt, Artificial Sequence
  Melanocyte protein PMEL (161-169)
aagaccuggggccaguacuggcaggug

SEQ ID NO: 28049 - RNA, 27 nt, Artificial Sequence
  Melanoma-associated antigen 1 (278-286)
aaggugcuggaguacgucaucaaggug

SEQ ID NO: 28050 - RNA, 27 nt, Artificial Sequence
  Glutamate carboxypeptidase 2 (298-306)
aaguacgccgacaagaucuacagcauc

SEQ ID NO: 28051 - RNA, 27 nt, Artificial Sequence
  Serine/threonine-protein phosphatase PP1-beta catalytic subunit (112-120)
aaguaccccgagaacuucuuccugcuc

SEQ ID NO: 28052 - RNA, 30 nt, Artificial Sequence
  Mammaglobin-A (83-92)
cugaucuacgacagcucccucugcgaccug

SEQ ID NO: 28053 - RNA, 27 nt, Artificial Sequence
  ATP-binding cassette sub-family F member 2 (251-259)
cugcucgacgagcccaccaaccaccug

SEQ ID NO: 28054 - RNA, 27 nt, Artificial Sequence
  Gamma-interferon-inducible lysosomal thiol reductase (24-32)
cugcucgacgugcccaccgccgccguc

SEQ ID NO: 28055 - RNA, 27 nt, Artificial Sequence
  Cellular tumor antigen p53 (264-272)
cugcucggccgcaacagcuucgaggug

SEQ ID NO: 28056 - RNA, 30 nt, Artificial Sequence
  Gamma-interferon-inducible lysosomal thiol reductase (23-32)
cugcuccuggacgugcccaccgccgccguc

SEQ ID NO: 28057 - RNA, 36 nt, Artificial Sequence
  Gamma-interferon-inducible lysosomal thiol reductase (15-26)
cugcuccuggacgugcccaccgccgccguccaggcg

SEQ ID NO: 28058 - RNA, 30 nt, Artificial Sequence
  Stress-70 protein, mitochondrial (436-445)
cugcuccuggacgugaccccccugagccuc

SEQ ID NO: 28059 - RNA, 27 nt, Artificial Sequence
  Mucin-1 (12-20)
cugcuccugcugaccgugcucaccguc

SEQ ID NO: 28060 - RNA, 27 nt, Artificial Sequence
  Mammaglobin-A (4-12)
cugauggugcucaugcuggccgcccug

SEQ ID NO: 28061 - RNA, 27 nt, Artificial Sequence
  Melanocyte protein PMEL (527-535)
cugcccaaggaggccugcauggagauc

SEQ ID NO: 28062 - RNA, 27 nt, Artificial Sequence
  Rac GTPase-activating protein 1 (403-411)
cugccccaggccaaccgcgacacccuc

SEQ ID NO: 28063 - RNA, 27 nt, Artificial Sequence
  Catenin beta-1 (370-378)
cugaccgaccccagccagcgccucgug

SEQ ID NO: 28064 - RNA, 27 nt, Artificial Sequence
  HLA class I histocompatibility antigen, B-39 alpha chain (2-10)
cuggugauggccccccgcaccguccuc

SEQ ID NO: 28065 - RNA, 27 nt, Artificial Sequence
  40S ribosomal protein S16 (40-48)
augaucgagccccgcacccugcaguac

SEQ ID NO: 28066 - RNA, 27 nt, Artificial Sequence
  Melanocyte protein PMEL (185-193)
augcugggcacccacaccauggaggug

SEQ ID NO: 28067 - RNA, 27 nt, Artificial Sequence
  Tyrosinase (1-9)
augcugcucgccgugcuguacugccug

SEQ ID NO: 28068 - RNA, 27 nt, Artificial Sequence
  HLA class I histocompatibility antigen, alpha chain E (1-9)
augguggacggcacccugcuccugcug

SEQ ID NO: 28069 - RNA, 27 nt, Artificial Sequence
  Vimentin (177-185)
aaccuggccgaggacaucaugcgccuc

SEQ ID NO: 28070 - RNA, 27 nt, Artificial Sequence
  Bifunctional purine biosynthesis protein PURH (101-109)
aaccuguaccccuucgugaagaccguc

SEQ ID NO: 28071 - RNA, 48 nt, Artificial Sequence
  Transferrin receptor protein 1 (215-230)
aaccccggcggguacguggccuacagcaaggccgcgaccgucaccggc

SEQ ID NO: 28072 - RNA, 54 nt, Artificial Sequence
  Transferrin receptor protein 1 (215-232)
aaccccggcggguacguggccuacagcaaggccgcgaccgucaccggcaagcug

SEQ ID NO: 28073 - RNA, 30 nt, Artificial Sequence
  ELAV-like protein 1 (186-195)
aaccccaaccagaacaagaacguggcccug

SEQ ID NO: 28074 - RNA, 27 nt, Artificial Sequence
  U1 small nuclear ribonucleoprotein A (229-237)
aaccaguuccccggcuucaaggaggug

SEQ ID NO: 28075 - RNA, 45 nt, Artificial Sequence
  Heat shock 70 kDa protein 1-like (170-184)
aacgugcugcgcaucaucaacgagcccaccgccgccgcgaucgcc

SEQ ID NO: 28076 - RNA, 45 nt, Artificial Sequence
  HLA class II histocompatibility antigen, DR alpha chain (52-66)
cagggcgcccuggccaacaucgcgguggacaaggccaaccucgag

SEQ ID NO: 28077 - RNA, 27 nt, Artificial Sequence
  Myosin-9 (478-486)
cagcuguucaaccacaccauguucauc

SEQ ID NO: 28078 - RNA, 27 nt, Artificial Sequence
  Myosin-9 (163-171)
cagcugauggccgagaagcuccagcug

SEQ ID NO: 28079 - RNA, 27 nt, Artificial Sequence
  T-complex protein 1 subunit alpha (187-195)
cagccccgcuacccggugaacagcguc

SEQ ID NO: 28080 - RNA, 30 nt, Artificial Sequence
  Carcinoembryonic antigen-related cell adhesion molecule 5 (268-277)
caguacagcugguucgugaacggcaccuuc

SEQ ID NO: 28081 - RNA, 27 nt, Artificial Sequence
  Histone H2AX (78-86)
cgcaucaucccccggcaccugcagcuc

SEQ ID NO: 28082 - RNA, 27 nt, Artificial Sequence
  Lamin-B1 (42-50)
cgccuggccguguacaucgacaagguc

SEQ ID NO: 28083 - RNA, 27 nt, Artificial Sequence
  Prelamin-A/C (41-49)
cgccuggccguguacaucgaccggguc

SEQ ID NO: 28084 - RNA, 27 nt, Artificial Sequence
  Melanocyte protein PMEL (626-634)
cgccugaugaagcaggacuucagcgug

SEQ ID NO: 28085 - RNA, 27 nt, Artificial Sequence
  60S acidic ribosomal protein P2 (38-46)
cgccugaacaaggugaucagcgagcuc

SEQ ID NO: 28086 - RNA, 27 nt, Artificial Sequence
  Vimentin (69-77)
cgccugcggagcuccgugcccggcguc

SEQ ID NO: 28087 - RNA, 27 nt, Artificial Sequence
  Wilms tumor protein (126-134)
cgcauguuccccaacgccccguaccug

SEQ ID NO: 28088 - RNA, 27 nt, Artificial Sequence
  Histone deacetylase 2 variant (122-130)
cgcaugcugccccacgccccgggcgug

SEQ ID NO: 28089 - RNA, 27 nt, Artificial Sequence
  Cellular tumor antigen p53 (65-73)
cgcaugcccgaggccgccccgcccgug

SEQ ID NO: 28090 - RNA, 27 nt, Artificial Sequence
  Actin, cytoplasmic 2 (103-111)
cgcaugcagaaggagaucaccgcccug

SEQ ID NO: 28091 - RNA, 69 nt, Artificial Sequence
  Melanoma antigen recognized by T-cells 1 (51-73)
cgcaacggcuaccgggcccugauggacaagagccuccacguggggacccagugcgcccugacccgccgg

SEQ ID NO: 28092 - RNA, 27 nt, Artificial Sequence
  B-lymphocyte antigen CD20 (222-230)
cgccccaagagcaacaucgugcugcuc

SEQ ID NO: 28093 - RNA, 27 nt, Artificial Sequence
  Actin, aortic smooth muscle (39-47)
cgcccccggcaccagggcgugaugguc

SEQ ID NO: 28094 - RNA, 27 nt, Artificial Sequence
  Probable global transcription activator SNF2L2 (261-269)
cgccccagcggcccggggcccgagcug

SEQ ID NO: 28095 - RNA, 27 nt, Artificial Sequence
  Myotubularin-related protein 5 (644-652)
cgccccuacagcaacguguccaaccug

SEQ ID NO: 28096 - RNA, 27 nt, Artificial Sequence
  Proteasome subunit beta type-1 (127-135)
cgccgguucuuccccuacuacguguac

SEQ ID NO: 28097 - RNA, 27 nt, Artificial Sequence
  60S ribosomal protein L7a (110-118)
cgccggcacuggggcgggaacgugcug

SEQ ID NO: 28098 - RNA, 27 nt, Artificial Sequence
  Histone H3.3 (53-61)
cgccgguaccagaagagcaccgagcug

SEQ ID NO: 28099 - RNA, 27 nt, Artificial Sequence
  60S ribosomal protein L24 (23-31)
cgcaccgacggcaagguguuccaguuc

SEQ ID NO: 28100 - RNA, 27 nt, Artificial Sequence
  40S ribosomal protein S3 (54-62)
cgcacccagaacgugcugggcgagaag

SEQ ID NO: 28101 - RNA, 27 nt, Artificial Sequence
  HLA class I histocompatibility antigen, Cw-7 alpha chain (2-10)
cgcgugauggccccccgggcccugcuc

SEQ ID NO: 28102 - RNA, 30 nt, Artificial Sequence
  HLA class I histocompatibility antigen, B-15 alpha chain (194-203)
cgcuaccuggagaacggcaaggagacccuc

SEQ ID NO: 28103 - RNA, 27 nt, Artificial Sequence
  Serine/threonine-protein kinase Sgk1 (208-216)
agcgcccugggcuaccuccacucccug

SEQ ID NO: 28104 - RNA, 27 nt, Artificial Sequence
  Tyrosinase (192-200)
agcgagaucuggcgcgacaucgacuuc

SEQ ID NO: 28105 - RNA, 27 nt, Artificial Sequence
  Serine/threonine-protein phosphatase PP1-alpha catalytic subunit (10-18)
agcaucaucggccgccugcucgaggug

SEQ ID NO: 28106 - RNA, 30 nt, Artificial Sequence
  Melanocyte protein PMEL (577-586)
agccuggccgacaccaacucccucgccgug

SEQ ID NO: 28107 - RNA, 27 nt, Artificial Sequence
  Heterogeneous nuclear ribonucleoprotein K (154-162)
agccuggccggcgggaucaucggcgug

SEQ ID NO: 28108 - RNA, 27 nt, Artificial Sequence
  L-dopachrome tautomerase (288-296)
agccuggacgacuacaaccaccucgug

SEQ ID NO: 28109 - RNA, 27 nt, Artificial Sequence
  Protein flightless-1 homolog (1009-1017)
agccuguuccccggcaagcucgaggug

SEQ ID NO: 28110 - RNA, 27 nt, Artificial Sequence
  Dual specificity protein phosphatase 5 (337-345)
agccugaucggccaccuccagacccug

SEQ ID NO: 28111 - RNA, 30 nt, Artificial Sequence
  TSC22 domain family protein 3 (27-36)
agccugcucggcggggacguggucuccgug

SEQ ID NO: 28112 - RNA, 27 nt, Artificial Sequence
  Cancer/testis antigen 1 (157-165)
agccugcucauguggaucacccagugc

SEQ ID NO: 28113 - RNA, 27 nt, Artificial Sequence
  Serine/threonine-protein phosphatase 2A 65 kDa regulatory subunit A alpha isoform (403-411)
agccugcuccccgccaucguggagcug

SEQ ID NO: 28114 - RNA, 33 nt, Artificial Sequence
  Protein transport protein Sec23B (138-148)
agccugcuccccccggacgcccuggugggccug

SEQ ID NO: 28115 - RNA, 33 nt, Artificial Sequence
  Protein transport protein Sec23A (156-166)
agccugcuccccccgaccgcccuggugggccug

SEQ ID NO: 28116 - RNA, 27 nt, Artificial Sequence
  Vimentin (226-234)
agccugcaggaggagaucgccuuccuc

SEQ ID NO: 28117 - RNA, 27 nt, Artificial Sequence
  CD59oprotein (106-114)
agccuguccgagaagaccgugcuccug

SEQ ID NO: 28118 - RNA, 27 nt, Artificial Sequence
  Collagen alpha-5(IV) chain (18-26)
agccuguggggccagcccgccgaggcc

SEQ ID NO: 28119 - RNA, 27 nt, Artificial Sequence
  AT-rich interactive domain-containing protein 3A (372-380)
agccccaagcugccgguguccagccuc

SEQ ID NO: 28120 - RNA, 33 nt, Artificial Sequence
  Polypyrimidine tract-binding protein 1 (141-151)
agccccaaccaggcccgcgcccaggcggcccug

SEQ ID NO: 28121 - RNA, 27 nt, Artificial Sequence
  Spermine synthase (128-136)
agccccuaccagaacaucaagauccug

SEQ ID NO: 28122 - RNA, 27 nt, Artificial Sequence
  Eukaryotic translation initiation factor 3 subunit D (61-69)
agccaguucggcgggggcucccaguac

SEQ ID NO: 28123 - RNA, 27 nt, Artificial Sequence
  Ornithine decarboxylase (180-188)
agcuccgagcagaccuucauguacuac

SEQ ID NO: 28124 - RNA, 27 nt, Artificial Sequence
  Glutamine-fructose-6-phosphate aminotransferase (isomerizing) 1 (95-103)
agcaccgaccacauccccauccuguac

SEQ ID NO: 28125 - RNA, 30 nt, Artificial Sequence
  Cellular tumor antigen p53 (149-157)
agcacccccccgcccggcgccacccgcgug

SEQ ID NO: 28126 - RNA, 27 nt, Artificial Sequence
  Eukaryotic translation initiation factor 3 subunit L (226-234)
agcgugcugaacguccuccacucccug

SEQ ID NO: 28127 - RNA, 27 nt, Artificial Sequence
  L-dopachrome tautomerase (180-188)
agcguguacgacuucuucgucuggcug

SEQ ID NO: 28128 - RNA, 27 nt, Artificial Sequence
  Mammaglobin-A (32-40)
accaucaacccccaggugagcaagacc

SEQ ID NO: 28129 - RNA, 27 nt, Artificial Sequence
  L-dopachrome tautomerase (360-368)
acccuggacagccaggugaugucccuc

SEQ ID NO: 28130 - RNA, 27 nt, Artificial Sequence
  Protein BTG2 (101-109)
acccuguggguggaccccuacgagguc

SEQ ID NO: 28131 - RNA, 27 nt, Artificial Sequence
  DNA-directed RNA polymerase II subunit RPB1 (527-535)
accccccagagcaaccgcccggugaug

SEQ ID NO: 28132 - RNA, 33 nt, Artificial Sequence
  Heat shock cognate 71 kDa protein (22-32)
accguguucgacgccaagcgccugaucggccgg

SEQ ID NO: 28133 - RNA, 27 nt, Artificial Sequence
  Carcinoembryonic antigen-related cell adhesion molecule 5 (652-660)
accuacgccugcuucgugagcaaccug

SEQ ID NO: 28134 - RNA, 27 nt, Artificial Sequence
  Receptor tyrosine-protein kinase erbB-2 (63-71)
accuaccugcccaccaacgccagccuc

SEQ ID NO: 28135 - RNA, 24 nt, Artificial Sequence
  Serine/threonine-protein phosphatase 2A 65 kDa regulatory subunit A alpha isoform (263-270)
guggccgacaaguucaccgagcug

SEQ ID NO: 28136 - RNA, 27 nt, Artificial Sequence
  Actin, cytoplasmic 2 (76-84)
guggcccuggacuucgagcaggagaug

SEQ ID NO: 28137 - RNA, 51 nt, Artificial Sequence
  HLA class I histocompatibility antigen, A-2 alpha chain (27-43)
guggacgacacccaguucguccgcuucgacagcgacgccgccucccagcgg

SEQ ID NO: 28138 - RNA, 57 nt, Artificial Sequence
  HLA class I histocompatibility antigen, A-2 alpha chain (27-45)
guggacgacacccaguucguccgcuucgacagcgacgccgccucccagcggauggag

SEQ ID NO: 28139 - RNA, 60 nt, Artificial Sequence
  HLA class I histocompatibility antigen, A-2 alpha chain (27-46)
guggacgacacccaguucguccgcuucgacagcgacgccgccucccagcggauggagccc

SEQ ID NO: 28140 - RNA, 63 nt, Artificial Sequence
  HLA class I histocompatibility antigen, A-2 alpha chain (27-47)
guggacgacacccaguucguccgcuucgacagcgacgccgccucccagcggauggagccccgc

SEQ ID NO: 28141 - RNA, 27 nt, Artificial Sequence
  Myeloblastin (169-177)
gugcugcaggagcucaacgucaccgug

SEQ ID NO: 28142 - RNA, 30 nt, Artificial Sequence
  Melanocyte protein PMEL (483-492)
gugcuguaccgcuacggcagcuucuccguc

SEQ ID NO: 28143 - RNA, 27 nt, Artificial Sequence
  HLA class I histocompatibility antigen, Cw-3 alpha chain (3-11)
gugauggccccccgcacccugauccuc

SEQ ID NO: 28144 - RNA, 27 nt, Artificial Sequence
  HLA class I histocompatibility antigen, A-2 alpha chain (3-11)
gugauggccccccgcacccugguccuc

SEQ ID NO: 28145 - RNA, 27 nt, Artificial Sequence
  Importin subunit alpha-5 (434-442)
gugauggacagcaagaucguccaggug

SEQ ID NO: 28146 - RNA, 27 nt, Artificial Sequence
  60S acidic ribosomal protein P2 (65-73)
gugcccgccggcggggccgucgcggug

SEQ ID NO: 28147 - RNA, 36 nt, Artificial Sequence
  rRNA 2'-O-methyltransferase fibrillarin (174-185)
gugagcgacaucgucggccccgacgggcugguguac

SEQ ID NO: 28148 - RNA, 45 nt, Artificial Sequence
  Beta-2-microglobulin (84-98)
gugacccugagccagcccaagaucgucaagugggaccgcgacaug

SEQ ID NO: 28149 - RNA, 27 nt, Artificial Sequence
  L-dopachrome tautomerase (82-90)
guggucaugggcacccugguggcccuc

SEQ ID NO: 28150 - RNA, 60 nt, Artificial Sequence
  Cancer/testis antigen 1 (161-180)
uggaucacccagugcuuccugcccguguuccucgcccagccgcccagcggccagcgccgg

SEQ ID NO: 28151 - RNA, 48 nt, Artificial Sequence
  Melanocyte protein PMEL (44-59)
uggaaccgccagcuguaccccgaguggaccgaggcccagcggcucgac

SEQ ID NO: 28152 - RNA, 27 nt, Artificial Sequence
  Elongation factor 2 (265-273)
uacuucgaccccgccaacggcaaguuc

SEQ ID NO: 28153 - RNA, 27 nt, Artificial Sequence
  Cyclin-A2 (178-186)
uaccacgaggacauccacaccuaccug

SEQ ID NO: 28154 - RNA, 27 nt, Artificial Sequence
  DNA (cytosine-5)-methyltransferase 1 (254-262)
uaccuggacgaccccgaccucaaguac

SEQ ID NO: 28155 - RNA, 27 nt, Artificial Sequence
  Melanocyte protein PMEL (280-288)
uaccuggagcccggcccggugaccgcc

SEQ ID NO: 28156 - RNA, 27 nt, Artificial Sequence
  Myosin-9 (260-268)
uaccugcucgagaagagccgcgccauc

SEQ ID NO: 28157 - RNA, 27 nt, Artificial Sequence
  Probable ATP-dependent RNA helicase DDX5 (148-156)
uaccugcuccccgccaucgugcacauc

SEQ ID NO: 28158 - RNA, 27 nt, Artificial Sequence
  Carcinoembryonic antigen-related cell adhesion molecule 5 (605-613)
uaccugagcggcgccaaccucaaccug

SEQ ID NO: 28159 - RNA, 27 nt, Artificial Sequence
  Myosin-9 (9-17)
uaccuguacguggacaagaacuucauc

SEQ ID NO: 28160 - RNA, 27 nt, Artificial Sequence
  Tyrosinase (369-377
uacauggacggcaccaugagccaggug

SEQ ID NO: 28161 - RNA, 27 nt, Artificial Sequence
  Tyrosinase (369-377)
uacaugaacggcaccaugagccaggug

SEQ ID NO: 28162 - RNA, 27 nt, Artificial Sequence
  Cellular tumor antigen p53 (103-111)
uaccagggcagcuacggguuccgccug

SEQ ID NO: 28163 - RNA, 36 nt, Artificial Sequence
  Cytochrome c oxidase subunit 2 (110-121)
uacaccgacuacggcgggcugaucuucaacagcuac

SEQ ID NO: 28164 - RNA, 27 nt, Artificial Sequence
  HLA class I histocompatibility antigen, Cw-7 alpha chain (12-20)
uucgccuacgacggcaaggacuacauc

SEQ ID NO: 28165 - RNA, 27 nt, Artificial Sequence
  HLA class I histocompatibility antigen, alpha chain E (137-145)
uucgccuacgacggcaaggacuaccug

SEQ ID NO: 28166 - RNA, 27 nt, Artificial Sequence
  IST1 homolog (326-334)
uucgugcugcccgagcucccgagcguc

SEQ ID NO: 28167 - RNA, 30 nt, Artificial Sequence
  60S ribosomal protein L35 (19-28)
aagcagcuggacgaccucaagguggagcug

SEQ ID NO: 28168 - RNA, 45 nt, Artificial Sequence
  Triosephosphate isomerase (23-37)
ggcgagcugaucgggacccucaacgccgccaaggugcccgcggac

SEQ ID NO: 28169 - RNA, 42 nt, Artificial Sequence
  HLA class II histocompatibility antigen, DR alpha chain (40-53)
cuggaggaguucggccgcuucgccagcuucgaggcccagggg

SEQ ID NO: 28170 - RNA, 27 nt, Artificial Sequence
  Sorting nexin-5 (257-265)
gaggagcccaccgugaucaagaaguac

SEQ ID NO: 28171 - RNA, 30 nt, Artificial Sequence
  Melanoma-associated antigen 4 (230-239)
ggcguguacgacgggcgcgagcacaccguc

SEQ ID NO: 28172 - RNA, 27 nt, Artificial Sequence
  HLA class I histocompatibility antigen, B-39 alpha chain (3-11)
gugauggccccccgcaccguccugcuc

SEQ ID NO: 28173 - RNA, 27 nt, Artificial Sequence
  Ubiquilin-4 (442-450)
aacccccgcgccaugcaggcccugcuc

SEQ ID NO: 28174 - RNA, 27 nt, Artificial Sequence
  HLA class I histocompatibility antigen, Cw-7 alpha chain (3-11)
gugauggccccccgcgcccugcuccug

SEQ ID NO: 28175 - RNA, 45 nt, Artificial Sequence
  Gamma-secretase C-terminal fragment 59 (562-576)
gacgccgaguuccgccacgacagcggcuacgaggugcaccaccag

SEQ ID NO: 28176 - RNA, 30 nt, Artificial Sequence
  Gamma-secretase C-terminal fragment 59 (565-574)
uuccgccacgacagcggcuacgaggugcac

SEQ ID NO: 28177 - RNA, 27 nt, Artificial Sequence
  HLA class I histocompatibility antigen, Cw-2 alpha chain (3-11)
gugauggccccccgcacccugcuccug

SEQ ID NO: 28178 - RNA, 39 nt, Artificial Sequence
  Gamma-secretase C-terminal fragment 59 (562-574)
gacgccgaguuccgccacgacagcggcuacgaggugcac

SEQ ID NO: 28179 - RNA, 24 nt, Artificial Sequence
  Beta-2-microglobulin (91-98)
aucgugaagugggaccgcgacaug

SEQ ID NO: 28180 - RNA, 42 nt, Artificial Sequence
  HLA class II histocompatibility antigen, DR alpha chain (50-63)
gaggcccagggcgcccuggcgaacaucgccguggacaaggcc

SEQ ID NO: 28181 - RNA, 45 nt, Artificial Sequence
  Interferon-induced transmembrane protein 1 (69-83)
gugggcgacgucaccggggcccaggccuacgcgagcaccgccaag

SEQ ID NO: 28182 - RNA, 45 nt, Artificial Sequence
  Gamma-secretase C-terminal fragment 59 (560-574)
uucgccgaggacgugggcagcaacaagggggccaucaucggccug

SEQ ID NO: 28183 - RNA, 33 nt, Artificial Sequence
  Amyloid beta A4 protein (20-30)
uucgccgaggacgugggcagcaacaagggggcc

SEQ ID NO: 28184 - RNA, 27 nt, Artificial Sequence
  Heat shock 70 kDa protein 1-like (395-403)
cugcucgacguggccccccugagccug

SEQ ID NO: 28185 - RNA, 27 nt, Artificial Sequence
  Heat shock 70 kDa protein 1B (391-399)
cugcuccugcuggacguggccccccuc

SEQ ID NO: 28186 - RNA, 48 nt, Artificial Sequence
  HLA class I histocompatibility antigen, B-15 alpha chain (53-68)
gacgacacccaguucgugcgcuucgacagcgacgccgccuccccccgg

SEQ ID NO: 28187 - RNA, 48 nt, Artificial Sequence
  HLA class I histocompatibility antigen, Cw-7 alpha chain (153-168)
gaccugcgcagcuggaccgccgccgacaccgcggcccagaucacgcag

SEQ ID NO: 28188 - RNA, 45 nt, Artificial Sequence
  HLA class I histocompatibility antigen, B-15 alpha chain (54-68)
gacacccaguucgugcgcuucgacagcgacgccgccuccccccgg

SEQ ID NO: 28189 - RNA, 51 nt, Artificial Sequence
  HLA class I histocompatibility antigen, A-2 alpha chain (29-45)
gacacccaguucgugcgcuucgacagcgacgccgccucccagcggauggag

SEQ ID NO: 28190 - RNA, 36 nt, Artificial Sequence
  HLA class I histocompatibility antigen, B-15 alpha chain (57-68)
uucgugcgcuucgacagcgacgccgccuccccccgg

SEQ ID NO: 28191 - RNA, 33 nt, Artificial Sequence
  HLA class I histocompatibility antigen, A-1 alpha chain (32-42)
uucgugcgcuucgacagcgacgccgccucccag

SEQ ID NO: 28192 - RNA, 45 nt, Artificial Sequence
  HLA class I histocompatibility antigen, B-15 alpha chain (154-168)
cugagcuccuggaccgccgccgacaccgcggcccagaucacgcag

SEQ ID NO: 28193 - RNA, 51 nt, Artificial Sequence
  HLA class I histocompatibility antigen, B-15 alpha chain (52-68)
guggacgacacccaguucguccgcuucgacagcgacgccgccuccccccgg

SEQ ID NO: 28194 - RNA, 27 nt, Artificial Sequence
  Vimentin (116-124)
aacuacaucgacaaggugcgcuuccug

SEQ ID NO: 28195 - RNA, 27 nt, Artificial Sequence
  G antigen 12H (9-17)
uacuacuggccccgcccgcggcgcuac

SEQ ID NO: 28196 - RNA, 27 nt, Artificial Sequence
  Transaldolase (168-176)
cugcucuucagcuucgcccaggccgug

SEQ ID NO: 28197 - RNA, 51 nt, Artificial Sequence
  T cell receptor beta chain (42-57)
ugcaagcccaucagcggccacaacucccuguuccagugguaccgccagacc

SEQ ID NO: 28198 - RNA, 27 nt, Artificial Sequence
  Putative pre-mRNA-splicing factor ATP-dependent RNA helicase DHX16 (410-418)
gccgccaucgcgaaccaccaggugcug

SEQ ID NO: 28199 - RNA, 27 nt, Artificial Sequence
  14-3-3 protein gamma (25-33)
gccgccaugaagaacgugaccgagcug

SEQ ID NO: 28200 - RNA, 27 nt, Artificial Sequence
  Serine/threonine-protein kinase SMG1 (111-119)
gcccugaacaaccuccugcacagccug

SEQ ID NO: 28201 - RNA, 27 nt, Artificial Sequence
  Cyclin-L1 (148-156)
gacgugaucaacgucuuccaccaccug

SEQ ID NO: 28202 - RNA, 27 nt, Artificial Sequence
  Fructose-bisphosphate aldolase A (15-23)
gagcugagcgacaucgcccaccgcauc

SEQ ID NO: 28203 - RNA, 27 nt, Artificial Sequence
  Glyceraldehyde-3-phosphate dehydrogenase (173-181)
ggccugaugaccaccgugcacgccauc

SEQ ID NO: 28204 - RNA, 27 nt, Artificial Sequence
  Elongation of very long chain fatty acids protein 1 (135-143)
ggccaggugaccuuccugcacgucuuc

SEQ ID NO: 28205 - RNA, 27 nt, Artificial Sequence
  Microtubule-associated protein RP/EB family member 2 (234-242)
cagcugaacgagcaggugcacagccuc

SEQ ID NO: 28206 - RNA, 27 nt, Artificial Sequence
  T-complex protein 1 subunit epsilon (79-87)
agcaugauggacguggaccaccagauc

SEQ ID NO: 28207 - RNA, 27 nt, Artificial Sequence
  Sphingolipid delta(4)-desaturase DES1 (83-91)
agcaugacccuggccauccacgagauc

SEQ ID NO: 28208 - RNA, 27 nt, Artificial Sequence
  Elongation of very long chain fatty acids protein 5 (171-179)
acccugaacagcuucauccacgugcuc

SEQ ID NO: 28209 - RNA, 27 nt, Artificial Sequence
  ORM1-like protein 2 (50-58)
acccugaccaacgugauccacaaccuc

SEQ ID NO: 28210 - RNA, 30 nt, Artificial Sequence
  Baculoviral IAP repeat-containing protein 7 (280-289)
cagcugugccccaucugccgcgccccggug

SEQ ID NO: 28211 - RNA, 30 nt, Artificial Sequence
  E3 ubiquitin-protein ligase TRIM68 (55-64)
uacaccugcccccugugccgcgccccggug

SEQ ID NO: 28212 - RNA, 33 nt, Artificial Sequence
  Putative HTLV-1-related endogenous sequence (14-24)
cccacccgcgccccgagcggcccccggcccccc

SEQ ID NO: 28213 - RNA, 33 nt, Artificial Sequence
  Putative HTLV-1-related endogenous sequence (117-127)
cgccggcgcgagggccccgaccggagcccgcgc

SEQ ID NO: 28214 - RNA, 27 nt, Artificial Sequence
  Myelin basic protein (175-183)
ggcacccugagcaagaucuucaagcuc

SEQ ID NO: 28215 - RNA, 27 nt, Artificial Sequence
  Myelin proteolipid protein (45-53)
aagcugaucgagaccuacuucagcaag

SEQ ID NO: 28216 - RNA, 27 nt, Artificial Sequence
  Gamma-secretase C-terminal fragment 59 (563-571)
gccgaguuccgccacgacagcggcuac

SEQ ID NO: 28217 - RNA, 27 nt, Artificial Sequence
  SAM and SH3 domain-containing protein 1 (305-313)
gcccuguacagcggcgugcacaagaag

SEQ ID NO: 28218 - RNA, 30 nt, Artificial Sequence
  E3 ubiquitin-protein ligase SIAH1 (6-15)
gccaccgcccugcccaccggcacgagcaag

SEQ ID NO: 28219 - RNA, 27 nt, Artificial Sequence
  Muscleblind-like protein 2 (359-367)
gccaccgccaaccagaucauccugaag

SEQ ID NO: 28220 - RNA, 27 nt, Artificial Sequence
  Annexin A1 (63-71)
gccaccaucaucgacauccugaccaag

SEQ ID NO: 28221 - RNA, 27 nt, Artificial Sequence
  Nuclear ubiquitous casein and cyclin-dependent kinase substrate 1 (176-184)
gccaccgugacccccagcccggucaag

SEQ ID NO: 28222 - RNA, 27 nt, Artificial Sequence
  Pleiotropic regulator 1 (118-126)
gccguggcccugccccuccagaccaag

SEQ ID NO: 28223 - RNA, 36 nt, Artificial Sequence
  NADH dehydrogenase (ubiquinone) 1 alpha subcomplex subunit 3 (29-40)
gccgugauccugcccccgcucagccccuacuucaag

SEQ ID NO: 28224 - RNA, 27 nt, Artificial Sequence
  CD99 antigen (177-185)
gccgugcagcgcacccugcucgagaag

SEQ ID NO: 28225 - RNA, 27 nt, Artificial Sequence
  Guanine nucleotide-binding protein G(o) subunit alpha (93-101)
gccgugaccgacgucaucaucgccaag

SEQ ID NO: 28226 - RNA, 42 nt, Artificial Sequence
  Calsyntenin-1 (56-69)
gaccccccgcugaucgcccucgacaaggacgccccccugcgc

SEQ ID NO: 28227 - RNA, 27 nt, Artificial Sequence
  GPI transamidase component PIG-T (161-169)
gacaccgaccacuacuuccugcgcuac

SEQ ID NO: 28228 - RNA, 42 nt, Artificial Sequence
  Perilipin-3 (222-235)
gacguggccagcguccagcagcagcgccaggagcaguccuac

SEQ ID NO: 28229 - RNA, 27 nt, Artificial Sequence
  WD40 repeat-containing protein SMU1 (9-17)
gacgugauccgccugaucaugcaguac

SEQ ID NO: 28230 - RNA, 30 nt, Artificial Sequence
  Protein S100-B (35-44)
gagcugaucaacaacgagcucagccacuuc

SEQ ID NO: 28231 - RNA, 33 nt, Artificial Sequence
  Annexin A11 (430-440)
gagaccgaccugcucgacauccgcagcgaguac

SEQ ID NO: 28232 - RNA, 27 nt, Artificial Sequence
  Histone H2B type 2-F (66-74)
uucgugaacgacaucuucgagcgcauc

SEQ ID NO: 28233 - RNA, 24 nt, Artificial Sequence
  Calmodulin (145-152)
uucgugcagaugaugaccgccaag

SEQ ID NO: 28234 - RNA, 42 nt, Artificial Sequence
  Phosphoinositide-3-kinase-interacting protein 1 (30-43)
ggccaccuguaccgcgaggaccagaccagccccgccccgggg

SEQ ID NO: 28235 - RNA, 27 nt, Artificial Sequence
  THO complex subunit 4 (147-155)
ggcaccgccgacgugcacuucgagcgc

SEQ ID NO: 28236 - RNA, 27 nt, Artificial Sequence
  Neuroblast differentiation-associated protein AHNAK (1210-1218)
ggcaccuucgggggccuggggagcaag

SEQ ID NO: 28237 - RNA, 27 nt, Artificial Sequence
  Phosphoserine aminotransferase (119-127)
ggcaccaucaacaucgugcaccccaag

SEQ ID NO: 28238 - RNA, 27 nt, Artificial Sequence
  Histone deacetylase 7 (159-167)
cacagcgagcgccacgugcugcucuac

SEQ ID NO: 28239 - RNA, 27 nt, Artificial Sequence
  Gelsolin (48-56)
aucaucuacaagggcgggaccagccgc

SEQ ID NO: 28240 - RNA, 30 nt, Artificial Sequence
  Tight junction protein ZO-1 (562-571)
auccccaacaagaaccgcgccgagcagcug

SEQ ID NO: 28241 - RNA, 39 nt, Artificial Sequence
  Calmodulin (126-138)
auccgcgaggccgacaucgacggcgacgggcaggugaac

SEQ ID NO: 28242 - RNA, 51 nt, Artificial Sequence
  POTE ankyrin domain family member F (1057-1073)
aucagcaagcaggaguacgacgaguccggccccagcaucgugcaccgcaag

SEQ ID NO: 28243 - RNA, 27 nt, Artificial Sequence
  NADH dehydrogenase (ubiquinone) iron-sulfur protein 7, mitochondrial (66-74)
aucguggccggcacccugaccaacaag

SEQ ID NO: 28244 - RNA, 27 nt, Artificial Sequence
  LIM domain transcription factor LMO4 (29-37)
aagaucgccgaccgcuuccugcucuac

SEQ ID NO: 28245 - RNA, 30 nt, Artificial Sequence
  Spectrin beta chain, non-erythrocytic 1 (1939-1948)
aagccccgcgacgugagcuccgucgagcug

SEQ ID NO: 28246 - RNA, 27 nt, Artificial Sequence
  NADH dehydrogenase (ubiquinone) 1 subunit C2 (106-114)
aagaccuacggcgagaucuucgagaag

SEQ ID NO: 28247 - RNA, 45 nt, Artificial Sequence
  Testican-2 (317-331)
cuggagcgcauccagauccaggaggccgccaagaagaagcccggc

SEQ ID NO: 28248 - RNA, 27 nt, Artificial Sequence
  Alpha-adducin (37-45)
cugaccgaccgcgagcucgaggaguac

SEQ ID NO: 28249 - RNA, 30 nt, Artificial Sequence
  V-type proton ATPase subunit F (46-55)
aacgagaucgaggacaccuuccgccaguuc

SEQ ID NO: 28250 - RNA, 24 nt, Artificial Sequence
  40S ribosomal protein SA (149-156)
aacaccgacagcccccugcgcuac

SEQ ID NO: 28251 - RNA, 27 nt, Artificial Sequence
  Bcl-2-associated transcription factor 1 (428-436)
aacaccgaggaggagggccugaaguac

SEQ ID NO: 28252 - RNA, 33 nt, Artificial Sequence
  ATP synthase-coupling factor 6, mitochondrial (98-108)
cccaaguucgaggugaucgagaagccgcaggcc

SEQ ID NO: 28253 - RNA, 39 nt, Artificial Sequence
  Phosphatidylethanolamine-binding protein 1 (2-14)
cccguggaccugagcaagugguccggcccgcucagccug

SEQ ID NO: 28254 - RNA, 27 nt, Artificial Sequence
  40S ribosomal protein S29 (5-13)
cagcuguacuggagccacccccgcaag

SEQ ID NO: 28255 - RNA, 30 nt, Artificial Sequence
  Septin-2 (291-300)
cgccuguaccccuggggcguggucgaggug

SEQ ID NO: 28256 - RNA, 27 nt, Artificial Sequence
  Methyl-CpG-binding domain protein 3 (74-82)
agcaucuucaagcagcccgugaccaag

SEQ ID NO: 28257 - RNA, 27 nt, Artificial Sequence
  Transformation/transcription domain-associated protein (1806-1814)
agcaucaccuccguguucaucaccaag

SEQ ID NO: 28258 - RNA, 30 nt, Artificial Sequence
  Transcription factor HES-1 (101-110)
agcaccgaccccuccgugcugggcaaguac

SEQ ID NO: 28259 - RNA, 27 nt, Artificial Sequence
  Protein transport protein Sec23B (115-123)
agcaccaucgaguacgugauccagcgc

SEQ ID NO: 28260 - RNA, 33 nt, Artificial Sequence
  Paralemmin-2 (155-165)
agcaccaucggccccgagggggugcaccagaag

SEQ ID NO: 28261 - RNA, 30 nt, Artificial Sequence
  Sodium/potassium-transporting ATPase subunit alpha-3 (946-955)
agcguguuccagcagggcaugaagaacaag

SEQ ID NO: 28262 - RNA, 33 nt, Artificial Sequence
  Stathmin (31-41)
agcgugcccgaguucccgcuguccccccccaag

SEQ ID NO: 28263 - RNA, 27 nt, Artificial Sequence
  Heterogeneous nuclear ribonucleoprotein L-like (68-76)
agcgugucccccgucgugcacgugcgc

SEQ ID NO: 28264 - RNA, 24 nt, Artificial Sequence
  Nodal modulator 3 (247-254)
accgccauccgccaccacgugcug

SEQ ID NO: 28265 - RNA, 33 nt, Artificial Sequence
  Interferon-induced GTP-binding protein Mx2 (194-204)
accaucaucgaccugcccggcaucacccgcgug

SEQ ID NO: 28266 - RNA, 27 nt, Artificial Sequence
  Neuronal membraneoprotein M6-b (264-272)
accaccuacaacuacgccgugcugaag

SEQ ID NO: 28267 - RNA, 27 nt, Artificial Sequence
  Contactin-1 (759-767)
gugaccaaccccgacaccggccgcuac

SEQ ID NO: 28268 - RNA, 24 nt, Artificial Sequence
  Cytosolic non-specific dipeptidase (468-475)
uacgaggugagccagcugaaggac

SEQ ID NO: 28269 - RNA, 27 nt, Artificial Sequence
  Septin-2 (121-129)
uacaucgacgagcaguucgagcgcuac

SEQ ID NO: 28270 - RNA, 30 nt, Artificial Sequence
  Noelin-2 (405-414)
uacaccgacgugcccuuccacaaccaguac

SEQ ID NO: 28271 - RNA, 33 nt, Artificial Sequence
  Serine/threonine-protein kinase DCLK1 (176-186)
uacaccgagcgcgacgccagcggcaugcuguac

SEQ ID NO: 28272 - RNA, 24 nt, Artificial Sequence
  U2 small nuclear ribonucleoprotein B'' (205-212)
gacgcccugcagggcuucaagauc

SEQ ID NO: 28273 - RNA, 45 nt, Artificial Sequence
  Melanocyte protein PMEL (45-59)
aaccgccagcuguaccccgaguggaccgaggcccagcggcucgac

SEQ ID NO: 28274 - RNA, 27 nt, Artificial Sequence
  Nuclear autoantigenic sperm protein (281-289)
gugcugaacgagcaggucaaggaggcc

SEQ ID NO: 28275 - RNA, 27 nt, Artificial Sequence
  60S ribosomal protein L5 (218-226)
gccuacaagaagcaguucagccaguac

SEQ ID NO: 28276 - RNA, 27 nt, Artificial Sequence
  Endoplasmic reticulum-Golgi intermediate compartment protein 1 (258-266)
gccaucaucggcgggaccuucaccgug

SEQ ID NO: 28277 - RNA, 27 nt, Artificial Sequence
  Programmed cell death protein 4 (283-291)
gcccuggacaaggccaccgugcuccug

SEQ ID NO: 28278 - RNA, 27 nt, Artificial Sequence
  Endoplasmin (381-389)
gcccugaaggacaagaucgagaaggcc

SEQ ID NO: 28279 - RNA, 27 nt, Artificial Sequence
  Glyceraldehyde-3-phosphate dehydrogenase (302-310)
gcccugaacgaccacuucgugaagcuc

SEQ ID NO: 28280 - RNA, 27 nt, Artificial Sequence
  Eukaryotic translation initiation factor 3 subunit F (349-357)
gcccugaacgagaagcucgugaaccug

SEQ ID NO: 28281 - RNA, 27 nt, Artificial Sequence
  Cofilin-1 (6-14)
gccgugagcgacggcgucaucaaggug

SEQ ID NO: 28282 - RNA, 27 nt, Artificial Sequence
  Actin, cytoplasmic 2 (21-29)
uucgccggcgacgacgccccccgcgcg

SEQ ID NO: 28283 - RNA, 30 nt, Artificial Sequence
  Pyruvate kinase PKM (12-21)
uucauccagacccagcagcugcacgccgcc

SEQ ID NO: 28284 - RNA, 30 nt, Artificial Sequence
  Dolichyl-diphosphooligosaccharide-proteinosyltransferase subunit STT3A (59-68)
uuccuggccgaggagggcuucuacaaguuc

SEQ ID NO: 28285 - RNA, 30 nt, Artificial Sequence
  5'(3')-deoxyribonucleotidase, cytosolic type (71-80)
uuccuggaccucgagcccaucccgggcgcc

SEQ ID NO: 28286 - RNA, 24 nt, Artificial Sequence
  CKLF-like MARVEL transmembrane domain-containing protein 6 (79-86)
uuccugcucagccugcugauccuc

SEQ ID NO: 28287 - RNA, 27 nt, Artificial Sequence
  Cleavage and polyadenylation specificity factor subunit 1 (185-193)
uuccugcccagcuacaucaucgacgug

SEQ ID NO: 28288 - RNA, 24 nt, Artificial Sequence
  Neutral amino acid transporter B(0) (89-96)
uucguguuccccggcgagcugcuc

SEQ ID NO: 28289 - RNA, 30 nt, Artificial Sequence
  Glyceraldehyde-3-phosphate dehydrogenase (169-178)
ggcaucguggaggggcugaugaccaccguc

SEQ ID NO: 28290 - RNA, 27 nt, Artificial Sequence
  Protein PRRC1 (212-220)
ggcaucuggggguucaucaagggcgug

SEQ ID NO: 28291 - RNA, 27 nt, Artificial Sequence
  Probable ATP-dependent RNA helicase DDX49 (311-319)
ggccuggacauccccaccgugcagguc

SEQ ID NO: 28292 - RNA, 24 nt, Artificial Sequence
  Nuclear pore complex protein Nup160 (1223-1230)
ggccuguucgacaccgccaucagc

SEQ ID NO: 28293 - RNA, 39 nt, Artificial Sequence
  ATP synthase subunit beta, mitochondrial (203-215)
ggccuguucgggggcgccggggugggcaagaccguccuc

SEQ ID NO: 28294 - RNA, 27 nt, Artificial Sequence
  Signal peptidase complex subunit 2 (79-87)
ggccugaucgacgggcgccucaccauc

SEQ ID NO: 28295 - RNA, 33 nt, Artificial Sequence
  Pyruvate kinase PKM (122-132)
ggccugaucaaggggagcggcaccgccgaggug

SEQ ID NO: 28296 - RNA, 30 nt, Artificial Sequence
  Protein kinase C iota type (241-250)
ggccugcaggacuucgaccuccugcgcgug

SEQ ID NO: 28297 - RNA, 27 nt, Artificial Sequence
  Histone acetyltransferase p300 (2240-2248)
ggccagaucgggcagcugccccaggcc

SEQ ID NO: 28298 - RNA, 27 nt, Artificial Sequence
  Histone H2A type 1-A (107-115)
ggcgugcugcccaacauccaggccguc

SEQ ID NO: 28299 - RNA, 30 nt, Artificial Sequence
  Small nuclear ribonucleoprotein G (67-76)
aucaucaugcuggaggcccucgagcgcgug

SEQ ID NO: 28300 - RNA, 27 nt, Artificial Sequence
  Heat shock 70 kDa protein 1-like (174-182)
aucaucaacgagcccaccgccgccgcg

SEQ ID NO: 28301 - RNA, 27 nt, Artificial Sequence
  Glyceraldehyde-3-phosphate dehydrogenase (206-214)
aucauccccgccagcaccggcgccgcg

SEQ ID NO: 28302 - RNA, 36 nt, Artificial Sequence
  Nucleosome assembly protein 1-like 1 (319-330)
auccuggccgccgacuucgagaucggccacuuccuc

SEQ ID NO: 28303 - RNA, 27 nt, Artificial Sequence
  Glyceraldehyde-3-phosphate dehydrogenase (273-281)
auccugggcuacaccgagcaccaggug

SEQ ID NO: 28304 - RNA, 27 nt, Artificial Sequence
  40S ribosomal protein S11 (72-80)
auccugagcggcguggucaccaagaug

SEQ ID NO: 28305 - RNA, 27 nt, Artificial Sequence
  Structural maintenance of chromosomes protein 3 (436-444)
aagcuggaccaggaccucaacgaggug

SEQ ID NO: 28306 - RNA, 39 nt, Artificial Sequence
  Centrin-2 (111-123)
aagcuguucgacgacgacgagaccggcaagaucagcuuc

SEQ ID NO: 28307 - RNA, 33 nt, Artificial Sequence
  GTP-binding nuclear protein Ran (167-177)
aagcugaucggcgaccccaaccucgaguucgug

SEQ ID NO: 28308 - RNA, 33 nt, Artificial Sequence
  40S ribosomal protein S3a (227-237)
aagcugauggagcuccacggcgaggggagcucc

SEQ ID NO: 28309 - RNA, 30 nt, Artificial Sequence
  ATP-dependent RNA helicase A (696-705)
aagguguucgaccccgucccggugggcgug

SEQ ID NO: 28310 - RNA, 24 nt, Artificial Sequence
  Gamma-interferon-inducible lysosomal thiol reductase (27-34)
cugcucgacgugcccaccgccgcc

SEQ ID NO: 28311 - RNA, 27 nt, Artificial Sequence
  Heat shock cognate 71 kDa protein (393-401)
cugcucgacgugaccccccugagccug

SEQ ID NO: 28312 - RNA, 24 nt, Artificial Sequence
  T-complex protein 1 subunit eta (68-75)
cugcucgacgugguccaccccgcc

SEQ ID NO: 28313 - RNA, 27 nt, Artificial Sequence
  T-complex protein 1 subunit eta (68-76)
cugcucgacgugguccaccccgccgcc

SEQ ID NO: 28314 - RNA, 27 nt, Artificial Sequence
  Transmembrane emp24 domain-containing protein 10 (23-31)
cugcucggcccccgccuggugcuggcc

SEQ ID NO: 28315 - RNA, 33 nt, Artificial Sequence
  Glyceraldehyde-3-phosphate dehydrogenase (174-184)
cugaugaccaccgugcacgccaucacggccacc

SEQ ID NO: 28316 - RNA, 27 nt, Artificial Sequence
  Proteasome-associated protein ECM29 homolog (162-170)
aaccuggccgagaagcccaagaccgug

SEQ ID NO: 28317 - RNA, 27 nt, Artificial Sequence
  GPN-loop GTPase 1 (42-50)
aaccuggaccccgccgugcacgagguc

SEQ ID NO: 28318 - RNA, 27 nt, Artificial Sequence
  60S ribosomal protein L10a (143-151)
aacaugguggccaaggucgacgaggug

SEQ ID NO: 28319 - RNA, 27 nt, Artificial Sequence
  Heterogeneous nuclear ribonucleoproteins C1/C2 (142-150)
cgcgugcccccgcccccccccaucgcc

SEQ ID NO: 28320 - RNA, 24 nt, Artificial Sequence
  Hydroxymethylglutaryl-CoA synthase, cytoplasmic (447-454)
agccuguucgagggcaccugguac

SEQ ID NO: 28321 - RNA, 27 nt, Artificial Sequence
  Hydroxymethylglutaryl-CoA synthase, cytoplasmic (482-490)
agccuguucgagggcaccugguaccuc

SEQ ID NO: 28322 - RNA, 21 nt, Artificial Sequence
  Sterol O-acyltransferase 1 (127-133)
agccugcucgacgagcugcug

SEQ ID NO: 28323 - RNA, 27 nt, Artificial Sequence
  Tuberin (526-534)
agccugcucgacaucaucgagaaggug

SEQ ID NO: 28324 - RNA, 27 nt, Artificial Sequence
  Eukaryotic translation elongation factor 1 epsilon-1 (8-16)
agccugcucgagaagucccugggccug

SEQ ID NO: 28325 - RNA, 27 nt, Artificial Sequence
  Neuroblast differentiation-associated protein AHNAK (2580-2588)
agcaugcccgacuucgaccugcaccuc

SEQ ID NO: 28326 - RNA, 27 nt, Artificial Sequence
  Phosphoinositide 3-kinase regulatory subunit 4 (906-914)
agccaggugcccgaggucaccaccgug

SEQ ID NO: 28327 - RNA, 36 nt, Artificial Sequence
  Annexin A2 (184-195)
agcgugaucgacuacgagcugaucgaccaggacgcc

SEQ ID NO: 28328 - RNA, 33 nt, Artificial Sequence
  U2 small nuclear ribonucleoprotein A' (213-223)
acccuggccgagguggagcgccucaagggccug

SEQ ID NO: 28329 - RNA, 27 nt, Artificial Sequence
  Serine/threonine-protein kinase SIK1 (473-481)
acccuggccgaggugagcacccgccuc

SEQ ID NO: 28330 - RNA, 27 nt, Artificial Sequence
  G2/mitotic-specific cyclin-B1 (321-329)
acccuggccaaguaccucauggagcug

SEQ ID NO: 28331 - RNA, 33 nt, Artificial Sequence
  Nucleolin (501-511)
acccugcaggagguguucgagaaggccaccuuc

SEQ ID NO: 28332 - RNA, 30 nt, Artificial Sequence
  L-lactate dehydrogenase B chain (323-332)
acccugugggacauccagaaggaccucaag

SEQ ID NO: 28333 - RNA, 27 nt, Artificial Sequence
  L-lactate dehydrogenase A chain (322-330)
acccuguggggcauccagaaggagcuc

SEQ ID NO: 28334 - RNA, 27 nt, Artificial Sequence
  Aladin (17-25)
acccuguacgagcacaacaacgagcuc

SEQ ID NO: 28335 - RNA, 33 nt, Artificial Sequence
  Microtubule-associated protein 4 (335-345)
gugcugcccaccgagaccgaggucgccccggcc

SEQ ID NO: 28336 - RNA, 27 nt, Artificial Sequence
  Peroxiredoxin-5, mitochondrial (184-192)
gugguccaggacggcaucgugaaggcc

SEQ ID NO: 28337 - RNA, 30 nt, Artificial Sequence
  HLA class I histocompatibility antigen, B-7 alpha chain (140-149)
uacgccuacgacggcaaggacuacaucgcc

SEQ ID NO: 28338 - RNA, 21 nt, Artificial Sequence
  Carbamoyl-phosphate synthase (ammonia), mitochondrial (389-395)
uaccuguucgacagcuucuuc

SEQ ID NO: 28339 - RNA, 24 nt, Artificial Sequence
  Bax inhibitor 1 (140-147)
uaccuguuccucggcgggauccug

SEQ ID NO: 28340 - RNA, 30 nt, Artificial Sequence
  Coiled-coil domain-containing protein 12 (62-71)
uacgugcccgaggacgaggaccugaagaag

SEQ ID NO: 28341 - RNA, 24 nt, Artificial Sequence
  Small nuclear ribonucleoprotein-associated proteins B and B' (18-25)
cgcaucuucaucggcaccuucaag

SEQ ID NO: 28342 - RNA, 54 nt, Artificial Sequence
  ATP synthase-coupling factor 6, mitochondrial (91-108)
cccaccuucaaguucgaggacccgaaguucgaggugaucgagaagccccaggcc

SEQ ID NO: 28343 - RNA, 27 nt, Artificial Sequence
  Kinectin (794-802)
agccugguggaggagcucaagaagguc

SEQ ID NO: 28344 - RNA, 27 nt, Artificial Sequence
  Kinectin (600-608)
gugcuggccgaggagcuccacaagguc

SEQ ID NO: 28345 - RNA, 33 nt, Artificial Sequence
  HLA class I histocompatibility antigen, B-15 alpha chain (193-203)
cgccgguaccuggagaacggcaaggagacccuc

SEQ ID NO: 28346 - RNA, 27 nt, Artificial Sequence
  Keratin, type I cytoskeletal 18 (307-315)
gcccugcucaacaucaaggugaagcug

SEQ ID NO: 28347 - RNA, 30 nt, Artificial Sequence
  Heat shock protein HSP 90-beta (346-355)
gccgaggacaaggagaacuacaagaaguuc

SEQ ID NO: 28348 - RNA, 27 nt, Artificial Sequence
  40S ribosomal protein S5 (12-20)
gccgagacccccgacaucaagcuguuc

SEQ ID NO: 28349 - RNA, 36 nt, Artificial Sequence
  Ribonucleoside-diphosphate reductase subunit M2 (165-176)
gaggagguggaccugagcaaggacauccagcacugg

SEQ ID NO: 28350 - RNA, 30 nt, Artificial Sequence
  Nucleosome assembly protein 1-like 4 (86-95)
gaggaggugcacgaccuggagcgcaaguac

SEQ ID NO: 28351 - RNA, 27 nt, Artificial Sequence
  U4/U6 small nuclear ribonucleoprotein Prp31 (105-113)
aacgagcugaacaucauccacaaguuc

SEQ ID NO: 28352 - RNA, 36 nt, Artificial Sequence
  ELAV-like protein 3 (161-172)
uucauccgcuucgacaagcggaucgaggccgaggag

SEQ ID NO: 28353 - RNA, 30 nt, Artificial Sequence
  ELAV-like protein 3 (29-38)
aagaccaaccugaucgugaacuaccucccc

SEQ ID NO: 28354 - RNA, 27 nt, Artificial Sequence
  Minor histocompatibility protein HA-1 (137-145)
gugcugcacgacgaccuccuggaggcc

SEQ ID NO: 28355 - RNA, 42 nt, Artificial Sequence
  Glyceraldehyde-3-phosphate dehydrogenase (26-39)
ggcaagguggacaucgucgccaucaacgaccccuucaucgac

SEQ ID NO: 28356 - RNA, 42 nt, Artificial Sequence
  Low affinity immunoglobulin epsilon Fc receptor (10-23)
aucagccaggagcuggaggagcuccgcgccgagcagcagcgg

SEQ ID NO: 28357 - RNA, 27 nt, Artificial Sequence
  26S proteasome non-ATPase regulatory subunit 2 (299-307)
ggccgccacgggguguuccuggagcuc

SEQ ID NO: 28358 - RNA, 27 nt, Artificial Sequence
  ATP-dependent RNA helicase DDX3X (234-242)
uuccugcuccccauccugagccagauc

SEQ ID NO: 28359 - RNA, 27 nt, Artificial Sequence
  Putative homeodomain transcription factor 2 (652-660)
gcccagcugcuccacgugcacgagauc

SEQ ID NO: 28360 - RNA, 27 nt, Artificial Sequence
  Transcription factor BTF3 (47-55)
gagaccaucaugaaccaggagaagcug

SEQ ID NO: 28361 - RNA, 27 nt, Artificial Sequence
  Ribosome biogenesis protein BRX1 homolog (141-149)
uuccuggugcagaacauccacacccuc

SEQ ID NO: 28362 - RNA, 27 nt, Artificial Sequence
  Microtubule-actin cross-linking factor 1, isoforms 1/2/3/5 (2558-2566)
caggccaucaagaacggccaggcccug

SEQ ID NO: 28363 - RNA, 39 nt, Artificial Sequence
  HLA class I histocompatibility antigen, B-8 alpha chain (111-123)
cagagcgaggccggcucccacacccugcagagcauguac

SEQ ID NO: 28364 - RNA, 27 nt, Artificial Sequence
  Dynamin-2 (390-398)
uacgccaucaagaacauccacggcgug

SEQ ID NO: 28365 - RNA, 27 nt, Artificial Sequence
  ELAV-like protein 4 (96-104)
gaccccaaggacgccgagaaggccauc

SEQ ID NO: 28366 - RNA, 27 nt, Artificial Sequence
  ELAV-like protein 4 (318-326)
ggccccuucggggccgugaacaacguc

SEQ ID NO: 28367 - RNA, 27 nt, Artificial Sequence
  ELAV-like protein 4 (197-205)
aagcccagcggcgccaccgagccgauc

SEQ ID NO: 28368 - RNA, 27 nt, Artificial Sequence
  ELAV-like protein 4 (265-273)
cccccgagcgccugcuccccccgcuuc

SEQ ID NO: 28369 - RNA, 27 nt, Artificial Sequence
  ELAV-like protein 4 (270-278)
agcccccgcuucuccccgaucaccauc

SEQ ID NO: 28370 - RNA, 36 nt, Artificial Sequence
  ATP-dependent RNA helicase DDX3Y (176-187)
cacaucgagaacuucagcgacaucgacaugggcgag

SEQ ID NO: 28371 - RNA, 27 nt, Artificial Sequence
  Histone demethylase UTY (719-727)
cugcucaucgccgacaacccccagcug

SEQ ID NO: 28372 - RNA, 27 nt, Artificial Sequence
  Pumilio homolog 3 (149-157)
cgcacccuggacaaggugcucgagguc

SEQ ID NO: 28373 - RNA, 27 nt, Artificial Sequence
  Histone H4 (83-91)
accgccauggacguggucuacgcccug

SEQ ID NO: 28374 - RNA, 27 nt, Artificial Sequence
  Histone H3.2 (119-127)
accaucaugcccaaggacauccagcug

SEQ ID NO: 28375 - RNA, 39 nt, Artificial Sequence
  Protein S100-A9 (67-79)
gacaccaacgccgacaagcagcugagcuucgaggaguuc

SEQ ID NO: 28376 - RNA, 48 nt, Artificial Sequence
  Annexin A2 (209-224)
gacgugcccaaguggaucagcaucaugaccgagcgcuccgucccgcac

SEQ ID NO: 28377 - RNA, 39 nt, Artificial Sequence
  Glyceraldehyde-3-phosphate dehydrogenase (269-281)
aucagcugguacgacaacgaguucggcuacuccaaccgc

SEQ ID NO: 28378 - RNA, 54 nt, Artificial Sequence
  Macrophage migration inhibitory factor (3-20)
aucgugaacaccaacgucccccgcgccagcgugccggacggcuuccuguccgag

SEQ ID NO: 28379 - RNA, 27 nt, Artificial Sequence
  Hemoglobin subunit alpha (41-49)
cugcgcguggaccccgucaacuucaag

SEQ ID NO: 28380 - RNA, 54 nt, Artificial Sequence
  40S ribosomal protein S17 (118-135)
caggugacccagcccaccgucggcaugaacuucaagacgccgcgcgggcccgug

SEQ ID NO: 28381 - RNA, 48 nt, Artificial Sequence
  Collagen alpha-1(I) chain (857-872)
cgccugcccaucaucgacguggccccgcucgacgucggcgcccccgac

SEQ ID NO: 28382 - RNA, 48 nt, Artificial Sequence
  Collagen alpha-2(I) chain (949-964)
cgccccaaggacuacgagguggacgccacccugaagagccucaacaac

SEQ ID NO: 28383 - RNA, 33 nt, Artificial Sequence
  T-complex protein 1 subunit theta (369-379)
gccgaggccuucgaggcgaucccccgcgcccug

SEQ ID NO: 28384 - RNA, 27 nt, Artificial Sequence
  Cullin-1 (484-492)
gccgaggccagcaugaucuccaagcug

SEQ ID NO: 28385 - RNA, 27 nt, Artificial Sequence
  DNA replication licensing factor MCM7 (328-336)
gccgaggaggacuucuacgagaagcug

SEQ ID NO: 28386 - RNA, 30 nt, Artificial Sequence
  BolA-like protein 2 (61-70)
gccgaggagcugccccacauccacgccuuc

SEQ ID NO: 28387 - RNA, 27 nt, Artificial Sequence
  DNA topoisomerase 2-beta (526-534)
gccgagaucaacaacaucaucaagauc

SEQ ID NO: 28388 - RNA, 30 nt, Artificial Sequence
  Cofilin-1 (150-159)
gccgagaagcugggcgggagcgccgugauc

SEQ ID NO: 28389 - RNA, 27 nt, Artificial Sequence
  Proteasome subunit alpha type-4 (137-145)
gccgagaagguggagaucgccacccug

SEQ ID NO: 28390 - RNA, 27 nt, Artificial Sequence
  Bifunctional glutamate/proline-tRNA ligase (1393-1401)
gccgagaacgaggccgagaccaagcug

SEQ ID NO: 28391 - RNA, 30 nt, Artificial Sequence
  Sodium/potassium-transporting ATPase subunit alpha-1 (677-686)
gccgagaacggcuuccugcccauccaccuc

SEQ ID NO: 28392 - RNA, 30 nt, Artificial Sequence
  Eukaryotic translation initiation factor 4 gamma 1 (1531-1540)
gccgagcagcagggcaaggggguggcccug

SEQ ID NO: 28393 - RNA, 36 nt, Artificial Sequence
  T-complex protein 1 subunit eta (76-87)
gccgaggugggcgacgggaccaccagcgucacgcug

SEQ ID NO: 28394 - RNA, 27 nt, Artificial Sequence
  MICOS complex subunit MIC60 (166-174)
ggcgaggggaagcccaccccggcccug

SEQ ID NO: 28395 - RNA, 33 nt, Artificial Sequence
  Peptidyl-prolyl cis-trans isomerase A (80-90)
ggcgagaaguucgaggacgagaacuucauccug

SEQ ID NO: 28396 - RNA, 27 nt, Artificial Sequence
  NADH dehydrogenase (ubiquinone) 1 beta subcomplex subunit 7 (127-135)
ggcgagguggaccccaaggucgcccug

SEQ ID NO: 28397 - RNA, 30 nt, Artificial Sequence
  G2/mitotic-specific cyclin-B1 (62-71)
ggcgagguggacgucgagcagcacacccug

SEQ ID NO: 28398 - RNA, 42 nt, Artificial Sequence
  Zinc finger MYM-type protein 2 (207-220)
ggcgaguaccugcccagcaagggggccggcaacaacgugcuc

SEQ ID NO: 28399 - RNA, 30 nt, Artificial Sequence
  Transforming protein RhoA (46-55)
aucgagguggacggcaagcaggucgagcug

SEQ ID NO: 28400 - RNA, 33 nt, Artificial Sequence
  40S ribosomal protein S17 (96-106)
aucgagguggaccccgacaccaaggagaugcug

SEQ ID NO: 28401 - RNA, 30 nt, Artificial Sequence
  Putative endoplasmin-like protein (341-350)
aaggaggacgaggacgacaagaccgugcug

SEQ ID NO: 28402 - RNA, 30 nt, Artificial Sequence
  Plasminogen activator inhibitor 1 RNA-binding protein (182-191)
aaggaggagggccccaaggagaugacccug

SEQ ID NO: 28403 - RNA, 27 nt, Artificial Sequence
  Uncharacterized protein C20orf24 (7-15)
aaggaggagcccccgcagccccagcug

SEQ ID NO: 28404 - RNA, 30 nt, Artificial Sequence
  Importin subunit beta-1 (183-192)
aaggaggagcccagcaacaacgugaagcug

SEQ ID NO: 28405 - RNA, 33 nt, Artificial Sequence
  Heat shock protein HSP 90-beta (452-462)
aaggaguucgacggcaagagccugguguccguc

SEQ ID NO: 28406 - RNA, 27 nt, Artificial Sequence
  Melanoma-associated antigen D2 (337-345)
aaggagaucgacaagaacgaccaccug

SEQ ID NO: 28407 - RNA, 30 nt, Artificial Sequence
  Protein Spindly (380-389)
aaggagaucgagagcaccaagggcgagcug

SEQ ID NO: 28408 - RNA, 30 nt, Artificial Sequence
  Coatomer subunit epsilon (241-250)
aaggagaacgacuucgaccgccuggugcuc

SEQ ID NO: 28409 - RNA, 27 nt, Artificial Sequence
  Targeting protein for Xklp2 (238-246)
aaggaggugaacuucaccagcgagcug

SEQ ID NO: 28410 - RNA, 27 nt, Artificial Sequence
  H/ACA ribonucleoprotein complex subunit 4 (151-159)
aaggaguacgugggcaucguccgccug

SEQ ID NO: 28411 - RNA, 30 nt, Artificial Sequence
  H/ACA ribonucleoprotein complex subunit 3 (8-17)
aacgagcagggcgaccgcguguacacccug

SEQ ID NO: 28412 - RNA, 30 nt, Artificial Sequence
  Cerebellar degeneration-related protein 2 (148-157)
cgcgagcuggaggagaccaaccagaagcuc

SEQ ID NO: 28413 - RNA, 27 nt, Artificial Sequence
  Exocyst complex component 2 (640-648)
cgccuguucgagaacuacaucgagcuc

SEQ ID NO: 28414 - RNA, 27 nt, Artificial Sequence
  1-phosphatidylinositol 3-phosphate 5-kinase (1841-1849)
agcgaggaggacuucauccgcucccug

SEQ ID NO: 28415 - RNA, 30 nt, Artificial Sequence
  Hydroxymethylglutaryl-CoA synthase, cytoplasmic (246-255)
agcgaguaccccaucguggacggcaagcug

SEQ ID NO: 28416 - RNA, 33 nt, Artificial Sequence
  Proteasome activator complex subunit 3 (220-230)
accgagaucgacgagaaggaguacaucagccug

SEQ ID NO: 28417 - RNA, 45 nt, Artificial Sequence
  HLA class I histocompatibility antigen, B-15 alpha chain (240-254)
accuggcagcgcgacggcgaggaccagacccaggacacggagcug

SEQ ID NO: 28418 - RNA, 30 nt, Artificial Sequence
  Nuclear pore complex protein Nup205 (350-359)
guggaggacgaccgcacccugcagagccuc

SEQ ID NO: 28419 - RNA, 30 nt, Artificial Sequence
  Septin-2 (86-95)
guggagaucgaggagcgcggcgucaagcug

SEQ ID NO: 28420 - RNA, 27 nt, Artificial Sequence
  Hemoglobin subunit alpha (25-33)
uacggcgccgaggcccuggagcgcaug

SEQ ID NO: 28421 - RNA, 42 nt, Artificial Sequence
  HLA class I histocompatibility antigen, A-1 alpha chain (29-42)
gacacccaguucgugcgcuucgacagcgacgccgccucccag

SEQ ID NO: 28422 - RNA, 27 nt, Artificial Sequence
  Neutral amino acid transporter B(0) (533-541)
guggccagcgagaaggaguccgucaug

SEQ ID NO: 28423 - RNA, 27 nt, Artificial Sequence
  Lysosomal protective protein (20-28)
auccgcgccgcccccccgccccuguuc

SEQ ID NO: 28424 - RNA, 27 nt, Artificial Sequence
  Serine/threonine-protein kinase 38-like (444-452)
aagcgcuucgagggccugacccagcgg

SEQ ID NO: 28425 - RNA, 48 nt, Artificial Sequence
  Alpha-1B-glycoprotein (173-188)
gcccccguggagcugauccucagcgacgagacccugccggcccccgag

SEQ ID NO: 28426 - RNA, 39 nt, Artificial Sequence
  Neuropilin-2 (696-708)
gagggccaguacgcccgccugaucagccccccggugcac

SEQ ID NO: 28427 - RNA, 45 nt, Artificial Sequence
  Calreticulin (106-120)
ggcgggggcuacgugaagcuguuccccaacagccucgaccagacc

SEQ ID NO: 28428 - RNA, 57 nt, Artificial Sequence
  Annexin A2 (50-68)
ggcguggacgaggucaccaucgugaacauccugaccaaccgcagcaacgcccagcgg

SEQ ID NO: 28429 - RNA, 45 nt, Artificial Sequence
  Filamin-A (2114-2128)
aaccccgccgaguucguggucaacaccagcaacgccggcgcgggg

SEQ ID NO: 28430 - RNA, 51 nt, Artificial Sequence
  Syntenin-1 (25-41)
aaccccgccaacccggccauccugagcgaggcguccgcccccaucccccac

SEQ ID NO: 28431 - RNA, 42 nt, Artificial Sequence
  Transferrin receptor protein 1 (680-693)
cgcguggaguaccacuuccugagccccuacgucuccccgaag

SEQ ID NO: 28432 - RNA, 39 nt, Artificial Sequence
  Cathepsin D (230-242)
agcuucuaccugucccgcgaccccgacgcccagccgggc

SEQ ID NO: 28433 - RNA, 63 nt, Artificial Sequence
  HLA class I histocompatibility antigen, B-51 alpha chain (27-47)
guggacgacacccaguucguccgcuucgacagcgacgccgccuccccccggaccgagccgcgc

SEQ ID NO: 28434 - RNA, 51 nt, Artificial Sequence
  Profilin-1 (35-51)
gugcccggcaagaccuucgucaacaucaccccggccgaggugggggugcug

SEQ ID NO: 28435 - RNA, 27 nt, Artificial Sequence
  Lymphocyte-specific protein 1 (197-205)
aagcugaucgaccgcaccgagagccuc

SEQ ID NO: 28436 - RNA, 27 nt, Artificial Sequence
  Synemin (426-434)
cgcaccuucagccccaccuacggccug

SEQ ID NO: 28437 - RNA, 27 nt, Artificial Sequence
  Insulin receptor substrate 2 (1097-1105)
cgcguggccagccccaccuccggcguc

SEQ ID NO: 28438 - RNA, 27 nt, Artificial Sequence
  ETS translocation variant 5 (45-53)
gagcuguuccaggaccucagccagcug

SEQ ID NO: 28439 - RNA, 27 nt, Artificial Sequence
  E3 ubiquitin-protein ligase Mdm2 (53-61)
gugcuguucuaccucggccaguacauc

SEQ ID NO: 28440 - RNA, 27 nt, Artificial Sequence
  U1 small nuclear ribonucleoprotein 70 kDa (423-431)
uaccuggcccccgagaacggcuaccuc

SEQ ID NO: 28441 - RNA, 27 nt, Artificial Sequence
  Coatomer subunit gamma-1 (147-155)
gccaucguggacaagguccccagcgug

SEQ ID NO: 28442 - RNA, 27 nt, Artificial Sequence
  T-complex protein 1 subunit gamma (129-137)
gcccuggacgacaugaucagcacccuc

SEQ ID NO: 28443 - RNA, 27 nt, Artificial Sequence
  DCN1-like protein 1 (94-102)
gcccuggaccccgccagcaucuccgug

SEQ ID NO: 28444 - RNA, 27 nt, Artificial Sequence
  U3 small nucleolar ribonucleoprotein protein IMP3 (78-86)
gcccugcucgacaagcuguacgcccug

SEQ ID NO: 28445 - RNA, 27 nt, Artificial Sequence
  Nuclear pore complex protein Nup205 (318-326)
gcccugcucgaccgcaucgugagcguc

SEQ ID NO: 28446 - RNA, 27 nt, Artificial Sequence
  Phosphoglycerate kinase 1 (354-362)
gcccugauggacgagguggucaaggcc

SEQ ID NO: 28447 - RNA, 27 nt, Artificial Sequence
  Diphthamide biosynthesis protein 1 (138-146)
gcccaggacuuccgcgugcuguacguc

SEQ ID NO: 28448 - RNA, 27 nt, Artificial Sequence
  Methionine aminopeptidase 2 (433-441)
gcccaguucgagcacaccauccugcuc

SEQ ID NO: 28449 - RNA, 27 nt, Artificial Sequence
  GTP-binding nuclear protein Ran (215-223)
gcccaguacgagcacgaccuggaggug

SEQ ID NO: 28450 - RNA, 33 nt, Artificial Sequence
  60S acidic ribosomal protein P0 (108-118)
uuccuggccgaccccagcgccuucguggcggcc

SEQ ID NO: 28451 - RNA, 33 nt, Artificial Sequence
  60S ribosomal protein L10a (110-120)
uuccuggccagcgagucccucaucaagcagauc

SEQ ID NO: 28452 - RNA, 27 nt, Artificial Sequence
  Dipeptidyl peptidase 9 (806-814)
uuccuggacgagaacgugcacuucuuc

SEQ ID NO: 28453 - RNA, 27 nt, Artificial Sequence
  ATP-binding cassette sub-family F member 2 (539-547)
uuccuggacgagcccaccaaccaccuc

SEQ ID NO: 28454 - RNA, 27 nt, Artificial Sequence
  Chloride intracellular channel protein 4 (178-186)
uuccuggacggcaacgagaugacccuc

SEQ ID NO: 28455 - RNA, 27 nt, Artificial Sequence
  3-hydroxy-3-methylglutaryl-coenzyme A reductase (113-121)
uuccuggacaaggagcucaccggccug

SEQ ID NO: 28456 - RNA, 27 nt, Artificial Sequence
  Acyl-protein thioesterase 2 (218-226)
uuccuggagaagcuccugcccccggug

SEQ ID NO: 28457 - RNA, 27 nt, Artificial Sequence
  Macrophage migration inhibitory factor (17-25)
uuccugagcgagcucacccagcagcug

SEQ ID NO: 28458 - RNA, 27 nt, Artificial Sequence
  26S proteasome non-ATPase regulatory subunit 14 (61-69)
uucguggacgacuacaccguccgcgug

SEQ ID NO: 28459 - RNA, 30 nt, Artificial Sequence
  Golgi-specific brefeldin A-resistance guanine nucleotide exchange factor 1 (1053-1062)
uucguggaccccaacggcaagaucagccug

SEQ ID NO: 28460 - RNA, 27 nt, Artificial Sequence
  E3 ubiquitin-protein ligase BRE1A (401-409)
caccuggacgaggcccgcacccuccug

SEQ ID NO: 28461 - RNA, 27 nt, Artificial Sequence
  Abl interactor 2 (89-97)
auccuggacgacaucggccacggggug

SEQ ID NO: 28462 - RNA, 27 nt, Artificial Sequence
  Nuclear pore complex protein Nup88 (183-191)
auccuggacccccacgugguccuccug

SEQ ID NO: 28463 - RNA, 27 nt, Artificial Sequence
  Thioredoxin-like protein 4A (40-48)
aagauggacgaggugcuguacagcauc

SEQ ID NO: 28464 - RNA, 27 nt, Artificial Sequence
  Protein BTG2 (73-81)
aagauggaccccaucaucagccgcgug

SEQ ID NO: 28465 - RNA, 27 nt, Artificial Sequence
  Elongation factor 2 (159-167)
aagauggaccgcgcccugcucgagcug

SEQ ID NO: 28466 - RNA, 24 nt, Artificial Sequence
  Transmembrane emp24 domain-containing protein 2 (42-49)
aagaugggccugaucuucgaggug

SEQ ID NO: 28467 - RNA, 24 nt, Artificial Sequence
  60S ribosomal protein L19 (119-126)
cugauggagcacauccacaagcuc

SEQ ID NO: 28468 - RNA, 27 nt, Artificial Sequence
  Glycogen phosphorylase, muscle form (271-279)
aaccuggccgagaacaucagccgcgug

SEQ ID NO: 28469 - RNA, 27 nt, Artificial Sequence
  Junction plakoglobin (5-13)
aaccugauggagcagcccaucaaggug

SEQ ID NO: 28470 - RNA, 30 nt, Artificial Sequence
  Dolichyl-diphosphooligosaccharide-proteinosyltransferase subunit 2 (51-60)
cgccuggacgagcucggcgggguguaccug

SEQ ID NO: 28471 - RNA, 27 nt, Artificial Sequence
  Putative eukaryotic translation initiation factor 2 subunit 3-like protein (17-25)
cgccaggaccugaccacccucgacgug

SEQ ID NO: 28472 - RNA, 27 nt, Artificial Sequence
  Serine/threonine-protein kinase/endoribonuclease IRE1 (37-45)
acccuggacggcagccuccacgccgug

SEQ ID NO: 28473 - RNA, 33 nt, Artificial Sequence
  Interferon-induced GTP-binding protein Mx1 (175-185)
acccugaucgaccuccccggcaucacccgcgug

SEQ ID NO: 28474 - RNA, 27 nt, Artificial Sequence
  Mitotic spindle-associated MMXD complex subunit MIP18 (97-105)
acccugaucggccucagcaucaaggug

SEQ ID NO: 28475 - RNA, 27 nt, Artificial Sequence
  Sulfiredoxin-1 (114-122)
acccugagcgaccuccgcguguaccug

SEQ ID NO: 28476 - RNA, 30 nt, Artificial Sequence
  Nucleolar GTP-binding protein 1 (322-331)
acccugaccgaggagggcgugaucaagguc

SEQ ID NO: 28477 - RNA, 27 nt, Artificial Sequence
  10 kDa heat shock protein, mitochondrial (81-89)
gugcuggacgacaaggacuacuuccuc

SEQ ID NO: 28478 - RNA, 27 nt, Artificial Sequence
  Anoctamin-6 (137-145)
gugcuggacgacaagcucgucuucgug

SEQ ID NO: 28479 - RNA, 27 nt, Artificial Sequence
  Nucleolar pre-ribosomal-associated protein 1 (1314-1322)
gugcuggaccagaagauccuccugcug

SEQ ID NO: 28480 - RNA, 33 nt, Artificial Sequence
  RNA-binding protein 34 (333-343)
gugcuguucgagaacaccgacagcguccaccuc

SEQ ID NO: 28481 - RNA, 27 nt, Artificial Sequence
  Eukaryotic translation initiation factor 4 gamma 1 (680-688)
gugcugaugaccgaggacaucaagcuc

SEQ ID NO: 28482 - RNA, 33 nt, Artificial Sequence
  Phosphoglycerate kinase 1 (407-417)
gugcugcccggcgucgacgcccucagcaacauc

SEQ ID NO: 28483 - RNA, 30 nt, Artificial Sequence
  S-adenosylmethionine synthase isoform type-2 (235-244)
uaccuggacgaggacaccaucuaccaccuc

SEQ ID NO: 28484 - RNA, 27 nt, Artificial Sequence
  Transmembrane protein 209 (409-417)
uaccuguucgagcgcaucaaggagcuc

SEQ ID NO: 28485 - RNA, 30 nt, Artificial Sequence
  HLA class I histocompatibility antigen, B-13 alpha chain (26-35)
uacguggacgacacccaguucguccgcuuc

SEQ ID NO: 28486 - RNA, 36 nt, Artificial Sequence
  Melanoma antigen recognized by T-cells 1 (100-111)
gcccccccggccuacgagaagcugagcgcggagcag

SEQ ID NO: 28487 - RNA, 45 nt, Artificial Sequence
  Melanoma antigen recognized by T-cells 1 (100-114)
gcccccccggccuacgagaagcugagcgcggagcagucccccccc

SEQ ID NO: 28488 - RNA, 48 nt, Artificial Sequence
  Melanoma antigen recognized by T-cells 1 (100-115)
gcccccccggccuacgagaagcugagcgcggagcaguccccccccccc

SEQ ID NO: 28489 - RNA, 51 nt, Artificial Sequence
  Melanoma antigen recognized by T-cells 1 (100-116)
gcccccccggccuacgagaagcugagcgcggagcagucccccccccccuac

SEQ ID NO: 28490 - RNA, 36 nt, Artificial Sequence
  Melanoma antigen recognized by T-cells 1 (99-110)
aacgcccccccggccuacgagaagcugagcgcggag

SEQ ID NO: 28491 - RNA, 60 nt, Artificial Sequence
  Melanoma antigen recognized by T-cells 1 (97-116)
gugcccaacgccccgcccgccuacgagaagcugagcgcggagcaguccccccccccguac

SEQ ID NO: 28492 - RNA, 48 nt, Artificial Sequence
  Gamma-secretase C-terminal fragment 59 (581-596)
uucgccgaggacgugggcagcaacaagggggccaucaucggccugaug

SEQ ID NO: 28493 - RNA, 27 nt, Artificial Sequence
  Ubiquitin carboxyl-terminal hydrolase 11 (583-591)
uucaccugggagggccuguacaacgug

SEQ ID NO: 28494 - RNA, 30 nt, Artificial Sequence
  Ataxin-10 (324-333)
cagguguuccccggccugcucgagcgcguc

SEQ ID NO: 28495 - RNA, 27 nt, Artificial Sequence
  Vacuolar protein sorting-associated protein 13B (29-37)
agccuguggggcggggacgugguccuc

SEQ ID NO: 28496 - RNA, 30 nt, Artificial Sequence
  Farnesyl pyrophosphate synthase (238-247)
uaccuggaccucuucggcgaccccagcgug

SEQ ID NO: 28497 - RNA, 27 nt, Artificial Sequence
  Suppressor of SWI4 1 homolog (26-34)
gccgccaacccccacagcuucguguuc

SEQ ID NO: 28498 - RNA, 33 nt, Artificial Sequence
  Golgin subfamily A member 7 (65-75)
gccgaggccgagaagcugggcgggcagagcuac

SEQ ID NO: 28499 - RNA, 27 nt, Artificial Sequence
  DNA replication licensing factor MCM4 (741-749)
gccgaggcccacgcgaaggugcgccug

SEQ ID NO: 28500 - RNA, 27 nt, Artificial Sequence
  Stomatin-like protein 2, mitochondrial (255-263)
gccgaggccauccgcauccuggcggcc

SEQ ID NO: 28501 - RNA, 27 nt, Artificial Sequence
  Nuclear pore complex protein Nup107 (415-423)
gccgaggacgagcuguucaaccgcuac

SEQ ID NO: 28502 - RNA, 33 nt, Artificial Sequence
  N-alpha-acetyltransferase 10 (45-55)
gccgaggacgagaacggcaagaucgugggguac

SEQ ID NO: 28503 - RNA, 33 nt, Artificial Sequence
  Cytochrome c oxidase subunit 6B1 (2-12)
gccgaggacauggagaccaagaucaagaacuac

SEQ ID NO: 28504 - RNA, 27 nt, Artificial Sequence
  General transcription factor II-I repeat domain-containing protein 2B (397-405)
gccgaguucaucaaguucaccgugauc

SEQ ID NO: 28505 - RNA, 27 nt, Artificial Sequence
  Heterogeneous nuclear ribonucleoprotein A0 (110-118)
gccgagggcgaccugaucgagcacuuc

SEQ ID NO: 28506 - RNA, 33 nt, Artificial Sequence
  60S ribosomal protein L8 (33-43)
gccgagggcauccacaccgggcaguucguguac

SEQ ID NO: 28507 - RNA, 27 nt, Artificial Sequence
  Condensin complex subunit 3 (712-720)
gccgagggccuggccaagcucauguuc

SEQ ID NO: 28508 - RNA, 27 nt, Artificial Sequence
  T-complex protein 1 subunit gamma (109-117)
gccgagcacuuccuggagcagcagaug

SEQ ID NO: 28509 - RNA, 30 nt, Artificial Sequence
  Spectrin beta chain, non-erythrocytic 1 (1958-1967)
gccgagaucgacgcccgcaacgacagcuuc

SEQ ID NO: 28510 - RNA, 27 nt, Artificial Sequence
  Regulation of nuclear pre-mRNA domain-containing protein 1A (232-240)
gccgagaucgacgaccgcaagcagcug

SEQ ID NO: 28511 - RNA, 30 nt, Artificial Sequence
  40S ribosomal protein SA (218-227)
gccgagaaggccgugaccaaggaggaguuc

SEQ ID NO: 28512 - RNA, 27 nt, Artificial Sequence
  Helicase SRCAP (394-402)
gccgagagccugcagcccaagggcuac

SEQ ID NO: 28513 - RNA, 27 nt, Artificial Sequence
  Spartin (569-577)
gccgagaccgugcagaccguccgcuac

SEQ ID NO: 28514 - RNA, 27 nt, Artificial Sequence
  Uncharacterized protein ZMYM6NB (44-52)
gccgagguguucccccugaaggucuuc

SEQ ID NO: 28515 - RNA, 30 nt, Artificial Sequence
  CLIP-associating protein 1 (357-366)
gccgaguacgacaacuucuuccagcaccug

SEQ ID NO: 28516 - RNA, 27 nt, Artificial Sequence
  Alpha-actinin-4 (306-314)
gccaucgaccagcugcaccucgaguac

SEQ ID NO: 28517 - RNA, 27 nt, Artificial Sequence
  Nucleolar protein 58 (12-20)
gccaucuucaaggugcugaacgagaag

SEQ ID NO: 28518 - RNA, 30 nt, Artificial Sequence
  Serine/threonine-protein kinase Kist (151-160)
gccaucaucgaccacaucuucgccagcaag

SEQ ID NO: 28519 - RNA, 30 nt, Artificial Sequence
  Transcription factor Sp2 (106-115)
gccauccagaaccccaccaugaucaacaag

SEQ ID NO: 28520 - RNA, 27 nt, Artificial Sequence
  Apolipoprotein L1 (142-150)
gcccuggccgacggcgugcagaagguc

SEQ ID NO: 28521 - RNA, 27 nt, Artificial Sequence
  Tankyrase-2 (1234-1242)
gcccuggccgaguacgugaucuaccgc

SEQ ID NO: 28522 - RNA, 27 nt, Artificial Sequence
  Uncharacterized protein C19orf43 (126-134)
gcccugaagaccggcaucguggccaag

SEQ ID NO: 28523 - RNA, 30 nt, Artificial Sequence
  Heat shock protein HSP 90-alpha (740-749)
gcccugcgcgacaacagcaccaugggcuac

SEQ ID NO: 28524 - RNA, 27 nt, Artificial Sequence
  X-ray repair cross-complementing protein 5 (376-384)
gcccugagcucccucauccacgcccug

SEQ ID NO: 28525 - RNA, 30 nt, Artificial Sequence
  Nucleolar protein 7 (190-199)
gcccaggccuucauccacaacagccuguac

SEQ ID NO: 28526 - RNA, 27 nt, Artificial Sequence
  U5 small nuclear ribonucleoprotein 200 kDa helicase (1246-1254)
gcccaggacgagcaccugaucaccuuc

SEQ ID NO: 28527 - RNA, 27 nt, Artificial Sequence
  15 kDa selenoprotein (78-86)
gcccaguucgagaccaagaagcuguac

SEQ ID NO: 28528 - RNA, 30 nt, Artificial Sequence
  Prelamin-A/C (169-178)
gcccagcacgaggaccagguggagcaguac

SEQ ID NO: 28529 - RNA, 27 nt, Artificial Sequence
  Ribosomal RNA processing protein 1 homolog B (90-98)
gcccagcaccuguucauccagaccuuc

SEQ ID NO: 28530 - RNA, 27 nt, Artificial Sequence
  116 kDa U5 small nuclear ribonucleoprotein component (574-582)
gcccagaucuuccgcccccugaaguuc

SEQ ID NO: 28531 - RNA, 27 nt, Artificial Sequence
  Paraneoplastic antigen Ma1 (246-254)
gcccagaucaaguuccugaacaccuac

SEQ ID NO: 28532 - RNA, 30 nt, Artificial Sequence
  Retinoic acid-induced protein 1 (1522-1531)
gcccagaagcagcccggccacaccaacuac

SEQ ID NO: 28533 - RNA, 27 nt, Artificial Sequence
  ADP-ribosylation factor GTPase-activating protein 2 (233-241)
gcccagaaggugagcucccagagcuuc

SEQ ID NO: 28534 - RNA, 27 nt, Artificial Sequence
  Nucleolar protein 56 (144-152)
gcccagcugggccucgggcacagcuac

SEQ ID NO: 28535 - RNA, 27 nt, Artificial Sequence
  Catenin beta-1 (481-489)
gcccagaacgccgugcgccugcacuac

SEQ ID NO: 28536 - RNA, 33 nt, Artificial Sequence
  nuclear pore complex protein Nup98 isoform 2 proprotein (110-120)
gcccagaacaagcccaccggcuucgggaacuuc

SEQ ID NO: 28537 - RNA, 33 nt, Artificial Sequence
  RNA-binding protein 14 (530-540)
gcccagcagcacccccaggccgcggccagcuac

SEQ ID NO: 28538 - RNA, 27 nt, Artificial Sequence
  Eukaryotic initiation factor 4A-I (113-121)
gcccagcagauccagaagguggucaug

SEQ ID NO: 28539 - RNA, 27 nt, Artificial Sequence
  Septin-7 (21-29)
gcccagcagaagaaccuggagggcuac

SEQ ID NO: 28540 - RNA, 27 nt, Artificial Sequence
  Protein polybromo-1 (234-242)
gcccagcgcauccagaacggcagcuac

SEQ ID NO: 28541 - RNA, 30 nt, Artificial Sequence
  Annexin A2 (66-75)
gcccagcgccaggacaucgccuucgcguac

SEQ ID NO: 28542 - RNA, 30 nt, Artificial Sequence
  Annexin A4 (49-58)
gcccagcgccaggagauccggaccgccuac

SEQ ID NO: 28543 - RNA, 30 nt, Artificial Sequence
  Centromere protein F (348-357)
gcccaguacgaccaggccagcaccaaguac

SEQ ID NO: 28544 - RNA, 33 nt, Artificial Sequence
  60S ribosomal protein L22-like 1 (118-128)
gccagcgacaaggagaccuacgagcugcgcuac

SEQ ID NO: 28545 - RNA, 30 nt, Artificial Sequence
  Histone H2B type 1-A (76-85)
gccagcgaggccucccgccuggcgcacuac

SEQ ID NO: 28546 - RNA, 30 nt, Artificial Sequence
  ADP-dependent glucokinase (24-33)
gccagcgaguuccccggcgcccagcacuac

SEQ ID NO: 28547 - RNA, 27 nt, Artificial Sequence
  Heterogeneous nuclear ribonucleoprotein U (205-213)
gccagcuacggcguguccaaggggaag

SEQ ID NO: 28548 - RNA, 30 nt, Artificial Sequence
  High affinity cAMP-specific 3',5'-cyclic phosphodiesterase 7A (294-303)
gccaccgacaucagccgccagaacgaguac

SEQ ID NO: 28549 - RNA, 27 nt, Artificial Sequence
  E3 ubiquitin-protein ligase UBR2 (31-39)
gccaccgaccugacccgcgagguguac

SEQ ID NO: 28550 - RNA, 27 nt, Artificial Sequence
  m7GpppX diphosphatase (135-143)
gccaccgagaagcaccugcagaaguac

SEQ ID NO: 28551 - RNA, 33 nt, Artificial Sequence
  Microtubule-actin cross-linking factor 1, isoforms 1/2/3/5 (326-336)
gccaccgagguggacagccgcuggcaggaguac

SEQ ID NO: 28552 - RNA, 27 nt, Artificial Sequence
  YTH domain-containing protein 1 (92-100)
gccaccgaguacaagaacgaggaguac

SEQ ID NO: 28553 - RNA, 27 nt, Artificial Sequence
  Eukaryotic translation initiation factor 5A-1 (146-154)
gccguggccaucaaggcgauggccaag

SEQ ID NO: 28554 - RNA, 30 nt, Artificial Sequence
  Activating transcription factor 7-interacting protein 1 (621-630)
gccguguucgacaagacccuggccgagcuc

SEQ ID NO: 28555 - RNA, 27 nt, Artificial Sequence
  Transmembrane protein 258 (16-24)
gccguguucccccaccugaccgucgug

SEQ ID NO: 28556 - RNA, 33 nt, Artificial Sequence
  U3 small nucleolar RNA-associated protein 6 homolog (467-477)
gccgugaucggcgccgacagcgucacccugaag

SEQ ID NO: 28557 - RNA, 27 nt, Artificial Sequence
  Nucleolar RNA helicase 2 (357-365)
gccgugaucggcgacgucauccgcgug

SEQ ID NO: 28558 - RNA, 30 nt, Artificial Sequence
  Nucleosome assembly protein 1-like 1 (107-116)
gccgugcuguaccagccccucuucgacaag

SEQ ID NO: 28559 - RNA, 30 nt, Artificial Sequence
  MICOS complex subunit MIC60 (247-256)
gccgugaacgcccacagcaacauccugaag

SEQ ID NO: 28560 - RNA, 27 nt, Artificial Sequence
  Elongation of very long chain fatty acids protein 5 (276-284)
gccgugaacggccacaccaacagcuuc

SEQ ID NO: 28561 - RNA, 27 nt, Artificial Sequence
  DNA-directed RNA polymerase II subunit RPB7 (87-95)
gccguggucacccaggugaacaaggug

SEQ ID NO: 28562 - RNA, 27 nt, Artificial Sequence
  RRP12-like protein (704-712)
gacgaggccgccaucagcaagcuguac

SEQ ID NO: 28563 - RNA, 33 nt, Artificial Sequence
  26S protease regulatory subunit 6B (265-275)
gacgagaucgacgccaucgccaccaagcgcuuc

SEQ ID NO: 28564 - RNA, 33 nt, Artificial Sequence
  26S protease regulatory subunit 7 (275-285)
gacgagaucgacgccaucggcggggcccgcuuc

SEQ ID NO: 28565 - RNA, 33 nt, Artificial Sequence
  26S protease regulatory subunit 4 (285-295)
gacgagaucgacgccaucggcaccaagcgcuac

SEQ ID NO: 28566 - RNA, 27 nt, Artificial Sequence
  Nucleolar protein 11 (17-25)
gacgagaacagcgugaucaaguccuuc

SEQ ID NO: 28567 - RNA, 27 nt, Artificial Sequence
  Prothymosin alpha (16-24)
gaccugaaggagaagaaggaggugguc

SEQ ID NO: 28568 - RNA, 30 nt, Artificial Sequence
  Vezatin (553-562)
gacagcgacuuccgcaaggacgacuucuac

SEQ ID NO: 28569 - RNA, 27 nt, Artificial Sequence
  Protein AF-10 (379-387)
gacagcgaccugcgcaacgacuccuac

SEQ ID NO: 28570 - RNA, 27 nt, Artificial Sequence
  Negative elongation factor C/D (348-356)
gacaccgacaucagccugauccgcuac

SEQ ID NO: 28571 - RNA, 27 nt, Artificial Sequence
  Transcription factor E2F1 (237-245)
gacaccgacagccagcgccuggccuac

SEQ ID NO: 28572 - RNA, 27 nt, Artificial Sequence
  RNA-binding protein 6 (398-406)
gacaccgacuaccgcagcauggaguac

SEQ ID NO: 28573 - RNA, 30 nt, Artificial Sequence
  Eukaryotic translation initiation factor 4 gamma 3 (1509-1518)
gacaccgagaaggagcugcaggcccucuac

SEQ ID NO: 28574 - RNA, 33 nt, Artificial Sequence
  Next to BRCA1 gene 1 protein (720-730)
gacaccagccgcccccugggcgacuccauguac

SEQ ID NO: 28575 - RNA, 27 nt, Artificial Sequence
  Mitochondrial import receptor subunit TOM7 homolog (7-15)
gaggccaagcagcgccugcagcagcuc

SEQ ID NO: 28576 - RNA, 30 nt, Artificial Sequence
  Heterogeneous nuclear ribonucleoprotein U-like protein 1 (585-594)
gaggaggccgacaagcuggugcgccaguac

SEQ ID NO: 28577 - RNA, 27 nt, Artificial Sequence
  Poly (ADP-ribose) polymerase 1 (809-817)
gaggaggccgagaucauccgcaaguac

SEQ ID NO: 28578 - RNA, 30 nt, Artificial Sequence
  RB1 protein (1-10)
gaggaggagcgccugagcauccagaacuuc

SEQ ID NO: 28579 - RNA, 30 nt, Artificial Sequence
  Eukaryotic translation initiation factor 3 subunit C (81-90)
gaggaguucgagcugcucggcaaggccuac

SEQ ID NO: 28580 - RNA, 27 nt, Artificial Sequence
  Condensin-2 complex subunit G2 (490-498)
gaggagggcgccguggacaagagcuac

SEQ ID NO: 28581 - RNA, 30 nt, Artificial Sequence
  Prelamin-A/C (53-62)
gaggagcuggacuuccagaagaacaucuac

SEQ ID NO: 28582 - RNA, 27 nt, Artificial Sequence
  Signal transducer and activator of transcription 1-alpha/beta (281-289)
gaggagcuggagcagaaguacaccuac

SEQ ID NO: 28583 - RNA, 27 nt, Artificial Sequence
  Poly (ADP-ribose) polymerase 1 (168-176)
gaggagcugggcuuccgccccgaguac

SEQ ID NO: 28584 - RNA, 27 nt, Artificial Sequence
  BolA-like protein 2 (62-70)
gaggagcugccccacauccacgccuuc

SEQ ID NO: 28585 - RNA, 27 nt, Artificial Sequence
  Signal transducer and activator of transcription 3 (285-293)
gaggagcugcagcagaaggugagcuac

SEQ ID NO: 28586 - RNA, 30 nt, Artificial Sequence
  Ataxin-2-like protein (284-293)
gaggagaacuacggcgugaagaccaccuac

SEQ ID NO: 28587 - RNA, 27 nt, Artificial Sequence
  G patch domain-containing protein 4 (16-24)
gaggagcagcugcucaagcacggcugg

SEQ ID NO: 28588 - RNA, 30 nt, Artificial Sequence
  Golgi resident protein GCP60 (489-498)
gaggagguguacgccggcagccaccaguac

SEQ ID NO: 28589 - RNA, 27 nt, Artificial Sequence
  AP-1 complex subunit sigma-3 (146-154)
gaggaguacaugaacaagcccaccuuc

SEQ ID NO: 28590 - RNA, 27 nt, Artificial Sequence
  Transferrin receptor protein 1 (575-583)
gagcugaucgagcgcauccccgagcuc

SEQ ID NO: 28591 - RNA, 27 nt, Artificial Sequence
  Cleavage stimulation factor subunit 3 (52-60)
gagaccgcccugcucguggaccgcuac

SEQ ID NO: 28592 - RNA, 33 nt, Artificial Sequence
  ATP-dependent RNA helicase DDX24 (571-581)
gagaccgacgagaaggacuucuaccuguacuac

SEQ ID NO: 28593 - RNA, 30 nt, Artificial Sequence
  Mediator of RNA polymerase II transcription subunit 23 (175-184)
gagaccgaccacaucaaccagaucggcuac

SEQ ID NO: 28594 - RNA, 30 nt, Artificial Sequence
  Sorting and assembly machinery component 50 homolog (206-215)
gagaccgaccgcggcaugagcgccgaguac

SEQ ID NO: 28595 - RNA, 33 nt, Artificial Sequence
  Protein polybromo-1 (1182-1192)
gagaccgagcacgagcccaccaagauguucuac

SEQ ID NO: 28596 - RNA, 33 nt, Artificial Sequence
  Protein LAP2 (803-813)
gagaccgagcaccuggagaacggcaacaaguac

SEQ ID NO: 28597 - RNA, 27 nt, Artificial Sequence
  Spectrin beta chain, erythrocytic (299-307)
gagaccgagaagaugaucgagaaguac

SEQ ID NO: 28598 - RNA, 30 nt, Artificial Sequence
  E3 ubiquitin-protein ligase RBBP6 (790-799)
gagaccgagcgcgaguacuucaaccgguac

SEQ ID NO: 28599 - RNA, 27 nt, Artificial Sequence
  Putative eukaryotic translation initiation factor 2 subunit 3-like protein (322-330)
uucgccgagcacaacgaccugcaguac

SEQ ID NO: 28600 - RNA, 27 nt, Artificial Sequence
  40S ribosomal protein S18 (28-36)
uucgccaucaccgccaucaagggcgug

SEQ ID NO: 28601 - RNA, 27 nt, Artificial Sequence
  Keratinocyte-associated protein 2 (110-118)
uucgccagcggccugauccaccgcgug

SEQ ID NO: 28602 - RNA, 27 nt, Artificial Sequence
  Dolichyl-diphosphooligosaccharide-proteinosyltransferase subunit DAD1 (99-107)
uucgccagcaccauccugcaccucgug

SEQ ID NO: 28603 - RNA, 27 nt, Artificial Sequence
  Minor histocompatibility antigen H13 (236-244)
uucgaggcccccaucaagcugguguuc

SEQ ID NO: 28604 - RNA, 27 nt, Artificial Sequence
  Catenin alpha-2 (609-617)
uucaucgacgccagccgccugguguac

SEQ ID NO: 28605 - RNA, 33 nt, Artificial Sequence
  TBC1 domain family member 31 (560-570)
uucaucgaccacgacaucaccagccagcuguac

SEQ ID NO: 28606 - RNA, 27 nt, Artificial Sequence
  Poly (ADP-ribose) polymerase 4 (797-805)
uucaucuucagcgacacccacgagcug

SEQ ID NO: 28607 - RNA, 33 nt, Artificial Sequence
  Basic leucine zipper and W2 domain-containing protein 1 (53-63)
uuccuggacgccagcggcgccaagcucgacuac

SEQ ID NO: 28608 - RNA, 30 nt, Artificial Sequence
  Neutral alpha-glucosidase AB (604-613)
uuccuggacgacggccacaccuucaacuac

SEQ ID NO: 28609 - RNA, 30 nt, Artificial Sequence
  RuvB-like 2 (433-442)
uuccuggacgagagccgcuccacccaguac

SEQ ID NO: 28610 - RNA, 27 nt, Artificial Sequence
  Signal transducer and activator of transcription 1-alpha/beta (14-22)
uuccuggagcaggugcaccagcucuac

SEQ ID NO: 28611 - RNA, 27 nt, Artificial Sequence
  Protein MCM10 homolog (333-341)
uuccuguucggcgaggugcacaaggcc

SEQ ID NO: 28612 - RNA, 30 nt, Artificial Sequence
  Hemoglobin subunit alpha (5-14)
uuccugagcuuccccaccaccaagacguac

SEQ ID NO: 28613 - RNA, 27 nt, Artificial Sequence
  Plexin-C1 (1065-1073)
uuccuggugaccgucauccacacccuc

SEQ ID NO: 28614 - RNA, 27 nt, Artificial Sequence
  DNA repair protein XRCC1 (161-169)
uuccagaaccccuuccgcagcgagcug

SEQ ID NO: 28615 - RNA, 27 nt, Artificial Sequence
  Protein AATF (298-306)
uuccaguaccccgacacccgcuaccug

SEQ ID NO: 28616 - RNA, 27 nt, Artificial Sequence
  Short transient receptor potential channel 4-associated protein (457-465)
uucagcgaccaccacgagaacaaguac

SEQ ID NO: 28617 - RNA, 27 nt, Artificial Sequence
  Cell cycle progression protein 1 (186-194)
uucagcgacuaccugcacccccaguac

SEQ ID NO: 28618 - RNA, 27 nt, Artificial Sequence
  Dihydrofolate reductase, mitochondrial (149-157)
uucagcgagaucgaccuggagaaguac

SEQ ID NO: 28619 - RNA, 30 nt, Artificial Sequence
  Splicing factor 3A subunit 3 (130-139)
uucaccgacgaggagggcuacgggcgcuac

SEQ ID NO: 28620 - RNA, 30 nt, Artificial Sequence
  Bifunctional glutamate/proline-tRNA ligase (48-57)
uucaccgacgugaacagcauccugcgcuac

SEQ ID NO: 28621 - RNA, 33 nt, Artificial Sequence
  RNMT-activating mini protein (19-29)
uucaccgagaacgacaaggaguaccaggaguac

SEQ ID NO: 28622 - RNA, 27 nt, Artificial Sequence
  ATP-dependent RNA helicase DDX24 (801-809)
uucaccgagagccagaagaccaaguac

SEQ ID NO: 28623 - RNA, 27 nt, Artificial Sequence
  Eukaryotic translation initiation factor 4 gamma 1 (1377-1385)
uucguggccgagcagaaggucgaguac

SEQ ID NO: 28624 - RNA, 27 nt, Artificial Sequence
  Coatomer subunit delta (9-17)
uucguggagaccgagagcguccgcuac

SEQ ID NO: 28625 - RNA, 27 nt, Artificial Sequence
  Coatomer subunit alpha (641-649)
uucgugaaggacgagaagacccgcuuc

SEQ ID NO: 28626 - RNA, 27 nt, Artificial Sequence
  Mothers against decapentaplegic homolog 9 (418-426)
uucgugaagggcuggggggccgaguac

SEQ ID NO: 28627 - RNA, 30 nt, Artificial Sequence
  Ubiquitin-like protein FUBI (4-13)
uucgugcgcgcccaggagcugcacaccuuc

SEQ ID NO: 28628 - RNA, 27 nt, Artificial Sequence
  Lysine-tRNA ligase (119-127)
ggcgaggaccccuacccgcacaaguuc

SEQ ID NO: 28629 - RNA, 27 nt, Artificial Sequence
  Cytochrome c oxidase subunit 6A1, mitochondrial (7-15)
ggcgaggaggggagcgcccgcaugugg

SEQ ID NO: 28630 - RNA, 27 nt, Artificial Sequence
  Polycomb protein SUZ12 (549-557)
ggcgagguggagcagcagcgcaccuac

SEQ ID NO: 28631 - RNA, 30 nt, Artificial Sequence
  SNARE-associated protein Snapin (127-136)
ggcaucuaccccccggggagccccggcaag

SEQ ID NO: 28632 - RNA, 33 nt, Artificial Sequence
  Ataxin-10 (379-389)
ggccuggccgacgccagccuccugaagaaggug

SEQ ID NO: 28633 - RNA, 27 nt, Artificial Sequence
  Signal recognition particle 54 kDa protein (302-310)
ggccugaucgacaaggugaacgagcuc

SEQ ID NO: 28634 - RNA, 27 nt, Artificial Sequence
  Probable JmjC domain-containing histone demethylation protein 2C (846-854)
ggccaggcccaccccagcgccuccuac

SEQ ID NO: 28635 - RNA, 27 nt, Artificial Sequence
  Putative ATP-dependent RNA helicase DDX11-like protein 8 (825-833)
ggccaggcccccccggggaaggcccug

SEQ ID NO: 28636 - RNA, 27 nt, Artificial Sequence
  General transcription factor 3C polypeptide 1 (604-612)
ggccaggacaagccccacgagaccuac

SEQ ID NO: 28637 - RNA, 30 nt, Artificial Sequence
  Tonsoku-like protein (670-679)
ggccaggacccccacagcucccaggccuuc

SEQ ID NO: 28638 - RNA, 27 nt, Artificial Sequence
  Nuclear pore complex protein Nup214 (1208-1216)
ggccaguucagcaagcccuucuccuuc

SEQ ID NO: 28639 - RNA, 33 nt, Artificial Sequence
  ATP-dependent 6-phosphofructokinase, platelet type (125-135)
ggccagaucgacaaggaggccgugcagaaguac

SEQ ID NO: 28640 - RNA, 27 nt, Artificial Sequence
  Alpha-endosulfine (45-53)
ggccagaagcccgggggcagcgacuuc

SEQ ID NO: 28641 - RNA, 27 nt, Artificial Sequence
  Heterogeneous nuclear ribonucleoprotein U (812-820)
ggccagaagcccuggagccagcacuac

SEQ ID NO: 28642 - RNA, 33 nt, Artificial Sequence
  60S ribosomal protein L26 (64-74)
ggccagcagaucgggaaggugguccagguguac

SEQ ID NO: 28643 - RNA, 30 nt, Artificial Sequence
  60S ribosomal protein L8 (3-12)
ggccagcgcaagggggccggcagcguguuc

SEQ ID NO: 28644 - RNA, 27 nt, Artificial Sequence
  60S ribosomal protein L28 (69-77)
ggccagcgcaagcccgccaccagcuac

SEQ ID NO: 28645 - RNA, 27 nt, Artificial Sequence
  DNA mismatch repair protein Msh2 (157-165)
ggccagcgccaggugggggucggcuac

SEQ ID NO: 28646 - RNA, 27 nt, Artificial Sequence
  Chromodomain-helicase-DNA-binding protein 8 (210-218)
ggccagagcaaggccgugaaggucuac

SEQ ID NO: 28647 - RNA, 27 nt, Artificial Sequence
  Cell division cycle protein 27 homolog (325-333)
ggccagaccgggaccaagagcguguuc

SEQ ID NO: 28648 - RNA, 27 nt, Artificial Sequence
  Transmembrane protein 43 (137-145)
ggccaggugaagaaggagacccgcuac

SEQ ID NO: 28649 - RNA, 27 nt, Artificial Sequence
  Clathrin heavy chain 1 (496-504)
ggccaggugcagaagaucguccuguac

SEQ ID NO: 28650 - RNA, 30 nt, Artificial Sequence
  Disintegrin and metalloproteinase domain-containing protein 10 (19-28)
ggccaguacgggaacccccugaacaaguac

SEQ ID NO: 28651 - RNA, 33 nt, Artificial Sequence
  Protein transport protein Sec23B (560-570)
ggccaguacaacaaggaggaccccaccagcuuc

SEQ ID NO: 28652 - RNA, 27 nt, Artificial Sequence
  Protein CASP (561-569)
ggcagcgacgacaccgagcugcgcuac

SEQ ID NO: 28653 - RNA, 30 nt, Artificial Sequence
  Gem-associated protein 5 (444-453)
ggcaccgacgacgggaaggugggccuguac

SEQ ID NO: 28654 - RNA, 27 nt, Artificial Sequence
  Ribosomal biogenesis protein LAS1L (107-115)
ggcaccgacgagcugcgccuccuguac

SEQ ID NO: 28655 - RNA, 27 nt, Artificial Sequence
  WD repeat-containing protein 34 (398-406)
ggcaccgacgggcacgugcaccuguac

SEQ ID NO: 28656 - RNA, 33 nt, Artificial Sequence
  DnaJ homolog subfamily B member 4 (38-48)
ggcaccgacgggcagggcgggaccuuccgcuac

SEQ ID NO: 28657 - RNA, 27 nt, Artificial Sequence
  Tyrosine-protein kinase Fyn (31-39)
ggcaccgaccccaccccgcagcacuac

SEQ ID NO: 28658 - RNA, 27 nt, Artificial Sequence
  Activating signal cointegrator 1 (235-243)
ggcacccugaaccagccccucaccaag

SEQ ID NO: 28659 - RNA, 27 nt, Artificial Sequence
  Putative mitochondrial import inner membrane translocase subunit Tim23B (113-121)
ggcaccaugaccgggaugcuguacaag

SEQ ID NO: 28660 - RNA, 30 nt, Artificial Sequence
  Peroxisomal acyl-coenzyme A oxidase 1 (263-272)
ggcaccuacgugaagccccugagcaacaag

SEQ ID NO: 28661 - RNA, 27 nt, Artificial Sequence
  HLA class II histocompatibility antigen, DO alpha chain (37-45)
ggcaccuacgugagcuccgucccccgc

SEQ ID NO: 28662 - RNA, 27 nt, Artificial Sequence
  Poly (ADP-ribose) polymerase 14 (924-932)
ggcguguucggguucccccugggccgc

SEQ ID NO: 28663 - RNA, 30 nt, Artificial Sequence
  Cytosolic non-specific dipeptidase (106-115)
ggcguguacgggggcagcguccacgaggcc

SEQ ID NO: 28664 - RNA, 30 nt, Artificial Sequence
  Mediator of RNA polymerase II transcription subunit 18 (127-136)
cacgaguucguggccaagggccaccuguuc

SEQ ID NO: 28665 - RNA, 30 nt, Artificial Sequence
  60S ribosomal protein L7 (192-201)
cacgagaucuacaccgugggcaagcgcuuc

SEQ ID NO: 28666 - RNA, 27 nt, Artificial Sequence
  Coatomer subunit alpha (103-111)
cacgaguaccccuggauccugagcgcc

SEQ ID NO: 28667 - RNA, 30 nt, Artificial Sequence
  Zinc finger protein 548 (24-33)
caccuggacgaggcccagcgccuccuguac

SEQ ID NO: 28668 - RNA, 27 nt, Artificial Sequence
  Protein FAM32A (95-103)
caccuggacacccucaccgagcacuac

SEQ ID NO: 28669 - RNA, 27 nt, Artificial Sequence
  Heat shock protein HSP 90-alpha A2 (189-197)
caccugaaggaggaccagaccgaguac

SEQ ID NO: 28670 - RNA, 27 nt, Artificial Sequence
  Myc-associated zinc finger protein (411-419)
caccugaacagccacgugcgccagguc

SEQ ID NO: 28671 - RNA, 27 nt, Artificial Sequence
  Heterogeneous nuclear ribonucleoproteins A2/B1 (127-135)
caccugcgcgacuacuucgaggaguac

SEQ ID NO: 28672 - RNA, 27 nt, Artificial Sequence
  V-type proton ATPase 116 kDa subunit a isoform 4 (722-730)
caccaggccauccacaccaucgaguac

SEQ ID NO: 28673 - RNA, 27 nt, Artificial Sequence
  Elongation of very long chain fatty acids protein 5 (137-145)
caccagaucaccgugcugcacgucuac

SEQ ID NO: 28674 - RNA, 27 nt, Artificial Sequence
  Zinc finger protein 770 (99-107)
caccagcagcugcacaacgagaccuac

SEQ ID NO: 28675 - RNA, 27 nt, Artificial Sequence
  Protein SSXT (207-215)
caccagcagcccccgagccagcaguac

SEQ ID NO: 28676 - RNA, 27 nt, Artificial Sequence
  Zinc finger and BTB domain-containing protein 43 (140-148)
caccagagccccuccagcuccagcuac

SEQ ID NO: 28677 - RNA, 27 nt, Artificial Sequence
  Signal transducing adapter molecule 2 (410-418)
caccaggugaccgucgcccagagcuac

SEQ ID NO: 28678 - RNA, 27 nt, Artificial Sequence
  Cirhin (556-564)
cacagcgaccagcagguguucgaguac

SEQ ID NO: 28679 - RNA, 30 nt, Artificial Sequence
  Catenin beta-1 (645-654)
cacagccgcaacgagggcguggccaccuac

SEQ ID NO: 28680 - RNA, 30 nt, Artificial Sequence
  U3 small nucleolar RNA-associated protein 6 homolog (267-276)
cacaccgacgacccccugaccugggacuac

SEQ ID NO: 28681 - RNA, 27 nt, Artificial Sequence
  DTW domain-containing protein 1 (175-183)
cacaccgacauccugaaggagaaguac

SEQ ID NO: 28682 - RNA, 30 nt, Artificial Sequence
  Bone morphogenetic protein receptor type-2 (316-325)
cacaccgagcugccccgcggcgaccacuac

SEQ ID NO: 28683 - RNA, 27 nt, Artificial Sequence
  Dedicator of cytokinesis protein 7 (913-921)
aucgccagcgacaucgugucccgcuuc

SEQ ID NO: 28684 - RNA, 27 nt, Artificial Sequence
  Filamin-A (898-906)
aucaucgaccaccacgacaacaccuac

SEQ ID NO: 28685 - RNA, 27 nt, Artificial Sequence
  SUMO-activating enzyme subunit 1 (309-317)
auccuggcccaggagaucgugaaggcc

SEQ ID NO: 28686 - RNA, 30 nt, Artificial Sequence
  Superkiller viralicidic activity 2-like 2 (470-479)
auccuguucagcgagggccucaucaaggcc

SEQ ID NO: 28687 - RNA, 27 nt, Artificial Sequence
  60S ribosomal protein L15 (133-141)
auccugaucgaccccuuccacaaggcc

SEQ ID NO: 28688 - RNA, 27 nt, Artificial Sequence
  Transcription elongation factor SPT6 (1267-1275)
aucaugaagaucgacaucgagaaguuc

SEQ ID NO: 28689 - RNA, 27 nt, Artificial Sequence
  X-ray repair cross-complementing protein 5 (528-536)
aucccccugagcaagaucaagacccuc

SEQ ID NO: 28690 - RNA, 27 nt, Artificial Sequence
  Eukaryotic translation initiation factor 3 subunit C (783-791)
auccaggaggagagccugcgcaccuac

SEQ ID NO: 28691 - RNA, 27 nt, Artificial Sequence
  60S ribosomal protein L18a (95-103)
auccagaucaugaagguggaggagauc

SEQ ID NO: 28692 - RNA, 27 nt, Artificial Sequence
  Catalase (398-406)
auccagaagaaggccgugaagaacuuc

SEQ ID NO: 28693 - RNA, 27 nt, Artificial Sequence
  Tuftelin-interacting protein 11 (336-344)
auccagaacgaccgccagcugcaguac

SEQ ID NO: 28694 - RNA, 27 nt, Artificial Sequence
  Hepatoma-derived growth factor-related protein 2 (84-92)
auccagaacaacccccacgccagcuac

SEQ ID NO: 28695 - RNA, 27 nt, Artificial Sequence
  Putative annexin A2-like protein (319-327)
auccagcaggacaccaagggcgacuac

SEQ ID NO: 28696 - RNA, 27 nt, Artificial Sequence
  Interferon-induced GTP-binding protein Mx1 (206-214)
auccagcgccaggagaccaucagccug

SEQ ID NO: 28697 - RNA, 27 nt, Artificial Sequence
  Protein transport protein Sec16A (1602-1610)
auccagcgcaccgaggccuacgaguac

SEQ ID NO: 28698 - RNA, 27 nt, Artificial Sequence
  Transcription elongation factor SPT5 (984-992)
auccaggugaagguccgcgacaccuac

SEQ ID NO: 28699 - RNA, 33 nt, Artificial Sequence
  Splicing factor 3B subunit 4 (6-16)
aucagcgagcgcaaccaggacgccaccguguac

SEQ ID NO: 28700 - RNA, 27 nt, Artificial Sequence
  40S ribosomal protein S16 (87-95)
aucagcaaggcccugguggccuacuac

SEQ ID NO: 28701 - RNA, 27 nt, Artificial Sequence
  Serine/threonine-protein kinase 17B (51-59)
aucagcaaguccaccggccaggaguac

SEQ ID NO: 28702 - RNA, 27 nt, Artificial Sequence
  Pre-mRNA-splicing factor CWC22 homolog (146-154)
aucaccgacaagaacagccuggccuac

SEQ ID NO: 28703 - RNA, 30 nt, Artificial Sequence
  Serine/threonine-protein kinase mTOR (664-673)
aucaccgaccccgacccggacauccgcuac

SEQ ID NO: 28704 - RNA, 30 nt, Artificial Sequence
  AAC42003.1 (85-94)
aucaccgacagcgccggccacauccuguac

SEQ ID NO: 28705 - RNA, 27 nt, Artificial Sequence
  E3 ubiquitin-protein ligase RNF213 (4163-4171)
aucaccgaggacaagaccgagcuguac

SEQ ID NO: 28706 - RNA, 27 nt, Artificial Sequence
  RNA polymerase I-specific transcription initiation factor RRN3 (516-524)
aucaccaacaaguaccagcugguguuc

SEQ ID NO: 28707 - RNA, 27 nt, Artificial Sequence
  Nuclear receptor corepressor 2 (1441-1449)
aucacccagggcaccccccugaaguac

SEQ ID NO: 28708 - RNA, 33 nt, Artificial Sequence
  HLA class II histocompatibility antigen, DQ alpha 1 chain (3-13)
aucguggccgaccacgucgccagcuacggcgug

SEQ ID NO: 28709 - RNA, 27 nt, Artificial Sequence
  Putative eukaryotic translation initiation factor 2 subunit 3-like protein (59-67)
aaggccaucagcggcgugcacaccguc

SEQ ID NO: 28710 - RNA, 27 nt, Artificial Sequence
  Nuclear pore membraneoprotein 210 (219-227)
aaggcccgcauccaggaggccguguac

SEQ ID NO: 28711 - RNA, 27 nt, Artificial Sequence
  Heat shock protein HSP 90-beta (452-460)
aaggaguucgacggcaagagccuggug

SEQ ID NO: 28712 - RNA, 27 nt, Artificial Sequence
  NADH dehydrogenase (ubiquinone) 1 beta subcomplex subunit 10 (121-129)
aaggagguggagcaguucacccagguc

SEQ ID NO: 28713 - RNA, 27 nt, Artificial Sequence
  Lysine-specific histone demethylase 1A (454-462)
aagaucaaggagcugcaccagcaguac

SEQ ID NO: 28714 - RNA, 27 nt, Artificial Sequence
  Thioredoxin-interacting protein (6-14)
aagaucaagagcuucgagguggucuuc

SEQ ID NO: 28715 - RNA, 27 nt, Artificial Sequence
  60S ribosomal protein L27 (67-75)
aagaucaagagcuucgugaaggucuac

SEQ ID NO: 28716 - RNA, 27 nt, Artificial Sequence
  60S ribosomal protein L5 (117-125)
aagaucuacgagggccagguggagguc

SEQ ID NO: 28717 - RNA, 30 nt, Artificial Sequence
  Putative elongation factor 1-alpha-like 3 (386-395)
aagcuggaggacggccccaaguuccucaag

SEQ ID NO: 28718 - RNA, 30 nt, Artificial Sequence
  Long-chain-fatty-acid-CoA ligase 4 (40-49)
aagcuguucgaccacgccgugagcaaguuc

SEQ ID NO: 28719 - RNA, 27 nt, Artificial Sequence
  Signal recognition particle receptor subunit alpha (81-89)
aagcugaucgacgacgugcaccgccuc

SEQ ID NO: 28720 - RNA, 33 nt, Artificial Sequence
  Embryonic stem cell-specific 5-hydroxymethylcytosine-binding protein (239-249)
aagcugauccaccccaccgagaacaucaccuuc

SEQ ID NO: 28721 - RNA, 27 nt, Artificial Sequence
  Dolichyl-diphosphooligosaccharide-proteinosyltransferase subunit DAD1 (25-33)
aagcugcucgacgccuaccugcuguac

SEQ ID NO: 28722 - RNA, 30 nt, Artificial Sequence
  DNA-directed RNA polymerases I, II, and III subunit RPABC5 (58-67)
aagcugcucaacuacgccccccuggagaag

SEQ ID NO: 28723 - RNA, 27 nt, Artificial Sequence
  Dystonin (4751-4759)
aagcugagcgaccucgacaacaagcug

SEQ ID NO: 28724 - RNA, 30 nt, Artificial Sequence
  60S ribosomal protein L23a (115-124)
aagcuguacgacaucgacguggccaagguc

SEQ ID NO: 28725 - RNA, 30 nt, Artificial Sequence
  ATP-citrate synthase (650-659)
aagcuguaccgccccggcagcguggccuac

SEQ ID NO: 28726 - RNA, 27 nt, Artificial Sequence
  Protein quaking (81-89)
aagcuguacgugcccgucaaggaguac

SEQ ID NO: 28727 - RNA, 27 nt, Artificial Sequence
  Homocysteine-responsive endoplasmic reticulum-resident ubiquitin-like domain member 1 protein (92-100)
aagaugcccgagaucaacgccaaggug

SEQ ID NO: 28728 - RNA, 27 nt, Artificial Sequence
  Transducin-like enhancer protein 2 (76-84)
aagcaggccgagaucgugaagcgccug

SEQ ID NO: 28729 - RNA, 27 nt, Artificial Sequence
  Gamma-interferon-inducible protein 16 (309-317)
aagcaggccagcggcaacaucguguac

SEQ ID NO: 28730 - RNA, 30 nt, Artificial Sequence
  Cytoplasmic dynein 1 heavy chain 1 (1181-1190)
aagcaguucgagaagcagguggagcuguac

SEQ ID NO: 28731 - RNA, 30 nt, Artificial Sequence
  Staphylococcal nuclease domain-containing protein 1 (869-878)
aagcaguuccagaaggugaucaccgaguac

SEQ ID NO: 28732 - RNA, 30 nt, Artificial Sequence
  Cytoplasmic dynein 1 heavy chain 1 (652-661)
aagcagaucgaccgccagcugaccgccuac

SEQ ID NO: 28733 - RNA, 27 nt, Artificial Sequence
  Thioredoxin (3-11)
aagcagaucgagagcaagaccgccuuc

SEQ ID NO: 28734 - RNA, 27 nt, Artificial Sequence
  Ribonucleoside-diphosphate reductase large subunit (529-537)
aagcagaucuucgagaccaucuacuac

SEQ ID NO: 28735 - RNA, 27 nt, Artificial Sequence
  ADP/ATP translocase 2 (43-51)
aagcagaucaccgccgacaagcaguac

SEQ ID NO: 28736 - RNA, 30 nt, Artificial Sequence
  Lamin-B receptor (234-243)
aagcagaaggaccccagccugcucaacuuc

SEQ ID NO: 28737 - RNA, 30 nt, Artificial Sequence
  Asparagine synthetase (glutamine-hydrolyzing) (272-281)
aagcagcugaaggaggcccaggugcaguac

SEQ ID NO: 28738 - RNA, 33 nt, Artificial Sequence
  Heterogeneous nuclear ribonucleoprotein L (455-465)
aagcagcccgccaucaugccgggccagagcuac

SEQ ID NO: 28739 - RNA, 30 nt, Artificial Sequence
  Caprin-1 (536-545)
aagcagcagaaccaguaccaggccagcuac

SEQ ID NO: 28740 - RNA, 27 nt, Artificial Sequence
  DNA-dependent protein kinase catalytic subunit (2970-2978)
aagcaguacgacgaggcccugaacaag

SEQ ID NO: 28741 - RNA, 30 nt, Artificial Sequence
  Alpha-actinin-4 (691-700)
aagcaguacgagcgcagcaucguggacuac

SEQ ID NO: 28742 - RNA, 27 nt, Artificial Sequence
  RAC-beta serine/threonine-protein kinase (30-38)
aagagcgacggcuccuucaucggguac

SEQ ID NO: 28743 - RNA, 27 nt, Artificial Sequence
  Replication factor C subunit 1 (870-878)
aagagcgaccuguucuuccacgacuac

SEQ ID NO: 28744 - RNA, 30 nt, Artificial Sequence
  Pre-mRNA-processing factor 40 homolog A (164-173)
aagagcgacuccggcaagcccuacuacuac

SEQ ID NO: 28745 - RNA, 27 nt, Artificial Sequence
  Helicase-like transcription factor (499-507)
aagagcgacgugcaccugaacuucuac

SEQ ID NO: 28746 - RNA, 27 nt, Artificial Sequence
  Pre-mRNA-splicing factor RBM22 (109-117)
aagagcgacgugaacaaggaguacuac

SEQ ID NO: 28747 - RNA, 27 nt, Artificial Sequence
  Kinesin-like protein KIF18A (241-249)
aagaccgccagcaucaaccagaacgug

SEQ ID NO: 28748 - RNA, 30 nt, Artificial Sequence
  Vacuolar protein sorting-associated protein 13A (1399-1408)
aagaccgacgaccugaccauggugcucuac

SEQ ID NO: 28749 - RNA, 27 nt, Artificial Sequence
  Chromodomain-helicase-DNA-binding protein 8 (165-173)
aagaccgacgagagccugaccaaguac

SEQ ID NO: 28750 - RNA, 27 nt, Artificial Sequence
  Raftlin (114-122)
aagaccgaccugcacaacgagggcuac

SEQ ID NO: 28751 - RNA, 27 nt, Artificial Sequence
  Coiled-coil domain-containing protein 94 (90-98)
aagaccgaccccgagaacaccgacuac

SEQ ID NO: 28752 - RNA, 33 nt, Artificial Sequence
  Signal-induced proliferation-associated 1-like protein 2 (436-446)
aagaccgacagcaccggcacgcacucccuguac

SEQ ID NO: 28753 - RNA, 33 nt, Artificial Sequence
  Pre-mRNA-processing-splicing factor 8 (341-351)
aagaccgaggaccccgaccugccggccuucuac

SEQ ID NO: 28754 - RNA, 33 nt, Artificial Sequence
  Serine/arginine-rich splicing factor 3 (23-33)
aagaccgagcuggagcgcgccuucggcuacuac

SEQ ID NO: 28755 - RNA, 30 nt, Artificial Sequence
  T-complex protein 1 subunit zeta-2 (196-205)
aagaccgaggugaacagcggcuucuucuac

SEQ ID NO: 28756 - RNA, 27 nt, Artificial Sequence
  Periphilin-1 (297-305)
aagaccaaggagaucgagcagguguac

SEQ ID NO: 28757 - RNA, 30 nt, Artificial Sequence
  Metastasis-associated protein MTA2 (311-320)
aagaccaccgaccgcuacauccagcagaag

SEQ ID NO: 28758 - RNA, 27 nt, Artificial Sequence
  Spatacsin (1273-1281)
aagguggccaacaucauccugagcuac

SEQ ID NO: 28759 - RNA, 27 nt, Artificial Sequence
  Heterogeneous nuclear ribonucleoprotein A/B (227-235)
aagguggcccagcccaaggaggucuac

SEQ ID NO: 28760 - RNA, 27 nt, Artificial Sequence
  Protein RRP5 homolog (1680-1688)
aagguguucgagcgcgccguccaguac

SEQ ID NO: 28761 - RNA, 27 nt, Artificial Sequence
  60 kDa heat shock protein, mitochondrial (344-352)
aaggugggcgaggucaucgugaccaag

SEQ ID NO: 28762 - RNA, 27 nt, Artificial Sequence
  Protein transport protein Sec61 subunit beta (67-75)
aaggugggccccgucccggugcuggug

SEQ ID NO: 28763 - RNA, 27 nt, Artificial Sequence
  40S ribosomal protein S19 (29-37)
aaggugcccgagugggucgacaccgug

SEQ ID NO: 28764 - RNA, 27 nt, Artificial Sequence
  Protein DEK (315-323)
aagguguacgagaacuaccccaccuac

SEQ ID NO: 28765 - RNA, 27 nt, Artificial Sequence
  Cyclin-dependent kinases regulatory subunit 2 (11-19)
aaguacuucgacgagcacuacgaguac

SEQ ID NO: 28766 - RNA, 27 nt, Artificial Sequence
  Protein disulfide-isomerase A3 (16-24)
cuggccgccgcgcgccucgccgccgcc

SEQ ID NO: 28767 - RNA, 27 nt, Artificial Sequence
  Heterogeneous nuclear ribonucleoprotein R (193-201)
cuggaguacgaggaccacaagagcgcc

SEQ ID NO: 28768 - RNA, 27 nt, Artificial Sequence
  Lamina-associated polypeptide 2, isoform alpha (313-321)
cugaucaaggagaccaccacgggcuac

SEQ ID NO: 28769 - RNA, 27 nt, Artificial Sequence
  60S ribosomal protein L28 (17-25)
cugaucaagcgcaacaagcagaccuac

SEQ ID NO: 28770 - RNA, 27 nt, Artificial Sequence
  ATP synthase F(0) complex subunit C1, mitochondrial (21-29)
cugauccgccccgugagcgccuccuuc

SEQ ID NO: 28771 - RNA, 27 nt, Artificial Sequence
  Cytospin-A (469-477)
cugcucgacgagcaccacaucagcuac

SEQ ID NO: 28772 - RNA, 30 nt, Artificial Sequence
  Zinc finger protein 557 (59-68)
cugcucgaccccgcccagcgcacccuguac

SEQ ID NO: 28773 - RNA, 30 nt, Artificial Sequence
  Clathrin heavy chain 1 (421-430)
cugcucgaccagggccagcugaacaaguac

SEQ ID NO: 28774 - RNA, 30 nt, Artificial Sequence
  Zinc finger protein 669 (106-115)
cugcucgacagcucccagaagaaccuguac

SEQ ID NO: 28775 - RNA, 30 nt, Artificial Sequence
  WD repeat-containing protein 6 (358-367)
cugcucgaggacaagcacuuccagagcuac

SEQ ID NO: 28776 - RNA, 27 nt, Artificial Sequence
  Signal transducer and activator of transcription 6 (56-64)
cugcucagcgacaccgugcagcaccug

SEQ ID NO: 28777 - RNA, 27 nt, Artificial Sequence
  Antigen peptide transporter 1 (684-692)
cugcucuacgagagccccgagcgcuac

SEQ ID NO: 28778 - RNA, 27 nt, Artificial Sequence
  Retinoic acid receptor RXR-gamma (423-431)
cugcccgcccuccgcagcaucggccug

SEQ ID NO: 28779 - RNA, 27 nt, Artificial Sequence
  Eukaryotic translation initiation factor 2-alpha kinase 1 (221-229)
cugcagcaccccaacaucgugggcuac

SEQ ID NO: 28780 - RNA, 27 nt, Artificial Sequence
  CDK5 regulatory subunit-associated protein 2 (355-363)
cugcagaaggcccagacccaggaguuc

SEQ ID NO: 28781 - RNA, 27 nt, Artificial Sequence
  Trifunctional purine biosynthetic protein adenosine-3 (429-437)
cugcagcagccccgcagccucaccuac

SEQ ID NO: 28782 - RNA, 27 nt, Artificial Sequence
  Farnesyl pyrophosphate synthase (341-349)
cugcagcgcgccacccccgagcaguac

SEQ ID NO: 28783 - RNA, 27 nt, Artificial Sequence
  R3H domain-containing protein 4 (70-78)
cugcagcgccucgagaacacccaguac

SEQ ID NO: 28784 - RNA, 27 nt, Artificial Sequence
  WD repeat-containing protein 27 (15-23)
cugagcgacaucgugaucgagaaguac

SEQ ID NO: 28785 - RNA, 27 nt, Artificial Sequence
  UAP56-interacting factor (99-107)
cugagcgacaagaacaucgagcaguac

SEQ ID NO: 28786 - RNA, 27 nt, Artificial Sequence
  Histone acetyltransferase KAT8 (325-333)
cugagcgaccucggcaagcuguccuac

SEQ ID NO: 28787 - RNA, 30 nt, Artificial Sequence
  Probable tRNA N6-adenosine threonylcarbamoyltransferase (315-324)
cugagcgacuccggcgugacccagcgcuac

SEQ ID NO: 28788 - RNA, 30 nt, Artificial Sequence
  Deoxynucleotidyltransferase terminal-interacting protein 2 (252-261)
cugagcgagaucaacaagcccaacuucuac

SEQ ID NO: 28789 - RNA, 33 nt, Artificial Sequence
  Serpin B8 (74-84)
cugagcgaggugaaccgcaccggcacccaguac

SEQ ID NO: 28790 - RNA, 27 nt, Artificial Sequence
  ATP synthase subunit alpha, mitochondrial (160-168)
cugaccgacgccgacgccaugaaguac

SEQ ID NO: 28791 - RNA, 27 nt, Artificial Sequence
  1,4-alpha-glucan-branching enzyme (569-577)
cugaccgacgacgaccuccugcgcuac

SEQ ID NO: 28792 - RNA, 30 nt, Artificial Sequence
  26S proteasome non-ATPase regulatory subunit 2 (391-400)
cugaccgacgacggcaacaaguggcucuac

SEQ ID NO: 28793 - RNA, 27 nt, Artificial Sequence
  Phosphatidylinositol 4,5-bisphosphate 3-kinase catalytic subunit alpha isoform (623-631)
cugaccgacgacaagcucagccaguac

SEQ ID NO: 28794 - RNA, 27 nt, Artificial Sequence
  Probable threonine-tRNA ligase 2, cytoplasmic (435-443)
cugaccgacuucauccgcgaggaguac

SEQ ID NO: 28795 - RNA, 30 nt, Artificial Sequence
  Coiled-coil domain-containing protein 127 (209-218)
cugaccgacaucuuccagcacgacaccuac

SEQ ID NO: 28796 - RNA, 30 nt, Artificial Sequence
  Elongation factor 2 (162-171)
cugaccgacaucaccaagggcgugcaguac

SEQ ID NO: 28797 - RNA, 30 nt, Artificial Sequence
  Tuberin (146-155)
cugaccgacaacggccgccacaucaccuac

SEQ ID NO: 28798 - RNA, 27 nt, Artificial Sequence
  Glucosylceramidase (252-260)
cugaccgaccccgaggccgccaaguac

SEQ ID NO: 28799 - RNA, 30 nt, Artificial Sequence
  ATPase family AAA domain-containing protein 5 (1663-1672)
cugaccgacgugcgcgagcagaacaaguac

SEQ ID NO: 28800 - RNA, 27 nt, Artificial Sequence
  Casein kinase II subunit alpha (128-136)
cugaccgacuacgacauccgcuucuac

SEQ ID NO: 28801 - RNA, 30 nt, Artificial Sequence
  Gamma-tubulin complex component 2 (88-97)
cugaccgaggacaaggagacccuccaguac

SEQ ID NO: 28802 - RNA, 27 nt, Artificial Sequence
  Integrator complex subunit 11 (242-250)
cugaccgagaaggccaaccacuacuac

SEQ ID NO: 28803 - RNA, 27 nt, Artificial Sequence
  Pogo transposable element with KRAB domain (64-72)
cugaccgagcagcagaaggcccucuac

SEQ ID NO: 28804 - RNA, 30 nt, Artificial Sequence
  Nuclear factor erythroid 2-related factor 2 (197-206)
cugaccgagguggacaacuaccacuucuac

SEQ ID NO: 28805 - RNA, 33 nt, Artificial Sequence
  Serpin B9 (74-84)
cugaccgaggugaacaaggccggcacccaguac

SEQ ID NO: 28806 - RNA, 27 nt, Artificial Sequence
  Folliculin-interacting protein 2 (997-1005)
cugguggccgaccucguccacaccgug

SEQ ID NO: 28807 - RNA, 27 nt, Artificial Sequence
  Pogo transposable element with KRAB domain (261-269)
cugguggaccagcgcgucgccgaguac

SEQ ID NO: 28808 - RNA, 30 nt, Artificial Sequence
  Exportin-5 (20-29)
augauggaccccaacagcacccagcgcuac

SEQ ID NO: 28809 - RNA, 30 nt, Artificial Sequence
  Protein transport protein Sec61 subunit gamma (5-14)
augcaguucguggagcccagccgccaguuc

SEQ ID NO: 28810 - RNA, 27 nt, Artificial Sequence
  Catenin beta-1 (662-670)
augagcgaggacaagccccaggacuac

SEQ ID NO: 28811 - RNA, 27 nt, Artificial Sequence
  Brefeldin A-inhibited guanine nucleotide-exchange protein 1 (574-582)
aacgccgccaacaucuucgagcgccug

SEQ ID NO: 28812 - RNA, 33 nt, Artificial Sequence
  Charged multivesicular body protein 5 (63-73)
aacgagauccaggaggcccugagccgcuccuac

SEQ ID NO: 28813 - RNA, 27 nt, Artificial Sequence
  Clathrin heavy chain 1 (935-943)
aacgagaacagccuguucaagucccuc

SEQ ID NO: 28814 - RNA, 27 nt, Artificial Sequence
  Calpain small subunit 1 (93-101)
aacgagagcgaggaggugcgccaguuc

SEQ ID NO: 28815 - RNA, 27 nt, Artificial Sequence
  PR domain zinc finger protein 15 (791-799)
aacgagguggacggcgaguaccgcuac

SEQ ID NO: 28816 - RNA, 33 nt, Artificial Sequence
  Nucleolar pre-ribosomal-associated protein 1 (127-137)
aacgagguggaccccggcgacuggcagaaguuc

SEQ ID NO: 28817 - RNA, 27 nt, Artificial Sequence
  DnaJ homolog subfamily C member 11 (261-269)
aaccuggacaagaacaccgugggcuac

SEQ ID NO: 28818 - RNA, 27 nt, Artificial Sequence
  Ubiquitin-conjugating enzyme E2 variant 3 (190-198)
aaccuggacagccagcgccuccaguac

SEQ ID NO: 28819 - RNA, 27 nt, Artificial Sequence
  Clathrin heavy chain 1 (74-82)
aaccccgccagcaaggugaucgcccug

SEQ ID NO: 28820 - RNA, 27 nt, Artificial Sequence
  Spermatid perinuclear RNA-binding protein (397-405)
aaccagauccgccccggccugcaguac

SEQ ID NO: 28821 - RNA, 27 nt, Artificial Sequence
  Dystonin (3331-3339)
aaccagaagcccccgagcgccgaguuc

SEQ ID NO: 28822 - RNA, 27 nt, Artificial Sequence
  Microtubule-actin cross-linking factor 1, isoforms 1/2/3/5 (5369-5377)
aaccagaagcccccgagcgccgaguac

SEQ ID NO: 28823 - RNA, 27 nt, Artificial Sequence
  Cytosolic carboxypeptidase 1 (749-757)
aacagcgacaucaacuccaaccacuac

SEQ ID NO: 28824 - RNA, 30 nt, Artificial Sequence
  DNA repair protein RAD51 homolog 1 (99-108)
aacaccgaccaccagacccagcugcucuac

SEQ ID NO: 28825 - RNA, 27 nt, Artificial Sequence
  Eukaryotic translation initiation factor 3 subunit C-like protein (462-470)
aacaccgacccccacagccaggaguac

SEQ ID NO: 28826 - RNA, 30 nt, Artificial Sequence
  Methionine aminopeptidase 1 (74-83)
aacaccgaccccugggccggcuaccgcuac

SEQ ID NO: 28827 - RNA, 27 nt, Artificial Sequence
  Tyrosine-protein phosphatase non-receptor type 11 (414-422)
aacaccgagcgcaccguguggcaguac

SEQ ID NO: 28828 - RNA, 27 nt, Artificial Sequence
  Protein UXT (66-74)
aacgugaucgagcgccugcaggaggcc

SEQ ID NO: 28829 - RNA, 27 nt, Artificial Sequence
  Nardilysin (107-115)
cccagcgacccgaagcaguaccgcuac

SEQ ID NO: 28830 - RNA, 33 nt, Artificial Sequence
  Mediator of RNA polymerase II transcription subunit 13 (1456-1466)
cccaccgacggcgacagccacgccgugaccuac

SEQ ID NO: 28831 - RNA, 27 nt, Artificial Sequence
  Absent in melanoma 1 protein (1215-1223)
cccaccgacccgaagguggucguguac

SEQ ID NO: 28832 - RNA, 33 nt, Artificial Sequence
  Ubiquitin carboxyl-terminal hydrolase 22 (453-463)
cccaccgacagccugaacaacgacaacaaguac

SEQ ID NO: 28833 - RNA, 33 nt, Artificial Sequence
  ADP-sugar pyrophosphatase (6-16)
cccaccgagagcucccagaacggcaagcaguac

SEQ ID NO: 28834 - RNA, 27 nt, Artificial Sequence
  Vimentin (311-319)
caggccaagcaggagagcaccgaguac

SEQ ID NO: 28835 - RNA, 33 nt, Artificial Sequence
  Nuclear autoantigenic sperm protein (67-77)
caggaggccgccagccugcucggcaagaaguac

SEQ ID NO: 28836 - RNA, 27 nt, Artificial Sequence
  Ras GTPase-activating protein-binding protein 1 (243-251)
caggaggaccugcgcaccuucagcugg

SEQ ID NO: 28837 - RNA, 30 nt, Artificial Sequence
  Nuclear pore complex protein Nup155 (718-727)
caggaguuccuggaccgcaacagccaguuc

SEQ ID NO: 28838 - RNA, 27 nt, Artificial Sequence
  Cytosolic non-specific dipeptidase (28-36)
caggagauccccgugaacguccgcuuc

SEQ ID NO: 28839 - RNA, 27 nt, Artificial Sequence
  Putative ATP-dependent RNA helicase DDX11-like protein 8 (240-248)
cagcuggcccaguucgugcacgagguc

SEQ ID NO: 28840 - RNA, 30 nt, Artificial Sequence
  Zinc finger protein 550 (19-28)
cagcuggaccucgcccagcgcacccuguac

SEQ ID NO: 28841 - RNA, 30 nt, Artificial Sequence
  Zinc finger protein 674 (24-33)
cagcuggacagcgcccagaagaaccucuac

SEQ ID NO: 28842 - RNA, 27 nt, Artificial Sequence
  Proteasome activator complex subunit 3 (33-41)
cagcugguggacaucaucgagaagguc

SEQ ID NO: 28843 - RNA, 27 nt, Artificial Sequence
  Nucleoporin NUP188 homolog (1544-1552)
cagcaggcccugcacaccgugcaguac

SEQ ID NO: 28844 - RNA, 27 nt, Artificial Sequence
  Homocysteine-responsive endoplasmic reticulum-resident ubiquitin-like domain member 1 protein (174-182)
cagcagaucuacgcccgccaguacuac

SEQ ID NO: 28845 - RNA, 27 nt, Artificial Sequence
  Signal recognition particle subunit SRP72 (107-115)
cagaccgacaagcugaaggagcucuac

SEQ ID NO: 28846 - RNA, 27 nt, Artificial Sequence
  Oxysterol-binding protein-related protein 8 (674-682)
cagaccgaggccacccaggagaaguac

SEQ ID NO: 28847 - RNA, 27 nt, Artificial Sequence
  Probable cation-transporting ATPase 13A3 (131-139)
cagaccgagagccagcagauccgcuac

SEQ ID NO: 28848 - RNA, 27 nt, Artificial Sequence
  Band 4.1-like protein 2 (42-50)
cagaccgagaccaagacgaucaccuac

SEQ ID NO: 28849 - RNA, 27 nt, Artificial Sequence
  26S proteasome non-ATPase regulatory subunit 13 (164-172)
cagaccaucggcaaccacgccagcuac

SEQ ID NO: 28850 - RNA, 33 nt, Artificial Sequence
  60S ribosomal protein L28 (23-33)
cagaccuacagcaccgagcccaacaaccugaag

SEQ ID NO: 28851 - RNA, 33 nt, Artificial Sequence
  Cytochrome b-c1 complex subunit 9 (34-44)
cgcgccuucgaccagggcgccgacgcgaucuac

SEQ ID NO: 28852 - RNA, 27 nt, Artificial Sequence
  Mitotic checkpoint protein BUB3 (186-194)
cgcgccuuccccaacaagcagggcuac

SEQ ID NO: 28853 - RNA, 30 nt, Artificial Sequence
  X-ray repair cross-complementing protein 5 (296-305)
cgcgccaacccccaggugggcgucgccuuc

SEQ ID NO: 28854 - RNA, 33 nt, Artificial Sequence
  Exocyst complex component 4 (551-561)
cgcgaggccgaccuggacuucgcccggcaguac

SEQ ID NO: 28855 - RNA, 30 nt, Artificial Sequence
  Signal peptidase complex subunit 2 (185-194)
cgcgaggccgaguucaccaagagcaucgcc

SEQ ID NO: 28856 - RNA, 27 nt, Artificial Sequence
  Patatin-like phospholipase domain-containing protein 2 (30-38)
cgcgagcacgcccccuuccugguggcc

SEQ ID NO: 28857 - RNA, 24 nt, Artificial Sequence
  Tubulin beta-4A chain (2-9)
cgcgagaucgugcaccugcaggcc

SEQ ID NO: 28858 - RNA, 27 nt, Artificial Sequence
  ATP-binding cassette sub-family F member 3 (425-433)
cgcgaguacgaggcccagcagcaguac

SEQ ID NO: 28859 - RNA, 27 nt, Artificial Sequence
  Pre-mRNA-splicing factor ATP-dependent RNA helicase DHX15 (399-407)
cgcaucuucgagcccccgccccccaag

SEQ ID NO: 28860 - RNA, 30 nt, Artificial Sequence
  Actin-related protein 2/3 complex subunit 2 (9-18)
cgcaucaucgaggagacccuggcccucaag

SEQ ID NO: 28861 - RNA, 27 nt, Artificial Sequence
  Protein FAM60A (102-110)
cgcaucaagagcaaccagaucuccaag

SEQ ID NO: 28862 - RNA, 30 nt, Artificial Sequence
  Chromobox protein homolog 6 (91-100)
cgcaucagcgacgugcacuucuccgucaag

SEQ ID NO: 28863 - RNA, 30 nt, Artificial Sequence
  Splicing factor 3B subunit 1 (276-285)
cgcaucuacaacgacgacaagaacaccuac

SEQ ID NO: 28864 - RNA, 27 nt, Artificial Sequence
  FAS-associated factor 2 (75-83)
cgcaucuacagcuacguggucucccgg

SEQ ID NO: 28865 - RNA, 27 nt, Artificial Sequence
  26S proteasome non-ATPase regulatory subunit 3 (107-115)
cgccugaaccacuacgugcucuacaag

SEQ ID NO: 28866 - RNA, 33 nt, Artificial Sequence
  Cell division cycle protein 27 homolog (214-224)
cgccugaaccucgagagcuccaacagcaaguac

SEQ ID NO: 28867 - RNA, 30 nt, Artificial Sequence
  Histone deacetylase 9 (670-679)
cgccugcaggagaccggccuccugaacaag

SEQ ID NO: 28868 - RNA, 33 nt, Artificial Sequence
  F-box only protein 5 (140-150)
cgccuguacgaggacagcggcuacuccagcuuc

SEQ ID NO: 28869 - RNA, 30 nt, Artificial Sequence
  ATP-binding cassette sub-family D member 1 (172-181)
cgccuguacuucagccagcagaccuacuac

SEQ ID NO: 28870 - RNA, 30 nt, Artificial Sequence
  V-type proton ATPase subunit d 1 (169-178)
cgccuguaccccgagggccucgcccagcug

SEQ ID NO: 28871 - RNA, 27 nt, Artificial Sequence
  Vimentin (13-21)
cgcauguucggcgggcccggcaccgcc

SEQ ID NO: 28872 - RNA, 33 nt, Artificial Sequence
  Enhancer of rudimentary homolog (42-52)
cgcaugaaccccaacagcccguccaucaccuac

SEQ ID NO: 28873 - RNA, 30 nt, Artificial Sequence
  ATP synthase subunit epsilon-like protein, mitochondrial (6-15)
cgccaggccggccugagcuacauccgguac

SEQ ID NO: 28874 - RNA, 27 nt, Artificial Sequence
  Polyadenylate-binding protein 1 (374-382)
cgccaggcccaccugaccaaccaguac

SEQ ID NO: 28875 - RNA, 30 nt, Artificial Sequence
  Vimentin (310-319)
cgccaggccaagcaggagagcaccgaguac

SEQ ID NO: 28876 - RNA, 27 nt, Artificial Sequence
  Caprin-1 (297-305)
cgccaguucauggccgagacccaguuc

SEQ ID NO: 28877 - RNA, 30 nt, Artificial Sequence
  Splicing factor 3B subunit 1 (517-526)
cgccagaucaccgacaaggcccgggaguuc

SEQ ID NO: 28878 - RNA, 27 nt, Artificial Sequence
  Protein OS-9 (639-647)
cgccagaaggagcuggagagcaacuac

SEQ ID NO: 28879 - RNA, 30 nt, Artificial Sequence
  Interferon-induced, double-stranded RNA-activated protein kinase (18-27)
cgccagaagcagggcgugguccugaaguac

SEQ ID NO: 28880 - RNA, 30 nt, Artificial Sequence
  Alpha-taxilin (77-86)
cgccagcuggaggacauccucagcaccuac

SEQ ID NO: 28881 - RNA, 33 nt, Artificial Sequence
  Prelamin-A/C (390-400)
cgccagaacggcgacgacccccugcucaccuac

SEQ ID NO: 28882 - RNA, 33 nt, Artificial Sequence
  Spectrin beta chain, non-erythrocytic 1 (1161-1171)
cgccagaaccugcucagccagucccacgccuac

SEQ ID NO: 28883 - RNA, 30 nt, Artificial Sequence
  Tetratricopeptide repeat protein 9C (19-28)
cgccagcccgacaacgccaaggcccuguac

SEQ ID NO: 28884 - RNA, 27 nt, Artificial Sequence
  Eukaryotic translation initiation factor 3 subunit C (905-913)
cgccagcagcagagccagaccgccuac

SEQ ID NO: 28885 - RNA, 33 nt, Artificial Sequence
  ATP-dependent RNA helicase DDX3X (603-613)
cgccagagcuccggcgccagcuccagcuccuuc

SEQ ID NO: 28886 - RNA, 27 nt, Artificial Sequence
  40S ribosomal protein S29 (44-52)
cgccaguacgccaaggacaucggcuuc

SEQ ID NO: 28887 - RNA, 33 nt, Artificial Sequence
  Transmembrane emp24 domain-containing protein 4 (33-43)
cgccaguacggcagcgaggggcgguucaccuuc

SEQ ID NO: 28888 - RNA, 27 nt, Artificial Sequence
  Non-receptor tyrosine-protein kinase TYK2 (521-529)
cgcagcuuccccuccgugcgggagcug

SEQ ID NO: 28889 - RNA, 27 nt, Artificial Sequence
  E3 ubiquitin-protein ligase AMFR (229-237)
cgcaccgcccacgugauccugcgguac

SEQ ID NO: 28890 - RNA, 27 nt, Artificial Sequence
  Proteasome subunit alpha type-2 (113-121)
cgcguggccagcgucaugcaggaguac

SEQ ID NO: 28891 - RNA, 30 nt, Artificial Sequence
  Calmodulin (91-100)
cgcguguucgacaaggacggcaacggguac

SEQ ID NO: 28892 - RNA, 30 nt, Artificial Sequence
  Nucleolysin TIA-1 isoform p40 (244-253)
cgcguguuccccgacaagggcuacagcuuc

SEQ ID NO: 28893 - RNA, 30 nt, Artificial Sequence
  Nucleolysin TIAR (213-222)
cgcguguuccccgagaagggcuacagcuuc

SEQ ID NO: 28894 - RNA, 30 nt, Artificial Sequence
  Kinesin-like protein KIF20A (466-475)
cgcguguuccagggcuucuucaccgggcgg

SEQ ID NO: 28895 - RNA, 33 nt, Artificial Sequence
  Fatty acid synthase (1694-1704)
cgcguguucaccaccgucggcagcgccgagaag

SEQ ID NO: 28896 - RNA, 33 nt, Artificial Sequence
  Non-specific lipid-transfer protein (13-23)
cgcguguucgucgugggcguggggaugaccaag

SEQ ID NO: 28897 - RNA, 33 nt, Artificial Sequence
  26S protease regulatory subunit 7 (239-249)
cgcgugaucggcagcgagcugguccagaaguac

SEQ ID NO: 28898 - RNA, 30 nt, Artificial Sequence
  Ectonucleoside triphosphate diphosphohydrolase 1 (97-106)
cgcgugaagggccccgggaucagcaaguuc

SEQ ID NO: 28899 - RNA, 27 nt, Artificial Sequence
  FACT complex subunit SSRP1 (316-324)
cgcgugaugaaggcccuggucaaccgg

SEQ ID NO: 28900 - RNA, 27 nt, Artificial Sequence
  DNA replication licensing factor MCM4 (387-395)
cgcgugaacgucaccggcaucuaccgg

SEQ ID NO: 28901 - RNA, 27 nt, Artificial Sequence
  Double-stranded RNA-binding protein Staufen homolog 1 (457-465)
cgcgugcagggcuuccaggucgaguac

SEQ ID NO: 28902 - RNA, 27 nt, Artificial Sequence
  Serine/threonine-protein phosphatase 6 regulatory subunit 3 (45-53)
cgcgugagcgacaucaacuucacccug

SEQ ID NO: 28903 - RNA, 30 nt, Artificial Sequence
  SUMO-specific isopeptidase USPL1 (717-726)
cgcgugaccagccaggucuccaaccugaag

SEQ ID NO: 28904 - RNA, 27 nt, Artificial Sequence
  5'-nucleotidase domain-containing protein 1 (141-149)
cgcguggucgacuaccugaccaagcuc

SEQ ID NO: 28905 - RNA, 27 nt, Artificial Sequence
  Serine/arginine-rich splicing factor 6 (3-11)
cgcguguacaucggccggcugagcuac

SEQ ID NO: 28906 - RNA, 27 nt, Artificial Sequence
  Serine/threonine-protein kinase SMG1 (36-44)
agcgccgaccccgacaaccugaaguac

SEQ ID NO: 28907 - RNA, 27 nt, Artificial Sequence
  Serine/threonine-protein kinase 17A (293-301)
agcgccguggacuucauccgcacccug

SEQ ID NO: 28908 - RNA, 30 nt, Artificial Sequence
  A-kinase anchor protein 2 (685-694)
agcgaggccgccgagcugcgcuccaccgcg

SEQ ID NO: 28909 - RNA, 27 nt, Artificial Sequence
  Zinc finger protein Rlf (1399-1407)
agcgaggccggcuccgccgcgcgcuuc

SEQ ID NO: 28910 - RNA, 27 nt, Artificial Sequence
  Histone-lysine N-methyltransferase SETD2 (461-469)
agcgaggaggaguacaagaagaccuac

SEQ ID NO: 28911 - RNA, 27 nt, Artificial Sequence
  U5 small nuclear ribonucleoprotein 200 kDa helicase (1010-1018)
agcgagaucgagcuguuccgcguguuc

SEQ ID NO: 28912 - RNA, 30 nt, Artificial Sequence
  Nesprin-2 (320-329)
agcgagaacgacaccuacuucaagaaguac

SEQ ID NO: 28913 - RNA, 30 nt, Artificial Sequence
  Uncharacterized protein C14orf119 (121-130)
agcgagcccgacuucguggccaaguucuac

SEQ ID NO: 28914 - RNA, 33 nt, Artificial Sequence
  Fructose-bisphosphate aldolase A (408-418)
agcgagucccuguucgugagcaaccacgccuac

SEQ ID NO: 28915 - RNA, 27 nt, Artificial Sequence
  Cyclin-G-associated kinase (305-313)
agcaucgccgaggugguccaccagcug

SEQ ID NO: 28916 - RNA, 27 nt, Artificial Sequence
  26S proteasome non-ATPase regulatory subunit 3 (418-426)
agccuggccgacaucgcccagaagcuc

SEQ ID NO: 28917 - RNA, 30 nt, Artificial Sequence
  Peroxisomal membrane protein 2 (66-75)
agccuggacgugggcgggccccuccgcuac

SEQ ID NO: 28918 - RNA, 27 nt, Artificial Sequence
  Nucleoporin GLE1 (288-296)
agccugaucuccggcaucauccgcgcc

SEQ ID NO: 28919 - RNA, 27 nt, Artificial Sequence
  Nucleolar protein 7 (197-205)
agccuguacggccccgggaccaaccgc

SEQ ID NO: 28920 - RNA, 27 nt, Artificial Sequence
  Nuclear pore complex protein Nup93 (787-795)
agccaggcccgcacccugaucaccuuc

SEQ ID NO: 28921 - RNA, 27 nt, Artificial Sequence
  60S ribosomal export protein NMD3 (228-236)
agccaggacauccacuccaacaccuac

SEQ ID NO: 28922 - RNA, 27 nt, Artificial Sequence
  14 kDa phosphohistidine phosphatase (83-91)
agccaggacaagaagauccacguguac

SEQ ID NO: 28923 - RNA, 27 nt, Artificial Sequence
  MKI67 FHA domain-interacting nucleolar phosphoprotein (66-74)
agccaguucggcaccgugacccgcuuc

SEQ ID NO: 28924 - RNA, 30 nt, Artificial Sequence
  Kinesin-associated protein 3 (208-217)
agccaguuccacggccugaucacccacuac

SEQ ID NO: 28925 - RNA, 27 nt, Artificial Sequence
  Heterogeneous nuclear ribonucleoprotein U (697-705)
agccagcacuaccaccagggcuacuac

SEQ ID NO: 28926 - RNA, 33 nt, Artificial Sequence
  U4/U6 small nuclear ribonucleoprotein Prp4 (224-234)
agccagaucggcgacgaccgccccaucuccuac

SEQ ID NO: 28927 - RNA, 27 nt, Artificial Sequence
  DCN1-like protein 1 (7-15)
agccagaaggacaaggugcgccaguuc

SEQ ID NO: 28928 - RNA, 27 nt, Artificial Sequence
  General transcription factor 3C polypeptide 1 (1442-1450)
agccagaugaaguccuaccagagcuuc

SEQ ID NO: 28929 - RNA, 27 nt, Artificial Sequence
  Transmembrane emp24 domain-containing protein 3 (196-204)
agccaggugcugcuccugaaguccuuc

SEQ ID NO: 28930 - RNA, 27 nt, Artificial Sequence
  E3 ubiquitin-protein ligase MARCH7 (122-130)
agccaggugccccgcuccagcuccaug

SEQ ID NO: 28931 - RNA, 27 nt, Artificial Sequence
  Midasin (130-138)
agcuccgacgccaaccccgugcgcuac

SEQ ID NO: 28932 - RNA, 27 nt, Artificial Sequence
  Arf-GAP with coiled-coil, ANK repeat and PH domain-containing protein 2 (251-259)
agcuccgacgacagcaagcuggaguac

SEQ ID NO: 28933 - RNA, 30 nt, Artificial Sequence
  Zinc finger protein 330 (258-267)
agcuccgacaaguacggcgacaccagcuac

SEQ ID NO: 28934 - RNA, 30 nt, Artificial Sequence
  Protein FAM208B (1580-1589)
agcuccgacaacgccacccugacccacuac

SEQ ID NO: 28935 - RNA, 27 nt, Artificial Sequence
  Heat shock 70 kDa protein 14 (75-83)
agcuccgacccccaggcccagaaguac

SEQ ID NO: 28936 - RNA, 27 nt, Artificial Sequence
  Spectrin beta chain, non-erythrocytic 1 (769-777)
agcuccgacgugggccacgacgaguac

SEQ ID NO: 28937 - RNA, 27 nt, Artificial Sequence
  Signal transducer and activator of transcription 3 (613-621)
agcuccaaggagggcggggugaccuuc

SEQ ID NO: 28938 - RNA, 30 nt, Artificial Sequence
  COP9 signalosome complex subunit 6 (241-250)
agcaccgacaaguucaagaccgacuucuac

SEQ ID NO: 28939 - RNA, 27 nt, Artificial Sequence
  Axin-1 (71-79)
agcaccgacccccgcccggccuccuac

SEQ ID NO: 28940 - RNA, 33 nt, Artificial Sequence
  Proteasome subunit beta type-8 (261-271)
agcaccgacguguccgaccugcuccaccaguac

SEQ ID NO: 28941 - RNA, 27 nt, Artificial Sequence
  Dedicator of cytokinesis protein 11 (109-117)
agcaccgacuggcacguggucaacuac

SEQ ID NO: 28942 - RNA, 27 nt, Artificial Sequence
  Mitochondrial Rho GTPase 2 (298-306)
agcaccgagcugaaccaccucggcuac

SEQ ID NO: 28943 - RNA, 27 nt, Artificial Sequence
  Cirhin (419-427)
agcaccgugucccgcuucuuccuguac

SEQ ID NO: 28944 - RNA, 27 nt, Artificial Sequence
  Cysteine-rich PDZ-binding protein (64-72)
agcgugcaccagcccggcucccacuac

SEQ ID NO: 28945 - RNA, 33 nt, Artificial Sequence
  Exosome complex exonuclease RRP44 (580-590)
agcgugaucaacuccaaggccagccugaccuac

SEQ ID NO: 28946 - RNA, 27 nt, Artificial Sequence
  Collagen type IV alpha-3-binding protein (484-492)
agcgugauccgcaagauccccgcccug

SEQ ID NO: 28947 - RNA, 27 nt, Artificial Sequence
  Vigilin (74-82)
agcgugaucacccaggucuuccacgug

SEQ ID NO: 28948 - RNA, 27 nt, Artificial Sequence
  WD repeat-containing protein 1 (458-466)
agcgugaaggaguggaccaucaccuac

SEQ ID NO: 28949 - RNA, 27 nt, Artificial Sequence
  Cytoplasmic FMR1-interacting protein 1 (214-222)
agcgugaagaacgaccacuccgccuac

SEQ ID NO: 28950 - RNA, 27 nt, Artificial Sequence
  Ribosomal biogenesis protein LAS1L (538-546)
agcgugaagcccgccuccagcuccuuc

SEQ ID NO: 28951 - RNA, 30 nt, Artificial Sequence
  Eukaryotic translation initiation factor 3 subunit I (39-48)
agcgugaacggcgagcgccuggggaccuac

SEQ ID NO: 28952 - RNA, 33 nt, Artificial Sequence
  Bone morphogenetic protein receptor type-2 (815-825)
agcgugaacucccacgccgccaccacccaguac

SEQ ID NO: 28953 - RNA, 27 nt, Artificial Sequence
  Epidermal growth factor receptor substrate 15 (746-754)
agcguguccaacgucgugaucaccaag

SEQ ID NO: 28954 - RNA, 33 nt, Artificial Sequence
  E3 ubiquitin-protein ligase Topors (191-201)
agcguguacucccccagcggcccggucaaccgc

SEQ ID NO: 28955 - RNA, 33 nt, Artificial Sequence
  Tubulin beta chain (48-58)
agcguguacuacaacgaggccaccggcgggaag

SEQ ID NO: 28956 - RNA, 27 nt, Artificial Sequence
  Cohesin subunit SA-2 (881-889)
accgccgccgacaucuucaagcaguac

SEQ ID NO: 28957 - RNA, 27 nt, Artificial Sequence
  Phosphatidylinositol 3,4,5-trisphosphate-dependent Rac exchanger 1 protein (345-353)
accgccgacuaccacagcaacggcuac

SEQ ID NO: 28958 - RNA, 27 nt, Artificial Sequence
  Phospholipid-transporting ATPase IG (35-43)
accgaggccuacaucgcccagcgcuuc

SEQ ID NO: 28959 - RNA, 30 nt, Artificial Sequence
  RNMT-activating mini protein (20-29)
accgagaacgacaaggaguaccaggaguac

SEQ ID NO: 28960 - RNA, 27 nt, Artificial Sequence
  Vacuolar protein sorting-associated protein 26A (225-233)
accgagaccgagacgaucgccaaguac

SEQ ID NO: 28961 - RNA, 27 nt, Artificial Sequence
  Ribosomal RNA processing protein 1 homolog B (77-85)
accaucgcccagcuggugcacgccguc

SEQ ID NO: 28962 - RNA, 27 nt, Artificial Sequence
  Heterogeneous nuclear ribonucleoproteins A2/B1 (164-172)
accaucaacggccacaacgccgaggug

SEQ ID NO: 28963 - RNA, 27 nt, Artificial Sequence
  Transformation/transcription domain-associated protein (378-386)
acccuggccgaccucgugcaccacguc

SEQ ID NO: 28964 - RNA, 30 nt, Artificial Sequence
  Syntaxin-binding protein 3 (187-196)
acccuggacgagaaccccggcgugcgcuac

SEQ ID NO: 28965 - RNA, 27 nt, Artificial Sequence
  Centrosomal protein CEP57L1 (127-135)
acccugcucgagaagcagcuggaguac

SEQ ID NO: 28966 - RNA, 33 nt, Artificial Sequence
  Pleckstrin homology domain-containing family B member 2 (103-113)
acccugcaggacagccgcaccaacacggccuac

SEQ ID NO: 28967 - RNA, 27 nt, Artificial Sequence
  Zinc finger protein 706 (46-54)
acccagaugcccgacccgaagaccuuc

SEQ ID NO: 28968 - RNA, 27 nt, Artificial Sequence
  SWI/SNF-related matrix-associated actin-dependent regulator of chromatin subfamily D member 2 (452-460)
acccagcgcgacuucaugcugagcuuc

SEQ ID NO: 28969 - RNA, 27 nt, Artificial Sequence
  V-type proton ATPase subunit E 2 (48-56)
acccagcgccugaagaucauggaguac

SEQ ID NO: 28970 - RNA, 27 nt, Artificial Sequence
  DNA replication licensing factor MCM7 (654-662)
acccagcgccccgccgacgugaucuuc

SEQ ID NO: 28971 - RNA, 30 nt, Artificial Sequence
  40S ribosomal protein S13 (18-27)
accagcgacgacgugaaggagcagaucuac

SEQ ID NO: 28972 - RNA, 27 nt, Artificial Sequence
  Cation-independent mannose-6-phosphate receptor (877-885)
accagcgacggccgccagaccacguac

SEQ ID NO: 28973 - RNA, 33 nt, Artificial Sequence
  Bifunctional glutamate/proline-tRNA ligase (269-279)
accagcgaccacuucgagaccaucaugaaguac

SEQ ID NO: 28974 - RNA, 30 nt, Artificial Sequence
  Nucleoporin Nup37 (108-117)
accagcgaccugcaggacaagaacgaguac

SEQ ID NO: 28975 - RNA, 33 nt, Artificial Sequence
  RNA polymerase II elongation factor ELL (458-468)
accagcgagacccccgacuaccugcucaaguac

SEQ ID NO: 28976 - RNA, 33 nt, Artificial Sequence
  Heterogeneous nuclear ribonucleoprotein F (256-266)
accaccgaccuguucggccgcgaccucagcuac

SEQ ID NO: 28977 - RNA, 27 nt, Artificial Sequence
  Tetratricopeptide repeat protein 13 (710-718)
accaccgaggagcgcacgcagcuguac

SEQ ID NO: 28978 - RNA, 30 nt, Artificial Sequence
  Heterogeneous nuclear ribonucleoproteins A2/B1 (20-29)
accaccgaggagagccugcgcaacuacuac

SEQ ID NO: 28979 - RNA, 27 nt, Artificial Sequence
  Tapasin (372-380)
accaccgagcagcacggcgcccgcuac

SEQ ID NO: 28980 - RNA, 30 nt, Artificial Sequence
  Condensin-2 complex subunit D3 (675-684)
accaccgagagccaggagcugucccgcuac

SEQ ID NO: 28981 - RNA, 27 nt, Artificial Sequence
  Endoplasmic reticulum-Golgi intermediate compartment protein 3 (40-48)
accaccgaggugcaccccgagcuguac

SEQ ID NO: 28982 - RNA, 27 nt, Artificial Sequence
  Coatomer subunit gamma-1 (759-767)
accguggccgaccacauccagaagguc

SEQ ID NO: 28983 - RNA, 27 nt, Artificial Sequence
  Threonine-tRNA ligase, cytoplasmic (150-158)
accgugaucgccaaggucaacaacgug

SEQ ID NO: 28984 - RNA, 27 nt, Artificial Sequence
  Transmembrane emp24 domain-containing protein 3 (153-161)
accgugaucgacagccagacccacuac

SEQ ID NO: 28985 - RNA, 30 nt, Artificial Sequence
  Importin subunit alpha-5 (433-442)
accgugauggacagcaagaucguccaggug

SEQ ID NO: 28986 - RNA, 27 nt, Artificial Sequence
  Sodium/potassium-transporting ATPase subunit alpha-3 (268-276)
accgugaugggccgcaucgccacccug

SEQ ID NO: 28987 - RNA, 27 nt, Artificial Sequence
  Band 4.1-like protein 2 (777-785)
guggaggaggagccccgcccggccgcc

SEQ ID NO: 28988 - RNA, 27 nt, Artificial Sequence
  26S protease regulatory subunit 4 (176-184)
guggagaaggccccccaggagaccuac

SEQ ID NO: 28989 - RNA, 27 nt, Artificial Sequence
  Choline/ethanolaminephosphotransferase 1 (268-276)
gugaucuucaccggcggggucggcaag

SEQ ID NO: 28990 - RNA, 27 nt, Artificial Sequence
  28S ribosomal protein S17, mitochondrial (34-42)
gugcuggaccccuaccuccugaaguac

SEQ ID NO: 28991 - RNA, 30 nt, Artificial Sequence
  Protein Niban (367-376)
gugcuguucgagaaggaggucaacgaggug

SEQ ID NO: 28992 - RNA, 27 nt, Artificial Sequence
  Caprin-1 (232-240)
gugcugaaggagaucgucgagcgcgug

SEQ ID NO: 28993 - RNA, 27 nt, Artificial Sequence
  Ribonucleoside-diphosphate reductase large subunit (245-253)
gugcugaaggagaagaucgccaaguac

SEQ ID NO: 28994 - RNA, 33 nt, Artificial Sequence
  Histone H4 (22-32)
gugcugcgcgacaacauccagggcaucaccaag

SEQ ID NO: 28995 - RNA, 27 nt, Artificial Sequence
  Cytoplasmic dynein 1 heavy chain 1 (3839-3847)
gugcuguacgagaaccccaaccucaag

SEQ ID NO: 28996 - RNA, 27 nt, Artificial Sequence
  Ubiquitin carboxyl-terminal hydrolase 7 (195-203)
gugcaggccgacgccccccacggcguc

SEQ ID NO: 28997 - RNA, 30 nt, Artificial Sequence
  E3 ubiquitin-protein ligase RNF19A (143-152)
gugcaggccgacguccagaaggagcgcuac

SEQ ID NO: 28998 - RNA, 27 nt, Artificial Sequence
  Interleukin enhancer-binding factor 2 (97-105)
gugcagaucgaggagguccgccaggug

SEQ ID NO: 28999 - RNA, 33 nt, Artificial Sequence
  Proteasome subunit alpha type-2 (102-112)
gugcagcgcgucgccagcgugaugcaggaguac

SEQ ID NO: 29000 - RNA, 27 nt, Artificial Sequence
  Transitional endoplasmic reticulum ATPase (747-755)
gugagcgacaacgacauccgcaaguac

SEQ ID NO: 29001 - RNA, 27 nt, Artificial Sequence
  Nuclear factor NF-kappa-B p100 subunit (317-325)
gugagcgacuccaagcaguucaccuac

SEQ ID NO: 29002 - RNA, 30 nt, Artificial Sequence
  Nuclear factor NF-kappa-B p100 subunit (317-326)
gugagcgacuccaagcaguucaccuacuac

SEQ ID NO: 29003 - RNA, 33 nt, Artificial Sequence
  Phospholipase D2 (65-75)
gugaccgcccaggucgugggcaccgagcgcuac

SEQ ID NO: 29004 - RNA, 27 nt, Artificial Sequence
  Acidic fibroblast growth factor intracellular-binding protein (29-37)
gugaccgacgccgucgcccugcgcgug

SEQ ID NO: 29005 - RNA, 30 nt, Artificial Sequence
  Alanine-tRNA ligase, cytoplasmic (480-489)
gugaccgacgacagccccaaguacaacuac

SEQ ID NO: 29006 - RNA, 33 nt, Artificial Sequence
  Histone-lysine N-methyltransferase 2C (1500-1510)
gugaccgacggcgccauccuggggaagcucuac

SEQ ID NO: 29007 - RNA, 30 nt, Artificial Sequence
  Attractin (145-154)
gugaccgacggccccgggaacuacaaguac

SEQ ID NO: 29008 - RNA, 30 nt, Artificial Sequence
  Proteasome-associated protein ECM29 homolog (1150-1159)
gugaccgacaagagcauggucgacaaguac

SEQ ID NO: 29009 - RNA, 30 nt, Artificial Sequence
  Histone-lysine N-methyltransferase, H3 lysine-79 specific (77-86)
gugaccgaccccgagaagcugaacaacuac

SEQ ID NO: 29010 - RNA, 27 nt, Artificial Sequence
  Dynamin-1-like protein (55-63)
gugaccgacagcauccgcgacgaguac

SEQ ID NO: 29011 - RNA, 30 nt, Artificial Sequence
  Pyridine nucleotide-disulfide oxidoreductase domain-containing protein 1 (98-107)
gugaccgaggacggcaaccagcacgucuac

SEQ ID NO: 29012 - RNA, 27 nt, Artificial Sequence
  Filamin-A (2353-2361)
gugaccgagaucgaccaggacaaguac

SEQ ID NO: 29013 - RNA, 33 nt, Artificial Sequence
  Staphylococcal nuclease domain-containing protein 1 (687-697)
gugaccgagaucaccgacgaccugcacuucuac

SEQ ID NO: 29014 - RNA, 27 nt, Artificial Sequence
  E3 ubiquitin-protein ligase RNF213 (4915-4923)
gugaccgagcugcacgucaucagcuac

SEQ ID NO: 29015 - RNA, 27 nt, Artificial Sequence
  Eukaryotic translation initiation factor 3 subunit C-like protein (23-31)
gugaccaagcccgucggcgggaacuac

SEQ ID NO: 29016 - RNA, 30 nt, Artificial Sequence
  Heterogeneous nuclear ribonucleoprotein U (696-705)
uggagccagcacuaccaccagggcuacuac

SEQ ID NO: 29017 - RNA, 30 nt, Artificial Sequence
  Chromodomain-helicase-DNA-binding protein 7 (859-868)
uggaccgacauccugagccacggccgcuac

SEQ ID NO: 29018 - RNA, 27 nt, Artificial Sequence
  Polypyrimidine tract-binding protein 3 (269-277)
uacgccgaccccgugaacgcccacuac

SEQ ID NO: 29019 - RNA, 27 nt, Artificial Sequence
  HLA class I histocompatibility antigen, B-15 alpha chain (140-148)
uacgccuacgacggcaaggacuacauc

SEQ ID NO: 29020 - RNA, 33 nt, Artificial Sequence
  HLA class I histocompatibility antigen, B-52 alpha chain (140-150)
uacgccuacgacggcaaggacuacaucgcccug

SEQ ID NO: 29021 - RNA, 27 nt, Artificial Sequence
  Cell division cycle-associated 7-like protein (433-441)
uacggcuacgacaacgugaaggaguac

SEQ ID NO: 29022 - RNA, 33 nt, Artificial Sequence
  Mediator of RNA polymerase II transcription subunit 10 (70-80)
uacaucgaccagggccgcaacccccagcuguac

SEQ ID NO: 29023 - RNA, 27 nt, Artificial Sequence
  Septin-7 (132-140)
uacaucgacagcaaguucgaggacuac

SEQ ID NO: 29024 - RNA, 27 nt, Artificial Sequence
  Hypoxia-inducible factor 1-alpha (111-119)
uacaucagcgacaacgugaacaaguac

SEQ ID NO: 29025 - RNA, 30 nt, Artificial Sequence
  Ubiquitin carboxyl-terminal hydrolase 22 (118-127)
uacaucuacgacaaggacauggagaucauc

SEQ ID NO: 29026 - RNA, 30 nt, Artificial Sequence
  Metastasis-associated protein MTA3 (123-132)
uaccuggacaaggaggacaccuucuucuac

SEQ ID NO: 29027 - RNA, 27 nt, Artificial Sequence
  Oxysterol-binding protein-related protein 3 (75-83)
uaccuggacaagggcauccucaaguac

SEQ ID NO: 29028 - RNA, 30 nt, Artificial Sequence
  tRNA (adenine(58)-N(1))-methyltransferase non-catalytic subunit TRM6 (53-62)
uaccuggacaacgugaucggccacagcuac

SEQ ID NO: 29029 - RNA, 27 nt, Artificial Sequence
  Nucleolar complex protein 4 homolog (174-182)
uaccuggacuacgacgacacccgcuac

SEQ ID NO: 29030 - RNA, 27 nt, Artificial Sequence
  Signal transducer and activator of transcription 3 (14-22)
uaccuggagcagcuccaccagcuguac

SEQ ID NO: 29031 - RNA, 27 nt, Artificial Sequence
  Dystonin (981-989)
uaccugaucaacgagaucgaccgcauc

SEQ ID NO: 29032 - RNA, 27 nt, Artificial Sequence
  Geminin (150-158)
uacauggccgagcugaucgagcgccuc

SEQ ID NO: 29033 - RNA, 27 nt, Artificial Sequence
  Thymidylate synthase (235-243)
uacaugaucgcccacaucaccggccug

SEQ ID NO: 29034 - RNA, 33 nt, Artificial Sequence
  Chromodomain-helicase-DNA-binding protein 1-like (712-722)
uaccaggaccccgacgccaccagccugaaguac

SEQ ID NO: 29035 - RNA, 27 nt, Artificial Sequence
  Up-regulated during skeletal muscle growth protein 5 (10-18)
uaccaguucaccggcaucaagaaguac

SEQ ID NO: 29036 - RNA, 27 nt, Artificial Sequence
  Integrator complex subunit 3 (156-164)
uaccagaagcagcccaagaucggcuac

SEQ ID NO: 29037 - RNA, 27 nt, Artificial Sequence
  Pre-mRNA-processing-splicing factor 8 (2326-2334)
uacagcgccgaccgcgaggaccuguac

SEQ ID NO: 29038 - RNA, 27 nt, Artificial Sequence
  Mitogen-activated protein kinase 6 (427-435)
uacagcgaccaccacgagaacaaguac

SEQ ID NO: 29039 - RNA, 30 nt, Artificial Sequence
  RNA binding motif protein, X-linked-like-1 (272-281)
uacagcgaccaccccuccggcgggagcuac

SEQ ID NO: 29040 - RNA, 30 nt, Artificial Sequence
  Cyclin-dependent kinases regulatory subunit 2 (8-17)
uacagcgacaaguacuucgacgagcacuac

SEQ ID NO: 29041 - RNA, 27 nt, Artificial Sequence
  Serine/threonine-protein kinase PLK1 (417-425)
uacagcgacaaguacggccugggguac

SEQ ID NO: 29042 - RNA, 27 nt, Artificial Sequence
  Glycoprotein endo-alpha-1,2-mannosidase-like protein (102-110)
uacagcgaccugcacgccuucuacuac

SEQ ID NO: 29043 - RNA, 30 nt, Artificial Sequence
  Cold-inducible RNA-binding protein (151-160)
uacagcgaccgcuccagcggcggguccuac

SEQ ID NO: 29044 - RNA, 30 nt, Artificial Sequence
  DNA mismatch repair protein Msh6 (469-478)
uacagcgacucccuggugcagaagggcuac

SEQ ID NO: 29045 - RNA, 30 nt, Artificial Sequence
  Serine hydroxymethyltransferase, cytosolic (73-82)
uacagcgagggcuaccccgggcagcgcuac

SEQ ID NO: 29046 - RNA, 33 nt, Artificial Sequence
  Store-operated calcium entry-associated regulatory factor (204-214)
uacagcgaguaccccccguucucccaccgcuac

SEQ ID NO: 29047 - RNA, 33 nt, Artificial Sequence
  FACT complex subunit SPT16 (18-28)
uacagcaacuggcgcaagggcgaggacgaguac

SEQ ID NO: 29048 - RNA, 27 nt, Artificial Sequence
  Histone-lysine N-methyltransferase EZH1 (729-737)
uacagccaggccgacgcccugaaguac

SEQ ID NO: 29049 - RNA, 27 nt, Artificial Sequence
  RNA binding motif protein, X-linked-like-1 (327-335)
uacagcuccagccgcuccgaccuguac

SEQ ID NO: 29050 - RNA, 33 nt, Artificial Sequence
  Eukaryotic translation initiation factor 3 subunit I (38-48)
uacagcgugaacggcgagcgccuggggaccuac

SEQ ID NO: 29051 - RNA, 33 nt, Artificial Sequence
  Trafficking protein particle complex subunit 4 (75-85)
uacaccgccgacggcaaggaggugcuggaguac

SEQ ID NO: 29052 - RNA, 24 nt, Artificial Sequence
  DnaJ homolog subfamily C member 3 (284-291)
uacaccgacgccaccagcaaguac

SEQ ID NO: 29053 - RNA, 27 nt, Artificial Sequence
  Meckelin (401-409)
uacaccgacgagaaccagcaccaguac

SEQ ID NO: 29054 - RNA, 30 nt, Artificial Sequence
  Serine/threonine-protein kinase pim-2 (194-203)
uacaccgacuucgacggcacccgcguguac

SEQ ID NO: 29055 - RNA, 30 nt, Artificial Sequence
  RNA-binding protein 7 (219-228)
uacaccgaccacggcagcgaccaccacuac

SEQ ID NO: 29056 - RNA, 33 nt, Artificial Sequence
  Glutathione S-transferase Mu 2 (23-33)
uacaccgacagcuccuacgaggagaagaaguac

SEQ ID NO: 29057 - RNA, 30 nt, Artificial Sequence
  Protein patched homolog 1 (564-573)
uacaccgacacccacgacaacacgcgcuac

SEQ ID NO: 29058 - RNA, 33 nt, Artificial Sequence
  ARF GTPase-activating protein GIT2 (492-502)
uacaccgacaccagcaaccacuccagccugaag

SEQ ID NO: 29059 - RNA, 24 nt, Artificial Sequence
  Thioredoxin-related transmembrane protein 2 (199-206)
uacaccgacgugagcacccgcuac

SEQ ID NO: 29060 - RNA, 30 nt, Artificial Sequence
  Zinc finger CCCH domain-containing protein 18 (65-74)
uacaccgagaccgagcccuaccacaacuac

SEQ ID NO: 29061 - RNA, 27 nt, Artificial Sequence
  Probable ATP-dependent RNA helicase DDX47 (236-244)
uacuacaucuucauccccagcaaguuc

SEQ ID NO: 29062 - RNA, 27 nt, Artificial Sequence
  ORM1-like protein 2 (59-67)
gccaccuacguguuccugcacaccguc

SEQ ID NO: 29063 - RNA, 27 nt, Artificial Sequence
  Eukaryotic translation initiation factor 2 subunit 3 (202-210)
gagcaguacgagcagauccuggccuuc

SEQ ID NO: 29064 - RNA, 27 nt, Artificial Sequence
  Tapasin (354-362)
caccacagcgacggcuccgugagccug

SEQ ID NO: 29065 - RNA, 27 nt, Artificial Sequence
  Cyclin-dependent kinases regulatory subunit 2 (59-67)
auccacgagcccgagccgcacauccug

SEQ ID NO: 29066 - RNA, 27 nt, Artificial Sequence
  Prelamin-A/C (341-349)
aaggccggccagguggucaccaucugg

SEQ ID NO: 29067 - RNA, 27 nt, Artificial Sequence
  AP-1 complex subunit beta-1 (249-257)
agccacgccaacuccgccgugguccug

SEQ ID NO: 29068 - RNA, 27 nt, Artificial Sequence
  Proliferating cell nuclear antigen (152-160)
agccacaucggcgacgccguggucauc

SEQ ID NO: 29069 - RNA, 27 nt, Artificial Sequence
  Ubiquitin-60S ribosomal protein L40 (70-78)
agcacccugcaccucgugcugcgccug

SEQ ID NO: 29070 - RNA, 30 nt, Artificial Sequence
  HLA class I histocompatibility antigen, B-15 alpha chain (162-171)
accgccgcccagaucacccagcgcaagugg

SEQ ID NO: 29071 - RNA, 27 nt, Artificial Sequence
  Septin-6 (73-81)
acccacacccagcccggcgugcagcug

SEQ ID NO: 29072 - RNA, 27 nt, Artificial Sequence
  DNA topoisomerase 2-alpha (684-692)
uaccuguacggccagaccaccacguac

SEQ ID NO: 29073 - RNA, 30 nt, Artificial Sequence
  Coilin (257-266)
aucagcgacggccccuccaaggugacccug

SEQ ID NO: 29074 - RNA, 27 nt, Artificial Sequence
  Cancer/testis antigen 1 (155-163)
cagcugagccuccugauguggaucacc

SEQ ID NO: 29075 - RNA, 27 nt, Artificial Sequence
  ATPase family AAA domain-containing protein 2 (1274-1282)
gccagcuccagccagaucauccacauc

SEQ ID NO: 29076 - RNA, 27 nt, Artificial Sequence
  Guanine nucleotide-binding protein G(I)/G(S)/G(T) subunit beta-2 (91-99)
cacgccaucccccugcgcagcuccugg

SEQ ID NO: 29077 - RNA, 27 nt, Artificial Sequence
  Acyl-CoA desaturase (115-123)
aucaccgccggcgcccaccgccugugg

SEQ ID NO: 29078 - RNA, 27 nt, Artificial Sequence
  Choline-phosphate cytidylyltransferase A (201-209)
agcaccuccgacaucaucacccgcauc

SEQ ID NO: 29079 - RNA, 27 nt, Artificial Sequence
  Serine/threonine-protein kinase pim-1 (191-199)
gcccugcucaaggacaccguguacacc

SEQ ID NO: 29080 - RNA, 27 nt, Artificial Sequence
  Death-associated protein kinase 2 (1-9)
augcugcucgacaagaacauccccauc

SEQ ID NO: 29081 - RNA, 27 nt, Artificial Sequence
  HLA class I histocompatibility antigen, B-15 alpha chain (163-171)
gccgcccagaucacccagcgcaagugg

SEQ ID NO: 29082 - RNA, 27 nt, Artificial Sequence
  Transcription termination factor 2 (113-121)
gagaccuuccaccacagcuccaacugg

SEQ ID NO: 29083 - RNA, 27 nt, Artificial Sequence
  Filamin-A (352-360)
ggcacccacaaggugaccguccuguuc

SEQ ID NO: 29084 - RNA, 27 nt, Artificial Sequence
  Filamin-A (452-460)
ggcgugcacaccguccacgugaccuuc

SEQ ID NO: 29085 - RNA, 57 nt, Artificial Sequence
  C-1-tetrahydrofolate synthase, cytoplasmic (72-90)
cacggcaacagcuccaucaucgccgaccagaucgcccugaagcucguggggcccgag

SEQ ID NO: 29086 - RNA, 57 nt, Artificial Sequence
  Major histocompatibility complex class I-related gene protein (3-21)
cacagccugcgcuacuuccggcucggcguguccgaccccauccgcggggucccggag

SEQ ID NO: 29087 - RNA, 30 nt, Artificial Sequence
  Delta(24)-sterol reductase (310-319)
cacaccuuccagaacgacauccacguguac

SEQ ID NO: 29088 - RNA, 24 nt, Artificial Sequence
  Protein SET (64-71)
aucgccaagauccccaacuucugg

SEQ ID NO: 29089 - RNA, 27 nt, Artificial Sequence
  Eukaryotic translation initiation factor 3 subunit C-like protein (385-393)
aucagcaagcaguuccaccaccagcug

SEQ ID NO: 29090 - RNA, 27 nt, Artificial Sequence
  Constitutive coactivator of PPAR-gamma-like protein 1 (982-990)
aucagcacccccgugauccgcaccuuc

SEQ ID NO: 29091 - RNA, 27 nt, Artificial Sequence
  T-complex protein 1 subunit gamma (160-168)
aucaccaccaaggccaucagccgcugg

SEQ ID NO: 29092 - RNA, 27 nt, Artificial Sequence
  DNA replication complex GINS protein PSF1 (5-13)
aaggccauggagcugauccgcgagcuc

SEQ ID NO: 29093 - RNA, 27 nt, Artificial Sequence
  60S ribosomal protein L18a (2-10)
aaggccagcggcacccugcgcgaguac

SEQ ID NO: 29094 - RNA, 27 nt, Artificial Sequence
  14-3-3 protein gamma (152-160)
aaggccuacagcgaggcccacgagauc

SEQ ID NO: 29095 - RNA, 27 nt, Artificial Sequence
  AP-1 complex subunit mu-2 (348-356)
aagagcuuccccggcgggaaggaguac

SEQ ID NO: 29096 - RNA, 30 nt, Artificial Sequence
  Dolichol-phosphate mannosyltransferase subunit 1 (42-51)
aagagcuucuccgagagcggcaucaacuac

SEQ ID NO: 29097 - RNA, 30 nt, Artificial Sequence
  Heterogeneous nuclear ribonucleoprotein M (203-212)
aagagccgcggcaucgggaccgugaccuuc

SEQ ID NO: 29098 - RNA, 27 nt, Artificial Sequence
  Plastin-3 (40-48)
aagagcuccgacaucgccaagaccuuc

SEQ ID NO: 29099 - RNA, 27 nt, Artificial Sequence
  THO complex subunit 2 (398-406)
aagaccuuccccuaccagcaccgcuac

SEQ ID NO: 29100 - RNA, 27 nt, Artificial Sequence
  Guanine nucleotide-binding protein subunit beta-2-like 1 (127-135)
aagaccaucaagcuguggaacacccuc

SEQ ID NO: 29101 - RNA, 27 nt, Artificial Sequence
  60S ribosomal protein L4 (163-171)
aagaccaaggaggccgugcugcuccug

SEQ ID NO: 29102 - RNA, 27 nt, Artificial Sequence
  Ribonucleoside-diphosphate reductase large subunit (52-60)
aagacccuggagcgcagcuaccuccug

SEQ ID NO: 29103 - RNA, 30 nt, Artificial Sequence
  Hexokinase-2 (777-786)
aagacccgcggcaucuucgagaccaaguuc

SEQ ID NO: 29104 - RNA, 27 nt, Artificial Sequence
  Ribosome-binding protein 1 (145-153)
aagguggccaaggucgagcccgccgug

SEQ ID NO: 29105 - RNA, 27 nt, Artificial Sequence
  Proteasome subunit beta type-5 (92-100)
aaggugaucgagaucaaccccuaccug

SEQ ID NO: 29106 - RNA, 27 nt, Artificial Sequence
  Anaphase-promoting complex subunit 2 (557-565)
aaggugcgcgaccagcagcuggucuac

SEQ ID NO: 29107 - RNA, 57 nt, Artificial Sequence
  Protein-tyrosine kinase 2-beta (528-546)
caggaggagaagagccuggaccccaugguguacaugaacgacaccuccccgcucacc

SEQ ID NO: 29108 - RNA, 27 nt, Artificial Sequence
  Vigilin (54-62)
cgcgccaagcccgaguaccacaaguuc

SEQ ID NO: 29109 - RNA, 24 nt, Artificial Sequence
  NEDD8 ultimate buster 1 (113-120)
cgcagcaagaucgccgagaccuuc

SEQ ID NO: 29110 - RNA, 27 nt, Artificial Sequence
  Pleiotropic regulator 1 (309-317)
cgcaccaaggccagcgugcacacccug

SEQ ID NO: 29111 - RNA, 27 nt, Artificial Sequence
  Baculoviral IAP repeat-containing protein 6 (597-605)
cgcacccugcccgugcuccugcuguac

SEQ ID NO: 29112 - RNA, 27 nt, Artificial Sequence
  E3 ubiquitin-protein ligase CBL-B (66-74)
cgcaccguggagaagaccuggaagcug

SEQ ID NO: 29113 - RNA, 30 nt, Artificial Sequence
  Basigin (137-146)
cgcgugcggagccaccuggccgcccucugg

SEQ ID NO: 29114 - RNA, 36 nt, Artificial Sequence
  Phosphatidylinositol 4-kinase type 2-beta (74-85)
agccgcuccagcuccgccgagcuggaccggagccgc

SEQ ID NO: 29115 - RNA, 27 nt, Artificial Sequence
  Histone-binding protein RBBP7 (376-384)
accgccaagaucagcgacuucuccugg

SEQ ID NO: 29116 - RNA, 27 nt, Artificial Sequence
  Junction plakoglobin (207-215)
accaccagccgcgugcugaagguccuc

SEQ ID NO: 29117 - RNA, 27 nt, Artificial Sequence
  High mobility group protein B3 (123-131)
guggccaagaagcugggcgagaugugg

SEQ ID NO: 29118 - RNA, 33 nt, Artificial Sequence
  Heterogeneous nuclear ribonucleoprotein U-like protein 1 (427-437)
gugggccugcccgccgccgggaagaccaccugg

SEQ ID NO: 29119 - RNA, 27 nt, Artificial Sequence
  Phosphoglycerate kinase 1 (328-336)
gugacccgcgccaagcagaucgucugg

SEQ ID NO: 29120 - RNA, 27 nt, Artificial Sequence
  Transcription elongation factor SPT5 (976-984)
gugaccaccgacauccaggucaaggug

SEQ ID NO: 29121 - RNA, 57 nt, Artificial Sequence
  Lymphocyte antigen 75 (1307-1325)
uacauggccagcugggugaugcugggcaucaccuaccgcaacaagucccucaugugg

SEQ ID NO: 29122 - RNA, 27 nt, Artificial Sequence
  Guanine nucleotide-binding protein subunit beta-2-like 1 (302-310)
uacaccgacaaccuggugcgcgucugg

SEQ ID NO: 29123 - RNA, 27 nt, Artificial Sequence
  40S ribosomal protein S21 (75-83)
gccgacggcaucgugagcaagaacuuc

SEQ ID NO: 29124 - RNA, 30 nt, Artificial Sequence
  Pleiotropic regulator 1 (471-480)
gccgaggccgacaagaccaucaagguguac

SEQ ID NO: 29125 - RNA, 27 nt, Artificial Sequence
  Putative RRN3-like protein RRN3P1 (4-12)
gccgaggccuuccuggagcaccucugg

SEQ ID NO: 29126 - RNA, 33 nt, Artificial Sequence
  Chloride intracellular channel protein 1 (157-167)
gccgaggacgagggcgugagccagcgcaaguuc

SEQ ID NO: 29127 - RNA, 33 nt, Artificial Sequence
  Heat shock protein HSP 90-beta (346-356)
gccgaggacaaggagaacuacaagaaguucuac

SEQ ID NO: 29128 - RNA, 33 nt, Artificial Sequence
  Transmembrane emp24 domain-containing protein 3 (50-60)
gccgaggaccugaacagccgcguguccuacugg

SEQ ID NO: 29129 - RNA, 33 nt, Artificial Sequence
  Transmembrane emp24 domain-containing protein 7 (170-180)
gccgaggaccugaacacccgcguggccuacugg

SEQ ID NO: 29130 - RNA, 30 nt, Artificial Sequence
  Plasminogen activator inhibitor 1 RNA-binding protein (236-245)
gccgaggacagcgugauggaccaccacuuc

SEQ ID NO: 29131 - RNA, 30 nt, Artificial Sequence
  Eukaryotic translation elongation factor 1 epsilon-1 (65-74)
gccgaggagaaggccaucgugcagcagugg

SEQ ID NO: 29132 - RNA, 27 nt, Artificial Sequence
  Transcription elongation factor SPT6 (985-993)
gccgaggagcuggagcgccagggcuac

SEQ ID NO: 29133 - RNA, 30 nt, Artificial Sequence
  G patch domain-containing protein 4 (15-24)
gccgaggagcagcugcucaagcacggcugg

SEQ ID NO: 29134 - RNA, 30 nt, Artificial Sequence
  General transcription factor 3C polypeptide 1 (182-191)
gccgaggagagcgaccugucccgccaguac

SEQ ID NO: 29135 - RNA, 30 nt, Artificial Sequence
  Myosin light polypeptide 6 (10-19)
gccgaguucaaggaggccuuccagcuguuc

SEQ ID NO: 29136 - RNA, 30 nt, Artificial Sequence
  Signal peptidase complex subunit 2 (187-196)
gccgaguucaccaagagcaucgccaaguuc

SEQ ID NO: 29137 - RNA, 27 nt, Artificial Sequence
  60S ribosomal protein L8 (33-41)
gccgagggcauccacaccgggcaguuc

SEQ ID NO: 29138 - RNA, 33 nt, Artificial Sequence
  Proteasome inhibitor PI31 subunit (114-124)
gccgagcaccugggcgacuuccaccgcaccuac

SEQ ID NO: 29139 - RNA, 27 nt, Artificial Sequence
  Kinesin-like protein KIF20B (872-880)
gccgagaucgaggacauccgcgugcug

SEQ ID NO: 29140 - RNA, 30 nt, Artificial Sequence
  rRNA-processing protein FCF1 homolog (108-117)
gccgagaucgagaagcugggccagaaguac

SEQ ID NO: 29141 - RNA, 36 nt, Artificial Sequence
  Cyclin-dependent kinase 6 (17-28)
gccgagaucggcgagggggccuacggcaagguguuc

SEQ ID NO: 29142 - RNA, 33 nt, Artificial Sequence
  Delta(24)-sterol reductase (227-237)
gccgagauccgcaucauccccgccaagaaguac

SEQ ID NO: 29143 - RNA, 33 nt, Artificial Sequence
  Filamin A (105-115)
gccgagaucguggagggcgagaaccacaccuac

SEQ ID NO: 29144 - RNA, 30 nt, Artificial Sequence
  Replication protein A 32 kDa subunit (83-92)
gccgagaaggcccccaccaacaucguguac

SEQ ID NO: 29145 - RNA, 30 nt, Artificial Sequence
  ATP-dependent RNA helicase DHX8 (57-66)
gccgagaagaacaccaccuucgacacguuc

SEQ ID NO: 29146 - RNA, 33 nt, Artificial Sequence
  Cysteine andine-rich protein 1 (129-139)
gccgagaaggugaucggcgccgggaagagcugg

SEQ ID NO: 29147 - RNA, 30 nt, Artificial Sequence
  ER membrane protein complex subunit 2 (162-171)
gccgagcuguacaucaacgagcacgacuac

SEQ ID NO: 29148 - RNA, 30 nt, Artificial Sequence
  Catenin beta-1 (478-487)
gccgagauggcccagaacgcggugcgccug

SEQ ID NO: 29149 - RNA, 27 nt, Artificial Sequence
  Cleavage stimulation factor subunit 1 (217-225)
gccgagaugcugcgcagcaucuccuuc

SEQ ID NO: 29150 - RNA, 27 nt, Artificial Sequence
  DNA-dependent protein kinase catalytic subunit (193-201)
gccgagaaccuguuccgcgccuuccuc

SEQ ID NO: 29151 - RNA, 33 nt, Artificial Sequence
  Proteasome subunit beta type-1 (211-221)
gccgagcgcgacguguacaccggcgacgcccug

SEQ ID NO: 29152 - RNA, 27 nt, Artificial Sequence
  Exportin-2 (513-521)
gccgagagcaucgugguccacaccuac

SEQ ID NO: 29153 - RNA, 27 nt, Artificial Sequence
  Full=Zinc finger CCCH domain-containing protein 16 (227-235)
gccgagguggccgcggagaagagcuuc

SEQ ID NO: 29154 - RNA, 33 nt, Artificial Sequence
  Targeting protein for Xklp2 (638-648)
gccgagguggaggcccagaaggcgcagcagcug

SEQ ID NO: 29155 - RNA, 27 nt, Artificial Sequence
  Transmembrane emp24 domain-containing protein 3 (92-100)
gccgaggugaagggcgucuaccaguuc

SEQ ID NO: 29156 - RNA, 30 nt, Artificial Sequence
  DNA-dependent protein kinase catalytic subunit (2320-2329)
gccgaggugcugggccucauccugcgcuac

SEQ ID NO: 29157 - RNA, 30 nt, Artificial Sequence
  Spectrin beta chain, non-erythrocytic 1 (1304-1313)
gacgaggcccgcaaccugcacagcaagugg

SEQ ID NO: 29158 - RNA, 27 nt, Artificial Sequence
  Protein KIAA0100 (696-704)
gacgaggccgugggcguccagaagugg

SEQ ID NO: 29159 - RNA, 30 nt, Artificial Sequence
  Transcription elongation factor SPT6 (573-582)
gacgaguucagccaccaggugcaggagugg

SEQ ID NO: 29160 - RNA, 27 nt, Artificial Sequence
  Heat shock protein HSP 90-alpha (288-296)
gacgagauggugagccugaaggacuac

SEQ ID NO: 29161 - RNA, 30 nt, Artificial Sequence
  Cyclin-dependent kinase inhibitor 3 (22-31)
gacgagcagacccccauccacaucagcugg

SEQ ID NO: 29162 - RNA, 27 nt, Artificial Sequence
  Spectrin beta chain, non-erythrocytic 1 (741-749)
gaggaggccagccugcuccaccaguuc

SEQ ID NO: 29163 - RNA, 33 nt, Artificial Sequence
  Eukaryotic translation initiation factor 3 subunit M (11-21)
gaggaggaccaggccgccgagcugcgcgcguac

SEQ ID NO: 29164 - RNA, 27 nt, Artificial Sequence
  Protein transport protein Sec23B (521-529)
gaggagggccccgacgugcugcgcugg

SEQ ID NO: 29165 - RNA, 33 nt, Artificial Sequence
  40S ribosomal protein S17 (36-46)
gaggagaucgccaucauccccagcaagaagcug

SEQ ID NO: 29166 - RNA, 30 nt, Artificial Sequence
  Sigma non-opioid intracellular receptor 1 (40-49)
gaggagaucgcccagcuggcccgccaguac

SEQ ID NO: 29167 - RNA, 33 nt, Artificial Sequence
  DNA repair protein RAD50 (1002-1012)
gaggagaucaacaagaucauccgcgaccugugg

SEQ ID NO: 29168 - RNA, 27 nt, Artificial Sequence
  Targeting protein for Xklp2 (351-359)
gaggagcuggagaagcuccagcaguac

SEQ ID NO: 29169 - RNA, 27 nt, Artificial Sequence
  26S proteasome non-ATPase regulatory subunit 13 (26-34)
gaggagcuguacaccaagaagcucugg

SEQ ID NO: 29170 - RNA, 36 nt, Artificial Sequence
  Nuclear pore complex protein Nup153 (1104-1115)
gaggagaugcccgccaccaagggcggguucagcuuc

SEQ ID NO: 29171 - RNA, 33 nt, Artificial Sequence
  Eukaryotic initiation factor 4A-I (396-406)
gaggagaugccccugaacguggccgaccucauc

SEQ ID NO: 29172 - RNA, 27 nt, Artificial Sequence
  General transcription factor 3C polypeptide 1 (183-191)
gaggagagcgaccugucccgccaguac

SEQ ID NO: 29173 - RNA, 30 nt, Artificial Sequence
  Protein SCO1 homolog, mitochondrial (121-130)
gaggagguggaccaggucgcccgcgccuac

SEQ ID NO: 29174 - RNA, 30 nt, Artificial Sequence
  F-box/LRR-repeat protein 3 (394-403)
gaggaggugcugauccccgaccagaaguac

SEQ ID NO: 29175 - RNA, 27 nt, Artificial Sequence
  von Willebrand factor (1339-1347)
gagcugcgccggaucgccagccaggug

SEQ ID NO: 29176 - RNA, 15 nt, Artificial Sequence
  DNA nucleotidylexotransferase (64-68)
uuccgccggggcaag

SEQ ID NO: 29177 - RNA, 27 nt, Artificial Sequence
  Spectrin beta chain, non-erythrocytic 1 (1059-1067)
ggcgaggccagcaagcugcagcaguuc

SEQ ID NO: 29178 - RNA, 30 nt, Artificial Sequence
  Endothelial differentiation-related factor 1 (35-44)
ggcgaggacguggagaccagcaagaagugg

SEQ ID NO: 29179 - RNA, 27 nt, Artificial Sequence
  Serine/arginine-rich splicing factor 9 (175-183)
ggcgagaccagcuacauccgcguguac

SEQ ID NO: 29180 - RNA, 33 nt, Artificial Sequence
  Peroxiredoxin-5, mitochondrial (36-46)
ggcgagugggccagcgggggcgugcgcuccuuc

SEQ ID NO: 29181 - RNA, 27 nt, Artificial Sequence
  Probable E3 ubiquitin-protein ligase makorin-2 (170-178)
cacgagauggagaaggccuucgccuuc

SEQ ID NO: 29182 - RNA, 30 nt, Artificial Sequence
  Antigen KI-67 (54-63)
cacgagcaggaggccauccugcacaacuuc

SEQ ID NO: 29183 - RNA, 30 nt, Artificial Sequence
  Mediator of RNA polymerase II transcription subunit 17 (187-196)
aucgaggacccccagauccaggcccacugg

SEQ ID NO: 29184 - RNA, 27 nt, Artificial Sequence
  Actin, aortic smooth muscle (73-81)
aucgagcacggcaucaucaccaacugg

SEQ ID NO: 29185 - RNA, 33 nt, Artificial Sequence
  DNA topoisomerase 2-alpha (921-931)
aucgagaucagcgagcugcccgugcgcaccugg

SEQ ID NO: 29186 - RNA, 27 nt, Artificial Sequence
  Non-canonical poly(A) RNA polymerase PAPD5 (227-235)
aucgagagcgugaucaaggagcugugg

SEQ ID NO: 29187 - RNA, 45 nt, Artificial Sequence
  Interleukin-9 receptor (168-182)
aucagccccgcccuggagccgaugaccacccuccuguccuacgag

SEQ ID NO: 29188 - RNA, 30 nt, Artificial Sequence
  T-complex protein 1 subunit gamma (6-15)
cuggagaucaagaagaucggcgacgaguac

SEQ ID NO: 29189 - RNA, 33 nt, Artificial Sequence
  Trafficking protein particle complex subunit 5 (105-115)
cuggagcaggccaacgacgacgcccgcaccuuc

SEQ ID NO: 29190 - RNA, 30 nt, Artificial Sequence
  Eukaryotic translation initiation factor 3 subunit D (314-323)
auggaggccaccuacaucaaccacaacuuc

SEQ ID NO: 29191 - RNA, 30 nt, Artificial Sequence
  Magnesium transporter protein 1 (242-251)
auggaguuccuguucaacaagaccggcugg

SEQ ID NO: 29192 - RNA, 27 nt, Artificial Sequence
  Transforming acidic coiled-coil-containing protein 3 (718-726)
auggagaagagcuucuccgaccuguuc

SEQ ID NO: 29193 - RNA, 30 nt, Artificial Sequence
  Membrane-associated tyrosine- and threonine-specific cdc2-inhibitory kinase (234-243)
auggagcugccccacggcggggagggcugg

SEQ ID NO: 29194 - RNA, 27 nt, Artificial Sequence
  AAC83183.1 (92-100)
auggagagccugaccaagcaccucuuc

SEQ ID NO: 29195 - RNA, 30 nt, Artificial Sequence
  60S ribosomal protein L4 (212-221)
aacgaggacaacggcaucaucaaggccuuc

SEQ ID NO: 29196 - RNA, 33 nt, Artificial Sequence
  Protein transport protein Sec23B (420-430)
aacgagcugggcguggggggcaccagccagugg

SEQ ID NO: 29197 - RNA, 30 nt, Artificial Sequence
  Long-chain-fatty-acid-CoA ligase 4 (65-74)
aacgagaugcagcccaacggcaagguguuc

SEQ ID NO: 29198 - RNA, 30 nt, Artificial Sequence
  Mortality factor 4-like protein 1 (215-224)
aacgagguggucgccggcaucaaggaguac

SEQ ID NO: 29199 - RNA, 24 nt, Artificial Sequence
  Ig kappa chain C region (1-8)
aacaucgugaugacccagagcccc

SEQ ID NO: 29200 - RNA, 27 nt, Artificial Sequence
  Multifunctional protein ADE2 (69-77)
caggaggccggcaucaagaccgccuuc

SEQ ID NO: 29201 - RNA, 33 nt, Artificial Sequence
  Guanine nucleotide-binding protein G(s) subunit alpha isoforms short (257-267)
caggaggcccugaaccucuucaagagcaucugg

SEQ ID NO: 29202 - RNA, 33 nt, Artificial Sequence
  Spectrin beta chain, non-erythrocytic 1 (1864-1874)
caggaggacgccgcccgccugcaggcggccuac

SEQ ID NO: 29203 - RNA, 30 nt, Artificial Sequence
  Annexin A2 (138-147)
caggagcugcaggagaucaaccgcguguac

SEQ ID NO: 29204 - RNA, 30 nt, Artificial Sequence
  TPT1-like protein (84-93)
caggagaccagcuucaccaaggaggccuac

SEQ ID NO: 29205 - RNA, 33 nt, Artificial Sequence
  AP-5 complex subunit zeta-1 (14-24)
cgcgagauccaggacgaggagcugaagaaguuc

SEQ ID NO: 29206 - RNA, 33 nt, Artificial Sequence
  Eukaryotic translation initiation factor 3 subunit C-like protein (201-211)
agcgaggcccccuccggcgagagccgcaaguuc

SEQ ID NO: 29207 - RNA, 27 nt, Artificial Sequence
  Histone H2B type 1-A (77-85)
agcgaggccucccgccuggcccacuac

SEQ ID NO: 29208 - RNA, 36 nt, Artificial Sequence
  Protein transport protein Sec31A (233-244)
agcgaggacgaccgccugcccgugauccagaugugg

SEQ ID NO: 29209 - RNA, 27 nt, Artificial Sequence
  DnaJ homolog subfamily C member 7 (393-401)
agcgaggacgagaucaagaaggccuac

SEQ ID NO: 29210 - RNA, 27 nt, Artificial Sequence
  WD repeat-containing protein 82 (86-94)
agcgaggacggcaagauccacgugugg

SEQ ID NO: 29211 - RNA, 30 nt, Artificial Sequence
  Poly (ADP-ribose) polymerase 1 (808-817)
agcgaggaggccgagaucauccgcaaguac

SEQ ID NO: 29212 - RNA, 27 nt, Artificial Sequence
  Polypyrimidine tract-binding protein 1 (485-493)
agcgaggaggaccugaaggugcucuuc

SEQ ID NO: 29213 - RNA, 36 nt, Artificial Sequence
  Eukaryotic translation initiation factor 3 subunit M (10-21)
agcgaggaggaccaggccgccgagcugcgcgcguac

SEQ ID NO: 29214 - RNA, 27 nt, Artificial Sequence
  General transcription factor 3C polypeptide 1 (415-423)
agcgaggagggccugcuccgccuguac

SEQ ID NO: 29215 - RNA, 30 nt, Artificial Sequence
  Disco-interacting protein 2 homolog A (29-38)
agcgagggcgacaucacccagaagggguac

SEQ ID NO: 29216 - RNA, 27 nt, Artificial Sequence
  DNA replication licensing factor MCM5 (690-698)
agcgagcacuccaucaucaaggacuuc

SEQ ID NO: 29217 - RNA, 27 nt, Artificial Sequence
  Disks large homolog 1 (143-151)
agcgagaucgagaacgugcacggcuuc

SEQ ID NO: 29218 - RNA, 33 nt, Artificial Sequence
  Protein SET (61-71)
agcgagcugaucgccaagauccccaacuucugg

SEQ ID NO: 29219 - RNA, 27 nt, Artificial Sequence
  Uncharacterized protein C14orf119 (121-129)
agcgagcccgacuucguggccaaguuc

SEQ ID NO: 29220 - RNA, 27 nt, Artificial Sequence
  Ubiquitin-conjugating enzyme E2 J1 (204-212)
agcgaguccgaccugaaccacagcuuc

SEQ ID NO: 29221 - RNA, 27 nt, Artificial Sequence
  Nucleolar transcription factor 1 (275-283)
agcgaguccgagcugacccgccuccug

SEQ ID NO: 29222 - RNA, 27 nt, Artificial Sequence
  Citrate synthase, mitochondrial (120-128)
agcgaguccaacuucgcccgcgccuac

SEQ ID NO: 29223 - RNA, 27 nt, Artificial Sequence
  GMP reductase 2 (46-54)
agcgagguggaccugacccgcuccuuc

SEQ ID NO: 29224 - RNA, 39 nt, Artificial Sequence
  Single Ig IL-1-related receptor (383-395)
agcgagguggacgucuccgaccugggcagccgcaacuac

SEQ ID NO: 29225 - RNA, 27 nt, Artificial Sequence
  Sulfhydryl oxidase 1 (223-231)
accgaggccaacgugguccgcaaguuc

SEQ ID NO: 29226 - RNA, 30 nt, Artificial Sequence
  Cyclin-D1-binding protein 1 (44-53)
accgaggaguucaaccgcgagauguucugg

SEQ ID NO: 29227 - RNA, 30 nt, Artificial Sequence
  Staphylococcal nuclease domain-containing protein 1 (663-672)
accgagaucaccgacgaccugcacuucuac

SEQ ID NO: 29228 - RNA, 27 nt, Artificial Sequence
  Eukaryotic translation initiation factor 3 subunit M (142-150)
accgagcuggaccaggugcgcaagugg

SEQ ID NO: 29229 - RNA, 30 nt, Artificial Sequence
  Serine/arginine-rich splicing factor 3 (24-33)
accgagcuggagcgcgccuucggcuacuac

SEQ ID NO: 29230 - RNA, 33 nt, Artificial Sequence
  HLA class II histocompatibility antigen, DRB1-15 beta chain (46-56)
accgagcugggccgccccgacgccgaguacugg

SEQ ID NO: 29231 - RNA, 27 nt, Artificial Sequence
  Pre-mRNA-splicing factor ISY1 homolog (37-45)
accgagcugcccaaggccgagaagugg

SEQ ID NO: 29232 - RNA, 33 nt, Artificial Sequence
  Coatomer subunit delta (46-56)
accgagauggacagccacgaggagaagguguuc

SEQ ID NO: 29233 - RNA, 27 nt, Artificial Sequence
  CUGBP Elav-like family member 1 (120-128)
accgagaacgacauccgcgugauguuc

SEQ ID NO: 29234 - RNA, 27 nt, Artificial Sequence
  Gamma-secretase subunit PEN-2 (48-56)
accgagcagagccagaucaagggcuac

SEQ ID NO: 29235 - RNA, 33 nt, Artificial Sequence
  Gamma-secretase subunit PEN-2 (48-58)
accgagcagagccagaucaagggcuacgugugg

SEQ ID NO: 29236 - RNA, 27 nt, Artificial Sequence
  Tyrosine-protein kinase BAZ1B (274-282)
guggaggacgagcuggucaagaaguac

SEQ ID NO: 29237 - RNA, 27 nt, Artificial Sequence
  Vigilin (405-413)
guggagaucaacaucgaccacaaguuc

SEQ ID NO: 29238 - RNA, 33 nt, Artificial Sequence
  Influenza virus NS1A-binding protein (576-586)
guggagauguacgaccccacccgcaacgagugg

SEQ ID NO: 29239 - RNA, 30 nt, Artificial Sequence
  Target of rapamycin complex subunit LST8 (298-307)
guggagaccggcgagaucaagcgcgaguac

SEQ ID NO: 29240 - RNA, 30 nt, Artificial Sequence
  Methionine aminopeptidase 2 (311-320)
uacgagguggagaucgacggcaagaccuac

SEQ ID NO: 29241 - RNA, 42 nt, Artificial Sequence
  Gamma-secretase C-terminal fragment 59 (565-578)
uuccgccacgacagcggcuacgaggugcaccaccagaagcug

SEQ ID NO: 29242 - RNA, 27 nt, Artificial Sequence
  Disintegrin and metalloproteinase domain-containing protein 10 (19-27)
ggccaguacgggaacccccugaacaag

SEQ ID NO: 29243 - RNA, 24 nt, Artificial Sequence
  Beta-2-microglobulin (21-28)
auccagcgcacccccaagauccag

SEQ ID NO: 29244 - RNA, 30 nt, Artificial Sequence
  Beta-2-microglobulin (21-30)
auccagcgcacccccaagauccagguguac

SEQ ID NO: 29245 - RNA, 27 nt, Artificial Sequence
  Splicing factor 3B subunit 2 (36-44)
cgccagaccggcaucgugcugaaccgg

SEQ ID NO: 29246 - RNA, 27 nt, Artificial Sequence
  Importin subunit alpha-1 (377-385)
ggccuggugcccuuccucgucagcgug

SEQ ID NO: 29247 - RNA, 27 nt, Artificial Sequence
  Neutral alpha-glucosidase AB (3-11)
gccguggccgcggucgccgcccgccgg

SEQ ID NO: 29248 - RNA, 30 nt, Artificial Sequence
  60S ribosomal protein L15 (131-140)
gaggugauccugaucgaccccuuccacaag

SEQ ID NO: 29249 - RNA, 30 nt, Artificial Sequence
  Cullin-4A (5-14)
gccccccgcaagggcagcuucuccgcccug

SEQ ID NO: 29250 - RNA, 30 nt, Artificial Sequence
  Fatty acid synthase (1169-1178)
aucccccgcgacccgagccagcaggagcug

SEQ ID NO: 29251 - RNA, 30 nt, Artificial Sequence
  Carbonic anhydrase 9 (397-406)
agcccccgcgccgccgagccggugcagcug

SEQ ID NO: 29252 - RNA, 27 nt, Artificial Sequence
  BTB/POZ domain-containing adapter for CUL3-mediated RhoA degradation protein 3 (28-36)
agccccuccagcaaguacgugaagcug

SEQ ID NO: 29253 - RNA, 27 nt, Artificial Sequence
  Melanoma-associated antigen 10 (254-262)
ggccuguacgacgggauggagcaccuc

SEQ ID NO: 29254 - RNA, 27 nt, Artificial Sequence
  26S proteasome non-ATPase regulatory subunit 6 (103-111)
gccaugauggccaaggcggaguaccug

SEQ ID NO: 29255 - RNA, 27 nt, Artificial Sequence
  40S ribosomal protein S26 (107-115)
gccccccgcccgccccccaagcccaug

SEQ ID NO: 29256 - RNA, 27 nt, Artificial Sequence
  Elongation factor 2 (286-294)
gccuaccugcccgugaacgagagcuuc

SEQ ID NO: 29257 - RNA, 27 nt, Artificial Sequence
  Long-chain-fatty-acid-CoA ligase 3 (326-334)
ggcuaccugccccucgcccacgugcug

SEQ ID NO: 29258 - RNA, 27 nt, Artificial Sequence
  m7GpppX diphosphatase (268-276)
cacuaccugcccagcuacuaccaccuc

SEQ ID NO: 29259 - RNA, 27 nt, Artificial Sequence
  N6-adenosine-methyltransferase subunit METTL14 (99-107)
aucuacaaggacagcuccaccuuccug

SEQ ID NO: 29260 - RNA, 27 nt, Artificial Sequence
  Ubiquitin-conjugating enzyme E2 H (17-25)
aagcugaucgagagcaagcacgaggug

SEQ ID NO: 29261 - RNA, 27 nt, Artificial Sequence
  Adenylosuccinate synthetase isozyme 2 (347-355)
aaguacgcccacaugaucaacggcuuc

SEQ ID NO: 29262 - RNA, 27 nt, Artificial Sequence
  Serine/threonine-protein phosphatase 2A 56 kDa regulatory subunit epsilon isoform (174-182)
aaguacaucgaccagaaguucgugcug

SEQ ID NO: 29263 - RNA, 27 nt, Artificial Sequence
  Actin-binding protein IPP (238-246)
aaguacaucgagggcgugagcgacuuc

SEQ ID NO: 29264 - RNA, 27 nt, Artificial Sequence
  Mitogen-activated protein kinase 4 (138-146)
aaguacauccacagcgccaacgugcug

SEQ ID NO: 29265 - RNA, 27 nt, Artificial Sequence
  Tyrosine-protein phosphatase non-receptor type 23 (70-78)
aaguaccugggccagcuccacuaccug

SEQ ID NO: 29266 - RNA, 30 nt, Artificial Sequence
  Mitochondrial carrier homolog 1 (280-289)
aaguaccugagcgugcagggccagcucuuc

SEQ ID NO: 29267 - RNA, 27 nt, Artificial Sequence
  Caprin-1 (98-106)
aaguaccaggaggugaccaacaaccug

SEQ ID NO: 29268 - RNA, 27 nt, Artificial Sequence
  Mitochondrial carrier homolog 1 (168-176)
aaguacagcggcgugcuguccagcauc

SEQ ID NO: 29269 - RNA, 27 nt, Artificial Sequence
  Microspherule protein 1 (251-259)
cuguacgaccccgugaucagcaagcuc

SEQ ID NO: 29270 - RNA, 27 nt, Artificial Sequence
  Splicing factor 3B subunit 3 (988-996)
aacuacaucagcggcauccagaccauc

SEQ ID NO: 29271 - RNA, 27 nt, Artificial Sequence
  Vimentin (357-365)
aacuaccaggacaccaucggccgccug

SEQ ID NO: 29272 - RNA, 27 nt, Artificial Sequence
  Stomatin-like protein 2, mitochondrial (236-244)
caguacgugagcgccuucuccaagcug

SEQ ID NO: 29273 - RNA, 30 nt, Artificial Sequence
  Actin, cytoplasmic 2 (85-94)
cgcguggcccccgaggagcacccgguccug

SEQ ID NO: 29274 - RNA, 27 nt, Artificial Sequence
  Casein kinase I isoform delta (178-186)
cgcuacgccagcaucaacacccaccug

SEQ ID NO: 29275 - RNA, 27 nt, Artificial Sequence
  Dolichyl-diphosphooligosaccharide-proteinosyltransferase subunit 2 (218-226)
cgcuacaucgccaacaccguggagcug

SEQ ID NO: 29276 - RNA, 27 nt, Artificial Sequence
  Signal transducer and activator of transcription 3 (13-21)
cgcuaccuggagcagcuccaccagcug

SEQ ID NO: 29277 - RNA, 27 nt, Artificial Sequence
  Protein kish-A (2-10)
agcgccaucuucaacuuccagucccug

SEQ ID NO: 29278 - RNA, 27 nt, Artificial Sequence
  Seipin (55-63)
agcuacaugcccaccgugucccaccug

SEQ ID NO: 29279 - RNA, 27 nt, Artificial Sequence
  CMP-N-acetylneuraminate-beta-galactosamide-alpha-2,3-sialyltransf erase 2 (239-247)
accuacgcccccgugaagagcuuccug

SEQ ID NO: 29280 - RNA, 27 nt, Artificial Sequence
  Cleft lip and palate transmembrane protein 1 (545-553)
accuacaaggcccugaacaccuucauc

SEQ ID NO: 29281 - RNA, 27 nt, Artificial Sequence
  Proteasome subunit beta type-6 (94-102)
accuaccagcugggcuuccacagcauc

SEQ ID NO: 29282 - RNA, 27 nt, Artificial Sequence
  RNA-binding protein 42 (91-99)
accuaccagcaggugcagcagacccug

SEQ ID NO: 29283 - RNA, 27 nt, Artificial Sequence
  DNA replication licensing factor MCM7 (231-239)
accuacaccagcgcccgcacgcugcuc

SEQ ID NO: 29284 - RNA, 27 nt, Artificial Sequence
  Alpha-enolase (18-26)
guguaccacaaccugaagaacgucauc

SEQ ID NO: 29285 - RNA, 27 nt, Artificial Sequence
  Unconventional myosin-Ic (350-358)
guguacagccgcaccuucaccuggcug

SEQ ID NO: 29286 - RNA, 33 nt, Artificial Sequence
  THO complex subunit 5 homolog (420-430)
uaccaguucgacaaggugggcauccugacccuc

SEQ ID NO: 29287 - RNA, 27 nt, Artificial Sequence
  Splicing factor 3B subunit 3 (1166-1174)
uacuacuuccccgugaagaacgucauc

SEQ ID NO: 29288 - RNA, 27 nt, Artificial Sequence
  Solute carrier family 35 member B1 (27-35)
uacuacggcauccugcaggagaagauc

SEQ ID NO: 29289 - RNA, 24 nt, Artificial Sequence
  Transformation/transcription domain-associated protein (1974-1981)
uacuaccccgugcgccaccaccug

SEQ ID NO: 29290 - RNA, 48 nt, Artificial Sequence
  Gamma-secretase C-terminal fragment 59 (563-578)
gccgaguuccgccacgacagcggcuacgaggugcaccaccagaagcug

SEQ ID NO: 29291 - RNA, 30 nt, Artificial Sequence
  Ribosome-binding protein 1 (168-177)
gccauccuggagaccgcccccaaggaggug

SEQ ID NO: 29292 - RNA, 27 nt, Artificial Sequence
  Sarcoplasmic/endoplasmic reticulum calcium ATPase 1 (206-214)
gccaucgugcgcagccugcccuccguc

SEQ ID NO: 29293 - RNA, 27 nt, Artificial Sequence
  ATP-dependent RNA helicase DDX50 (247-255)
gcccuggccgcggcccucgcccacauc

SEQ ID NO: 29294 - RNA, 30 nt, Artificial Sequence
  Splicing factor, proline- and glutamine-rich (343-352)
gcccuggccgagaucgcgaaggccgagcuc

SEQ ID NO: 29295 - RNA, 36 nt, Artificial Sequence
  DDB1- and CUL4-associated factor 11 (187-198)
gcccuggccggccaccaggacgggaucaccuucauc

SEQ ID NO: 29296 - RNA, 27 nt, Artificial Sequence
  EH domain-containing protein 1 (502-510)
gcccuggccaaccaccucaucaaggug

SEQ ID NO: 29297 - RNA, 27 nt, Artificial Sequence
  COP9 signalosome complex subunit 7a (30-38)
gcccuggccacccucauccaccaggug

SEQ ID NO: 29298 - RNA, 27 nt, Artificial Sequence
  Cullin-2 (304-312)
gcccuggacaaggcccucaccagcgug

SEQ ID NO: 29299 - RNA, 27 nt, Artificial Sequence
  Glutathione S-transferase A4 (73-81)
gcccuggaggagaagauccccaacauc

SEQ ID NO: 29300 - RNA, 27 nt, Artificial Sequence
  WD repeat-containing protein 19 (108-116)
gcccuguucgagggcaaggugcagcuc

SEQ ID NO: 29301 - RNA, 27 nt, Artificial Sequence
  H/ACA ribonucleoprotein complex subunit 4 (179-187)
gcccuguuccagcgccccccgcucauc

SEQ ID NO: 29302 - RNA, 27 nt, Artificial Sequence
  Serine palmitoyltransferase 2 (292-300)
gcccugggccccaccgggcgcggcgug

SEQ ID NO: 29303 - RNA, 33 nt, Artificial Sequence
  Syntaxin-binding protein 3 (373-383)
gcccugggcaccgacgccgaggggcagaaggug

SEQ ID NO: 29304 - RNA, 27 nt, Artificial Sequence
  Apoptosis-associated speck-like protein containing a CARD (118-126)
gcccugaucgcccgcgugaccaacguc

SEQ ID NO: 29305 - RNA, 27 nt, Artificial Sequence
  DNA damage-inducible transcript 3 protein (158-166)
gcccugaucgaccgcauggugaaccuc

SEQ ID NO: 29306 - RNA, 33 nt, Artificial Sequence
  Erlin-2 (214-224)
gcccugaucgaggccgagaagguggcgcagguc

SEQ ID NO: 29307 - RNA, 27 nt, Artificial Sequence
  DNA polymerase alpha subunit B (22-30)
gcccugaucgagaagcucguggagcug

SEQ ID NO: 29308 - RNA, 27 nt, Artificial Sequence
  Thyroid adenoma-associated protein (142-150)
gcccugaucacccgcaucuucggcgug

SEQ ID NO: 29309 - RNA, 27 nt, Artificial Sequence
  Proliferating cell nuclear antigen (18-26)
gcccugaaggaccucaucaacgaggcc

SEQ ID NO: 29310 - RNA, 33 nt, Artificial Sequence
  Eukaryotic translation initiation factor 3 subunit D (439-449)
gcccugcucgccggcagcgaguaccugaagcug

SEQ ID NO: 29311 - RNA, 27 nt, Artificial Sequence
  AP-3 complex subunit delta-1 (461-469)
gcccugcucgacagcgcccaccugcug

SEQ ID NO: 29312 - RNA, 36 nt, Artificial Sequence
  Extended synaptotagmin-2 (137-148)
gcccugcucgaggacgaggagcgcgugguccggcug

SEQ ID NO: 29313 - RNA, 27 nt, Artificial Sequence
  Transportin-1 (689-697)
gcccugcucggcgaccugaccaaggcc

SEQ ID NO: 29314 - RNA, 27 nt, Artificial Sequence
  NudC domain-containing protein 3 (12-20)
gcccugcucggcauccugcagcacgug

SEQ ID NO: 29315 - RNA, 27 nt, Artificial Sequence
  ATP synthase subunit beta, mitochondrial (320-328)
gcccugcucggccgcauccccagcgcc

SEQ ID NO: 29316 - RNA, 27 nt, Artificial Sequence
  Ubiquitin carboxyl-terminal hydrolase 35 (288-296)
gcccugcucaagggccuggccgcggug

SEQ ID NO: 29317 - RNA, 27 nt, Artificial Sequence
  Proline and serine-rich protein 1 (900-908)
gcccugcuccagcaggugcacagcgcc

SEQ ID NO: 29318 - RNA, 27 nt, Artificial Sequence
  Lysine-specific histone demethylase 1A (418-426)
gcccugcucagcggccugcgcgaggcc

SEQ ID NO: 29319 - RNA, 33 nt, Artificial Sequence
  Hsp90 co-chaperone Cdc37 (204-214)
gcccugauggagcagguggcccaccagaccauc

SEQ ID NO: 29320 - RNA, 33 nt, Artificial Sequence
  Ubiquitin-conjugating enzyme E2 S (128-138)
gcccugaacgaggaggccggccgccuccugcug

SEQ ID NO: 29321 - RNA, 27 nt, Artificial Sequence
  Talin-1 (777-785)
gcccugaacgagcuccugcagcacgug

SEQ ID NO: 29322 - RNA, 27 nt, Artificial Sequence
  Kinetochore protein NDC80 homolog (274-282)
gcccugaacgagcagaucgcccgccuc

SEQ ID NO: 29323 - RNA, 27 nt, Artificial Sequence
  Influenza virus NS1A-binding protein (460-468)
gcccugaacggcaagcucuacaucgug

SEQ ID NO: 29324 - RNA, 27 nt, Artificial Sequence
  Integrator complex subunit 4 (235-243)
gcccugcaggagaagcucuggaacgug

SEQ ID NO: 29325 - RNA, 27 nt, Artificial Sequence
  BRISC complex subunit Abro1 (215-223)
gcccugcaggagaaggugcaggccguc

SEQ ID NO: 29326 - RNA, 27 nt, Artificial Sequence
  Enhancer of filamentation 1 (806-814)
gcccugcaggagauggugcaccagguc

SEQ ID NO: 29327 - RNA, 27 nt, Artificial Sequence
  Alpha-taxilin (67-75)
gcccugcgcgacgugagcgaggagcuc

SEQ ID NO: 29328 - RNA, 27 nt, Artificial Sequence
  SET and MYND domain-containing protein 4 (220-228)
gcccugcgcgaggagaacgagcagcuc

SEQ ID NO: 29329 - RNA, 27 nt, Artificial Sequence
  Leucine-rich PPR motif-containing protein, mitochondrial (676-684)
gcccugcgcggcgagaucgagaccgug

SEQ ID NO: 29330 - RNA, 27 nt, Artificial Sequence
  HAUS augmin-like complex subunit 1 (219-227)
gcccugagcgagaagcucgcccgccug

SEQ ID NO: 29331 - RNA, 30 nt, Artificial Sequence
  T-complex protein 1 subunit zeta (162-171)
gcccugagcaaggagggcaucguggcccuc

SEQ ID NO: 29332 - RNA, 27 nt, Artificial Sequence
  Coatomer subunit gamma-1 (159-167)
gcccuggugagcucccuccaccugcug

SEQ ID NO: 29333 - RNA, 30 nt, Artificial Sequence
  Guanine nucleotide-binding protein G(s) subunit alpha isoforms short (142-151)
gcccugugggaggacgagggcgugcgcgcc

SEQ ID NO: 29334 - RNA, 27 nt, Artificial Sequence
  FERM, RhoGEF and pleckstrin domain-containing protein 2 (602-610)
gcccugugggagggccccagcaaggcc

SEQ ID NO: 29335 - RNA, 27 nt, Artificial Sequence
  Mannose-1-phosphate guanyltransferase alpha (254-262)
gcccuguacgccagccgccucuaccug

SEQ ID NO: 29336 - RNA, 27 nt, Artificial Sequence
  Structural maintenance of chromosomes flexible hinge domain-containing protein 1 (656-664)
gcccuguacgacgaggugcgcaccguc

SEQ ID NO: 29337 - RNA, 27 nt, Artificial Sequence
  Asparagine synthetase (glutamine-hydrolyzing) (131-139)
gcccuguacgacaacguggagaagcuc

SEQ ID NO: 29338 - RNA, 27 nt, Artificial Sequence
  A-kinase anchor protein 11 (579-587)
gcccuguaccaccucgccaucaagcug

SEQ ID NO: 29339 - RNA, 30 nt, Artificial Sequence
  tRNA-splicing ligase RtcB homolog (146-155)
gccauguucgaccacauccccgugggcguc

SEQ ID NO: 29340 - RNA, 27 nt, Artificial Sequence
  Sister chromatid cohesion protein PDS5 homolog A (534-542)
gccauguucggcaagcugaugaccauc

SEQ ID NO: 29341 - RNA, 27 nt, Artificial Sequence
  Autophagy-related protein 101 (20-28)
gccaugcuggccgugcuccacaccguc

SEQ ID NO: 29342 - RNA, 33 nt, Artificial Sequence
  ATP-binding cassette sub-family F member 1 (296-306)
gccaugcuggagaacgccagcgacaucaagcuc

SEQ ID NO: 29343 - RNA, 27 nt, Artificial Sequence
  Ankyrin repeat and KH domain-containing protein 1 (1231-1239)
gccaugaacggccacgugcccgccguc

SEQ ID NO: 29344 - RNA, 27 nt, Artificial Sequence
  Phosphopantothenoylcysteine decarboxylase (65-73)
gccaugugggagcaccccaucaccgcc

SEQ ID NO: 29345 - RNA, 30 nt, Artificial Sequence
  Bifunctional methylenetetrahydrofolate dehydrogenase/cyclohydrolase, mitochondrial (270-279)
gccgugaucgacgucggcaucaaccgcgug

SEQ ID NO: 29346 - RNA, 27 nt, Artificial Sequence
  Leucine-rich repeat flightless-interacting protein 2 (349-357)
gaccugaaggaccagauccaggacgug

SEQ ID NO: 29347 - RNA, 27 nt, Artificial Sequence
  ADP-ribosylation factor GTPase-activating protein 3 (152-160)
uucgccagccacgugucccccgagguc

SEQ ID NO: 29348 - RNA, 30 nt, Artificial Sequence
  Plexin-B2 (141-150)
uucaucuucgacgugcacguccacgaggug

SEQ ID NO: 29349 - RNA, 30 nt, Artificial Sequence
  Ankyrin repeat and LEM domain-containing protein 2 (100-109)
uucaucuucgagaagaagcuggcccaggcc

SEQ ID NO: 29350 - RNA, 30 nt, Artificial Sequence
  Signal transducer and activator of transcription 5B (332-341)
uucaucaucgagaagcagcccccgcaggug

SEQ ID NO: 29351 - RNA, 27 nt, Artificial Sequence
  DNA-directed RNA polymerase I subunit RPA2 (31-39)
uucaucaucaacggcaucgagaaggug

SEQ ID NO: 29352 - RNA, 30 nt, Artificial Sequence
  Son of sevenless homolog 1 (444-453)
uucaucauggagggcacccugacccgcgug

SEQ ID NO: 29353 - RNA, 27 nt, Artificial Sequence
  Formin-like protein 1 (47-55)
uucaucaacaucgugguccacagcgug

SEQ ID NO: 29354 - RNA, 27 nt, Artificial Sequence
  Exocyst complex component 4 (169-177)
uucauccaggagaucgagcacgcccug

SEQ ID NO: 29355 - RNA, 27 nt, Artificial Sequence
  26S proteasome non-ATPase regulatory subunit 13 (63-71)
uucaucagcgaguucgagcaccgcgug

SEQ ID NO: 29356 - RNA, 27 nt, Artificial Sequence
  Dystonin (4051-4059)
uucaucugggagaacauccacacccug

SEQ ID NO: 29357 - RNA, 30 nt, Artificial Sequence
  Cytoskeleton-associated protein 5 (478-487)
uuccuggccgacguggacaagcucaagcug

SEQ ID NO: 29358 - RNA, 30 nt, Artificial Sequence
  DNA dC-dU-editing enzyme APOBEC-3F (106-115)
uuccuggccgagcaccccaacgugacccuc

SEQ ID NO: 29359 - RNA, 33 nt, Artificial Sequence
  General transcription factor 3C polypeptide 2 (609-619)
uuccuggcccacgaccaggccgugcgcacccuc

SEQ ID NO: 29360 - RNA, 27 nt, Artificial Sequence
  DCC-interacting protein 13-alpha (225-233)
uuccuggccaacaucggcaccagcgug

SEQ ID NO: 29361 - RNA, 27 nt, Artificial Sequence
  Nucleoside diphosphate kinase 3 (25-33)
uuccuggccgugaagcccgacggcguc

SEQ ID NO: 29362 - RNA, 27 nt, Artificial Sequence
  Basic leucine zipper and W2 domain-containing protein 1 (57-65)
uuccuggacgccagcggcgccaagcuc

SEQ ID NO: 29363 - RNA, 27 nt, Artificial Sequence
  Probable JmjC domain-containing histone demethylation protein 2C (60-68)
uuccuggacgacgugguccacagccuc

SEQ ID NO: 29364 - RNA, 27 nt, Artificial Sequence
  Dipeptidyl peptidase 8 (72-80)
uuccuggacgagaacgugcacuucgcc

SEQ ID NO: 29365 - RNA, 27 nt, Artificial Sequence
  Myotubularin (308-316)
uuccuggacauccacaacauccacgug

SEQ ID NO: 29366 - RNA, 27 nt, Artificial Sequence
  Ubiquitin fusion degradation protein 1 homolog (168-176)
uuccuggacaucaccaaccccaaggcc

SEQ ID NO: 29367 - RNA, 27 nt, Artificial Sequence
  RHO/RAC effector protein (1023-1031)
uuccuggacaagaacgaccacagccuc

SEQ ID NO: 29368 - RNA, 27 nt, Artificial Sequence
  Epidermal growth factor receptor substrate 15-like 1 (67-75)
uuccuggacaagcagggcuucuacgug

SEQ ID NO: 29369 - RNA, 27 nt, Artificial Sequence
  Serine/threonine-protein kinase N1 (458-466)
uuccuggacaacgagcgccacgaggug

SEQ ID NO: 29370 - RNA, 33 nt, Artificial Sequence
  Sphingomyelin phosphodiesterase 4 (86-96)
uuccuggaccccggcgggccgaugaugaagcuc

SEQ ID NO: 29371 - RNA, 30 nt, Artificial Sequence
  Probable dolichyl pyrophosphate Glc1Man9GlcNAc2 alpha-1,3-glucosyltransferase (305-314)
uuccuggaccccaacaacaucccgaaggcc

SEQ ID NO: 29372 - RNA, 27 nt, Artificial Sequence
  trabeculin-alpha (1734-1742)
uuccuggaccagcacggccacaaccuc

SEQ ID NO: 29373 - RNA, 27 nt, Artificial Sequence
  Gamma-tubulin complex component 5 (53-61)
uuccuggacgugaacagccacaagauc

SEQ ID NO: 29374 - RNA, 27 nt, Artificial Sequence
  Bromodomain adjacent to zinc finger domain protein 2A (750-758)
uuccuggagcccgugaacccgcgccuc

SEQ ID NO: 29375 - RNA, 27 nt, Artificial Sequence
  Serine/threonine-protein phosphatase 4 regulatory subunit 3A (581-589)
uuccuguucgagcccguggucaaggcc

SEQ ID NO: 29376 - RNA, 27 nt, Artificial Sequence
  Protein yippee-like 5 (43-51)
uuccuguucaacaagguggucaaccuc

SEQ ID NO: 29377 - RNA, 27 nt, Artificial Sequence
  Protein TASOR (98-106)
uuccuguuccaggagccccgcagcauc

SEQ ID NO: 29378 - RNA, 27 nt, Artificial Sequence
  Protein FAM177A1 (116-124)
uuccugggcgagaagaucgccagcgug

SEQ ID NO: 29379 - RNA, 27 nt, Artificial Sequence
  Meckelin (880-888)
uuccugggcagcuucaucgaccacgug

SEQ ID NO: 29380 - RNA, 30 nt, Artificial Sequence
  60S ribosomal protein L34 (95-104)
uuccugaucgaggagcagaagaucgugguc

SEQ ID NO: 29381 - RNA, 30 nt, Artificial Sequence
  TBCC domain-containing protein 1 (214-223)
uuccugaucgagggcaccaucagccgcgcc

SEQ ID NO: 29382 - RNA, 27 nt, Artificial Sequence
  T-complex protein 1 subunit beta (218-226)
uuccugcucgacaagaagaucggcgug

SEQ ID NO: 29383 - RNA, 33 nt, Artificial Sequence
  Plectin (3718-3728)
uuccugcucgaccccgugaagggcgagcgccug

SEQ ID NO: 29384 - RNA, 27 nt, Artificial Sequence
  GDP-mannose 4,6 dehydratase (9-17)
uuccugcucgagaagggcuacgaggug

SEQ ID NO: 29385 - RNA, 27 nt, Artificial Sequence
  Protein arginine N-methyltransferase 3 (423-431)
uuccugcucgagaagcccuucagcgug

SEQ ID NO: 29386 - RNA, 27 nt, Artificial Sequence
  Unconventional myosin-If (148-156)
uuccugcucgagaagagccgcgugguc

SEQ ID NO: 29387 - RNA, 27 nt, Artificial Sequence
  TBC1 domain family member 9B (187-195)
uuccugcucggcaaggaggugagccug

SEQ ID NO: 29388 - RNA, 33 nt, Artificial Sequence
  Poly (ADP-ribose) polymerase 10 (535-545)
uuccugcucggccccgaggggcagcaccugcug

SEQ ID NO: 29389 - RNA, 30 nt, Artificial Sequence
  Transport and Golgi organization protein 6 homolog (990-999)
uuccugcucggcagcgugguccacgaggug

SEQ ID NO: 29390 - RNA, 27 nt, Artificial Sequence
  Protein transport protein Sec24A (394-402)
uuccugcuccacauccagcagcaggug

SEQ ID NO: 29391 - RNA, 30 nt, Artificial Sequence
  GMP synthase (glutamine-hydrolyzing) (510-519)
uuccugcuccccaucaagaccgugggcguc

SEQ ID NO: 29392 - RNA, 27 nt, Artificial Sequence
  Nuclear pore complex protein Nup133 (610-618)
uuccugauggacuucauccaccaggug

SEQ ID NO: 29393 - RNA, 33 nt, Artificial Sequence
  SHC SH2 domain-binding protein 1 (439-449)
uuccugaugaagaacagcgaccucuacggcgcc

SEQ ID NO: 29394 - RNA, 27 nt, Artificial Sequence
  3-hydroxyacyl-CoA dehydrogenase type-2 (245-253)
uuccugaacggcgaggugauccgccuc

SEQ ID NO: 29395 - RNA, 27 nt, Artificial Sequence
  Translation initiation factor eIF-2B subunit delta (300-308)
uuccugaacaaggagaucaccagcgug

SEQ ID NO: 29396 - RNA, 27 nt, Artificial Sequence
  Ubiquitin-associated protein 2-like (434-442)
uuccugcaggagaagagccccgccgug

SEQ ID NO: 29397 - RNA, 30 nt, Artificial Sequence
  DNA dC-dU-editing enzyme APOBEC-3B (104-113)
uuccugcaggagaacacccacgugcgccuc

SEQ ID NO: 29398 - RNA, 27 nt, Artificial Sequence
  Glutathione S-transferase A4 (87-95)
uuccugcaggaguacaccgugaagcuc

SEQ ID NO: 29399 - RNA, 27 nt, Artificial Sequence
  Proteasome activator complex subunit 4 (673-681)
uuccugcagcccgagcucgugaagcug

SEQ ID NO: 29400 - RNA, 27 nt, Artificial Sequence
  cAMP-dependent protein kinase type I-alpha regulatory subunit (49-57)
uuccugcgcgaguacuucgagcggcuc

SEQ ID NO: 29401 - RNA, 33 nt, Artificial Sequence
  6-phosphofructo-2-kinase/fructose-2,6-bisphosphatase 4 (83-93)
uuccugagcgaggagggcgggcacguggccguc

SEQ ID NO: 29402 - RNA, 30 nt, Artificial Sequence
  DNA dC-dU-editing enzyme APOBEC-3B (107-116)
uuccugagcgagcaccccaacgugacccuc

SEQ ID NO: 29403 - RNA, 33 nt, Artificial Sequence
  Lysine-tRNA ligase (585-595)
uuccugaccgacagcaacaacaucaaggaggug

SEQ ID NO: 29404 - RNA, 27 nt, Artificial Sequence
  Calcium and integrin-binding protein 1 (21-29)
uuccugaccaagcaggagauccuccug

SEQ ID NO: 29405 - RNA, 27 nt, Artificial Sequence
  Zinc transporter ZIP6 (435-443)
uuccugguggagcacguccucacccug

SEQ ID NO: 29406 - RNA, 27 nt, Artificial Sequence
  DDB1- and CUL4-associated factor 15 (73-81)
uuccuguacgccggccacaucuuccuc

SEQ ID NO: 29407 - RNA, 27 nt, Artificial Sequence
  DNA topoisomerase 2-beta (701-709)
uuccuguacgacgacaaccagcgcgug

SEQ ID NO: 29408 - RNA, 30 nt, Artificial Sequence
  Alpha-ketoglutarate-dependent dioxygenase FTO (206-215)
uucauggacccccagaagaugccguaccug

SEQ ID NO: 29409 - RNA, 30 nt, Artificial Sequence
  Serine/threonine-protein phosphatase 6 catalytic subunit (244-253)
uucauguucgacgagaagcuggugaccguc

SEQ ID NO: 29410 - RNA, 27 nt, Artificial Sequence
  U4/U6 small nuclear ribonucleoprotein Prp3 (195-203)
uucaugaacgacgccaucgagaaggcc

SEQ ID NO: 29411 - RNA, 27 nt, Artificial Sequence
  Putative helicase MOV-10 (35-43)
uucguggacggccugaccuucaagguc

SEQ ID NO: 29412 - RNA, 30 nt, Artificial Sequence
  Ubiquitin carboxyl-terminal hydrolase 10 (604-613)
ggcaucuucgggggccacauccgcagcgug

SEQ ID NO: 29413 - RNA, 33 nt, Artificial Sequence
  D13S824E locus (103-113)
ggcauccugaccaaggagcuccugcacagcgug

SEQ ID NO: 29414 - RNA, 27 nt, Artificial Sequence
  CAD protein (445-453)
ggccuggccgacaagguguacuuccuc

SEQ ID NO: 29415 - RNA, 33 nt, Artificial Sequence
  Threonine-tRNA ligase, cytoplasmic (145-155)
ggccuggccgacaacaccgugaucgccaagguc

SEQ ID NO: 29416 - RNA, 27 nt, Artificial Sequence
  Importin-4 (306-314)
ggccuggccccccaccucgagcagauc

SEQ ID NO: 29417 - RNA, 27 nt, Artificial Sequence
  Filamin-B (1451-1459)
ggccuggccccccucgaggugcgcguc

SEQ ID NO: 29418 - RNA, 30 nt, Artificial Sequence
  Putative helicase MOV-10 (451-460)
ggccuggacgacaucaaggaccucaaggug

SEQ ID NO: 29419 - RNA, 27 nt, Artificial Sequence
  Probable helicase with zinc finger domain (341-349)
ggccuggaccacuacguguacaagguc

SEQ ID NO: 29420 - RNA, 30 nt, Artificial Sequence
  Rho GTPase-activating protein 12 (126-135)
ggccuggacaucgacgggaucuaccgcgug

SEQ ID NO: 29421 - RNA, 30 nt, Artificial Sequence
  Proline-rich protein 12 (188-197)
ggccuggaccccaacaagccgcccgagcuc

SEQ ID NO: 29422 - RNA, 30 nt, Artificial Sequence
  WD repeat-containing protein 70 (189-198)
ggccuggaccccagcggggcccgccucgug

SEQ ID NO: 29423 - RNA, 27 nt, Artificial Sequence
  Hexokinase-1 (818-826)
ggccuggaccgccucaacgugaccguc

SEQ ID NO: 29424 - RNA, 27 nt, Artificial Sequence
  Cleavage stimulation factor subunit 3 (220-228)
ggccuggaccgcaacgcccccagcgug

SEQ ID NO: 29425 - RNA, 27 nt, Artificial Sequence
  Nischarin (1238-1246)
ggccuguucgaccagcacuuccgccuc

SEQ ID NO: 29426 - RNA, 27 nt, Artificial Sequence
  Targeting protein for Xklp2 (12-20)
ggccuguuccaggggaagaccccccuc

SEQ ID NO: 29427 - RNA, 27 nt, Artificial Sequence
  Protein SPT2 homolog (93-101)
ggccuggggcccccgggccgcagcgug

SEQ ID NO: 29428 - RNA, 24 nt, Artificial Sequence
  Bardet-Biedl syndrome 1 protein (382-389)
ggccuggggcccaccuucaagcuc

SEQ ID NO: 29429 - RNA, 27 nt, Artificial Sequence
  Microtubule-actin cross-linking factor 1, isoforms 1/2/3/5 (195-203)
ggccugaucgaccgccaggugaccguc

SEQ ID NO: 29430 - RNA, 30 nt, Artificial Sequence
  Ubiquitin-like domain-containing CTD phosphatase 1 (225-234)
ggccugaucgacgugaagccccucgggguc

SEQ ID NO: 29431 - RNA, 27 nt, Artificial Sequence
  Programmed cell death protein 5 (91-99)
ggccugaucgagauccucaagaaggug

SEQ ID NO: 29432 - RNA, 33 nt, Artificial Sequence
  Na(+)/H(+) exchange regulatory cofactor NHE-RF1 (122-132)
ggccugcucgccggggaccgccugguggagguc

SEQ ID NO: 29433 - RNA, 27 nt, Artificial Sequence
  Trifunctional purine biosynthetic protein adenosine-3 (685-693)
ggccugcucgagaacaucccccgcgug

SEQ ID NO: 29434 - RNA, 30 nt, Artificial Sequence
  Hom s 1 (11-20)
ggccugcucgagaccaccgugcagaagguc

SEQ ID NO: 29435 - RNA, 27 nt, Artificial Sequence
  Tumor necrosis factor receptor superfamily member 10B (362-370)
ggccugauggacaacgagaucaaggug

SEQ ID NO: 29436 - RNA, 27 nt, Artificial Sequence
  Glucocorticoid modulatory element-binding protein 1 (312-320)
ggccugauggacaccgugaagaagguc

SEQ ID NO: 29437 - RNA, 30 nt, Artificial Sequence
  Hydroxyacyl-coenzyme A dehydrogenase, mitochondrial (36-45)
ggccugaugggggccggcaucgcccaggug

SEQ ID NO: 29438 - RNA, 27 nt, Artificial Sequence
  Myocyte-specific enhancer factor 2A (27-35)
ggccugaugaagaaggccuacgagcuc

SEQ ID NO: 29439 - RNA, 27 nt, Artificial Sequence
  Kinetochore protein NDC80 homolog (330-338)
ggccugaacgaggagaucgcccgcgug

SEQ ID NO: 29440 - RNA, 30 nt, Artificial Sequence
  Zinc finger protein 106 (808-817)
ggccugccccgcuucgggaucgagauggug

SEQ ID NO: 29441 - RNA, 27 nt, Artificial Sequence
  Signal recognition particle subunit SRP72 (170-178)
ggccugcaggaggggacccacgagcuc

SEQ ID NO: 29442 - RNA, 30 nt, Artificial Sequence
  Rho GTPase-activating protein 35 (1277-1286)
ggccugagcaccgaggggaucuaccgcgug

SEQ ID NO: 29443 - RNA, 30 nt, Artificial Sequence
  Probable RNA-binding protein 23 (209-218)
ggccugaccgggcagcgccuccugggcgug

SEQ ID NO: 29444 - RNA, 27 nt, Artificial Sequence
  Anamorsin (27-35)
ggccugguggacaagcuccaggcccug

SEQ ID NO: 29445 - RNA, 27 nt, Artificial Sequence
  Anaphase-promoting complex subunit 1 (56-64)
ggccugguggggagccuccaggagguc

SEQ ID NO: 29446 - RNA, 27 nt, Artificial Sequence
  Intraflagellar transport protein 172 homolog (410-418)
ggccugugggaggaggccuaccgcgug

SEQ ID NO: 29447 - RNA, 33 nt, Artificial Sequence
  Protein PRRC2B (1324-1334)
ggccugugggggcccgaggaggagccgcaccuc

SEQ ID NO: 29448 - RNA, 27 nt, Artificial Sequence
  TRPM8 channel-associated factor 1 (327-335)
ggccugugggggcccgugcacgagcuc

SEQ ID NO: 29449 - RNA, 30 nt, Artificial Sequence
  tRNA (adenine(58)-N(1))-methyltransferase non-catalytic subunit TRM6 (83-92)
ggccuguacgaguucccccucaacaaggug

SEQ ID NO: 29450 - RNA, 27 nt, Artificial Sequence
  Long-chain-fatty-acid-CoA ligase 3 (310-318)
ggcauggccgagcgcauccccgagcug

SEQ ID NO: 29451 - RNA, 33 nt, Artificial Sequence
  DNA damage-binding protein 1 (56-66)
ggcauguacgggaagaucgccgugauggagcug

SEQ ID NO: 29452 - RNA, 27 nt, Artificial Sequence
  ORM1-like protein 3 (59-67)
ggcauguacaucuuccugcacaccgug

SEQ ID NO: 29453 - RNA, 33 nt, Artificial Sequence
  WD repeat-containing protein 18 (99-109)
ggcguggccgagagcauccaccugugggagguc

SEQ ID NO: 29454 - RNA, 33 nt, Artificial Sequence
  Putative eukaryotic translation initiation factor 2 subunit 3-like protein (277-287)
ggcguggccgggggcagcauccugaaggggguc

SEQ ID NO: 29455 - RNA, 27 nt, Artificial Sequence
  Chitinase domain-containing protein 1 (236-244)
caccuggccgaggcccuccaccaggcg

SEQ ID NO: 29456 - RNA, 27 nt, Artificial Sequence
  E3 ubiquitin-protein ligase BRE1A (291-299)
caccuggccgaggugcucgagcgcguc

SEQ ID NO: 29457 - RNA, 27 nt, Artificial Sequence
  Protein VPRBP (425-433)
caccuggccaucaagcucgagcaggug

SEQ ID NO: 29458 - RNA, 27 nt, Artificial Sequence
  E3 ubiquitin-protein ligase TRIM22 (73-81)
caccuggccaacaucguggagcgcguc

SEQ ID NO: 29459 - RNA, 27 nt, Artificial Sequence
  Tetratricopeptide repeat protein 17 (671-679)
caccuggacgccaccaagcuccugcug

SEQ ID NO: 29460 - RNA, 27 nt, Artificial Sequence
  Ninein (404-412)
caccugcucgagcgcguggaccagguc

SEQ ID NO: 29461 - RNA, 27 nt, Artificial Sequence
  Golgin subfamily A member 4 (1695-1703)
caccugagcgagcucaacaccaagcug

SEQ ID NO: 29462 - RNA, 27 nt, Artificial Sequence
  Lysine-tRNA ligase (148-156)
caccugaccgacaucacccucaaggug

SEQ ID NO: 29463 - RNA, 27 nt, Artificial Sequence
  Multiple C2 and transmembrane domain-containing protein 1 (245-253)
caccuguggcgcggcaucgugagcauc

SEQ ID NO: 29464 - RNA, 27 nt, Artificial Sequence
  Nucleoside diphosphate-linked moiety X motif 19 (348-356)
caccuguacgacauccacgugaccguc

SEQ ID NO: 29465 - RNA, 27 nt, Artificial Sequence
  Probable helicase senataxin (435-443)
caccuguacagcgaggugaaggagguc

SEQ ID NO: 29466 - RNA, 30 nt, Artificial Sequence
  Folliculin-interacting protein 1 (827-836)
aucaucgccgacauggacaaguggaccgug

SEQ ID NO: 29467 - RNA, 33 nt, Artificial Sequence
  Cofilin-1 (47-57)
aucauccuggaggagggcaaggagauccucgug

SEQ ID NO: 29468 - RNA, 27 nt, Artificial Sequence
  Ras GTPase-activating-like protein IQGAP1 (1071-1079)
auccuggcccccguggucaaggagauc

SEQ ID NO: 29469 - RNA, 27 nt, Artificial Sequence
  26S proteasome non-ATPase regulatory subunit 1 (736-744)
auccuggacgccggcgggcacaacgug

SEQ ID NO: 29470 - RNA, 33 nt, Artificial Sequence
  26S proteasome non-ATPase regulatory subunit 1 (736-746)
auccuggacgccggcgggcacaacgugaccauc

SEQ ID NO: 29471 - RNA, 27 nt, Artificial Sequence
  F-box only protein 8 (162-170)
auccuggacgacagccccaaggagauc

SEQ ID NO: 29472 - RNA, 33 nt, Artificial Sequence
  Melanoma inhibitory activity protein 3 (156-166)
auccuggacgacaccgccaagaaccuccgcgug

SEQ ID NO: 29473 - RNA, 27 nt, Artificial Sequence
  IQ domain-containing protein D (55-63)
auccuggacgaggccaucuacaaggug

SEQ ID NO: 29474 - RNA, 27 nt, Artificial Sequence
  Axin-1 (508-516)
auccuggacgagcacgugcagcgcguc

SEQ ID NO: 29475 - RNA, 33 nt, Artificial Sequence
  Dihydroxyacetone phosphate acyltransferase (106-116)
auccuggacgagaugagccacaagcuccgccug

SEQ ID NO: 29476 - RNA, 27 nt, Artificial Sequence
  Protein DBF4 homolog A (461-469)
auccuggacaucagcgagcacacccuc

SEQ ID NO: 29477 - RNA, 27 nt, Artificial Sequence
  F-box only protein 25 (65-73)
auccuggacaagaucgugcagaagguc

SEQ ID NO: 29478 - RNA, 27 nt, Artificial Sequence
  Hermansky-Pudlak syndrome 5 protein (446-454)
auccuggacagcggcaucuaccgcauc

SEQ ID NO: 29479 - RNA, 30 nt, Artificial Sequence
  Cofilin-1 (48-57)
auccuggaggagggcaaggagauccucgug

SEQ ID NO: 29480 - RNA, 27 nt, Artificial Sequence
  Heat shock protein HSP 90-alpha (394-402)
auccuggagaagaagguggagaagguc

SEQ ID NO: 29481 - RNA, 27 nt, Artificial Sequence
  Guanine nucleotide-binding protein subunit beta-5 (320-328)
auccuguucggccacgagaaccgcgug

SEQ ID NO: 29482 - RNA, 27 nt, Artificial Sequence
  Cytosolic phospholipase A2 (399-407)
auccuguucaaccgcgugcucggcguc

SEQ ID NO: 29483 - RNA, 27 nt, Artificial Sequence
  60S acidic ribosomal protein P1 (15-23)
auccugcacgacgacgaggugaccguc

SEQ ID NO: 29484 - RNA, 27 nt, Artificial Sequence
  ATP-binding cassette sub-family B member 7, mitochondrial (22-30)
auccugauccgcccccucgugagcguc

SEQ ID NO: 29485 - RNA, 33 nt, Artificial Sequence
  Dual specificity mitogen-activated protein kinase kinase 7 (249-259)
auccugcucgacgagcgcggccagaucaagcug

SEQ ID NO: 29486 - RNA, 30 nt, Artificial Sequence
  Lon protease homolog 2, peroxisomal (293-302)
auccugcucgacaacgaccacuacgccaug

SEQ ID NO: 29487 - RNA, 27 nt, Artificial Sequence
  Protein virilizer homolog (532-540)
auccugcucgaccagaccgugcgcguc

SEQ ID NO: 29488 - RNA, 27 nt, Artificial Sequence
  Histone-lysine N-methyltransferase SETD1A (58-66)
auccugcucgagcacaacuacgcccug

SEQ ID NO: 29489 - RNA, 33 nt, Artificial Sequence
  Beta-adrenergic receptor kinase 1 (32-42)
auccugcuccccgagccgagcauccgcuccgug

SEQ ID NO: 29490 - RNA, 27 nt, Artificial Sequence
  Endosomal/lysomomal potassium channel TMEM175 (218-226)
auccugcuccccuacgugagcaagguc

SEQ ID NO: 29491 - RNA, 33 nt, Artificial Sequence
  Serine/threonine-protein kinase TAO2 (157-167)
auccugcucagcgagcccggccuggugaagcug

SEQ ID NO: 29492 - RNA, 33 nt, Artificial Sequence
  60S ribosomal protein L19 (118-128)
auccugauggagcacauccacaagcucaaggcc

SEQ ID NO: 29493 - RNA, 27 nt, Artificial Sequence
  Pre-mRNA-splicing factor ATP-dependent RNA helicase DHX15 (271-279)
auccugaugggcgugcucaaggagguc

SEQ ID NO: 29494 - RNA, 27 nt, Artificial Sequence
  Cohesin subunit SA-2 (794-802)
auccugaugaucuucagccaccagauc

SEQ ID NO: 29495 - RNA, 27 nt, Artificial Sequence
  Epidermal growth factor receptor substrate 15 (67-75)
auccugaacaagcaggaguucuucgug

SEQ ID NO: 29496 - RNA, 27 nt, Artificial Sequence
  Cell division control protein 6 homolog (354-362)
auccugcaggaccgccucaaccaggug

SEQ ID NO: 29497 - RNA, 27 nt, Artificial Sequence
  AT-rich interactive domain-containing protein 4B (796-804)
auccugcaggagaagcuccaggagauc

SEQ ID NO: 29498 - RNA, 27 nt, Artificial Sequence
  Transcription activator BRG1 (366-374)
auccugcaggagcgcgaguaccggcuc

SEQ ID NO: 29499 - RNA, 27 nt, Artificial Sequence
  Putative eukaryotic translation initiation factor 2 subunit 3-like protein (187-195)
auccugcagaacaagaucgaccucgug

SEQ ID NO: 29500 - RNA, 27 nt, Artificial Sequence
  Ankyrin repeat and SOCS box protein 3 (486-494)
auccugcagcagcacaucgccaccgug

SEQ ID NO: 29501 - RNA, 27 nt, Artificial Sequence
  Poly (ADP-ribose) polymerase 1 (712-720)
auccugagcgaggugcagcaggccguc

SEQ ID NO: 29502 - RNA, 27 nt, Artificial Sequence
  Ribonucleases P/MRP protein subunit POP1 (442-450)
auccugaccgaggccaucaaggccgcg

SEQ ID NO: 29503 - RNA, 27 nt, Artificial Sequence
  Translin-associated protein X (86-94)
auccugaccgagagcgagaucaagcuc

SEQ ID NO: 29504 - RNA, 27 nt, Artificial Sequence
  Phosphotriesterase-related protein (316-324)
auccugaccaacgugguccccaagaug

SEQ ID NO: 29505 - RNA, 27 nt, Artificial Sequence
  T-complex protein 1 subunit eta (186-194)
auccuguacgacaagcucgagaagauc

SEQ ID NO: 29506 - RNA, 27 nt, Artificial Sequence
  Methionine adenosyltransferase 2 subunit beta (184-192)
auccuguacggcgagguggagaagcuc

SEQ ID NO: 29507 - RNA, 27 nt, Artificial Sequence
  Chromosome transmission fidelity protein 8 homolog (58-66)
auccuguacggcaagaucauccaccuc

SEQ ID NO: 29508 - RNA, 33 nt, Artificial Sequence
  Catenin alpha-1 (549-559)
aucauggcccagcugccccaggagcagaaggcc

SEQ ID NO: 29509 - RNA, 27 nt, Artificial Sequence
  Ras GTPase-activating-like protein IQGAP1 (1079-1087)
aucauggacgacaagagccugaacauc

SEQ ID NO: 29510 - RNA, 27 nt, Artificial Sequence
  Staphylococcal nuclease domain-containing protein 1 (665-673)
aucaccgacgaccugcacuucuacgug

SEQ ID NO: 29511 - RNA, 27 nt, Artificial Sequence
  Splicing factor 3A subunit 1 (52-60)
aucguggacaagaccgccagcuucguc

SEQ ID NO: 29512 - RNA, 33 nt, Artificial Sequence
  Probable JmjC domain-containing histone demethylation protein 2C (2276-2286)
aucgugcugcccgccggcgcccuccaccagguc

SEQ ID NO: 29513 - RNA, 27 nt, Artificial Sequence
  Aurora kinase B (242-250)
aagaucgccgacuucggcuggagcgug

SEQ ID NO: 29514 - RNA, 30 nt, Artificial Sequence
  DNA topoisomerase 2-alpha (83-92)
aagaucuucgacgagauccuggugaacgcc

SEQ ID NO: 29515 - RNA, 30 nt, Artificial Sequence
  Vam6/Vps39-like protein (471-480)
aagaucuucaccgaggaccugcccgaggug

SEQ ID NO: 29516 - RNA, 30 nt, Artificial Sequence
  B-Raf serine/threonine-protein (638-647)
aagaucggcgacuucgggcuggccaccgug

SEQ ID NO: 29517 - RNA, 27 nt, Artificial Sequence
  Kelch-like protein 13 (131-139)
aagaucaucgacuucaucuacaccgcc

SEQ ID NO: 29518 - RNA, 27 nt, Artificial Sequence
  Interleukin-6 receptor subunit beta (362-370)
aagauccuggacuacgaggugacccuc

SEQ ID NO: 29519 - RNA, 27 nt, Artificial Sequence
  Ankyrin repeat domain-containing protein 17 (748-756)
aagauccuggaggagcuccagaaggug

SEQ ID NO: 29520 - RNA, 27 nt, Artificial Sequence
  Protein IWS1 homolog (639-647)
aagauccugcaggagcuccccagcgug

SEQ ID NO: 29521 - RNA, 27 nt, Artificial Sequence
  G2/M phase-specific E3 ubiquitin-protein ligase (105-113)
aagauccugagcgagcucuucaccgug

SEQ ID NO: 29522 - RNA, 27 nt, Artificial Sequence
  Adenomatous polyposis coli protein (1645-1653)
aagaucauggaccaggugcagcaggcc

SEQ ID NO: 29523 - RNA, 33 nt, Artificial Sequence
  Flotillin-2 (57-67)
aagaucaugaccgagaaggagcugcucgccgug

SEQ ID NO: 29524 - RNA, 27 nt, Artificial Sequence
  Calpastatin (416-424)
aagcuggccgccgcgaucagcgaggug

SEQ ID NO: 29525 - RNA, 33 nt, Artificial Sequence
  Transitional endoplasmic reticulum ATPase (17-27)
aagcuggccgacgacguggaccucgagcagguc

SEQ ID NO: 29526 - RNA, 30 nt, Artificial Sequence
  Cyclin-dependent kinase 9 (164-173)
aagcuggccgacuucggccucgcccgcgcg

SEQ ID NO: 29527 - RNA, 30 nt, Artificial Sequence
  E3 ubiquitin-protein ligase listerin (404-413)
aagcuggccgacaucagcaucaacuacgug

SEQ ID NO: 29528 - RNA, 27 nt, Artificial Sequence
  Guanosine-3',5'-bis(diphosphate) 3'-pyrophosphohydrolase MESH1 (119-127)
aagcuggccgacaagcucuacaaccug

SEQ ID NO: 29529 - RNA, 27 nt, Artificial Sequence
  Protein PRR14L (1063-1071)
aagcuggccgagggcgugcucgacguc

SEQ ID NO: 29530 - RNA, 27 nt, Artificial Sequence
  MAP kinase-activated protein kinase 5 (452-460)
aagcuggccgagaucgugaagcagguc

SEQ ID NO: 29531 - RNA, 27 nt, Artificial Sequence
  Nck-associated protein 1 (12-20)
aagcuggccgagaagcucaccauccug

SEQ ID NO: 29532 - RNA, 30 nt, Artificial Sequence
  Nuclear poreoprotein p62 (435-444)
aagcuggccgagaacaucgacgcccagcuc

SEQ ID NO: 29533 - RNA, 27 nt, Artificial Sequence
  FACT complex subunit SPT16 (216-224)
aagcuggccgagagcguggagaaggcc

SEQ ID NO: 29534 - RNA, 27 nt, Artificial Sequence
  Transcription factor BTF3 (54-62)
aagcuggccaagcuccaggcccaggug

SEQ ID NO: 29535 - RNA, 27 nt, Artificial Sequence
  DNA excision repair protein ERCC-6-like (655-663)
aagcuggacgagcacaucgccuaccuc

SEQ ID NO: 29536 - RNA, 33 nt, Artificial Sequence
  DNA topoisomerase 2-alpha (278-288)
aagcuggacgagaccggcaacagccucaaggug

SEQ ID NO: 29537 - RNA, 33 nt, Artificial Sequence
  Kelch repeat and BTB domain-containing protein 4 (508-518)
aagcuggaccccgccaccagcgccgugaccguc

SEQ ID NO: 29538 - RNA, 27 nt, Artificial Sequence
  N-acetylneuraminate lyase (77-85)
aagcuggaccaggugaucauccacguc

SEQ ID NO: 29539 - RNA, 27 nt, Artificial Sequence
  DENN domain-containing protein 4C (705-713)
aagcuguucgaccgcccccaggagcuc

SEQ ID NO: 29540 - RNA, 33 nt, Artificial Sequence
  DENN domain-containing protein 4C (705-715)
aagcuguucgaccgcccccaggagcucaagcug

SEQ ID NO: 29541 - RNA, 27 nt, Artificial Sequence
  Fatty acyl-CoA reductase 2 (63-71)
aagcuguucgagaaggugaaggagguc

SEQ ID NO: 29542 - RNA, 27 nt, Artificial Sequence
  Putative homeodomain transcription factor 2 (586-594)
aagcuguucggccaccucaccagcgcc

SEQ ID NO: 29543 - RNA, 27 nt, Artificial Sequence
  28S ribosomal protein S33, mitochondrial (35-43)
aagcuguucagcgagcucccccuggcc

SEQ ID NO: 29544 - RNA, 27 nt, Artificial Sequence
  Hom s 1 (129-137)
aagcugggccucaagccccuggaggug

SEQ ID NO: 29545 - RNA, 27 nt, Artificial Sequence
  AP-1 complex subunit beta-1 (147-155)
aagcugcacgacaucaacgcccagcuc

SEQ ID NO: 29546 - RNA, 30 nt, Artificial Sequence
  Guanine nucleotide-binding protein subunit beta-5 (32-41)
aagcugcacgacguggagcuccaccagguc

SEQ ID NO: 29547 - RNA, 27 nt, Artificial Sequence
  RNA-binding protein 4B (59-67)
aagcugcacggcgugaacaucaacguc

SEQ ID NO: 29548 - RNA, 30 nt, Artificial Sequence
  Zinc finger protein 143 (59-68)
aagcugaucgacggccaggugauccagcuc

SEQ ID NO: 29549 - RNA, 27 nt, Artificial Sequence
  cAMP-responsive element modulator (103-111)
aagcugaucgaggagcucgagacccug

SEQ ID NO: 29550 - RNA, 30 nt, Artificial Sequence
  Elongation factor 2 (314-323)
aagcugaucgagaagcucgacaucaagcug

SEQ ID NO: 29551 - RNA, 27 nt, Artificial Sequence
  WD repeat-containing protein 43 (416-424)
aagcugauccuccugaucacccaggug

SEQ ID NO: 29552 - RNA, 27 nt, Artificial Sequence
  CTD small phosphatase-like protein 2 (434-442)
aagcugauccccuuccucgagaagcug

SEQ ID NO: 29553 - RNA, 27 nt, Artificial Sequence
  Ras-related GTP-binding protein C (235-243)
aagcugaucccccagcucccgacccug

SEQ ID NO: 29554 - RNA, 27 nt, Artificial Sequence
  DNA repair and recombination protein RAD54B (649-657)
aagcugcucgccgugauccacgagcug

SEQ ID NO: 29555 - RNA, 39 nt, Artificial Sequence
  HIV Tat-specific factor 1 (199-211)
aagcugcucgacgaggacgagauccgcggcuacaagcug

SEQ ID NO: 29556 - RNA, 33 nt, Artificial Sequence
  Negative elongation factor A (255-265)
aagcugcucgacaucagcgagcuggacauggug

SEQ ID NO: 29557 - RNA, 27 nt, Artificial Sequence
  Integrator complex subunit 4 (341-349)
aagcugcucgaccugaugccccgccug

SEQ ID NO: 29558 - RNA, 33 nt, Artificial Sequence
  Rho-associated protein kinase 1 (1093-1103)
aagcugcucgaccugagcgacuccaccagcgug

SEQ ID NO: 29559 - RNA, 27 nt, Artificial Sequence
  E3 ISG15-protein ligase HERC5 (795-803)
aagcugcucgaccagaugcccagccug

SEQ ID NO: 29560 - RNA, 27 nt, Artificial Sequence
  T-complex protein 1 subunit eta (55-63)
aagcugcucgacgugguccaccccgcc

SEQ ID NO: 29561 - RNA, 27 nt, Artificial Sequence
  Renal cancer differentiation gene 1 protein (69-77)
aagcugcucgaggccaccagcgccgug

SEQ ID NO: 29562 - RNA, 30 nt, Artificial Sequence
  E3 ubiquitin-protein ligase UBR4 (335-344)
aagcugcucgaggagcagggcaucuuccug

SEQ ID NO: 29563 - RNA, 36 nt, Artificial Sequence
  Prolyl 4-hydroxylase subunit alpha-1 (230-241)
aagcugcucgagcuggaccccgagcaccagcgcgcc

SEQ ID NO: 29564 - RNA, 30 nt, Artificial Sequence
  Archaemetzincin-2 (125-134)
aagcugcucgagcccgugccggucagcgug

SEQ ID NO: 29565 - RNA, 27 nt, Artificial Sequence
  EH domain-binding protein 1 (684-692)
aagcugcucgaggugcagccccagguc

SEQ ID NO: 29566 - RNA, 27 nt, Artificial Sequence
  Hyaluronan mediated motility receptor (233-241)
aagcugcucgaguacaucgaggagauc

SEQ ID NO: 29567 - RNA, 27 nt, Artificial Sequence
  Conserved oligomeric Golgi complex subunit 5 (336-344)
aagcugauggaccacaucuacgccgug

SEQ ID NO: 29568 - RNA, 30 nt, Artificial Sequence
  Proliferating cell nuclear antigen (117-126)
aagcugauggaccucgacguggagcagcug

SEQ ID NO: 29569 - RNA, 27 nt, Artificial Sequence
  Dolichyl-diphosphooligosaccharide-proteinosyltransferase subunit STT3A (289-297)
aagcugaacccccagcaguucgaggug

SEQ ID NO: 29570 - RNA, 27 nt, Artificial Sequence
  Ribosomal L1 domain-containing protein 1 (242-250)
aagcugcccgagaagugggagagcgug

SEQ ID NO: 29571 - RNA, 27 nt, Artificial Sequence
  Regulator of G-protein signaling 10 (129-137)
aagcugcaggaccagaucuucaaccuc

SEQ ID NO: 29572 - RNA, 27 nt, Artificial Sequence
  Nesprin-2 (2292-2300)
aagcugcaggagcucgagaaccgccug

SEQ ID NO: 29573 - RNA, 27 nt, Artificial Sequence
  Signal transducer and activator of transcription 1-alpha/beta (350-358)
aagcugcaggagcucaacuacaaccug

SEQ ID NO: 29574 - RNA, 27 nt, Artificial Sequence
  Protein Jade-2 (282-290)
aagcugcaggagcagaucuuccaccuc

SEQ ID NO: 29575 - RNA, 27 nt, Artificial Sequence
  DNA-directed RNA polymerase II subunit RPB3 (255-263)
aagcugagcgaccuccagacccagcug

SEQ ID NO: 29576 - RNA, 27 nt, Artificial Sequence
  Probable tRNA N6-adenosine threonylcarbamoyltransferase (189-197)
aagcugguggagcuccccuacaccguc

SEQ ID NO: 29577 - RNA, 27 nt, Artificial Sequence
  Electron transfer flavoprotein subunit beta (147-155)
aagcuggugaaggaggucaucgccgug

SEQ ID NO: 29578 - RNA, 27 nt, Artificial Sequence
  Protein Mis18-alpha (218-226)
aagcugugggaggccgagagcaagcuc

SEQ ID NO: 29579 - RNA, 27 nt, Artificial Sequence
  Phosphatidylinositol 4-kinase beta (788-796)
aagcuguacgacggcuuccaguaccuc

SEQ ID NO: 29580 - RNA, 27 nt, Artificial Sequence
  Cytochrome P450 20A1 (274-282)
aagcuguacgaggagaucaaccaggug

SEQ ID NO: 29581 - RNA, 27 nt, Artificial Sequence
  Delta(24)-sterol reductase (287-295)
aagcuguacgagcagcaccacgugguc

SEQ ID NO: 29582 - RNA, 30 nt, Artificial Sequence
  Ectopic P granules protein 5 homolog (225-234)
aagcuguacccccagcucccggccgagauc

SEQ ID NO: 29583 - RNA, 27 nt, Artificial Sequence
  CCAAT/enhancer-binding protein zeta (211-219)
aagcuguaccagcacgagaucaaccuc

SEQ ID NO: 29584 - RNA, 39 nt, Artificial Sequence
  Stathmin (95-107)
aagauggccgaggagaagcugacccacaagauggaggcc

SEQ ID NO: 29585 - RNA, 27 nt, Artificial Sequence
  MORF4 family-associated protein 1-like 1 (109-117)
aagauggccgagaugcugguggagcuc

SEQ ID NO: 29586 - RNA, 27 nt, Artificial Sequence
  ATP-binding cassette sub-family F member 3 (459-467)
aagaugcuggagaagcuccccgagcug

SEQ ID NO: 29587 - RNA, 27 nt, Artificial Sequence
  Nodal modulator 3 (261-269)
aagaugauggacgugaccgucaccauc

SEQ ID NO: 29588 - RNA, 27 nt, Artificial Sequence
  Proteasome subunit beta type-2 (37-45)
aagaugagcgagaagauccugcuccug

SEQ ID NO: 29589 - RNA, 30 nt, Artificial Sequence
  cAMP-dependent protein kinase type I-beta regulatory subunit (244-253)
aagauguacgaggaguuccugagcaaggug

SEQ ID NO: 29590 - RNA, 27 nt, Artificial Sequence
  Rap1 GTPase-GDP dissociation stimulator 1 (67-75)
aagguggccaacaucaucgccgagguc

SEQ ID NO: 29591 - RNA, 27 nt, Artificial Sequence
  Myosin light polypeptide 6 (69-77)
aaggugcuggacuucgagcacuuccuc

SEQ ID NO: 29592 - RNA, 27 nt, Artificial Sequence
  Probable E3 ubiquitin-protein ligase HERC4 (595-603)
aaggugcuggagauccuccaccgcguc

SEQ ID NO: 29593 - RNA, 33 nt, Artificial Sequence
  Protein SON (298-308)
aaggugcuggagcccagcgagacccucgucgug

SEQ ID NO: 29594 - RNA, 27 nt, Artificial Sequence
  Proteasome activator complex subunit 2 (145-153)
aaggugcuggagcgcgucaacgccgug

SEQ ID NO: 29595 - RNA, 27 nt, Artificial Sequence
  CCR4-NOT transcription complex subunit 1 (128-136)
aaggugcugggcaucgucgugggggug

SEQ ID NO: 29596 - RNA, 27 nt, Artificial Sequence
  Amyloid beta A4 protein (9-17)
cugcucgccgccuggaccgcgcgcgcc

SEQ ID NO: 29597 - RNA, 27 nt, Artificial Sequence
  DNA fragmentation factor subunit beta (69-77)
cugcucgccgaccugcugcacaacgug

SEQ ID NO: 29598 - RNA, 27 nt, Artificial Sequence
  CREB-binding protein (653-661)
cugcucgccgagaagaucuacaagauc

SEQ ID NO: 29599 - RNA, 27 nt, Artificial Sequence
  Nuclear autoantigenic sperm protein (243-251)
cugcucgccgagacccacuaccagcug

SEQ ID NO: 29600 - RNA, 33 nt, Artificial Sequence
  SCAN domain-containing protein 1 (194-204)
cugcucgccauccugcccgaggccgcgcgcgcc

SEQ ID NO: 29601 - RNA, 27 nt, Artificial Sequence
  Cyclin-dependent kinase inhibitor 1C (103-111)
cugcucgccccccgcccgguggccguc

SEQ ID NO: 29602 - RNA, 27 nt, Artificial Sequence
  Protein quaking (40-48)
cugcucgacgaggagaucagccgcgug

SEQ ID NO: 29603 - RNA, 24 nt, Artificial Sequence
  T-complex protein 1 subunit beta (219-226)
cugcucgacaagaagaucggcgug

SEQ ID NO: 29604 - RNA, 33 nt, Artificial Sequence
  ERI1 exoribonuclease 3 (155-165)
cugcucgaccccaacgugaagagcaucuucguc

SEQ ID NO: 29605 - RNA, 27 nt, Artificial Sequence
  Talin-1 (1761-1769)
cugcucgaccagaccaagacccuggcc

SEQ ID NO: 29606 - RNA, 27 nt, Artificial Sequence
  Cyclin-I (72-80)
cugcucgaccgcuuccuggccaccgug

SEQ ID NO: 29607 - RNA, 27 nt, Artificial Sequence
  Tight junction protein ZO-2 (821-829)
cugcucgacgugacccccaaggccguc

SEQ ID NO: 29608 - RNA, 27 nt, Artificial Sequence
  Exocyst complex component 4 (7-15)
cugcucuucgacaaguucaacgccgug

SEQ ID NO: 29609 - RNA, 27 nt, Artificial Sequence
  Heterogeneous nuclear ribonucleoprotein M (229-237)
cugcucuucgaccgccccaugcacgug

SEQ ID NO: 29610 - RNA, 30 nt, Artificial Sequence
  DNA-directed RNA polymerase II subunit RPB11-b1 (11-20)
cugcucuucgagggcgagaagaucaccauc

SEQ ID NO: 29611 - RNA, 27 nt, Artificial Sequence
  Conserved oligomeric Golgi complex subunit 4 (51-59)
cugcucuucgagggcaucgcccgcauc

SEQ ID NO: 29612 - RNA, 27 nt, Artificial Sequence
  Cip1-interacting zinc finger protein (83-91)
cugcucggccccccgcccguggggguc

SEQ ID NO: 29613 - RNA, 24 nt, Artificial Sequence
  Neuferricin (59-66)
cugcucggccgcguguacgacguc

SEQ ID NO: 29614 - RNA, 33 nt, Artificial Sequence
  Cyclin-dependent kinase 1 (134-144)
cugcucaucgacgacaagggcaccaucaagcug

SEQ ID NO: 29615 - RNA, 27 nt, Artificial Sequence
  Nuclear pore complex protein Nup205 (248-256)
cugcucaucggccaccuggagcgcgug

SEQ ID NO: 29616 - RNA, 27 nt, Artificial Sequence
  RCC1 and BTB domain-containing protein 1 (125-133)
cugcucaucaagcagguggucgaggug

SEQ ID NO: 29617 - RNA, 36 nt, Artificial Sequence
  Histone H2B type 2-F (101-112)
cugcuccugcccggcgagcuggccaagcacgccgug

SEQ ID NO: 29618 - RNA, 27 nt, Artificial Sequence
  Eukaryotic translation initiation factor 3 subunit H (242-250)
cugcucauggaccgcguggacgagaug

SEQ ID NO: 29619 - RNA, 27 nt, Artificial Sequence
  CDK5 regulatory subunit-associated protein 2 (1394-1402)
cugcucauggagcacauccaggagauc

SEQ ID NO: 29620 - RNA, 27 nt, Artificial Sequence
  Zinc finger SWIM domain-containing protein 1 (234-242)
cugcucaacgaccgcaucuggcuggcc

SEQ ID NO: 29621 - RNA, 27 nt, Artificial Sequence
  DNA-directed RNA polymerase II subunit RPB4 (32-40)
cugcucaacagcgaggugcacaugcug

SEQ ID NO: 29622 - RNA, 27 nt, Artificial Sequence
  Rho guanine nucleotide exchange factor 2 (627-635)
cugcuccaggacgccauccgcgaggug

SEQ ID NO: 29623 - RNA, 27 nt, Artificial Sequence
  Vam6/Vps39-like protein (218-226)
cugcuccaggacaagcaguucgagcug

SEQ ID NO: 29624 - RNA, 27 nt, Artificial Sequence
  E3 ubiquitin-protein ligase TRIM37 (221-229)
cugcuccaggagguggagcaccagcug

SEQ ID NO: 29625 - RNA, 27 nt, Artificial Sequence
  DEP domain-containing protein 1A (20-28)
cugcuccagccccaccuggagcgcgug

SEQ ID NO: 29626 - RNA, 27 nt, Artificial Sequence
  Small nuclear ribonucleoprotein Sm D1 (38-46)
cugcucguggacgucgagcccaaggug

SEQ ID NO: 29627 - RNA, 30 nt, Artificial Sequence
  Lipopolysaccharide-responsive and beige-like anchor protein (407-416)
cugcucuacgacggcaagcugagcuccgcc

SEQ ID NO: 29628 - RNA, 33 nt, Artificial Sequence
  Electron transfer flavoprotein subunit alpha, mitochondrial (184-194)
cugcucuacgaccuggccgaccagcugcacgcc

SEQ ID NO: 29629 - RNA, 27 nt, Artificial Sequence
  Solute carrier family 43 member 3 (191-199)
cugcucuacgagaagggcaucagccug

SEQ ID NO: 29630 - RNA, 30 nt, Artificial Sequence
  Integrin alpha-4 (42-51)
cugcucuaccagggcccccacaacacccug

SEQ ID NO: 29631 - RNA, 30 nt, Artificial Sequence
  Uridine-cytidine kinase-like 1 (470-479)
cugauggccgagaugggcgugcacagcguc

SEQ ID NO: 29632 - RNA, 27 nt, Artificial Sequence
  KH domain-containing, RNA-binding, signal transduction-associated protein 1 (243-251)
cugauggcccacgccauggaggaggug

SEQ ID NO: 29633 - RNA, 27 nt, Artificial Sequence
  Rho guanine nucleotide exchange factor 18 (267-275)
cugaugcagaccgaggugcaccacguc

SEQ ID NO: 29634 - RNA, 27 nt, Artificial Sequence
  Steroid receptor RNA activator 1 (183-191)
cugaugguggaccacgucaccgaggug

SEQ ID NO: 29635 - RNA, 30 nt, Artificial Sequence
  Cytochrome c oxidase subunit 7C, mitochondrial (54-63)
cuggugguccgccaccagcuccugaagacc

SEQ ID NO: 29636 - RNA, 27 nt, Artificial Sequence
  EH domain-containing protein 1 (385-393)
augcuggccaacgacaucgcccgccuc

SEQ ID NO: 29637 - RNA, 27 nt, Artificial Sequence
  Ubiquitin carboxyl-terminal hydrolase 11 (568-576)
augcuguucggccacccccuccuggug

SEQ ID NO: 29638 - RNA, 27 nt, Artificial Sequence
  Flotillin-1 (356-364)
augcugcucgagaagcugccccaggug

SEQ ID NO: 29639 - RNA, 27 nt, Artificial Sequence
  Breast cancer type 1 susceptibility protein (1657-1665)
augcugaacgagcacgacuucgaggug

SEQ ID NO: 29640 - RNA, 27 nt, Artificial Sequence
  trim5alpha (75-83)
aacaucguggagaagcugcgcgagguc

SEQ ID NO: 29641 - RNA, 27 nt, Artificial Sequence
  E3 ubiquitin-protein ligase TRIM22 (76-84)
aacaucguggagcgcgucaaggaggug

SEQ ID NO: 29642 - RNA, 27 nt, Artificial Sequence
  Ral GTPase-activating protein subunit beta (190-198)
aaccuggccgagaagcucaucggcgug

SEQ ID NO: 29643 - RNA, 27 nt, Artificial Sequence
  F-box only protein 22 (24-32)
aaccuggccgagguggucgagcgcgug

SEQ ID NO: 29644 - RNA, 27 nt, Artificial Sequence
  Glycerol-3-phosphate dehydrogenase, mitochondrial (146-154)
aaccugcucgagaucgccccccaccug

SEQ ID NO: 29645 - RNA, 27 nt, Artificial Sequence
  Propionyl-CoA carboxylase beta chain, mitochondrial (27-35)
aacaugguggacaucauccacagcguc

SEQ ID NO: 29646 - RNA, 27 nt, Artificial Sequence
  Transcription elongation factor SPT5 (558-566)
aacauguacggcaagguggucaccgug

SEQ ID NO: 29647 - RNA, 30 nt, Artificial Sequence
  Utrophin (2315-2324)
aaccagugggacggcacccagcacggggug

SEQ ID NO: 29648 - RNA, 39 nt, Artificial Sequence
  Melanocyte protein PMEL (45-57)
aaccgccagcuguaccccgaguggaccgaggcccagcgg

SEQ ID NO: 29649 - RNA, 27 nt, Artificial Sequence
  60S ribosomal protein L35 (20-28)
cagcuggacgaccucaagguggagcug

SEQ ID NO: 29650 - RNA, 27 nt, Artificial Sequence
  SNARE-associated protein Snapin (39-47)
cagcuggacagccacgugcacgccguc

SEQ ID NO: 29651 - RNA, 27 nt, Artificial Sequence
  Testis-expressed sequence 10 protein (575-583)
cagcugaucgacaucauccacaccgcc

SEQ ID NO: 29652 - RNA, 27 nt, Artificial Sequence
  SEC14-like protein 1 (559-567)
cagcugaucgacaagguguggcagcuc

SEQ ID NO: 29653 - RNA, 27 nt, Artificial Sequence
  Ethylmalonyl-CoA decarboxylase (79-87)
cagcugcucgagaaggugaucgagcug

SEQ ID NO: 29654 - RNA, 27 nt, Artificial Sequence
  HEAT repeat-containing protein 2 (843-851)
cagcugcuccagcacgugcaggccguc

SEQ ID NO: 29655 - RNA, 27 nt, Artificial Sequence
  60S ribosomal protein L6 (267-275)
cagcugcagggcuaccuccgcagcgug

SEQ ID NO: 29656 - RNA, 27 nt, Artificial Sequence
  Mitochondrial dynamics protein MID51 (384-392)
cagcugaccaacgugauccuccaccug

SEQ ID NO: 29657 - RNA, 27 nt, Artificial Sequence
  Casein kinase I isoform delta (111-119)
cagaugaucagccgcaucgaguacauc

SEQ ID NO: 29658 - RNA, 33 nt, Artificial Sequence
  Zinc finger protein 131 (113-123)
cagaugcuggaggccaucaaggcccucgaggug

SEQ ID NO: 29659 - RNA, 27 nt, Artificial Sequence
  40S ribosomal protein S8 (77-85)
cgcaucaucgacguggucuacaacgcc

SEQ ID NO: 29660 - RNA, 33 nt, Artificial Sequence
  CCR4-NOT transcription complex subunit 1 (459-469)
cgccuggccgaggugggccaguacgagcagguc

SEQ ID NO: 29661 - RNA, 27 nt, Artificial Sequence
  DNA replication licensing factor MCM7 (164-172)
cgccuggcccagcacaucaccuacgug

SEQ ID NO: 29662 - RNA, 27 nt, Artificial Sequence
  Vacuolar protein sorting-associated protein 53 homolog (74-82)
cgccuggacgacaacauccggaccgug

SEQ ID NO: 29663 - RNA, 33 nt, Artificial Sequence
  Putative sodium-coupled neutral amino acid transporter 10 (413-423)
cgccugggcgaggccgaggggcucaugaaggug

SEQ ID NO: 29664 - RNA, 30 nt, Artificial Sequence
  Protein quaking (39-48)
cgccugcucgacgaggagaucagccgggug

SEQ ID NO: 29665 - RNA, 27 nt, Artificial Sequence
  CLIP-associating protein 1 (367-375)
cgccugcucgacggcgccuucaagcug

SEQ ID NO: 29666 - RNA, 27 nt, Artificial Sequence
  KN motif and ankyrin repeat domain-containing protein 2 (654-662)
cgccugcucgacuacguggucaacauc

SEQ ID NO: 29667 - RNA, 33 nt, Artificial Sequence
  Pyridoxal-dependent decarboxylase domain-containing protein 1 (630-640)
cgccugcucgaggagggcgugcugcggcagauc

SEQ ID NO: 29668 - RNA, 27 nt, Artificial Sequence
  Pinin (207-215)
cgccugcucgagcagaagguggagcug

SEQ ID NO: 29669 - RNA, 27 nt, Artificial Sequence
  E3 ubiquitin-protein ligase RNF213 (4648-4656)
cgccugcuccaggagcagcaccagcug

SEQ ID NO: 29670 - RNA, 27 nt, Artificial Sequence
  V-type proton ATPase subunit H (382-390)
cgccugaacgagaagaacuacgagcuc

SEQ ID NO: 29671 - RNA, 27 nt, Artificial Sequence
  Cytospin-A (639-647)
cgccugcaggacgccaucgccaaggug

SEQ ID NO: 29672 - RNA, 30 nt, Artificial Sequence
  Ubiquitin-conjugating enzyme E2 A (15-24)
cgccugcaggaggaccccccggccggcgug

SEQ ID NO: 29673 - RNA, 30 nt, Artificial Sequence
  Ubiquitin-conjugating enzyme E2 B (15-24)
cgccugcaggaggaccccccggugggcguc

SEQ ID NO: 29674 - RNA, 27 nt, Artificial Sequence
  Inhibitor of nuclear factor kappa-B kinase-interacting protein (38-46)
cgccugcaggaggagaucaacgaggug

SEQ ID NO: 29675 - RNA, 27 nt, Artificial Sequence
  Double-strand-break repair protein rad21 homolog (450-458)
cgccugcaggagagcgugauggaggcc

SEQ ID NO: 29676 - RNA, 30 nt, Artificial Sequence
  SHC SH2 domain-binding protein 1 (594-603)
cgccugagcgagcucggcaucacccaggcc

SEQ ID NO: 29677 - RNA, 27 nt, Artificial Sequence
  PRA1 family protein 3 (178-186)
cgccugaccgacuacaucagcaaggug

SEQ ID NO: 29678 - RNA, 27 nt, Artificial Sequence
  Eukaryotic translation initiation factor 3 subunit H (165-173)
cgccugacccccaagcucauggaggug

SEQ ID NO: 29679 - RNA, 33 nt, Artificial Sequence
  Proliferating cell nuclear antigen (5-15)
cgccuggugcagggcagcauccucaagaagguc

SEQ ID NO: 29680 - RNA, 27 nt, Artificial Sequence
  DEP domain-containing protein 1B (15-23)
cgccuguggaacgagaccguggagcuc

SEQ ID NO: 29681 - RNA, 27 nt, Artificial Sequence
  DNA damage-binding protein 1 (134-142)
cgccuguacgacggccucuucaaggug

SEQ ID NO: 29682 - RNA, 36 nt, Artificial Sequence
  ATP-binding cassette sub-family B member 10, mitochondrial (542-553)
cgccuguacgaccccgccagcggcaccaucucccuc

SEQ ID NO: 29683 - RNA, 27 nt, Artificial Sequence
  Serine/threonine-protein kinase Kist (287-295)
cgcauguucgacggcaaguucgugguc

SEQ ID NO: 29684 - RNA, 30 nt, Artificial Sequence
  Serine/threonine-protein kinase Kist (287-296)
cgcauguucgacggcaaguucguggucgcc

SEQ ID NO: 29685 - RNA, 36 nt, Artificial Sequence
  Melanocyte protein PMEL (46-57)
cgccagcuguaccccgaguggaccgaggcccagcgg

SEQ ID NO: 29686 - RNA, 42 nt, Artificial Sequence
  Melanocyte protein PMEL (46-59)
cgccagcuguaccccgaguggaccgaggcccagcggcucgac

SEQ ID NO: 29687 - RNA, 54 nt, Artificial Sequence
  Melanocyte protein PMEL (40-57)
cgcaccaaggccuggaaccggcagcuguaccccgaguggaccgaggcccagcgc

SEQ ID NO: 29688 - RNA, 33 nt, Artificial Sequence
  Aurora kinase B (360-370)
cgcgugcugcccccgagcgcccuccaguccguc

SEQ ID NO: 29689 - RNA, 27 nt, Artificial Sequence
  SHC-transforming protein 1 (255-263)
cgcgugcccccgcccccccagagcguc

SEQ ID NO: 29690 - RNA, 27 nt, Artificial Sequence
  Serine/threonine-protein phosphatase PP1-gamma catalytic subunit (7-15)
agcaucauccagcgccugcucgaggug

SEQ ID NO: 29691 - RNA, 27 nt, Artificial Sequence
  Eukaryotic translation initiation factor 2 subunit 1 (110-118)
agcauccugcgccacguggccgagguc

SEQ ID NO: 29692 - RNA, 27 nt, Artificial Sequence
  Anaphase-promoting complex subunit 7 (276-284)
agccuggccgaccucuacuuccgcgcc

SEQ ID NO: 29693 - RNA, 27 nt, Artificial Sequence
  TATA-binding protein-associated factor 172 (784-792)
agccuggccgacgugcacaucgagguc

SEQ ID NO: 29694 - RNA, 27 nt, Artificial Sequence
  2'-5'-oligoadenylate synthase 3 (247-255)
agccuggccgagggccuccgcaccgug

SEQ ID NO: 29695 - RNA, 27 nt, Artificial Sequence
  LisH domain-containing protein ARMC9 (400-408)
agccuggccgagggccgccucuaccug

SEQ ID NO: 29696 - RNA, 27 nt, Artificial Sequence
  Ankyrin repeat and SOCS box protein 6 (353-361)
agccuggccgagaagauccaggcccuc

SEQ ID NO: 29697 - RNA, 30 nt, Artificial Sequence
  DNA polymerase epsilon catalytic subunit A (943-952)
agccuggccgagcucaagggcuucgaggug

SEQ ID NO: 29698 - RNA, 27 nt, Artificial Sequence
  Sestrin-1 (129-137)
agccuggccgagcucgugcacgccguc

SEQ ID NO: 29699 - RNA, 30 nt, Artificial Sequence
  V-type proton ATPase catalytic subunit A (500-509)
agccuggccgagaccgacaagaucacccuc

SEQ ID NO: 29700 - RNA, 27 nt, Artificial Sequence
  Trinucleotide repeat-containing gene 6A protein (198-206)
agccuggcccacgagcucuggaaggug

SEQ ID NO: 29701 - RNA, 27 nt, Artificial Sequence
  TNFAIP3-interacting protein 2 (146-154)
agccuggccaacgagacccaccagcuc

SEQ ID NO: 29702 - RNA, 27 nt, Artificial Sequence
  Phosphatidylinositol 3-kinase regulatory subunit gamma (63-71)
agccuggcccaguacaaccccaagcuc

SEQ ID NO: 29703 - RNA, 27 nt, Artificial Sequence
  Baculoviral IAP repeat-containing protein 6 (1230-1238)
agccuggccucccuccuggccaaggug

SEQ ID NO: 29704 - RNA, 27 nt, Artificial Sequence
  TELO2-interacting protein 1 homolog (380-388)
agccuggccaccucccucccccgccug

SEQ ID NO: 29705 - RNA, 27 nt, Artificial Sequence
  Leucine-rich repeat and coiled-coil domain-containing protein 1 (37-45)
agccuggacuccacccuccacgccgug

SEQ ID NO: 29706 - RNA, 30 nt, Artificial Sequence
  Transmembrane emp24 domain-containing protein 9 (130-139)
agccuguucgccggcgggaugcuccgcgug

SEQ ID NO: 29707 - RNA, 30 nt, Artificial Sequence
  F-box/LRR-repeat protein 5 (73-82)
agccuguucgagaagggccucaagaacgug

SEQ ID NO: 29708 - RNA, 27 nt, Artificial Sequence
  Programmed cell death 6-interacting protein (103-111)
agccuguucggcggguccgugaagcuc

SEQ ID NO: 29709 - RNA, 30 nt, Artificial Sequence
  Ribosome production factor 1 (265-274)
agccuguucccccacaacccgcaguucauc

SEQ ID NO: 29710 - RNA, 27 nt, Artificial Sequence
  Exostosin-2 (478-486)
agccuguuccgcgugaucaccgagguc

SEQ ID NO: 29711 - RNA, 24 nt, Artificial Sequence
  Bloom syndrome protein (853-860)
agccugggcaagguguucgggguc

SEQ ID NO: 29712 - RNA, 27 nt, Artificial Sequence
  U1 small nuclear ribonucleoprotein C (24-32)
agccugaucgacaagaccaccgccgcc

SEQ ID NO: 29713 - RNA, 27 nt, Artificial Sequence
  AAC41999.1 (170-178)
agccugaucgagaagauccccaccgcc

SEQ ID NO: 29714 - RNA, 27 nt, Artificial Sequence
  Transcription factor RFX3 (374-382)
agccugaucgagaagcucuggcagacc

SEQ ID NO: 29715 - RNA, 27 nt, Artificial Sequence
  Importin subunit alpha-1 (490-498)
agccugaucgagaaguacuucuccgug

SEQ ID NO: 29716 - RNA, 27 nt, Artificial Sequence
  Ubiquitin carboxyl-terminal hydrolase 34 (1442-1450)
agccugauccagcgccucauguccgug

SEQ ID NO: 29717 - RNA, 27 nt, Artificial Sequence
  Polymerase I and transcript release factor (56-64)
agccugcucgacaagaucaucggcgcc

SEQ ID NO: 29718 - RNA, 30 nt, Artificial Sequence
  Rho guanine nucleotide exchange factor 18 (642-651)
agccugcucgagaagcagcagaucuaccug

SEQ ID NO: 29719 - RNA, 27 nt, Artificial Sequence
  Mediator of RNA polymerase II transcription subunit 12 (1224-1232)
agccugcucgagaacaucgccaaggcc

SEQ ID NO: 29720 - RNA, 27 nt, Artificial Sequence
  Heterogeneous nuclear ribonucleoprotein C-like 1 (196-204)
agccugcucgagaaccuggagaagauc

SEQ ID NO: 29721 - RNA, 27 nt, Artificial Sequence
  Serine/threonine-protein kinase ATR (549-557)
agccugcucgaguccgugcagaagcug

SEQ ID NO: 29722 - RNA, 33 nt, Artificial Sequence
  Neurochondrin (337-347)
agccugcucaaggagccccagaaggugcagcug

SEQ ID NO: 29723 - RNA, 30 nt, Artificial Sequence
  Adrenocortical dysplasia protein homolog (124-133)
agccugcuccccaccgagcagccgcgccug

SEQ ID NO: 29724 - RNA, 27 nt, Artificial Sequence
  Ran GTPase-activating protein 1 (579-587)
agccugcuccagacccuguacaaggug

SEQ ID NO: 29725 - RNA, 27 nt, Artificial Sequence
  Arfaptin-2 (71-79)
agccugcuccagacccagcacgcccug

SEQ ID NO: 29726 - RNA, 30 nt, Artificial Sequence
  Pericentrin (1754-1763)
agccugaugggccccgugguccacgaggug

SEQ ID NO: 29727 - RNA, 27 nt, Artificial Sequence
  Hermansky-Pudlak syndrome 4 protein (573-581)
agccugaacggccucgaggugcaccug

SEQ ID NO: 29728 - RNA, 27 nt, Artificial Sequence
  Choline/ethanolamine kinase (86-94)
agccugcccgaccaccucccguccgug

SEQ ID NO: 29729 - RNA, 27 nt, Artificial Sequence
  WD repeat-containing protein 3 (348-356)
agccugcaggacgagauccagcgcgug

SEQ ID NO: 29730 - RNA, 27 nt, Artificial Sequence
  Peroxisomal membrane protein 4 (59-67)
agccugcaggagaagcucugggccauc

SEQ ID NO: 29731 - RNA, 27 nt, Artificial Sequence
  Dynactin subunit 1 (1169-1177)
agccuguccgacaccguggagaagcuc

SEQ ID NO: 29732 - RNA, 27 nt, Artificial Sequence
  AP-3 complex subunit mu-1 (219-227)
agccuguccuucaugaacccccgccuc

SEQ ID NO: 29733 - RNA, 27 nt, Artificial Sequence
  Alsin (755-763)
agccuguccagcuuccuccacggcgug

SEQ ID NO: 29734 - RNA, 27 nt, Artificial Sequence
  Eukaryotic translation initiation factor 3 subunit F (301-309)
agccuggugaaccagguccccaagauc

SEQ ID NO: 29735 - RNA, 27 nt, Artificial Sequence
  FACT complex subunit SSRP1 (309-317)
agccuguacgagauggugucccgcguc

SEQ ID NO: 29736 - RNA, 27 nt, Artificial Sequence
  Mediator of RNA polymerase II transcription subunit 12 (1349-1357)
agccuguacucccaggugcaccagauc

SEQ ID NO: 29737 - RNA, 27 nt, Artificial Sequence
  RNA-binding protein 28 (53-61)
agcaugcuggaggacgugcagcgcgcc

SEQ ID NO: 29738 - RNA, 27 nt, Artificial Sequence
  Zinc finger MYM-type protein 3 (1346-1354)
agcaugcugaaccgcauccucgccgug

SEQ ID NO: 29739 - RNA, 27 nt, Artificial Sequence
  RNA polymerase II-associated protein 1 (1333-1341)
agcaugcugcagaagaccuggcuccug

SEQ ID NO: 29740 - RNA, 27 nt, Artificial Sequence
  General transcription factor 3C polypeptide 5 (74-82)
agcauguacgacaaggugcugaugcuc

SEQ ID NO: 29741 - RNA, 27 nt, Artificial Sequence
  EH domain-containing protein 4 (482-490)
agcgugcugggcaagaucuggaagcuc

SEQ ID NO: 29742 - RNA, 27 nt, Artificial Sequence
  Huntingtin (111-119)
acccuggccgccgcggugcccaagauc

SEQ ID NO: 29743 - RNA, 27 nt, Artificial Sequence
  Set1/Ash2 histone methyltransferase complex subunit ASH2 (512-520)
acccuggccgacgugcucuaccacguc

SEQ ID NO: 29744 - RNA, 30 nt, Artificial Sequence
  Non-POU domain-containing octamer-binding protein (31-40)
acccuggccgagaucgccaagguggagcuc

SEQ ID NO: 29745 - RNA, 27 nt, Artificial Sequence
  Ancient ubiquitous protein 1 (365-373)
acccuggcccagcgcgugaaggagguc

SEQ ID NO: 29746 - RNA, 27 nt, Artificial Sequence
  Pre-mRNA-processing factor 40 homolog A (170-178)
acccuggacgccggcaacaucaagcuc

SEQ ID NO: 29747 - RNA, 27 nt, Artificial Sequence
  Coiled-coil domain-containing protein 93 (524-532)
acccuggacgacaagaagguguaccuc

SEQ ID NO: 29748 - RNA, 27 nt, Artificial Sequence
  Probable ATP-dependent RNA helicase DDX27 (87-95)
acccuggacgagaagaucgagaaggug

SEQ ID NO: 29749 - RNA, 27 nt, Artificial Sequence
  Nuclear respiratory factor 1 (118-126)
acccuggacgaguacaccacgcgcgug

SEQ ID NO: 29750 - RNA, 27 nt, Artificial Sequence
  Fanconi anemia group D2 protein (847-855)
acccuggacaucaccccccacacggug

SEQ ID NO: 29751 - RNA, 27 nt, Artificial Sequence
  E3 ubiquitin-protein ligase UHRF1 (57-65)
acccuguucgacuacgaggugcgccuc

SEQ ID NO: 29752 - RNA, 27 nt, Artificial Sequence
  Staphylococcal nuclease domain-containing protein 1 (582-590)
acccuguucaccaaggagcucgugcug

SEQ ID NO: 29753 - RNA, 33 nt, Artificial Sequence
  Dynamin-2 (133-143)
acccugaucgaccuccccggcaucaccaaggug

SEQ ID NO: 29754 - RNA, 27 nt, Artificial Sequence
  Cyclic AMP-dependent transcription factor ATF-1 (254-262)
acccugaucgaggagcucaagacccug

SEQ ID NO: 29755 - RNA, 30 nt, Artificial Sequence
  Cleavage and polyadenylation specificity factor subunit 1 (348-357)
acccugaucaccgacggcaugcgcagcgug

SEQ ID NO: 29756 - RNA, 27 nt, Artificial Sequence
  Negative elongation factor C/D (294-302)
acccugcucgaccgcauggugcaccug

SEQ ID NO: 29757 - RNA, 30 nt, Artificial Sequence
  HEAT repeat-containing protein 5B (1620-1629)
acccugcucgacagccccuacgcccgcgug

SEQ ID NO: 29758 - RNA, 30 nt, Artificial Sequence
  NmrA-like family domain-containing protein 1 (23-32)
acccugcucgaggacggcaccuucaaggug

SEQ ID NO: 29759 - RNA, 27 nt, Artificial Sequence
  Tetratricopeptide repeat protein 21B (311-319)
acccugcucgagcgcgccuucagccug

SEQ ID NO: 29760 - RNA, 27 nt, Artificial Sequence
  Cell division cycle protein 27 homolog (544-552)
acccugcucggccacgaguucgugcug

SEQ ID NO: 29761 - RNA, 27 nt, Artificial Sequence
  Coatomer subunit alpha (88-96)
acccugcucggccaccuggacuacauc

SEQ ID NO: 29762 - RNA, 27 nt, Artificial Sequence
  Inositol 1,4,5-trisphosphate receptor type 1 (2386-2394)
acccugcucaacgugaucaagagcguc

SEQ ID NO: 29763 - RNA, 27 nt, Artificial Sequence
  Perilipin-2 (327-335)
acccugcucagcaacauccagggcgug

SEQ ID NO: 29764 - RNA, 27 nt, Artificial Sequence
  V-type proton ATPase subunit C 1 (184-192)
acccugcucguggucgugcccaagcug

SEQ ID NO: 29765 - RNA, 27 nt, Artificial Sequence
  Protein NOXP20 (254-262)
acccugauggagcgcaccgugagccuc

SEQ ID NO: 29766 - RNA, 27 nt, Artificial Sequence
  CAD protein (639-647)
acccugaacgaccgcgaguaccagcuc

SEQ ID NO: 29767 - RNA, 27 nt, Artificial Sequence
  Short transient receptor potential channel 1 (45-53)
acccugaacgagaagcucuuccugcug

SEQ ID NO: 29768 - RNA, 27 nt, Artificial Sequence
  Pinin (7-15)
acccugcaggagcagcucgagaaggcc

SEQ ID NO: 29769 - RNA, 27 nt, Artificial Sequence
  Mitochondrial import receptor subunit TOM22 homolog (35-43)
acccugagcgagcgccucuggggccug

SEQ ID NO: 29770 - RNA, 27 nt, Artificial Sequence
  AP-3 complex subunit mu-2 (219-227)
acccugagcuucaugaacccccgccuc

SEQ ID NO: 29771 - RNA, 27 nt, Artificial Sequence
  Splicing factor 3B subunit 3 (165-173)
acccugguguaccacgucgugggcgug

SEQ ID NO: 29772 - RNA, 33 nt, Artificial Sequence
  Malate dehydrogenase, mitochondrial (54-64)
acccuguacgacaucgcccacacccccggcgug

SEQ ID NO: 29773 - RNA, 27 nt, Artificial Sequence
  60S ribosomal protein L10a (9-17)
acccuguacgaggccgugcgcgagguc

SEQ ID NO: 29774 - RNA, 33 nt, Artificial Sequence
  Quinone oxidoreductase (225-235)
accauggccaaggagagcuccaucaucggcgug

SEQ ID NO: 29775 - RNA, 27 nt, Artificial Sequence
  Dual specificity protein phosphatase 14 (92-100)
accguggccgacaagauccacagcguc

SEQ ID NO: 29776 - RNA, 27 nt, Artificial Sequence
  EH domain-containing protein 1 (479-487)
accgugcugggcaagaucuggaagcuc

SEQ ID NO: 29777 - RNA, 27 nt, Artificial Sequence
  Cell division cycle and apoptosis regulator protein 1 (1120-1128)
accgugauggacgagauccacaccguc

SEQ ID NO: 29778 - RNA, 27 nt, Artificial Sequence
  Protein PAT1 homolog 1 (459-467)
gugaucaucgagaagaccuacagccug

SEQ ID NO: 29779 - RNA, 30 nt, Artificial Sequence
  Tropomyosin alpha-4 chain (134-143)
gugauccuggagggcgagcucgagcgcgcc

SEQ ID NO: 29780 - RNA, 27 nt, Artificial Sequence
  40S ribosomal protein S15a (6-14)
gugcuggccgacgcccucaagagcauc

SEQ ID NO: 29781 - RNA, 27 nt, Artificial Sequence
  Prefoldin subunit 4 (107-115)
gugcuggccgaccucaagguccagcug

SEQ ID NO: 29782 - RNA, 27 nt, Artificial Sequence
  Neurobeachin-like protein 2 (65-73)
gugcuggccgagcagcuccaccaggcc

SEQ ID NO: 29783 - RNA, 30 nt, Artificial Sequence
  E3 ubiquitin-protein ligase RNF130 (74-83)
gugcuggccccccucccgcugcacggcguc

SEQ ID NO: 29784 - RNA, 27 nt, Artificial Sequence
  Calmodulin-regulated spectrin-associated protein 1 (1065-1073)
gugcuggacgccagcgucaaggaggug

SEQ ID NO: 29785 - RNA, 27 nt, Artificial Sequence
  HEAT repeat-containing protein 3 (702-710)
gugcuggacaacgucaagaugaaccuc

SEQ ID NO: 29786 - RNA, 27 nt, Artificial Sequence
  Carbohydrate sulfotransferase 14 (134-142)
gugcuggacagcgucgacgugcgccuc

SEQ ID NO: 29787 - RNA, 30 nt, Artificial Sequence
  Cytosolic carboxypeptidase 1 (592-601)
gugcuguucgagggccgcaccguccagcuc

SEQ ID NO: 29788 - RNA, 27 nt, Artificial Sequence
  Isochorismatase domain-containing protein 1 (143-151)
gugcuguucggcgucgagacccacgug

SEQ ID NO: 29789 - RNA, 27 nt, Artificial Sequence
  Rab GTPase-activating protein 1-like (129-137)
gugcuguucaacaagcucaccuaccug

SEQ ID NO: 29790 - RNA, 27 nt, Artificial Sequence
  Sorting nexin-5 (197-205)
gugcuguucaccggcgucaaggaggug

SEQ ID NO: 29791 - RNA, 33 nt, Artificial Sequence
  Centrosomal protein of 76 kDa (112-122)
gugcugggcgggaaggccuuccucgagcaccug

SEQ ID NO: 29792 - RNA, 27 nt, Artificial Sequence
  Exportin-1 (784-792)
gugcugaucgacuaccagcgcaacguc

SEQ ID NO: 29793 - RNA, 27 nt, Artificial Sequence
  ORM1-like protein 3 (134-142)
gugcugauccccaagcucccgcagcug

SEQ ID NO: 29794 - RNA, 27 nt, Artificial Sequence
  von Willebrand factor A domain-containing protein 8 (511-519)
gugcugcucgacggcauccaccgcguc

SEQ ID NO: 29795 - RNA, 36 nt, Artificial Sequence
  Asparagine synthetase (glutamine-hydrolyzing) (41-52)
gugcugcucgacaccgccaacaagaaggucuuccug

SEQ ID NO: 29796 - RNA, 39 nt, Artificial Sequence
  Ras-related protein Rab-5A (24-36)
gugcugcucggcgagagcgccgucgggaaguccagccug

SEQ ID NO: 29797 - RNA, 27 nt, Artificial Sequence
  MAU2 chromatid cohesion factor homolog (356-364)
gugcugcucggccacaucuucuacguc

SEQ ID NO: 29798 - RNA, 27 nt, Artificial Sequence
  Kelch-like protein 24 (404-412)
gugcugcucggcaaggucuacguggug

SEQ ID NO: 29799 - RNA, 30 nt, Artificial Sequence
  Protein FAM171B (19-28)
gugcugcucaaggcccgccugguccccgcc

SEQ ID NO: 29800 - RNA, 33 nt, Artificial Sequence
  Anamorsin (98-108)
gugcugcucagcgacuccaaccugcacgacgcc

SEQ ID NO: 29801 - RNA, 27 nt, Artificial Sequence
  Protein yippee-like 1 (66-74)
gugcugcucaccggccugcacgccguc

SEQ ID NO: 29802 - RNA, 27 nt, Artificial Sequence
  Inhibitor of nuclear factor kappa-B kinase subunit alpha (271-279)
gugcugauggaccacauccucaaccug

SEQ ID NO: 29803 - RNA, 27 nt, Artificial Sequence
  Probable ATP-dependent RNA helicase DDX56 (130-138)
gugcugauggagaagcccgacgucgug

SEQ ID NO: 29804 - RNA, 27 nt, Artificial Sequence
  Uncharacterized protein C18orf8 (434-442)
gugcugauggaguacauccgcagccuc

SEQ ID NO: 29805 - RNA, 27 nt, Artificial Sequence
  Protein LLP homolog (39-47)
gugcugaugaaggacguccaggagauc

SEQ ID NO: 29806 - RNA, 30 nt, Artificial Sequence
  Cyclin-dependent kinase 1 (69-78)
gugcugaugcaggacagccgccucuaccug

SEQ ID NO: 29807 - RNA, 27 nt, Artificial Sequence
  AP-2 complex subunit sigma (90-98)
gugcugaacgaguacuuccacaacguc

SEQ ID NO: 29808 - RNA, 27 nt, Artificial Sequence
  Maestro heat-like repeat-containing protein family member 1 (1078-1086)
gugcugcaggagaagguccccgagauc

SEQ ID NO: 29809 - RNA, 30 nt, Artificial Sequence
  Nucleolar protein 9 (544-553)
gugcugcagaaccucaagggccaguacguc

SEQ ID NO: 29810 - RNA, 27 nt, Artificial Sequence
  High mobility group protein 20A (167-175)
gugcugcagcagcaccucgagacccug

SEQ ID NO: 29811 - RNA, 27 nt, Artificial Sequence
  HLA class II histocompatibility antigen, DR beta 3 chain (2-10)
gugcugagcucccgccucgccuucgcc

SEQ ID NO: 29812 - RNA, 27 nt, Artificial Sequence
  Importin-9 (169-177)
gugcugaccgaguucacccgcgagguc

SEQ ID NO: 29813 - RNA, 27 nt, Artificial Sequence
  Protein asunder homolog (229-237)
gugcugaccagcgagguccacuccgug

SEQ ID NO: 29814 - RNA, 27 nt, Artificial Sequence
  ELAV-like protein 1 (137-145)
gugcuggucgaccagaccaccggccuc

SEQ ID NO: 29815 - RNA, 27 nt, Artificial Sequence
  Ribonuclease UK114 (25-33)
gugcuggucgaccgcaccaucuacauc

SEQ ID NO: 29816 - RNA, 33 nt, Artificial Sequence
  Zinc finger BED domain-containing protein 1 (374-384)
gugcuggucgaggacagcaacaaccaccaccuc

SEQ ID NO: 29817 - RNA, 27 nt, Artificial Sequence
  Tyrosine-protein kinase JAK1 (997-1005)
gugcuggucgagagcgagcaccaggug

SEQ ID NO: 29818 - RNA, 27 nt, Artificial Sequence
  Signal transducer and activator of transcription 1-alpha/beta (300-308)
gugcugugggaccgcaccuucagccuc

SEQ ID NO: 29819 - RNA, 27 nt, Artificial Sequence
  Mediator of RNA polymerase II transcription subunit 12 (571-579)
gugcuguacgaccagccccgccacguc

SEQ ID NO: 29820 - RNA, 27 nt, Artificial Sequence
  Putative RNA-binding protein 15 (219-227)
gugcuguacgaccgcccccucaagauc

SEQ ID NO: 29821 - RNA, 27 nt, Artificial Sequence
  AKT-interacting protein (200-208)
gugcuguacgagaaggacauccagcuc

SEQ ID NO: 29822 - RNA, 27 nt, Artificial Sequence
  Werner syndrome ATP-dependent helicase (1155-1163)
gugcuguacggcaagcucgucgaggcc

SEQ ID NO: 29823 - RNA, 27 nt, Artificial Sequence
  Set1/Ash2 histone methyltransferase complex subunit ASH2 (516-524)
gugcuguaccacgucgagaccgaggug

SEQ ID NO: 29824 - RNA, 30 nt, Artificial Sequence
  Protein downstream neighbor of Son (395-404)
gugcuguacccccacgagccgaccgccguc

SEQ ID NO: 29825 - RNA, 27 nt, Artificial Sequence
  Protein artemis (131-139)
gugcuguacaccggcgacuuccgccuc

SEQ ID NO: 29826 - RNA, 27 nt, Artificial Sequence
  Anaphase-promoting complex subunit 1 (498-506)
gugcuguacaccggcgucgugcgcgug

SEQ ID NO: 29827 - RNA, 30 nt, Artificial Sequence
  Adenosylhomocysteinase 2 (277-286)
gugauguucggcgggaagcaggucguggug

SEQ ID NO: 29828 - RNA, 27 nt, Artificial Sequence
  Ligand-dependent nuclear receptor-interacting factor 1 (358-366)
gugauguucaacggcaaggucuaccug

SEQ ID NO: 29829 - RNA, 24 nt, Artificial Sequence
  Kelch-like protein 8 (201-208)
gugaugggcaagaucuucgccguc

SEQ ID NO: 29830 - RNA, 30 nt, Artificial Sequence
  Adenosylhomocysteinase (209-218)
gugaugaucgccggcaaggucgccguggug

SEQ ID NO: 29831 - RNA, 27 nt, Artificial Sequence
  Cullin-2 (25-33)
gugaugcuggaguacgucgagcgcgcc

SEQ ID NO: 29832 - RNA, 27 nt, Artificial Sequence
  DNA-directed RNA polymerases I, II, and III subunit RPABC3 (55-63)
gugauguacggcaaggucuaccgcauc

SEQ ID NO: 29833 - RNA, 27 nt, Artificial Sequence
  Cytoskeleton-associated protein 5 (1001-1009)
uggcuggccgagaagcuccccacccug

SEQ ID NO: 29834 - RNA, 27 nt, Artificial Sequence
  Transcription factor 25 (392-400)
uggcuggaggagaacgugcacgagguc

SEQ ID NO: 29835 - RNA, 33 nt, Artificial Sequence
  Nuclear migration protein nudC (184-194)
uggcugaucgaggacggcaagguggucaccgug

SEQ ID NO: 29836 - RNA, 27 nt, Artificial Sequence
  Serine/threonine-protein phosphatase 2A 65 kDa regulatory subunit A alpha isoform isoform X1 (271-279)
uggcugguggaccacgucuacgccauc

SEQ ID NO: 29837 - RNA, 42 nt, Artificial Sequence
  Melanocyte protein PMEL (44-57)
uggaaccgccagcuguaccccgaguggaccgaggcccagcgg

SEQ ID NO: 29838 - RNA, 30 nt, Artificial Sequence
  Helicase-like transcription factor (121-130)
uacaucauggacaacaagcuggcccagauc

SEQ ID NO: 29839 - RNA, 27 nt, Artificial Sequence
  Unconventional myosin-If (18-26)
uacaucaugagcuacaucucccgcgug

SEQ ID NO: 29840 - RNA, 27 nt, Artificial Sequence
  CCR4-NOT transcription complex subunit 1 (237-245)
uaccuggcccccuuccuccgcaacgug

SEQ ID NO: 29841 - RNA, 27 nt, Artificial Sequence
  COP9 signalosome complex subunit 1 (357-365)
uaccuggccccccacgugcgcacccuc

SEQ ID NO: 29842 - RNA, 27 nt, Artificial Sequence
  Nucleoprotein TPR (422-430)
uaccuggacgagaucgugaaggagguc

SEQ ID NO: 29843 - RNA, 27 nt, Artificial Sequence
  Tuberin (190-198)
uaccuggacgaguacaucgcccgcaug

SEQ ID NO: 29844 - RNA, 27 nt, Artificial Sequence
  Neutral alpha-glucosidase C (478-486)
uaccuggacuucaccaaccccaaggug

SEQ ID NO: 29845 - RNA, 27 nt, Artificial Sequence
  Protein flightless-1 homolog (154-162)
uaccuggaccucagcgagaaccgccug

SEQ ID NO: 29846 - RNA, 27 nt, Artificial Sequence
  UPF0585 protein C16orf13 (21-29)
uaccuggaccccgcccagcgcggcgug

SEQ ID NO: 29847 - RNA, 27 nt, Artificial Sequence
  BTB/POZ domain-containing protein KCTD3 (224-232)
uaccuggacuggaccaucgagcgcgug

SEQ ID NO: 29848 - RNA, 27 nt, Artificial Sequence
  DBF4-type zinc finger-containing protein 2 (1397-1405)
uaccuggaggacaagagcuacaagcuc

SEQ ID NO: 29849 - RNA, 27 nt, Artificial Sequence
  NADH dehydrogenase (ubiquinone) iron-sulfur protein 8, mitochondrial (74-82)
uaccuguuccgcgagcccgccaccauc

SEQ ID NO: 29850 - RNA, 27 nt, Artificial Sequence
  Protein unc-50 homolog (55-63)
uaccuguucaccagcccccagcgcgug

SEQ ID NO: 29851 - RNA, 27 nt, Artificial Sequence
  Vacuole membrane protein 1 (137-145)
uaccugggcccccacaucgccagcgug

SEQ ID NO: 29852 - RNA, 24 nt, Artificial Sequence
  SUMO-activating enzyme subunit 2 (164-171)
uaccugggccaggugaccaccauc

SEQ ID NO: 29853 - RNA, 27 nt, Artificial Sequence
  Mitotic checkpoint serine/threonine-protein kinase BUB1 beta (141-149)
uaccugcacaaccagggcaucggggug

SEQ ID NO: 29854 - RNA, 33 nt, Artificial Sequence
  EKC/KEOPS complex subunit TPRKB (121-131)
uaccugaucagccagguggagggccaccagguc

SEQ ID NO: 29855 - RNA, 27 nt, Artificial Sequence
  Myosin-10 (264-272)
uaccugcucgagaagagccgcgccgug

SEQ ID NO: 29856 - RNA, 33 nt, Artificial Sequence
  Cyclin-D1-binding protein 1 (104-114)
uaccugcuccccaaggaccagggcaucacccug

SEQ ID NO: 29857 - RNA, 30 nt, Artificial Sequence
  PRKC apoptosis WT1 regulator protein (215-224)
uaccugcuccaggagcccccgcgcaccgug

SEQ ID NO: 29858 - RNA, 27 nt, Artificial Sequence
  Probable methyltransferase TARBP1 (286-294)
uaccugcuccagcgcgccguggagguc

SEQ ID NO: 29859 - RNA, 30 nt, Artificial Sequence
  E3 ubiquitin-protein ligase HUWE1 (1351-1360)
uaccugcucacccaccccccgcccaucaug

SEQ ID NO: 29860 - RNA, 30 nt, Artificial Sequence
  26S proteasome non-ATPase regulatory subunit 8 (142-151)
uaccugauggagggcagcuacaacaaggug

SEQ ID NO: 29861 - RNA, 27 nt, Artificial Sequence
  Leucine-tRNA ligase, cytoplasmic (901-909)
uaccugauggaggugacccacgaccuc

SEQ ID NO: 29862 - RNA, 27 nt, Artificial Sequence
  Striatin-interacting protein 2 (207-215)
uaccugaugguggagaacauccgccuc

SEQ ID NO: 29863 - RNA, 27 nt, Artificial Sequence
  Zinc finger protein Pegasus (211-219)
uaccugaacgacuucacccacgagauc

SEQ ID NO: 29864 - RNA, 27 nt, Artificial Sequence
  A-kinase anchor protein 10, mitochondrial (504-512)
uaccugaacgaccucauccacagcgug

SEQ ID NO: 29865 - RNA, 27 nt, Artificial Sequence
  RNA polymerase II subunit A C-terminal domain phosphatase (611-619)
uaccugaacaaggagaucgaggaggcc

SEQ ID NO: 29866 - RNA, 27 nt, Artificial Sequence
  DNA repair protein complementing XP-G cells (242-250)
uaccugaaccagcacaucgagcacgug

SEQ ID NO: 29867 - RNA, 33 nt, Artificial Sequence
  Protein phosphatase 1G (74-84)
uaccugcccgacaucaucaaggaccagaaggcc

SEQ ID NO: 29868 - RNA, 27 nt, Artificial Sequence
  Interleukin-1 receptor-associated kinase-like 2 (381-389)
uaccugcccgaggacuucauccgcgug

SEQ ID NO: 29869 - RNA, 27 nt, Artificial Sequence
  Dual specificity protein kinase CLK2 (259-267)
uaccugcccuacccgauccaccaggug

SEQ ID NO: 29870 - RNA, 27 nt, Artificial Sequence
  Sterol regulatory element-binding protein 2 (379-387)
uaccugcagcaggugaaccacaagcuc

SEQ ID NO: 29871 - RNA, 27 nt, Artificial Sequence
  Actin-related protein 2/3 complex subunit 4 (8-16)
uaccugagcgccgugcgcgccacccuc

SEQ ID NO: 29872 - RNA, 27 nt, Artificial Sequence
  Hsp90 co-chaperone Cdc37 (174-182)
uaccugagcgacaacgugcaccucguc

SEQ ID NO: 29873 - RNA, 27 nt, Artificial Sequence
  Replication factor C subunit 5 (157-165)
uaccugagcaagaucauccccgcccuc

SEQ ID NO: 29874 - RNA, 27 nt, Artificial Sequence
  SLC45A3-BRAF fusion protein (236-244)
uaccugagccccgaccucuccaaggug

SEQ ID NO: 29875 - RNA, 27 nt, Artificial Sequence
  THO complex subunit 5 homolog (225-233)
uaccugagcucccuccagccccgccug

SEQ ID NO: 29876 - RNA, 27 nt, Artificial Sequence
  Histone deacetylase 3 (183-191)
uaccugaccgaccgcgugaugaccguc

SEQ ID NO: 29877 - RNA, 30 nt, Artificial Sequence
  40S ribosomal protein S10 (70-79)
uaccugaccaacgagggcauccaguaccuc

SEQ ID NO: 29878 - RNA, 27 nt, Artificial Sequence
  Heat shock protein HSP 90-alpha (142-150)
uaccugguggccgagaaggucaccgug

SEQ ID NO: 29879 - RNA, 27 nt, Artificial Sequence
  Protein unc-93 homolog B1 (246-254)
uaccuguacgaccucaaccacacccug

SEQ ID NO: 29880 - RNA, 27 nt, Artificial Sequence
  Sodium- and chloride-dependent taurine transporter (277-285)
uaccuguaccccgacaucacccgccuc

SEQ ID NO: 29881 - RNA, 27 nt, Artificial Sequence
  Cullin-7 (1355-1363)
uacauggccgaccgccugcucggcgug

SEQ ID NO: 29882 - RNA, 27 nt, Artificial Sequence
  Kinetochore-associated protein 1 (1575-1583)
uacaugcuggagcacgugaucacccuc

SEQ ID NO: 29883 - RNA, 27 nt, Artificial Sequence
  Elongation of very long chain fatty acids protein 1 (200-208)
uaccaguaccccgugaucauccaccug

SEQ ID NO: 29884 - RNA, 27 nt, Artificial Sequence
  Histone deacetylase 1 (188-196)
uacaccaccgaccgcgugaugacgguc

SEQ ID NO: 29885 - RNA, 30 nt, Artificial Sequence
  Syntaxin-binding protein 5 (234-243)
uacaccuacgacgaggccauccacagcgug

SEQ ID NO: 29886 - RNA, 27 nt, Artificial Sequence
  Speriolin-like protein (56-64)
uacguguuccccggcgucacccgccug

SEQ ID NO: 29887 - RNA, 33 nt, Artificial Sequence
  Plectin (3961-3971)
uacgugaucgaccccaucaagggccugaagcuc

SEQ ID NO: 29888 - RNA, 27 nt, Artificial Sequence
  Erythroid differentiation-related factor 1 (607-615)
uacgugcuggagggccucaagagcguc

SEQ ID NO: 29889 - RNA, 27 nt, Artificial Sequence
  Translation initiation factor eIF-2B subunit delta (413-421)
uacgugcugcccgaggucagcaaggug

SEQ ID NO: 29890 - RNA, 45 nt, Artificial Sequence
  Vimentin (452-466)
ggccaggugaucaacgagaccagccagcaccacgacgaccuggag

SEQ ID NO: 29891 - RNA, 27 nt, Artificial Sequence
  Ubiquitin-conjugating enzyme E2 J2 (121-129)
uucaugguggagaagggccccacccug

SEQ ID NO: 29892 - RNA, 27 nt, Artificial Sequence
  26S proteasome non-ATPase regulatory subunit 3 (216-224)
cgcguguacgaguuccuggacaagcuc

SEQ ID NO: 29893 - RNA, 27 nt, Artificial Sequence
  E3 ubiquitin-protein ligase Hakai (341-349)
gcccccccgcccccccccccgcccccc

SEQ ID NO: 29894 - RNA, 27 nt, Artificial Sequence
  Farnesyl pyrophosphate synthase (36-44)
gcccgccugaaggaggugcucgaguac

SEQ ID NO: 29895 - RNA, 27 nt, Artificial Sequence
  Annexin A5 (92-100)
gacgccuacgagcugaagcacgcccuc

SEQ ID NO: 29896 - RNA, 27 nt, Artificial Sequence
  cAMP-dependent protein kinase catalytic subunit alpha (34-42)
gaccaguucgagcgcaucaagacccug

SEQ ID NO: 29897 - RNA, 27 nt, Artificial Sequence
  Cytochrome c (90-98)
gaggagcgcgccgaccugaucgccuac

SEQ ID NO: 29898 - RNA, 27 nt, Artificial Sequence
  T-complex protein 1 subunit theta (418-426)
gagcuggccaagcagaucaccagcuac

SEQ ID NO: 29899 - RNA, 27 nt, Artificial Sequence
  COMM domain-containing protein 2 (116-124)
gagcuggcccccagccucccguccuac

SEQ ID NO: 29900 - RNA, 27 nt, Artificial Sequence
  Akirin-1 (166-174)
gagcaguacgagagcuucgugaaguuc

SEQ ID NO: 29901 - RNA, 24 nt, Artificial Sequence
  U5 small nuclear ribonucleoprotein 200 kDa helicase (1231-1238)
gaggugauccugcaccacgaguac

SEQ ID NO: 29902 - RNA, 27 nt, Artificial Sequence
  ORM1-like protein 1 (9-17)
gaggugaaccccaacacccgcgucaug

SEQ ID NO: 29903 - RNA, 27 nt, Artificial Sequence
  Proteasome subunit alpha type-5 (125-133)
gagguguaccacaagagcaugacccug

SEQ ID NO: 29904 - RNA, 27 nt, Artificial Sequence
  Transcription factor 25 (248-256)
uucgccuucgagcacagcgaggaguac

SEQ ID NO: 29905 - RNA, 27 nt, Artificial Sequence
  Septin-6 (154-162)
uucaucgcccccaccggccacagccug

SEQ ID NO: 29906 - RNA, 27 nt, Artificial Sequence
  Sodium channel and clathrin linker 1 (55-63)
uuccuggccccccucgugaccgaguac

SEQ ID NO: 29907 - RNA, 27 nt, Artificial Sequence
  Tetratricopeptide repeat protein 14 (257-265)
uucgugaaccccggcgucguggaguuc

SEQ ID NO: 29908 - RNA, 27 nt, Artificial Sequence
  Structural maintenance of chromosomes protein 4 (524-532)
ggccgcauccccgggaucuacggccgg

SEQ ID NO: 29909 - RNA, 30 nt, Artificial Sequence
  BCL-6 corepressor (860-869)
ggccgcaucagcgacuuccacgagaccuac

SEQ ID NO: 29910 - RNA, 27 nt, Artificial Sequence
  NEDD8-activating enzyme E1 regulatory subunit (434-442)
ggccgcuaccccggggugagcaacuac

SEQ ID NO: 29911 - RNA, 27 nt, Artificial Sequence
  RANBP2-like and GRIP domain-containing protein 2 (188-196)
cacgaggccgagcgcaacaucgcccug

SEQ ID NO: 29912 - RNA, 27 nt, Artificial Sequence
  Heterogeneous nuclear ribonucleoprotein L (348-356)
caccccccgcccccccccccgcccccc

SEQ ID NO: 29913 - RNA, 30 nt, Artificial Sequence
  Nodal modulator 3 (227-236)
caccgcuucgagcaggccuucuacaccuac

SEQ ID NO: 29914 - RNA, 27 nt, Artificial Sequence
  Mediator of RNA polymerase II transcription subunit 19 (27-35)
aagcccccgcccccccccccgcccccc

SEQ ID NO: 29915 - RNA, 27 nt, Artificial Sequence
  Afadin (1323-1331)
cugcccccgcccccccccccgcccccc

SEQ ID NO: 29916 - RNA, 27 nt, Artificial Sequence
  Tubulin beta-2A chain (233-241)
cugcgcuuccccggccagcucaacgcc

SEQ ID NO: 29917 - RNA, 27 nt, Artificial Sequence
  Keratinocyte-associated protein 2 (1-9)
augguggucggcaccgggaccagccug

SEQ ID NO: 29918 - RNA, 27 nt, Artificial Sequence
  Heat shock protein HSP 90-beta (28-36)
aacccccaggagcgcacccugacccuc

SEQ ID NO: 29919 - RNA, 27 nt, Artificial Sequence
  N-alpha-acetyltransferase 50 (23-31)
aaccaggugaucuuccccgucagcuac

SEQ ID NO: 29920 - RNA, 27 nt, Artificial Sequence
  Origin recognition complex subunit 1 (665-673)
aaccgcgugagcucccggcugggccuc

SEQ ID NO: 29921 - RNA, 27 nt, Artificial Sequence
  Alanine-tRNA ligase, cytoplasmic (55-63)
aacaccaucgaccccagccacccgaug

SEQ ID NO: 29922 - RNA, 27 nt, Artificial Sequence
  Histone H4 (34-42)
aacgugauccgcgacgccgucaccuac

SEQ ID NO: 29923 - RNA, 27 nt, Artificial Sequence
  Anaphase-promoting complex subunit 7 (184-192)
caggagcgccccagcgugaccuccuac

SEQ ID NO: 29924 - RNA, 27 nt, Artificial Sequence
  Syntaxin-binding protein 2 (143-151)
agccuggacgccccccacuccaccuac

SEQ ID NO: 29925 - RNA, 27 nt, Artificial Sequence
  Fructose-bisphosphate aldolase A (356-364)
agccuguucguguccaaccacgccuac

SEQ ID NO: 29926 - RNA, 27 nt, Artificial Sequence
  Abl interactor 1 (398-406)
agccccccgcccccccccccgcccccc

SEQ ID NO: 29927 - RNA, 27 nt, Artificial Sequence
  T-complex protein 1 subunit eta (208-216)
agccagcugguggccggcgucgccuuc

SEQ ID NO: 29928 - RNA, 27 nt, Artificial Sequence
  FERM domain-containing protein 4A (824-832)
agccagucccagcccagcucccaguac

SEQ ID NO: 29929 - RNA, 27 nt, Artificial Sequence
  60S ribosome subunit biogenesis protein NIP7 homolog (126-134)
agccaguaccagggcguggucguguac

SEQ ID NO: 29930 - RNA, 24 nt, Artificial Sequence
  Dolichol-phosphate mannosyltransferase subunit 3 (78-85)
gugggcuaccgcgucgccaccuuc

SEQ ID NO: 29931 - RNA, 27 nt, Artificial Sequence
  Protein enabled homolog (379-387)
gugcccccgcccccccccccgcccccc

SEQ ID NO: 29932 - RNA, 27 nt, Artificial Sequence
  Endoplasmin (727-735)
uaccugcuccccgacaccaaggccuac

SEQ ID NO: 29933 - RNA, 27 nt, Artificial Sequence
  Elongation factor 2 (489-497)
gagcacgcccacaacaugcgcgugaug

SEQ ID NO: 29934 - RNA, 27 nt, Artificial Sequence
  T-complex protein 1 subunit eta (282-290)
caccacagcggcgccaaggugguccug

SEQ ID NO: 29935 - RNA, 30 nt, Artificial Sequence
  60S ribosomal protein L8 (49-58)
auccacgaccccggccgcggggccccgcug

SEQ ID NO: 29936 - RNA, 33 nt, Artificial Sequence
  Heat shock protein HSP 90-beta (441-451)
auccacgaggacagcaccaaccgccggcgccug

SEQ ID NO: 29937 - RNA, 27 nt, Artificial Sequence
  F-actin-capping protein subunit beta (235-243)
aagaccaaggacaucgugaacggccug

SEQ ID NO: 29938 - RNA, 27 nt, Artificial Sequence
  Transcription activator BRG1 (899-907)
acccacuacguggccccccgccggcug

SEQ ID NO: 29939 - RNA, 27 nt, Artificial Sequence
  Actin-related protein 2 (378-386)
uaccaggagaagggcgugcgcguccug

SEQ ID NO: 29940 - RNA, 27 nt, Artificial Sequence
  Centromere protein W (77-85)
gccgccgcgaaggugauccugaagaag

SEQ ID NO: 29941 - RNA, 27 nt, Artificial Sequence
  Histone H1.1 (63-71)
gccgcccugaagaaggcgcucgccgcc

SEQ ID NO: 29942 - RNA, 27 nt, Artificial Sequence
  MICOS complex subunit MIC60 (93-101)
gccgccuacaacgugccccugccgaag

SEQ ID NO: 29943 - RNA, 30 nt, Artificial Sequence
  Crooked neck-like protein 1 (493-502)
gccgaggccgaggcggugcgcgaggucuac

SEQ ID NO: 29944 - RNA, 27 nt, Artificial Sequence
  Dystonin (6939-6947)
gccgaggccgagcagacccugcgcuuc

SEQ ID NO: 29945 - RNA, 27 nt, Artificial Sequence
  Exportin-T (39-47)
gccgaggcccuggcgcagcgcaccuac

SEQ ID NO: 29946 - RNA, 27 nt, Artificial Sequence
  DNA replication licensing factor MCM5 (620-628)
gccgaggcccugagcaagaugaagcuc

SEQ ID NO: 29947 - RNA, 27 nt, Artificial Sequence
  Chondroitin sulfate glucuronyltransferase (568-576)
gccgaggcccccagccaggugcgccug

SEQ ID NO: 29948 - RNA, 27 nt, Artificial Sequence
  78 kDa glucose-regulated protein (157-165)
gccgaggccuaccugggcaagaaggug

SEQ ID NO: 29949 - RNA, 30 nt, Artificial Sequence
  X-ray repair cross-complementing protein 6 (224-233)
gccgaggacgaggaccugcgcgugcacuuc

SEQ ID NO: 29950 - RNA, 27 nt, Artificial Sequence
  WD and tetratricopeptide repeats protein 1 (45-53)
gccgaggacggccugauccgccaguac

SEQ ID NO: 29951 - RNA, 30 nt, Artificial Sequence
  DNA replication licensing factor MCM3 (278-287)
gccgaggacaucgccaagaucaagaaguuc

SEQ ID NO: 29952 - RNA, 30 nt, Artificial Sequence
  Transmembrane emp24 domain-containing protein 3 (50-59)
gccgaggaccugaacagccgcguguccuac

SEQ ID NO: 29953 - RNA, 30 nt, Artificial Sequence
  Transmembrane emp24 domain-containing protein 7 (179-188)
gccgaggaccugaacacccgcguggccuac

SEQ ID NO: 29954 - RNA, 33 nt, Artificial Sequence
  Retinoblastoma-like protein 1 (193-203)
gccgaggaggagaucggcaccccccgcaaguuc

SEQ ID NO: 29955 - RNA, 27 nt, Artificial Sequence
  Clathrin heavy chain 1 (360-368)
gccgaggagcuguucgcccgcaaguuc

SEQ ID NO: 29956 - RNA, 27 nt, Artificial Sequence
  Alpha-2-macroglobulin receptor-associated protein (250-258)
gccgaguucgaggagccccgcgugauc

SEQ ID NO: 29957 - RNA, 27 nt, Artificial Sequence
  Immunoglobulin-binding protein 1 (122-130)
gccgaguucgagcugcccaagaccaug

SEQ ID NO: 29958 - RNA, 27 nt, Artificial Sequence
  Myeloid leukemia factor 2 (224-232)
gccgagggccccccgcgccuggccauc

SEQ ID NO: 29959 - RNA, 33 nt, Artificial Sequence
  Histone-lysine N-methyltransferase NSD3 (1027-1037)
gccgagggccagaccagcaucaacaagaccuuc

SEQ ID NO: 29960 - RNA, 27 nt, Artificial Sequence
  Plectin (1687-1695)
gccgagggcaccgcccagcagcgccug

SEQ ID NO: 29961 - RNA, 27 nt, Artificial Sequence
  RNA-binding protein 34 (222-230)
gccgagggcacccugagcaagaagcuc

SEQ ID NO: 29962 - RNA, 27 nt, Artificial Sequence
  Perilipin-2 (303-311)
gccgagcacaucgagagccgcacccug

SEQ ID NO: 29963 - RNA, 27 nt, Artificial Sequence
  Secernin-1 (219-227)
gccgagcaccccgagcugcgcagcuac

SEQ ID NO: 29964 - RNA, 30 nt, Artificial Sequence
  DNA dC-dU-editing enzyme APOBEC-3D (121-130)
gccgagcaccccaacgugacccugaccauc

SEQ ID NO: 29965 - RNA, 27 nt, Artificial Sequence
  Vacuolar protein sorting-associated protein 13A (547-555)
gccgagcacagcaccgugaucaccuuc

SEQ ID NO: 29966 - RNA, 27 nt, Artificial Sequence
  Syntaxin-18 (279-287)
gccgagaucgacagcauccaccagcug

SEQ ID NO: 29967 - RNA, 30 nt, Artificial Sequence
  Nesprin-2 (1575-1584)
gccgagaucgagaucgugaaggaggaguuc

SEQ ID NO: 29968 - RNA, 33 nt, Artificial Sequence
  WD repeat-containing protein 91 (30-40)
gccgagaucaaggccgacaaggagaagggcuuc

SEQ ID NO: 29969 - RNA, 27 nt, Artificial Sequence
  Tubulin-specific chaperone A (54-62)
gccgagauccugcaggagagccgcaug

SEQ ID NO: 29970 - RNA, 33 nt, Artificial Sequence
  MAP3K12-binding inhibitory protein 1 (172-182)
gccgagaucaacgagaacaacgugcgcgaguuc

SEQ ID NO: 29971 - RNA, 30 nt, Artificial Sequence
  Myosin light polypeptide 6 (107-116)
gccgagauccgccacgugcuggucacccuc

SEQ ID NO: 29972 - RNA, 27 nt, Artificial Sequence
  BAG64702.1 (1-9)
gccgagaucaccgacaagcugggccuc

SEQ ID NO: 29973 - RNA, 27 nt, Artificial Sequence
  Nuclear migration protein nudC (2-10)
gccgagaagcugaucacccagaccuuc

SEQ ID NO: 29974 - RNA, 30 nt, Artificial Sequence
  Spectrin alpha chain, non-erythrocytic 1 (381-390)
gccgagcuggaccgccagaucaagagcuuc

SEQ ID NO: 29975 - RNA, 30 nt, Artificial Sequence
  Transcriptional regulator ATRX (1293-1302)
gccgagcuggaggagaaccagcgcagcuac

SEQ ID NO: 29976 - RNA, 27 nt, Artificial Sequence
  Dolichyl-diphosphooligosaccharide-proteinosyltransferase subunit 2 (288-296)
gccgagcugaccccccaccagaccuuc

SEQ ID NO: 29977 - RNA, 27 nt, Artificial Sequence
  Nuclear receptor corepressor 1 (522-530)
gccgagaacgaccccacccgccaguac

SEQ ID NO: 29978 - RNA, 27 nt, Artificial Sequence
  General transcription factor 3C polypeptide 1 (42-50)
gccgagaacggccugaccgugcgccuc

SEQ ID NO: 29979 - RNA, 33 nt, Artificial Sequence
  Eukaryotic translation initiation factor 4 gamma 1 (544-554)
gccgagaacauccagcccggcgagcagaaguac

SEQ ID NO: 29980 - RNA, 27 nt, Artificial Sequence
  Glycogen phosphorylase, muscle form (273-281)
gccgagaacaucagccgcgugcuguac

SEQ ID NO: 29981 - RNA, 27 nt, Artificial Sequence
  X-ray repair cross-complementing protein 5 (48-56)
gccgagaacaaggacgagaucgcccug

SEQ ID NO: 29982 - RNA, 27 nt, Artificial Sequence
  Protein kinase C delta type (405-413)
gccgagaaccccuuccugacccaccuc

SEQ ID NO: 29983 - RNA, 30 nt, Artificial Sequence
  ATP-dependent RNA helicase DDX42 (93-102)
gccgagaacagccccacccgccagcaguuc

SEQ ID NO: 29984 - RNA, 27 nt, Artificial Sequence
  E3 ubiquitin-protein ligase TTC3 (1392-1400)
gccgagaacguggccggccaccagauc

SEQ ID NO: 29985 - RNA, 27 nt, Artificial Sequence
  RAB6A-GEF complex partner protein 1 (906-914)
gccgagaacgugcccgccagcaaguuc

SEQ ID NO: 29986 - RNA, 33 nt, Artificial Sequence
  Vigilin (1010-1020)
gccgagcaggaggaccgcgcccugcggagcuuc

SEQ ID NO: 29987 - RNA, 27 nt, Artificial Sequence
  Plectin (2014-2022)
gccgagcaggagagcgcccgccagcug

SEQ ID NO: 29988 - RNA, 33 nt, Artificial Sequence
  B-cell receptor-associated protein 31 (21-31)
gccgagagcgccuccgaggcggccaagaaguac

SEQ ID NO: 29989 - RNA, 27 nt, Artificial Sequence
  T-complex protein 1 subunit beta (113-121)
gccgagagccugaucgccaagaagauc

SEQ ID NO: 29990 - RNA, 27 nt, Artificial Sequence
  Sphingomyelin phosphodiesterase 4 (513-521)
gccgagagccccgccggccacuccuuc

SEQ ID NO: 29991 - RNA, 27 nt, Artificial Sequence
  Protein THEMIS2 (120-128)
gccgagagccccgagcgcgugcugcuc

SEQ ID NO: 29992 - RNA, 33 nt, Artificial Sequence
  Chitinase domain-containing protein 1 (57-67)
gccgagagcgugguccuggagcaccgcuccuac

SEQ ID NO: 29993 - RNA, 27 nt, Artificial Sequence
  Poly(A)-specific ribonuclease PARN (455-463)
gccgagagcuaccgcauccagaccuac

SEQ ID NO: 29994 - RNA, 30 nt, Artificial Sequence
  Translation initiation factor eIF-2B subunit epsilon (406-415)
gccgaggugggcgccgcggggaagggcuac

SEQ ID NO: 29995 - RNA, 33 nt, Artificial Sequence
  RNA-binding protein 8A (78-88)
gccgaguacggcgagaucaagaacauccaccug

SEQ ID NO: 29996 - RNA, 27 nt, Artificial Sequence
  Histone deacetylase 1 (239-247)
gccaucuucaagcccgugaugagcaag

SEQ ID NO: 29997 - RNA, 27 nt, Artificial Sequence
  Pre-mRNA-processing factor 6 (764-772)
gccauccuggagaagagccgccucaag

SEQ ID NO: 29998 - RNA, 33 nt, Artificial Sequence
  Serine/threonine-protein phosphatase 2A 65 kDa regulatory subunit A alpha isoform (457-467)
gccauccgcgaggccgcgaccagcaaccugaag

SEQ ID NO: 29999 - RNA, 27 nt, Artificial Sequence
  Cleavage and polyadenylation specificity factor subunit 7 (346-354)
gccaucagcuccagcgccaucuccaag

SEQ ID NO: 30000 - RNA, 27 nt, Artificial Sequence
  39S ribosomal protein L20, mitochondrial (106-114)
gccaucuacgagcccaagaccuucaag

SEQ ID NO: 30001 - RNA, 27 nt, Artificial Sequence
  Melanoma-associated antigen F1 (61-69)
gcccuggccgcgaaggcccucgcccgc

SEQ ID NO: 30002 - RNA, 27 nt, Artificial Sequence
  Proteasome subunit alpha type-4 (120-128)
gcccuggccaucaaggugcucaacaag

SEQ ID NO: 30003 - RNA, 27 nt, Artificial Sequence
  Lysine-specific demethylase 2B (171-179)
gcccuggccaacaagccccuccgccgg

SEQ ID NO: 30004 - RNA, 27 nt, Artificial Sequence
  Eukaryotic translation initiation factor 3 subunit C-like protein (251-259)
gcccuggccagccgcuuccucaagaag

SEQ ID NO: 30005 - RNA, 27 nt, Artificial Sequence
  Translation factor GUF1, mitochondrial (274-282)
gcccuguucgacggcguggucagcaag

SEQ ID NO: 30006 - RNA, 27 nt, Artificial Sequence
  V-type proton ATPase subunit E 1 (214-222)
gcccuguucggcgccaacgcgaaccgc

SEQ ID NO: 30007 - RNA, 30 nt, Artificial Sequence
  Sorting nexin-5 (315-324)
gcccugaucgacuacgagaacagcaacaag

SEQ ID NO: 30008 - RNA, 30 nt, Artificial Sequence
  T-complex protein 1 subunit zeta (279-288)
gcccugaucaagcacaagcccagcgugaag

SEQ ID NO: 30009 - RNA, 30 nt, Artificial Sequence
  60S ribosomal protein L9 (159-168)
gcccugauccagcaggccaccaccgugaag

SEQ ID NO: 30010 - RNA, 30 nt, Artificial Sequence
  Actin-related protein 2/3 complex subunit 5 (58-67)
gcccugaagaaccccccgaucaacaccaag

SEQ ID NO: 30011 - RNA, 30 nt, Artificial Sequence
  40S ribosomal protein S15a (10-19)
gcccugaagagcaucaacaacgccgagaag

SEQ ID NO: 30012 - RNA, 27 nt, Artificial Sequence
  Eukaryotic translation initiation factor 4 gamma 1 (785-793)
gcccugaaggugcccaccaccgagaag

SEQ ID NO: 30013 - RNA, 33 nt, Artificial Sequence
  Prefoldin subunit 6 (48-58)
gcccugcucgacggcagcaacguggucuucaag

SEQ ID NO: 30014 - RNA, 27 nt, Artificial Sequence
  Serine hydroxymethyltransferase, mitochondrial (340-348)
gcccugcucgagcgcggcuacagccug

SEQ ID NO: 30015 - RNA, 27 nt, Artificial Sequence
  Interferon alpha-inducible protein 6 (113-121)
gcccugaugggcuacgccacccacaag

SEQ ID NO: 30016 - RNA, 27 nt, Artificial Sequence
  Engulfment and cell motility protein 2 (573-581)
gcccugaaccacaaggugcuccacuac

SEQ ID NO: 30017 - RNA, 27 nt, Artificial Sequence
  60S ribosomal protein L4 (132-140)
gcccugcccgcccucgugaugagcaag

SEQ ID NO: 30018 - RNA, 27 nt, Artificial Sequence
  AT-rich interactive domain-containing protein 4B (407-415)
gcccugcccgagaagguggucaacaag

SEQ ID NO: 30019 - RNA, 30 nt, Artificial Sequence
  m7GpppX diphosphatase (320-329)
gcccugcgcgccgacgacccccuccugaag

SEQ ID NO: 30020 - RNA, 27 nt, Artificial Sequence
  Probable helicase senataxin (1619-1627)
gcccugagccccucccucaagaacaag

SEQ ID NO: 30021 - RNA, 27 nt, Artificial Sequence
  Transcription initiation factor IIE subunit beta (16-24)
gcccugagcacccccguggucgagaag

SEQ ID NO: 30022 - RNA, 30 nt, Artificial Sequence
  Nuclear receptor corepressor 1 (607-616)
gcccuggugagcacccccguccgcaccaag

SEQ ID NO: 30023 - RNA, 27 nt, Artificial Sequence
  F-box only protein 21 (373-381)
gcccuguacggcguggucaacgugaag

SEQ ID NO: 30024 - RNA, 33 nt, Artificial Sequence
  Cytochrome c oxidase subunit 7A-related protein, mitochondrial (104-114)
gcccuguacauggccagccagcccaagaacaag

SEQ ID NO: 30025 - RNA, 27 nt, Artificial Sequence
  Anaphase-promoting complex subunit 1 (1587-1595)
gcccuguacccccacuucccggcccac

SEQ ID NO: 30026 - RNA, 27 nt, Artificial Sequence
  Nucleosome assembly protein 1-like 4 (97-105)
gcccuguaccagccccucuucgacaag

SEQ ID NO: 30027 - RNA, 27 nt, Artificial Sequence
  Mitochondrial ubiquitin ligase activator of NFKB 1 (24-32)
gcccuguacagcguguaccgccagaag

SEQ ID NO: 30028 - RNA, 27 nt, Artificial Sequence
  Pyruvate kinase PKM (21-29)
gccauggccgacaccuuccuggagcac

SEQ ID NO: 30029 - RNA, 27 nt, Artificial Sequence
  Baculoviral IAP repeat-containing protein 6 (2448-2456)
gccaugaagcccaagccgcugagcgug

SEQ ID NO: 30030 - RNA, 33 nt, Artificial Sequence
  NAD(P)H dehydrogenase (quinone) 1 (128-138)
gccauguacgacaagggccccuuccgcagcaag

SEQ ID NO: 30031 - RNA, 24 nt, Artificial Sequence
  Lysine-specific demethylase 5D (795-802)
gccaacaaggugcgcgucgcccug

SEQ ID NO: 30032 - RNA, 27 nt, Artificial Sequence
  Major facilitator superfamily domain-containing protein 12 (11-19)
gcccccagcccgcgcccccugucccuc

SEQ ID NO: 30033 - RNA, 27 nt, Artificial Sequence
  THO complex subunit 4 (51-59)
gcccccuacagccgcccgaagcagcug

SEQ ID NO: 30034 - RNA, 27 nt, Artificial Sequence
  40S ribosomal protein S3 (44-52)
gcccaggccgagagccugcgcuacaag

SEQ ID NO: 30035 - RNA, 33 nt, Artificial Sequence
  Hydroxymethylglutaryl-CoA synthase, cytoplasmic (393-403)
gcccaguacagcccccagcagcuggccggcaag

SEQ ID NO: 30036 - RNA, 30 nt, Artificial Sequence
  Nucleolar protein 58 (344-353)
gccagccuggugggccagaccucccccaag

SEQ ID NO: 30037 - RNA, 27 nt, Artificial Sequence
  Casein kinase II subunit beta (204-212)
gccagcaacuucaagucccccgugaag

SEQ ID NO: 30038 - RNA, 27 nt, Artificial Sequence
  Sec1 family domain-containing protein 1 (482-490)
gccagcuacggcuccaccaccacgaag

SEQ ID NO: 30039 - RNA, 33 nt, Artificial Sequence
  Actin, cytoplasmic 2 (19-29)
gccaccgccgcgagcuccagcucccuggagaag

SEQ ID NO: 30040 - RNA, 30 nt, Artificial Sequence
  Receptor expression-enhancing protein 3 (130-139)
gccaccgccgcggugaccgccgccgucaag

SEQ ID NO: 30041 - RNA, 27 nt, Artificial Sequence
  Mediator of RNA polymerase II transcription subunit 12 (294-302)
gccaccgccggcuucaccaucgggcgc

SEQ ID NO: 30042 - RNA, 27 nt, Artificial Sequence
  Kinetochore protein Nuf2 (353-361)
gccaccgcccaguucaagaucaacaag

SEQ ID NO: 30043 - RNA, 27 nt, Artificial Sequence
  E3 ubiquitin-protein ligase makorin-1 (117-125)
gccaccgccaccgagcugacgaccaag

SEQ ID NO: 30044 - RNA, 27 nt, Artificial Sequence
  Adenomatous polyposis coli protein (1083-1091)
gccaccgacauccccagcucccagaag

SEQ ID NO: 30045 - RNA, 27 nt, Artificial Sequence
  Myosin-9 (540-548)
gccaccgacaagagcuucguggagaag

SEQ ID NO: 30046 - RNA, 27 nt, Artificial Sequence
  Probable ATP-dependent RNA helicase DHX37 (603-611)
gccaccuuccccguggccccgcgcuac

SEQ ID NO: 30047 - RNA, 33 nt, Artificial Sequence
  Protein transport protein Sec31A (61-71)
gccaccuucagcuccagccaccgcuaccacaag

SEQ ID NO: 30048 - RNA, 27 nt, Artificial Sequence
  Exosome complex component RRP41 (79-87)
gccaccuucagcaccggcgagcgcaag

SEQ ID NO: 30049 - RNA, 30 nt, Artificial Sequence
  Angio-associated migratory cell protein (18-27)
gccaccggcgacaugagcgggcugcucaag

SEQ ID NO: 30050 - RNA, 27 nt, Artificial Sequence
  Trans-3-hydroxy-L-proline dehydratase (302-310)
gccaccggcagcguguucaccgggaag

SEQ ID NO: 30051 - RNA, 27 nt, Artificial Sequence
  Lamina-associated polypeptide 2, isoform alpha (583-591)
gccacccacaccgccuucguggcgaag

SEQ ID NO: 30052 - RNA, 27 nt, Artificial Sequence
  Helicase with zinc finger domain 2 (1314-1322)
gccaccaucaccaaggugcugcagaag

SEQ ID NO: 30053 - RNA, 27 nt, Artificial Sequence
  Hexokinase-2 (388-396)
gccacccuggccgcggugcuccagcgc

SEQ ID NO: 30054 - RNA, 30 nt, Artificial Sequence
  Fanconi anemia group I protein (1123-1132)
gccacccugcccaaccagccgguggagaag

SEQ ID NO: 30055 - RNA, 27 nt, Artificial Sequence
  Pescadillo homolog (14-22)
gccaccaacuacaucacccgcaacaag

SEQ ID NO: 30056 - RNA, 27 nt, Artificial Sequence
  Nucleolar and spindle-associated protein 1 (346-354)
gccacccagacccccgugagcaacaag

SEQ ID NO: 30057 - RNA, 27 nt, Artificial Sequence
  Retinoblastoma-associated protein (27-35)
gccaccagcgccuuccagacccagaag

SEQ ID NO: 30058 - RNA, 27 nt, Artificial Sequence
  DNA repair protein XRCC2 (193-201)
gccaccacccagacgaucaugcagaag

SEQ ID NO: 30059 - RNA, 30 nt, Artificial Sequence
  Derlin-1 (21-30)
gccaccguggccgucccccuggugggcaag

SEQ ID NO: 30060 - RNA, 27 nt, Artificial Sequence
  Pre-mRNA-processing-splicing factor 8 (765-773)
gccaccguggacaagaccgucugcaag

SEQ ID NO: 30061 - RNA, 30 nt, Artificial Sequence
  Importin subunit beta-1 (862-871)
gccaccugggccaccaaggagcugcgcaag

SEQ ID NO: 30062 - RNA, 30 nt, Artificial Sequence
  60S ribosomal protein L13 (23-32)
gccaccugguucaaccagcccgcccgcaag

SEQ ID NO: 30063 - RNA, 30 nt, Artificial Sequence
  DNA (cytosine-5)-methyltransferase 3A (168-177)
gccaccuacaacaagcagcccauguaccgc

SEQ ID NO: 30064 - RNA, 27 nt, Artificial Sequence
  Putative rhophilin-2-like protein RHPN2P1 (502-510)
gccaccuacagcgugggcaugcagaag

SEQ ID NO: 30065 - RNA, 30 nt, Artificial Sequence
  TRAF2 and NCK-interacting protein kinase (83-92)
gccaccuacuacggcgccuucaucaagaag

SEQ ID NO: 30066 - RNA, 27 nt, Artificial Sequence
  T-complex protein 1 subunit gamma (73-81)
gccguggcccacgcgcugaccgagaag

SEQ ID NO: 30067 - RNA, 30 nt, Artificial Sequence
  WD repeat-containing protein 3 (14-23)
gccguguucggcgucaucgggagccagaag

SEQ ID NO: 30068 - RNA, 33 nt, Artificial Sequence
  Importin subunit alpha-1 (338-348)
gccguguuccccagccugcucaccaacccgaag

SEQ ID NO: 30069 - RNA, 30 nt, Artificial Sequence
  Nucleoside diphosphate kinase 6 (39-48)
gccgugcaccagcagauccugagcaacaag

SEQ ID NO: 30070 - RNA, 27 nt, Artificial Sequence
  Methylsterol monooxygenase 1 (15-23)
gccgugaucgaggacaccuggcacuac

SEQ ID NO: 30071 - RNA, 33 nt, Artificial Sequence
  Protein HIRA (394-404)
gccgugaucgagaaccccgagaugcugaaguac

SEQ ID NO: 30072 - RNA, 27 nt, Artificial Sequence
  Probable phospholipid-transporting ATPase IF (301-309)
gccgugaucagcaccauccugaaguac

SEQ ID NO: 30073 - RNA, 27 nt, Artificial Sequence
  Integrator complex subunit 12 (240-248)
gccgugaaggacccccuggucaagaag

SEQ ID NO: 30074 - RNA, 27 nt, Artificial Sequence
  Nuclear pore complex protein Nup160 (1177-1185)
gccgugcugggcaaggggcaccaguac

SEQ ID NO: 30075 - RNA, 27 nt, Artificial Sequence
  Cyclin-I (179-187)
gccgugcugaccaagcagcuccugcac

SEQ ID NO: 30076 - RNA, 30 nt, Artificial Sequence
  Signal peptidase complex catalytic subunit SEC11C (180-189)
gccgugaugggcgccuacguccugcucaag

SEQ ID NO: 30077 - RNA, 30 nt, Artificial Sequence
  Structural maintenance of chromosomes protein 4 (1190-1199)
gccgugaaccccaaggagaucgccagcaag

SEQ ID NO: 30078 - RNA, 27 nt, Artificial Sequence
  Sororin (53-61)
gccgugcgcaagcccaucguccugaag

SEQ ID NO: 30079 - RNA, 27 nt, Artificial Sequence
  Histone H2B type 1-K (118-126)
gccgugaccaaguacaccagcgccaag

SEQ ID NO: 30080 - RNA, 33 nt, Artificial Sequence
  Nuclear pore complex protein Nup160 (1113-1123)
gccguguacgaccgccccggcgccagcccgaag

SEQ ID NO: 30081 - RNA, 27 nt, Artificial Sequence
  Integrator complex subunit 8 (269-277)
gccguguacgagaacgcccgcgagaag

SEQ ID NO: 30082 - RNA, 27 nt, Artificial Sequence
  Toll-interacting protein (84-92)
gccguguacgagacccccaccgcccac

SEQ ID NO: 30083 - RNA, 33 nt, Artificial Sequence
  Ras GTPase-activating protein-binding protein 1 (54-64)
gccguguacggccagaaggagauccaccgcaag

SEQ ID NO: 30084 - RNA, 27 nt, Artificial Sequence
  Amyloid protein-binding protein 2 (337-345)
gccuacagcuccuacgugcaccaguac

SEQ ID NO: 30085 - RNA, 27 nt, Artificial Sequence
  182 kDa tankyrase-1-binding protein (415-423)
gacgcccaccugcgccccaccagccuc

SEQ ID NO: 30086 - RNA, 24 nt, Artificial Sequence
  Cytoplasmic FMR1-interacting protein 2 (285-292)
gacgccaagaagcgcaucaaccug

SEQ ID NO: 30087 - RNA, 27 nt, Artificial Sequence
  Heat shock protein 105 kDa (255-263)
gacgccaagagcaagauccgcgcccug

SEQ ID NO: 30088 - RNA, 27 nt, Artificial Sequence
  Chromodomain-helicase-DNA-binding protein 2 (106-114)
gacgaggcccugaucggcaagaaguuc

SEQ ID NO: 30089 - RNA, 30 nt, Artificial Sequence
  Pre-mRNA-processing-splicing factor 8 (1104-1113)
gacgaggcccgcgaccugauccagcgguac

SEQ ID NO: 30090 - RNA, 30 nt, Artificial Sequence
  EH domain-containing protein 4 (201-210)
gacgaguucagcgaggccaucaaggccuuc

SEQ ID NO: 30091 - RNA, 33 nt, Artificial Sequence
  26S protease regulatory subunit 10B (247-257)
gacgagaucgacgccaucggcgggcgccgguuc

SEQ ID NO: 30092 - RNA, 30 nt, Artificial Sequence
  U4/U6 small nuclear ribonucleoprotein Prp31 (322-331)
gacgagaucgagcgcaaguucgacaagugg

SEQ ID NO: 30093 - RNA, 27 nt, Artificial Sequence
  Zinc finger MYND domain-containing protein 11 (348-356)
gacgagcuggagcuccaccagcgcuuc

SEQ ID NO: 30094 - RNA, 30 nt, Artificial Sequence
  General transcription factor IIH subunit 5 (24-33)
gacgagagcaacgcccugggcaagaaguuc

SEQ ID NO: 30095 - RNA, 27 nt, Artificial Sequence
  Ubiquitin carboxyl-terminal hydrolase 19 (1197-1205)
gacgagagccagguggucacccgcuac

SEQ ID NO: 30096 - RNA, 27 nt, Artificial Sequence
  Serrate RNA effector molecule homolog (164-172)
gacgagaccgaggccgugaagcgcuac

SEQ ID NO: 30097 - RNA, 30 nt, Artificial Sequence
  60S ribosomal protein L26 (53-62)
gacgaggugcaggucgugcgcggccacuac

SEQ ID NO: 30098 - RNA, 27 nt, Artificial Sequence
  Ras GTPase-activating protein-binding protein 2 (60-68)
gacauccaccacaaggugcugagccuc

SEQ ID NO: 30099 - RNA, 27 nt, Artificial Sequence
  Heat shock 70 kDa protein 4 (255-263)
gacaucaagagcaagauccgcgcccug

SEQ ID NO: 30100 - RNA, 27 nt, Artificial Sequence
  Heterogeneous nuclear ribonucleoprotein F (196-204)
gaccccccgcugaaguucaugagcgug

SEQ ID NO: 30101 - RNA, 27 nt, Artificial Sequence
  Cullin-1 (348-356)
gacgugcacaagaaguacaacgcccug

SEQ ID NO: 30102 - RNA, 27 nt, Artificial Sequence
  Spectrin alpha chain, non-erythrocytic 1 (50-58)
gacgugaaggccaagcugcacgagcuc

SEQ ID NO: 30103 - RNA, 27 nt, Artificial Sequence
  Coatomer subunit beta (34-42)
gacgugaagagcaagaccgaggcccug

SEQ ID NO: 30104 - RNA, 24 nt, Artificial Sequence
  Pumilio homolog 3 (320-327)
gaggccgugaucaagcacagccug

SEQ ID NO: 30105 - RNA, 30 nt, Artificial Sequence
  NADH dehydrogenase (ubiquinone) 1 alpha subcomplex subunit 13 (122-131)
gaggaggcccugcacgccagccacggcuuc

SEQ ID NO: 30106 - RNA, 27 nt, Artificial Sequence
  DDB1- and CUL4-associated factor 10 (132-140)
gaggaggccaacgugggccgcggguac

SEQ ID NO: 30107 - RNA, 33 nt, Artificial Sequence
  15 kDa selenoprotein (76-86)
gaggaggcccaguucgagaccaagaagcuguac

SEQ ID NO: 30108 - RNA, 30 nt, Artificial Sequence
  Negative elongation factor E (10-19)
gaggaggaggaggcccugcagaagaaguuc

SEQ ID NO: 30109 - RNA, 27 nt, Artificial Sequence
  60S ribosomal protein L13 (171-179)
gaggaggagaagaacuucaaggccuuc

SEQ ID NO: 30110 - RNA, 30 nt, Artificial Sequence
  Coiled-coil domain-containing protein 66 (780-789)
gaggaggagccccugaacauccacagcuuc

SEQ ID NO: 30111 - RNA, 27 nt, Artificial Sequence
  HLA class II histocompatibility antigen, DR alpha chain (41-49)
gaggaguucggccgcuucgccagcuuc

SEQ ID NO: 30112 - RNA, 30 nt, Artificial Sequence
  E3 ubiquitin-protein ligase MGRN1 (140-149)
gaggaguuccugaacggccgcgccguguac

SEQ ID NO: 30113 - RNA, 27 nt, Artificial Sequence
  Cullin-4A (269-277)
gaggagggcgaccgcgugaucaccuac

SEQ ID NO: 30114 - RNA, 27 nt, Artificial Sequence
  WD repeat-containing protein 36 (776-784)
gaggagggccuggugaacaacaaguac

SEQ ID NO: 30115 - RNA, 30 nt, Artificial Sequence
  A-kinase anchor protein 2 (256-265)
gaggagcaccuggagagccacaagaaguac

SEQ ID NO: 30116 - RNA, 27 nt, Artificial Sequence
  Unconventional myosin-Ie (749-757)
gaggagcaccccgagcugcagcaguuc

SEQ ID NO: 30117 - RNA, 27 nt, Artificial Sequence
  Vimentin (229-237)
gaggagaucgccuuccugaagaagcuc

SEQ ID NO: 30118 - RNA, 30 nt, Artificial Sequence
  PH domain leucine-rich repeat-containing protein phosphatase 1 (287-296)
gaggagaucgaccugagcggcaacaagcuc

SEQ ID NO: 30119 - RNA, 24 nt, Artificial Sequence
  Probable ATP-dependent RNA helicase DDX56 (421-428)
gaggagaucgagggcuuccgcuac

SEQ ID NO: 30120 - RNA, 27 nt, Artificial Sequence
  Paxillin (389-397)
gaggagaucggcagccgcaacuucuuc

SEQ ID NO: 30121 - RNA, 27 nt, Artificial Sequence
  Retinoblastoma-like protein 1 (195-203)
gaggagaucggcaccccccgcaaguuc

SEQ ID NO: 30122 - RNA, 30 nt, Artificial Sequence
  Bloom syndrome protein (942-951)
gaggagauccccgugagcucccacuacuuc

SEQ ID NO: 30123 - RNA, 30 nt, Artificial Sequence
  Kinesin-like protein KIF21A (473-482)
gaggagaucagcaacaugauccacuccuac

SEQ ID NO: 30124 - RNA, 33 nt, Artificial Sequence
  Thioredoxin-related transmembrane protein 2 (148-158)
gaggagcuggagcgcgacaagcgggugaccugg

SEQ ID NO: 30125 - RNA, 24 nt, Artificial Sequence
  Clathrin heavy chain 1 (361-368)
gaggagcuguucgcccgcaaguuc

SEQ ID NO: 30126 - RNA, 27 nt, Artificial Sequence
  2',3'-cyclic-nucleotide 3'-phosphodiesterase (191-199)
gaggagcugggcaaccacaaggccuuc

SEQ ID NO: 30127 - RNA, 27 nt, Artificial Sequence
  Protein FAM192A (107-115)
gaggagcugaaggagcucaaggaguac

SEQ ID NO: 30128 - RNA, 30 nt, Artificial Sequence
  Proteasome subunit beta type-4 (119-128)
gaggagcugcucggcgacgggcacagcuac

SEQ ID NO: 30129 - RNA, 30 nt, Artificial Sequence
  Sorting nexin-14 (340-349)
gaggagcugcagaagaucuacaagaccuac

SEQ ID NO: 30130 - RNA, 27 nt, Artificial Sequence
  Krueppel-like factor 6 (124-132)
gaggagcugagccccaccgccaaguuc

SEQ ID NO: 30131 - RNA, 33 nt, Artificial Sequence
  Eukaryotic initiation factor 4A-I (239-249)
gaggagcugacccucgagggcauccgccaguuc

SEQ ID NO: 30132 - RNA, 30 nt, Artificial Sequence
  Coiled-coil domain-containing protein 93 (132-141)
gaggagaugggcgacuacauccgcagcuac

SEQ ID NO: 30133 - RNA, 30 nt, Artificial Sequence
  Nuclear pore complex protein Nup153 (1104-1113)
gaggagaugcccgccaccaagggcggguuc

SEQ ID NO: 30134 - RNA, 30 nt, Artificial Sequence
  Folliculin-interacting protein 1 (434-443)
gaggagaacgccguggacgucaagcaguac

SEQ ID NO: 30135 - RNA, 27 nt, Artificial Sequence
  Tropomodulin-3 (310-318)
gaggagaacaccaacauccugaaguuc

SEQ ID NO: 30136 - RNA, 27 nt, Artificial Sequence
  G2/mitotic-specific cyclin-B1 (183-191)
gaggagcaggccgugcgccccaaguac

SEQ ID NO: 30137 - RNA, 27 nt, Artificial Sequence
  Targeting protein for Xklp2 (170-178)
gaggagcaggagcuggagaagagcaug

SEQ ID NO: 30138 - RNA, 27 nt, Artificial Sequence
  Nuclear receptor-binding protein (235-243)
gaggagcagaagaaccugcacuucuuc

SEQ ID NO: 30139 - RNA, 30 nt, Artificial Sequence
  Cyclin-G-associated kinase (740-749)
gaggagcagcaggacauccugagcaaguuc

SEQ ID NO: 30140 - RNA, 30 nt, Artificial Sequence
  Nitrogen permease regulator 2-like protein (336-345)
gaggagcagagccaccccgcccgccuguac

SEQ ID NO: 30141 - RNA, 27 nt, Artificial Sequence
  OTU domain-containing protein 5 (177-185)
gaggagcagguggcccgcgagagcuac

SEQ ID NO: 30142 - RNA, 27 nt, Artificial Sequence
  Histone-binding protein RBBP4 (13-21)
gaggagcgcgugaucaacgaggaguac

SEQ ID NO: 30143 - RNA, 27 nt, Artificial Sequence
  Sorting nexin-24 (11-19)
gaggagagcgaccuggagcgcggcuac

SEQ ID NO: 30144 - RNA, 27 nt, Artificial Sequence
  Poly(rC)-binding protein 2 (41-49)
gaggagagcggcgcccgcaucaacauc

SEQ ID NO: 30145 - RNA, 27 nt, Artificial Sequence
  Vacuolar fusion protein CCZ1 homolog (215-223)
gaggagagccugaacaucgugaaguac

SEQ ID NO: 30146 - RNA, 30 nt, Artificial Sequence
  ATP-dependent RNA helicase DDX19B (301-310)
gaggagacccuggacaccaucaagcaguac

SEQ ID NO: 30147 - RNA, 30 nt, Artificial Sequence
  Elongation factor 1-gamma (325-334)
gaggagacccagacccuggugcgcgaguac

SEQ ID NO: 30148 - RNA, 30 nt, Artificial Sequence
  Adenylate cyclase type 3 (1088-1097)
gaggagacccaggugauccugcgcgaguac

SEQ ID NO: 30149 - RNA, 30 nt, Artificial Sequence
  Cleavage and polyadenylation specificity factor subunit 1 (1111-1120)
gaggagaccgugagcggccugaagggguac

SEQ ID NO: 30150 - RNA, 30 nt, Artificial Sequence
  MICOS complex subunit MIC19 (168-177)
gaggagguggaggccaaguucaagcgcuac

SEQ ID NO: 30151 - RNA, 24 nt, Artificial Sequence
  G patch domain-containing protein 4 (211-218)
gaggagguggagagccgcgccuac

SEQ ID NO: 30152 - RNA, 30 nt, Artificial Sequence
  Chromodomain-helicase-DNA-binding protein 1-like (214-223)
gaggaggugggcgacuucauccagcgcuac

SEQ ID NO: 30153 - RNA, 27 nt, Artificial Sequence
  Ferritin light chain (137-145)
gaggaggugaagcugaucaagaagaug

SEQ ID NO: 30154 - RNA, 27 nt, Artificial Sequence
  Alanine-tRNA ligase, cytoplasmic (378-386)
gaggaggugcaguuccugaagacccuc

SEQ ID NO: 30155 - RNA, 30 nt, Artificial Sequence
  Glutaredoxin-3 (139-148)
gaggaggugcgccagggccugaaggccuac

SEQ ID NO: 30156 - RNA, 24 nt, Artificial Sequence
  Pre-B-cell leukemia transcription factor 3 (11-18)
gagaucaaggagaagaccggccug

SEQ ID NO: 30157 - RNA, 27 nt, Artificial Sequence
  AP-2 complex subunit alpha-1 (29-37)
gagaucaagcgcaucaacaaggagcug

SEQ ID NO: 30158 - RNA, 27 nt, Artificial Sequence
  40S ribosomal protein S24 (39-47)
gagauccgcgagaagcuggccaagaug

SEQ ID NO: 30159 - RNA, 27 nt, Artificial Sequence
  Crooked neck-like protein 1 (571-579)
gagauccgccagaagaaccugagccuc

SEQ ID NO: 30160 - RNA, 27 nt, Artificial Sequence
  Enhancer of mRNA-decapping protein 3 (285-293)
gagcugcacaagaagcuccugagcgug

SEQ ID NO: 30161 - RNA, 27 nt, Artificial Sequence
  Alpha-2-macroglobulin receptor-associated protein (20-28)
gagcugaaggagaagcuccgcagcauc

SEQ ID NO: 30162 - RNA, 24 nt, Artificial Sequence
  Neuroblastoma-amplified sequence (1048-1055)
gagcugcucgagaagcacggccug

SEQ ID NO: 30163 - RNA, 27 nt, Artificial Sequence
  Heat shock protein HSP 90-beta (529-537)
gagcgcaucaugaaggcccaggcccug

SEQ ID NO: 30164 - RNA, 27 nt, Artificial Sequence
  Protein phosphatase 1 regulatory subunit 7 (95-103)
gaggugcugaagaaggucaagacccuc

SEQ ID NO: 30165 - RNA, 24 nt, Artificial Sequence
  Heterogeneous nuclear ribonucleoprotein M (130-137)
gaggugcugaacaagcacagccuc

SEQ ID NO: 30166 - RNA, 27 nt, Artificial Sequence
  Exosome component 10 (254-262)
uucgcccaccccuaccaguacgagcug

SEQ ID NO: 30167 - RNA, 27 nt, Artificial Sequence
  Long-chain-fatty-acid-CoA ligase 3 (551-559)
uucgaggacgagaacggccagcgcugg

SEQ ID NO: 30168 - RNA, 30 nt, Artificial Sequence
  X-ray repair cross-complementing protein 6 (478-487)
uucgagaaccccgugcugcagcagcacuuc

SEQ ID NO: 30169 - RNA, 27 nt, Artificial Sequence
  Cyclin-dependent kinase 14 (275-283)
uucggccuggcccgcgccaagagcgug

SEQ ID NO: 30170 - RNA, 27 nt, Artificial Sequence
  Translocation protein SEC62 (278-286)
uuccgcccccuguacacccacgaguac

SEQ ID NO: 30171 - RNA, 24 nt, Artificial Sequence
  Myosin-9 (831-838)
uucaccaaggugaagccccugcuc

SEQ ID NO: 30172 - RNA, 27 nt, Artificial Sequence
  Gamma-interferon-inducible protein 16 (533-541)
uucguguacgagcccaaggagcagaag

SEQ ID NO: 30173 - RNA, 30 nt, Artificial Sequence
  Constitutive coactivator of peroxisome proliferator-activated receptor gamma (663-672)
uucguguaccccggcaacccgcugcgccac

SEQ ID NO: 30174 - RNA, 27 nt, Artificial Sequence
  Serine/threonine-protein phosphatase 2A 65 kDa regulatory subunit A alpha isoform (190-198)
ggcgaguucgccaaggugcuggagcuc

SEQ ID NO: 30175 - RNA, 33 nt, Artificial Sequence
  DNA replication licensing factor MCM5 (552-562)
ggcgagaucgaccuggccaagcucaagaaguuc

SEQ ID NO: 30176 - RNA, 27 nt, Artificial Sequence
  Serine/threonine-protein phosphatase PP1-beta catalytic subunit (216-224)
ggcgagaacgaccgcggggugagcuuc

SEQ ID NO: 30177 - RNA, 30 nt, Artificial Sequence
  HLA class I histocompatibility antigen, B-7 alpha chain (42-51)
ggcgagccccgcuucaucagcgugggguac

SEQ ID NO: 30178 - RNA, 30 nt, Artificial Sequence
  Protein SCAF11 (201-210)
ggcgagagcuccuucaccuaccgcgccuac

SEQ ID NO: 30179 - RNA, 27 nt, Artificial Sequence
  Rho GTPase-activating protein 21 (129-137)
ggcgagagcgugaucgggaagaccuac

SEQ ID NO: 30180 - RNA, 33 nt, Artificial Sequence
  Arfaptin-1 (19-29)
ggcgagguggacgacagccgcgagcacuccuuc

SEQ ID NO: 30181 - RNA, 27 nt, Artificial Sequence
  AP-2 complex subunit mu (12-20)
ggcgaggugcugaucagccgcgucuac

SEQ ID NO: 30182 - RNA, 27 nt, Artificial Sequence
  Endoplasmic reticulum-Golgi intermediate compartment protein 3 (255-263)
ggcgaggugcugcgcaccaaccaguuc

SEQ ID NO: 30183 - RNA, 30 nt, Artificial Sequence
  Proline and serine-rich protein 1 (157-166)
ggcaucuuccccgggaccccgcugaagaag

SEQ ID NO: 30184 - RNA, 30 nt, Artificial Sequence
  Ubiquitin carboxyl-terminal hydrolase 36 (460-469)
ggcaucaucagcuccccccugaccgggaag

SEQ ID NO: 30185 - RNA, 27 nt, Artificial Sequence
  Alpha-2-macroglobulin receptor-associated protein (145-153)
ggccuggacgacccccgccucgagaag

SEQ ID NO: 30186 - RNA, 33 nt, Artificial Sequence
  Targeting protein for Xklp2 (12-22)
ggccuguuccaggggaagaccccccuccgcaag

SEQ ID NO: 30187 - RNA, 30 nt, Artificial Sequence
  Glutathione S-transferase kappa 1 (142-151)
ggccugcucgagaagaucgccacccccaag

SEQ ID NO: 30188 - RNA, 27 nt, Artificial Sequence
  Kelch repeat and BTB domain-containing protein 7 (280-288)
ggccugcucaccaagcccaucgugaag

SEQ ID NO: 30189 - RNA, 27 nt, Artificial Sequence
  Microtubule-associated protein 4 (735-743)
ggccugaacaagaagcccaugagccuc

SEQ ID NO: 30190 - RNA, 27 nt, Artificial Sequence
  Epidermal growth factor receptor substrate 15-like 1 (46-54)
ggccugagcgacaucauccucgggaag

SEQ ID NO: 30191 - RNA, 27 nt, Artificial Sequence
  Calcium homeostasis endoplasmic reticulum protein (680-688)
ggccuguacgaguucuuccgcgccaag

SEQ ID NO: 30192 - RNA, 27 nt, Artificial Sequence
  Cyclin-dependent kinase 9 (136-144)
ggccuguacuacauccaccgcaacaag

SEQ ID NO: 30193 - RNA, 30 nt, Artificial Sequence
  26S proteasome non-ATPase regulatory subunit 8 (146-155)
ggcagcuacaacaagguguuccuggccaag

SEQ ID NO: 30194 - RNA, 27 nt, Artificial Sequence
  RNA polymerase II-associated protein 3 (188-196)
ggcagcuacuccaaggccuucgcccgc

SEQ ID NO: 30195 - RNA, 30 nt, Artificial Sequence
  Zinc finger E-box-binding homeobox 1 (190-199)
ggcagcuacuccagccacaucuccagcaag

SEQ ID NO: 30196 - RNA, 27 nt, Artificial Sequence
  Dynein light chain 1, cytoplasmic (63-71)
ggcagcuacgugacccacgagaccaag

SEQ ID NO: 30197 - RNA, 30 nt, Artificial Sequence
  39S ribosomal protein L2, mitochondrial (222-231)
ggcaccgccaucauccagcugcccagcaag

SEQ ID NO: 30198 - RNA, 27 nt, Artificial Sequence
  Fidgetin-like protein 1 (444-452)
ggcaccgggaagacccugaucggcaag

SEQ ID NO: 30199 - RNA, 27 nt, Artificial Sequence
  ATP-binding cassette sub-family F member 3 (103-111)
ggcaccaagcugcccgggcuccugaag

SEQ ID NO: 30200 - RNA, 27 nt, Artificial Sequence
  WD repeat-containing protein 46 (390-398)
ggcaccuaccagccccugagcacccgc

SEQ ID NO: 30201 - RNA, 27 nt, Artificial Sequence
  Protein quaking (198-206)
ggcaccuaccgcgacgccaacaucaag

SEQ ID NO: 30202 - RNA, 27 nt, Artificial Sequence
  Rho-associated protein kinase 1 (285-293)
ggcaccuacagcaagaucaugaaccac

SEQ ID NO: 30203 - RNA, 27 nt, Artificial Sequence
  Protein phosphatase 1 regulatory subunit 7 (159-167)
ggcguggacaagcugacccgccucaag

SEQ ID NO: 30204 - RNA, 27 nt, Artificial Sequence
  Profilin-1 (118-126)
ggcgugcacgggggccugaucaacaag

SEQ ID NO: 30205 - RNA, 33 nt, Artificial Sequence
  Exosome complex component RRP40 (136-146)
ggcgugaucgggcaggacggccugcucuucaag

SEQ ID NO: 30206 - RNA, 27 nt, Artificial Sequence
  Ubiquinol-cytochrome-c reductase complex assembly factor 1 (118-126)
ggcgugaaccccuacauccugaagaag

SEQ ID NO: 30207 - RNA, 27 nt, Artificial Sequence
  Eukaryotic translation initiation factor 3 subunit C-like protein (190-198)
ggcgugagcgccgccaccuuccugaag

SEQ ID NO: 30208 - RNA, 27 nt, Artificial Sequence
  Antizyme inhibitor 1 (319-327)
ggcguguacgggagcuucgccuccaag

SEQ ID NO: 30209 - RNA, 30 nt, Artificial Sequence
  Nuclear pore complex protein Nup160 (105-114)
ggcguguacgucagcgagacccagaaccgc

SEQ ID NO: 30210 - RNA, 27 nt, Artificial Sequence
  Alanine-tRNA ligase, cytoplasmic (301-309)
cacgcccgcaccaucaccguggcccug

SEQ ID NO: 30211 - RNA, 27 nt, Artificial Sequence
  Transketolase (243-251)
cacgccagcgaccgcaucaucgcccug

SEQ ID NO: 30212 - RNA, 27 nt, Artificial Sequence
  Stathmin (64-72)
cacgaggccgaggugcugaagcagcuc

SEQ ID NO: 30213 - RNA, 27 nt, Artificial Sequence
  WD repeat-containing protein 6 (315-323)
cacgagggcgagauccugcaggccuuc

SEQ ID NO: 30214 - RNA, 33 nt, Artificial Sequence
  Carbohydrate sulfotransferase 10 (215-225)
cacgagaucgcccccggcaucauccgcaaguac

SEQ ID NO: 30215 - RNA, 27 nt, Artificial Sequence
  Nardilysin (1054-1062)
cacgagaucgaggcccugaagagcuuc

SEQ ID NO: 30216 - RNA, 24 nt, Artificial Sequence
  LanC-like protein 1 (89-96)
cacggcuacgugaagcagagccug

SEQ ID NO: 30217 - RNA, 27 nt, Artificial Sequence
  Histone H2A.V (87-95)
cacauccacaagagccugaucggcaag

SEQ ID NO: 30218 - RNA, 27 nt, Artificial Sequence
  E3 ubiquitin-protein ligase TRIP12 (1751-1759)
caccuggaggacaucgugcgccagaag

SEQ ID NO: 30219 - RNA, 27 nt, Artificial Sequence
  Unconventional myosin-VI (430-438)
caccuguucgaccacguggucaaccgc

SEQ ID NO: 30220 - RNA, 27 nt, Artificial Sequence
  Nardilysin (708-716)
caccugaucagcccccucauccagaag

SEQ ID NO: 30221 - RNA, 33 nt, Artificial Sequence
  Hermansky-Pudlak syndrome 5 protein (400-410)
caccugaagagccagcucgaccacggcaccuac

SEQ ID NO: 30222 - RNA, 27 nt, Artificial Sequence
  Integrin-linked protein kinase (248-256)
cacacccuggagccccucaucccgcgc

SEQ ID NO: 30223 - RNA, 30 nt, Artificial Sequence
  Serine/threonine-protein kinase WNK1 (339-348)
cacacccgcacccccccgaucauccaccgg

SEQ ID NO: 30224 - RNA, 27 nt, Artificial Sequence
  Centromere protein M (122-130)
cacaccuaccagagcccccugcucuac

SEQ ID NO: 30225 - RNA, 30 nt, Artificial Sequence
  T-complex protein 1 subunit epsilon (135-144)
cacgugaucgagacccugaucggcaagaag

SEQ ID NO: 30226 - RNA, 27 nt, Artificial Sequence
  Gamma-interferon-inducible protein 16 (241-249)
cacgugaagguccugaacaccagccuc

SEQ ID NO: 30227 - RNA, 27 nt, Artificial Sequence
  Ankyrin repeat family A protein 2 (113-121)
cacguguacacccccagcaccacgaag

SEQ ID NO: 30228 - RNA, 30 nt, Artificial Sequence
  Little elongation complex subunit 1 (1936-1945)
cacguguacgucggcaacaucagcaagaag

SEQ ID NO: 30229 - RNA, 33 nt, Artificial Sequence
  Deoxynucleoside triphosphate triphosphohydrolase SAMHD1 (397-407)
aucgagaucaccggcgccgggggcaagaaguac

SEQ ID NO: 30230 - RNA, 27 nt, Artificial Sequence
  Lanosterol 14-alpha demethylase (175-183)
aucgagaaggagaccaaggaguacuuc

SEQ ID NO: 30231 - RNA, 27 nt, Artificial Sequence
  NADH dehydrogenase (ubiquinone) 1 beta subcomplex subunit 4 (60-68)
aucgagaaccccgcccugcuccgcugg

SEQ ID NO: 30232 - RNA, 27 nt, Artificial Sequence
  Constitutive coactivator of PPAR-gamma-like protein 1 (325-333)
aucggcuacuacagcgccaccuccaag

SEQ ID NO: 30233 - RNA, 27 nt, Artificial Sequence
  T-complex protein 1 subunit gamma (155-163)
aucaucaacagcuccaucaccaccaag

SEQ ID NO: 30234 - RNA, 27 nt, Artificial Sequence
  TFIIH basal transcription factor complex helicase XPD subunit (533-541)
auccuggagaacauccagcgcaacaag

SEQ ID NO: 30235 - RNA, 27 nt, Artificial Sequence
  Thymidine kinase, cytosolic (24-32)
auccugggccccauguucagcgggaag

SEQ ID NO: 30236 - RNA, 27 nt, Artificial Sequence
  Pre-mRNA-processing-splicing factor 8 (2105-2113)
auccugcccaagaacgugcucaagaag

SEQ ID NO: 30237 - RNA, 30 nt, Artificial Sequence
  BAG35700.1 (99-108)
auccugcgcgacggcaucaccgccgggaag

SEQ ID NO: 30238 - RNA, 27 nt, Artificial Sequence
  Trifunctional purine biosynthetic protein adenosine-3 (190-198)
auccugagcggccccuucgugcagaag

SEQ ID NO: 30239 - RNA, 27 nt, Artificial Sequence
  Actin, gamma-enteric smooth muscle (150-158)
auccugaccgagcgcggcuacagcuuc

SEQ ID NO: 30240 - RNA, 27 nt, Artificial Sequence
  Ornithine decarboxylase (218-226)
auccuguacgaccacgcccacgugaag

SEQ ID NO: 30241 - RNA, 27 nt, Artificial Sequence
  Peroxiredoxin-6 (147-155)
auccuguaccccgccaccaccggccgc

SEQ ID NO: 30242 - RNA, 27 nt, Artificial Sequence
  LYR motif-containing protein 1 (79-87)
auccccuacccgcgccccauccaccug

SEQ ID NO: 30243 - RNA, 27 nt, Artificial Sequence
  SWI/SNF complex subunit SMARCC2 (39-47)
auccaggccgagcccccgaccaacaag

SEQ ID NO: 30244 - RNA, 30 nt, Artificial Sequence
  Lysine-specific histone demethylase 1B (637-646)
auccaguucaaccccccgcugagcgagaag

SEQ ID NO: 30245 - RNA, 27 nt, Artificial Sequence
  Induced myeloid leukemia cell differentiation protein Mcl-1 (115-123)
aucagcuucggcgccuucguggccaag

SEQ ID NO: 30246 - RNA, 27 nt, Artificial Sequence
  3-hydroxy-3-methylglutaryl-coenzyme A reductase (354-362)
aucaccagccccguggucacccagaag

SEQ ID NO: 30247 - RNA, 27 nt, Artificial Sequence
  Pre-mRNA-processing factor 40 homolog A (229-237)
aucguggccggcagccugaucaccaag

SEQ ID NO: 30248 - RNA, 27 nt, Artificial Sequence
  V-type proton ATPase 16 kDa proteolipid subunit (147-155)
aucguggcccugauccucagcaccaag

SEQ ID NO: 30249 - RNA, 27 nt, Artificial Sequence
  HLA class II histocompatibility antigen, DP alpha 1 chain (238-246)
aucgugggcaccguccugaucaucaag

SEQ ID NO: 30250 - RNA, 33 nt, Artificial Sequence
  ATP synthase subunit g, mitochondrial (56-66)
aucgugaacagcgcccagaccggcuccuucaag

SEQ ID NO: 30251 - RNA, 30 nt, Artificial Sequence
  Interferon regulatory factor 9 (119-128)
aucgugagcggccagcccgggacccagaag

SEQ ID NO: 30252 - RNA, 30 nt, Artificial Sequence
  Cleavage and polyadenylation specificity factor subunit 2 (17-26)
aucguguacgccgucgacuucaaccacaag

SEQ ID NO: 30253 - RNA, 27 nt, Artificial Sequence
  Serine palmitoyltransferase 2 (237-245)
aucguguacggccagccccgcacccgg

SEQ ID NO: 30254 - RNA, 27 nt, Artificial Sequence
  Sentrin-specific protease 6 (648-656)
aucguguaccccccgccccccgccaag

SEQ ID NO: 30255 - RNA, 30 nt, Artificial Sequence
  Elongation factor 1-gamma (428-437)
aaggccuucaaccagggcaagaucuucaag

SEQ ID NO: 30256 - RNA, 27 nt, Artificial Sequence
  Tyrosine-protein kinase BAZ1B (885-893)
aaggccuuccaggagggcaucgccaag

SEQ ID NO: 30257 - RNA, 30 nt, Artificial Sequence
  Zinc finger CCCH domain-containing protein 4 (890-899)
aaggccaaggagcccccguucgugcgcaag

SEQ ID NO: 30258 - RNA, 27 nt, Artificial Sequence
  Squalene monooxygenase (318-326)
aaggccaaccacgccgagcugauccuc

SEQ ID NO: 30259 - RNA, 27 nt, Artificial Sequence
  RNA cytidine acetyltransferase (367-375)
aaggccagcgagguguuccugcagcgc

SEQ ID NO: 30260 - RNA, 27 nt, Artificial Sequence
  Ribonuclease inhibitor (226-234)
aaggccagccugcgcgagcucgcccug

SEQ ID NO: 30261 - RNA, 27 nt, Artificial Sequence
  UDP-glucose:glycoprotein glucosyltransferase 2 (5-13)
aaggccaccaacgugguccgccugcuc

SEQ ID NO: 30262 - RNA, 27 nt, Artificial Sequence
  Bifunctional apoptosis regulator (261-269)
aaggccgugaaccccggccgcagccug

SEQ ID NO: 30263 - RNA, 27 nt, Artificial Sequence
  SWI/SNF-related matrix-associated actin-dependent regulator of chromatin subfamily E member 1 (113-121)
aaggccuaccacaacagccccgccuac

SEQ ID NO: 30264 - RNA, 27 nt, Artificial Sequence
  Zinc finger protein 302 (72-80)
aaggccuaccccuucccgcugagccac

SEQ ID NO: 30265 - RNA, 27 nt, Artificial Sequence
  Phosphatidylinositol 4-phosphate 5-kinase type-1 alpha (187-195)
aaggaggccgaguuccugcagaagcuc

SEQ ID NO: 30266 - RNA, 33 nt, Artificial Sequence
  Transmembrane emp24 domain-containing protein 10 (87-97)
aaggaggacgccaccaagggcaaguucgccuuc

SEQ ID NO: 30267 - RNA, 27 nt, Artificial Sequence
  COP9 signalosome complex subunit 6 (78-86)
aaggaggagcaguucaagcagguguuc

SEQ ID NO: 30268 - RNA, 27 nt, Artificial Sequence
  Septin-7 (100-108)
aaggagggcggggugcagcugcuccug

SEQ ID NO: 30269 - RNA, 30 nt, Artificial Sequence
  Phosphatidylinositol-binding clathrin assembly protein (231-240)
aaggagggccuggacaucuacaagaaguuc

SEQ ID NO: 30270 - RNA, 33 nt, Artificial Sequence
  Adenosylhomocysteinase 2 (20-30)
aaggagaucgaggacgccgagaaguacagcuuc

SEQ ID NO: 30271 - RNA, 27 nt, Artificial Sequence
  Heat shock protein HSP 90-alpha A2 (41-49)
aaggagaucuuccugcgcgagcucauc

SEQ ID NO: 30272 - RNA, 30 nt, Artificial Sequence
  Putative homeodomain transcription factor 2 (737-746)
aaggagcuggacagccccuuccgccucuac

SEQ ID NO: 30273 - RNA, 30 nt, Artificial Sequence
  DnaJ homolog subfamily B member 14 (282-291)
aaggagcuggagcgccucaccagccuguac

SEQ ID NO: 30274 - RNA, 27 nt, Artificial Sequence
  Ezrin (61-69)
aaggagaacccccugcaguucaaguuc

SEQ ID NO: 30275 - RNA, 30 nt, Artificial Sequence
  Integrator complex subunit 11 (493-502)
aaggagcaggagaccgcccugcgcguguac

SEQ ID NO: 30276 - RNA, 27 nt, Artificial Sequence
  Hypoxia-inducible factor 1-alpha (32-40)
aaggagagcgagguguucuacgagcug

SEQ ID NO: 30277 - RNA, 27 nt, Artificial Sequence
  Moesin (72-80)
aaggagagcccccugcucuucaaguuc

SEQ ID NO: 30278 - RNA, 27 nt, Artificial Sequence
  Transcription elongation factor B polypeptide 2 (19-27)
aaggagagcuccaccguguucgagcug

SEQ ID NO: 30279 - RNA, 27 nt, Artificial Sequence
  CCAAT/enhancer-binding protein zeta (652-660)
aaggagaccgagaucgugaagaagcug

SEQ ID NO: 30280 - RNA, 27 nt, Artificial Sequence
  Small kinetochore-associated protein (78-86)
aaggagguggacgucagcaagcagcug

SEQ ID NO: 30281 - RNA, 27 nt, Artificial Sequence
  RANBP2-like and GRIP domain-containing protein 1 (31-39)
aaggaguacgaccuggccaagaaguac

SEQ ID NO: 30282 - RNA, 27 nt, Artificial Sequence
  Mitochondrial fission 1 protein (85-93)
aaggaguacgagaaggcccugaaguac

SEQ ID NO: 30283 - RNA, 27 nt, Artificial Sequence
  Spliceosome RNA helicase DDX39B (131-139)
aaggaguacgagcgcuucagcaaguac

SEQ ID NO: 30284 - RNA, 27 nt, Artificial Sequence
  Activating signal cointegrator 1 complex subunit 2 (170-178)
aagggcaacagcccccugcuccagaag

SEQ ID NO: 30285 - RNA, 27 nt, Artificial Sequence
  Fibroblast growth factor receptor 1 (669-677)
aagaucgccgacuucggccuggcccgc

SEQ ID NO: 30286 - RNA, 30 nt, Artificial Sequence
  Kinetochore protein Nuf2 (447-456)
aagaucgacgagaagaccgccgagcugaag

SEQ ID NO: 30287 - RNA, 27 nt, Artificial Sequence
  60S ribosomal protein L7-like 1 (114-122)
aagaucuucagcggcguguucgucaag

SEQ ID NO: 30288 - RNA, 27 nt, Artificial Sequence
  Tyrosine-protein kinase JAK2 (842-850)
aagaucggcgacuucgggcugaccaag

SEQ ID NO: 30289 - RNA, 27 nt, Artificial Sequence
  Replication factor C subunit 1 (306-314)
aagaucggcgaggugagcucccccaag

SEQ ID NO: 30290 - RNA, 27 nt, Artificial Sequence
  Replication factor C subunit 2 (176-184)
aagaucaucgagcccauccagagccgc

SEQ ID NO: 30291 - RNA, 30 nt, Artificial Sequence
  T-complex protein 1 subunit eta (48-57)
aagaucaaggagaucgccgugaccgucaag

SEQ ID NO: 30292 - RNA, 27 nt, Artificial Sequence
  40S ribosomal protein S18 (78-86)
aagauccccgacugguuccugaaccgc

SEQ ID NO: 30293 - RNA, 27 nt, Artificial Sequence
  SAGA-associated factor 29 (50-58)
aagaucagccccuacuaccgcaccaag

SEQ ID NO: 30294 - RNA, 27 nt, Artificial Sequence
  B-cell linker protein (6-14)
aagaucaccgugcccgccagccagaag

SEQ ID NO: 30295 - RNA, 30 nt, Artificial Sequence
  COMM domain-containing protein 2 (42-51)
aagaucuacgagggcgccgcccgcaagcug

SEQ ID NO: 30296 - RNA, 24 nt, Artificial Sequence
  SWI/SNF-related matrix-associated actin-dependent regulator of chromatin subfamily A member 5 (411-418)
aagaucuacgugggccugagcaag

SEQ ID NO: 30297 - RNA, 27 nt, Artificial Sequence
  Cyclin-dependent kinase 4 (81-89)
aagcuggccgacuucggccucgcccgc

SEQ ID NO: 30298 - RNA, 27 nt, Artificial Sequence
  DNA-dependent protein kinase catalytic subunit (1617-1625)
aagcuggccaccaccauccuccagcac

SEQ ID NO: 30299 - RNA, 27 nt, Artificial Sequence
  Myc proto-oncogene protein (341-349)
aagcuggacagcgugcgcguccuccgg

SEQ ID NO: 30300 - RNA, 33 nt, Artificial Sequence
  Translationally-controlled tumor protein (102-112)
aagcuggaggagcagcgccccgagcgggugaag

SEQ ID NO: 30301 - RNA, 33 nt, Artificial Sequence
  Cleavage stimulation factor subunit 1 (198-208)
aagcuguucgacuacagcaagcccuccgccaag

SEQ ID NO: 30302 - RNA, 27 nt, Artificial Sequence
  Baculoviral IAP repeat-containing protein 2 (45-53)
aagcugggcgacagccccauccagaag

SEQ ID NO: 30303 - RNA, 27 nt, Artificial Sequence
  Nucleolar protein 58 (93-101)
aagcugggcggggugaucaaggagaag

SEQ ID NO: 30304 - RNA, 30 nt, Artificial Sequence
  Serine/threonine-protein kinase Chk1 (461-470)
aagcugaucgacaucgugagcucccagaag

SEQ ID NO: 30305 - RNA, 27 nt, Artificial Sequence
  SHC SH2 domain-binding protein 1 (262-270)
aagcugaucgagaacccccuccugcgc

SEQ ID NO: 30306 - RNA, 33 nt, Artificial Sequence
  40S ribosomal protein S9 (30-40)
aagcugaucggcgaguacgggcuccgcaacaag

SEQ ID NO: 30307 - RNA, 33 nt, Artificial Sequence
  60S ribosomal protein L19 (24-34)
aagcugaucaaggacggccucaucauccgcaag

SEQ ID NO: 30308 - RNA, 33 nt, Artificial Sequence
  Myc proto-oncogene protein (413-423)
aagcugaucagcgaggaggaccuccugcgcaag

SEQ ID NO: 30309 - RNA, 30 nt, Artificial Sequence
  60S ribosomal protein L4 (173-182)
aagcugaaggccuggaacgacaucaagaag

SEQ ID NO: 30310 - RNA, 27 nt, Artificial Sequence
  Galactosylgalactosylxylosylprotein 3-beta-glucuronosyltransferase 3 (4-12)
aagcugaagaacguguuccucgccuac

SEQ ID NO: 30311 - RNA, 27 nt, Artificial Sequence
  BRISC and BRCA1-A complex member 1 (297-305)
aagcugcucgcccacccccugcagcgc

SEQ ID NO: 30312 - RNA, 30 nt, Artificial Sequence
  SWI/SNF-related matrix-associated actin-dependent regulator of chromatin subfamily D member 3 (176-185)
aagcugcucgacgaccccagcaagcagaag

SEQ ID NO: 30313 - RNA, 27 nt, Artificial Sequence
  Tyrosine-tRNA ligase, cytoplasmic (319-327)
aagcugcucgaccccauccgcgagaag

SEQ ID NO: 30314 - RNA, 33 nt, Artificial Sequence
  T-complex protein 1 subunit eta (55-65)
aagcugcucgacgugguccaccccgccgccaag

SEQ ID NO: 30315 - RNA, 33 nt, Artificial Sequence
  40S ribosomal protein S16 (49-59)
aagcugcucgagcccgugcugcugcucggcaag

SEQ ID NO: 30316 - RNA, 27 nt, Artificial Sequence
  Prefoldin subunit 6 (58-66)
aagcugcucggccccgugcuggucaag

SEQ ID NO: 30317 - RNA, 30 nt, Artificial Sequence
  Nucleolar protein 7 (112-121)
aagcugcuccccgacaccauccuggagaag

SEQ ID NO: 30318 - RNA, 27 nt, Artificial Sequence
  Target of rapamycin complex 2 subunit MAPKAP1 (222-230)
aagcugaacgacaacgugagcgccuac

SEQ ID NO: 30319 - RNA, 27 nt, Artificial Sequence
  116 kDa U5 small nuclear ribonucleoprotein component (409-417)
aagcugaacauccgcccccuccugcgg

SEQ ID NO: 30320 - RNA, 30 nt, Artificial Sequence
  60S ribosomal protein L4 (327-336)
aagcugaaccccuacgccaagaccaugcgc

SEQ ID NO: 30321 - RNA, 27 nt, Artificial Sequence
  Activator of 90 kDa heat shock protein ATPase homolog 1 (10-18)
aagcugaacuggaccggcaccagcaag

SEQ ID NO: 30322 - RNA, 27 nt, Artificial Sequence
  U5 small nuclear ribonucleoprotein 200 kDa helicase (885-893)
aagcugcccgaggagguggucaagaag

SEQ ID NO: 30323 - RNA, 27 nt, Artificial Sequence
  Class E basic helix-loop-helix protein 40 (51-59)
aagcugccccaccgccucaucgagaag

SEQ ID NO: 30324 - RNA, 30 nt, Artificial Sequence
  60S ribosomal protein L27a (116-125)
aagcugcccaagcagccggugaucgucaag

SEQ ID NO: 30325 - RNA, 30 nt, Artificial Sequence
  Hematopoietic SH2 domain-containing protein  (6-15)
aagcugccccucccgcugcccccccgccug

SEQ ID NO: 30326 - RNA, 27 nt, Artificial Sequence
  EH domain-containing protein 1 (475-483)
aagcugcccaacaccgugcucggcaag

SEQ ID NO: 30327 - RNA, 27 nt, Artificial Sequence
  Protein SET (75-83)
aagcugcgccagcccuucuuccagaag

SEQ ID NO: 30328 - RNA, 27 nt, Artificial Sequence
  Phosphatidylethanolamine-binding protein 1 (88-96)
aagcuguacgagcagcucagcggcaag

SEQ ID NO: 30329 - RNA, 27 nt, Artificial Sequence
  Cilia- and flagella-associated protein 20 (182-190)
aagcuguaccuccccgugcagaacaag

SEQ ID NO: 30330 - RNA, 27 nt, Artificial Sequence
  Polyribonucleotide 5'-hydroxyl-kinase Clp1 (198-206)
aagcuguacaacaagaucaccagccgc

SEQ ID NO: 30331 - RNA, 27 nt, Artificial Sequence
  DnaJ homolog subfamily B member 14 (36-44)
aagcuguacccccucccgagcgcccgc

SEQ ID NO: 30332 - RNA, 27 nt, Artificial Sequence
  Elongator complex protein 3 (316-324)
aagcuguaccccacccucgugauccgc

SEQ ID NO: 30333 - RNA, 33 nt, Artificial Sequence
  Nodal modulator 2 (57-67)
aagcuguacaccaagcacggcacccucaaguac

SEQ ID NO: 30334 - RNA, 30 nt, Artificial Sequence
  Midasin (592-601)
aagauggccgaggugaucggcagcaagcug

SEQ ID NO: 30335 - RNA, 27 nt, Artificial Sequence
  BCL-6 corepressor (460-468)
aagauggcccccaccgugcugguccac

SEQ ID NO: 30336 - RNA, 27 nt, Artificial Sequence
  Low density lipoprotein receptor adapter protein 1 (123-131)
aagaugcacgacaagguguucgccuac

SEQ ID NO: 30337 - RNA, 33 nt, Artificial Sequence
  Protein FAM136A (128-138)
aagaugaaggaggcccugcucagcaucggcaag

SEQ ID NO: 30338 - RNA, 27 nt, Artificial Sequence
  Protein LAP2 (174-182)
aagaugcugcccaagaccaugaaccgc

SEQ ID NO: 30339 - RNA, 33 nt, Artificial Sequence
  Selenoprotein T (32-42)
aagaugcaguacgccaccggcccccugcucaag

SEQ ID NO: 30340 - RNA, 27 nt, Artificial Sequence
  Enhancer of rudimentary homolog (34-42)
aagauguacgaggagcaccugaagcgc

SEQ ID NO: 30341 - RNA, 30 nt, Artificial Sequence
  cAMP-dependent protein kinase catalytic subunit beta (71-80)
aagcagaucgagcacacccugaacgagaag

SEQ ID NO: 30342 - RNA, 30 nt, Artificial Sequence
  Pumilio homolog 3 (310-319)
aagcagauccugacccccauggcccagaag

SEQ ID NO: 30343 - RNA, 33 nt, Artificial Sequence
  Small EDRK-rich factor 2 (37-47)
aagcagcgcgacagcgagaucaugcagcagaag

SEQ ID NO: 30344 - RNA, 33 nt, Artificial Sequence
  T-complex protein 1 subunit theta (98-108)
aagcaguacggcaacgagguguuccuggccaag

SEQ ID NO: 30345 - RNA, 27 nt, Artificial Sequence
  60S ribosomal protein L10a (47-55)
aagcgcuucagcggcaccgugcggcug

SEQ ID NO: 30346 - RNA, 27 nt, Artificial Sequence
  A-kinase anchor protein 13 (266-274)
aagcgccaggaggugaucuacgagcug

SEQ ID NO: 30347 - RNA, 27 nt, Artificial Sequence
  DNA replication licensing factor MCM4 (216-224)
aagagcuucgacaagaaccuguaccgc

SEQ ID NO: 30348 - RNA, 30 nt, Artificial Sequence
  Renin receptor (255-264)
aagagcuucgacaccucccugauccgcaag

SEQ ID NO: 30349 - RNA, 27 nt, Artificial Sequence
  Chromosome alignment-maintaining phosphoprotein 1 (334-342)
aagagcggccccccggagcugcgcaag

SEQ ID NO: 30350 - RNA, 27 nt, Artificial Sequence
  Aurora kinase B (125-133)
aagagccacuucaucguggcccugaag

SEQ ID NO: 30351 - RNA, 30 nt, Artificial Sequence
  Cytoplasmic FMR1-interacting protein 2 (777-786)
aagagccuggaccaggccaucucccgcuuc

SEQ ID NO: 30352 - RNA, 30 nt, Artificial Sequence
  WD repeat-containing protein 36 (360-369)
aagagccugggccacgggcucaucaacaag

SEQ ID NO: 30353 - RNA, 27 nt, Artificial Sequence
  Mediator of RNA polymerase II transcription subunit 27 (195-203)
aagagcaacuaccagguguuccagaag

SEQ ID NO: 30354 - RNA, 27 nt, Artificial Sequence
  Transport and Golgi organization protein 6 homolog (711-719)
aagagcuccgacuucgccgugcugaag

SEQ ID NO: 30355 - RNA, 27 nt, Artificial Sequence
  Histone H3.3 (57-65)
aagagcaccgagcugcucauccgcaag

SEQ ID NO: 30356 - RNA, 27 nt, Artificial Sequence
  Nucleolar protein 7 (170-178)
aagagcuaccuggccgugcgccucaag

SEQ ID NO: 30357 - RNA, 27 nt, Artificial Sequence
  116 kDa U5 small nuclear ribonucleoprotein component (612-620)
aagagcuaccccucccugaccaccaag

SEQ ID NO: 30358 - RNA, 30 nt, Artificial Sequence
  Pre-mRNA-processing-splicing factor 8 (1792-1801)
aagaccuucgagggcaaccugaccacgaag

SEQ ID NO: 30359 - RNA, 27 nt, Artificial Sequence
  Zinc finger and BTB domain-containing protein 40 (1053-1061)
aagaccuuccccaacaccaucgagcac

SEQ ID NO: 30360 - RNA, 27 nt, Artificial Sequence
  Protein FAM3C (112-120)
aagaccggcgaggugcuggacaccaag

SEQ ID NO: 30361 - RNA, 30 nt, Artificial Sequence
  Pseudouridylate synthase 7 homolog (77-86)
aagaccaaggaccccaccgccgcccugcgc

SEQ ID NO: 30362 - RNA, 30 nt, Artificial Sequence
  60S ribosomal protein L4 (163-172)
aagaccaaggaggccgugcugcuccugaag

SEQ ID NO: 30363 - RNA, 30 nt, Artificial Sequence
  Cyclin-dependent kinase 11A (11-20)
aagacccuggacgagauccuccaggagaag

SEQ ID NO: 30364 - RNA, 33 nt, Artificial Sequence
  RNA cytidine acetyltransferase (184-194)
aagacccuggaccaggccaaggccgugcucaag

SEQ ID NO: 30365 - RNA, 27 nt, Artificial Sequence
  Huntingtin (1402-1410)
aagaccaaccugaccagcgugacgaag

SEQ ID NO: 30366 - RNA, 27 nt, Artificial Sequence
  Actin-related protein 2/3 complex subunit 2 (214-222)
aagaccagcgacuuccugaaggugcuc

SEQ ID NO: 30367 - RNA, 27 nt, Artificial Sequence
  Cyclin-dependent kinase 11B (551-559)
aagaccagcaaccugcuccugucccac

SEQ ID NO: 30368 - RNA, 27 nt, Artificial Sequence
  26S proteasome non-ATPase regulatory subunit 1 (302-310)
aagaccagcuccgccuucgugggcaag

SEQ ID NO: 30369 - RNA, 27 nt, Artificial Sequence
  Zinc finger FYVE domain-containing protein 16 (1328-1336)
aagaccagcuccggcuuccuggccaag

SEQ ID NO: 30370 - RNA, 33 nt, Artificial Sequence
  Cyclic AMP-dependent transcription factor ATF-6 beta (655-665)
aagaccagcaccgugcccccgucccugcgcaag

SEQ ID NO: 30371 - RNA, 27 nt, Artificial Sequence
  Bridging integrator 3 (67-75)
aagaccgugaucgagccccugaagaag

SEQ ID NO: 30372 - RNA, 30 nt, Artificial Sequence
  DNA damage-binding protein 1 (191-200)
aagaccuacgaggugagccugcgcgagaag

SEQ ID NO: 30373 - RNA, 33 nt, Artificial Sequence
  26S proteasome non-ATPase regulatory subunit 11 (175-185)
aagaccuaccacgcccugagcaaccuccccaag

SEQ ID NO: 30374 - RNA, 33 nt, Artificial Sequence
  High mobility group protein B1 (76-86)
aagaccuacauccccccgaagggcgagaccaag

SEQ ID NO: 30375 - RNA, 33 nt, Artificial Sequence
  DNA-directed RNA polymerase II subunit RPB1 (697-707)
aagaccuaccaggacauccagaacaccaucaag

SEQ ID NO: 30376 - RNA, 27 nt, Artificial Sequence
  Interferon-induced, double-stranded RNA-activated protein kinase (291-299)
aagaccuacgugaucaagcgcgucaag

SEQ ID NO: 30377 - RNA, 27 nt, Artificial Sequence
  T-complex protein 1 subunit theta (296-304)
aagguggccgacauggcccugcacuac

SEQ ID NO: 30378 - RNA, 30 nt, Artificial Sequence
  RNA-binding protein 43 (71-80)
aagguggccgagaacgucauccgccagaag

SEQ ID NO: 30379 - RNA, 27 nt, Artificial Sequence
  Serine/threonine-protein kinase Chk2 (245-253)
aagguggccaucaagaucaucagcaag

SEQ ID NO: 30380 - RNA, 30 nt, Artificial Sequence
  60S ribosomal protein L7a (11-20)
aagguggcccccgccccggcggucgugaag

SEQ ID NO: 30381 - RNA, 33 nt, Artificial Sequence
  60S ribosomal protein L7a (11-21)
aagguggcccccgccccggcggucgugaagaag

SEQ ID NO: 30382 - RNA, 30 nt, Artificial Sequence
  Heat shock cognate 71 kDa protein (601-610)
aaggugugcaaccccaucaucaccaagcug

SEQ ID NO: 30383 - RNA, 30 nt, Artificial Sequence
  60S ribosomal protein L13a (103-112)
aagguguucgacggcauccccccgcccuac

SEQ ID NO: 30384 - RNA, 30 nt, Artificial Sequence
  GMP synthase (glutamine-hydrolyzing) (207-216)
aagguguucggcgggaccguccacaagaag

SEQ ID NO: 30385 - RNA, 27 nt, Artificial Sequence
  Cytoskeleton-associated protein 5 (96-104)
aagguguucaaccagcccaaggccaag

SEQ ID NO: 30386 - RNA, 30 nt, Artificial Sequence
  Thioredoxin (64-73)
aaggugggcgaguucagcggggccaacaag

SEQ ID NO: 30387 - RNA, 27 nt, Artificial Sequence
  28S ribosomal protein S17, mitochondrial (90-98)
aaggugaucgaccccgucaccggcaag

SEQ ID NO: 30388 - RNA, 27 nt, Artificial Sequence
  Serine hydroxymethyltransferase, mitochondrial (238-246)
aaggugauccccagcccguucaagcac

SEQ ID NO: 30389 - RNA, 30 nt, Artificial Sequence
  Structural maintenance of chromosomes protein 4 (512-521)
aaggugcuggacgccaucauccaggagaag

SEQ ID NO: 30390 - RNA, 30 nt, Artificial Sequence
  Eukaryotic translation initiation factor 3 subunit L (292-301)
aaggugcuggagaacaucgagcucaacaag

SEQ ID NO: 30391 - RNA, 33 nt, Artificial Sequence
  G2/mitotic-specific cyclin-B2 (318-328)
aaggugcugggccaggggaaguggaaccucaag

SEQ ID NO: 30392 - RNA, 27 nt, Artificial Sequence
  Tryptophan-tRNA ligase, mitochondrial (333-341)
aaggugcugcagaucggcagcgccaag

SEQ ID NO: 30393 - RNA, 30 nt, Artificial Sequence
  Septin-7 (185-194)
aaggugaacaucaucccccugaucgccaag

SEQ ID NO: 30394 - RNA, 30 nt, Artificial Sequence
  Septin-2 (174-183)
aaggugaacaucguccccgugaucgccaag

SEQ ID NO: 30395 - RNA, 27 nt, Artificial Sequence
  Transferrin receptor protein 1 (495-503)
aaggugagcgccuccccccugcucuac

SEQ ID NO: 30396 - RNA, 27 nt, Artificial Sequence
  B-lymphocyte antigen CD19 (291-299)
aaggugagcgccgucacccuggccuac

SEQ ID NO: 30397 - RNA, 27 nt, Artificial Sequence
  Astrotactin-2 (149-157)
aaggugagcgacuacauccugcagcac

SEQ ID NO: 30398 - RNA, 27 nt, Artificial Sequence
  Thioredoxin-related transmembrane protein 2 (207-215)
aaggugagcaccuccccccugaccaag

SEQ ID NO: 30399 - RNA, 30 nt, Artificial Sequence
  Rab GDP dissociation inhibitor beta (23-32)
aaggugaccgagggcagcuucgucuacaag

SEQ ID NO: 30400 - RNA, 27 nt, Artificial Sequence
  Unconventional myosin-Id (707-715)
aagguguggcgcggcacccuggcccgg

SEQ ID NO: 30401 - RNA, 27 nt, Artificial Sequence
  Nipped-B-like protein (52-60)
aagguguacgacaaggccaucaaccgc

SEQ ID NO: 30402 - RNA, 33 nt, Artificial Sequence
  78 kDa glucose-regulated protein (446-456)
aagguguacgagggcgagcgcccccugaccaag

SEQ ID NO: 30403 - RNA, 27 nt, Artificial Sequence
  Eukaryotic translation initiation factor 3 subunit L (70-78)
aagguguacgagcugcaggccagccgc

SEQ ID NO: 30404 - RNA, 27 nt, Artificial Sequence
  E3 ubiquitin-protein ligase RAD18 (115-123)
aagguguacacccccgucgccagccgc

SEQ ID NO: 30405 - RNA, 30 nt, Artificial Sequence
  Motile sperm domain-containing protein 2 (172-181)
aagguguacuaccccaaguaccugagcaag

SEQ ID NO: 30406 - RNA, 30 nt, Artificial Sequence
  Ubiquitin-associated protein 2-like (87-96)
cuggagggcaaccccgacacccacagcugg

SEQ ID NO: 30407 - RNA, 27 nt, Artificial Sequence
  Microtubule-associated protein RP/EB family member 1 (67-75)
cuggagcacgaguacauccagaacuuc

SEQ ID NO: 30408 - RNA, 24 nt, Artificial Sequence
  Hyaluronan mediated motility receptor (121-128)
cuggagaagcagcucaucgagcug

SEQ ID NO: 30409 - RNA, 30 nt, Artificial Sequence
  DNA replication licensing factor MCM2 (790-799)
cuggagagcuucaucgacacccagaaguuc

SEQ ID NO: 30410 - RNA, 30 nt, Artificial Sequence
  Guanine nucleotide-binding protein G(s) subunit alpha isoforms short (286-295)
cugcucgccgagaaggugcuggccggcaag

SEQ ID NO: 30411 - RNA, 33 nt, Artificial Sequence
  Eukaryotic translation initiation factor 3 subunit C-like protein (634-644)
cugcucgacauccagagcuccggccgcgccaag

SEQ ID NO: 30412 - RNA, 27 nt, Artificial Sequence
  Prelamin-A/C (140-148)
cugcucaacagcaaggaggccgcccug

SEQ ID NO: 30413 - RNA, 33 nt, Artificial Sequence
  T-complex protein 1 subunit beta (109-119)
cugcuccgcgaggccgagagccugaucgccaag

SEQ ID NO: 30414 - RNA, 33 nt, Artificial Sequence
  Methionine synthase reductase (6-16)
cugcucuacgccacccagcagggccaggccaag

SEQ ID NO: 30415 - RNA, 30 nt, Artificial Sequence
  Replication factor C subunit 5 (57-66)
cugcucuacggccccccggggaccggcaag

SEQ ID NO: 30416 - RNA, 27 nt, Artificial Sequence
  Leucine-rich repeat-containing protein 58 (83-91)
cugccccacaaccgccucgugagccug

SEQ ID NO: 30417 - RNA, 27 nt, Artificial Sequence
  Ribosomal RNA processing protein 1 homolog B (585-593)
cugcccagccagaagaccgccucccuc

SEQ ID NO: 30418 - RNA, 27 nt, Artificial Sequence
  Proteasome assembly chaperone 2 (40-48)
cugcccagccgcaagcucguggcccug

SEQ ID NO: 30419 - RNA, 27 nt, Artificial Sequence
  Squalene monooxygenase (548-556)
cugagcuccggcgccgugcucuacaag

SEQ ID NO: 30420 - RNA, 27 nt, Artificial Sequence
  Neuroguidin (201-209)
cugagcuccagcgugauccgcgagcuc

SEQ ID NO: 30421 - RNA, 27 nt, Artificial Sequence
  60S ribosomal protein L34 (11-19)
cugagcuacaacaccgccuccaacaag

SEQ ID NO: 30422 - RNA, 30 nt, Artificial Sequence
  Importin subunit alpha-1 (344-353)
cugaccaaccccaagaccaacauccagaag

SEQ ID NO: 30423 - RNA, 30 nt, Artificial Sequence
  40S ribosomal protein S7 (131-140)
cugguguuccccagcgagaucgucggcaag

SEQ ID NO: 30424 - RNA, 27 nt, Artificial Sequence
  Filamin-A (1766-1774)
cuggugauccccuucaccaucaagaag

SEQ ID NO: 30425 - RNA, 27 nt, Artificial Sequence
  PRELI domain containing protein 3B (186-194)
auggccgccgcggccuucgccgagaag

SEQ ID NO: 30426 - RNA, 27 nt, Artificial Sequence
  Cyclin-T1 (410-418)
auggaggccaacgugaagagccaguac

SEQ ID NO: 30427 - RNA, 27 nt, Artificial Sequence
  Transformation/transcription domain-associated protein (1736-1744)
auggaggaggagauccccaagaacuac

SEQ ID NO: 30428 - RNA, 27 nt, Artificial Sequence
  Nucleolar protein 58 (64-72)
auggagggcaagaucaacaagcagcug

SEQ ID NO: 30429 - RNA, 27 nt, Artificial Sequence
  Ribonucleoside-diphosphate reductase subunit M2 (228-236)
auggagaacauccacagcgagauguac

SEQ ID NO: 30430 - RNA, 30 nt, Artificial Sequence
  Dolichyl-diphosphooligosaccharide-proteinosyltransferase 48 kDa subunit (18-27)
auggagcccagcaccgccgcccgcgcgugg

SEQ ID NO: 30431 - RNA, 33 nt, Artificial Sequence
  Large proline-rich protein BAG6 (929-939)
augcccgugggcccggacgccauccugcgcuac

SEQ ID NO: 30432 - RNA, 27 nt, Artificial Sequence
  60S ribosomal protein L26 (30-38)
augagcuccccccugagcaaggagcuc

SEQ ID NO: 30433 - RNA, 27 nt, Artificial Sequence
  Histone deacetylase 1 (37-45)
augacccacaaccugcuccugaacuac

SEQ ID NO: 30434 - RNA, 27 nt, Artificial Sequence
  Myosin-7B (138-146)
aacgaggccagcgugcugcacaaccuc

SEQ ID NO: 30435 - RNA, 27 nt, Artificial Sequence
  DnaJ homolog subfamily B member 5 (16-24)
aacgaggacgagaucaagaaggccuac

SEQ ID NO: 30436 - RNA, 27 nt, Artificial Sequence
  Nuclear factor interleukin-3-regulated protein (343-351)
aacgaguucgaggccacccagaagcug

SEQ ID NO: 30437 - RNA, 27 nt, Artificial Sequence
  Ras-related protein Rab-7a (184-192)
aacgaguuccccgagccgaucaagcug

SEQ ID NO: 30438 - RNA, 30 nt, Artificial Sequence
  Kinetochore protein NDC80 homolog (555-564)
aacgagcuggacgccgugcagcgcgaguac

SEQ ID NO: 30439 - RNA, 27 nt, Artificial Sequence
  Putative eukaryotic translation initiation factor 2 subunit 3-like protein (71-79)
aacgagcuggagcgcaacaucaccauc

SEQ ID NO: 30440 - RNA, 27 nt, Artificial Sequence
  Fizzy-related protein homolog (412-420)
aacgagcuggugagcacccacggcuac

SEQ ID NO: 30441 - RNA, 27 nt, Artificial Sequence
  Mediator of RNA polymerase II transcription subunit 23 (148-156)
aacgagaacgacaucaucacccacuuc

SEQ ID NO: 30442 - RNA, 27 nt, Artificial Sequence
  CUGBP Elav-like family member 2 (120-128)
aacgagaacgacauccgcgugauguuc

SEQ ID NO: 30443 - RNA, 27 nt, Artificial Sequence
  Serine/threonine-protein kinase PAK 2 (445-453)
aacgagaacccccugcgcgcccucuac

SEQ ID NO: 30444 - RNA, 27 nt, Artificial Sequence
  Serine/threonine/tyrosine-interacting-like protein 1 (124-132)
aacgagcagacccugcagcgcagcugg

SEQ ID NO: 30445 - RNA, 27 nt, Artificial Sequence
  Monocarboxylate transporter 7 (57-65)
aacgagagcaacucccgcaucagcugg

SEQ ID NO: 30446 - RNA, 27 nt, Artificial Sequence
  Oxysterol-binding protein-related protein 9 (671-679)
aacgaguacgagagccgcucccugugg

SEQ ID NO: 30447 - RNA, 27 nt, Artificial Sequence
  DnaJ homolog subfamily A member 1 (120-128)
aacggcgccacccgcaagcuggcccuc

SEQ ID NO: 30448 - RNA, 27 nt, Artificial Sequence
  Lysine-specific histone demethylase 1A (474-482)
aaccugaaggagaagaucaaggagcuc

SEQ ID NO: 30449 - RNA, 27 nt, Artificial Sequence
  Histone-binding protein RBBP4 (245-253)
aaccugaagcucaagcugcacagcuuc

SEQ ID NO: 30450 - RNA, 27 nt, Artificial Sequence
  AP-3 complex subunit delta-1 (372-380)
aaccugauggagaucgugaagaagcuc

SEQ ID NO: 30451 - RNA, 24 nt, Artificial Sequence
  Serine/threonine-protein phosphatase 2A 65 kDa regulatory subunit A beta isoform isoform b (350-357)
aaccagcacgugaagagcgcccug

SEQ ID NO: 30452 - RNA, 27 nt, Artificial Sequence
  Copine-8 (263-271)
aacguguacgaggucgugaaccccaag

SEQ ID NO: 30453 - RNA, 30 nt, Artificial Sequence
  Polypyrimidine tract-binding protein 1 (440-449)
caggaggaccagggccugaccaaggacuac

SEQ ID NO: 30454 - RNA, 30 nt, Artificial Sequence
  Forkhead box protein K2 (318-327)
caggaggagcccggcaaggggagcuucugg

SEQ ID NO: 30455 - RNA, 33 nt, Artificial Sequence
  RNA polymerase II subunit A C-terminal domain phosphatase SSU72 (177-187)
caggaguucgaggagaagagcggccgcaccuuc

SEQ ID NO: 30456 - RNA, 27 nt, Artificial Sequence
  Alpha-galactosidase A (357-365)
caggagaucggcgggccccgcagcuac

SEQ ID NO: 30457 - RNA, 33 nt, Artificial Sequence
  Splicing factor 3B subunit 1 (41-51)
caggagaucuacggcgggagcgacucccgcuuc

SEQ ID NO: 30458 - RNA, 30 nt, Artificial Sequence
  Translin-associated protein X (44-53)
caggagcuggacgcccgccacgacaaguac

SEQ ID NO: 30459 - RNA, 27 nt, Artificial Sequence
  Mis18-binding protein 1 (582-590)
caggagcugaucggcaagaaggaguac

SEQ ID NO: 30460 - RNA, 30 nt, Artificial Sequence
  Desmin (113-122)
caggagcugaacgaccgcuucgccaacuac

SEQ ID NO: 30461 - RNA, 30 nt, Artificial Sequence
  DNA-(apurinic or apyrimidinic site) lyase (109-118)
caggagcugcccggccucagccaccaguac

SEQ ID NO: 30462 - RNA, 30 nt, Artificial Sequence
  Protein phosphatase 1G (202-211)
caggagaacggccccaccgccaaggccuac

SEQ ID NO: 30463 - RNA, 27 nt, Artificial Sequence
  tRNA (cytosine(34)-C(5))-methyltransferase (545-553)
caggagaaccccuucuuccgcaagcug

SEQ ID NO: 30464 - RNA, 27 nt, Artificial Sequence
  Condensin-2 complex subunit H2 (444-452)
caggagaccgagcugagccagcgcauc

SEQ ID NO: 30465 - RNA, 27 nt, Artificial Sequence
  Protein C10 (28-36)
caggaggugaucaaggccuacggcuuc

SEQ ID NO: 30466 - RNA, 24 nt, Artificial Sequence
  60S ribosomal protein L6 (269-276)
cagggcuaccugcgcagcguguuc

SEQ ID NO: 30467 - RNA, 27 nt, Artificial Sequence
  Histone deacetylase 2 (240-248)
cagaucuucaagcccaucaucagcaag

SEQ ID NO: 30468 - RNA, 27 nt, Artificial Sequence
  60S ribosomal protein L7 (116-124)
cagaucuucaacggcaccuucgugaag

SEQ ID NO: 30469 - RNA, 30 nt, Artificial Sequence
  Ubiquitin-60S ribosomal protein L40 (7-16)
cagaucuucgugaagacccugaccggcaag

SEQ ID NO: 30470 - RNA, 33 nt, Artificial Sequence
  40S ribosomal protein S16 (79-89)
cagaucuacgccauccgccagagcaucuccaag

SEQ ID NO: 30471 - RNA, 24 nt, Artificial Sequence
  60S ribosomal protein L15 (91-98)
cagcugaaguucgcccgcagccuc

SEQ ID NO: 30472 - RNA, 27 nt, Artificial Sequence
  Cleft lip and palate transmembrane protein 1 (316-324)
cagcuguacgccgcccagagcaccaag

SEQ ID NO: 30473 - RNA, 27 nt, Artificial Sequence
  Myosin-9 (648-656)
cagcuguacaaggagcagcucgccaag

SEQ ID NO: 30474 - RNA, 27 nt, Artificial Sequence
  F-box only protein 5 (293-301)
cagcuguacagcaaggccauccagcgc

SEQ ID NO: 30475 - RNA, 24 nt, Artificial Sequence
  40S ribosomal protein S11 (18-25)
cagaacaagaagcgcgugcugcuc

SEQ ID NO: 30476 - RNA, 27 nt, Artificial Sequence
  TRAF3-interacting JNK-activating modulator (38-46)
cagagcacccagcgcucccuggcccuc

SEQ ID NO: 30477 - RNA, 27 nt, Artificial Sequence
  U5 small nuclear ribonucleoprotein 200 kDa helicase (438-446)
cagaccuacgugggcaucaccgagaag

SEQ ID NO: 30478 - RNA, 27 nt, Artificial Sequence
  40S ribosomal protein S9 (113-121)
cagguguucaagcugggccucgccaag

SEQ ID NO: 30479 - RNA, 27 nt, Artificial Sequence
  Eukaryotic translation initiation factor 3 subunit E (354-362)
caggugaucgagaagaccaagagccug

SEQ ID NO: 30480 - RNA, 27 nt, Artificial Sequence
  TCF3 fusion partner (94-102)
caggugaacgagcgcguccugaaccgg

SEQ ID NO: 30481 - RNA, 27 nt, Artificial Sequence
  Inorganic pyrophosphatase (9-17)
cgcgccgcccccuucagccuggaguac

SEQ ID NO: 30482 - RNA, 27 nt, Artificial Sequence
  ATP-dependent RNA helicase DDX19B (56-64)
cgcgccgcccagagccugcucaacaag

SEQ ID NO: 30483 - RNA, 27 nt, Artificial Sequence
  LBH domain-containing protein 1 (95-103)
cgcgccaacaucacccugagcggcaag

SEQ ID NO: 30484 - RNA, 27 nt, Artificial Sequence
  Midasin (1000-1008)
cgcgccagccaccccaucgugcagaag

SEQ ID NO: 30485 - RNA, 27 nt, Artificial Sequence
  Perilipin-2 (230-238)
cgcgccuaccagcaggcccugagccgg

SEQ ID NO: 30486 - RNA, 30 nt, Artificial Sequence
  Protein VPRBP (31-40)
cgcgaggccgaccagccccugcggaccuac

SEQ ID NO: 30487 - RNA, 27 nt, Artificial Sequence
  Signal peptidase complex subunit 2 (185-193)
cgcgaggccgaguucaccaagagcauc

SEQ ID NO: 30488 - RNA, 27 nt, Artificial Sequence
  NADH dehydrogenase (ubiquinone) 1 beta subcomplex subunit 11, mitochondrial (120-128)
cgcgaggccgagcggcuggugaaguac

SEQ ID NO: 30489 - RNA, 27 nt, Artificial Sequence
  Ubiquilin-2 (597-605)
cgcgaggccaaccugcaggcccucauc

SEQ ID NO: 30490 - RNA, 27 nt, Artificial Sequence
  Gamma-taxilin (154-162)
cgcgaggagcacaucgacaagguguuc

SEQ ID NO: 30491 - RNA, 30 nt, Artificial Sequence
  Nuclear receptor-binding protein (234-243)
cgcgaggagcagaagaaccugcacuucuuc

SEQ ID NO: 30492 - RNA, 30 nt, Artificial Sequence
  Exostosin-2 (567-576)
cgcgaguuccccgaccggcuggugggcuac

SEQ ID NO: 30493 - RNA, 30 nt, Artificial Sequence
  Di-N-acetylchitobiase (169-178)
cgcgagaucgagggcagccaggugaccuuc

SEQ ID NO: 30494 - RNA, 27 nt, Artificial Sequence
  Ataxin-2-like protein (324-332)
cgcgagaucgagagcuccccccaguac

SEQ ID NO: 30495 - RNA, 30 nt, Artificial Sequence
  Sorting nexin-17 (146-155)
cgcgagaaggaggacggcgccuucagcuuc

SEQ ID NO: 30496 - RNA, 30 nt, Artificial Sequence
  Ras-related GTP-binding protein A (97-106)
cgcgagcuggagaaggacaugcacuacuac

SEQ ID NO: 30497 - RNA, 27 nt, Artificial Sequence
  Tropomyosin alpha-3 chain (7-15)
cgcgagauggacgagcagauccggcug

SEQ ID NO: 30498 - RNA, 30 nt, Artificial Sequence
  Tetratricopeptide repeat protein 39C (46-55)
cgcgagagcgaccagcuguucaagcaguac

SEQ ID NO: 30499 - RNA, 27 nt, Artificial Sequence
  Aurora kinase A (180-188)
cgcgagguggagauccagagccaccug

SEQ ID NO: 30500 - RNA, 33 nt, Artificial Sequence
  Histone H2B type 2-E (48-58)
cgcaucgccggcgaggccagccggcuggcgcac

SEQ ID NO: 30501 - RNA, 33 nt, Artificial Sequence
  40S ribosomal protein S19 (133-143)
cgcaucgccggccagguggccgcggccaacaag

SEQ ID NO: 30502 - RNA, 33 nt, Artificial Sequence
  60S ribosomal protein L18a (31-41)
cgcaucuucgcccccaaccacguggucgccaag

SEQ ID NO: 30503 - RNA, 27 nt, Artificial Sequence
  60S ribosomal protein L10 (32-40)
cgcaucuucgaccugggccggaagaag

SEQ ID NO: 30504 - RNA, 33 nt, Artificial Sequence
  Nuclear pore complex protein Nup214 (26-36)
cgcaucuucgacagccccgaggagcugccgaag

SEQ ID NO: 30505 - RNA, 30 nt, Artificial Sequence
  Ribonucleoside-diphosphate reductase subunit M2 (50-59)
cgcaucuuccaggagcccaccgagccgaag

SEQ ID NO: 30506 - RNA, 27 nt, Artificial Sequence
  Unconventional myosin-Ie (627-635)
cgcaucuuccagaaguuccugcagcgg

SEQ ID NO: 30507 - RNA, 27 nt, Artificial Sequence
  Sorbitol dehydrogenase (56-64)
cgcaucggcaacuucaucgugaagaag

SEQ ID NO: 30508 - RNA, 30 nt, Artificial Sequence
  Serine/threonine-protein kinase Nek6 (243-252)
cgcauccacgagaacggcuacaacuucaag

SEQ ID NO: 30509 - RNA, 27 nt, Artificial Sequence
  U3 small nucleolar ribonucleoprotein protein MPP10 (48-56)
cgcauccacggcagcccccugcagaag

SEQ ID NO: 30510 - RNA, 27 nt, Artificial Sequence
  60S ribosomal protein L31 (32-40)
cgcauccacggcgugggguucaagaag

SEQ ID NO: 30511 - RNA, 27 nt, Artificial Sequence
  Importin-8 (433-441)
cgcaucaucgaccuggugcuccagaag

SEQ ID NO: 30512 - RNA, 27 nt, Artificial Sequence
  Replication factor C subunit 4 (185-193)
cgcaucaucgagccccugaccagccgg

SEQ ID NO: 30513 - RNA, 27 nt, Artificial Sequence
  Putative Polycomb group protein ASXL1 (573-581)
cgcaucaagcccccguggguggucaag

SEQ ID NO: 30514 - RNA, 27 nt, Artificial Sequence
  26S proteasome non-ATPase regulatory subunit 8 (196-204)
cgcauccuguucuucaacacccccaag

SEQ ID NO: 30515 - RNA, 27 nt, Artificial Sequence
  60S ribosomal protein L10a (122-130)
cgcauccugggccccgggcucaacaag

SEQ ID NO: 30516 - RNA, 27 nt, Artificial Sequence
  40S ribosomal protein S7 (97-105)
cgcauccugcccaagccgacccggaag

SEQ ID NO: 30517 - RNA, 27 nt, Artificial Sequence
  40S ribosomal protein S11 (71-79)
cgcauccugagcggcguggucaccaag

SEQ ID NO: 30518 - RNA, 30 nt, Artificial Sequence
  Helicase-like transcription factor (514-523)
cgcauccgggagcccgcccugcucagcaag

SEQ ID NO: 30519 - RNA, 33 nt, Artificial Sequence
  Heat shock 70 kDa protein 14 (56-66)
cgcauccggaacaucagcaacaccgugaugaag

SEQ ID NO: 30520 - RNA, 33 nt, Artificial Sequence
  Protein PML (31-41)
cgcauccggaccggcagcgcccuggugcagcgc

SEQ ID NO: 30521 - RNA, 27 nt, Artificial Sequence
  DNA-directed RNA polymerases I, II, and III subunit RPABC2 (51-59)
cgcaucaccacccccuacaugacgaag

SEQ ID NO: 30522 - RNA, 27 nt, Artificial Sequence
  Translational activator GCN1 (122-130)
cgcaucguguuccccagccgggccaag

SEQ ID NO: 30523 - RNA, 27 nt, Artificial Sequence
  Zinc finger protein 195 (247-255)
cgcaucuacgccggcggggagcacuac

SEQ ID NO: 30524 - RNA, 33 nt, Artificial Sequence
  Fragile X mental retardation syndrome-related protein 1 (263-273)
cgcaucuacggcgagagcgccgacgccgugaag

SEQ ID NO: 30525 - RNA, 27 nt, Artificial Sequence
  Dual specificity tyrosine-phosphorylation-regulated kinase 1A (317-325)
cgcaucuaccaguacauccagagccgg

SEQ ID NO: 30526 - RNA, 30 nt, Artificial Sequence
  Integrator complex subunit 1 (219-228)
cgccuggccgaggccgcgguggccgagaag

SEQ ID NO: 30527 - RNA, 30 nt, Artificial Sequence
  RNA pseudouridylate synthase domain-containing protein 4 (45-54)
cgccuggccgagaagcuccgggcccagaag

SEQ ID NO: 30528 - RNA, 27 nt, Artificial Sequence
  Ubiquitin carboxyl-terminal hydrolase 19 (897-905)
cgccuggccgaggugaucaagaaccgg

SEQ ID NO: 30529 - RNA, 30 nt, Artificial Sequence
  Phosducin-like protein 3 (78-87)
cgccuggccgaguggaaggccaccaagcuc

SEQ ID NO: 30530 - RNA, 33 nt, Artificial Sequence
  40S ribosomal protein S21 (71-81)
cgccuggccaaggccgacggcaucgugagcaag

SEQ ID NO: 30531 - RNA, 27 nt, Artificial Sequence
  Golgi phosphoprotein 3 (176-184)
cgccuggccaagaaccucguggagaag

SEQ ID NO: 30532 - RNA, 33 nt, Artificial Sequence
  60S ribosomal protein L19 (9-19)
cgccuggccagcuccgugcuccggugcggcaag

SEQ ID NO: 30533 - RNA, 30 nt, Artificial Sequence
  Guanine nucleotide-binding protein G(I)/G(S)/G(O) subunit gamma-5 (18-27)
cgccuggaggccggccucaaccgggugaag

SEQ ID NO: 30534 - RNA, 30 nt, Artificial Sequence
  40S ribosomal protein S9 (70-79)
cgccuguucgagggcaacgcccuccugcgg

SEQ ID NO: 30535 - RNA, 27 nt, Artificial Sequence
  Cartilage-associated protein (107-115)
cgccuguucggcgggcuccugcggcgc

SEQ ID NO: 30536 - RNA, 24 nt, Artificial Sequence
  60S ribosomal protein L13 (190-197)
cgccuguucggcauccgggccaag

SEQ ID NO: 30537 - RNA, 27 nt, Artificial Sequence
  Ubiquitin-associated domain-containing protein 2 (164-172)
cgccuguuccccccgcuccggcagcgc

SEQ ID NO: 30538 - RNA, 27 nt, Artificial Sequence
  Heterogeneous nuclear ribonucleoprotein R (146-154)
cgccuguucgugggcagcauccccaag

SEQ ID NO: 30539 - RNA, 33 nt, Artificial Sequence
  Heterogeneous nuclear ribonucleoprotein Q (244-254)
cgccuguucgugggcagcauccccaaguccaag

SEQ ID NO: 30540 - RNA, 27 nt, Artificial Sequence
  DNA damage-binding protein 1 (327-335)
cgccugggcgacagccagcucgugaag

SEQ ID NO: 30541 - RNA, 27 nt, Artificial Sequence
  Semaphorin-7A (24-32)
cgccugggccucccccugcggcugcgc

SEQ ID NO: 30542 - RNA, 27 nt, Artificial Sequence
  Cleavage and polyadenylation specificity factor subunit 1 (387-395)
cgccugggcaacagccuccugcugaag

SEQ ID NO: 30543 - RNA, 27 nt, Artificial Sequence
  Pentatricopeptide repeat domain-containing protein 3, mitochondrial (15-23)
cgccugggccagccccucaccgggcgg

SEQ ID NO: 30544 - RNA, 30 nt, Artificial Sequence
  Egl nine homolog 2 (270-279)
cgccugggcagcuacgugaucaacgggcgg

SEQ ID NO: 30545 - RNA, 33 nt, Artificial Sequence
  Parkinson disease 7 domain-containing protein 1 (68-78)
cgccugaaggccuacgccagccccgcgaagcuc

SEQ ID NO: 30546 - RNA, 27 nt, Artificial Sequence
  Protein RRP5 homolog (385-393)
cgccugaaggacggcgugcucgccuac

SEQ ID NO: 30547 - RNA, 33 nt, Artificial Sequence
  Nuclear pore complex protein Nup98-Nup96 (515-525)
cgccugaagcccaccaacccggccgcccagaag

SEQ ID NO: 30548 - RNA, 30 nt, Artificial Sequence
  HAUS augmin-like complex subunit 1 (226-235)
cgccugaagcagcagaccaucccccucaag

SEQ ID NO: 30549 - RNA, 33 nt, Artificial Sequence
  FERM, RhoGEF and pleckstrin domain-containing protein 2 (321-331)
cgccugcucgaccagcccaagccgaaggccaag

SEQ ID NO: 30550 - RNA, 30 nt, Artificial Sequence
  Glycogen synthase kinase-3 beta (319-328)
cgccugcucgaguacacccccaccgcccgg

SEQ ID NO: 30551 - RNA, 33 nt, Artificial Sequence
  Nucleolar protein 56 (77-87)
cgccugcuccuggagacccaccugcccagcaag

SEQ ID NO: 30552 - RNA, 30 nt, Artificial Sequence
  Histone H2B type 2-F (100-109)
cgccugcuccugcccggcgagcuggccaag

SEQ ID NO: 30553 - RNA, 33 nt, Artificial Sequence
  Poly (ADP-ribose) polymerase 14 (858-868)
cgccugcuccccggcaacgccaccaucagcaag

SEQ ID NO: 30554 - RNA, 27 nt, Artificial Sequence
  BTB/POZ domain-containing protein KCTD20 (259-267)
cgccugaacgccccccucagccagaug

SEQ ID NO: 30555 - RNA, 30 nt, Artificial Sequence
  Tubulin gamma-1 chain (156-165)
cgccugaacgaccgguaccccaagaagcuc

SEQ ID NO: 30556 - RNA, 30 nt, Artificial Sequence
  LYR motif-containing protein 2 (5-14)
cgccugcccccggccacccucacccugaag

SEQ ID NO: 30557 - RNA, 27 nt, Artificial Sequence
  NF-kappa-B inhibitor beta (339-347)
cgccugcccccgacccccgccagcaag

SEQ ID NO: 30558 - RNA, 27 nt, Artificial Sequence
  Kinesin-like protein KIF18B (390-398)
cgccugcccagcuccacccucaagcgg

SEQ ID NO: 30559 - RNA, 30 nt, Artificial Sequence
  Histone deacetylase 5 (529-538)
cgccugcaggagaccggccuccugagcaag

SEQ ID NO: 30560 - RNA, 33 nt, Artificial Sequence
  Egl nine homolog 2 (218-228)
cgccugcgggacggccagcucgugagccagcgc

SEQ ID NO: 30561 - RNA, 27 nt, Artificial Sequence
  HCLS1-associated protein X-1 (118-126)
cgccugcgggagggccagacccuccgc

SEQ ID NO: 30562 - RNA, 27 nt, Artificial Sequence
  AP-5 complex subunit zeta-1 (429-437)
cgccugagcuuccccaaccucuucaag

SEQ ID NO: 30563 - RNA, 27 nt, Artificial Sequence
  A-kinase anchor protein 11 (941-949)
cgccugagcaaguccaucaucaagcac

SEQ ID NO: 30564 - RNA, 30 nt, Artificial Sequence
  40S ribosomal protein S4, X isoform (202-211)
cgccugagcaacaucuucgugaucggcaag

SEQ ID NO: 30565 - RNA, 30 nt, Artificial Sequence
  Prelamin-A/C (307-316)
cgccugagccccuccccgaccagccagcgg

SEQ ID NO: 30566 - RNA, 30 nt, Artificial Sequence
  60S ribosomal protein L34 (10-19)
cgccugagcuacaacaccgccuccaacaag

SEQ ID NO: 30567 - RNA, 30 nt, Artificial Sequence
  Proliferating cell nuclear antigen (5-14)
cgccuggugcagggcagcauccucaagaag

SEQ ID NO: 30568 - RNA, 30 nt, Artificial Sequence
  E3 ubiquitin-protein ligase MARCH6 (597-606)
cgccuguacgagcacaucaagaacgacaag

SEQ ID NO: 30569 - RNA, 27 nt, Artificial Sequence
  ATP-binding cassette sub-family D member 1 (172-180)
cgccuguacuucagccagcagaccuac

SEQ ID NO: 30570 - RNA, 27 nt, Artificial Sequence
  Kelch-like protein 20 (534-542)
cgccuguacggcgggaugaacuaccgg

SEQ ID NO: 30571 - RNA, 30 nt, Artificial Sequence
  Protein KIAA0100 (809-818)
cgccuguacggcaacacccccaugcggcgc

SEQ ID NO: 30572 - RNA, 30 nt, Artificial Sequence
  Terminal uridylyltransferase 4 (269-278)
cgccuguacggcagcucccucacccgguuc

SEQ ID NO: 30573 - RNA, 33 nt, Artificial Sequence
  TNF receptor-associated factor 1 (308-318)
cgccuguaccucaacggcgacgggaccggcaag

SEQ ID NO: 30574 - RNA, 27 nt, Artificial Sequence
  DnaJ homolog subfamily B member 12 (36-44)
cgccuguaccccaccccgcgggugcgc

SEQ ID NO: 30575 - RNA, 30 nt, Artificial Sequence
  E3 ubiquitin-protein ligase UBR5 (2771-2780)
cgccuguacgugccccucuacagcuccaag

SEQ ID NO: 30576 - RNA, 30 nt, Artificial Sequence
  60S ribosomal protein L4 (100-109)
cgcauguucgcccccaccaagaccuggcgg

SEQ ID NO: 30577 - RNA, 33 nt, Artificial Sequence
  DNA methyltransferase 1-associated protein 1 (326-336)
cgcaugaagcugcccagcuccgugggccagaag

SEQ ID NO: 30578 - RNA, 27 nt, Artificial Sequence
  Dolichyl-diphosphooligosaccharide-proteinosyltransferase subunit 2 (619-627)
cgcaugcuggcccagcaggccgugaag

SEQ ID NO: 30579 - RNA, 24 nt, Artificial Sequence
  Proteasome subunit beta type-5 (80-87)
cgcaacaaggagcggaucagcgug

SEQ ID NO: 30580 - RNA, 27 nt, Artificial Sequence
  Chromosome transmission fidelity protein 8 homolog (109-117)
cgccccaagccgaucaucaccagcgug

SEQ ID NO: 30581 - RNA, 24 nt, Artificial Sequence
  Zinc finger MIZ domain-containing protein 1 (589-596)
cgccccagcgugcgguccguccug

SEQ ID NO: 30582 - RNA, 27 nt, Artificial Sequence
  Apoptosis inhibitor 5 (189-197)
cgccaggccgugccccuguucagcaag

SEQ ID NO: 30583 - RNA, 27 nt, Artificial Sequence
  39S ribosomal protein L55, mitochondrial (47-55)
cgccaguucuggacccggaccaagaag

SEQ ID NO: 30584 - RNA, 27 nt, Artificial Sequence
  Phosphate carrier protein, mitochondrial (224-232)
cgccagauccccuacaccaugaugaag

SEQ ID NO: 30585 - RNA, 27 nt, Artificial Sequence
  60S ribosomal protein L7a (89-97)
cgccagaccgccacccagcugcucaag

SEQ ID NO: 30586 - RNA, 27 nt, Artificial Sequence
  Formin-binding protein 1 (239-247)
cgccaggugauccccaucaucggcaag

SEQ ID NO: 30587 - RNA, 27 nt, Artificial Sequence
  F-box only protein 33 (21-29)
cgccaguacgacaaguuccugacccac

SEQ ID NO: 30588 - RNA, 27 nt, Artificial Sequence
  Protein-lysine N-methyltransferase EEF2KMT (18-26)
cgccgguuccuggccgcccgcacccuc

SEQ ID NO: 30589 - RNA, 27 nt, Artificial Sequence
  Growth factor receptor-bound protein 2 (137-145)
cgccggggcgacuucauccacgugaug

SEQ ID NO: 30590 - RNA, 27 nt, Artificial Sequence
  60S ribosomal protein L23 (89-97)
cgccggaaggacggcguguuccuguac

SEQ ID NO: 30591 - RNA, 27 nt, Artificial Sequence
  Neuroepithelial cell-transforming gene 1 protein (32-40)
cgccggcaggaggccaucuacgagaug

SEQ ID NO: 30592 - RNA, 27 nt, Artificial Sequence
  Isoleucine-tRNA ligase, cytoplasmic (402-410)
cgcagcgacaccccccugaucuacaag

SEQ ID NO: 30593 - RNA, 27 nt, Artificial Sequence
  Uncharacterized protein KIAA1551 (365-373)
cgcagccugggcuccagccccgugaag

SEQ ID NO: 30594 - RNA, 30 nt, Artificial Sequence
  60S ribosomal protein L30 (106-115)
cgcagcaugcccgagcagaccggcgagaag

SEQ ID NO: 30595 - RNA, 27 nt, Artificial Sequence
  Structural maintenance of chromosomes protein 3 (132-140)
cgcagcaaccccuacuacaucgugaag

SEQ ID NO: 30596 - RNA, 30 nt, Artificial Sequence
  Protein BRICK1 (44-53)
cgcagccggcuggccacccucaacgagaag

SEQ ID NO: 30597 - RNA, 27 nt, Artificial Sequence
  Protein PRRC2C (2148-2156)
cgcagcaccgaccccgugaccacgaag

SEQ ID NO: 30598 - RNA, 33 nt, Artificial Sequence
  Cytoskeleton-associated protein 2-like (319-329)
cgcagcuaccccgugaccgagcagcgggucaag

SEQ ID NO: 30599 - RNA, 27 nt, Artificial Sequence
  Heterogeneous nuclear ribonucleoprotein F (192-200)
cgcagcuacuccgaccccccgcugaag

SEQ ID NO: 30600 - RNA, 27 nt, Artificial Sequence
  Vimentin (28-36)
cgcagcuacgugaccaccuccacgcgg

SEQ ID NO: 30601 - RNA, 27 nt, Artificial Sequence
  Sorting and assembly machinery component 50 homolog (240-248)
cgcaccgccagcuucgccgugcggaag

SEQ ID NO: 30602 - RNA, 30 nt, Artificial Sequence
  T-complex protein 1 subunit eta (114-123)
cgcaccgccacccagcuggccgugaacaag

SEQ ID NO: 30603 - RNA, 30 nt, Artificial Sequence
  UAP56-interacting factor (226-235)
cgcaccgccgugcccagcuuccugaccaag

SEQ ID NO: 30604 - RNA, 27 nt, Artificial Sequence
  Plectin (471-479)
cgcaccgaguacaaccugcggcucaag

SEQ ID NO: 30605 - RNA, 27 nt, Artificial Sequence
  Cyclin-dependent kinase 12 (1374-1382)
cgcaccuucagcggcucccugagccac

SEQ ID NO: 30606 - RNA, 30 nt, Artificial Sequence
  Cold shock domain-containing protein E1 (78-87)
cgcaccggcaagcccaucgccgugaagcug

SEQ ID NO: 30607 - RNA, 27 nt, Artificial Sequence
  Eukaryotic translation initiation factor 4H (221-229)
cgcaccggccccccgauggggagccgg

SEQ ID NO: 30608 - RNA, 30 nt, Artificial Sequence
  Eukaryotic translation initiation factor 4H (155-164)
cgcaccggccccccgauggggagccgguuc

SEQ ID NO: 30609 - RNA, 27 nt, Artificial Sequence
  Cell division cycle 5-like protein (83-91)
cgcaccaucgcccccaucaucggccgg

SEQ ID NO: 30610 - RNA, 27 nt, Artificial Sequence
  Biogenesis of lysosome-related organelles complex 1 subunit 1 (106-114)
cgcaccaucgccaccgcccuggaguac

SEQ ID NO: 30611 - RNA, 27 nt, Artificial Sequence
  Beta-catenin-like protein 1 (270-278)
cgcaccaucuucccccuguucaugaag

SEQ ID NO: 30612 - RNA, 30 nt, Artificial Sequence
  60S ribosomal protein L37a (4-13)
cgcaccaagaaggugggcaucgucgggaag

SEQ ID NO: 30613 - RNA, 30 nt, Artificial Sequence
  39S ribosomal protein L2, mitochondrial (69-78)
cgcaccaaguacaccaucacgcccgugaag

SEQ ID NO: 30614 - RNA, 30 nt, Artificial Sequence
  Peroxisomal multifunctional enzyme type 2 (251-260)
cgcacccugggcgccaucgugcggcagaag

SEQ ID NO: 30615 - RNA, 27 nt, Artificial Sequence
  Cytosolic carboxypeptidase 1 (1067-1075)
cgcacccugcccaagauccucagccac

SEQ ID NO: 30616 - RNA, 30 nt, Artificial Sequence
  Ubiquitin-40S ribosomal protein S27a (74-83)
cgcacccugagcgacuacaacauccagaag

SEQ ID NO: 30617 - RNA, 27 nt, Artificial Sequence
  RAD50-interacting protein 1 (155-163)
cgcaccaacuggcccaacaccggcaag

SEQ ID NO: 30618 - RNA, 33 nt, Artificial Sequence
  Dynamin-binding protein (144-154)
cgcacccgggacuacgccagccugcccccgaag

SEQ ID NO: 30619 - RNA, 27 nt, Artificial Sequence
  ATP-dependent RNA helicase DDX24 (666-674)
cgcaccagcgagaucuacgugcaccgg

SEQ ID NO: 30620 - RNA, 27 nt, Artificial Sequence
  Sterol regulatory element-binding protein 2 (332-340)
cgcaccacccacaacaucaucgagaag

SEQ ID NO: 30621 - RNA, 30 nt, Artificial Sequence
  Cleavage and polyadenylation specificity factor subunit 2 (358-367)
cgcaccacccccggcacgcuggcccgguuc

SEQ ID NO: 30622 - RNA, 30 nt, Artificial Sequence
  Diphosphoinositol polyphosphate phosphohydrolase 1 (10-19)
cgcaccuacgacggcgacggguacaagaag

SEQ ID NO: 30623 - RNA, 30 nt, Artificial Sequence
  Diphosphoinositol polyphosphate phosphohydrolase 2 (7-16)
cgcaccuacgaccgggagggcuucaagaag

SEQ ID NO: 30624 - RNA, 30 nt, Artificial Sequence
  Coatomer subunit beta' (759-768)
cgcaccuaccugcccagccaggugucccgg

SEQ ID NO: 30625 - RNA, 27 nt, Artificial Sequence
  Exocyst complex component 4 (74-82)
cgcaccuaccagagcaucaccgagcgg

SEQ ID NO: 30626 - RNA, 30 nt, Artificial Sequence
  Lon protease homolog 2, peroxisomal (371-380)
cgcaccuacgugggcagcaugcccgggcgg

SEQ ID NO: 30627 - RNA, 27 nt, Artificial Sequence
  Plakophilin-4 (418-426)
cgcaccuacuacagccccguguaccgg

SEQ ID NO: 30628 - RNA, 33 nt, Artificial Sequence
  tRNA pseudouridine synthase-like 1 (270-280)
cgcguggcccccgcccacggccuguuccucaag

SEQ ID NO: 30629 - RNA, 30 nt, Artificial Sequence
  Protein ERGIC-53 (12-21)
cgcguggcccccagccugaagucccagcgg

SEQ ID NO: 30630 - RNA, 33 nt, Artificial Sequence
  Chromobox protein homolog 6 (9-19)
cgcguguucgccgccgagagcaucaucaagcgg

SEQ ID NO: 30631 - RNA, 27 nt, Artificial Sequence
  F-box only protein 3 (143-151)
cgcguguucgacguccccauccggcgc

SEQ ID NO: 30632 - RNA, 33 nt, Artificial Sequence
  ATP synthase mitochondrial F1 complex assembly factor 1 (45-55)
cgcguguuccccguccggccgggcagcgggcgc

SEQ ID NO: 30633 - RNA, 30 nt, Artificial Sequence
  tRNA (guanine(26)-N(2))-dimethyltransferase (327-336)
cgcguguucaccggccaggccaaggucaag

SEQ ID NO: 30634 - RNA, 27 nt, Artificial Sequence
  Poly (ADP-ribose) polymerase 3 (110-118)
cgcgugggcgaggucgggcagagcaag

SEQ ID NO: 30635 - RNA, 30 nt, Artificial Sequence
  Poly (ADP-ribose) polymerase 1 (591-600)
cgcgugggcaccgucaucgggagcaacaag

SEQ ID NO: 30636 - RNA, 33 nt, Artificial Sequence
  Bifunctional methylenetetrahydrofolate dehydrogenase/cyclohydrolase, mitochondrial (278-288)
cgcgugcacgaccccgucaccgccaagccgaag

SEQ ID NO: 30637 - RNA, 30 nt, Artificial Sequence
  Choline/ethanolaminephosphotransferase 1 (267-276)
cgcgugaucuucaccggcggggucggcaag

SEQ ID NO: 30638 - RNA, 33 nt, Artificial Sequence
  Drebrin-like protein (68-78)
cgcgugaaggaccccaacagcggccugccgaag

SEQ ID NO: 30639 - RNA, 27 nt, Artificial Sequence
  YEATS domain-containing protein 4 (11-19)
cgcgugaagggcgucaccaucgugaag

SEQ ID NO: 30640 - RNA, 30 nt, Artificial Sequence
  60S ribosomal protein L8 (147-156)
cgcgugaagcugcccagcggcuccaagaag

SEQ ID NO: 30641 - RNA, 30 nt, Artificial Sequence
  Sorting nexin-3 (52-61)
cgcgugaagaccaaccugcccaucuucaag

SEQ ID NO: 30642 - RNA, 30 nt, Artificial Sequence
  Copper transport protein ATOX1 (20-29)
cgcgugcugaacaagcucggcggggucaag

SEQ ID NO: 30643 - RNA, 27 nt, Artificial Sequence
  U3 small nucleolar RNA-associated protein 14 homolog A (631-639)
cgcgugcugcccuacccguucacccac

SEQ ID NO: 30644 - RNA, 27 nt, Artificial Sequence
  60S ribosomal export protein NMD3 (397-405)
cgcgugcccgacgucgugcugaucaag

SEQ ID NO: 30645 - RNA, 33 nt, Artificial Sequence
  Protein FAM136A (8-18)
cgcgugcaggaggccgucgagagcauggugaag

SEQ ID NO: 30646 - RNA, 30 nt, Artificial Sequence
  Acetolactate synthase-like protein (181-190)
cgcgugcgggacaucguccccacccugcgc

SEQ ID NO: 30647 - RNA, 27 nt, Artificial Sequence
  Inosine-5'-monophosphate dehydrogenase 2 (126-134)
cgcgugcgggacgucuucgaggccaag

SEQ ID NO: 30648 - RNA, 30 nt, Artificial Sequence
  Transmembrane protein 107 (3-12)
cgcgugagcggccugguccccucccgguuc

SEQ ID NO: 30649 - RNA, 27 nt, Artificial Sequence
  Mitochondrial import receptor subunit TOM5 homolog (39-47)
cgcgugacccccuucauccugaagaag

SEQ ID NO: 30650 - RNA, 27 nt, Artificial Sequence
  Dolichyl-diphosphooligosaccharide-proteinosyltransferase subunit 2 (256-264)
cgcgugaccuaccccgccaaggccaag

SEQ ID NO: 30651 - RNA, 33 nt, Artificial Sequence
  Fanconi anemia group D2 protein (185-195)
cgcguggucgacggcaaggaccugaccaccaag

SEQ ID NO: 30652 - RNA, 33 nt, Artificial Sequence
  Ribosome biogenesis protein WDR12 (281-291)
cgcgugugggacgucgagagcggcucccugaag

SEQ ID NO: 30653 - RNA, 27 nt, Artificial Sequence
  Splicing factor 3B subunit 3 (968-976)
cgcguguacgaccugggcaagaagaag

SEQ ID NO: 30654 - RNA, 33 nt, Artificial Sequence
  WD repeat-containing protein 74 (208-218)
cgcguguacgaccccgccagcccgcagcggcgc

SEQ ID NO: 30655 - RNA, 30 nt, Artificial Sequence
  Arf-GAP with coiled-coil, ANK repeat and PH domain-containing protein 2 (477-486)
cgcguguacgaggccaacgucgagaagaug

SEQ ID NO: 30656 - RNA, 33 nt, Artificial Sequence
  Centrosomal protein of 104 kDa (621-631)
cgcguguacgagguccgggagaccgccgugcgc

SEQ ID NO: 30657 - RNA, 27 nt, Artificial Sequence
  Programmed cell death 6-interacting protein (606-614)
cgcguguacggcgggcugaccaccaag

SEQ ID NO: 30658 - RNA, 27 nt, Artificial Sequence
  Probable E3 ubiquitin-protein ligase TRIM8 (538-546)
cgcguguacggccagcccagcaccaag

SEQ ID NO: 30659 - RNA, 33 nt, Artificial Sequence
  Probable E3 ubiquitin-protein ligase TRIM8 (538-548)
cgcguguacggccagcccagcaccaagcacuac

SEQ ID NO: 30660 - RNA, 33 nt, Artificial Sequence
  UPF0769 protein C21orf59 (33-43)
cgcguguacaacggccggcugaagguccagcgc

SEQ ID NO: 30661 - RNA, 33 nt, Artificial Sequence
  Serine/threonine-protein kinase pim-2 (201-211)
cgcguguacagccccccggaguggaucucccgg

SEQ ID NO: 30662 - RNA, 30 nt, Artificial Sequence
  E3 ubiquitin-protein ligase Itchy homolog (177-186)
cgcguguacuacgucgaccacguggagaag

SEQ ID NO: 30663 - RNA, 27 nt, Artificial Sequence
  Superkiller viralicidic activity 2-like 2 (738-746)
agcgccaucuccagcgugcgccuguac

SEQ ID NO: 30664 - RNA, 27 nt, Artificial Sequence
  Ubiquilin-1 (452-460)
agcgccauguccaacccccgcgccaug

SEQ ID NO: 30665 - RNA, 30 nt, Artificial Sequence
  40S ribosomal protein S21 (18-27)
agcgccuccaaccgcaucaucggcgccaag

SEQ ID NO: 30666 - RNA, 27 nt, Artificial Sequence
  Condensin-2 complex subunit G2 (606-614)
agcgaggccgccgcgccccgcgccuuc

SEQ ID NO: 30667 - RNA, 27 nt, Artificial Sequence
  Ferritin heavy chain (79-87)
agcgaggccgccaucaaccgccagauc

SEQ ID NO: 30668 - RNA, 27 nt, Artificial Sequence
  Microtubule-actin cross-linking factor 1, isoforms 1/2/3/5 (3831-3839)
agcgaggccgagcagacccugcgcuuc

SEQ ID NO: 30669 - RNA, 27 nt, Artificial Sequence
  Single-stranded DNA-binding protein 2 (86-94)
agcgaggccaaggccuuccacgacuac

SEQ ID NO: 30670 - RNA, 30 nt, Artificial Sequence
  PERQ amino acid-rich with GYF domain-containing protein 2 (1182-1191)
agcgaggccaaggaguucgccaagcaguuc

SEQ ID NO: 30671 - RNA, 33 nt, Artificial Sequence
  Transcriptional adapter 1 (16-26)
agcgaggcccugggcgacaacgugaagcaguac

SEQ ID NO: 30672 - RNA, 27 nt, Artificial Sequence
  Cytoplasmic dynein 1 heavy chain 1 (1405-1413)
agcgaggcccugaaggaccgccacugg

SEQ ID NO: 30673 - RNA, 27 nt, Artificial Sequence
  Zinc finger protein 296 (189-197)
agcgaggcccccgaggccccgcugcuc

SEQ ID NO: 30674 - RNA, 30 nt, Artificial Sequence
  ATP-dependent RNA helicase DDX50 (2-11)
agcgaggacaacccccagacccugcucuuc

SEQ ID NO: 30675 - RNA, 27 nt, Artificial Sequence
  UV-stimulated scaffold protein A (35-43)
agcgaggagcagcugucccgcgccuac

SEQ ID NO: 30676 - RNA, 27 nt, Artificial Sequence
  X-ray repair cross-complementing protein 5 (650-658)
agcgaggagcagcgcuucaacaacuuc

SEQ ID NO: 30677 - RNA, 27 nt, Artificial Sequence
  WD repeat-containing protein 63 (190-198)
agcgaguucggcgcccccaucaaguuc

SEQ ID NO: 30678 - RNA, 30 nt, Artificial Sequence
  Pre-mRNA-processing-splicing factor 8 (1377-1386)
agcgaguucaucgacucccagcgcgugugg

SEQ ID NO: 30679 - RNA, 27 nt, Artificial Sequence
  Programmed cell death protein 6 (83-91)
agcgaguucaccggcguguggaaguac

SEQ ID NO: 30680 - RNA, 33 nt, Artificial Sequence
  Proteasome subunit beta type-5 (72-82)
agcgagggcaaccgcaucuccggggccaccuuc

SEQ ID NO: 30681 - RNA, 33 nt, Artificial Sequence
  WD repeat-containing protein 62 (1273-1283)
agcgagggccaggagcccgcccugcgcuccugg

SEQ ID NO: 30682 - RNA, 30 nt, Artificial Sequence
  E3 ubiquitin-protein ligase MARCH6 (14-23)
agcgagggcacccccgagaagccgcuguac

SEQ ID NO: 30683 - RNA, 30 nt, Artificial Sequence
  Serine hydroxymethyltransferase, mitochondrial (67-76)
agcgagggcuaccccgggaagcgcuacuac

SEQ ID NO: 30684 - RNA, 27 nt, Artificial Sequence
  Serine hydroxymethyltransferase, cytosolic (74-82)
agcgagggcuaccccgggcagcgcuac

SEQ ID NO: 30685 - RNA, 27 nt, Artificial Sequence
  Pre-mRNA-splicing factor CWC22 homolog (326-334)
agcgagaucgacaagcgcgugcaguac

SEQ ID NO: 30686 - RNA, 27 nt, Artificial Sequence
  Talin-1 (290-298)
agcgagaucgaggccaaggugcgcuac

SEQ ID NO: 30687 - RNA, 27 nt, Artificial Sequence
  Beta-parvin (141-149)
agcgagaucggccagaagcagaagcug

SEQ ID NO: 30688 - RNA, 33 nt, Artificial Sequence
  Ribosome-binding protein 1 (242-252)
agcgagaaggccggcaucauccaggacaccugg

SEQ ID NO: 30689 - RNA, 27 nt, Artificial Sequence
  Nuclear pore complex protein Nup155 (295-303)
agcgagaagggcgugauccaggucuac

SEQ ID NO: 30690 - RNA, 27 nt, Artificial Sequence
  Plectin (3212-3220)
agcgagcugcaggcccgcgagaccuuc

SEQ ID NO: 30691 - RNA, 27 nt, Artificial Sequence
  Inositol 1,4,5-trisphosphate receptor type 1 (2099-2107)
agcgagaacgccgagcgcauccuguac

SEQ ID NO: 30692 - RNA, 27 nt, Artificial Sequence
  AP-2 complex subunit mu (347-355)
agcgagaacgccaucguguggaagauc

SEQ ID NO: 30693 - RNA, 27 nt, Artificial Sequence
  DnaJ homolog subfamily A member 2 (20-28)
agcgagaacgagcugaagaaggccuac

SEQ ID NO: 30694 - RNA, 33 nt, Artificial Sequence
  DNA-dependent protein kinase catalytic subunit (2174-2184)
agcgagaacaacggcggggagggcauccacuac

SEQ ID NO: 30695 - RNA, 30 nt, Artificial Sequence
  Mediator of RNA polymerase II transcription subunit 12 (891-900)
agcgagaaccccgccaaccgcuacuccuuc

SEQ ID NO: 30696 - RNA, 27 nt, Artificial Sequence
  F-box/LRR-repeat protein 3 (261-269)
agcgagaaccccggccagacccacuuc

SEQ ID NO: 30697 - RNA, 33 nt, Artificial Sequence
  Protein sel-1 homolog 1 (20-30)
agcgagcagcagcacuccgcccaggccauguuc

SEQ ID NO: 30698 - RNA, 27 nt, Artificial Sequence
  HLA class II histocompatibility antigen, DRB1-11 beta chain (221-229)
agcgaguccgcccagagcaagaugcug

SEQ ID NO: 30699 - RNA, 33 nt, Artificial Sequence
  Eukaryotic initiation factor 4A-I (40-50)
agcgagucccugcuccgcggcaucuacgccuac

SEQ ID NO: 30700 - RNA, 27 nt, Artificial Sequence
  Retinoic acid receptor alpha (17-25)
agcgagucccgcaugguggucaccuuc

SEQ ID NO: 30701 - RNA, 27 nt, Artificial Sequence
  Vacuolar protein sorting-associated protein 51 homolog (16-24)
agcgagaccgacauggugcgccagauc

SEQ ID NO: 30702 - RNA, 27 nt, Artificial Sequence
  26S proteasome non-ATPase regulatory subunit 2 (546-554)
agcgagaccgagcugaaggacaccuac

SEQ ID NO: 30703 - RNA, 27 nt, Artificial Sequence
  Misshapen-like kinase 1 (969-977)
agcgagacccccgagauccgcaaguac

SEQ ID NO: 30704 - RNA, 27 nt, Artificial Sequence
  Serine/threonine-protein kinase Nek6 (224-232)
agcgagaccaccgccgcccacucccug

SEQ ID NO: 30705 - RNA, 27 nt, Artificial Sequence
  U5 small nuclear ribonucleoprotein 200 kDa helicase (1230-1238)
agcgaggugauccugcaccacgaguac

SEQ ID NO: 30706 - RNA, 27 nt, Artificial Sequence
  Arginine-glutamic acid dipeptide repeats protein (1257-1265)
agcgaguacgcccgcccccacgugaug

SEQ ID NO: 30707 - RNA, 30 nt, Artificial Sequence
  Proteasome subunit alpha type-5 (6-15)
agcgaguacgaccgcggcgugaacaccuuc

SEQ ID NO: 30708 - RNA, 30 nt, Artificial Sequence
  Nucleolar protein 56 (275-284)
agcgaguaccgccagucccugcacaccuac

SEQ ID NO: 30709 - RNA, 24 nt, Artificial Sequence
  Pleiotropic regulator 1 (226-233)
agcggcaagcugaagcucucccug

SEQ ID NO: 30710 - RNA, 27 nt, Artificial Sequence
  Manganese-transporting ATPase 13A1 (75-83)
agcaucgccgcccccuucaccuccaag

SEQ ID NO: 30711 - RNA, 27 nt, Artificial Sequence
  Myotubularin-related protein 10 (210-218)
agcauccugggcaccccccucuccaag

SEQ ID NO: 30712 - RNA, 30 nt, Artificial Sequence
  U2 small nuclear ribonucleoprotein A' (119-128)
agcauccugcgcaaccccgugaccaacaag

SEQ ID NO: 30713 - RNA, 30 nt, Artificial Sequence
  Cytospin-A (887-896)
agcaucuccggccccaucagcaccuccaag

SEQ ID NO: 30714 - RNA, 33 nt, Artificial Sequence
  Double-stranded RNA-specific adenosine deaminase (1110-1120)
agcaucuacgacuccaagcgccagagcggcaag

SEQ ID NO: 30715 - RNA, 27 nt, Artificial Sequence
  Importin-8 (234-242)
agccuggccgagauccuccugaagaag

SEQ ID NO: 30716 - RNA, 30 nt, Artificial Sequence
  Heterogeneous nuclear ribonucleoprotein K (154-163)
agccuggccggcgggaucaucggcgugaag

SEQ ID NO: 30717 - RNA, 27 nt, Artificial Sequence
  G2/M phase-specific E3 ubiquitin-protein ligase (424-432)
agccuguucgagggcucccucagcaag

SEQ ID NO: 30718 - RNA, 27 nt, Artificial Sequence
  Serine/threonine-protein phosphatase 2A 56 kDa regulatory subunit epsilon isoform (278-286)
agccuguuccacgcccagcucgccuac

SEQ ID NO: 30719 - RNA, 27 nt, Artificial Sequence
  Adenylate cyclase type 6 (161-169)
agccuguuccccaaggcccuccagcgc

SEQ ID NO: 30720 - RNA, 27 nt, Artificial Sequence
  Cytochrome c oxidase subunit 6C (30-38)
agccugggcguggccgcccucuacaag

SEQ ID NO: 30721 - RNA, 30 nt, Artificial Sequence
  Histone H2A.V (91-100)
agccugaucggcaagaaggggcagcagaag

SEQ ID NO: 30722 - RNA, 27 nt, Artificial Sequence
  N-alpha-acetyltransferase 30 (63-71)
agccugaaguccaaggugcucagcguc

SEQ ID NO: 30723 - RNA, 27 nt, Artificial Sequence
  COP9 signalosome complex subunit 2 (433-441)
agccugaaccaggccguggucuccaag

SEQ ID NO: 30724 - RNA, 30 nt, Artificial Sequence
  Cell division cycle-associated protein 2 (247-256)
agccugcccgccaacaccccgcuccgcaag

SEQ ID NO: 30725 - RNA, 27 nt, Artificial Sequence
  Zinc finger protein 697 (327-335)
agccuguccagccaccuccugucccac

SEQ ID NO: 30726 - RNA, 33 nt, Artificial Sequence
  Protection of telomeres protein 1 (417-427)
agccuguacgacuccaagaucuggaccaccaag

SEQ ID NO: 30727 - RNA, 33 nt, Artificial Sequence
  MICOS complex subunit MIC26 (41-51)
agccuguacuccgugcccgagggccagagcaag

SEQ ID NO: 30728 - RNA, 27 nt, Artificial Sequence
  A-kinase anchor protein 13 (930-938)
agcccccugaccaaguccaucagccuc

SEQ ID NO: 30729 - RNA, 24 nt, Artificial Sequence
  Elongation factor 2 (95-102)
agccccaacaagcacaaccgccug

SEQ ID NO: 30730 - RNA, 27 nt, Artificial Sequence
  WD repeat-containing protein 3 (558-566)
agccccaaccagaagcugcucgccgug

SEQ ID NO: 30731 - RNA, 24 nt, Artificial Sequence
  Gamma-interferon-inducible protein 16 (166-173)
agccccuccccgaagaccagccug

SEQ ID NO: 30732 - RNA, 24 nt, Artificial Sequence
  Elongation factor 2 (2-9)
agccccgugguccgcguggccgug

SEQ ID NO: 30733 - RNA, 27 nt, Artificial Sequence
  Uridine diphosphate glucose pyrophosphatase (83-91)
agccccuaccugcgcccgcucacccug

SEQ ID NO: 30734 - RNA, 27 nt, Artificial Sequence
  Ubiquitin carboxyl-terminal hydrolase 48 (410-418)
agccgcaacgccuacaugcugguguac

SEQ ID NO: 30735 - RNA, 27 nt, Artificial Sequence
  RNA-binding protein EWS (328-336)
agcuccgcccccccgcugaccggcaag

SEQ ID NO: 30736 - RNA, 27 nt, Artificial Sequence
  Immediate early response gene 5 protein (275-283)
agcuccuucagcggccugcuccgcaag

SEQ ID NO: 30737 - RNA, 27 nt, Artificial Sequence
  40S ribosomal protein S5 (184-192)
agcuccaacagcuacgccaucaagaag

SEQ ID NO: 30738 - RNA, 27 nt, Artificial Sequence
  Proteasome activator complex subunit 4 (977-985)
agcuccuacagccaggugcgcaacaag

SEQ ID NO: 30739 - RNA, 27 nt, Artificial Sequence
  PCI domain-containing protein 2 (203-211)
agcaccgcccagcgcgugaccuacaag

SEQ ID NO: 30740 - RNA, 27 nt, Artificial Sequence
  MAP7 domain-containing protein 1 (454-462)
agcaccgccuccgagcugagccccaag

SEQ ID NO: 30741 - RNA, 27 nt, Artificial Sequence
  60S ribosomal protein L18 (41-49)
agcaccuucaaccaggugguccugaag

SEQ ID NO: 30742 - RNA, 27 nt, Artificial Sequence
  WD repeat and coiled-coil-containing protein C2orf44 (449-457)
agcaccuucuccgccccccugaacaag

SEQ ID NO: 30743 - RNA, 27 nt, Artificial Sequence
  Kanadaptin (238-246)
agcacccacggcaccuuccugaacaag

SEQ ID NO: 30744 - RNA, 27 nt, Artificial Sequence
  Double-stranded RNA-binding protein Staufen homolog 2 (41-49)
agcacccugcccaagccggugcagaag

SEQ ID NO: 30745 - RNA, 27 nt, Artificial Sequence
  F-box only protein 11 (143-151)
agcaccaacucccaccccauccugcgc

SEQ ID NO: 30746 - RNA, 27 nt, Artificial Sequence
  LisH domain-containing protein ARMC9 (382-390)
agcaccuccgacgugguccgccaguac

SEQ ID NO: 30747 - RNA, 27 nt, Artificial Sequence
  E3 ubiquitin-protein ligase CHFR (78-86)
agcaccuccggcaccgugaucaacaag

SEQ ID NO: 30748 - RNA, 27 nt, Artificial Sequence
  Lysine-specific histone demethylase 1A (633-641)
agcaccucccagaccuucaucuacaag

SEQ ID NO: 30749 - RNA, 27 nt, Artificial Sequence
  Heterogeneous nuclear ribonucleoprotein U-like protein 2 (165-173)
agcaccuacggcgugaccaaggggaag

SEQ ID NO: 30750 - RNA, 27 nt, Artificial Sequence
  Cathepsin Z (38-46)
agcaccuacccccgcccgcacgaguac

SEQ ID NO: 30751 - RNA, 27 nt, Artificial Sequence
  Nucleolar pre-ribosomal-associated protein 1 (2084-2092)
agcguggccgagcacccccugucccgc

SEQ ID NO: 30752 - RNA, 27 nt, Artificial Sequence
  MOB kinase activator 1A (188-196)
agcguggccaagaccauccugaagcgc

SEQ ID NO: 30753 - RNA, 30 nt, Artificial Sequence
  Lysine-specific demethylase 5C (959-968)
agcguggcccccuccccggccgucgacaag

SEQ ID NO: 30754 - RNA, 27 nt, Artificial Sequence
  Lysine-specific demethylase 5A (796-804)
agcguggcccagcugcuccuguccaag

SEQ ID NO: 30755 - RNA, 27 nt, Artificial Sequence
  Probable cation-transporting ATPase 13A4 (871-879)
agcguggccucccccuucaccagcaag

SEQ ID NO: 30756 - RNA, 27 nt, Artificial Sequence
  Sentrin-specific protease 5 (115-123)
agcguggacggccccgucucccagaag

SEQ ID NO: 30757 - RNA, 27 nt, Artificial Sequence
  Exostosin-2 (692-700)
agcguguucggcaccaugccccugaag

SEQ ID NO: 30758 - RNA, 27 nt, Artificial Sequence
  SRR1-like protein (301-309)
agcgugcacugguuccccguccagaag

SEQ ID NO: 30759 - RNA, 27 nt, Artificial Sequence
  Epidermal growth factor receptor kinase substrate 8 (380-388)
agcgugcuguccccccuccugaacaag

SEQ ID NO: 30760 - RNA, 27 nt, Artificial Sequence
  Nodal modulator 2 (130-138)
agcgugaacggcaagguccuguccaag

SEQ ID NO: 30761 - RNA, 27 nt, Artificial Sequence
  Ubiquitin carboxyl-terminal hydrolase 11 (442-450)
agcgugccccugccgaucucccacaag

SEQ ID NO: 30762 - RNA, 30 nt, Artificial Sequence
  Cytoplasmic dynein 1 light intermediate chain 1 (419-428)
agcgugucccccaucccggccggcagcaag

SEQ ID NO: 30763 - RNA, 30 nt, Artificial Sequence
  Zinc finger protein 697 (10-19)
agcguguccagccaccuguucacccacaag

SEQ ID NO: 30764 - RNA, 27 nt, Artificial Sequence
  Zinc finger protein 619 (226-234)
agcguguccacccaccugaucaccaag

SEQ ID NO: 30765 - RNA, 27 nt, Artificial Sequence
  Fatty acyl-CoA reductase 1 (39-47)
agcguguacguccuggugcgccagaag

SEQ ID NO: 30766 - RNA, 27 nt, Artificial Sequence
  Histone H2B type 2-F (39-47)
agcguguacgucuacaaggugcugaag

SEQ ID NO: 30767 - RNA, 27 nt, Artificial Sequence
  Nucleolar RNA helicase 2 (15-23)
accgccaugaagaagggcgagacccug

SEQ ID NO: 30768 - RNA, 30 nt, Artificial Sequence
  Pre-mRNA-processing-splicing factor 8 (1079-1088)
accgaggccgcccaccccauccgccuguuc

SEQ ID NO: 30769 - RNA, 30 nt, Artificial Sequence
  NHP2-like protein 1 (2-11)
accgaggccgacgugaaccccaaggccuac

SEQ ID NO: 30770 - RNA, 27 nt, Artificial Sequence
  Splicing factor, proline- and glutamine-rich (309-317)
accgaggacgaguucaagcgccuguuc

SEQ ID NO: 30771 - RNA, 30 nt, Artificial Sequence
  60S ribosomal protein L13 (170-179)
accgaggaggagaagaacuucaaggccuuc

SEQ ID NO: 30772 - RNA, 30 nt, Artificial Sequence
  Protein SET (136-145)
accgaguucgaggacaucaagagcggcuac

SEQ ID NO: 30773 - RNA, 30 nt, Artificial Sequence
  Neutral alpha-glucosidase AB (174-183)
accgagggcggggagcccuaccgccuguac

SEQ ID NO: 30774 - RNA, 27 nt, Artificial Sequence
  T-complex protein 1 subunit theta (342-350)
accgagaucgagcuggccaagcagauc

SEQ ID NO: 30775 - RNA, 27 nt, Artificial Sequence
  RNA-binding protein 27 (734-742)
accgagcuggaccuccacaagcgccug

SEQ ID NO: 30776 - RNA, 27 nt, Artificial Sequence
  RNA-binding protein 26 (793-801)
accgagcuggaccucuacaagaagaug

SEQ ID NO: 30777 - RNA, 27 nt, Artificial Sequence
  Cell cycle progression protein 1 (432-440)
accgagcuggagcgcaagcucaccuuc

SEQ ID NO: 30778 - RNA, 30 nt, Artificial Sequence
  Exocyst complex component 4 (67-76)
accgagcugaccacggccauccgcaccuac

SEQ ID NO: 30779 - RNA, 27 nt, Artificial Sequence
  Geranylgeranyl pyrophosphate synthase (238-246)
accgagaacaucgacaucaagaaguac

SEQ ID NO: 30780 - RNA, 33 nt, Artificial Sequence
  Fructose-bisphosphate aldolase A (103-113)
accgagaacaccgaggagaaccgccgguucuac

SEQ ID NO: 30781 - RNA, 27 nt, Artificial Sequence
  Probable cation-transporting ATPase 13A3 (132-140)
accgagagccagcagauccgcuacuuc

SEQ ID NO: 30782 - RNA, 27 nt, Artificial Sequence
  Nuclear factor erythroid 2-related factor 2 (198-206)
accgagguggacaacuaccacuucuac

SEQ ID NO: 30783 - RNA, 24 nt, Artificial Sequence
  Basigin (48-55)
accgaggugaccggccaccgcugg

SEQ ID NO: 30784 - RNA, 27 nt, Artificial Sequence
  Myosin phosphatase Rho-interacting protein (441-449)
accgaguaccccgugcagcgcaacuac

SEQ ID NO: 30785 - RNA, 33 nt, Artificial Sequence
  GPI transamidase component PIG-T (450-460)
accgaguacacccccgacccgaaccacggcuuc

SEQ ID NO: 30786 - RNA, 27 nt, Artificial Sequence
  Protein kinase C delta-binding protein (181-189)
accggccugcagaaggugcagagccuc

SEQ ID NO: 30787 - RNA, 27 nt, Artificial Sequence
  Alpha-enolase (72-80)
accaucgcccccgcccuggugagcaag

SEQ ID NO: 30788 - RNA, 27 nt, Artificial Sequence
  Histidine triad nucleotide-binding protein 1 (17-25)
accaucuucggcaagaucauccgcaag

SEQ ID NO: 30789 - RNA, 27 nt, Artificial Sequence
  NHP2-like protein 1 (105-113)
accaucaaggagggcagccagcugaag

SEQ ID NO: 30790 - RNA, 27 nt, Artificial Sequence
  H/ACA ribonucleoprotein complex subunit 3 (47-55)
accaucaagaagcgcuucaaggugcug

SEQ ID NO: 30791 - RNA, 27 nt, Artificial Sequence
  Signal peptidase complex subunit 2 (129-137)
accaucuacaccagcuacaaggagaag

SEQ ID NO: 30792 - RNA, 24 nt, Artificial Sequence
  Retinoblastoma-like protein 1 (803-810)
accaucuacgugggccgcgucaag

SEQ ID NO: 30793 - RNA, 24 nt, Artificial Sequence
  Interferon-related developmental regulator 1 (118-125)
acccugggccccauccucaagaag

SEQ ID NO: 30794 - RNA, 27 nt, Artificial Sequence
  Protein BRICK1 (49-57)
acccugaacgagaagcucaccgcccug

SEQ ID NO: 30795 - RNA, 27 nt, Artificial Sequence
  GPI mannosyltransferase 3 (40-48)
acccuguacuucaacacccaggagaag

SEQ ID NO: 30796 - RNA, 27 nt, Artificial Sequence
  Splicing factor 3B subunit 3 (759-767)
accaacacccugcgcauccucgcccug

SEQ ID NO: 30797 - RNA, 27 nt, Artificial Sequence
  Ubiquitin-like protein 7 (248-256)
acccccagcucccgcccggccagccug

SEQ ID NO: 30798 - RNA, 27 nt, Artificial Sequence
  Exportin-6 (55-63)
acccgcaacgacuacgugaugauguac

SEQ ID NO: 30799 - RNA, 27 nt, Artificial Sequence
  Perilipin-2 (63-71)
accagcgcccugcccaucauccagaag

SEQ ID NO: 30800 - RNA, 27 nt, Artificial Sequence
  Huntingtin (1215-1223)
accagcggccccgugaccacguccaag

SEQ ID NO: 30801 - RNA, 24 nt, Artificial Sequence
  YTH domain-containing protein 1 (327-334)
accagcaagcugaaguacgugcuc

SEQ ID NO: 30802 - RNA, 27 nt, Artificial Sequence
  Male-specific lethal 3 homolog (328-336)
accaccggcgagcccgccacgccgaag

SEQ ID NO: 30803 - RNA, 30 nt, Artificial Sequence
  Flap endonuclease 1 (60-69)
accaccagccaccugaugggcauguucuac

SEQ ID NO: 30804 - RNA, 27 nt, Artificial Sequence
  Elongation factor 1-alpha 1 (22-30)
accaccacgggccaccugaucuacaag

SEQ ID NO: 30805 - RNA, 27 nt, Artificial Sequence
  Derlin-1 (22-30)
accguggccgucccccuggugggcaag

SEQ ID NO: 30806 - RNA, 27 nt, Artificial Sequence
  COP9 signalosome complex subunit 3 (378-386)
accgugaacccccaguucguccagaag

SEQ ID NO: 30807 - RNA, 30 nt, Artificial Sequence
  HIG1 domain family member 2A, mitochondrial (27-36)
accguguaccgcaaccccgagagcuucaag

SEQ ID NO: 30808 - RNA, 27 nt, Artificial Sequence
  Talin-1 (1188-1196)
guggccaaggccgucacccaggcgcug

SEQ ID NO: 30809 - RNA, 27 nt, Artificial Sequence
  DNA damage-binding protein 1 (510-518)
guggccgucggccgcgcccuguacuac

SEQ ID NO: 30810 - RNA, 27 nt, Artificial Sequence
  Translin-associated protein X (128-136)
guggaggccgucagcuuccagcacuuc

SEQ ID NO: 30811 - RNA, 33 nt, Artificial Sequence
  Nodal modulator 3 (448-458)
guggagggcaccaucggggacuucaaggccuac

SEQ ID NO: 30812 - RNA, 27 nt, Artificial Sequence
  3-phosphoinositide-dependent protein kinase 1 (325-333)
guggagaacaaccugauccucaagaug

SEQ ID NO: 30813 - RNA, 27 nt, Artificial Sequence
  Sodium-coupled neutral amino acid transporter 2 (354-362)
guggagagcgagcugcuccacaccuac

SEQ ID NO: 30814 - RNA, 27 nt, Artificial Sequence
  Intraflagellar transport protein 81 homolog (196-204)
guggagaccgcccagaaccaccagugg

SEQ ID NO: 30815 - RNA, 30 nt, Artificial Sequence
  Cleavage and polyadenylation specificity factor subunit 3 (444-453)
gugauccuggagguccagagcaaccccaag

SEQ ID NO: 30816 - RNA, 27 nt, Artificial Sequence
  Centrosomal protein of 57 kDa (326-334)
gugaucaacagcaucccccuggccaag

SEQ ID NO: 30817 - RNA, 27 nt, Artificial Sequence
  DNA-directed RNA polymerase I subunit RPA2 (81-89)
gugaucagccccccgaccguccccaag

SEQ ID NO: 30818 - RNA, 33 nt, Artificial Sequence
  Ras GTPase-activating protein-binding protein 1 (113-123)
gugcuggcccccgagggcagcgucgccaacaag

SEQ ID NO: 30819 - RNA, 33 nt, Artificial Sequence
  Ras GTPase-activating protein-binding protein 2 (113-123)
gugcuggcccccgagggcagcgucccgaacaag

SEQ ID NO: 30820 - RNA, 27 nt, Artificial Sequence
  Interferon-stimulated gene 20 kDa protein (132-140)
gugcugagcgagcgccuccugcacaag

SEQ ID NO: 30821 - RNA, 27 nt, Artificial Sequence
  DNA-directed RNA polymerase II subunit RPB2 (1020-1028)
gugcuguacaacggcuucaccgggcgc

SEQ ID NO: 30822 - RNA, 27 nt, Artificial Sequence
  Long-chain-fatty-acid-CoA ligase 4 (576-584)
gugcccaaccagaagcgccugacccuc

SEQ ID NO: 30823 - RNA, 27 nt, Artificial Sequence
  Protein kintoun (155-163)
gugccccgcauccagccgcagagccug

SEQ ID NO: 30824 - RNA, 27 nt, Artificial Sequence
  Leucine-rich repeat-containing protein 20 (35-43)
gugagcuuccccaucggcaucuacaag

SEQ ID NO: 30825 - RNA, 24 nt, Artificial Sequence
  Vimentin (31-38)
gugaccaccagcacgcgcaccuac

SEQ ID NO: 30826 - RNA, 27 nt, Artificial Sequence
  Nucleolar and spindle-associated protein 1 (308-316)
gugaccgucagcggcgggacccccaag

SEQ ID NO: 30827 - RNA, 30 nt, Artificial Sequence
  Septin-7 (317-326)
gugaccuacaacggcgucgacaacaacaag

SEQ ID NO: 30828 - RNA, 27 nt, Artificial Sequence
  Histone deacetylase 9 (78-86)
guggucgaccccguggugcgcgagaag

SEQ ID NO: 30829 - RNA, 27 nt, Artificial Sequence
  Probable 18S rRNA (guanine-N(7))-methyltransferase (188-196)
guggucgacuaccccaacagcgccaag

SEQ ID NO: 30830 - RNA, 27 nt, Artificial Sequence
  Heterogeneous nuclear ribonucleoproteins A2/B1 (39-47)
guggucaugcgcgaccccgccagcaag

SEQ ID NO: 30831 - RNA, 27 nt, Artificial Sequence
  Heterogeneous nuclear ribonucleoprotein A3 (65-73)
guggucaugcgcgacccccagaccaag

SEQ ID NO: 30832 - RNA, 30 nt, Artificial Sequence
  Transmembrane protein 263 (101-110)
guggucaacaaggugccccugaccggcaag

SEQ ID NO: 30833 - RNA, 33 nt, Artificial Sequence
  X-ray repair cross-complementing protein 5 (574-584)
gugguccaggacggcaucacccugaucaccaag

SEQ ID NO: 30834 - RNA, 27 nt, Artificial Sequence
  60S ribosomal protein L22-like 1 (65-73)
guggucagcgagaagcaguucuccaag

SEQ ID NO: 30835 - RNA, 27 nt, Artificial Sequence
  Glutathione S-transferase P (6-14)
guggucuacuuccccgugcgcggccgg

SEQ ID NO: 30836 - RNA, 27 nt, Artificial Sequence
  Adenylosuccinate lyase (363-371)
guggucuaccccaaggugaucgagcgc

SEQ ID NO: 30837 - RNA, 27 nt, Artificial Sequence
  ER membrane protein complex subunit 1 (790-798)
guggucuaccaguacuggaacaccaag

SEQ ID NO: 30838 - RNA, 33 nt, Artificial Sequence
  NmrA-like family domain-containing protein 1 (109-119)
guggucuacagcggccuggagaacaucaagaag

SEQ ID NO: 30839 - RNA, 27 nt, Artificial Sequence
  JmjC domain-containing protein 8 (81-89)
uacgccuucgugcgccccgucauccug

SEQ ID NO: 30840 - RNA, 27 nt, Artificial Sequence
  CCR4-NOT transcription complex subunit 1 (93-101)
uacgccaucgacaacccccugcacuac

SEQ ID NO: 30841 - RNA, 27 nt, Artificial Sequence
  WD repeat-containing protein 82 (63-71)
uacgccaacagcaaggccgugacccug

SEQ ID NO: 30842 - RNA, 27 nt, Artificial Sequence
  Splicing factor 3B subunit 1 (761-769)
uacgccaacuacuacacccgcgaggug

SEQ ID NO: 30843 - RNA, 27 nt, Artificial Sequence
  WD repeat-containing protein 3 (84-92)
uacgaggacggcagcauccgcaucuuc

SEQ ID NO: 30844 - RNA, 30 nt, Artificial Sequence
  NADH dehydrogenase (ubiquinone) 1 beta subcomplex subunit 11, mitochondrial (67-76)
uacgagaagaaccccgacagccacggcuac

SEQ ID NO: 30845 - RNA, 27 nt, Artificial Sequence
  Lon protease homolog 2, peroxisomal (599-607)
uacgagauggaggugagccagcgccug

SEQ ID NO: 30846 - RNA, 27 nt, Artificial Sequence
  AN1-type zinc finger protein 5 (21-29)
uacggcaacccccgcaccaacgggaug

SEQ ID NO: 30847 - RNA, 27 nt, Artificial Sequence
  Cullin-3 (34-42)
uaccgcaacgccuacaccauggugcug

SEQ ID NO: 30848 - RNA, 27 nt, Artificial Sequence
  MICOS complex subunit MIC27 (44-52)
uacaccgcccccccgcugcagagcaag

SEQ ID NO: 30849 - RNA, 27 nt, Artificial Sequence
  ATP-dependent RNA helicase DDX3X (200-208)
uacacccgccccaccccggugcagaag

SEQ ID NO: 30850 - RNA, 27 nt, Artificial Sequence
  Vimentin (30-38)
uacgugaccaccagcacgcgcaccuac

SEQ ID NO: 30851 - RNA, 27 nt, Artificial Sequence
  Serine/threonine-protein kinase mTOR (853-861)
uacguggucgagcccuaccgcaaguac

SEQ ID NO: 30852 - RNA, 27 nt, Artificial Sequence
  Enhancer of filamentation 1 (164-172)
uacguguacgaguaccccagccgcuac

SEQ ID NO: 30853 - RNA, 30 nt, Artificial Sequence
  Nucleolar pre-ribosomal-associated protein 1 (1468-1477)
uacuacagccaccuggagggcgcccgcuuc

SEQ ID NO: 30854 - RNA, 27 nt, Artificial Sequence
  Selenoprotein H (10-18)
gccgaggccgcgguggucgccguggcc

SEQ ID NO: 30855 - RNA, 27 nt, Artificial Sequence
  Transcription factor BTF3 (128-136)
gccgaggcccugcccaagcagagcgug

SEQ ID NO: 30856 - RNA, 27 nt, Artificial Sequence
  E3 ubiquitin-protein ligase HUWE1 (1156-1164)
gccgaggacaaggacacccccgcccug

SEQ ID NO: 30857 - RNA, 33 nt, Artificial Sequence
  Centromere protein H (228-238)
gccgaggaccccgcccugaaggagaucgugcuc

SEQ ID NO: 30858 - RNA, 33 nt, Artificial Sequence
  Probable ATP-dependent RNA helicase DDX56 (121-131)
gccgaggacagcgugucccagcgcgccguccug

SEQ ID NO: 30859 - RNA, 27 nt, Artificial Sequence
  Transforming acidic coiled-coil-containing protein 3 (469-477)
gccgaggacacccccgugguccagcug

SEQ ID NO: 30860 - RNA, 30 nt, Artificial Sequence
  Beta-hexosaminidase subunit alpha (266-275)
gccgaguucgacacccccggccacacccug

SEQ ID NO: 30861 - RNA, 30 nt, Artificial Sequence
  26S proteasome non-ATPase regulatory subunit 8 (113-122)
gccgaguuccacaccgagcuggagcgccuc

SEQ ID NO: 30862 - RNA, 27 nt, Artificial Sequence
  Zinc phosphodiesterase ELAC protein 2 (677-685)
gccgaguucaucaugcugaaccacuuc

SEQ ID NO: 30863 - RNA, 30 nt, Artificial Sequence
  Calmodulin (11-20)
gccgaguucaaggaggccuucagccuguuc

SEQ ID NO: 30864 - RNA, 30 nt, Artificial Sequence
  BRCA1-A complex subunit BRE (90-99)
gccgaguuccugcccgacccgagcgcccuc

SEQ ID NO: 30865 - RNA, 36 nt, Artificial Sequence
  DNA dC-dU-editing enzyme APOBEC-3B (105-116)
gccgaguuccugagcgagcaccccaacgugacccuc

SEQ ID NO: 30866 - RNA, 27 nt, Artificial Sequence
  ATP-dependent RNA helicase DHX8 (979-987)
gccgaguucccccuggagccgaugcuc

SEQ ID NO: 30867 - RNA, 27 nt, Artificial Sequence
  Cytochrome c oxidase subunit 6B1 (9-17)
gccgagggcaccuuccccgggaagauc

SEQ ID NO: 30868 - RNA, 27 nt, Artificial Sequence
  SRSF protein kinase 1 (114-122)
gccgagcacuacaccgagaccgcccug

SEQ ID NO: 30869 - RNA, 33 nt, Artificial Sequence
  DNA repair protein RAD50 (134-144)
gccgagaucgaccgcgagaugaucagcucccug

SEQ ID NO: 30870 - RNA, 27 nt, Artificial Sequence
  Insulin-like growth factor 2 mRNA-binding protein 2 (201-209)
gccgagaucgagaucaugaagaagcug

SEQ ID NO: 30871 - RNA, 36 nt, Artificial Sequence
  Sodium/potassium-transporting ATPase subunit alpha-1 (69-80)
gccgagauccuggcccgcgacggccccaacgcgcuc

SEQ ID NO: 30872 - RNA, 33 nt, Artificial Sequence
  Lamin-B1 (347-357)
gccgagauccgcgaccagaugcagcagcagcug

SEQ ID NO: 30873 - RNA, 27 nt, Artificial Sequence
  Transcription factor 25 (361-369)
gccgagaucagccagcccccggcccug

SEQ ID NO: 30874 - RNA, 36 nt, Artificial Sequence
  BAG64702.1 (100-111)
gccgagaucaccgacaagcugggccuccacagccug

SEQ ID NO: 30875 - RNA, 30 nt, Artificial Sequence
  Importin subunit alpha-1 (451-460)
gccgagaagcugggcgagaccgagaagcuc

SEQ ID NO: 30876 - RNA, 27 nt, Artificial Sequence
  T-complex protein 1 subunit epsilon (350-358)
gccgagaagcugggcuucgccgggcuc

SEQ ID NO: 30877 - RNA, 30 nt, Artificial Sequence
  Coiled-coil domain-containing protein 85B (121-130)
gccgagcuggagggccgccaggaggagcuc

SEQ ID NO: 30878 - RNA, 30 nt, Artificial Sequence
  Centrosomal protein of 55 kDa (140-149)
gccgagcuggagagcaagaccaacacccuc

SEQ ID NO: 30879 - RNA, 36 nt, Artificial Sequence
  Tropomodulin-3 (286-297)
gccgagcugaagaucgacaaccagcgccagcagcuc

SEQ ID NO: 30880 - RNA, 27 nt, Artificial Sequence
  COMM domain-containing protein 4 (192-200)
gccgagcugaagcaggcccagacccuc

SEQ ID NO: 30881 - RNA, 27 nt, Artificial Sequence
  trabeculin-alpha (1770-1778)
gccgagcugaagcaggugcagacccuc

SEQ ID NO: 30882 - RNA, 30 nt, Artificial Sequence
  Microtubule-associated protein RP/EB family member 1 (194-203)
gccgagcugaugcagcaggugaacguccuc

SEQ ID NO: 30883 - RNA, 33 nt, Artificial Sequence
  14-3-3 protein theta (34-44)
gccgagcugagcaacgaggagcgcaaccuccug

SEQ ID NO: 30884 - RNA, 33 nt, Artificial Sequence
  Sodium/potassium-transporting ATPase subunit alpha-1 (677-687)
gccgagaacggcuuccugcccauccaccuccug

SEQ ID NO: 30885 - RNA, 33 nt, Artificial Sequence
  Armadillo repeat-containing X-linked protein 3 (271-281)
gccgagaaccccgccaugacccgcgagcugcuc

SEQ ID NO: 30886 - RNA, 27 nt, Artificial Sequence
  Eukaryotic translation initiation factor 4 gamma 1 (1379-1387)
gccgagcagaagguggaguacacccug

SEQ ID NO: 30887 - RNA, 27 nt, Artificial Sequence
  Double-strand-break repair protein rad21 homolog (576-584)
gccgagagcaucucccugcucgagcug

SEQ ID NO: 30888 - RNA, 27 nt, Artificial Sequence
  Uncharacterized protein C6orf226 (67-75)
gccgagagccugcccccgcccacccuc

SEQ ID NO: 30889 - RNA, 33 nt, Artificial Sequence
  Endoplasmin (528-538)
gccgagagcucccccuucguggagcgccugcuc

SEQ ID NO: 30890 - RNA, 27 nt, Artificial Sequence
  Magnesium transporter protein 1 (299-307)
gccgagacccacaucgugcugcucuuc

SEQ ID NO: 30891 - RNA, 27 nt, Artificial Sequence
  DNA-directed RNA polymerase I subunit RPA1 (1590-1598)
gccgaggugcuggaccuccgccggcug

SEQ ID NO: 30892 - RNA, 33 nt, Artificial Sequence
  Syntaxin-binding protein 1 (297-307)
gccgaggugagccaggaggucacccgcucccug

SEQ ID NO: 30893 - RNA, 30 nt, Artificial Sequence
  Cytochrome b-c1 complex subunit 9 (42-51)
gccaucuacgaccacaucaacgagggcgug

SEQ ID NO: 30894 - RNA, 30 nt, Artificial Sequence
  Rab GDP dissociation inhibitor beta (137-146)
gcccgcuacggcaagagccccuaccuguac

SEQ ID NO: 30895 - RNA, 27 nt, Artificial Sequence
  Replication factor C subunit 4 (343-351)
gacgagcaccugcagcucaucagccug

SEQ ID NO: 30896 - RNA, 33 nt, Artificial Sequence
  Small nuclear ribonucleoprotein Sm D2 (22-32)
gaggaguucaacaccggcccccugagcgugcuc

SEQ ID NO: 30897 - RNA, 27 nt, Artificial Sequence
  Transmembrane emp24 domain-containing protein 10 (136-144)
gaggagaucgccaagguggagaagcug

SEQ ID NO: 30898 - RNA, 27 nt, Artificial Sequence
  Protein RRP5 homolog (820-828)
gaggagcugcagggcgugcgcagccuc

SEQ ID NO: 30899 - RNA, 33 nt, Artificial Sequence
  T-complex protein 1 subunit delta (363-373)
gaggaggugaaccugaacggcagcgggaagcuc

SEQ ID NO: 30900 - RNA, 27 nt, Artificial Sequence
  Nucleophosmin (92-100)
uucgagaucacccccccggugguccug

SEQ ID NO: 30901 - RNA, 27 nt, Artificial Sequence
  Actin, cytoplasmic 1 (223-231)
uucgagcaggagauggccaccgccgcg

SEQ ID NO: 30902 - RNA, 27 nt, Artificial Sequence
  Serine/arginine repetitive matrix protein 2 (873-881)
uucgagagcucccccgacccggagcug

SEQ ID NO: 30903 - RNA, 30 nt, Artificial Sequence
  Mitochondrial Rho GTPase 2 (11-20)
ggcgaggcccagguggggaagaccagccug

SEQ ID NO: 30904 - RNA, 36 nt, Artificial Sequence
  Heterogeneous nuclear ribonucleoprotein C-like 1 (69-80)
ggcgaggacgggcgcaugaucgccggccaggugcug

SEQ ID NO: 30905 - RNA, 30 nt, Artificial Sequence
  Cytoplasmic dynein 1 heavy chain 1 (1073-1082)
ggcgaggaccugaacaaguggcaggcccuc

SEQ ID NO: 30906 - RNA, 30 nt, Artificial Sequence
  HDAC2 protein (482-491)
ggcgaggaccccgacaagcgcaucagcauc

SEQ ID NO: 30907 - RNA, 27 nt, Artificial Sequence
  Histone-binding protein RBBP7 (146-154)
ggcgaguucgggggcuucgggagcgug

SEQ ID NO: 30908 - RNA, 33 nt, Artificial Sequence
  PC4 and SFRS1-interacting protein (251-261)
ggcgagggggacagcgugaucacccagguccug

SEQ ID NO: 30909 - RNA, 27 nt, Artificial Sequence
  Nardilysin-arginine dibasic convertase), isoform CRA_d (823-831)
ggcgagcacgggcugaucauccgcgug

SEQ ID NO: 30910 - RNA, 33 nt, Artificial Sequence
  Elongation factor 2 (42-52)
ggcgagcacaucaucgccggggccggcgagcug

SEQ ID NO: 30911 - RNA, 27 nt, Artificial Sequence
  Ragulator complex protein LAMTOR4 (44-52)
ggcgagcacacccugcucgugaccguc

SEQ ID NO: 30912 - RNA, 33 nt, Artificial Sequence
  26S protease regulatory subunit 10B (338-348)
ggcgagaucgacuacgaggccaucgugaagcug

SEQ ID NO: 30913 - RNA, 33 nt, Artificial Sequence
  Golgin subfamily B member 1 (2640-2650)
ggcgagaucgaggacaagcugaagaaggagcuc

SEQ ID NO: 30914 - RNA, 33 nt, Artificial Sequence
  Coatomer subunit beta' (518-528)
ggcgagauccaggagaucgugaagaccgggcug

SEQ ID NO: 30915 - RNA, 27 nt, Artificial Sequence
  Prolyl 4-hydroxylase subunit alpha-1 (197-205)
ggcgagaucagcaccaucgacaaggug

SEQ ID NO: 30916 - RNA, 27 nt, Artificial Sequence
  Filamin-A (1802-1810)
ggcgagaucaccggggaggugcgcaug

SEQ ID NO: 30917 - RNA, 27 nt, Artificial Sequence
  Coatomer subunit beta' (549-557)
ggcgagaucgugaccaucgcccaccug

SEQ ID NO: 30918 - RNA, 30 nt, Artificial Sequence
  Proliferating cell nuclear antigen (173-182)
ggcgagcuggggaacggcaacaucaagcuc

SEQ ID NO: 30919 - RNA, 27 nt, Artificial Sequence
  E3 SUMO-protein ligase PIAS3 (130-138)
ggcgagcugauccgccccaccacccuc

SEQ ID NO: 30920 - RNA, 27 nt, Artificial Sequence
  Prohibitin (137-145)
ggcgagcugaucacccagcgcgagcuc

SEQ ID NO: 30921 - RNA, 30 nt, Artificial Sequence
  40S ribosomal protein S21 (63-72)
ggcgagagcgacgacuccauccugcgccuc

SEQ ID NO: 30922 - RNA, 33 nt, Artificial Sequence
  Ubiquitin carboxyl-terminal hydrolase 22 (352-362)
ggcgagagccacguguccgggaccaccacgcug

SEQ ID NO: 30923 - RNA, 33 nt, Artificial Sequence
  Maspardin (165-175)
ggccagagcgagcuggccucccgccucacccug

SEQ ID NO: 30924 - RNA, 30 nt, Artificial Sequence
  RNA-binding protein EWS (382-391)
cacgaggcccagcacggcgugaccagccug

SEQ ID NO: 30925 - RNA, 27 nt, Artificial Sequence
  Kinesin-associated protein 3 (357-365)
cacgaggaccugcucaacaucacccug

SEQ ID NO: 30926 - RNA, 27 nt, Artificial Sequence
  Chromodomain-helicase-DNA-binding protein 6 (1642-1650)
cacgaggaccccggccaggccacccug

SEQ ID NO: 30927 - RNA, 27 nt, Artificial Sequence
  V-type proton ATPase subunit D (113-121)
cacgagggcaccgacagcuacgagcug

SEQ ID NO: 30928 - RNA, 30 nt, Artificial Sequence
  Taperin (362-371)
cacgagaucgaggugaucggcggguaccug

SEQ ID NO: 30929 - RNA, 27 nt, Artificial Sequence
  Transcription elongation factor SPT6 (746-754)
cacgagcuggaccagggccagcagcuc

SEQ ID NO: 30930 - RNA, 33 nt, Artificial Sequence
  Coronin-1C (313-323)
cacgagauggacaccagcaacggcgugcugcuc

SEQ ID NO: 30931 - RNA, 27 nt, Artificial Sequence
  Importin subunit alpha-4 (468-476)
cacgagaacgaggacaucuacaagcug

SEQ ID NO: 30932 - RNA, 30 nt, Artificial Sequence
  Pre-mRNA-processing factor 19 (305-314)
cacgagagcgccgugaccggccugucccuc

SEQ ID NO: 30933 - RNA, 27 nt, Artificial Sequence
  Single-stranded DNA-binding protein, mitochondrial (16-24)
cacgagagcgagaccaccacgucccug

SEQ ID NO: 30934 - RNA, 27 nt, Artificial Sequence
  Vacuolar protein sorting-associated protein 33A (58-66)
cacgagguggagaagauguucacccug

SEQ ID NO: 30935 - RNA, 27 nt, Artificial Sequence
  STAGA complex 65 subunit gamma (219-227)
cacgaggugggcaucgggagcguccug

SEQ ID NO: 30936 - RNA, 27 nt, Artificial Sequence
  DNA replication licensing factor MCM4 (588-596)
cacgaggugauggagcagcagacccug

SEQ ID NO: 30937 - RNA, 27 nt, Artificial Sequence
  F-box only protein 38 (323-331)
cacgaggugcgcauccagcccagccug

SEQ ID NO: 30938 - RNA, 30 nt, Artificial Sequence
  3-hydroxy-3-methylglutaryl-coenzyme A reductase (619-628)
cacgaguacuuccccgagaugcagauccug

SEQ ID NO: 30939 - RNA, 27 nt, Artificial Sequence
  Protein C-ets-1 (189-197)
caccccaucagcuccgaggagcugcuc

SEQ ID NO: 30940 - RNA, 33 nt, Artificial Sequence
  DNA repair endonuclease XPF (748-758)
aucgaguucgaccccagcaagccguucucccug

SEQ ID NO: 30941 - RNA, 27 nt, Artificial Sequence
  Proliferating cell nuclear antigen (197-205)
aucgagaugaacgagcccgugcagcug

SEQ ID NO: 30942 - RNA, 30 nt, Artificial Sequence
  Nuclear poreoprotein p62 (366-375)
aucgagaacggcgagaagaucaccagccug

SEQ ID NO: 30943 - RNA, 30 nt, Artificial Sequence
  Melanoma-associated antigen F1 (112-121)
auccuguuccccgacaucaucgcccgcgcc

SEQ ID NO: 30944 - RNA, 30 nt, Artificial Sequence
  Clathrin light chain A (227-236)
aucagccugaagcaggccccccucgugcac

SEQ ID NO: 30945 - RNA, 27 nt, Artificial Sequence
  NAD(P)H dehydrogenase (quinone) 1 (143-151)
aucugggacgagaccccccuguacuuc

SEQ ID NO: 30946 - RNA, 24 nt, Artificial Sequence
  Guanine nucleotide-binding protein subunit beta-2-like 1 (106-113)
aaggacgugcugagcgucgccuuc

SEQ ID NO: 30947 - RNA, 33 nt, Artificial Sequence
  T-complex protein 1 subunit theta (367-377)
aaggaggacggcgccaucagcaccaucgugcug

SEQ ID NO: 30948 - RNA, 27 nt, Artificial Sequence
  Ubiquitin carboxyl-terminal hydrolase 48 (790-798)
aaggaggacagcaagcugaucgcccuc

SEQ ID NO: 30949 - RNA, 27 nt, Artificial Sequence
  Myosin-9 (1084-1092)
aaggaggaggagcugcaggccgcccuc

SEQ ID NO: 30950 - RNA, 30 nt, Artificial Sequence
  Plasminogen activator inhibitor 1 RNA-binding protein (8-17)
aaggaggagacccagcccccgguggcccug

SEQ ID NO: 30951 - RNA, 30 nt, Artificial Sequence
  Chitinase domain-containing protein 1 (269-278)
aaggaguucgagcagcuggcccccgugcuc

SEQ ID NO: 30952 - RNA, 30 nt, Artificial Sequence
  ATP-dependent RNA helicase DDX24 (116-125)
aaggaguucgaggugaaggaccccgagcug

SEQ ID NO: 30953 - RNA, 33 nt, Artificial Sequence
  E3 ubiquitin-protein ligase listerin (1308-1318)
aaggaguucuucagccagggcauccacucccug

SEQ ID NO: 30954 - RNA, 30 nt, Artificial Sequence
  Inhibitor of growth protein 4 (52-61)
aaggaguucggcgacgacaaggugcagcug

SEQ ID NO: 30955 - RNA, 30 nt, Artificial Sequence
  Eukaryotic translation initiation factor 4 gamma 1 (1365-1374)
aaggaguuccugcccgagggccaggacauc

SEQ ID NO: 30956 - RNA, 33 nt, Artificial Sequence
  Serine-tRNA ligase, cytoplasmic (457-467)
aaggaguucaugcccccgggccugcaggagcuc

SEQ ID NO: 30957 - RNA, 36 nt, Artificial Sequence
  Heterogeneous nuclear ribonucleoprotein Q (66-77)
aaggaguucaacgaggacggcgcccuggccgugcuc

SEQ ID NO: 30958 - RNA, 27 nt, Artificial Sequence
  Protein zer-1 homolog (579-587)
aaggaguuccccgagaagcaggagcug

SEQ ID NO: 30959 - RNA, 27 nt, Artificial Sequence
  Regulator of G-protein signaling 10 (61-69)
aaggaguucagcgaggagaacgugcug

SEQ ID NO: 30960 - RNA, 36 nt, Artificial Sequence
  Apolipoprotein L2 (196-207)
aaggaguucgugggcgggaacacccccaacguccug

SEQ ID NO: 30961 - RNA, 27 nt, Artificial Sequence
  Cyclin-dependent kinase 9 (56-64)
aaggagggcuuccccaucaccgcccug

SEQ ID NO: 30962 - RNA, 33 nt, Artificial Sequence
  Vacuolar protein sorting-associated protein 33A (56-66)
aaggagcacgagguggagaagauguucacccug

SEQ ID NO: 30963 - RNA, 36 nt, Artificial Sequence
  Serine/Arginine-related protein 53 (223-234)
aaggagaucgaccccaccagcaucccgaccgccauc

SEQ ID NO: 30964 - RNA, 27 nt, Artificial Sequence
  Ran GTPase-activating protein 1 (43-51)
aaggagaucgaggacuucgacagccug

SEQ ID NO: 30965 - RNA, 30 nt, Artificial Sequence
  RNA cytidine acetyltransferase (729-738)
aaggagaucgagcugcccagcggccagcuc

SEQ ID NO: 30966 - RNA, 27 nt, Artificial Sequence
  Transcription initiation factor IIB (272-280)
aaggagaucggcgacaucgccggggug

SEQ ID NO: 30967 - RNA, 27 nt, Artificial Sequence
  Ras suppressor protein 1 (177-185)
aaggagaucggcgagcugacccagcuc

SEQ ID NO: 30968 - RNA, 30 nt, Artificial Sequence
  V-type proton ATPase 116 kDa subunit a isoform 1 (109-118)
aaggagaucaacaccaaccaggaggcccug

SEQ ID NO: 30969 - RNA, 27 nt, Artificial Sequence
  Scavenger receptor class B member 1 (57-65)
aaggagauccccaucccguucuaccug

SEQ ID NO: 30970 - RNA, 30 nt, Artificial Sequence
  Centromere protein F (1675-1684)
aaggagauccaggagcuggagcagcuccug

SEQ ID NO: 30971 - RNA, 30 nt, Artificial Sequence
  Spatacsin (1706-1715)
aaggagaucacccaggagaugcagacccug

SEQ ID NO: 30972 - RNA, 36 nt, Artificial Sequence
  Importin-11 (778-789)
aaggagaucaccaccgagggccaggugcagguccug

SEQ ID NO: 30973 - RNA, 30 nt, Artificial Sequence
  Eukaryotic translation initiation factor 3 subunit E (29-38)
aaggagaucuacaacgagaaggagcugcuc

SEQ ID NO: 30974 - RNA, 30 nt, Artificial Sequence
  Double-stranded RNA-binding protein Staufen homolog 2 (288-297)
aaggagaaggagcccgacuacgugcugcuc

SEQ ID NO: 30975 - RNA, 30 nt, Artificial Sequence
  Double-stranded RNA-binding protein Staufen homolog 1 (258-267)
aaggagaaggagcccgaguacacccugcuc

SEQ ID NO: 30976 - RNA, 27 nt, Artificial Sequence
  Protein transport protein Sec16A (1490-1498)
aaggagaagcccgaggaggagagccug

SEQ ID NO: 30977 - RNA, 30 nt, Artificial Sequence
  Heat shock protein HSP 90-alpha A2 (280-289)
aaggagaaguacaucgaccaggaggagcug

SEQ ID NO: 30978 - RNA, 30 nt, Artificial Sequence
  Alpha-2-macroglobulin receptor-associated protein (272-281)
aaggagcuggaggccuuccgcgaggagcuc

SEQ ID NO: 30979 - RNA, 30 nt, Artificial Sequence
  Ribosome-binding protein 1 (235-244)
aaggagcuggagagccagguguccggccuc

SEQ ID NO: 30980 - RNA, 33 nt, Artificial Sequence
  Probable ATP-dependent RNA helicase DDX56 (208-218)
aaggagcugauccuccacaaccccgugacccug

SEQ ID NO: 30981 - RNA, 30 nt, Artificial Sequence
  CDK5 regulatory subunit-associated protein 2 (665-674)
aaggagcuguacaccgacaaccagcaccuc

SEQ ID NO: 30982 - RNA, 27 nt, Artificial Sequence
  Aurora kinase B (57-65)
aaggagcccgugaccccgagcgcccug

SEQ ID NO: 30983 - RNA, 27 nt, Artificial Sequence
  CDK5 regulatory subunit-associated protein 2 (559-567)
aaggagcaggacaucuacacccaccug

SEQ ID NO: 30984 - RNA, 27 nt, Artificial Sequence
  Plectin (2047-2055)
aaggagcaggagcugcagcagacccuc

SEQ ID NO: 30985 - RNA, 30 nt, Artificial Sequence
  Nucleoprotein TPR (995-1004)
aaggagagcgccgaguuccagacccagcug

SEQ ID NO: 30986 - RNA, 30 nt, Artificial Sequence
  Antizyme inhibitor 1 (203-212)
aaggagagccagguguacguccacgcccug

SEQ ID NO: 30987 - RNA, 27 nt, Artificial Sequence
  Gamma-interferon-inducible protein 16 (299-307)
aaggagacccugaagaucgacauccuc

SEQ ID NO: 30988 - RNA, 27 nt, Artificial Sequence
  Periodic tryptophan protein 1 homolog (19-27)
aaggagacccccgacaagguggagcug

SEQ ID NO: 30989 - RNA, 39 nt, Artificial Sequence
  Sequestosome-1 (324-336)
aaggagguggaccccagcaccggcgagcugcagucccuc

SEQ ID NO: 30990 - RNA, 27 nt, Artificial Sequence
  DNA replication licensing factor MCM6 (332-340)
aaggagugggagaagguguucgagaug

SEQ ID NO: 30991 - RNA, 33 nt, Artificial Sequence
  Lupus La protein (75-85)
aaggaguggcuggaggacaagggccaggugcuc

SEQ ID NO: 30992 - RNA, 27 nt, Artificial Sequence
  40S ribosomal protein S2 (58-66)
aaggaguggaugcccgugaccaagcug

SEQ ID NO: 30993 - RNA, 27 nt, Artificial Sequence
  DNA-directed RNA polymerases I, II, and III subunit RPABC4 (50-58)
aagcgccugguggucuucgacgcccgg

SEQ ID NO: 30994 - RNA, 33 nt, Artificial Sequence
  Dual specificity protein kinase CLK3 (601-611)
cuggaguucgaccccgcccagcgcaucacccuc

SEQ ID NO: 30995 - RNA, 27 nt, Artificial Sequence
  Microtubule-associated protein RP/EB family member 2 (98-106)
cuggagcacgaguacauccacaacuuc

SEQ ID NO: 30996 - RNA, 27 nt, Artificial Sequence
  Mitochondrial import inner membrane translocase subunit TIM50 (324-332)
cuggagcaggaggagcagcagcgccuc

SEQ ID NO: 30997 - RNA, 30 nt, Artificial Sequence
  Cyclin-dependent kinase 7 (5-14)
cuggaggugaucaucaaggacaacagccuc

SEQ ID NO: 30998 - RNA, 33 nt, Artificial Sequence
  POTE ankyrin domain family member F (794-804)
cugcgcguggcccccgaggagcacccgguccuc

SEQ ID NO: 30999 - RNA, 30 nt, Artificial Sequence
  Eukaryotic translation initiation factor 4 gamma 1 (1290-1299)
auggagaucgacaucccccacguguggcug

SEQ ID NO: 31000 - RNA, 27 nt, Artificial Sequence
  MICOS complex subunit MIC60 (474-482)
auggagaacgagaugcgcacccagcug

SEQ ID NO: 31001 - RNA, 30 nt, Artificial Sequence
  Interleukin enhancer-binding factor 3 (561-570)
auggagguggaggucgacggccagaaguuc

SEQ ID NO: 31002 - RNA, 27 nt, Artificial Sequence
  Pre-mRNA-processing-splicing factor 8 (1868-1876)
augcuggacccccucgaggugcaccug

SEQ ID NO: 31003 - RNA, 27 nt, Artificial Sequence
  Elongation factor 2 (673-681)
aacgagaucaaggacagcguggucgcc

SEQ ID NO: 31004 - RNA, 24 nt, Artificial Sequence
  Heterogeneous nuclear ribonucleoprotein K (38-45)
aacaccgacgagaugguggagcug

SEQ ID NO: 31005 - RNA, 30 nt, Artificial Sequence
  Poly(U)-binding-splicing factor PUF60 (318-327)
caggaggccguggccggcgcggccguccug

SEQ ID NO: 31006 - RNA, 33 nt, Artificial Sequence
  Tyrosine-protein kinase BAZ1B (891-901)
caggaguuccugaccgacaugaagcagguguuc

SEQ ID NO: 31007 - RNA, 27 nt, Artificial Sequence
  Pumilio homolog 3 (495-503)
caggagcacgcccaggaggugguccug

SEQ ID NO: 31008 - RNA, 27 nt, Artificial Sequence
  Nuclear pore complex protein Nup205 (13-21)
caggagauccccgagccgcugcagcuc

SEQ ID NO: 31009 - RNA, 27 nt, Artificial Sequence
  Fc receptor-like A (166-174)
caggagcuguuccccgccccgauccuc

SEQ ID NO: 31010 - RNA, 33 nt, Artificial Sequence
  40S ribosomal protein S9 (27-37)
caggagcugaagcucaucggcgaguacgggcug

SEQ ID NO: 31011 - RNA, 36 nt, Artificial Sequence
  Heterogeneous nuclear ribonucleoprotein H (438-449)
caggagaacagcuccgacuuccagagcaacaucgcc

SEQ ID NO: 31012 - RNA, 33 nt, Artificial Sequence
  T-complex protein 1 subunit theta (95-105)
caggaggugggcgacgggaccaacuucguccug

SEQ ID NO: 31013 - RNA, 24 nt, Artificial Sequence
  Coatomer subunit epsilon (97-104)
cgcgacagcaucguggccgagcug

SEQ ID NO: 31014 - RNA, 30 nt, Artificial Sequence
  Ribosome-binding protein 1 (360-369)
cgcgaggccgaggagacccagagcacccug

SEQ ID NO: 31015 - RNA, 33 nt, Artificial Sequence
  Nodal modulator 2 (274-284)
cgcgaggacggcagcuucuccuucuacagccug

SEQ ID NO: 31016 - RNA, 27 nt, Artificial Sequence
  Guanine nucleotide-binding protein G(s) subunit alpha isoforms short (244-252)
cgcgaggacaaccagaccaaccggcug

SEQ ID NO: 31017 - RNA, 27 nt, Artificial Sequence
  Nucleolar complex protein 2 homolog (609-617)
cgcgaggagggcaccccccugacccuc

SEQ ID NO: 31018 - RNA, 27 nt, Artificial Sequence
  DNA topoisomerase 1 (708-716)
cgcgaggagaacaagcagaucgcccug

SEQ ID NO: 31019 - RNA, 27 nt, Artificial Sequence
  Eukaryotic initiation factor 4A-II (256-264)
cgcgaggaguggaagcuggacacccuc

SEQ ID NO: 31020 - RNA, 30 nt, Artificial Sequence
  Spermine synthase (251-260)
cgcgaguucgacuacgugaucaacgaccug

SEQ ID NO: 31021 - RNA, 30 nt, Artificial Sequence
  DNA mismatch repair protein Msh6 (1321-1330)
cgcgaguucgagaagaugaaccagagccug

SEQ ID NO: 31022 - RNA, 36 nt, Artificial Sequence
  Heterogeneous nuclear ribonucleoprotein R (69-80)
cgcgaguucaacgaggagggcgcccugagcgugcuc

SEQ ID NO: 31023 - RNA, 27 nt, Artificial Sequence
  Inner centromere protein (47-55)
cgcgaguucagcaaggagcccgagcug

SEQ ID NO: 31024 - RNA, 27 nt, Artificial Sequence
  Eukaryotic translation initiation factor 3 subunit I (20-28)
cgcgagggcgaccugcucuucaccgug

SEQ ID NO: 31025 - RNA, 27 nt, Artificial Sequence
  ZW10 interactor (104-112)
cgcgagcacguggaggccaucaagauc

SEQ ID NO: 31026 - RNA, 33 nt, Artificial Sequence
  ZW10 interactor (104-114)
cgcgagcacguggaggccaucaagaucggccug

SEQ ID NO: 31027 - RNA, 33 nt, Artificial Sequence
  Histone H3.3 (73-83)
cgcgagaucgcccaggacuucaagaccgaccug

SEQ ID NO: 31028 - RNA, 33 nt, Artificial Sequence
  Serine/threonine-protein phosphatase PP1-alpha catalytic subunit (21-31)
cgcgagaucuuccugagccagcccauccuccug

SEQ ID NO: 31029 - RNA, 30 nt, Artificial Sequence
  Structural maintenance of chromosomes flexible hinge domain-containing protein 1 (393-402)
cgcgagauccaggacgacaugcagacccug

SEQ ID NO: 31030 - RNA, 27 nt, Artificial Sequence
  DNA-dependent protein kinase catalytic subunit (2753-2761)
cgcgagaaggagaucaagagcgagcug

SEQ ID NO: 31031 - RNA, 27 nt, Artificial Sequence
  Actin-related protein 2 (125-133)
cgcgagaagaucguggaggucauguuc

SEQ ID NO: 31032 - RNA, 27 nt, Artificial Sequence
  Aurora kinase A (151-159)
cgcgagaagcagagcaaguucauccug

SEQ ID NO: 31033 - RNA, 30 nt, Artificial Sequence
  Myosin-9 (1110-1119)
cgcgagcuggagagccagaucuccgagcuc

SEQ ID NO: 31034 - RNA, 30 nt, Artificial Sequence
  TRAF3-interacting JNK-activating modulator (73-82)
cgcgagcuggagagccagcuccacgugcug

SEQ ID NO: 31035 - RNA, 33 nt, Artificial Sequence
  NADH dehydrogenase (ubiquinone) 1 alpha subcomplex subunit 13 (79-89)
cgcgagaaccuggaggaggaggccaucaucaug

SEQ ID NO: 31036 - RNA, 36 nt, Artificial Sequence
  T-complex protein 1 subunit delta (160-171)
cgcgagacccugcucaacagcgccaccacgucccug

SEQ ID NO: 31037 - RNA, 33 nt, Artificial Sequence
  Elongation factor 2 (80-90)
cgcgagaccgugagcgaggaguccaacguccug

SEQ ID NO: 31038 - RNA, 30 nt, Artificial Sequence
  Epsilon-sarcoglycan (213-222)
cgcgagguggagaacccccagaaccagcug

SEQ ID NO: 31039 - RNA, 27 nt, Artificial Sequence
  Protein disulfide-isomerase A6 (18-26)
cgcgaggugauccagagcgacucccug

SEQ ID NO: 31040 - RNA, 30 nt, Artificial Sequence
  Proteasome subunit beta type-4 (165-174)
cgcgaggugcuggagaagcagcccguccuc

SEQ ID NO: 31041 - RNA, 27 nt, Artificial Sequence
  SWI/SNF complex subunit SMARCC2 (599-607)
cgcgaguggaccgagcaggagacccug

SEQ ID NO: 31042 - RNA, 30 nt, Artificial Sequence
  Transcription factor E2F7 (615-624)
cgcgaguacgaggacggcccccugagccuc

SEQ ID NO: 31043 - RNA, 33 nt, Artificial Sequence
  GDP-L-fucose synthase (38-48)
cgcgaguacaacgagguggagcccaucauccug

SEQ ID NO: 31044 - RNA, 33 nt, Artificial Sequence
  Vimentin (381-391)
cgcgaguaccaggaccugcucaacgugaagaug

SEQ ID NO: 31045 - RNA, 27 nt, Artificial Sequence
  Metastasis-associated protein MTA2 (188-196)
cgccagaucgaccaguuccuggugguc

SEQ ID NO: 31046 - RNA, 27 nt, Artificial Sequence
  Runt-related transcription factor 3 (264-272)
cgcagcuuccccacccugccgacccuc

SEQ ID NO: 31047 - RNA, 33 nt, Artificial Sequence
  HLA class I histocompatibility antigen, B-15 alpha chain (352-362)
agcgcccagggcuccgacgugagccugaccgcc

SEQ ID NO: 31048 - RNA, 27 nt, Artificial Sequence
  Asparagine synthetase (glutamine-hydrolyzing) (159-167)
agcgaggccaagggccuggugacccuc

SEQ ID NO: 31049 - RNA, 27 nt, Artificial Sequence
  Chromodomain-helicase-DNA-binding protein 4 (1833-1841)
agcgaggaccccucccacccgagcaug

SEQ ID NO: 31050 - RNA, 27 nt, Artificial Sequence
  SRA stem-loop-interacting RNA-binding protein, mitochondrial (69-77)
agcgaggagggccugcgcaacgcccuc

SEQ ID NO: 31051 - RNA, 30 nt, Artificial Sequence
  Poly (ADP-ribose) polymerase 9 (292-301)
agcgaguucauccugggcaaguccgagcuc

SEQ ID NO: 31052 - RNA, 30 nt, Artificial Sequence
  Cold shock domain-containing protein E1 (183-192)
agcgaguucaagggcgaccuggagacccuc

SEQ ID NO: 31053 - RNA, 30 nt, Artificial Sequence
  Cold shock domain-containing protein E1 (519-528)
agcgaguucuccggcgacguggacagccug

SEQ ID NO: 31054 - RNA, 27 nt, Artificial Sequence
  Zinc finger protein 451 (35-43)
agcgagggcccccugcgcccggugcuc

SEQ ID NO: 31055 - RNA, 27 nt, Artificial Sequence
  Protein SON (1526-1534)
agcgagcacggcaucaacaucgaccug

SEQ ID NO: 31056 - RNA, 33 nt, Artificial Sequence
  Spectrin beta chain, non-erythrocytic 1 (1024-1034)
agcgagcaccccgaccaggcccaggccauccug

SEQ ID NO: 31057 - RNA, 36 nt, Artificial Sequence
  Copper transport protein ATOX1 (44-55)
agcgagcacuccauggacacccugcucgccacccug

SEQ ID NO: 31058 - RNA, 27 nt, Artificial Sequence
  Coatomer subunit zeta-1 (34-42)
agcgagaucgcccugcucgagggccug

SEQ ID NO: 31059 - RNA, 30 nt, Artificial Sequence
  Cyclin-dependent kinase 1 (208-217)
agcgagaucgaccagcuguuccgcaucuuc

SEQ ID NO: 31060 - RNA, 27 nt, Artificial Sequence
  Rho guanine nucleotide exchange factor 18 (689-697)
agcgagaucgagggcauccagucccug

SEQ ID NO: 31061 - RNA, 30 nt, Artificial Sequence
  Neuroblast differentiation-associated protein AHNAK (845-854)
agcgagaucaaggugcccgacgucgagcug

SEQ ID NO: 31062 - RNA, 30 nt, Artificial Sequence
  Eukaryotic translation initiation factor 4B (442-451)
agcgagaagucccuggagaacgagacccuc

SEQ ID NO: 31063 - RNA, 27 nt, Artificial Sequence
  116 kDa U5 small nuclear ribonucleoprotein component (91-99)
agcgagcugauccgcaacgugacccuc

SEQ ID NO: 31064 - RNA, 33 nt, Artificial Sequence
  E3 ubiquitin-protein ligase UBR5 (466-476)
agcgagcugcagggcgagcgcaucgugucccuc

SEQ ID NO: 31065 - RNA, 27 nt, Artificial Sequence
  Death-associated protein kinase 3 (429-437)
agcgagaugcgcuucgugcaggaccug

SEQ ID NO: 31066 - RNA, 27 nt, Artificial Sequence
  Leucine-rich repeat-containing protein 47 (315-323)
agcgagaaccccgugccgcugaccguc

SEQ ID NO: 31067 - RNA, 27 nt, Artificial Sequence
  Protein SON (197-205)
agcgagccccacauccuggagacccuc

SEQ ID NO: 31068 - RNA, 27 nt, Artificial Sequence
  Programmed cell death protein 5 (88-96)
agcgagcagggccugaucgagauccuc

SEQ ID NO: 31069 - RNA, 27 nt, Artificial Sequence
  DNA replication licensing factor MCM4 (142-150)
agcgagcagucccugggccagaagcuc

SEQ ID NO: 31070 - RNA, 27 nt, Artificial Sequence
  Guanylate-binding protein 1 (360-368)
agcgagcgcgaggccaucgagguguuc

SEQ ID NO: 31071 - RNA, 27 nt, Artificial Sequence
  Signal peptidase complex catalytic subunit SEC11C (57-65)
agcgagucccccaucguggucgugcug

SEQ ID NO: 31072 - RNA, 27 nt, Artificial Sequence
  Actin-related protein 2/3 complex subunit 1B (242-250)
agcgagacccugccccuccuggcccug

SEQ ID NO: 31073 - RNA, 36 nt, Artificial Sequence
  Annexin A2 (296-307)
agcgagguggacaugcugaagauccgcuccgaguuc

SEQ ID NO: 31074 - RNA, 27 nt, Artificial Sequence
  Proteasome maturation protein (124-132)
agcgaggugaugggcgagccccaccug

SEQ ID NO: 31075 - RNA, 27 nt, Artificial Sequence
  AP-1 complex subunit beta-1 (347-355)
agccaggccaacaucgcccaggugcug

SEQ ID NO: 31076 - RNA, 27 nt, Artificial Sequence
  Rab GTPase-activating protein 1-like (162-170)
agccaguaccccuucccggugacccug

SEQ ID NO: 31077 - RNA, 33 nt, Artificial Sequence
  Probable ATP-dependent RNA helicase DDX41 (118-128)
agcguggccgagggccgcgcccugauguccguc

SEQ ID NO: 31078 - RNA, 27 nt, Artificial Sequence
  General vesicular transport factor p115 (18-26)
accgaggccgagaccauccagaagcug

SEQ ID NO: 31079 - RNA, 27 nt, Artificial Sequence
  SH2 domain-containing protein 3C (769-777)
accgagcacggcguggaggucgugcug

SEQ ID NO: 31080 - RNA, 30 nt, Artificial Sequence
  Nucleolin (452-461)
accgagaucgacggccgcagcaucucccug

SEQ ID NO: 31081 - RNA, 27 nt, Artificial Sequence
  Adenosylhomocysteinase (244-252)
accgagaucgaccccaucaacgcccug

SEQ ID NO: 31082 - RNA, 30 nt, Artificial Sequence
  Polyadenylate-binding protein-interacting protein 1 (66-75)
accgagaucgagcaguucgccgagacccug

SEQ ID NO: 31083 - RNA, 27 nt, Artificial Sequence
  Suppressor of SWI4 1 homolog (72-80)
accgagaucggcccccgcaugacccug

SEQ ID NO: 31084 - RNA, 33 nt, Artificial Sequence
  Microtubule-associated protein 4 (428-438)
accgagaucagcuccgccgagaagguggcccug

SEQ ID NO: 31085 - RNA, 24 nt, Artificial Sequence
  Histone H3.1 (59-66)
accgagcugcucauccgcaagcug

SEQ ID NO: 31086 - RNA, 30 nt, Artificial Sequence
  Chromodomain-helicase-DNA-binding protein 4 (1265-1274)
accgagcugcagggcaugaacgaguaccuc

SEQ ID NO: 31087 - RNA, 33 nt, Artificial Sequence
  Transcription factor BTF3 (106-116)
accgagaugcugcccagcauccucaaccagcug

SEQ ID NO: 31088 - RNA, 27 nt, Artificial Sequence
  Probable ATP-dependent RNA helicase DDX6 (6-14)
accgagaaccccgugaucaugggccug

SEQ ID NO: 31089 - RNA, 27 nt, Artificial Sequence
  Poly(rC)-binding protein 1 (6-14)
accgagagcggccugaacgugacccuc

SEQ ID NO: 31090 - RNA, 27 nt, Artificial Sequence
  Steroid hormone receptor ERR1 (88-96)
accgagaccgagcccccgguggcccug

SEQ ID NO: 31091 - RNA, 24 nt, Artificial Sequence
  Elongation factor 1-alpha 1 (287-294)
accgaggugaagagcgucgagaug

SEQ ID NO: 31092 - RNA, 27 nt, Artificial Sequence
  Pinin (538-546)
accgaggugcccgucgagccggugcug

SEQ ID NO: 31093 - RNA, 27 nt, Artificial Sequence
  Cytoskeleton-associated protein 4 (55-63)
accgaggugcgcgagcuggucagccuc

SEQ ID NO: 31094 - RNA, 27 nt, Artificial Sequence
  Asparagine synthetase (glutamine-hydrolyzing) (269-277)
acccugcucaagcagcugaaggaggcc

SEQ ID NO: 31095 - RNA, 33 nt, Artificial Sequence
  Integrin beta-7 (702-712)
guggaggacgacgcccgcggcaccgucgugcug

SEQ ID NO: 31096 - RNA, 30 nt, Artificial Sequence
  Eukaryotic translation initiation factor 3 subunit A (253-262)
guggaggacauccacggccuguucagccuc

SEQ ID NO: 31097 - RNA, 33 nt, Artificial Sequence
  Serine/threonine-protein phosphatase 2A 65 kDa regulatory subunit A alpha isoform (436-446)
guggaguucuucgacgagaagcugaacagccuc

SEQ ID NO: 31098 - RNA, 27 nt, Artificial Sequence
  F-box only protein 7 (135-143)
guggagggccaggucccccacagccug

SEQ ID NO: 31099 - RNA, 27 nt, Artificial Sequence
  GPN-loop GTPase 2 (169-177)
guggagcugccccacaucaaccuccug

SEQ ID NO: 31100 - RNA, 27 nt, Artificial Sequence
  Melanoma-associated antigen 12 (279-287)
guggagaccagcuacgucaaggugcug

SEQ ID NO: 31101 - RNA, 27 nt, Artificial Sequence
  Melanoma-associated antigen D2 (37-45)
guggagguccccgagaccccgaaggcc

SEQ ID NO: 31102 - RNA, 27 nt, Artificial Sequence
  Vigilin (656-664)
guggaggucagcauccccgccaagcug

SEQ ID NO: 31103 - RNA, 27 nt, Artificial Sequence
  Basic leucine zipper and W2 domain-containing protein 2 (305-313)
guggaguggaacaagaaggaggagcug

SEQ ID NO: 31104 - RNA, 30 nt, Artificial Sequence
  Stomatin-like protein 3 (151-160)
gugcugggcacccagacccucagccagauc

SEQ ID NO: 31105 - RNA, 27 nt, Artificial Sequence
  Condensin complex subunit 1 (162-170)
ugggaggaggagcgccagcccauccug

SEQ ID NO: 31106 - RNA, 27 nt, Artificial Sequence
  Catenin beta-1 (66-74)
ugggagcagggcuucagccaguccuuc

SEQ ID NO: 31107 - RNA, 27 nt, Artificial Sequence
  Myosin light polypeptide 6 (141-149)
uacgaggagcuggugcgcaugguccuc

SEQ ID NO: 31108 - RNA, 30 nt, Artificial Sequence
  Nucleophosmin (67-76)
uacgagggcagccccaucaaggugacccug

SEQ ID NO: 31109 - RNA, 27 nt, Artificial Sequence
  60S ribosomal protein L6 (240-248)
uacgagaucaccgagcagcgcaagauc

SEQ ID NO: 31110 - RNA, 30 nt, Artificial Sequence
  Septin-11 (95-104)
uacgagcugcaggagagcaacgugcgccuc

SEQ ID NO: 31111 - RNA, 30 nt, Artificial Sequence
  Glutamine-dependent NAD(+) synthetase (58-67)
uacgagagcgacacccugcuccacuccuuc

SEQ ID NO: 31112 - RNA, 36 nt, Artificial Sequence
  Mitogen-activated protein kinase kinase kinase 5 (675-686)
uacgaguacgacgagaacggcgaccgcgugguccug

SEQ ID NO: 31113 - RNA, 27 nt, Artificial Sequence
  60S ribosomal protein L7a (158-166)
gcccacgacguggaccccaucgagcug

SEQ ID NO: 31114 - RNA, 30 nt, Artificial Sequence
  40S ribosomal protein S29 (47-56)
gccaaggacaucggcuucaucaagcuggac

SEQ ID NO: 31115 - RNA, 24 nt, Artificial Sequence
  Long-chain-fatty-acid-CoA ligase 4 (42-49)
uucgaccacgccgugagcaaguuc

SEQ ID NO: 31116 - RNA, 27 nt, Artificial Sequence
  Eukaryotic translation initiation factor 3 subunit L (478-486)
uuccuggaccucaccgagcaggaguuc

SEQ ID NO: 31117 - RNA, 27 nt, Artificial Sequence
  Ubiquitin-like modifier-activating enzyme 1 (637-645)
uuccccaacgccaucgagcacacccug

SEQ ID NO: 31118 - RNA, 27 nt, Artificial Sequence
  Bcl-2-associated transcription factor 1 (338-346)
uucaccgacgaggagagccgcguguuc

SEQ ID NO: 31119 - RNA, 30 nt, Artificial Sequence
  Bcl-2-associated transcription factor 1 (338-347)
uucaccgacgaggagagccgcguguuccug

SEQ ID NO: 31120 - RNA, 27 nt, Artificial Sequence
  Disco-interacting protein 2 homolog B (444-452)
uucuacgacgagcgcaucguggucgug

SEQ ID NO: 31121 - RNA, 27 nt, Artificial Sequence
  WD repeat-containing protein 46 (188-196)
cacuucgaccugaaccuccgccaguuc

SEQ ID NO: 31122 - RNA, 30 nt, Artificial Sequence
  HLA class I histocompatibility antigen, A-24 alpha chain (216-225)
caccccaucagcgaccacgaggccacccug

SEQ ID NO: 31123 - RNA, 27 nt, Artificial Sequence
  Integrator complex subunit 2 (1006-1014)
aucgccgaccccaacaucgccaagcug

SEQ ID NO: 31124 - RNA, 27 nt, Artificial Sequence
  Heterogeneous nuclear ribonucleoprotein M (188-196)
auccccaacgagaucauccacgcccug

SEQ ID NO: 31125 - RNA, 27 nt, Artificial Sequence
  UPF0428 protein CXorf56 (100-108)
aucguggacggcgccgucgugaaguuc

SEQ ID NO: 31126 - RNA, 27 nt, Artificial Sequence
  Long-chain-fatty-acid-CoA ligase 4 (41-49)
cuguucgaccacgccgugagcaaguuc

SEQ ID NO: 31127 - RNA, 27 nt, Artificial Sequence
  Cleavage stimulation factor subunit 1 (370-378)
cugcccgacgagcgcaccaucagccuc

SEQ ID NO: 31128 - RNA, 30 nt, Artificial Sequence
  Nucleolar transcription factor 1 (365-374)
cugcccgaggaggagcagcagcgcgugcuc

SEQ ID NO: 31129 - RNA, 27 nt, Artificial Sequence
  Microtubule-associated protein 4 (308-316)
cugcccaccgagaaggagguggcccuc

SEQ ID NO: 31130 - RNA, 24 nt, Artificial Sequence
  Fructose-bisphosphate aldolase A (271-278)
cugagcgaccaccacaucuaccuc

SEQ ID NO: 31131 - RNA, 27 nt, Artificial Sequence
  MMS19 nucleotide excision repair protein homolog (636-644)
augcccgagaaggagccgagcgugcug

SEQ ID NO: 31132 - RNA, 27 nt, Artificial Sequence
  AF4/FMR2 family member 4 (1053-1061)
augcccagcccggugucccccaagcug

SEQ ID NO: 31133 - RNA, 27 nt, Artificial Sequence
  Ras-related C3 botulinum toxin substrate 1 (45-53)
augguggacggcaagcccgucaaccug

SEQ ID NO: 31134 - RNA, 27 nt, Artificial Sequence
  Bone morphogenetic protein receptor type-1B (507-515)
aaccccgccagccgccugaccgcccuc

SEQ ID NO: 31135 - RNA, 27 nt, Artificial Sequence
  Multiple epidermal growth factor-like domains protein 8 (2530-2538)
cccgccccgcccccccccccgcccccc

SEQ ID NO: 31136 - RNA, 30 nt, Artificial Sequence
  Keratin, type II cytoskeletal 1 (338-347)
agcauggacaacaaccgcucccuggaccuc

SEQ ID NO: 31137 - RNA, 27 nt, Artificial Sequence
  Nuclear pore complex protein Nup155 (220-228)
agcaccgacaacggccgcaucuuccug

SEQ ID NO: 31138 - RNA, 27 nt, Artificial Sequence
  Coatomer subunit epsilon (111-119)
agcguggacgucaccaacaccacguuc

SEQ ID NO: 31139 - RNA, 27 nt, Artificial Sequence
  Fatty acid synthase (545-553)
accuucgacgacaucgugcacagcuuc

SEQ ID NO: 31140 - RNA, 27 nt, Artificial Sequence
  Tumor suppressor candidate 3 (165-173)
accuucgaccugcagcgcaucggcuuc

SEQ ID NO: 31141 - RNA, 27 nt, Artificial Sequence
  Rho GTPase-activating protein 24 (436-444)
accuacgacaacgugcaccagcaguuc

SEQ ID NO: 31142 - RNA, 27 nt, Artificial Sequence
  ATP-dependent RNA helicase A (697-705)
guguucgaccccgucccggugggcgug

SEQ ID NO: 31143 - RNA, 30 nt, Artificial Sequence
  10 kDa heat shock protein, mitochondrial (81-90)
gugcuggacgacaaggacuacuuccucuuc

SEQ ID NO: 31144 - RNA, 30 nt, Artificial Sequence
  Metastasis-associated protein MTA3 (135-144)
guguacgaccccagccugaagacccuccug

SEQ ID NO: 31145 - RNA, 24 nt, Artificial Sequence
  ADP-ribosylation factor GTPase-activating protein 3 (312-319)
uacuucgacgagcccguggagcug

SEQ ID NO: 31146 - RNA, 27 nt, Artificial Sequence
  Transcription factor HES-1 (155-163)
uaccccggccagccgcaccccgcccug

SEQ ID NO: 31147 - RNA, 27 nt, Artificial Sequence
  Nuclear nucleic acid-binding protein C1D (10-18)
uaccccguggagauccacgaguaccug

SEQ ID NO: 31148 - RNA, 27 nt, Artificial Sequence
  Pecanex-like protein 1 (22-30)
uacuacgacccccaccaggccaccuuc

SEQ ID NO: 31149 - RNA, 27 nt, Artificial Sequence
  ATP-binding cassette sub-family F member 3 (500-508)
uacuacgaccccaagcacgugaucuuc

SEQ ID NO: 31150 - RNA, 30 nt, Artificial Sequence
  Melanoma antigen preferentially expressed in tumors (300-309)
gcccuguacguggacagccucuucuuccug

SEQ ID NO: 31151 - RNA, 27 nt, Artificial Sequence
  Fatty acid synthase (986-994)
gcccaggccgagguguacaaggagcug

SEQ ID NO: 31152 - RNA, 30 nt, Artificial Sequence
  2',3'-cyclic-nucleotide 3'-phosphodiesterase (249-258)
gcccagcaggacgugcugaagaagagcuac

SEQ ID NO: 31153 - RNA, 24 nt, Artificial Sequence
  Cytochrome c oxidase subunit 2 (156-163)
agccaggacgugcugcacuccugg

SEQ ID NO: 31154 - RNA, 27 nt, Artificial Sequence
  RNA exonuclease 4 (126-134)
gcccgcgugagcaucgucaaccaguac

SEQ ID NO: 31155 - RNA, 30 nt, Artificial Sequence
  RNA-binding protein 14 (646-655)
gcccgcuacagcggcuccuacaacgacuac

SEQ ID NO: 31156 - RNA, 30 nt, Artificial Sequence
  Talin-1 (1272-1281)
ggccgcuucgggcaggacuucagcaccuuc

SEQ ID NO: 31157 - RNA, 27 nt, Artificial Sequence
  YTH domain-containing family protein 2 (30-38)
ggccgcguguucaucaucaagagcuac

SEQ ID NO: 31158 - RNA, 27 nt, Artificial Sequence
  ATP-dependent RNA helicase DDX42 (228-236)
aagcgcuucggcaaggccuacaaccug

SEQ ID NO: 31159 - RNA, 27 nt, Artificial Sequence
  Eukaryotic translation initiation factor 3 subunit E (73-81)
aagcgcaccaccguggucgcccagcug

SEQ ID NO: 31160 - RNA, 27 nt, Artificial Sequence
  Proteasome subunit beta type-5 (113-121)
cgccgggccaucuaccaggccaccuac

SEQ ID NO: 31161 - RNA, 27 nt, Artificial Sequence
  DNA replication licensing factor MCM5 (602-610)
cgccggagcuccauccccaucaccgug

SEQ ID NO: 31162 - RNA, 39 nt, Artificial Sequence
  HLA class I histocompatibility antigen, B-15 alpha chain (193-205)
cgccgguaccuggagaacggcaaggagacccuccagcgc

SEQ ID NO: 31163 - RNA, 30 nt, Artificial Sequence
  Probable bifunctional methylenetetrahydrofolate dehydrogenase/cyclohydrolase 2 (246-255)
caccgcuacacccccaaggagcagcugaag

SEQ ID NO: 31164 - RNA, 27 nt, Artificial Sequence
  60S ribosomal protein L7 (199-207)
aagcgcuucaaggaggccaacaacuuc

SEQ ID NO: 31165 - RNA, 45 nt, Artificial Sequence
  Heat shock 70 kDa protein 1-like (171-185)
gugcugcgcaucaucaacgagcccaccgccgccgcgaucgccuac

SEQ ID NO: 31166 - RNA, 27 nt, Artificial Sequence
  Polypyrimidine tract-binding protein 1 (169-177)
gccgccguggacgcgggcauggccaug

SEQ ID NO: 31167 - RNA, 33 nt, Artificial Sequence
  HLA class I histocompatibility antigen, alpha chain E (137-147)
uucgccuacgacggcaaggacuaccugacccuc

SEQ ID NO: 31168 - RNA, 42 nt, Artificial Sequence
  HLA class I histocompatibility antigen, A-29 alpha chain (21-34)
uucaucgccgugggcuacgucgacgacacccaguucgugcgc

SEQ ID NO: 31169 - RNA, 30 nt, Artificial Sequence
  Ubiquitin-like protein ISG15 (45-54)
cuggccgugcaccccagcggcgucgcccuc

SEQ ID NO: 31170 - RNA, 27 nt, Artificial Sequence
  N-acetyltransferase 8 (174-182)
auccuggacaccggcaccauccagcuc

SEQ ID NO: 31171 - RNA, 27 nt, Artificial Sequence
  Protein prune homolog 2 (1910-1918)
gcccuguucgacggcgacccccaccuc

SEQ ID NO: 31172 - RNA, 27 nt, Artificial Sequence
  Phosphatidylinositol 4,5-bisphosphate 3-kinase catalytic subunit delta isoform (477-485)
gagguggccccccacccggucuacuac

SEQ ID NO: 31173 - RNA, 27 nt, Artificial Sequence
  Chloride intracellular channel protein 1 (167-175)
uuccuggacggcaacgagcucacccug

SEQ ID NO: 31174 - RNA, 27 nt, Artificial Sequence
  Carbonic anhydrase 9 (254-262)
caccugagcaccgccuucgcccgcgug

SEQ ID NO: 31175 - RNA, 27 nt, Artificial Sequence
  40S ribosomal protein S16 (49-57)
aagcugcucgagcccgugcugcugcuc

SEQ ID NO: 31176 - RNA, 27 nt, Artificial Sequence
  Glutathione peroxidase 1 (40-48)
cugcucaucgagaacguggccagccug

SEQ ID NO: 31177 - RNA, 27 nt, Artificial Sequence
  Proliferating cell nuclear antigen (228-236)
agcauguccgccgacgugccccugguc

SEQ ID NO: 31178 - RNA, 39 nt, Artificial Sequence
  Dermokine (410-422)
gccaucaucgagggcgccgacgcgagcucccugcagaag

SEQ ID NO: 31179 - RNA, 33 nt, Artificial Sequence
  PRELI domain-containing protein 1, mitochondrial (142-152)
gccgugcaggaguucggccuggcccgcuucaag

SEQ ID NO: 31180 - RNA, 27 nt, Artificial Sequence
  Putative WAS protein family homolog 3 (42-50)
aaggugagcggcgacaucuucucccgc

SEQ ID NO: 31181 - RNA, 39 nt, Artificial Sequence
  Mitochondrial import inner membrane translocase subunit Tim23 (156-168)
accguggccgccggcaccaugacggggaugcuguacaag

SEQ ID NO: 31182 - RNA, 33 nt, Artificial Sequence
  Tryptophan-tRNA ligase, mitochondrial (162-172)
gugcugcaggccgccgacauccuccuguacaag

SEQ ID NO: 31183 - RNA, 27 nt, Artificial Sequence
  Cytochrome c oxidase subunit 6A1, mitochondrial (29-37)
gugagcaugcugaacgucuaccucaag

SEQ ID NO: 31184 - RNA, 27 nt, Artificial Sequence
  40S ribosomal protein S4, X isoform (171-179)
ggccgcaucggggugaucaccaaccgg

SEQ ID NO: 31185 - RNA, 51 nt, Artificial Sequence
  SLAM family member 6 (103-119)
gacaccggcagcuaccgcgcccagaucuccaccaagacgagcgccaagcug

SEQ ID NO: 31186 - RNA, 45 nt, Artificial Sequence
  Transferrin receptor protein 1 (680-694)
cgcguggaguaccacuuccugagccccuacgucuccccgaaggag

SEQ ID NO: 31187 - RNA, 54 nt, Artificial Sequence
  Transferrin receptor protein 1 (680-697)
cgcguggaguaccacuuccugagccccuacgucuccccgaaggagagccccuuc

SEQ ID NO: 31188 - RNA, 45 nt, Artificial Sequence
  HLA class I histocompatibility antigen, A-1 alpha chain (28-42)
gacgacacccaguucgugcgcuucgacagcgacgccgccucccag

SEQ ID NO: 31189 - RNA, 48 nt, Artificial Sequence
  HLA class I histocompatibility antigen, A-2 alpha chain (28-43)
gacgacacccaguucgugcgcuucgacagcgacgccgccucccagcgg

SEQ ID NO: 31190 - RNA, 51 nt, Artificial Sequence
  HLA class I histocompatibility antigen, A-2 alpha chain (28-44)
gacgacacccaguucgugcgcuucgacagcgacgccgccucccagcggaug

SEQ ID NO: 31191 - RNA, 54 nt, Artificial Sequence
  HLA class I histocompatibility antigen, A-2 alpha chain (28-45)
gacgacacccaguucgugcgcuucgacagcgacgccgccucccagcggauggag

SEQ ID NO: 31192 - RNA, 51 nt, Artificial Sequence
  HLA class I histocompatibility antigen, Cw-7 alpha chain (153-169)
gaccugcgcagcuggaccgccgccgacaccgcggcccagaucacgcagcgg

SEQ ID NO: 31193 - RNA, 39 nt, Artificial Sequence
  HLA class I histocompatibility antigen, alpha chain E (140-152)
gaccugcgcagcuggaccgccguggacaccgccgcgcag

SEQ ID NO: 31194 - RNA, 48 nt, Artificial Sequence
  HLA class I histocompatibility antigen, A-2 alpha chain (29-44)
gacacccaguucgugcgcuucgacagcgacgccgccucccagcggaug

SEQ ID NO: 31195 - RNA, 54 nt, Artificial Sequence
  HLA class I histocompatibility antigen, Cw-7 alpha chain (152-169)
gaggaccugcgcagcuggaccgccgccgacaccgcggcccagaucacgcagcgg

SEQ ID NO: 31196 - RNA, 54 nt, Artificial Sequence
  HLA class I histocompatibility antigen, B-15 alpha chain (152-169)
gaggaccugagcuccuggaccgccgccgacaccgcggcccagaucacgcagcgc

SEQ ID NO: 31197 - RNA, 36 nt, Artificial Sequence
  HLA class I histocompatibility antigen, A-2 alpha chain (32-43)
uucgugcgcuucgacagcgacgccgccucccagcgg

SEQ ID NO: 31198 - RNA, 45 nt, Artificial Sequence
  Heat shock cognate 71 kDa protein (484-498)
ggcauccugaacgugagcgccgucgacaaguccaccgggaaggag

SEQ ID NO: 31199 - RNA, 42 nt, Artificial Sequence
  HLA class I histocompatibility antigen, B-15 alpha chain (154-167)
cugagcuccuggaccgccgccgacaccgcggcccagaucacg

SEQ ID NO: 31200 - RNA, 48 nt, Artificial Sequence
  HLA class I histocompatibility antigen, B-15 alpha chain (154-169)
cugagcuccuggaccgccgccgacaccgcggcccagaucacgcagcgc

SEQ ID NO: 31201 - RNA, 54 nt, Artificial Sequence
  HLA class I histocompatibility antigen, Cw-7 alpha chain (151-168)
aacgaggaccugcgcagcuggaccgccgccgacaccgcggcccagaucacgcag

SEQ ID NO: 31202 - RNA, 42 nt, Artificial Sequence
  HLA class I histocompatibility antigen, B-15 alpha chain (155-168)
agcuccuggaccgccgccgacaccgcggcccagaucacgcag

SEQ ID NO: 31203 - RNA, 42 nt, Artificial Sequence
  HLA class I histocompatibility antigen, B-15 alpha chain (55-68)
acccaguucgugcgcuucgacagcgacgccgccuccccccgg

SEQ ID NO: 31204 - RNA, 42 nt, Artificial Sequence
  HLA class I histocompatibility antigen, A-2 alpha chain (30-43)
acccaguucgugcgcuucgacagcgacgccgccucccagcgg

SEQ ID NO: 31205 - RNA, 48 nt, Artificial Sequence
  HLA class I histocompatibility antigen, A-1 alpha chain (27-42)
guggacgacacccaguucguccgcuucgacagcgacgccgccucccag

SEQ ID NO: 31206 - RNA, 54 nt, Artificial Sequence
  HLA class I histocompatibility antigen, A-2 alpha chain (27-44)
guggacgacacccaguucguccgcuucgacagcgacgccgccucccagcggaug

SEQ ID NO: 31207 - RNA, 27 nt, Artificial Sequence
  Ankyrin repeat domain-containing protein 17 (744-752)
gccccccgcgugccgguccaggcccug

SEQ ID NO: 31208 - RNA, 27 nt, Artificial Sequence
  Probable ubiquitin carboxyl-terminal hydrolase FAF-Y (2050-2058)
gcccgcuuccuguucaccaccggcuuc

SEQ ID NO: 31209 - RNA, 42 nt, Artificial Sequence
  Transferrin receptor protein 1 (15-28)
ggcgagccccugagcuacacccgcuucucccucgcccggcag

SEQ ID NO: 31210 - RNA, 48 nt, Artificial Sequence
  Transferrin receptor protein 1 (15-30)
ggcgagccccugagcuacacccgcuucucccucgcccggcagguggac

SEQ ID NO: 31211 - RNA, 51 nt, Artificial Sequence
  Transferrin receptor protein 1 (14-30)
ggcggggagccccugagcuacacccgcuucucccucgcccggcagguggac

SEQ ID NO: 31212 - RNA, 54 nt, Artificial Sequence
  Transferrin receptor protein 1 (14-31)
ggcggggagccccugagcuacacccgcuucucccucgcccggcagguggacggc

SEQ ID NO: 31213 - RNA, 27 nt, Artificial Sequence
  Annexin A3 (33-41)
ggcaucgggaccgacgagaagaugcug

SEQ ID NO: 31214 - RNA, 27 nt, Artificial Sequence
  Microtubule-associated protein 1B (225-233)
ggccugagcgaguucaccgaguaccuc

SEQ ID NO: 31215 - RNA, 27 nt, Artificial Sequence
  SCAN domain-containing protein 1 (121-129)
ggcccccgcgaggccuuccggcagcug

SEQ ID NO: 31216 - RNA, 27 nt, Artificial Sequence
  Splicing factor 3B subunit 3 (430-438)
ggcccccgcagcucccugcgggugcuc

SEQ ID NO: 31217 - RNA, 27 nt, Artificial Sequence
  Glyoxylate reductase/hydroxypyruvate reductase (162-170)
ggccgcaucgggcaggccaucgcccgg

SEQ ID NO: 31218 - RNA, 30 nt, Artificial Sequence
  40S ribosomal protein S11 (70-79)
ggccgcauccugagcgggguggucaccaag

SEQ ID NO: 31219 - RNA, 27 nt, Artificial Sequence
  Eukaryotic initiation factor 4A-II (368-376)
ggccgcaaggggguggccaucaacuuc

SEQ ID NO: 31220 - RNA, 27 nt, Artificial Sequence
  40S ribosomal protein S4, Y isoform 1 (190-198)
ggccgcgugggggucaucaccaaccgg

SEQ ID NO: 31221 - RNA, 27 nt, Artificial Sequence
  Splicing factor 3B subunit 3 (957-965)
ggccgcgugcugaucggggucggcaag

SEQ ID NO: 31222 - RNA, 30 nt, Artificial Sequence
  Nucleolar RNA helicase 2 (403-412)
aucccccagaagcagcgcgagaucacccug

SEQ ID NO: 31223 - RNA, 27 nt, Artificial Sequence
  Probable ATP-dependent RNA helicase DDX4 (355-363)
aucaccgccagccgcuucaaggagcug

SEQ ID NO: 31224 - RNA, 27 nt, Artificial Sequence
  EH domain-containing protein 2 (480-488)
aagcugcccaacagcgugcucggccgc

SEQ ID NO: 31225 - RNA, 27 nt, Artificial Sequence
  Speriolin-like protein (246-254)
aagcugcgcgagcucacccagcgguac

SEQ ID NO: 31226 - RNA, 27 nt, Artificial Sequence
  Ubiquitin carboxyl-terminal hydrolase 45 (297-305)
cugcuccacuaccugcuggacgccgug

SEQ ID NO: 31227 - RNA, 27 nt, Artificial Sequence
  40S ribosomal protein S4, X isoform (238-246)
cugccccgcggcaaggggauccggcuc

SEQ ID NO: 31228 - RNA, 30 nt, Artificial Sequence
  DNA replication licensing factor MCM6 (215-224)
cugccccgcggcagcaucccgcggucccuc

SEQ ID NO: 31229 - RNA, 33 nt, Artificial Sequence
  2',3'-cyclic-nucleotide 3'-phosphodiesterase (303-313)
cugccccgcggcagccgggcccacaucacccuc

SEQ ID NO: 31230 - RNA, 27 nt, Artificial Sequence
  39S ribosomal protein L20, mitochondrial (89-97)
aaccuggugaagugccaggucgagcuc

SEQ ID NO: 31231 - RNA, 33 nt, Artificial Sequence
  Trinucleotide repeat-containing gene 18 protein (554-564)
aaccgcaaggcccuggccaagggccucgggcug

SEQ ID NO: 31232 - RNA, 33 nt, Artificial Sequence
  Transmembrane emp24 domain-containing protein 4 (23-33)
aacuaccccgagaucgccgccaaggacaagcug

SEQ ID NO: 31233 - RNA, 27 nt, Artificial Sequence
  Lymphocyte antigen 75 (791-799)
cagauccccaagggccgcaccccgaag

SEQ ID NO: 31234 - RNA, 27 nt, Artificial Sequence
  Ribonucleoside-diphosphate reductase large subunit (742-750)
cgccccgccgccaacccgauccaguuc

SEQ ID NO: 31235 - RNA, 27 nt, Artificial Sequence
  Aldo-keto reductase family 1 member C1 (91-99)
cgccccgagcuggugcggccggcccuc

SEQ ID NO: 31236 - RNA, 30 nt, Artificial Sequence
  Protein phosphatase 1 regulatory subunit 35 (234-243)
cgcccccggccgagcgaggacaccuuccug

SEQ ID NO: 31237 - RNA, 27 nt, Artificial Sequence
  Frizzled-2 (2-10)
cgcccccggagcgcccugccgcgccuc

SEQ ID NO: 31238 - RNA, 27 nt, Artificial Sequence
  HLA class I histocompatibility antigen, alpha chain E (25-33)
agccugaaguacuuccacaccuccgug

SEQ ID NO: 31239 - RNA, 27 nt, Artificial Sequence
  Histone H2B type 2-F (79-87)
agccgccuggcccacuacaacaagcgg

SEQ ID NO: 31240 - RNA, 27 nt, Artificial Sequence
  EH domain-containing protein 2 (484-492)
agcgugcugggccgcaucuggaagcuc

SEQ ID NO: 31241 - RNA, 33 nt, Artificial Sequence
  Heterogeneous nuclear ribonucleoprotein K (78-88)
gugcccgacagcuccggcccggagcgcauccug

SEQ ID NO: 31242 - RNA, 27 nt, Artificial Sequence
  Vimentin (216-224)
gcccgccuggaccucgagcggaaggug

SEQ ID NO: 31243 - RNA, 27 nt, Artificial Sequence
  E3 ubiquitin-protein ligase HECTD1 (174-182)
gcccgccugggcgugaucagcaagguc

SEQ ID NO: 31244 - RNA, 30 nt, Artificial Sequence
  V-type proton ATPase subunit S1 (217-226)
gcccgccugagccucaccuacgagcggcug

SEQ ID NO: 31245 - RNA, 27 nt, Artificial Sequence
  Peroxisomal membrane protein PEX16 (38-46)
ggccgcuucgccgacagccacgagcug

SEQ ID NO: 31246 - RNA, 30 nt, Artificial Sequence
  40S ribosomal protein S21 (44-53)
ggccgcuucaacgggcaguucaagaccuac

SEQ ID NO: 31247 - RNA, 27 nt, Artificial Sequence
  Pro-interleukin-16 (881-889)
ggccgcuucagcgggcugcucggccgg

SEQ ID NO: 31248 - RNA, 27 nt, Artificial Sequence
  60S ribosomal protein L13a (17-25)
ggccgccuggccgccaucguggcgaag

SEQ ID NO: 31249 - RNA, 27 nt, Artificial Sequence
  Leucine-tRNA ligase, cytoplasmic (57-65)
ggccgccugcaccucgggcacaccuuc

SEQ ID NO: 31250 - RNA, 27 nt, Artificial Sequence
  Amidophosphoribosyltransferase (354-362)
ggccgcaccuucauccagcccaacaug

SEQ ID NO: 31251 - RNA, 27 nt, Artificial Sequence
  Ubiquitin-60S ribosomal protein L40 (58-66)
ggccgcacccugagcgacuacaacauc

SEQ ID NO: 31252 - RNA, 30 nt, Artificial Sequence
  Lamin-B receptor (14-23)
ggccgcuggcccgggagcucccuguacuac

SEQ ID NO: 31253 - RNA, 27 nt, Artificial Sequence
  40S ribosomal protein S25 (103-111)
caccgcgcccaggugaucuacacccgg

SEQ ID NO: 31254 - RNA, 27 nt, Artificial Sequence
  Transcription activator BRG1 (1255-1263)
caccgcaucggccagcagaacgaggug

SEQ ID NO: 31255 - RNA, 27 nt, Artificial Sequence
  H/ACA ribonucleoprotein complex subunit 3 (44-52)
caccgcaucaccaucaagaagcgguuc

SEQ ID NO: 31256 - RNA, 30 nt, Artificial Sequence
  Heterogeneous nuclear ribonucleoprotein H (274-283)
caccgcuacggcgacgggggcagcaccuuc

SEQ ID NO: 31257 - RNA, 27 nt, Artificial Sequence
  Histone H2A type 1-A (88-96)
auccgcaacgacgaggagcugaacaag

SEQ ID NO: 31258 - RNA, 27 nt, Artificial Sequence
  Hsc70-interacting protein (153-161)
aagcgcgccagcguguucgucaagcug

SEQ ID NO: 31259 - RNA, 27 nt, Artificial Sequence
  Signal peptidase complex subunit 2 (164-172)
aagcgcuucgacgacaaguacacccug

SEQ ID NO: 31260 - RNA, 27 nt, Artificial Sequence
  YEATS domain-containing protein 2 (299-307)
aagcgcaucgacaucauccacaaccug

SEQ ID NO: 31261 - RNA, 27 nt, Artificial Sequence
  Protein arginine N-methyltransferase 1 (266-274)
aagcgcaacgacuacgugcacgcccug

SEQ ID NO: 31262 - RNA, 27 nt, Artificial Sequence
  Cyclic AMP-responsive element-binding protein 3-like protein 2 (270-278)
aagcgcacccugaucgccgagggcuac

SEQ ID NO: 31263 - RNA, 30 nt, Artificial Sequence
  DNA-dependent protein kinase catalytic subunit (263-272)
aagcgcuacgccgugcccagcgccggccug

SEQ ID NO: 31264 - RNA, 27 nt, Artificial Sequence
  Small nuclear ribonucleoprotein Sm D2 (110-118)
cugcgcaacccccucaucgccggcaag

SEQ ID NO: 31265 - RNA, 30 nt, Artificial Sequence
  Solute carrier family 25 member 46 (98-107)
aaccgcuucgccggcuucgggaucggccug

SEQ ID NO: 31266 - RNA, 27 nt, Artificial Sequence
  General transcription factor II-I (491-499)
aaccgcaucaaguucgugaucaagcgg

SEQ ID NO: 31267 - RNA, 27 nt, Artificial Sequence
  L-lactate dehydrogenase A chain (111-119)
cagcgcaacgugaacaucuucaaguuc

SEQ ID NO: 31268 - RNA, 27 nt, Artificial Sequence
  Annexin A2 (67-75)
cagcgccaggacaucgccuucgccuac

SEQ ID NO: 31269 - RNA, 36 nt, Artificial Sequence
  40S ribosomal protein S30 (114-125)
cgccgguucgugaacgucgugcccaccuucggcaag

SEQ ID NO: 31270 - RNA, 27 nt, Artificial Sequence
  2'-5'-oligoadenylate synthase 1 (94-102)
cgccggggcgaguucauccaggagauc

SEQ ID NO: 31271 - RNA, 30 nt, Artificial Sequence
  NADH dehydrogenase (ubiquinone) 1 alpha subcomplex subunit 1 (52-61)
cgccggaucagcggcguggaccgcuacuac

SEQ ID NO: 31272 - RNA, 30 nt, Artificial Sequence
  Protein disulfide-isomerase A3 (4-13)
cgccggcuggcccucuuccccggcguggcc

SEQ ID NO: 31273 - RNA, 27 nt, Artificial Sequence
  Reticulocalbin-1 (8-16)
cgccggcugggccucgcccuggggcug

SEQ ID NO: 31274 - RNA, 27 nt, Artificial Sequence
  S-adenosylmethionine synthase isoform type-1 (312-320)
cgccgggugcugguccaggugagcuac

SEQ ID NO: 31275 - RNA, 33 nt, Artificial Sequence
  Probable ATP-dependent RNA helicase DDX5 (24-34)
agccgcgccggcccccuguccgggaagaaguuc

SEQ ID NO: 31276 - RNA, 27 nt, Artificial Sequence
  Membralin (120-128)
agccgcgcccccguguuccugcaguuc

SEQ ID NO: 31277 - RNA, 30 nt, Artificial Sequence
  Dynamin-like 120 kDa protein, mitochondrial (499-508)
agccgcauccagcagaucaucgagggcaag

SEQ ID NO: 31278 - RNA, 27 nt, Artificial Sequence
  Growth hormone-inducible transmembrane protein (146-154)
agccgcacccccgugcugaugaacuuc

SEQ ID NO: 31279 - RNA, 30 nt, Artificial Sequence
  Clathrin heavy chain 1 (1341-1350)
agccgcgugaacauccccaagguccugcgg

SEQ ID NO: 31280 - RNA, 27 nt, Artificial Sequence
  Heat shock-related 70 kDa protein 2 (344-352)
acccgcauccccaagauccagaagcug

SEQ ID NO: 31281 - RNA, 27 nt, Artificial Sequence
  Polyadenylate-binding protein 1 (289-297)
acccgcuaccagggcgugaaccuguac

SEQ ID NO: 31282 - RNA, 33 nt, Artificial Sequence
  Histone H2B type 2-F (99-109)
gugcgccugcuccugcccggcgagcuggccaag

SEQ ID NO: 31283 - RNA, 30 nt, Artificial Sequence
  Eukaryotic translation initiation factor 3 subunit B (340-349)
gugcgcuggagccccaagggcaccuaccug

SEQ ID NO: 31284 - RNA, 27 nt, Artificial Sequence
  Ras-specific guanine nucleotide-releasing factor 1 (983-991)
gccgccgcgaacaucauccgcacccug

SEQ ID NO: 31285 - RNA, 27 nt, Artificial Sequence
  Cytoskeleton-associated protein 4 (73-81)
gccgccgacaccgagcgccuggcgcuc

SEQ ID NO: 31286 - RNA, 42 nt, Artificial Sequence
  Voltage-dependent anion-selective channel protein 2 (222-235)
gccgccaaguaccagcuggaccccaccgcgagcaucuccgcc

SEQ ID NO: 31287 - RNA, 27 nt, Artificial Sequence
  RNA polymerase II subunit A C-terminal domain phosphatase (41-49)
gccgccgugcgcaucggcagcguccug

SEQ ID NO: 31288 - RNA, 36 nt, Artificial Sequence
  Protein unc-13 homolog D (1011-1022)
gccgacgaccuggagggcgaggccuuccucccccug

SEQ ID NO: 31289 - RNA, 39 nt, Artificial Sequence
  Protein unc-13 homolog D (1011-1023)
gccgacgaccuggagggcgaggccuuccucccccugcgc

SEQ ID NO: 31290 - RNA, 42 nt, Artificial Sequence
  Protein unc-13 homolog D (1011-1024)
gccgacgaccuggagggcgaggccuuccucccccugcgcgag

SEQ ID NO: 31291 - RNA, 45 nt, Artificial Sequence
  SLAM family member 6 (47-61)
gccgacgacaacgugagcuuccgcugggaggcccugggcaacacc

SEQ ID NO: 31292 - RNA, 48 nt, Artificial Sequence
  SLAM family member 6 (47-62)
gccgacgacaacgugagcuuccgcugggaggcccugggcaacacccuc

SEQ ID NO: 31293 - RNA, 36 nt, Artificial Sequence
  Golgi apparatus protein 1 (724-735)
gccgacaucuucguggaccccguccugcacaccgcc

SEQ ID NO: 31294 - RNA, 42 nt, Artificial Sequence
  Golgi apparatus protein 1 (1059-1072)
gccgacaucuucguggaccccguccugcacaccgccugcgcg

SEQ ID NO: 31295 - RNA, 36 nt, Artificial Sequence
  Low affinity immunoglobulin epsilon Fc receptor (40-51)
gccgaccugagcuccuucaagagccaggagcucaac

SEQ ID NO: 31296 - RNA, 42 nt, Artificial Sequence
  Low affinity immunoglobulin epsilon Fc receptor (40-53)
gccgaccugagcuccuucaagagccaggagcucaacgagcgc

SEQ ID NO: 31297 - RNA, 45 nt, Artificial Sequence
  Low affinity immunoglobulin epsilon Fc receptor (40-54)
gccgaccugagcuccuucaagagccaggagcucaacgagcgcaac

SEQ ID NO: 31298 - RNA, 48 nt, Artificial Sequence
  Low affinity immunoglobulin epsilon Fc receptor (40-55)
gccgaccugagcuccuucaagagccaggagcucaacgagcgcaacgag

SEQ ID NO: 31299 - RNA, 51 nt, Artificial Sequence
  Low affinity immunoglobulin epsilon Fc receptor (40-56)
gccgaccugagcuccuucaagagccaggagcucaacgagcgcaacgaggcc

SEQ ID NO: 31300 - RNA, 48 nt, Artificial Sequence
  T-complex protein 1 subunit beta (163-178)
gccgacagcuaccuggacgagggcuuccuccuggacaagaagaucggg

SEQ ID NO: 31301 - RNA, 27 nt, Artificial Sequence
  Eukaryotic translation initiation factor 6 (130-138)
gccgacgugcugaaggucgagguguuc

SEQ ID NO: 31302 - RNA, 27 nt, Artificial Sequence
  Proline-rich protein 12 (390-398)
gccgaggaggccggcgggacccgccug

SEQ ID NO: 31303 - RNA, 27 nt, Artificial Sequence
  Probable ribonuclease ZC3H12D (154-162)
gccgagcuggagcgccaggccgugcuc

SEQ ID NO: 31304 - RNA, 30 nt, Artificial Sequence
  A-kinase anchor protein 2 (688-697)
gccgagcugcgcagcaccgccucccuccug

SEQ ID NO: 31305 - RNA, 48 nt, Artificial Sequence
  Ragulator complex protein LAMTOR1 (36-51)
gccgagcccaacuaccacagccugccguccgcccgcaccgacgagcag

SEQ ID NO: 31306 - RNA, 57 nt, Artificial Sequence
  Low affinity immunoglobulin epsilon Fc receptor (19-37)
gccgagcagcagcgccugaagagccaggaccucgagcuguccuggaaccugaacggc

SEQ ID NO: 31307 - RNA, 30 nt, Artificial Sequence
  Ribonucleoside-diphosphate reductase subunit M2 B (284-293)
gccgagaccaccgacaacguguucacgcug

SEQ ID NO: 31308 - RNA, 27 nt, Artificial Sequence
  Zinc finger protein 638 (1263-1271)
gccgagguggagaagaacgagaccguc

SEQ ID NO: 31309 - RNA, 45 nt, Artificial Sequence
  Peroxisomal multifunctional enzyme type 2 (19-33)
gccggccuggggcgcgccuacgcgcucgccuucgccgagcggggc

SEQ ID NO: 31310 - RNA, 45 nt, Artificial Sequence
  B- and T-lymphocyte attenuator (191-205)
gccggccgcgagaucaaccugguggacgcccaccucaagagcgag

SEQ ID NO: 31311 - RNA, 51 nt, Artificial Sequence
  B- and T-lymphocyte attenuator (191-207)
gccggccgcgagaucaaccugguggacgcccaccucaagagcgagcagacc

SEQ ID NO: 31312 - RNA, 36 nt, Artificial Sequence
  CD44 antigen (8-19)
gccggcguguuccacgucgagaagaacgggcgcuac

SEQ ID NO: 31313 - RNA, 30 nt, Artificial Sequence
  Cordon-bleu protein-like 1 (1088-1097)
gccauccgcagcggcgaggccgcggccaag

SEQ ID NO: 31314 - RNA, 36 nt, Artificial Sequence
  C-C chemokine receptor type 7 (94-105)
gccaucgugcaggccgucagcgcgcaccgccaccgg

SEQ ID NO: 31315 - RNA, 42 nt, Artificial Sequence
  Ragulator complex protein LAMTOR3 (21-34)
gccaucguggucagcgaccgcgacggcgugcccgugaucaag

SEQ ID NO: 31316 - RNA, 45 nt, Artificial Sequence
  IgG receptor FcRn large subunit p51 (131-145)
gccaaguucgcccugaacggcgaggaguucaugaacuucgaccuc

SEQ ID NO: 31317 - RNA, 48 nt, Artificial Sequence
  IgG receptor FcRn large subunit p51 (131-146)
gccaaguucgcccugaacggcgaggaguucaugaacuucgaccucaag

SEQ ID NO: 31318 - RNA, 42 nt, Artificial Sequence
  Glutathione peroxidase 1 (84-97)
gcccugaugaccgaccccaagcucaucaccuggagcccggug

SEQ ID NO: 31319 - RNA, 39 nt, Artificial Sequence
  IgG receptor FcRn large subunit p51 (134-146)
gcccugaacggcgaggaguucaugaacuucgaccucaag

SEQ ID NO: 31320 - RNA, 27 nt, Artificial Sequence
  Serine/threonine-protein kinase LATS1 (729-737)
gcccuguacgccaccaagacccuccgc

SEQ ID NO: 31321 - RNA, 42 nt, Artificial Sequence
  E3 ubiquitin-protein ligase CHIP (43-56)
gccaaccugcagcgcgccuacagccucgcgaaggagcagcgg

SEQ ID NO: 31322 - RNA, 33 nt, Artificial Sequence
  A-kinase anchor protein 2 (298-308)
gcccccgccagcucccacgagcgcgcgagcaug

SEQ ID NO: 31323 - RNA, 30 nt, Artificial Sequence
  Interferon regulatory factor 9 (199-208)
gcccccuuccagggcgaccagcgcagccug

SEQ ID NO: 31324 - RNA, 30 nt, Artificial Sequence
  T-cell activation Rho GTPase-activating protein (268-277)
gcccccggcagcgugcugccgcgcgcccuc

SEQ ID NO: 31325 - RNA, 45 nt, Artificial Sequence
  Platelet endothelial cell adhesion molecule (159-173)
gcccccauccacuucaccaucgagaagcuggagcucaacgagaag

SEQ ID NO: 31326 - RNA, 42 nt, Artificial Sequence
  Alpha-1B-glycoprotein (205-218)
gccccccuggagggcgcccgcuucgcgcucgugcgggaggac

SEQ ID NO: 31327 - RNA, 27 nt, Artificial Sequence
  TBC1 domain family member 22A (113-121)
gccccccugcagcgcagccagucccuc

SEQ ID NO: 31328 - RNA, 27 nt, Artificial Sequence
  Cordon-bleu protein-like 1 (891-899)
gcccccaacccggcccccaaggagcug

SEQ ID NO: 31329 - RNA, 24 nt, Artificial Sequence
  Negative elongation factor E (257-264)
gccccccgcaagggcaacacccug

SEQ ID NO: 31330 - RNA, 27 nt, Artificial Sequence
  Cyclin-dependent kinase inhibitor 1C (105-113)
gccccccgcccgguggccgucgcggug

SEQ ID NO: 31331 - RNA, 27 nt, Artificial Sequence
  Endoplasmic reticulum resident protein 44 (391-399)
gcccccagcgaguaccgcuacacccug

SEQ ID NO: 31332 - RNA, 30 nt, Artificial Sequence
  Endoplasmic reticulum resident protein 44 (391-400)
gcccccagcgaguaccgcuacacccugcuc

SEQ ID NO: 31333 - RNA, 48 nt, Artificial Sequence
  Lipolysis-stimulated lipoprotein receptor (216-231)
gcccccagcaccuacgcccaccuguccccggcgaagaccccccccccc

SEQ ID NO: 31334 - RNA, 51 nt, Artificial Sequence
  Lipolysis-stimulated lipoprotein receptor (216-232)
gcccccagcaccuacgcccaccuguccccggcgaagacccccccccccccg

SEQ ID NO: 31335 - RNA, 54 nt, Artificial Sequence
  Lipolysis-stimulated lipoprotein receptor (216-233)
gcccccagcaccuacgcccaccuguccccggcgaagacccccccccccccggcc

SEQ ID NO: 31336 - RNA, 39 nt, Artificial Sequence
  C-C chemokine receptor type 7 (190-202)
gcccgcaacuucgagcggaacaaggccaucaaggugauc

SEQ ID NO: 31337 - RNA, 45 nt, Artificial Sequence
  C-C chemokine receptor type 7 (190-204)
gcccgcaacuucgagcggaacaaggccaucaaggugaucaucgcg

SEQ ID NO: 31338 - RNA, 48 nt, Artificial Sequence
  Glucose-6-phosphate isomerase (181-196)
gccagcaagaccuucaccacgcaggagaccaucaccaacgccgagacc

SEQ ID NO: 31339 - RNA, 45 nt, Artificial Sequence
  Cystatin-C (63-77)
gccagcaacgacauguaccacucccgcgcccugcaggugguccgg

SEQ ID NO: 31340 - RNA, 48 nt, Artificial Sequence
  Cystatin-C (63-78)
gccagcaacgacauguaccacucccgcgcccugcaggugguccgggcg

SEQ ID NO: 31341 - RNA, 27 nt, Artificial Sequence
  A-kinase anchor protein 2 (107-115)
gccagccgccaggcccccccgcacauc

SEQ ID NO: 31342 - RNA, 30 nt, Artificial Sequence
  Exostosin-2 (691-700)
gccagcguguucggcaccaugccccugaag

SEQ ID NO: 31343 - RNA, 30 nt, Artificial Sequence
  Fatty acyl-CoA reductase 2 (227-236)
gccaccuucgagaagauccccuucgagcgc

SEQ ID NO: 31344 - RNA, 45 nt, Artificial Sequence
  Ras-related protein Rab-11A (49-63)
gccacccgcagcauccagguggacggcaagaccaucaaggcccag

SEQ ID NO: 31345 - RNA, 48 nt, Artificial Sequence
  Ras-related protein Rab-11A (49-64)
gccacccgcagcauccagguggacggcaagaccaucaaggcccagauc

SEQ ID NO: 31346 - RNA, 27 nt, Artificial Sequence
  Cadherin EGF LAG seven-pass G-type receptor 1 (1076-1084)
gccaccagcgccccccuggugucccgc

SEQ ID NO: 31347 - RNA, 33 nt, Artificial Sequence
  Tumor protein p53-inducible protein 11 (90-100)
gccguguucgacggcgcccaggucaccagcaag

SEQ ID NO: 31348 - RNA, 27 nt, Artificial Sequence
  Short-chain dehydrogenase/reductase 3 (9-17)
gccgugggccugguccuccccgccaag

SEQ ID NO: 31349 - RNA, 30 nt, Artificial Sequence
  A-kinase anchor protein 2 (230-239)
gccgugaagaagaaccccggcaucgccgcg

SEQ ID NO: 31350 - RNA, 51 nt, Artificial Sequence
  SLAM family member 6 (46-62)
gacgccgacgacaacgugagcuuccgcugggaggcccugggcaacacccuc

SEQ ID NO: 31351 - RNA, 42 nt, Artificial Sequence
  Peroxisomal multifunctional enzyme type 2 (88-101)
gacgccuucggccgcaucgacguggucgugaacaacgccggg

SEQ ID NO: 31352 - RNA, 45 nt, Artificial Sequence
  Lymphocyte antigen 9 (125-139)
gacgccggcagcuacaaggcccagaucaaccagcgcaacuucgag

SEQ ID NO: 31353 - RNA, 51 nt, Artificial Sequence
  Lymphocyte antigen 9 (125-141)
gacgccggcagcuacaaggcccagaucaaccagcgcaacuucgaggugacc

SEQ ID NO: 31354 - RNA, 24 nt, Artificial Sequence
  Cell division cycle-associated 7-like protein (200-207)
gacgcccugcucaagcgcaccaug

SEQ ID NO: 31355 - RNA, 27 nt, Artificial Sequence
  Probable ribosome biogenesis protein RLP24 (91-99)
gacgccaugaagcgcguggaggagauc

SEQ ID NO: 31356 - RNA, 39 nt, Artificial Sequence
  Platelet endothelial cell adhesion molecule (416-428)
gacgcccaguucgaggugaucaagggccagaccaucgag

SEQ ID NO: 31357 - RNA, 45 nt, Artificial Sequence
  Platelet endothelial cell adhesion molecule (416-430)
gacgcccaguucgaggugaucaagggccagaccaucgagguccgc

SEQ ID NO: 31358 - RNA, 36 nt, Artificial Sequence
  Ceruloplasmin (715-726)
gacgacaacaucaagaccuacagcgaccaccccgag

SEQ ID NO: 31359 - RNA, 39 nt, Artificial Sequence
  Ceruloplasmin (715-727)
gacgacaacaucaagaccuacagcgaccaccccgagaag

SEQ ID NO: 31360 - RNA, 42 nt, Artificial Sequence
  SLAM family member 6 (48-61)
gacgacaacgugagcuuccgcugggaggcccugggcaacacc

SEQ ID NO: 31361 - RNA, 45 nt, Artificial Sequence
  SLAM family member 6 (48-62)
gacgacaacgugagcuuccgcugggaggcccugggcaacacccuc

SEQ ID NO: 31362 - RNA, 51 nt, Artificial Sequence
  Ceramide glucosyltransferase (91-107)
gacgaccccgccaucgacgugugcaagaagcugcucggcaaguacccgaac

SEQ ID NO: 31363 - RNA, 27 nt, Artificial Sequence
  Dystrophin (386-394)
gacgagcaccugcucauccagcacuac

SEQ ID NO: 31364 - RNA, 27 nt, Artificial Sequence
  E3 ubiquitin-protein ligase Mdm2 (68-76)
gacgagaagcagcagcacaucguguac

SEQ ID NO: 31365 - RNA, 27 nt, Artificial Sequence
  Dynamin-binding protein (858-866)
gacgagcugcccaaguuccaccaguac

SEQ ID NO: 31366 - RNA, 27 nt, Artificial Sequence
  Transmembrane emp24 domain-containing protein 4 (48-56)
gacgagaccauggugaucggcaacuac

SEQ ID NO: 31367 - RNA, 27 nt, Artificial Sequence
  Uncharacterized protein CXorf21 (47-55)
gacgagacccaggugcgcagccuguac

SEQ ID NO: 31368 - RNA, 24 nt, Artificial Sequence
  TBC1 domain family member 22A (223-230)
gacgaggugcaccaggacaccuac

SEQ ID NO: 31369 - RNA, 27 nt, Artificial Sequence
  E3 ubiquitin-protein ligase Mdm2 (273-281)
gacgagguguaccaggucaccguguac

SEQ ID NO: 31370 - RNA, 42 nt, Artificial Sequence
  MyoD family inhibitor domain-containing protein (67-80)
gacggcgagcugauccgcacccagccccagcggcucccgcag

SEQ ID NO: 31371 - RNA, 24 nt, Artificial Sequence
  Obscurin-like protein 1 (299-306)
gacggcggguucgugcugaagguc

SEQ ID NO: 31372 - RNA, 54 nt, Artificial Sequence
  Beta-1,4-galactosyltransferase 1 (110-127)
gacggccugaacagccucaccuaccaggugcuggacguccagcgcuacccccug

SEQ ID NO: 31373 - RNA, 39 nt, Artificial Sequence
  Plasma membrane calcium-transporting ATPase 1 (257-269)
gacggcagcuaccgcaucuucuccaagggggccagcgag

SEQ ID NO: 31374 - RNA, 24 nt, Artificial Sequence
  T-cell activation Rho GTPase-activating protein (29-36)
gacaucaaggagcacccccugcuc

SEQ ID NO: 31375 - RNA, 27 nt, Artificial Sequence
  Probable ribosome biogenesis protein RLP24 (123-131)
gacaucaaggaggugaagcagaacauc

SEQ ID NO: 31376 - RNA, 48 nt, Artificial Sequence
  Vesicle-associated membrane protein 3 (27-42)
gacaucaugcgcgugaacgucgacaaggugcuggagcgggaccagaag

SEQ ID NO: 31377 - RNA, 51 nt, Artificial Sequence
  Vesicle-associated membrane protein 3 (27-43)
gacaucaugcgcgugaacgucgacaaggugcuggagcgggaccagaagcuc

SEQ ID NO: 31378 - RNA, 39 nt, Artificial Sequence
  Endoplasmin (536-548)
gacaagaucuacuucauggccggcagcucccgcaaggag

SEQ ID NO: 31379 - RNA, 48 nt, Artificial Sequence
  Ceramide glucosyltransferase (43-58)
gacaagcagcccuacagcaagcugccgggcgugucccuccugaagccc

SEQ ID NO: 31380 - RNA, 51 nt, Artificial Sequence
  Ceramide glucosyltransferase (43-59)
gacaagcagcccuacagcaagcugccgggcgugucccuccugaagccccug

SEQ ID NO: 31381 - RNA, 27 nt, Artificial Sequence
  Poly (ADP-ribose) polymerase 3 (217-225)
gaccuggacgugaagaagaugccccuc

SEQ ID NO: 31382 - RNA, 45 nt, Artificial Sequence
  Perilipin-3 (369-383)
gaccugagcuccagcauccucgcccagucccgcgagcggguggcc

SEQ ID NO: 31383 - RNA, 27 nt, Artificial Sequence
  Cytoskeleton-associated protein 4 (188-196)
gacaugaaggccaagguggccagccug

SEQ ID NO: 31384 - RNA, 48 nt, Artificial Sequence
  Phosphoinositide-3-kinase-interacting protein 1 (28-43)
gacaacggccaccuguaccgcgaggaccagaccagccccgccccgggg

SEQ ID NO: 31385 - RNA, 54 nt, Artificial Sequence
  Phosphoinositide-3-kinase-interacting protein 1 (28-45)
gacaacggccaccuguaccgcgaggaccagaccagccccgccccggggcuccgg

SEQ ID NO: 31386 - RNA, 42 nt, Artificial Sequence
  Protein CDV3 homolog (139-152)
gacaaccaguacgccgugcuggagaaccagaagagcucccac

SEQ ID NO: 31387 - RNA, 39 nt, Artificial Sequence
  SLAM family member 6 (49-61)
gacaacgugagcuuccgcugggaggcccugggcaacacc

SEQ ID NO: 31388 - RNA, 42 nt, Artificial Sequence
  SLAM family member 6 (49-62)
gacaacgugagcuuccgcugggaggcccugggcaacacccuc

SEQ ID NO: 31389 - RNA, 45 nt, Artificial Sequence
  SLAM family member 6 (49-63)
gacaacgugagcuuccgcugggaggcccugggcaacacccucucc

SEQ ID NO: 31390 - RNA, 45 nt, Artificial Sequence
  Golgi apparatus protein 1 (492-506)
gaccccggcgccgacuaccgcaucgaccgggcccugaacgaggcg

SEQ ID NO: 31391 - RNA, 51 nt, Artificial Sequence
  Peroxiredoxin-1 (107-123)
gaccccaagcgcaccaucgcccaggacuacggcgugcugaaggccgacgag

SEQ ID NO: 31392 - RNA, 54 nt, Artificial Sequence
  Peroxiredoxin-1 (107-124)
gaccccaagcgcaccaucgcccaggacuacggcgugcugaaggccgacgagggg

SEQ ID NO: 31393 - RNA, 27 nt, Artificial Sequence
  Methyltransferase-like protein 7A (98-106)
gaccccaacccgaacuucgagaaguuc

SEQ ID NO: 31394 - RNA, 45 nt, Artificial Sequence
  Glucose-6-phosphate isomerase (276-290)
gaccagcacuuccgcaccaccccccuggagaagaacgccccggug

SEQ ID NO: 31395 - RNA, 27 nt, Artificial Sequence
  Perilipin-2 (38-46)
gaccaguaccccuaccugaagagcgug

SEQ ID NO: 31396 - RNA, 27 nt, Artificial Sequence
  T-cell activation Rho GTPase-activating protein (165-173)
gacagcgccggcccccaggacgcccgc

SEQ ID NO: 31397 - RNA, 42 nt, Artificial Sequence
  Ceruloplasmin (187-200)
gacagcgccguguucuucgagcagggcaccacccgcaucggg

SEQ ID NO: 31398 - RNA, 39 nt, Artificial Sequence
  T-complex protein 1 subunit beta (164-176)
gacagcuaccuggacgagggcuuccuccuggacaagaag

SEQ ID NO: 31399 - RNA, 45 nt, Artificial Sequence
  T-complex protein 1 subunit beta (164-178)
gacagcuaccuggacgagggcuuccuccuggacaagaagaucggg

SEQ ID NO: 31400 - RNA, 48 nt, Artificial Sequence
  SLAM family member 6 (103-118)
gacaccggcagcuaccgcgcccagaucuccaccaagacgagcgccaag

SEQ ID NO: 31401 - RNA, 39 nt, Artificial Sequence
  SLAM family member 6 (193-205)
gacaccaucaccaucuacagcacgaucaaccacuccaag

SEQ ID NO: 31402 - RNA, 27 nt, Artificial Sequence
  Interferon regulatory factor 9 (104-112)
gacguggccgagcccuacaaggucuac

SEQ ID NO: 31403 - RNA, 45 nt, Artificial Sequence
  HLA class II histocompatibility antigen, DO beta chain (69-83)
gacgugggcauguucgucgcccugaccaagcucgggcagcccgac

SEQ ID NO: 31404 - RNA, 60 nt, Artificial Sequence
  Endoplasmin (783-802)
gacgugggcaccgacgaggaggaggagaccgccaaggagagcacggccgagaaggacgag

SEQ ID NO: 31405 - RNA, 30 nt, Artificial Sequence
  Dynamin-binding protein (46-55)
gacgugaccggccaguuccccagcuccuuc

SEQ ID NO: 31406 - RNA, 48 nt, Artificial Sequence
  Testican-2 (66-81)
gaggacgacuacaucaagagcugggaggacaaccagcagggcgacgag

SEQ ID NO: 31407 - RNA, 27 nt, Artificial Sequence
  Elongator complex protein 3 (321-329)
gaggaccccgaccaggacauccugauc

SEQ ID NO: 31408 - RNA, 51 nt, Artificial Sequence
  SLAM family member 6 (102-118)
gaggacaccggcagcuaccgcgcccagaucuccaccaagacgagcgccaag

SEQ ID NO: 31409 - RNA, 45 nt, Artificial Sequence
  Receptor-type tyrosine-protein phosphatase alpha (384-398)
gaggaguucaagaagcugaccagcaucaagauccagaacgacaag

SEQ ID NO: 31410 - RNA, 27 nt, Artificial Sequence
  ATP-binding cassette sub-family A member 6 (1600-1608)
gaggagaucgacaccaccaugcgcugg

SEQ ID NO: 31411 - RNA, 51 nt, Artificial Sequence
  14-3-3 protein beta/alpha (41-57)
gaggagcgcaaccugcucagcguggccuacaagaacgucgugggcgcccgg

SEQ ID NO: 31412 - RNA, 42 nt, Artificial Sequence
  Ras GTPase-activating-like protein IQGAP1 (61-74)
gaggaggugaucacccugauccgcagcaaccagcagcucgag

SEQ ID NO: 31413 - RNA, 45 nt, Artificial Sequence
  Ras GTPase-activating-like protein IQGAP1 (61-75)
gaggaggugaucacccugauccgcagcaaccagcagcucgagaac

SEQ ID NO: 31414 - RNA, 39 nt, Artificial Sequence
  Glycosyltransferase 8 domain-containing protein 1 (272-284)
gagggccuguacagccgcacccucgccggguccaucacc

SEQ ID NO: 31415 - RNA, 48 nt, Artificial Sequence
  Glycosyltransferase 8 domain-containing protein 1 (272-287)
gagggccuguacagccgcacccucgccggguccaucaccacgcccccg

SEQ ID NO: 31416 - RNA, 39 nt, Artificial Sequence
  Serine incorporator 3 (399-411)
gagggcgugcaguacagcuacucccuguuccaccucaug

SEQ ID NO: 31417 - RNA, 42 nt, Artificial Sequence
  Serine incorporator 3 (399-412)
gagggcgugcaguacagcuacucccuguuccaccucaugcug

SEQ ID NO: 31418 - RNA, 45 nt, Artificial Sequence
  Cystatin-C (47-61)
gagggcgugcgccgggcccuggacuucgccgucggggaguacaac

SEQ ID NO: 31419 - RNA, 48 nt, Artificial Sequence
  Cystatin-C (47-62)
gagggcgugcgccgggcccuggacuucgccgucggggaguacaacaag

SEQ ID NO: 31420 - RNA, 27 nt, Artificial Sequence
  Lysine-specific demethylase 2B (554-562)
gagcacgccgacgacgaccccagccug

SEQ ID NO: 31421 - RNA, 27 nt, Artificial Sequence
  Dynamin-binding protein (916-924)
gagcacagccgcgugcugcagcagcuc

SEQ ID NO: 31422 - RNA, 27 nt, Artificial Sequence
  Endoplasmic reticulum resident protein 44 (277-285)
gagaucuuccagaacgagguggcccgc

SEQ ID NO: 31423 - RNA, 45 nt, Artificial Sequence
  Calsyntenin-1 (203-217)
gagaucaucacccccgacgugccguucaccgucgacaaggacggc

SEQ ID NO: 31424 - RNA, 48 nt, Artificial Sequence
  Perilipin-3 (64-79)
gagaagggcgugcgcacccugaccgccgccgcggucagcggggcccag

SEQ ID NO: 31425 - RNA, 51 nt, Artificial Sequence
  Perilipin-3 (64-80)
gagaagggcgugcgcacccugaccgccgccgcggucagcggggcccagccc

SEQ ID NO: 31426 - RNA, 54 nt, Artificial Sequence
  Perilipin-3 (64-81)
gagaagggcgugcgcacccugaccgccgccgcggucagcggggcccagcccauc

SEQ ID NO: 31427 - RNA, 39 nt, Artificial Sequence
  Glycosyltransferase 8 domain-containing protein 1 (347-359)
gagaagugguacauccccgacccgaccggcaaguucaac

SEQ ID NO: 31428 - RNA, 48 nt, Artificial Sequence
  Testican-2 (316-331)
gagcuggagcgcauccagauccaggaggccgccaagaagaagcccggc

SEQ ID NO: 31429 - RNA, 42 nt, Artificial Sequence
  ATP synthase subunit alpha, mitochondrial (295-308)
gagcuguucuacaagggcauccgccccgccaucaacgugggg

SEQ ID NO: 31430 - RNA, 39 nt, Artificial Sequence
  Alpha-1B-glycoprotein (176-188)
gagcugauccucagcgacgagacccugcccgccccggag

SEQ ID NO: 31431 - RNA, 27 nt, Artificial Sequence
  NACHT, LRR and PYD domains-containing protein 2 (1026-1034)
gagcugaacaagcuccuggaggagauc

SEQ ID NO: 31432 - RNA, 27 nt, Artificial Sequence
  Baculoviral IAP repeat-containing protein 5 (95-103)
gagcugacccucggcgaguuccugaag

SEQ ID NO: 31433 - RNA, 45 nt, Artificial Sequence
  SLAM family member 6 (191-205)
gagaacgacaccaucaccaucuacagcacgaucaaccacuccaag

SEQ ID NO: 31434 - RNA, 60 nt, Artificial Sequence
  SLAM family member 6 (191-210)
gagaacgacaccaucaccaucuacagcacgaucaaccacuccaaggagagcaagcccacc

SEQ ID NO: 31435 - RNA, 45 nt, Artificial Sequence
  Alpha-mannosidase 2 (64-78)
gagaacaacgagaucaucagcaacauccgcgacuccgugaucaac

SEQ ID NO: 31436 - RNA, 24 nt, Artificial Sequence
  Proline-rich protein 12 (830-837)
gagaacgugaacaagaaggacuac

SEQ ID NO: 31437 - RNA, 45 nt, Artificial Sequence
  Low affinity immunoglobulin epsilon Fc receptor (20-34)
gagcagcagcgccugaagagccaggaccucgagcuguccuggaac

SEQ ID NO: 31438 - RNA, 27 nt, Artificial Sequence
  RNA polymerase II subunit A C-terminal domain phosphatase (86-94)
gagcgcgccggcgugguccgggagcug

SEQ ID NO: 31439 - RNA, 39 nt, Artificial Sequence
  Testican-2 (318-330)
gagcgcauccagauccaggaggccgccaagaagaagccc

SEQ ID NO: 31440 - RNA, 42 nt, Artificial Sequence
  Testican-2 (318-331)
gagcgcauccagauccaggaggccgccaagaagaagcccggc

SEQ ID NO: 31441 - RNA, 45 nt, Artificial Sequence
  Testican-2 (318-332)
gagcgcauccagauccaggaggccgccaagaagaagcccggcauc

SEQ ID NO: 31442 - RNA, 48 nt, Artificial Sequence
  14-3-3 protein beta/alpha (42-57)
gagcgcaaccugcucagcguggccuacaagaacgucgugggcgcccgg

SEQ ID NO: 31443 - RNA, 45 nt, Artificial Sequence
  Platelet endothelial cell adhesion molecule (92-106)
gagagcuacuucauccccgaggugcgcaucuacgacuccggcacc

SEQ ID NO: 31444 - RNA, 51 nt, Artificial Sequence
  DnaJ homolog subfamily C member 5 (180-196)
gagaccacccagcugacggccgacagccaccccuccuaccacaccgacggc

SEQ ID NO: 31445 - RNA, 27 nt, Artificial Sequence
  DNA dC-dU-editing enzyme APOBEC-3D (299-307)
gagguggccgaguuccuggcccgccac

SEQ ID NO: 31446 - RNA, 27 nt, Artificial Sequence
  Zinc finger protein 638 (1173-1181)
gaggugaaggaggagaucccccugguc

SEQ ID NO: 31447 - RNA, 48 nt, Artificial Sequence
  Phosphoinositide-3-kinase-interacting protein 1 (127-142)
gaggugcaggucuucgcccccgccaacgcgcugccggcccgcagcgag

SEQ ID NO: 31448 - RNA, 45 nt, Artificial Sequence
  Endoplasmin (359-373)
gaggugaccuucaagagcauccuguucguccccaccuccgccccg

SEQ ID NO: 31449 - RNA, 36 nt, Artificial Sequence
  Fas apoptotic inhibitory molecule 3 (253-264)
gaguacgugagccuguaccaccagcccgccgccaug

SEQ ID NO: 31450 - RNA, 42 nt, Artificial Sequence
  CD44 antigen (7-20)
uucgccggcguguuccacgucgagaagaacgggcgcuacagc

SEQ ID NO: 31451 - RNA, 42 nt, Artificial Sequence
  HLA class II histocompatibility antigen, DM alpha chain (67-80)
uucgacuucagccagaacacccgcgugccccggcugccggag

SEQ ID NO: 31452 - RNA, 69 nt, Artificial Sequence
  Heterogeneous nuclear ribonucleoprotein A1-like 2 (110-132)
uucggcaacuacaacaaccagagcuccaacuucgggcccaugaagggcgggaacuucggcgggcgcagc

SEQ ID NO: 31453 - RNA, 69 nt, Artificial Sequence
  Heterogeneous nuclear ribonucleoprotein A1-like 2 (120-142)
uucggccccaugaaggggggcaacuucgggggccgcagcuccgggccguacggcggcgggggccaguac

SEQ ID NO: 31454 - RNA, 27 nt, Artificial Sequence
  T-cell activation Rho GTPase-activating protein (545-553)
uuccaguacgccaaggagagcuacauc

SEQ ID NO: 31455 - RNA, 27 nt, Artificial Sequence
  Transcription regulator protein BACH2 (345-353)
uucagcaucaccaaguccguggagcug

SEQ ID NO: 31456 - RNA, 27 nt, Artificial Sequence
  Poly (ADP-ribose) polymerase 3 (264-272)
uucuacaccgugaucccccacaacuuc

SEQ ID NO: 31457 - RNA, 30 nt, Artificial Sequence
  RNA polymerase II subunit A C-terminal domain phosphatase (40-49)
ggcgccgccgugcgcaucgggagcguccug

SEQ ID NO: 31458 - RNA, 42 nt, Artificial Sequence
  Protein unc-13 homolog D (1010-1023)
ggcgccgacgaccuggagggggaggccuuccucccccugcgc

SEQ ID NO: 31459 - RNA, 42 nt, Artificial Sequence
  Glycosyltransferase 8 domain-containing protein 1 (79-92)
ggcgccaucgccgcgaucaacagcauccagcacaacacccgc

SEQ ID NO: 31460 - RNA, 36 nt, Artificial Sequence
  HLA class II histocompatibility antigen, DM alpha chain (89-100)
ggcgacgcccccgccauccuguucgacaaggaguuc

SEQ ID NO: 31461 - RNA, 48 nt, Artificial Sequence
  Ceruloplasmin (102-117)
ggcgacaagguguacguccaccugaagaaccucgccagccgccccuac

SEQ ID NO: 31462 - RNA, 51 nt, Artificial Sequence
  Ceruloplasmin (102-118)
ggcgacaagguguacguccaccugaagaaccucgccagccgccccuacacc

SEQ ID NO: 31463 - RNA, 27 nt, Artificial Sequence
  Zinc finger protein 107 (751-759)
ggcgacuacgggcgcgccuucaaccug

SEQ ID NO: 31464 - RNA, 27 nt, Artificial Sequence
  Cell division cycle-associated 7-like protein (377-385)
ggcgaggacgugcgcagcgcccugcuc

SEQ ID NO: 31465 - RNA, 27 nt, Artificial Sequence
  A-kinase anchor protein 2 (435-443)
ggcgaguucaccagcgcccgcgccgug

SEQ ID NO: 31466 - RNA, 27 nt, Artificial Sequence
  E3 ubiquitin-protein ligase Mdm2 (339-347)
ggcgagaucagcgagaaggccaagcug

SEQ ID NO: 31467 - RNA, 39 nt, Artificial Sequence
  MyoD family inhibitor domain-containing protein (68-80)
ggcgagcugauccgcacccagccccagcggcucccgcag

SEQ ID NO: 31468 - RNA, 51 nt, Artificial Sequence
  Transferrin receptor protein 1 (15-31)
ggcgagccccugagcuacacccgcuucucccucgcccggcagguggacggg

SEQ ID NO: 31469 - RNA, 54 nt, Artificial Sequence
  Heterogeneous nuclear ribonucleoprotein A3 (172-189)
ggcgggggcuacgggagcggcgggggcuccggcggguacggcagccgccgguuc

SEQ ID NO: 31470 - RNA, 36 nt, Artificial Sequence
  Heterogeneous nuclear ribonucleoprotein A3 (159-170)
ggcgggagcuucggcgggcgcuccagcggcuccccc

SEQ ID NO: 31471 - RNA, 27 nt, Artificial Sequence
  Probable ATP-dependent RNA helicase DDX46 (366-374)
ggcaucgccaagaccgggagcggcaag

SEQ ID NO: 31472 - RNA, 36 nt, Artificial Sequence
  Kynureninase (432-443)
ggcauccgcguggcccccgucccgcuguacaacagc

SEQ ID NO: 31473 - RNA, 42 nt, Artificial Sequence
  Kynureninase (432-445)
ggcauccgcguggcccccgucccgcuguacaacagcuuccac

SEQ ID NO: 31474 - RNA, 39 nt, Artificial Sequence
  Peroxiredoxin-1 (129-141)
ggccuguucaucaucgacgacaaggggauccuccgccag

SEQ ID NO: 31475 - RNA, 45 nt, Artificial Sequence
  Peroxiredoxin-1 (129-143)
ggccuguucaucaucgacgacaaggggauccuccgccagaucacc

SEQ ID NO: 31476 - RNA, 39 nt, Artificial Sequence
  Peroxisomal multifunctional enzyme type 2 (20-32)
ggccuggggcgcgccuacgcccucgcguucgccgagcgg

SEQ ID NO: 31477 - RNA, 42 nt, Artificial Sequence
  Peroxisomal multifunctional enzyme type 2 (20-33)
ggccuggggcgcgccuacgcccucgcguucgccgagcggggc

SEQ ID NO: 31478 - RNA, 45 nt, Artificial Sequence
  Ragulator complex protein LAMTOR3 (18-32)
ggccugcacgccaucguggucagcgaccgcgacggggugcccgug

SEQ ID NO: 31479 - RNA, 51 nt, Artificial Sequence
  Ragulator complex protein LAMTOR3 (18-34)
ggccugcacgccaucguggucagcgaccgcgacggggugcccgugaucaag

SEQ ID NO: 31480 - RNA, 42 nt, Artificial Sequence
  Interleukin-4 receptor subunit alpha (192-205)
ggcaaccccgccuaccgcagcuucuccaacagccugucccag

SEQ ID NO: 31481 - RNA, 51 nt, Artificial Sequence
  Polypeptide N-acetylgalactosaminyltransferase 1 (404-420)
ggcaaccagguguucagcuacaccgccaacaaggagauccgcaccgacgac

SEQ ID NO: 31482 - RNA, 36 nt, Artificial Sequence
  Fibromodulin (4-15)
ggcaaccgcaucaacgaguucagcaucuccagcuuc

SEQ ID NO: 31483 - RNA, 45 nt, Artificial Sequence
  Pericentriolar material 1 protein (1456-1470)
ggcaacaccgugauccaccuggaccaggcccucgcccgcaugcgg

SEQ ID NO: 31484 - RNA, 42 nt, Artificial Sequence
  CD44 antigen (141-154)
ggccccaucaccaucaccaucgugaaccgcgacgggacgcgg

SEQ ID NO: 31485 - RNA, 27 nt, Artificial Sequence
  Probable ribosome biogenesis protein RLP24 (11-19)
ggccccaucuacccggggcacggcaug

SEQ ID NO: 31486 - RNA, 45 nt, Artificial Sequence
  Cation-independent mannose-6-phosphate receptor (972-986)
ggcccccugaaguuccuccaccaggacaucgacagcgggcagggc

SEQ ID NO: 31487 - RNA, 51 nt, Artificial Sequence
  Cation-independent mannose-6-phosphate receptor (972-988)
ggcccccugaaguuccuccaccaggacaucgacagcgggcagggcauccgc

SEQ ID NO: 31488 - RNA, 45 nt, Artificial Sequence
  Heterogeneous nuclear ribonucleoprotein A1-like 2 (121-135)
ggccccaugaaggggggcaacuucgggggccgcagcuccgggccg

SEQ ID NO: 31489 - RNA, 39 nt, Artificial Sequence
  Protein CDV3 homolog (83-95)
ggccccccggagaucuacagcgacacccaguuccccucc

SEQ ID NO: 31490 - RNA, 45 nt, Artificial Sequence
  Protein CDV3 homolog (83-97)
ggccccccggagaucuacagcgacacccaguuccccucccugcag

SEQ ID NO: 31491 - RNA, 48 nt, Artificial Sequence
  Interleukin-4 receptor subunit alpha (295-310)
ggccccccgggggaggccggcuacaaggccuucagcucccugcucgcg

SEQ ID NO: 31492 - RNA, 54 nt, Artificial Sequence
  Interleukin-4 receptor subunit alpha (295-312)
ggccccccgggggaggccggcuacaaggccuucagcucccugcucgcgagcucc

SEQ ID NO: 31493 - RNA, 57 nt, Artificial Sequence
  Interleukin-4 receptor subunit alpha (295-313)
ggccccccgggggaggccggcuacaaggccuucagcucccugcucgcgagcuccgcc

SEQ ID NO: 31494 - RNA, 69 nt, Artificial Sequence
  Interleukin-4 receptor subunit alpha (295-317)
ggccccccgggggaggccggcuacaaggccuucagcucccugcucgcgagcuccgccgugagccccgag

SEQ ID NO: 31495 - RNA, 72 nt, Artificial Sequence
  Interleukin-4 receptor subunit alpha (295-318)
ggccccccgggggaggccggcuacaaggccuucagcucccugcucgcgagcuccgccgugagccccgagaag

SEQ ID NO: 31496 - RNA, 30 nt, Artificial Sequence
  Ubiquitin-like protein 7 (263-272)
ggcccccgcccgaucacccagagcgagcug

SEQ ID NO: 31497 - RNA, 39 nt, Artificial Sequence
  Heterogeneous nuclear ribonucleoprotein A1-like 2 (134-146)
ggccccuacgggggcgggggccaguacuucgccaagccg

SEQ ID NO: 31498 - RNA, 48 nt, Artificial Sequence
  60S ribosomal protein L3 (136-151)
ggccagggguaccugaucaaggacggcaagcucaucaagaacaacgcc

SEQ ID NO: 31499 - RNA, 27 nt, Artificial Sequence
  Glycosylphosphatidylinositol anchor attachment 1 protein (448-456)
ggccagcacguggccacccagcacuuc

SEQ ID NO: 31500 - RNA, 27 nt, Artificial Sequence
  AT-rich interactive domain-containing protein 5B (138-146)
ggccagaaggaggcccugcucaaguac

SEQ ID NO: 31501 - RNA, 39 nt, Artificial Sequence
  ATP synthase subunit alpha, mitochondrial (147-159)
ggccagaagcgcagcaccguggcccagcuggucaagcgg

SEQ ID NO: 31502 - RNA, 30 nt, Artificial Sequence
  A-kinase anchor protein 2 (343-352)
ggccagagcaccccccgccuguucuccauc

SEQ ID NO: 31503 - RNA, 27 nt, Artificial Sequence
  Transcription regulator protein BACH2 (68-76)
ggccagaccaagaacgaccuggugguc

SEQ ID NO: 31504 - RNA, 42 nt, Artificial Sequence
  B- and T-lymphocyte attenuator (193-206)
ggccgcgagaucaaccugguggacgcccaccucaagagcgag

SEQ ID NO: 31505 - RNA, 30 nt, Artificial Sequence
  Ras-specific guanine nucleotide-releasing factor 1 (386-395)
ggccgcuucaagaaccugcgggaggcccuc

SEQ ID NO: 31506 - RNA, 27 nt, Artificial Sequence
  Protein asunder homolog (674-682)
ggccgccugaacagcgugaacaaccgg

SEQ ID NO: 31507 - RNA, 27 nt, Artificial Sequence
  Probable ribonuclease ZC3H12D (383-391)
ggccgcgugcccgggccgcugagccuc

SEQ ID NO: 31508 - RNA, 42 nt, Artificial Sequence
  Carbohydrate sulfotransferase 2 (176-189)
ggcagcuccuucuucggggagcuguucaaccagaaccccgag

SEQ ID NO: 31509 - RNA, 42 nt, Artificial Sequence
  SLAM family member 6 (105-118)
ggcagcuaccgcgcccagaucuccaccaagaccagcgccaag

SEQ ID NO: 31510 - RNA, 36 nt, Artificial Sequence
  Plasma membrane calcium-transporting ATPase 1 (258-269)
ggcagcuaccgcaucuucuccaagggggccagcgag

SEQ ID NO: 31511 - RNA, 30 nt, Artificial Sequence
  Kelch-like ECH-associated protein 1 (419-428)
ggcgugaucgacgggcacaucuacgccguc

SEQ ID NO: 31512 - RNA, 36 nt, Artificial Sequence
  Serine incorporator 3 (400-411)
ggcgugcaguacagcuacucccuguuccaccucaug

SEQ ID NO: 31513 - RNA, 39 nt, Artificial Sequence
  Serine incorporator 3 (400-412)
ggcgugcaguacagcuacucccuguuccaccucaugcug

SEQ ID NO: 31514 - RNA, 48 nt, Artificial Sequence
  Interleukin-4 receptor subunit alpha (301-316)
ggcuacaaggccuucagcucccugcucgccagcuccgcggugagcccc

SEQ ID NO: 31515 - RNA, 51 nt, Artificial Sequence
  Interleukin-4 receptor subunit alpha (301-317)
ggcuacaaggccuucagcucccugcucgccagcuccgcggugagccccgag

SEQ ID NO: 31516 - RNA, 27 nt, Artificial Sequence
  Dystrophin (325-333)
ggcuaccugcccgugcagaccguccuc

SEQ ID NO: 31517 - RNA, 39 nt, Artificial Sequence
  Ragulator complex protein LAMTOR3 (20-32)
cacgccaucguggucagcgaccgcgacggcgugcccgug

SEQ ID NO: 31518 - RNA, 27 nt, Artificial Sequence
  HLA class II histocompatibility antigen, DM alpha chain (87-95)
cacgagaucgaccgcuacaccgccauc

SEQ ID NO: 31519 - RNA, 27 nt, Artificial Sequence
  Elongator complex protein 3 (261-269)
cacggcaaccugcgcgagcucgcccug

SEQ ID NO: 31520 - RNA, 42 nt, Artificial Sequence
  Fibromodulin (137-150)
cacggcaaccagaucaccagcgacaagguggggcgcaagguc

SEQ ID NO: 31521 - RNA, 30 nt, Artificial Sequence
  Poly (ADP-ribose) polymerase 3 (457-466)
caccacaucaacaccgacaaccccagccug

SEQ ID NO: 31522 - RNA, 27 nt, Artificial Sequence
  DmX-like protein 1 (888-896)
caccugaagagcauccccgugucccuc

SEQ ID NO: 31523 - RNA, 27 nt, Artificial Sequence
  Cyclin-dependent kinase 14 (229-237)
caccccgacaacgugaagcuguuccuc

SEQ ID NO: 31524 - RNA, 42 nt, Artificial Sequence
  Ceramide glucosyltransferase (193-206)
cacccccgcuacuacaucagcgccaacgugaccggcuucaag

SEQ ID NO: 31525 - RNA, 42 nt, Artificial Sequence
  Beta-1,4-galactosyltransferase 1 (199-212)
caccccgugcugcagcgccagcagcucgacuacggcaucuac

SEQ ID NO: 31526 - RNA, 27 nt, Artificial Sequence
  Hematopoietic SH2 domain-containing protein (64-72)
cacgugggcuacacccugagcuacaag

SEQ ID NO: 31527 - RNA, 27 nt, Artificial Sequence
  Cytoskeleton-associated protein 4 (129-137)
cacgugcuggaggagguccagcaggug

SEQ ID NO: 31528 - RNA, 45 nt, Artificial Sequence
  Voltage-dependent anion-selective channel protein 2 (221-235)
aucgccgccaaguaccagcuggaccccaccgcgagcaucuccgcc

SEQ ID NO: 31529 - RNA, 48 nt, Artificial Sequence
  Voltage-dependent anion-selective channel protein 2 (221-236)
aucgccgccaaguaccagcuggaccccaccgcgagcaucuccgccaag

SEQ ID NO: 31530 - RNA, 42 nt, Artificial Sequence
  14-3-3 protein zeta/delta (61-74)
aucgccgagcuggacacccucagcgaggaguccuacaaggac

SEQ ID NO: 31531 - RNA, 45 nt, Artificial Sequence
  14-3-3 protein zeta/delta (61-75)
aucgccgagcuggacacccucagcgaggaguccuacaaggacagc

SEQ ID NO: 31532 - RNA, 36 nt, Artificial Sequence
  Golgi apparatus protein 1 (362-373)
aucgcccaggacuacaaggugagcuacucccuggcc

SEQ ID NO: 31533 - RNA, 39 nt, Artificial Sequence
  Golgi apparatus protein 1 (362-374)
aucgcccaggacuacaaggugagcuacucccuggccaag

SEQ ID NO: 31534 - RNA, 27 nt, Artificial Sequence
  Perilipin-2 (313-321)
aucgcccgcaaccugacccagcagcuc

SEQ ID NO: 31535 - RNA, 45 nt, Artificial Sequence
  60S ribosomal protein L3 (216-230)
aucgacaccaccagcaaguucggccacgggcgcuuccagacgaug

SEQ ID NO: 31536 - RNA, 57 nt, Artificial Sequence
  60S ribosomal protein L3 (65-83)
aucgacgugaucggcgucaccaaggggaagggcuacaagggggugaccagccgcugg

SEQ ID NO: 31537 - RNA, 30 nt, Artificial Sequence
  Plexin-B3 (1741-1750)
aucgaggaccccggcacccugcacaucugg

SEQ ID NO: 31538 - RNA, 42 nt, Artificial Sequence
  Polypeptide N-acetylgalactosaminyltransferase 1 (88-101)
aucgaggagaucgugcuggucgacgacgccagcgagcgcgac

SEQ ID NO: 31539 - RNA, 45 nt, Artificial Sequence
  Polypeptide N-acetylgalactosaminyltransferase 1 (88-102)
aucgaggagaucgugcuggucgacgacgccagcgagcgcgacuuc

SEQ ID NO: 31540 - RNA, 27 nt, Artificial Sequence
  Perilipin-2 (306-314)
aucgagagccgcacccuggccaucgcc

SEQ ID NO: 31541 - RNA, 45 nt, Artificial Sequence
  Ras-related protein Rab-11A (44-58)
aucggcguggaguucgccacccgcagcauccaggucgacgggaag

SEQ ID NO: 31542 - RNA, 27 nt, Artificial Sequence
  Elongation factor Tu, mitochondrial (171-179)
aucggcguggagcacgucgugguguac

SEQ ID NO: 31543 - RNA, 42 nt, Artificial Sequence
  Calsyntenin-1 (204-217)
aucaucacccccgacgugccguucaccgucgacaaggacggc

SEQ ID NO: 31544 - RNA, 48 nt, Artificial Sequence
  Fas apoptotic inhibitory molecule 3 (68-83)
aucaaggccgaguacaagggccgcgugacccugaagcaguacccccgg

SEQ ID NO: 31545 - RNA, 24 nt, Artificial Sequence
  Dynamin-binding protein (527-534)
aucaaggugagcaagcagcugcuc

SEQ ID NO: 31546 - RNA, 27 nt, Artificial Sequence
  ATP-binding cassette sub-family A member 6 (1270-1278)
auccuggacgagaagcccgugaucauc

SEQ ID NO: 31547 - RNA, 27 nt, Artificial Sequence
  DNA dC-dU-editing enzyme APOBEC-3D (26-34)
auccuguacggccgcagcuacaccugg

SEQ ID NO: 31548 - RNA, 45 nt, Artificial Sequence
  Vesicle-associated membrane protein 3 (28-42)
aucaugcgcgugaacgucgacaaggugcuggagcgggaccagaag

SEQ ID NO: 31549 - RNA, 39 nt, Artificial Sequence
  Receptor-type tyrosine-protein phosphatase alpha (79-91)
aucaaccgccggauggccgacgacaacaagcuguuccgc

SEQ ID NO: 31550 - RNA, 42 nt, Artificial Sequence
  Protocadherin-9 (157-170)
aucaacagccgcuuccccaucccguccgccaccgaccccgac

SEQ ID NO: 31551 - RNA, 48 nt, Artificial Sequence
  Ras GTPase-activating-like protein IQGAP1 (232-247)
auccccgccgacaccuucgccgcgcugaagaacccgaacgccaugcuc

SEQ ID NO: 31552 - RNA, 36 nt, Artificial Sequence
  Platelet endothelial cell adhesion molecule (96-107)
auccccgaggugcgcaucuacgacagcggcaccuac

SEQ ID NO: 31553 - RNA, 27 nt, Artificial Sequence
  NACHT, LRR and PYD domains-containing protein 2 (193-201)
auccccuucagcaacccgcgcgugcug

SEQ ID NO: 31554 - RNA, 42 nt, Artificial Sequence
  Fibromodulin (308-321)
auccccccggugaacaccaaccuggagaaccucuaccugcag

SEQ ID NO: 31555 - RNA, 24 nt, Artificial Sequence
  Eukaryotic translation initiation factor 6 (46-53)
auccccgugguccacgccagcauc

SEQ ID NO: 31556 - RNA, 27 nt, Artificial Sequence
  Monoglyceride lipase (24-32)
auccccuaccaggaccugccgcaccuc

SEQ ID NO: 31557 - RNA, 27 nt, Artificial Sequence
  Methyltransferase-like protein 7A (225-233)
auccaggccccccugagcugggagcuc

SEQ ID NO: 31558 - RNA, 27 nt, Artificial Sequence
  Cyclin-dependent kinase 14 (264-272)
aucagcgacaccggcgagcugaagcuc

SEQ ID NO: 31559 - RNA, 27 nt, Artificial Sequence
  Probable ATP-dependent RNA helicase DDX46 (331-339)
aucagcaugaagauccugaacucccuc

SEQ ID NO: 31560 - RNA, 48 nt, Artificial Sequence
  Low affinity immunoglobulin epsilon Fc receptor (10-25)
aucagccaggagcuggaggagcuccgcgccgagcagcagcggcugaag

SEQ ID NO: 31561 - RNA, 42 nt, Artificial Sequence
  Golgi apparatus protein 1 (553-566)
aucagccgcgacuggaagcuggaccccgugcucuaccggaag

SEQ ID NO: 31562 - RNA, 24 nt, Artificial Sequence
  B-lymphocyte antigen CD19 (274-281)
aucaccgcccgccccgugcugugg

SEQ ID NO: 31563 - RNA, 27 nt, Artificial Sequence
  Zinc finger protein 107 (139-147)
aaggccuucaacugguucagcacccug

SEQ ID NO: 31564 - RNA, 45 nt, Artificial Sequence
  Interleukin-4 receptor subunit alpha (303-317)
aaggccuucagcucccugcucgccagcuccgcggugagccccgag

SEQ ID NO: 31565 - RNA, 42 nt, Artificial Sequence
  Platelet endothelial cell adhesion molecule (274-287)
aaggacaaggccaucguggcccacaaccgccacggcaacaag

SEQ ID NO: 31566 - RNA, 45 nt, Artificial Sequence
  Platelet endothelial cell adhesion molecule (274-288)
aaggacaaggccaucguggcccacaaccgccacggcaacaaggcg

SEQ ID NO: 31567 - RNA, 27 nt, Artificial Sequence
  Endoplasmic reticulum resident protein 44 (336-344)
aaggacgugcugauccccggcaagcuc

SEQ ID NO: 31568 - RNA, 27 nt, Artificial Sequence
  Cytoskeleton-associated protein 4 (71-79)
aaggaggccgccgacaccgagcgccug

SEQ ID NO: 31569 - RNA, 33 nt, Artificial Sequence
  Uncharacterized protein CXorf21 (31-41)
aaggaggaggagaccaacagcguggccacccug

SEQ ID NO: 31570 - RNA, 24 nt, Artificial Sequence
  Negative elongation factor E (373-380)
aaggagaaccugguggacggcuuc

SEQ ID NO: 31571 - RNA, 27 nt, Artificial Sequence
  Cell division cycle-associated 7-like protein (280-288)
aaguucgccgaggaguucuacagcuuc

SEQ ID NO: 31572 - RNA, 42 nt, Artificial Sequence
  IgG receptor FcRn large subunit p51 (132-145)
aaguucgcccugaacggcgaggaguucaugaacuucgaccuc

SEQ ID NO: 31573 - RNA, 36 nt, Artificial Sequence
  Heterogeneous nuclear ribonucleoprotein A1-like 2 (124-135)
aagggcgggaacuucggcgggcgcagcuccggcccc

SEQ ID NO: 31574 - RNA, 39 nt, Artificial Sequence
  Heterogeneous nuclear ribonucleoprotein A3 (158-170)
aagggcgggagcuucggcgggcgcuccagcggcuccccc

SEQ ID NO: 31575 - RNA, 36 nt, Artificial Sequence
  Low affinity immunoglobulin epsilon Fc receptor (101-112)
aagggcaccaagcagugggugcacgcccgcuacgcc

SEQ ID NO: 31576 - RNA, 42 nt, Artificial Sequence
  Perilipin-3 (65-78)
aagggcgugcgcacccugaccgccgccgcggucagcggggcc

SEQ ID NO: 31577 - RNA, 45 nt, Artificial Sequence
  Perilipin-3 (65-79)
aagggcgugcgcacccugaccgccgccgcggucagcggggcccag

SEQ ID NO: 31578 - RNA, 30 nt, Artificial Sequence
  B-cell linker protein (6-15)
aagaucaccgugcccgccagccagaagcug

SEQ ID NO: 31579 - RNA, 27 nt, Artificial Sequence
  Afadin- and alpha-actinin-binding protein (328-336)
aagcuggacaaccaggugagcaagguc

SEQ ID NO: 31580 - RNA, 30 nt, Artificial Sequence
  B-lymphocyte antigen CD19 (150-159)
aagcugaugagccccaagcucuacgugugg

SEQ ID NO: 31581 - RNA, 54 nt, Artificial Sequence
  Ragulator complex protein LAMTOR3 (12-29)
aagcugcccagcguggagggccuccacgccaucgucguguccgaccgcgacggg

SEQ ID NO: 31582 - RNA, 30 nt, Artificial Sequence
  RNA polymerase II subunit A C-terminal domain phosphatase (238-247)
aagcuguacgagcuccacguguucaccuuc

SEQ ID NO: 31583 - RNA, 27 nt, Artificial Sequence
  Ubiquitin-like protein 7 (100-108)
aagcccgagccgguggacaaggucgcc

SEQ ID NO: 31584 - RNA, 45 nt, Artificial Sequence
  B- and T-lymphocyte attenuator (252-266)
aagcccggcaucguguacgccagccugaaccacuccgucaucggg

SEQ ID NO: 31585 - RNA, 27 nt, Artificial Sequence
  hematopoietic SH2 domain-containing protein isoform X7 (112-120)
aagcccaucgagccgcgccgggagcug

SEQ ID NO: 31586 - RNA, 27 nt, Artificial Sequence
  Dynamin-binding protein (183-191)
aagccccgccagagcuccccgcagcug

SEQ ID NO: 31587 - RNA, 27 nt, Artificial Sequence
  AT-rich interactive domain-containing protein 5B (518-526)
aagcccagcgaggagcgcaagaccauc

SEQ ID NO: 31588 - RNA, 27 nt, Artificial Sequence
  Plateletoprotein 4 (394-402)
aagcccagcgagaagauccaggugcug

SEQ ID NO: 31589 - RNA, 27 nt, Artificial Sequence
  Zinc finger protein 638 (538-546)
aagcccaccagcgcccgcuccggccug

SEQ ID NO: 31590 - RNA, 27 nt, Artificial Sequence
  Dynamin-binding protein (531-539)
aagcagcugcucgccgcccuggagauc

SEQ ID NO: 31591 - RNA, 27 nt, Artificial Sequence
  AT-rich interactive domain-containing protein 5B (171-179)
aagcagacccccaaggugcuggucgug

SEQ ID NO: 31592 - RNA, 27 nt, Artificial Sequence
  Dystrophin (152-160)
aagcagguggccagcuccaccggcuuc

SEQ ID NO: 31593 - RNA, 39 nt, Artificial Sequence
  Endoplasmin (72-84)
aagagcgagaaguucgccuuccaggccgaggugaaccgc

SEQ ID NO: 31594 - RNA, 30 nt, Artificial Sequence
  Probable ATP-dependent RNA helicase DDX46 (374-383)
aagaccaucgccuuccugcuccccauguuc

SEQ ID NO: 31595 - RNA, 27 nt, Artificial Sequence
  T-cell activation Rho GTPase-activating protein (56-64)
aaggugcugagcuggcccuuccucaug

SEQ ID NO: 31596 - RNA, 30 nt, Artificial Sequence
  Cyclin-dependent kinase 14 (155-164)
aaggugaacggcaagcuggucgcccucaag

SEQ ID NO: 31597 - RNA, 27 nt, Artificial Sequence
  DmX-like protein 1 (194-202)
aaggugugguacaacgucgagaacugg

SEQ ID NO: 31598 - RNA, 30 nt, Artificial Sequence
  Zinc finger protein 638 (730-739)
aaguacaucgagaccaccccccugacgauc

SEQ ID NO: 31599 - RNA, 42 nt, Artificial Sequence
  Alpha-1B-glycoprotein (204-217)
cuggccccccucgagggcgcccgcuucgcgcuggugcgggag

SEQ ID NO: 31600 - RNA, 45 nt, Artificial Sequence
  Alpha-1B-glycoprotein (204-218)
cuggccccccucgagggcgcccgcuucgcgcuggugcgggaggac

SEQ ID NO: 31601 - RNA, 45 nt, Artificial Sequence
  Transmembrane protein C16orf54 (117-131)
cuggaggcccgcgccaccgcgcccccggcccccagcgcccccaac

SEQ ID NO: 31602 - RNA, 27 nt, Artificial Sequence
  T-cell activation Rho GTPase-activating protein (66-74)
cuggagaacgaccagagccucuccuuc

SEQ ID NO: 31603 - RNA, 39 nt, Artificial Sequence
  Polypeptide N-acetylgalactosaminyltransferase 1 (355-367)
cuggagaacaucuaccccgacagccagaucccgcgccac

SEQ ID NO: 31604 - RNA, 42 nt, Artificial Sequence
  Polypeptide N-acetylgalactosaminyltransferase 1 (355-368)
cuggagaacaucuaccccgacagccagaucccgcgccacuac

SEQ ID NO: 31605 - RNA, 27 nt, Artificial Sequence
  Uncharacterized protein CXorf21 (214-222)
cuggagcagaagguggucgagcucuac

SEQ ID NO: 31606 - RNA, 30 nt, Artificial Sequence
  Cadherin EGF LAG seven-pass G-type receptor 1 (2401-2410)
cuggagguggaggagcgcaccaagcccguc

SEQ ID NO: 31607 - RNA, 39 nt, Artificial Sequence
  Cation-independent mannose-6-phosphate receptor (2073-2085)
cugggcgacaucuacuucaagcucuuccgcgccagcggg

SEQ ID NO: 31608 - RNA, 42 nt, Artificial Sequence
  Ragulator complex protein LAMTOR3 (19-32)
cugcacgccaucguggucagcgaccgcgacggcgugcccgug

SEQ ID NO: 31609 - RNA, 45 nt, Artificial Sequence
  Ragulator complex protein LAMTOR3 (19-33)
cugcacgccaucguggucagcgaccgcgacggcgugcccgugauc

SEQ ID NO: 31610 - RNA, 48 nt, Artificial Sequence
  Ragulator complex protein LAMTOR3 (19-34)
cugcacgccaucguggucagcgaccgcgacggcgugcccgugaucaag

SEQ ID NO: 31611 - RNA, 39 nt, Artificial Sequence
  Golgi apparatus protein 1 (361-373)
cugaucgcccaggacuacaaggugagcuacucccucgcc

SEQ ID NO: 31612 - RNA, 45 nt, Artificial Sequence
  Ras GTPase-activating-like protein IQGAP1 (347-361)
cugaagcagcuccugagcgacaagcagcagaagcgccaguccggc

SEQ ID NO: 31613 - RNA, 48 nt, Artificial Sequence
  Ras GTPase-activating-like protein IQGAP1 (347-362)
cugaagcagcuccugagcgacaagcagcagaagcgccaguccggccag

SEQ ID NO: 31614 - RNA, 30 nt, Artificial Sequence
  NACHT, LRR and PYD domains-containing protein 2 (823-832)
cugcucgacgagggcgccaagcugcuguac

SEQ ID NO: 31615 - RNA, 39 nt, Artificial Sequence
  Beta-1,4-galactosyltransferase 1 (112-124)
cugaacagccucaccuaccaggugcuggacguccagcgc

SEQ ID NO: 31616 - RNA, 45 nt, Artificial Sequence
  Beta-1,4-galactosyltransferase 1 (112-126)
cugaacagccucaccuaccaggugcuggacguccagcgcuacccc

SEQ ID NO: 31617 - RNA, 48 nt, Artificial Sequence
  Beta-1,4-galactosyltransferase 1 (112-127)
cugaacagccucaccuaccaggugcuggacguccagcgcuacccccug

SEQ ID NO: 31618 - RNA, 45 nt, Artificial Sequence
  Fas apoptotic inhibitory molecule 3 (120-134)
cugaacgugcacagcgaguacgagcccuccugggaggagcagccg

SEQ ID NO: 31619 - RNA, 45 nt, Artificial Sequence
  Phosphoinositide-3-kinase-interacting protein 1 (137-151)
cugcccgcccgcagcgaggccgcggccgugcagccggucaucggc

SEQ ID NO: 31620 - RNA, 27 nt, Artificial Sequence
  DmX-like protein 1 (1557-1565)
cugcccgccuaccgcgcccagcuccug

SEQ ID NO: 31621 - RNA, 42 nt, Artificial Sequence
  Putative endoplasmin-like protein (219-232)
cugcccgaguucgacggcaagcgcuuccagaacguggccaag

SEQ ID NO: 31622 - RNA, 36 nt, Artificial Sequence
  Cullin-associated NEDD8-dissociated protein 1 (297-308)
cugcccgaguucuacaagaccgugagcccggcccuc

SEQ ID NO: 31623 - RNA, 27 nt, Artificial Sequence
  TBC1 domain family member 22A (121-129)
cugccccacagcgccaccgugacccuc

SEQ ID NO: 31624 - RNA, 36 nt, Artificial Sequence
  Glycosyltransferase 8 domain-containing protein 1 (157-168)
cugcccauccucgugccgagcgccaagaaggccauc

SEQ ID NO: 31625 - RNA, 39 nt, Artificial Sequence
  Glycosyltransferase 8 domain-containing protein 1 (157-169)
cugcccauccucgugccgagcgccaagaaggccaucuac

SEQ ID NO: 31626 - RNA, 42 nt, Artificial Sequence
  Glycosyltransferase 8 domain-containing protein 1 (157-170)
cugcccauccucgugccgagcgccaagaaggccaucuacaug

SEQ ID NO: 31627 - RNA, 45 nt, Artificial Sequence
  Glycosyltransferase 8 domain-containing protein 1 (157-171)
cugcccauccucgugccgagcgccaagaaggccaucuacauggac

SEQ ID NO: 31628 - RNA, 48 nt, Artificial Sequence
  Glycosyltransferase 8 domain-containing protein 1 (157-172)
cugcccauccucgugccgagcgccaagaaggccaucuacauggacgac

SEQ ID NO: 31629 - RNA, 27 nt, Artificial Sequence
  ATP-binding cassette sub-family A member 6 (899-907)
cugccccaggagccgcgcaccagccuc

SEQ ID NO: 31630 - RNA, 39 nt, Artificial Sequence
  Beta-1,4-galactosyltransferase 1 (50-62)
cugccccagcucgugggcgucagcaccccgcugcagggg

SEQ ID NO: 31631 - RNA, 42 nt, Artificial Sequence
  Beta-1,4-galactosyltransferase 1 (50-63)
cugccccagcucgugggcgucagcaccccgcugcaggggggc

SEQ ID NO: 31632 - RNA, 45 nt, Artificial Sequence
  Beta-1,4-galactosyltransferase 1 (50-64)
cugccccagcucgugggcgucagcaccccgcugcaggggggcucc

SEQ ID NO: 31633 - RNA, 27 nt, Artificial Sequence
  Proline and serine-rich protein 2 (219-227)
cugccccgcccgcagggcaucaccgug

SEQ ID NO: 31634 - RNA, 42 nt, Artificial Sequence
  Pro-cathepsin H (48-61)
cugcccagccaggccuucgaguacauccucuacaacaagggc

SEQ ID NO: 31635 - RNA, 45 nt, Artificial Sequence
  Pro-cathepsin H (48-62)
cugcccagccaggccuucgaguacauccucuacaacaagggcauc

SEQ ID NO: 31636 - RNA, 48 nt, Artificial Sequence
  Pro-cathepsin H (48-63)
cugcccagccaggccuucgaguacauccucuacaacaagggcaucaug

SEQ ID NO: 31637 - RNA, 51 nt, Artificial Sequence
  Pro-cathepsin H (48-64)
cugcccagccaggccuucgaguacauccucuacaacaagggcaucaugggg

SEQ ID NO: 31638 - RNA, 45 nt, Artificial Sequence
  Ragulator complex protein LAMTOR3 (13-27)
cugcccagcguggagggccuccacgccaucgucguguccgaccgc

SEQ ID NO: 31639 - RNA, 42 nt, Artificial Sequence
  Fas apoptotic inhibitory molecule 3 (32-45)
cugcccuaccucuuccagaugccggccuacgccagcuccagc

SEQ ID NO: 31640 - RNA, 45 nt, Artificial Sequence
  Fas apoptotic inhibitory molecule 3 (32-46)
cugcccuaccucuuccagaugccggccuacgccagcuccagcaag

SEQ ID NO: 31641 - RNA, 39 nt, Artificial Sequence
  Fibromodulin (27-39)
cugcaggugcuccgccuggacggcaacgagaucaagcgg

SEQ ID NO: 31642 - RNA, 42 nt, Artificial Sequence
  Fibromodulin (27-40)
cugcaggugcuccgccuggacggcaacgagaucaagcggagc

SEQ ID NO: 31643 - RNA, 45 nt, Artificial Sequence
  Fibromodulin (27-41)
cugcaggugcuccgccuggacggcaacgagaucaagcggagcgcc

SEQ ID NO: 31644 - RNA, 48 nt, Artificial Sequence
  Fibromodulin (178-193)
cugcgcgagcuccaccuggaccacaaccagaucagccgggugcccaac

SEQ ID NO: 31645 - RNA, 27 nt, Artificial Sequence
  DmX-like protein 1 (2001-2009)
cugagcgagcagaccuccgugccccuc

SEQ ID NO: 31646 - RNA, 24 nt, Artificial Sequence
  Transcription regulator protein BACH2 (709-716)
cugagccaggaggugugccgcgac

SEQ ID NO: 31647 - RNA, 36 nt, Artificial Sequence
  Testican-2 (45-56)
cugagcuccaucagccaguacuccggcaagaucaag

SEQ ID NO: 31648 - RNA, 24 nt, Artificial Sequence
  Baculoviral IAP repeat-containing protein 5 (96-103)
cugacccucggcgaguuccugaag

SEQ ID NO: 31649 - RNA, 27 nt, Artificial Sequence
  Baculoviral IAP repeat-containing protein 5 (96-104)
cugacccucggcgaguuccugaagcug

SEQ ID NO: 31650 - RNA, 24 nt, Artificial Sequence
  ATP-binding cassette sub-family A member 6 (1544-1551)
cugaccuacaagcuccccguggcc

SEQ ID NO: 31651 - RNA, 24 nt, Artificial Sequence
  A-kinase anchor protein 2 (561-568)
cugguggacgacccccucgaguac

SEQ ID NO: 31652 - RNA, 27 nt, Artificial Sequence
  RNA polymerase II subunit A C-terminal domain phosphatase (239-247)
cuguacgagcuccacguguucaccuuc

SEQ ID NO: 31653 - RNA, 42 nt, Artificial Sequence
  Fibromodulin (271-284)
cuguacgugcgccucagccacaacucccugaccaacaacggc

SEQ ID NO: 31654 - RNA, 45 nt, Artificial Sequence
  60S ribosomal protein L3 (237-251)
augggcccccugaagaaggaccgcaucgccaaggaggagggggcc

SEQ ID NO: 31655 - RNA, 39 nt, Artificial Sequence
  Pro-cathepsin H (222-234)
augaacggcuacuuccugaucgagcgcgggaagaacaug

SEQ ID NO: 31656 - RNA, 27 nt, Artificial Sequence
  Ras-specific guanine nucleotide-releasing factor 1 (773-781)
augagccccuucuccaaggccacccug

SEQ ID NO: 31657 - RNA, 30 nt, Artificial Sequence
  Perilipin-2 (62-71)
augaccagcgcccugcccaucauccagaag

SEQ ID NO: 31658 - RNA, 27 nt, Artificial Sequence
  RUN and FYVE domain-containing protein 1 (291-299)
auguacagcgacguguggaagcagcug

SEQ ID NO: 31659 - RNA, 45 nt, Artificial Sequence
  Heterogeneous nuclear ribonucleoprotein A1-like 2 (108-122)
aacgacuucggcaacuacaacaaccagagcuccaacuucgggccc

SEQ ID NO: 31660 - RNA, 36 nt, Artificial Sequence
  SLAM family member 6 (192-203)
aacgacaccaucaccaucuacagcacgaucaaccac

SEQ ID NO: 31661 - RNA, 39 nt, Artificial Sequence
  SLAM family member 6 (192-204)
aacgacaccaucaccaucuacagcacgaucaaccacucc

SEQ ID NO: 31662 - RNA, 42 nt, Artificial Sequence
  SLAM family member 6 (192-205)
aacgacaccaucaccaucuacagcacgaucaaccacuccaag

SEQ ID NO: 31663 - RNA, 48 nt, Artificial Sequence
  Glutathione peroxidase 1 (100-115)
aacgacguggccuggaacuucgagaaguuccuggucggccccgacggg

SEQ ID NO: 31664 - RNA, 30 nt, Artificial Sequence
  ATP-binding cassette sub-family A member 6 (811-820)
aacgagauggagcuggcccacagcuccuuc

SEQ ID NO: 31665 - RNA, 24 nt, Artificial Sequence
  Ribonucleoside-diphosphate reductase subunit M2 B (50-57)
aacgagaaccugguggagcgcuuc

SEQ ID NO: 31666 - RNA, 36 nt, Artificial Sequence
  C-C chemokine receptor type 7 (192-203)
aacuucgagcgcaacaaggccaucaaggugaucauc

SEQ ID NO: 31667 - RNA, 39 nt, Artificial Sequence
  C-C chemokine receptor type 7 (192-204)
aacuucgagcgcaacaaggccaucaaggugaucaucgcc

SEQ ID NO: 31668 - RNA, 36 nt, Artificial Sequence
  Fas apoptotic inhibitory molecule 3 (66-77)
aacuucaucaaggccgaguacaagggccgcgugacc

SEQ ID NO: 31669 - RNA, 42 nt, Artificial Sequence
  Platelet endothelial cell adhesion molecule (187-200)
aacuucgugauccuggaguuccccgucgaggagcaggaccgc

SEQ ID NO: 31670 - RNA, 45 nt, Artificial Sequence
  Phosphoinositide-3-kinase-interacting protein 1 (29-43)
aacggccaccuguaccgcgaggaccagaccagccccgccccgggg

SEQ ID NO: 31671 - RNA, 48 nt, Artificial Sequence
  Phosphoinositide-3-kinase-interacting protein 1 (29-44)
aacggccaccuguaccgcgaggaccagaccagccccgccccggggcuc

SEQ ID NO: 31672 - RNA, 51 nt, Artificial Sequence
  Phosphoinositide-3-kinase-interacting protein 1 (29-45)
aacggccaccuguaccgcgaggaccagaccagccccgccccggggcuccgg

SEQ ID NO: 31673 - RNA, 42 nt, Artificial Sequence
  CD44 antigen (16-29)
aacggccgcuacagcaucucccggaccgaggccgccgaccug

SEQ ID NO: 31674 - RNA, 36 nt, Artificial Sequence
  Pro-cathepsin H (223-234)
aacggcuacuuccugaucgagcgcgggaagaacaug

SEQ ID NO: 31675 - RNA, 30 nt, Artificial Sequence
  Thymidylate synthase (260-269)
aaccacaucgagccccugaagauccagcuc

SEQ ID NO: 31676 - RNA, 48 nt, Artificial Sequence
  B- and T-lymphocyte attenuator (251-266)
aacaagcccggcaucguguacgccagccugaaccacuccgucaucggg

SEQ ID NO: 31677 - RNA, 39 nt, Artificial Sequence
  E3 ubiquitin-protein ligase CHIP (44-56)
aaccugcagcgcgccuacagccucgccaaggagcagcgg

SEQ ID NO: 31678 - RNA, 42 nt, Artificial Sequence
  Alpha-mannosidase 2 (65-78)
aacaacgagaucaucagcaacauccgcgacuccgugaucaac

SEQ ID NO: 31679 - RNA, 39 nt, Artificial Sequence
  Neurofibromin (66-78)
aacaacaugcgcaucuucggcgaggccgccgagaagaac

SEQ ID NO: 31680 - RNA, 39 nt, Artificial Sequence
  Interleukin-4 receptor subunit alpha (193-205)
aaccccgccuaccgcagcuucuccaacagccugucccag

SEQ ID NO: 31681 - RNA, 51 nt, Artificial Sequence
  Transferrin receptor protein 1 (215-231)
aaccccggcggguacguggccuacagcaaggccgcgaccgucaccggcaag

SEQ ID NO: 31682 - RNA, 33 nt, Artificial Sequence
  Uncharacterized protein CXorf21 (203-213)
aaccccaucagcaacgccgugcugaacgaguac

SEQ ID NO: 31683 - RNA, 51 nt, Artificial Sequence
  Kynureninase (429-445)
aaccccaacggcauccgcguggccccggucccccuguacaacagcuuccac

SEQ ID NO: 31684 - RNA, 48 nt, Artificial Sequence
  MyoD family inhibitor domain-containing protein (64-79)
aaccccagcgacggcgagcugauccgcacccagccgcagcggcucccc

SEQ ID NO: 31685 - RNA, 51 nt, Artificial Sequence
  MyoD family inhibitor domain-containing protein (64-80)
aaccccagcgacggcgagcugauccgcacccagccgcagcggcucccccag

SEQ ID NO: 31686 - RNA, 54 nt, Artificial Sequence
  MyoD family inhibitor domain-containing protein (64-81)
aaccccagcgacggcgagcugauccgcacccagccgcagcggcucccccagcug

SEQ ID NO: 31687 - RNA, 39 nt, Artificial Sequence
  Polypeptide N-acetylgalactosaminyltransferase 1 (405-417)
aaccagguguucagcuacaccgccaacaaggagauccgc

SEQ ID NO: 31688 - RNA, 42 nt, Artificial Sequence
  Polypeptide N-acetylgalactosaminyltransferase 1 (405-418)
aaccagguguucagcuacaccgccaacaaggagauccgcacc

SEQ ID NO: 31689 - RNA, 48 nt, Artificial Sequence
  Polypeptide N-acetylgalactosaminyltransferase 1 (405-420)
aaccagguguucagcuacaccgccaacaaggagauccgcaccgacgac

SEQ ID NO: 31690 - RNA, 27 nt, Artificial Sequence
  Cyclin-dependent kinase 14 (406-414)
aaccgccugagcgcccaggccgcgcuc

SEQ ID NO: 31691 - RNA, 36 nt, Artificial Sequence
  Transferrin receptor protein 1 (198-209)
aacagcgugaucaucgucgacaagaacggccgccug

SEQ ID NO: 31692 - RNA, 39 nt, Artificial Sequence
  Transferrin receptor protein 1 (198-210)
aacagcgugaucaucgucgacaagaacggccgccuggug

SEQ ID NO: 31693 - RNA, 42 nt, Artificial Sequence
  Transferrin receptor protein 1 (198-211)
aacagcgugaucaucgucgacaagaacggccgccugguguac

SEQ ID NO: 31694 - RNA, 42 nt, Artificial Sequence
  Glucose-6-phosphate isomerase (108-121)
aacacccccauccugguggacggcaaggacgucaugccggag

SEQ ID NO: 31695 - RNA, 45 nt, Artificial Sequence
  Glucose-6-phosphate isomerase (108-122)
aacacccccauccugguggacggcaaggacgucaugccggaggug

SEQ ID NO: 31696 - RNA, 48 nt, Artificial Sequence
  Glucose-6-phosphate isomerase (108-123)
aacacccccauccugguggacggcaaggacgucaugccggaggugaac

SEQ ID NO: 31697 - RNA, 42 nt, Artificial Sequence
  Pericentriolar material 1 protein (1457-1470)
aacaccgugauccaccuggaccaggcccucgcccgcaugcgg

SEQ ID NO: 31698 - RNA, 45 nt, Artificial Sequence
  Pericentriolar material 1 protein (1457-1471)
aacaccgugauccaccuggaccaggcccucgcccgcaugcgggag

SEQ ID NO: 31699 - RNA, 39 nt, Artificial Sequence
  SLAM family member 6 (50-62)
aacgugagcuuccgcugggaggcccugggcaacacccuc

SEQ ID NO: 31700 - RNA, 51 nt, Artificial Sequence
  Peroxiredoxin-1 (108-124)
cccaagcgcaccaucgcccaggacuacggcgugcugaaggccgacgagggg

SEQ ID NO: 31701 - RNA, 39 nt, Artificial Sequence
  Calsyntenin-1 (57-69)
cccccgcugaucgcccucgacaaggacgccccccugcgc

SEQ ID NO: 31702 - RNA, 39 nt, Artificial Sequence
  Pro-cathepsin H (49-61)
cccagccaggccuucgaguacauccuguacaacaagggc

SEQ ID NO: 31703 - RNA, 42 nt, Artificial Sequence
  Pro-cathepsin H (49-62)
cccagccaggccuucgaguacauccuguacaacaagggcauc

SEQ ID NO: 31704 - RNA, 45 nt, Artificial Sequence
  Pro-cathepsin H (49-63)
cccagccaggccuucgaguacauccuguacaacaagggcaucaug

SEQ ID NO: 31705 - RNA, 45 nt, Artificial Sequence
  Low affinity immunoglobulin epsilon Fc receptor (39-53)
caggccgaccugagcuccuucaagagccaggagcucaacgagcgc

SEQ ID NO: 31706 - RNA, 33 nt, Artificial Sequence
  Ras-specific guanine nucleotide-releasing factor 1 (993-1003)
caggaggaccccggcgacaaccagaucacccug

SEQ ID NO: 31707 - RNA, 30 nt, Artificial Sequence
  ATP synthase F(0) complex subunit C1, mitochondrial (106-115)
cagcuguucagcuacgccauccucggcuuc

SEQ ID NO: 31708 - RNA, 27 nt, Artificial Sequence
  Transmembrane emp24 domain-containing protein 4 (162-170)
cagcugcucgaccagguggagcagauc

SEQ ID NO: 31709 - RNA, 39 nt, Artificial Sequence
  Glutathione peroxidase 1 (12-24)
cagagcguguacgccuucuccgcccgcccccuggcgggc

SEQ ID NO: 31710 - RNA, 51 nt, Artificial Sequence
  Glutathione peroxidase 1 (12-28)
cagagcguguacgccuucuccgcccgcccccuggcgggcggggagccgguc

SEQ ID NO: 31711 - RNA, 45 nt, Artificial Sequence
  Lipolysis-stimulated lipoprotein receptor (423-437)
cgcgacgaccuguacgaccaggacgacagccgggacuucccccgc

SEQ ID NO: 31712 - RNA, 33 nt, Artificial Sequence
  Dystrophin (314-324)
cgcgacuucggccccgccagccagcacuuccug

SEQ ID NO: 31713 - RNA, 27 nt, Artificial Sequence
  Transcription regulator protein BACH2 (715-723)
cgcgacauccagagccccgagcagauc

SEQ ID NO: 31714 - RNA, 24 nt, Artificial Sequence
  Elongation factor Tu, mitochondrial (53-60)
cgcgacaagccccacgugaacguc

SEQ ID NO: 31715 - RNA, 33 nt, Artificial Sequence
  TRAF3-interacting JNK-activating modulator (92-102)
cgcgaccugcagaugaaccaggcccuccgguuc

SEQ ID NO: 31716 - RNA, 24 nt, Artificial Sequence
  Probable ATP-dependent RNA helicase DDX46 (658-665)
cgcgacagcaucaucaacgacuuc

SEQ ID NO: 31717 - RNA, 27 nt, Artificial Sequence
  Eukaryotic translation initiation factor 6 (237-245)
cgcgacagccugaucgacucccucacc

SEQ ID NO: 31718 - RNA, 33 nt, Artificial Sequence
  Cadherin EGF LAG seven-pass G-type receptor 1 (380-390)
cgcgacagccccaucaacgccaaccugcgguac

SEQ ID NO: 31719 - RNA, 27 nt, Artificial Sequence
  Transcription regulator protein BACH2 (258-266)
cgcgaggacaacagcuccaacagccug

SEQ ID NO: 31720 - RNA, 30 nt, Artificial Sequence
  ATP-binding cassette sub-family A member 6 (1183-1192)
cgcgaguuccccgaggccaacuucgagcug

SEQ ID NO: 31721 - RNA, 48 nt, Artificial Sequence
  Alpha-1B-glycoprotein (123-138)
cgcggcgagaaggagcugcucgugccccggagcuccaccagcccggac

SEQ ID NO: 31722 - RNA, 39 nt, Artificial Sequence
  Peroxiredoxin-1 (128-140)
cgcggccuguucaucaucgacgacaaggggauccuccgg

SEQ ID NO: 31723 - RNA, 42 nt, Artificial Sequence
  Peroxiredoxin-1 (128-141)
cgcggccuguucaucaucgacgacaaggggauccuccggcag

SEQ ID NO: 31724 - RNA, 48 nt, Artificial Sequence
  Peroxiredoxin-1 (128-143)
cgcggccuguucaucaucgacgacaaggggauccuccggcagaucacc

SEQ ID NO: 31725 - RNA, 27 nt, Artificial Sequence
  DNA dC-dU-editing enzyme APOBEC-3D (306-314)
cgccacagcaacgugaaccugaccauc

SEQ ID NO: 31726 - RNA, 30 nt, Artificial Sequence
  Zinc finger protein 107 (152-161)
cgcauccacaccggcgagaagcccuacaag

SEQ ID NO: 31727 - RNA, 30 nt, Artificial Sequence
  Fibromodulin (324-333)
cgcaucaacgaguucagcaucuccagcuuc

SEQ ID NO: 31728 - RNA, 27 nt, Artificial Sequence
  Cytoskeleton-associated protein 4 (199-207)
cgcaucagcgaggugcugcagaagcuc

SEQ ID NO: 31729 - RNA, 42 nt, Artificial Sequence
  Leukosialin (349-362)
cgcaagagccggcagggcucccuggccauggaggagcucaag

SEQ ID NO: 31730 - RNA, 48 nt, Artificial Sequence
  Beta-1,4-galactosyltransferase 1 (49-64)
cgccugccccagcucgugggcgucagcaccccgcugcaggggggcucc

SEQ ID NO: 31731 - RNA, 36 nt, Artificial Sequence
  Proline-rich protein 12 (1113-1124)
cgccccgccggcgagccguacaaccggaagacccug

SEQ ID NO: 31732 - RNA, 24 nt, Artificial Sequence
  Cadherin EGF LAG seven-pass G-type receptor 1 (2237-2244)
cgccccuucgugaucgucaccgcc

SEQ ID NO: 31733 - RNA, 27 nt, Artificial Sequence
  Cadherin EGF LAG seven-pass G-type receptor 1 (2367-2375)
cgccccaucaucaacaccccgauggug

SEQ ID NO: 31734 - RNA, 27 nt, Artificial Sequence
  A-kinase anchor protein 2 (800-808)
cgccccaagaaccugaugcagacccuc

SEQ ID NO: 31735 - RNA, 24 nt, Artificial Sequence
  B-lymphocyte antigen CD20 (222-229)
cgccccaagagcaacaucgugcug

SEQ ID NO: 31736 - RNA, 27 nt, Artificial Sequence
  Arrestin domain-containing protein 4 (148-156)
cgccccaaggugccggaccagagcguc

SEQ ID NO: 31737 - RNA, 27 nt, Artificial Sequence
  A-kinase anchor protein 2 (109-117)
cgccaggcccccccgcacaucgagcug

SEQ ID NO: 31738 - RNA, 42 nt, Artificial Sequence
  Golgi apparatus protein 1 (358-371)
cgccagaagcugaucgcccaggacuacaaggugagcuacucc

SEQ ID NO: 31739 - RNA, 45 nt, Artificial Sequence
  Golgi apparatus protein 1 (358-372)
cgccagaagcugaucgcccaggacuacaaggugagcuacucccuc

SEQ ID NO: 31740 - RNA, 48 nt, Artificial Sequence
  Golgi apparatus protein 1 (358-373)
cgccagaagcugaucgcccaggacuacaaggugagcuacucccucgcc

SEQ ID NO: 31741 - RNA, 51 nt, Artificial Sequence
  Golgi apparatus protein 1 (358-374)
cgccagaagcugaucgcccaggacuacaaggugagcuacucccucgccaag

SEQ ID NO: 31742 - RNA, 27 nt, Artificial Sequence
  Dystrophin (178-186)
cgccagcugggcgagguggccagcuuc

SEQ ID NO: 31743 - RNA, 24 nt, Artificial Sequence
  Cordon-bleu protein-like 1 (1082-1089)
cgccagagccugcucaccgccauc

SEQ ID NO: 31744 - RNA, 27 nt, Artificial Sequence
  Dynamin-binding protein (661-669)
cgccggaaggaccuggugcucaaguac

SEQ ID NO: 31745 - RNA, 45 nt, Artificial Sequence
  Leukosialin (348-362)
cgccggaagagccgccagggcucccuggccauggaggagcucaag

SEQ ID NO: 31746 - RNA, 36 nt, Artificial Sequence
  Ras-related protein Rab-11A (51-62)
cgcagcauccagguggacggcaagaccaucaaggcc

SEQ ID NO: 31747 - RNA, 39 nt, Artificial Sequence
  Ras-related protein Rab-11A (51-63)
cgcagcauccagguggacggcaagaccaucaaggcccag

SEQ ID NO: 31748 - RNA, 42 nt, Artificial Sequence
  Ras-related protein Rab-11A (51-64)
cgcagcauccagguggacggcaagaccaucaaggcccagauc

SEQ ID NO: 31749 - RNA, 33 nt, Artificial Sequence
  TP53-target gene 5 protein (40-50)
cgcaccgugcugaagaaccucagccugcugaag

SEQ ID NO: 31750 - RNA, 42 nt, Artificial Sequence
  Golgi apparatus protein 1 (995-1008)
agcgcccuggacuaccgccucgacccccagcugcagcugcac

SEQ ID NO: 31751 - RNA, 33 nt, Artificial Sequence
  AN1-type zinc finger protein 5 (63-73)
agcgccuccgugcagcgcgccgacaccagccug

SEQ ID NO: 31752 - RNA, 42 nt, Artificial Sequence
  IgG receptor FcRn large subunit p51 (253-266)
agcgacggcuccuuccacgccagcuccagccugaccgugaag

SEQ ID NO: 31753 - RNA, 42 nt, Artificial Sequence
  Plasma membrane calcium-transporting ATPase 1 (256-269)
agcgacggcuccuaccgcaucuucagcaagggggccuccgag

SEQ ID NO: 31754 - RNA, 27 nt, Artificial Sequence
  Probable ribonuclease ZC3H12D (505-513)
agcgaccuggcccgccucauccugcug

SEQ ID NO: 31755 - RNA, 45 nt, Artificial Sequence
  ATP synthase subunit alpha, mitochondrial (348-362)
agcgaccuggacgccgccacccagcagcuccugucccgcggcgug

SEQ ID NO: 31756 - RNA, 27 nt, Artificial Sequence
  TRAF3-interacting JNK-activating modulator (138-146)
agcgaggccgagaagcugacccucgug

SEQ ID NO: 31757 - RNA, 30 nt, Artificial Sequence
  Lysine-specific demethylase 2B (477-486)
agcgaggaguccgugaagagcaccacccug

SEQ ID NO: 31758 - RNA, 27 nt, Artificial Sequence
  Elongator complex protein 3 (338-346)
agcgaggagaccuuccgcuucgagcug

SEQ ID NO: 31759 - RNA, 27 nt, Artificial Sequence
  Zinc finger protein 638 (865-873)
agcgagaucaagaccuccaucgaggug

SEQ ID NO: 31760 - RNA, 27 nt, Artificial Sequence
  Ribonucleoside-diphosphate reductase subunit M2 B (275-283)
agcgaguaccagcgcuucgccgugaug

SEQ ID NO: 31761 - RNA, 57 nt, Artificial Sequence
  DnaJ homolog subfamily C member 5 (12-30)
agcggcgagucccuguaccacgugcucgggcuggacaagaacgccaccagcgacgac

SEQ ID NO: 31762 - RNA, 42 nt, Artificial Sequence
  Heterogeneous nuclear ribonucleoprotein A1-like 2 (133-146)
agcggccccuacgggggcgggggccaguacuucgccaagccg

SEQ ID NO: 31763 - RNA, 75 nt, Artificial Sequence
  Heterogeneous nuclear ribonucleoprotein A3 (147-171)
agcggccagcagcaguccaacuacgggcccaugaagggcgggagcuucggcgggcgcuccagcggcuccccguac

SEQ ID NO: 31764 - RNA, 69 nt, Artificial Sequence
  Heterogeneous nuclear ribonucleoprotein A3 (167-189)
agcggcucccccuacgggggcggguacggcagcgggggcggcuccgggggcuacgggagccgccgguuc

SEQ ID NO: 31765 - RNA, 45 nt, Artificial Sequence
  Carbohydrate sulfotransferase 2 (175-189)
agcggcuccagcuucuucggggagcuguucaaccagaaccccgag

SEQ ID NO: 31766 - RNA, 39 nt, Artificial Sequence
  Ceramide glucosyltransferase (192-204)
agccacccccgcuacuacaucuccgccaacgugaccggc

SEQ ID NO: 31767 - RNA, 45 nt, Artificial Sequence
  Ceramide glucosyltransferase (192-206)
agccacccccgcuacuacaucuccgccaacgugaccggcuucaag

SEQ ID NO: 31768 - RNA, 27 nt, Artificial Sequence
  Hematopoietic SH2 domain-containing protein (61-69)
agccacucccacgugggcuacacccug

SEQ ID NO: 31769 - RNA, 45 nt, Artificial Sequence
  Serine incorporator 3 (252-266)
agcaucaucuccauccaccccaagauccaggagcaccagccgcgc

SEQ ID NO: 31770 - RNA, 24 nt, Artificial Sequence
  Uncharacterized protein CXorf21 (192-199)
agcaucaaggagaaguccagccug

SEQ ID NO: 31771 - RNA, 27 nt, Artificial Sequence
  Protein asunder homolog (394-402)
agcauccuggaggaccccccguccauc

SEQ ID NO: 31772 - RNA, 42 nt, Artificial Sequence
  Golgi apparatus protein 1 (1057-1070)
agcaaggccgacaucuucguggaccccguccugcacaccgcc

SEQ ID NO: 31773 - RNA, 36 nt, Artificial Sequence
  Perilipin-2 (369-380)
agccugcucaccuccagcaagggccagcugcagaag

SEQ ID NO: 31774 - RNA, 27 nt, Artificial Sequence
  DmX-like protein 1 (607-615)
agccugaaccaguggcucguguccuuc

SEQ ID NO: 31775 - RNA, 27 nt, Artificial Sequence
  DmX-like protein 1 (1285-1293)
agcaugaccucccuggcccagaagauc

SEQ ID NO: 31776 - RNA, 42 nt, Artificial Sequence
  Cystatin-C (64-77)
agcaacgacauguaccacucccgcgcccugcaggugguccgg

SEQ ID NO: 31777 - RNA, 42 nt, Artificial Sequence
  Vitamin D-binding protein (234-247)
agcaaccugaucaagcucgcccagaaggugcccaccgccgac

SEQ ID NO: 31778 - RNA, 45 nt, Artificial Sequence
  Glucose-6-phosphate isomerase (107-121)
agcaacacccccauccugguggacggcaaggacgucaugccggag

SEQ ID NO: 31779 - RNA, 51 nt, Artificial Sequence
  Glucose-6-phosphate isomerase (107-123)
agcaacacccccauccugguggacggcaaggacgucaugccggaggugaac

SEQ ID NO: 31780 - RNA, 27 nt, Artificial Sequence
  NACHT, LRR and PYD domains-containing protein 2 (739-747)
agccccgccgacgcccaccgcaaccug

SEQ ID NO: 31781 - RNA, 36 nt, Artificial Sequence
  Calcium and integrin-binding protein 1 (80-91)
agccccgccaaggacucccugagcuucgaggacuuc

SEQ ID NO: 31782 - RNA, 45 nt, Artificial Sequence
  Calcium and integrin-binding protein 1 (80-94)
agccccgccaaggacucccugagcuucgaggacuuccucgaccug

SEQ ID NO: 31783 - RNA, 24 nt, Artificial Sequence
  Tumor necrosis factor receptor superfamily member 13C (50-57)
agccccgccccgcgcaccgcccug

SEQ ID NO: 31784 - RNA, 27 nt, Artificial Sequence
  Cordon-bleu protein-like 1 (911-919)
agccccgagcagacccuguccccgcuc

SEQ ID NO: 31785 - RNA, 45 nt, Artificial Sequence
  Transferrin receptor protein 1 (695-709)
agccccuuccgccacguguucuggggcuccgggagccacacccug

SEQ ID NO: 31786 - RNA, 24 nt, Artificial Sequence
  Ras-specific guanine nucleotide-releasing factor 1 (774-781)
agccccuucuccaaggccacccug

SEQ ID NO: 31787 - RNA, 42 nt, Artificial Sequence
  Beta-1,4-galactosyltransferase 1 (174-187)
agcccccacaagguggccaucaucaucccguuccgcaaccgg

SEQ ID NO: 31788 - RNA, 48 nt, Artificial Sequence
  Beta-1,4-galactosyltransferase 1 (174-189)
agcccccacaagguggccaucaucaucccguuccgcaaccggcaggag

SEQ ID NO: 31789 - RNA, 51 nt, Artificial Sequence
  Beta-1,4-galactosyltransferase 1 (174-190)
agcccccacaagguggccaucaucaucccguuccgcaaccggcaggagcac

SEQ ID NO: 31790 - RNA, 39 nt, Artificial Sequence
  Phosphate-regulating neutral endopeptidase (424-436)
agccccccgcaguuccgcgugaacggcgccaucuccaac

SEQ ID NO: 31791 - RNA, 45 nt, Artificial Sequence
  Phosphate-regulating neutral endopeptidase (424-438)
agccccccgcaguuccgcgugaacggcgccaucuccaacuucgag

SEQ ID NO: 31792 - RNA, 48 nt, Artificial Sequence
  Phosphate-regulating neutral endopeptidase (424-439)
agccccccgcaguuccgcgugaacggcgccaucuccaacuucgaggag

SEQ ID NO: 31793 - RNA, 51 nt, Artificial Sequence
  Phosphate-regulating neutral endopeptidase (424-440)
agccccccgcaguuccgcgugaacggcgccaucuccaacuucgaggaguuc

SEQ ID NO: 31794 - RNA, 27 nt, Artificial Sequence
  Zinc finger protein 296 (218-226)
agcccccgcgccuccggcagcgggcug

SEQ ID NO: 31795 - RNA, 30 nt, Artificial Sequence
  Lysine-specific demethylase 2B (832-841)
agcccccgcccgccccugggcuccagccuc

SEQ ID NO: 31796 - RNA, 45 nt, Artificial Sequence
  Golgi apparatus protein 1 (1141-1155)
agccccuccaagaacuacauccugagcgugaucuccggcagcauc

SEQ ID NO: 31797 - RNA, 24 nt, Artificial Sequence
  T-cell activation Rho GTPase-activating protein (149-156)
agccccucccgccagccgcaggug

SEQ ID NO: 31798 - RNA, 54 nt, Artificial Sequence
  SLAM family member 6 (167-184)
agccccaccaacaacaccguguacgccuccgucacgcacagcaaccgcgagacc

SEQ ID NO: 31799 - RNA, 30 nt, Artificial Sequence
  Cadherin EGF LAG seven-pass G-type receptor 1 (2960-2969)
agccccaccuccagccgcaccuccagccug

SEQ ID NO: 31800 - RNA, 42 nt, Artificial Sequence
  Alpha-mannosidase 2 (670-683)
agccccaccgugcaggucuucuccgccagcggcaagccggug

SEQ ID NO: 31801 - RNA, 33 nt, Artificial Sequence
  ATP synthase F(0) complex subunit C1, mitochondrial (32-42)
agccccgugaacuccagcaagcagccguccuac

SEQ ID NO: 31802 - RNA, 24 nt, Artificial Sequence
  Lysine-specific demethylase 2B (842-849)
agccccugguggcgcuccagccug

SEQ ID NO: 31803 - RNA, 63 nt, Artificial Sequence
  Heterogeneous nuclear ribonucleoprotein A3 (169-189)
agccccuacggcgggggcuacggguccggcgggggcagcggcggguacggcucccgccgguuc

SEQ ID NO: 31804 - RNA, 27 nt, Artificial Sequence
  Melanoma antigen preferentially expressed in tumors (406-414)
agccagcugaccacccucuccuucuac

SEQ ID NO: 31805 - RNA, 45 nt, Artificial Sequence
  Platelet endothelial cell adhesion molecule (409-423)
agccagccccgcaucuccuacgacgcccaguucgaggugaucaag

SEQ ID NO: 31806 - RNA, 48 nt, Artificial Sequence
  Platelet endothelial cell adhesion molecule (409-424)
agccagccccgcaucuccuacgacgcccaguucgaggugaucaagggc

SEQ ID NO: 31807 - RNA, 27 nt, Artificial Sequence
  Tumor protein p53-inducible protein 11 (14-22)
agccagaccgaccuggugucccgccuc

SEQ ID NO: 31808 - RNA, 45 nt, Artificial Sequence
  Interleukin-4 receptor subunit alpha (90-104)
agccgcgacgacuuccaggagggccgggaggggaucguggcccgc

SEQ ID NO: 31809 - RNA, 27 nt, Artificial Sequence
  T-cell activation Rho GTPase-activating protein (308-316)
agccgccaccaguccuucaccaccaag

SEQ ID NO: 31810 - RNA, 27 nt, Artificial Sequence
  T-cell activation Rho GTPase-activating protein (5-13)
agcucccacaacgccagcaagacccug

SEQ ID NO: 31811 - RNA, 45 nt, Artificial Sequence
  Ragulator complex protein LAMTOR1 (55-69)
agcuccauccuggccaagaccgccagcaacaucaucgacgugucc

SEQ ID NO: 31812 - RNA, 39 nt, Artificial Sequence
  Serine incorporator 3 (351-363)
agcuccauccgcaccagcaccaacucccagguggacaag

SEQ ID NO: 31813 - RNA, 48 nt, Artificial Sequence
  Alpha-mannosidase 2 (669-684)
agcucccccaccgugcaggucuucagcgccuccggcaagccgguggag

SEQ ID NO: 31814 - RNA, 27 nt, Artificial Sequence
  DmX-like protein 1 (1271-1279)
agcuccagcggccugcaccccccgaag

SEQ ID NO: 31815 - RNA, 39 nt, Artificial Sequence
  Interleukin-4 receptor subunit alpha (490-502)
agcuccagcuccuuccaccccgccccgggcaacgcccag

SEQ ID NO: 31816 - RNA, 27 nt, Artificial Sequence
  Interleukin-1 beta (84-92)
agcguggaccccaagaacuacccgaag

SEQ ID NO: 31817 - RNA, 39 nt, Artificial Sequence
  15 kDa selenoprotein (150-162)
agcguggaggaguuccuguccgagaagcucgagcgcauc

SEQ ID NO: 31818 - RNA, 36 nt, Artificial Sequence
  Transferrin receptor protein 1 (199-210)
agcgugaucaucgucgacaagaacggccgccuggug

SEQ ID NO: 31819 - RNA, 27 nt, Artificial Sequence
  AT-rich interactive domain-containing protein 5B (278-286)
agcgugauccagcacguccaguccuuc

SEQ ID NO: 31820 - RNA, 30 nt, Artificial Sequence
  Probable ATP-dependent RNA helicase DDX46 (198-207)
agcgugaagggcgggggcgggaacgagaag

SEQ ID NO: 31821 - RNA, 42 nt, Artificial Sequence
  Plasma membrane calcium-transporting ATPase 1 (110-123)
agcgugaagaagaugaugaaggacaacaaccugguccgccac

SEQ ID NO: 31822 - RNA, 27 nt, Artificial Sequence
  Zinc finger protein 638 (619-627)
agcgugaagcccaccuccgccaccaag

SEQ ID NO: 31823 - RNA, 33 nt, Artificial Sequence
  Interleukin-17 receptor A (789-799)
agcgugcaguccgaccagggcuacaucagccgc

SEQ ID NO: 31824 - RNA, 45 nt, Artificial Sequence
  Low affinity immunoglobulin epsilon Fc receptor (32-46)
agcuggaaccugaacggccuccaggccgaccuguccagcuucaag

SEQ ID NO: 31825 - RNA, 45 nt, Artificial Sequence
  Receptor-type tyrosine-protein phosphatase alpha (182-196)
accgccaccaucgugauggucacgaaccugaaggagcgcaaggag

SEQ ID NO: 31826 - RNA, 30 nt, Artificial Sequence
  Dystrophin (30-39)
accgaggccgagaccacggccaacgugcug

SEQ ID NO: 31827 - RNA, 24 nt, Artificial Sequence
  Transcription regulator protein BACH2 (559-566)
accgagcaccaggagcccggccug

SEQ ID NO: 31828 - RNA, 27 nt, Artificial Sequence
  Cordon-bleu protein-like 1 (804-812)
accgagcaccaggugcccagcuccguc

SEQ ID NO: 31829 - RNA, 33 nt, Artificial Sequence
  Uncharacterized protein CXorf21 (281-291)
accgagaucaccgagaucagcacgcccucccug

SEQ ID NO: 31830 - RNA, 27 nt, Artificial Sequence
  Ribonucleoside-diphosphate reductase subunit M2 B (128-136)
accuucggcgagcgcguggucgccuuc

SEQ ID NO: 31831 - RNA, 45 nt, Artificial Sequence
  Cation-independent mannose-6-phosphate receptor (1446-1460)
accggccaccuguucgaccucagcucccugagcgggcgcgccggc

SEQ ID NO: 31832 - RNA, 42 nt, Artificial Sequence
  Low affinity immunoglobulin epsilon Fc receptor (139-152)
accggcagcuggaucgggcugcgcaaccucgaccugaagggc

SEQ ID NO: 31833 - RNA, 45 nt, Artificial Sequence
  SLAM family member 6 (104-118)
accggcagcuaccgcgcccagaucuccaccaagacgagcgccaag

SEQ ID NO: 31834 - RNA, 27 nt, Artificial Sequence
  ATP-binding cassette sub-family A member 6 (728-736)
acccaccacauccccgacgccaagcug

SEQ ID NO: 31835 - RNA, 27 nt, Artificial Sequence
  Transcription regulator protein BACH2 (70-78)
accaagaacgaccugguggucagccuc

SEQ ID NO: 31836 - RNA, 24 nt, Artificial Sequence
  Baculoviral IAP repeat-containing protein 5 (97-104)
acccugggcgaguuccucaagcug

SEQ ID NO: 31837 - RNA, 39 nt, Artificial Sequence
  Fas apoptotic inhibitory molecule 3 (65-77)
accaacuucaucaaggccgaguacaagggccgcgugacc

SEQ ID NO: 31838 - RNA, 42 nt, Artificial Sequence
  Calsyntenin-1 (140-153)
accaacgugaagaagagccacaaggccaccguccacauccag

SEQ ID NO: 31839 - RNA, 27 nt, Artificial Sequence
  Interferon regulatory factor 9 (382-390)
acccccgagcagcaggccgccauccug

SEQ ID NO: 31840 - RNA, 27 nt, Artificial Sequence
  Cyclin-dependent kinase 14 (174-182)
acccccuucaccgccauccgcgaggcc

SEQ ID NO: 31841 - RNA, 27 nt, Artificial Sequence
  AT-rich interactive domain-containing protein 5B (36-44)
acccccaucgagcgcaucccguaccug

SEQ ID NO: 31842 - RNA, 36 nt, Artificial Sequence
  Glucose-6-phosphate isomerase (109-120)
acccccauccugguggacggcaaggacgucaugccg

SEQ ID NO: 31843 - RNA, 39 nt, Artificial Sequence
  Glucose-6-phosphate isomerase (109-121)
acccccauccugguggacggcaaggacgucaugccggag

SEQ ID NO: 31844 - RNA, 42 nt, Artificial Sequence
  Glucose-6-phosphate isomerase (109-122)
acccccauccugguggacggcaaggacgucaugccggaggug

SEQ ID NO: 31845 - RNA, 45 nt, Artificial Sequence
  Glucose-6-phosphate isomerase (109-123)
acccccauccugguggacggcaaggacgucaugccggaggugaac

SEQ ID NO: 31846 - RNA, 27 nt, Artificial Sequence
  Probable ribonuclease ZC3H12D (145-153)
acccccauccgcgagcagcacgugcug

SEQ ID NO: 31847 - RNA, 48 nt, Artificial Sequence
  Protein CDV3 homolog (80-95)
accccccagggcccgcccgagaucuacagcgacacccaguuccccucc

SEQ ID NO: 31848 - RNA, 54 nt, Artificial Sequence
  Protein CDV3 homolog (80-97)
accccccagggcccgcccgagaucuacagcgacacccaguuccccucccugcag

SEQ ID NO: 31849 - RNA, 60 nt, Artificial Sequence
  Protein CDV3 homolog (80-99)
accccccagggcccgcccgagaucuacagcgacacccaguuccccucccugcagagcacg

SEQ ID NO: 31850 - RNA, 54 nt, Artificial Sequence
  SLAM family member 6 (188-205)
accccccgcgagaacgacaccaucacgaucuacagcaccaucaaccacuccaag

SEQ ID NO: 31851 - RNA, 69 nt, Artificial Sequence
  SLAM family member 6 (188-210)
accccccgcgagaacgacaccaucacgaucuacagcaccaucaaccacuccaaggagagcaagccgacc

SEQ ID NO: 31852 - RNA, 27 nt, Artificial Sequence
  Protein asunder homolog (320-328)
accccccgcaccaacaacaucgagcug

SEQ ID NO: 31853 - RNA, 45 nt, Artificial Sequence
  E3 ubiquitin-protein ligase CHIP (246-260)
acccccagcggcaucaccuacgaccgcaaggacaucgaggagcac

SEQ ID NO: 31854 - RNA, 36 nt, Artificial Sequence
  Putative heat shock 70 kDa protein 7 (40-51)
acccccagcuacguggccuucaccgacacggagcgc

SEQ ID NO: 31855 - RNA, 39 nt, Artificial Sequence
  Putative heat shock 70 kDa protein 7 (40-52)
acccccagcuacguggccuucaccgacacggagcgccug

SEQ ID NO: 31856 - RNA, 27 nt, Artificial Sequence
  Zinc finger protein 107 (512-520)
acccgccacaagaucgugcacaccaag

SEQ ID NO: 31857 - RNA, 42 nt, Artificial Sequence
  Cytochrome b ascorbate-dependent protein 3 (187-200)
acccgccccuaccacagccugccguccgaggccguguucgcc

SEQ ID NO: 31858 - RNA, 45 nt, Artificial Sequence
  Cytochrome b ascorbate-dependent protein 3 (187-201)
acccgccccuaccacagccugccguccgaggccguguucgccaac

SEQ ID NO: 31859 - RNA, 42 nt, Artificial Sequence
  Ras-related protein Rab-11A (50-63)
acccgcagcauccagguggacggcaagaccaucaaggcccag

SEQ ID NO: 31860 - RNA, 42 nt, Artificial Sequence
  Ceramide glucosyltransferase (191-204)
accagccacccccgcuacuacaucuccgccaacgugaccggc

SEQ ID NO: 31861 - RNA, 48 nt, Artificial Sequence
  Ceramide glucosyltransferase (191-206)
accagccacccccgcuacuacaucuccgccaacgugaccggcuucaag

SEQ ID NO: 31862 - RNA, 48 nt, Artificial Sequence
  B- and T-lymphocyte attenuator (128-143)
accacccuguacgugacggacgucaagagcgccuccgagcgccccagc

SEQ ID NO: 31863 - RNA, 42 nt, Artificial Sequence
  Fas apoptotic inhibitory molecule 3 (64-77)
accaccaacuucaucaaggccgaguacaagggccgcgugacg

SEQ ID NO: 31864 - RNA, 42 nt, Artificial Sequence
  DnaJ homolog subfamily C member 5 (181-194)
accacccagcugacggccgacagccaccccuccuaccacacc

SEQ ID NO: 31865 - RNA, 45 nt, Artificial Sequence
  DnaJ homolog subfamily C member 5 (181-195)
accacccagcugacggccgacagccaccccuccuaccacaccgac

SEQ ID NO: 31866 - RNA, 48 nt, Artificial Sequence
  DnaJ homolog subfamily C member 5 (181-196)
accacccagcugacggccgacagccaccccuccuaccacaccgacggc

SEQ ID NO: 31867 - RNA, 27 nt, Artificial Sequence
  Cordon-bleu protein-like 1 (732-740)
accaccuacaagaucgugcccccgaag

SEQ ID NO: 31868 - RNA, 33 nt, Artificial Sequence
  Eukaryotic translation initiation factor 6 (141-151)
accguggccgaccagguccuggugggcagcuac

SEQ ID NO: 31869 - RNA, 27 nt, Artificial Sequence
  ATP-binding cassette sub-family A member 6 (572-580)
accgugaaggagaaccugagccucuuc

SEQ ID NO: 31870 - RNA, 36 nt, Artificial Sequence
  C-C chemokine receptor type 7 (93-104)
guggccaucguccaggccgugagcgcgcaccgccac

SEQ ID NO: 31871 - RNA, 39 nt, Artificial Sequence
  C-C chemokine receptor type 7 (93-105)
guggccaucguccaggccgugagcgcgcaccgccaccgg

SEQ ID NO: 31872 - RNA, 42 nt, Artificial Sequence
  C-C chemokine receptor type 7 (93-106)
guggccaucguccaggccgugagcgcgcaccgccaccgggcc

SEQ ID NO: 31873 - RNA, 45 nt, Artificial Sequence
  C-C chemokine receptor type 7 (93-107)
guggccaucguccaggccgugagcgcgcaccgccaccgggcccgc

SEQ ID NO: 31874 - RNA, 36 nt, Artificial Sequence
  Interleukin-4 receptor subunit alpha (102-113)
guggcccgccugaccgagagccucuuccuggaccug

SEQ ID NO: 31875 - RNA, 42 nt, Artificial Sequence
  Interleukin-4 receptor subunit alpha (102-115)
guggcccgccugaccgagagccucuuccuggaccugcucggc

SEQ ID NO: 31876 - RNA, 36 nt, Artificial Sequence
  Cytochrome b ascorbate-dependent protein 3 (99-110)
guggccgucuucaccuuccacaaccacggccgcacc

SEQ ID NO: 31877 - RNA, 39 nt, Artificial Sequence
  Cytochrome b ascorbate-dependent protein 3 (99-111)
guggccgucuucaccuuccacaaccacggccgcaccgcc

SEQ ID NO: 31878 - RNA, 45 nt, Artificial Sequence
  Cytochrome b ascorbate-dependent protein 3 (99-113)
guggccgucuucaccuuccacaaccacggccgcaccgccaaccug

SEQ ID NO: 31879 - RNA, 39 nt, Artificial Sequence
  Vesicle-associated membrane protein 1 (52-64)
guggacaagguccuggagcgcgaccagaagcucagcgag

SEQ ID NO: 31880 - RNA, 45 nt, Artificial Sequence
  Vesicle-associated membrane protein 3 (33-47)
guggacaagguccuggagcgcgaccagaagcucagcgagcuggac

SEQ ID NO: 31881 - RNA, 48 nt, Artificial Sequence
  Vesicle-associated membrane protein 3 (33-48)
guggacaagguccuggagcgcgaccagaagcucagcgagcuggacgac

SEQ ID NO: 31882 - RNA, 51 nt, Artificial Sequence
  Vesicle-associated membrane protein 1 (52-68)
guggacaagguccuggagcgcgaccagaagcucagcgagcuggacgaccgg

SEQ ID NO: 31883 - RNA, 45 nt, Artificial Sequence
  T-complex protein 1 subunit beta (408-422)
guggacaacaucaucaaggccgccccccgcaagcgggucccggac

SEQ ID NO: 31884 - RNA, 36 nt, Artificial Sequence
  15 kDa selenoprotein (151-162)
guggaggaguuccugagcgagaagcucgagcgcauc

SEQ ID NO: 31885 - RNA, 45 nt, Artificial Sequence
  Glycosyltransferase 8 domain-containing protein 1 (270-284)
guggaggagggccuguacagccgcacccucgccggguccaucacc

SEQ ID NO: 31886 - RNA, 30 nt, Artificial Sequence
  B-lymphocyte antigen CD19 (115-124)
guggagggcagcggggagcuguuccgcugg

SEQ ID NO: 31887 - RNA, 27 nt, Artificial Sequence
  Interferon regulatory factor 9 (320-328)
guggagcuguuccgcaccgccuacuuc

SEQ ID NO: 31888 - RNA, 39 nt, Artificial Sequence
  Transferrin receptor protein 1 (681-693)
guggaguaccacuuccugagccccuacgucuccccgaag

SEQ ID NO: 31889 - RNA, 42 nt, Artificial Sequence
  Transferrin receptor protein 1 (681-694)
guggaguaccacuuccugagccccuacgucuccccgaaggag

SEQ ID NO: 31890 - RNA, 45 nt, Artificial Sequence
  Phosphoinositide-3-kinase-interacting protein 1 (130-144)
guguucgcccccgccaacgcgcugccggcccgcagcgaggccgcc

SEQ ID NO: 31891 - RNA, 27 nt, Artificial Sequence
  HLA class II histocompatibility antigen, DM alpha chain (12-20)
guguucacccugaagccccucgaguuc

SEQ ID NO: 31892 - RNA, 39 nt, Artificial Sequence
  Cystatin-C (57-69)
gugggcgaguacaacaaggccagcaacgacauguaccac

SEQ ID NO: 31893 - RNA, 45 nt, Artificial Sequence
  Phosphate-regulating neutral endopeptidase (131-145)
gugggcaagauguucgucgacguguacuuccaggaggacaagaag

SEQ ID NO: 31894 - RNA, 48 nt, Artificial Sequence
  Phosphate-regulating neutral endopeptidase (131-146)
gugggcaagauguucgucgacguguacuuccaggaggacaagaaggag

SEQ ID NO: 31895 - RNA, 42 nt, Artificial Sequence
  HLA class II histocompatibility antigen, DO beta chain (70-83)
gugggcauguucgucgcccugaccaagcucgggcagcccgac

SEQ ID NO: 31896 - RNA, 51 nt, Artificial Sequence
  Perilipin-3 (406-422)
gugggccccuucgccccggggaucaccgagaaggcccccgaggagaagaag

SEQ ID NO: 31897 - RNA, 42 nt, Artificial Sequence
  Cullin-associated NEDD8-dissociated protein 1 (747-760)
gugggccaguucauccaggacgucaagaacagccgcuccacc

SEQ ID NO: 31898 - RNA, 45 nt, Artificial Sequence
  Cullin-associated NEDD8-dissociated protein 1 (747-761)
gugggccaguucauccaggacgucaagaacagccgcuccaccgac

SEQ ID NO: 31899 - RNA, 36 nt, Artificial Sequence
  Ceruloplasmin (107-118)
gugcaccugaagaaccucgccagccgccccuacacc

SEQ ID NO: 31900 - RNA, 45 nt, Artificial Sequence
  Polypeptide N-acetylgalactosaminyltransferase 1 (76-90)
gugcacagcgucaucaaccgcuccccccggcacaugaucgaggag

SEQ ID NO: 31901 - RNA, 39 nt, Artificial Sequence
  Interleukin-4 receptor subunit alpha (189-201)
gugaucgccggcaaccccgccuaccgcagcuucuccaac

SEQ ID NO: 31902 - RNA, 30 nt, Artificial Sequence
  Methyltransferase-like protein 7A (45-54)
gugaucuacaacgagcagauggccagcaag

SEQ ID NO: 31903 - RNA, 39 nt, Artificial Sequence
  Plasma membrane calcium-transporting ATPase 1 (111-123)
gugaagaagaugaugaaggacaacaaccugguccgccac

SEQ ID NO: 31904 - RNA, 42 nt, Artificial Sequence
  Vesicle-associated membrane protein 1 (55-68)
gugcuggagcgcgaccagaagcucagcgagcuggacgaccgg

SEQ ID NO: 31905 - RNA, 24 nt, Artificial Sequence
  ATP-binding cassette sub-family A member 6 (320-327)
gugcugcucaagaaggccguccug

SEQ ID NO: 31906 - RNA, 27 nt, Artificial Sequence
  Methyltransferase-like protein 7A (163-171)
gugcugcgccccggcggggccuucuac

SEQ ID NO: 31907 - RNA, 36 nt, Artificial Sequence
  Serine incorporator 3 (91-102)
gugcuggucggcuacaaggccguguaccgcaucagc

SEQ ID NO: 31908 - RNA, 27 nt, Artificial Sequence
  Ras GTPase-activating protein nGAP (848-856)
gugaugcuggacguccccauccgccuc

SEQ ID NO: 31909 - RNA, 30 nt, Artificial Sequence
  B-cell linker protein (9-18)
gugcccgccagccagaagcugcgccagcuc

SEQ ID NO: 31910 - RNA, 27 nt, Artificial Sequence
  Endoplasmic reticulum resident protein 44 (242-250)
gugccccugguccgcgagaucaccuuc

SEQ ID NO: 31911 - RNA, 27 nt, Artificial Sequence
  BRCA2 and CDKN1A-interacting protein (285-293)
gugcccaugaccccgcugcgcaccguc

SEQ ID NO: 31912 - RNA, 57 nt, Artificial Sequence
  Interleukin-4 receptor subunit alpha (241-259)
gugccccagccggagcccgagaccugggagcagauccugcgccggaacguccuccag

SEQ ID NO: 31913 - RNA, 48 nt, Artificial Sequence
  Cation-independent mannose-6-phosphate receptor (1001-1016)
gugcccagcccggucgacugccaggugaccgaccuggccggcaacgag

SEQ ID NO: 31914 - RNA, 42 nt, Artificial Sequence
  Fibromodulin (103-116)
gugcccagccgcaugaaguacgucuacuuccagaacaaccag

SEQ ID NO: 31915 - RNA, 48 nt, Artificial Sequence
  Fibromodulin (103-118)
gugcccagccgcaugaaguacgucuacuuccagaacaaccagaucacc

SEQ ID NO: 31916 - RNA, 51 nt, Artificial Sequence
  Fibromodulin (103-119)
gugcccagccgcaugaaguacgucuacuuccagaacaaccagaucaccucc

SEQ ID NO: 31917 - RNA, 39 nt, Artificial Sequence
  Ragulator complex protein LAMTOR3 (30-42)
gugcccgucaucaagguggccaacgacaacgccccggag

SEQ ID NO: 31918 - RNA, 27 nt, Artificial Sequence
  Beta-1,4-galactosyltransferase 1 (117-125)
gugcccgucccgcacaccaccgcccug

SEQ ID NO: 31919 - RNA, 27 nt, Artificial Sequence
  Plateletoprotein 4 (96-104)
gugcccuacccggucaccaccacggug

SEQ ID NO: 31920 - RNA, 42 nt, Artificial Sequence
  Protocadherin-9 (176-189)
gugcagcacuacgagcugcucaacggccagagcgucuucggg

SEQ ID NO: 31921 - RNA, 45 nt, Artificial Sequence
  Phosphoinositide-3-kinase-interacting protein 1 (128-142)
gugcaggucuucgcccccgccaacgcgcugccggcccgcagcgag

SEQ ID NO: 31922 - RNA, 39 nt, Artificial Sequence
  Cystatin-C (76-88)
gugcgcgcccggaagcagaucgucgccggcgugaacuac

SEQ ID NO: 31923 - RNA, 27 nt, Artificial Sequence
  Perilipin-2 (218-226)
gugcgccugggcagccucuccaccaag

SEQ ID NO: 31924 - RNA, 54 nt, Artificial Sequence
  Cystatin-C (49-66)
gugcgccgggcccuggacuucgccgucggcgaguacaacaaggcgagcaacgac

SEQ ID NO: 31925 - RNA, 36 nt, Artificial Sequence
  SLAM family member 6 (51-62)
gugagcuuccgcugggaggcccugggcaacacccuc

SEQ ID NO: 31926 - RNA, 42 nt, Artificial Sequence
  Rab GTPase-activating protein 1 (17-30)
gugagcacccugaacuccgaggacuucguccucgugagccgc

SEQ ID NO: 31927 - RNA, 45 nt, Artificial Sequence
  Rab GTPase-activating protein 1 (17-31)
gugagcacccugaacuccgaggacuucguccucgugagccgccag

SEQ ID NO: 31928 - RNA, 48 nt, Artificial Sequence
  Rab GTPase-activating protein 1 (17-32)
gugagcacccugaacuccgaggacuucguccucgugagccgccagggc

SEQ ID NO: 31929 - RNA, 39 nt, Artificial Sequence
  HLA class II histocompatibility antigen, DM alpha chain (200-212)
gugacccacgagaucgaccgcuacaccgccaucgccuac

SEQ ID NO: 31930 - RNA, 51 nt, Artificial Sequence
  Fas apoptotic inhibitory molecule 3 (118-134)
gugacccugaacguccacagcgaguacgagcccuccugggaggagcagccg

SEQ ID NO: 31931 - RNA, 27 nt, Artificial Sequence
  Zinc finger protein 296 (209-217)
guggucggccccgccgccgaggcgaag

SEQ ID NO: 31932 - RNA, 42 nt, Artificial Sequence
  Cullin-associated NEDD8-dissociated protein 1 (746-759)
guggucggccaguucauccaggacgugaagaacagccgcucc

SEQ ID NO: 31933 - RNA, 45 nt, Artificial Sequence
  Cullin-associated NEDD8-dissociated protein 1 (746-760)
guggucggccaguucauccaggacgugaagaacagccgcuccacc

SEQ ID NO: 31934 - RNA, 48 nt, Artificial Sequence
  Cullin-associated NEDD8-dissociated protein 1 (746-761)
guggucggccaguucauccaggacgugaagaacagccgcuccaccgac

SEQ ID NO: 31935 - RNA, 51 nt, Artificial Sequence
  Cullin-associated NEDD8-dissociated protein 1 (746-762)
guggucggccaguucauccaggacgugaagaacagccgcuccaccgacagc

SEQ ID NO: 31936 - RNA, 39 nt, Artificial Sequence
  Cystatin-C (75-87)
gugguccgcgcccggaagcagaucguggccggcgugaac

SEQ ID NO: 31937 - RNA, 42 nt, Artificial Sequence
  Cystatin-C (75-88)
gugguccgcgcccggaagcagaucguggccggcgugaacuac

SEQ ID NO: 31938 - RNA, 30 nt, Artificial Sequence
  Negative elongation factor E (371-380)
guguacaaggagaaccuggucgacggcuuc

SEQ ID NO: 31939 - RNA, 30 nt, Artificial Sequence
  Lysine-specific demethylase 2B (316-325)
guguacacccccgucgacagccugguguuc

SEQ ID NO: 31940 - RNA, 39 nt, Artificial Sequence
  Ceruloplasmin (105-117)
guguacguccaccugaagaaccucgccagccgccccuac

SEQ ID NO: 31941 - RNA, 42 nt, Artificial Sequence
  Ceruloplasmin (105-118)
guguacguccaccugaagaaccucgccagccgccccuacacc

SEQ ID NO: 31942 - RNA, 48 nt, Artificial Sequence
  Ceruloplasmin (105-120)
guguacguccaccugaagaaccucgccagccgccccuacaccuuccac

SEQ ID NO: 31943 - RNA, 42 nt, Artificial Sequence
  Glycosyltransferase 8 domain-containing protein 1 (346-359)
ugggagaagugguacauccccgacccgaccggcaaguucaac

SEQ ID NO: 31944 - RNA, 36 nt, Artificial Sequence
  Fibromodulin (133-144)
uggaucgcccugcacggcaaccagaucaccagcgac

SEQ ID NO: 31945 - RNA, 39 nt, Artificial Sequence
  Fibromodulin (133-145)
uggaucgcccugcacggcaaccagaucaccagcgacaag

SEQ ID NO: 31946 - RNA, 36 nt, Artificial Sequence
  Glutathione peroxidase 1 (104-115)
uggaacuucgagaaguuccuggugggccccgacggg

SEQ ID NO: 31947 - RNA, 42 nt, Artificial Sequence
  Platelet endothelial cell adhesion molecule (415-428)
uacgacgcccaguucgaggugaucaagggccagaccaucgag

SEQ ID NO: 31948 - RNA, 36 nt, Artificial Sequence
  Vitamin D-binding protein (84-95)
uacgacacccgcaccagcgcccuguccgccaagagc

SEQ ID NO: 31949 - RNA, 57 nt, Artificial Sequence
  Heterogeneous nuclear ribonucleoprotein A3 (171-189)
uacggcgggggcuacgggagcggcgggggcuccggcggguacggcagccgccgguuc

SEQ ID NO: 31950 - RNA, 42 nt, Artificial Sequence
  Interleukin-4 receptor subunit alpha (302-315)
uacaaggccuucagcucccugcucgccagcuccgcggugagc

SEQ ID NO: 31951 - RNA, 45 nt, Artificial Sequence
  Interleukin-4 receptor subunit alpha (302-316)
uacaaggccuucagcucccugcucgccagcuccgcggugagcccc

SEQ ID NO: 31952 - RNA, 48 nt, Artificial Sequence
  Interleukin-4 receptor subunit alpha (302-317)
uacaaggccuucagcucccugcucgccagcuccgcggugagccccgag

SEQ ID NO: 31953 - RNA, 36 nt, Artificial Sequence
  Glycosyltransferase 8 domain-containing protein 1 (123-134)
uacaagaucgugaacuucgaccccaagcugcucgag

SEQ ID NO: 31954 - RNA, 39 nt, Artificial Sequence
  Glycosyltransferase 8 domain-containing protein 1 (123-135)
uacaagaucgugaacuucgaccccaagcugcucgagggc

SEQ ID NO: 31955 - RNA, 45 nt, Artificial Sequence
  Glycosyltransferase 8 domain-containing protein 1 (123-137)
uacaagaucgugaacuucgaccccaagcugcucgagggcaagguc

SEQ ID NO: 31956 - RNA, 39 nt, Artificial Sequence
  Ragulator complex protein LAMTOR3 (68-80)
uacaacaccuaccaggugguccaguucaaccgccugccc

SEQ ID NO: 31957 - RNA, 42 nt, Artificial Sequence
  Ragulator complex protein LAMTOR3 (68-81)
uacaacaccuaccaggugguccaguucaaccgccugccccuc

SEQ ID NO: 31958 - RNA, 45 nt, Artificial Sequence
  Ragulator complex protein LAMTOR3 (68-82)
uacaacaccuaccaggugguccaguucaaccgccugccccucgug

SEQ ID NO: 31959 - RNA, 48 nt, Artificial Sequence
  Ragulator complex protein LAMTOR3 (68-83)
uacaacaccuaccaggugguccaguucaaccgccugccccucguggug

SEQ ID NO: 31960 - RNA, 27 nt, Artificial Sequence
  Zinc finger protein 638 (459-467)
uaccccaacaagggcguggggcaggcc

SEQ ID NO: 31961 - RNA, 57 nt, Artificial Sequence
  Fas apoptotic inhibitory molecule 3 (81-99)
uacccccgcaagaaccuguuccucguggaggucacccagcugaccgagagcgacucc

SEQ ID NO: 31962 - RNA, 60 nt, Artificial Sequence
  Fas apoptotic inhibitory molecule 3 (81-100)
uacccccgcaagaaccuguuccucguggaggucacccagcugaccgagagcgacuccggc

SEQ ID NO: 31963 - RNA, 27 nt, Artificial Sequence
  Beta-1,4-galactosyltransferase 1 (117-125)
uaccaggugcuggacguccagcgcuac

SEQ ID NO: 31964 - RNA, 42 nt, Artificial Sequence
  Serine incorporator 3 (350-363)
uacagcuccauccgcaccagcaccaacucccagguggacaag

SEQ ID NO: 31965 - RNA, 27 nt, Artificial Sequence
  E3 ubiquitin-protein ligase Mdm2 (48-56)
uacaccaugaaggaggugcuguucuac

SEQ ID NO: 31966 - RNA, 36 nt, Artificial Sequence
  Ceruloplasmin (106-117)
uacgugcaccugaagaaccucgccagccgccccuac

SEQ ID NO: 31967 - RNA, 39 nt, Artificial Sequence
  Ceruloplasmin (106-118)
uacgugcaccugaagaaccucgccagccgccccuacacc

SEQ ID NO: 31968 - RNA, 45 nt, Artificial Sequence
  Ceruloplasmin (106-120)
uacgugcaccugaagaaccucgccagccgccccuacaccuuccac

SEQ ID NO: 31969 - RNA, 24 nt, Artificial Sequence
  HLA class II histocompatibility antigen, DM alpha chain (116-123)
uacugggugccccgcaacgcccug

SEQ ID NO: 31970 - RNA, 42 nt, Artificial Sequence
  Ragulator complex protein LAMTOR3 (67-80)
uacuacaacaccuaccaggugguccaguucaaccgccugccc

SEQ ID NO: 31971 - RNA, 45 nt, Artificial Sequence
  Ragulator complex protein LAMTOR3 (67-81)
uacuacaacaccuaccaggugguccaguucaaccgccugccccuc

SEQ ID NO: 31972 - RNA, 48 nt, Artificial Sequence
  Ragulator complex protein LAMTOR3 (67-82)
uacuacaacaccuaccaggugguccaguucaaccgccugccccucgug

SEQ ID NO: 31973 - RNA, 30 nt, Artificial Sequence
  Melanoma-associated antigen C2 (191-200)
cugcucuucggccuggcccugaucgaggug

SEQ ID NO: 31974 - RNA, 42 nt, Artificial Sequence
  C-C motif chemokine 3 (59-72)
aagcccggcgugaucuuccugaccaagcgcagccggcagguc

SEQ ID NO: 31975 - RNA, 15 nt, Artificial Sequence
  Ig gamma-1 chain C region (91-95)
agcgccguguacuac

SEQ ID NO: 31976 - RNA, 27 nt, Artificial Sequence
  Serum albumin (444-452)
acccccacccugguggaggucagccgc

SEQ ID NO: 31977 - RNA, 36 nt, Artificial Sequence
  DNA topoisomerase 2-alpha (978-989)
gccgaggccgagcgcgugggccugcacaaggucuuc

SEQ ID NO: 31978 - RNA, 36 nt, Artificial Sequence
  Basement membrane-specific heparan sulfate proteoglycan core protein (1484-1495)
gcccuggccgaccucgacgagcugcugauccgcgcg

SEQ ID NO: 31979 - RNA, 36 nt, Artificial Sequence
  Protein phosphatase 1M (122-133)
gcccuguucgacggccacgggggccccgccgcggcc

SEQ ID NO: 31980 - RNA, 39 nt, Artificial Sequence
  Sequestosome-1 (53-65)
gcccuguuccccgcccuccgcccgggcggguuccaggcg

SEQ ID NO: 31981 - RNA, 36 nt, Artificial Sequence
  UPF0585 protein C16orf13 (153-164)
gcccugcucgaggaccugggcaaggccagcgggcug

SEQ ID NO: 31982 - RNA, 39 nt, Artificial Sequence
  Signal transducer and activator of transcription 1-alpha/beta (589-601)
gcccugcucaaggaccagcagcccggcaccuuccugcug

SEQ ID NO: 31983 - RNA, 51 nt, Artificial Sequence
  Glyceraldehyde-3-phosphate dehydrogenase (202-218)
gcccugcagaacaucauccccgccagcaccggcgcggccaaggccgugggg

SEQ ID NO: 31984 - RNA, 36 nt, Artificial Sequence
  Guanine nucleotide-binding protein G(I)/G(S)/G(T) subunit beta-1 (74-85)
gcccugugggacaucgagaccggccagcagaccacg

SEQ ID NO: 31985 - RNA, 36 nt, Artificial Sequence
  26S protease regulatory subunit 7 (76-87)
gcccugugggaccucgccgcggacaagcagacccug

SEQ ID NO: 31986 - RNA, 36 nt, Artificial Sequence
  Peroxisomal multifunctional enzyme type 2 (193-204)
gcccccaacgccggcagccgcaugacccagaccgug

SEQ ID NO: 31987 - RNA, 39 nt, Artificial Sequence
  60S ribosomal protein L13 (47-59)
gccccccgcccggccagcggccccauccggcccaucgug

SEQ ID NO: 31988 - RNA, 39 nt, Artificial Sequence
  HLA class I histocompatibility antigen, A-23 alpha chain (5-17)
gccccccgcacccuggugcuccugcugagcggcgcccuc

SEQ ID NO: 31989 - RNA, 48 nt, Artificial Sequence
  HLA class II histocompatibility antigen, DR alpha chain (51-66)
gcccagggcgcccuggcgaacaucgccguggacaaggccaaccucgag

SEQ ID NO: 31990 - RNA, 36 nt, Artificial Sequence
  Actin, cytoplasmic 2 (19-30)
gccaccgccgcgagcuccagcucccuggagaagagc

SEQ ID NO: 31991 - RNA, 48 nt, Artificial Sequence
  Annexin A2 (52-67)
gacgaggugaccaucgucaacauccugaccaaccgcagcaacgcccag

SEQ ID NO: 31992 - RNA, 39 nt, Artificial Sequence
  Interferon-induced transmembrane protein 1 (71-83)
gacgugaccggcgcccaggccuacgcgagcaccgccaag

SEQ ID NO: 31993 - RNA, 39 nt, Artificial Sequence
  HLA class II histocompatibility antigen, DR alpha chain (50-62)
gaggcccagggcgcccuggcgaacaucgccguggacaag

SEQ ID NO: 31994 - RNA, 51 nt, Artificial Sequence
  HLA class I histocompatibility antigen, Cw-7 alpha chain (152-168)
gaggaccugcgcagcuggaccgccgccgacaccgcggcccagaucacgcag

SEQ ID NO: 31995 - RNA, 48 nt, Artificial Sequence
  Myosin-9 (1232-1247)
gaggagguggacggcaaggccgacggggccgaggcgaagcccgccgag

SEQ ID NO: 31996 - RNA, 51 nt, Artificial Sequence
  Heat shock cognate 71 kDa protein (444-460)
gagggcgagcgcgccaugaccaaggacaacaaccugcucgggaaguucgag

SEQ ID NO: 31997 - RNA, 48 nt, Artificial Sequence
  Actin, cytoplasmic 2 (15-30)
gagcaggagauggccaccgccgcgagcuccagcucccuggagaagagc

SEQ ID NO: 31998 - RNA, 36 nt, Artificial Sequence
  Zinc finger protein ZPR1 (349-360)
uucaucauggacgaccccgccggcaacagcuaccug

SEQ ID NO: 31999 - RNA, 36 nt, Artificial Sequence
  Sorting nexin-14 (234-245)
uuccuggccgaccccgacaccgugaaccaccuccug

SEQ ID NO: 32000 - RNA, 36 nt, Artificial Sequence
  Cytochrome c oxidase assembly factor 3 homolog, mitochondrial (84-95)
uuccuggacgagcucgaggacgaggccaaggccgcg

SEQ ID NO: 32001 - RNA, 36 nt, Artificial Sequence
  Heterogeneous nuclear ribonucleoprotein U (198-209)
uuccugugggccggcgggcgcgccagcuacggcgug

SEQ ID NO: 32002 - RNA, 36 nt, Artificial Sequence
  Arf-GAP with Rho-GAP domain, ANK repeat and PH domain-containing protein 1 (1183-1194)
uucaccgccgacccccugagccuccugcgcaacgug

SEQ ID NO: 32003 - RNA, 36 nt, Artificial Sequence
  Nucleolin (630-641)
ggcgagaucgacgggaacaaggugacccuggacugg

SEQ ID NO: 32004 - RNA, 48 nt, Artificial Sequence
  Heat shock cognate 71 kDa protein (445-460)
ggcgagcgcgccaugaccaaggacaacaaccugcucgggaaguucgag

SEQ ID NO: 32005 - RNA, 51 nt, Artificial Sequence
  Keratin, type I cytoskeletal 9 (15-31)
ggcgggggcgggggcgggggccugggcagcgggggcuccauccgcagcucc

SEQ ID NO: 32006 - RNA, 36 nt, Artificial Sequence
  Putative RNA-binding protein 15 (1399-1410)
ggccuggcccccgccgagguggucguggcgaccgug

SEQ ID NO: 32007 - RNA, 36 nt, Artificial Sequence
  ERI1 exoribonuclease 3 (154-165)
ggccugcucgaccccaacgugaagagcaucuucguc

SEQ ID NO: 32008 - RNA, 39 nt, Artificial Sequence
  Anion exchange protein 2 (714-726)
ggccugcucggggagaagacccaggaccugaucggcgug

SEQ ID NO: 32009 - RNA, 48 nt, Artificial Sequence
  Phosphoglycerate kinase 1 (338-353)
ggccccgugggggucuucgagugggaggccuucgcccgcggcaccaag

SEQ ID NO: 32010 - RNA, 51 nt, Artificial Sequence
  Phosphoglycerate kinase 1 (338-354)
ggccccgugggggucuucgagugggaggccuucgcccgcggcaccaaggcg

SEQ ID NO: 32011 - RNA, 45 nt, Artificial Sequence
  Calmodulin (135-149)
ggccaggugaacuacgaggaguucguccagaugaugaccgccaag

SEQ ID NO: 32012 - RNA, 57 nt, Artificial Sequence
  Keratin, type II cytoskeletal 1 (560-578)
ggcagcgggggcggguccuacggcagcgggggcggcgggggcgggcacggcuccuac

SEQ ID NO: 32013 - RNA, 48 nt, Artificial Sequence
  HLA class I histocompatibility antigen, B-39 alpha chain (25-40)
ggcagccacuccaugcgcuacuucuacaccagcgugucccggcccggg

SEQ ID NO: 32014 - RNA, 39 nt, Artificial Sequence
  Tumor susceptibility gene 101 protein (219-231)
ggcaccaucagcgaggacaccauccgcgccucccugauc

SEQ ID NO: 32015 - RNA, 36 nt, Artificial Sequence
  A-kinase anchor protein 1, mitochondrial (608-619)
aucaucugggagaucgaggugcccaagcaccugguc

SEQ ID NO: 32016 - RNA, 36 nt, Artificial Sequence
  Cirhin (454-465)
auccuguucagcgaggacuccaccaagcucuucgug

SEQ ID NO: 32017 - RNA, 36 nt, Artificial Sequence
  4-hydroxyphenylpyruvate dioxygenase-like protein (312-323)
auccugcucgacggcgacaaggggaaguuccugcug

SEQ ID NO: 32018 - RNA, 39 nt, Artificial Sequence
  Nucleosome-remodeling factor subunit BPTF (1571-1583)
aagaucauccccgagaacgacaucaagagccugaccgug

SEQ ID NO: 32019 - RNA, 39 nt, Artificial Sequence
  Centrin-3 (108-120)
aagcuguucgacgacgacgacagcggcaagaucucccuc

SEQ ID NO: 32020 - RNA, 36 nt, Artificial Sequence
  Uridine-cytidine kinase 2 (2-13)
aagcuguucguggacaccgacgccgacacccgccuc

SEQ ID NO: 32021 - RNA, 36 nt, Artificial Sequence
  Retinoic acid receptor RXR-gamma (441-452)
aagcugaucggcgacacccccaucgacaccuuccuc

SEQ ID NO: 32022 - RNA, 39 nt, Artificial Sequence
  40S ribosomal protein S17 (107-119)
aagcugcucgacuucggcagccuguccaaccugcaggug

SEQ ID NO: 32023 - RNA, 36 nt, Artificial Sequence
  Golgin subfamily A member 4 (849-860)
aagcugcucgaccuggagaccgagcgcauccugcuc

SEQ ID NO: 32024 - RNA, 36 nt, Artificial Sequence
  Utrophin (226-237)
aagcugcucgaccccgaggacguggccguccagcug

SEQ ID NO: 32025 - RNA, 36 nt, Artificial Sequence
  Prelamin-A/C (297-308)
aagcugcucgagggcgaggaggagcgccugcggcug

SEQ ID NO: 32026 - RNA, 36 nt, Artificial Sequence
  Vimentin (236-247)
aagcugcucgagggcgaggagagccgcaucucccug

SEQ ID NO: 32027 - RNA, 42 nt, Artificial Sequence
  V-type proton ATPase subunit H (396-409)
aagcugcucgaggugagcgacgacccccagguccuggccgug

SEQ ID NO: 32028 - RNA, 39 nt, Artificial Sequence
  Methionine aminopeptidase 1 (15-27)
aagcugcucagcuccgaggacaucgagggcaugcgccug

SEQ ID NO: 32029 - RNA, 36 nt, Artificial Sequence
  Isovaleryl-CoA dehydrogenase, mitochondrial (398-409)
aagcuguacgagaucggcgccgggaccagcgaggug

SEQ ID NO: 32030 - RNA, 36 nt, Artificial Sequence
  Eukaryotic translation initiation factor 3 subunit C-like protein (765-776)
aaggugugggaccuguuccccgaggccgacaagguc

SEQ ID NO: 32031 - RNA, 45 nt, Artificial Sequence
  HLA class I histocompatibility antigen, Cw-7 alpha chain (154-168)
cugcgcagcuggaccgccgccgacaccgcggcccagaucacgcag

SEQ ID NO: 32032 - RNA, 42 nt, Artificial Sequence
  Mitochondrial import receptor subunit TOM5 homolog (38-51)
cugcgcgugacccccuucauccucaagaagcuggacagcauc

SEQ ID NO: 32033 - RNA, 39 nt, Artificial Sequence
  Beta-2-microglobulin (89-101)
cugagccagcccaagaucgugaagugggaccgcgacaug

SEQ ID NO: 32034 - RNA, 39 nt, Artificial Sequence
  Actin, cytoplasmic 2 (18-30)
auggccaccgccgcgagcuccagcucccuggagaagagc

SEQ ID NO: 32035 - RNA, 57 nt, Artificial Sequence
  HLA class I histocompatibility antigen, Cw-7 alpha chain (151-169)
aacgaggaccugcgcagcuggaccgccgccgacaccgcggcccagaucacgcagcgg

SEQ ID NO: 32036 - RNA, 36 nt, Artificial Sequence
  Alkyldihydroxyacetonephosphate synthase, peroxisomal (324-335)
aacaucuacggcaacaucgaggaccuggugguccac

SEQ ID NO: 32037 - RNA, 36 nt, Artificial Sequence
  Poly(U)-binding-splicing factor PUF60 (270-281)
aaccuguucgaccucggcgggcaguaccugcgcgug

SEQ ID NO: 32038 - RNA, 36 nt, Artificial Sequence
  Inosine-5'-monophosphate dehydrogenase 2 (312-323)
aaccugaucgacgccggcguggacgcccuccgcguc

SEQ ID NO: 32039 - RNA, 36 nt, Artificial Sequence
  Cyclin-dependent kinase 1 (133-144)
aaccugcucaucgacgacaagggcaccaucaagcug

SEQ ID NO: 32040 - RNA, 42 nt, Artificial Sequence
  Protein ERGIC-53 (162-175)
aaccccgccaucgugaucaucggcaacaacgggcagauccac

SEQ ID NO: 32041 - RNA, 51 nt, Artificial Sequence
  Heat shock 70 kDa protein 1-like (170-186)
aacgugcugcgcaucaucaacgagcccaccgccgccgcgaucgccuacggc

SEQ ID NO: 32042 - RNA, 51 nt, Artificial Sequence
  Hsp90 co-chaperone Cdc37 (362-378)
ccccugcucgaggccgugccgaagaccggcgacgagaaggacgucagcgug

SEQ ID NO: 32043 - RNA, 36 nt, Artificial Sequence
  Nucleolar RNA helicase 2 (109-120)
caggagauccccguggagcagaaggagggcgccuuc

SEQ ID NO: 32044 - RNA, 36 nt, Artificial Sequence
  Signal recognition particle 54 kDa protein (385-396)
caggagcuggacagcaccgacggcgccaagguguuc

SEQ ID NO: 32045 - RNA, 48 nt, Artificial Sequence
  Septin-2 (381-396)
cagaugcagggcggggacggcgacgggggcgcccuggggcaccacgug

SEQ ID NO: 32046 - RNA, 36 nt, Artificial Sequence
  Polyadenylate-binding protein 4 (179-190)
cgcgaggccgagcugggcgccaaggcgaaggaguuc

SEQ ID NO: 32047 - RNA, 36 nt, Artificial Sequence
  Polyadenylate-binding protein 3 (179-190)
cgcgaggccgagcugggcgcccgggcgaaggaguuc

SEQ ID NO: 32048 - RNA, 36 nt, Artificial Sequence
  Bromodomain adjacent to zinc finger domain protein 2B (1684-1695)
cgcaucaucgaccccgaggaccugaaggcccuccug

SEQ ID NO: 32049 - RNA, 36 nt, Artificial Sequence
  Nucleolar complex protein 2 homolog (10-21)
cgccuggccgagcucaccguggacgaguuccuggcc

SEQ ID NO: 32050 - RNA, 36 nt, Artificial Sequence
  Protein unc-45 homolog A (202-213)
cgccugcucgacaugggcgagaccgaccugaugcug

SEQ ID NO: 32051 - RNA, 36 nt, Artificial Sequence
  Iron-sulfur cluster assembly 2 homolog, mitochondrial (59-70)
cgccugcucgagaucaccgagggcagcgaguuccug

SEQ ID NO: 32052 - RNA, 36 nt, Artificial Sequence
  Cytoskeleton-associated protein 5 (1718-1729)
cgccugcuccccgacaccaucaacagcaucaaccug

SEQ ID NO: 32053 - RNA, 39 nt, Artificial Sequence
  ATP-dependent RNA helicase DHX36 (643-655)
cgccugauggaccccccgagcaacgaggccgugcuccug

SEQ ID NO: 32054 - RNA, 36 nt, Artificial Sequence
  Multidrug resistance protein 1 (378-389)
cgccuguacgaccccaccgagggcauggugagcguc

SEQ ID NO: 32055 - RNA, 42 nt, Artificial Sequence
  WD repeat-containing protein 11 (918-931)
cgccuguacggcgacgagagcgagcuccacuucuggaccgug

SEQ ID NO: 32056 - RNA, 36 nt, Artificial Sequence
  Transmembrane emp24 domain-containing protein 9 (11-22)
cgcccccggccgggcaccgggcugggccgcgugaug

SEQ ID NO: 32057 - RNA, 36 nt, Artificial Sequence
  Serine-rich coiled-coil domain-containing protein 2 (24-35)
cgccccuacgccgccggcgggaagaagcuggcgcuc

SEQ ID NO: 32058 - RNA, 36 nt, Artificial Sequence
  Anaphase-promoting complex subunit 2 (163-174)
cgcgugcuggaccccagcauggucauccucgaggug

SEQ ID NO: 32059 - RNA, 42 nt, Artificial Sequence
  HLA class I histocompatibility antigen, A-23 alpha chain (352-365)
agcgcccagggcuccgacgugagccugaccgccugcaagguc

SEQ ID NO: 32060 - RNA, 36 nt, Artificial Sequence
  Protein KRI1 homolog (456-467)
agcgagcaggaggagcugcgcgacaagcgggccuac

SEQ ID NO: 32061 - RNA, 48 nt, Artificial Sequence
  Keratin, type I cytoskeletal 9 (13-28)
agcggcgggggcgggggcgggggccugggcuccgggggcagcauccgc

SEQ ID NO: 32062 - RNA, 36 nt, Artificial Sequence
  Stress-70 protein, mitochondrial (253-264)
agcauccuggagauccagaagggcguguucgagguc

SEQ ID NO: 32063 - RNA, 36 nt, Artificial Sequence
  Centrosomal protein of 192 kDa (19-30)
agccuguucggcaacuccgggauccucgagaacgug

SEQ ID NO: 32064 - RNA, 36 nt, Artificial Sequence
  DNA-dependent protein kinase catalytic subunit (3305-3316)
agccugcucgacgagaacaacguguccagcuaccug

SEQ ID NO: 32065 - RNA, 36 nt, Artificial Sequence
  Zinc finger protein 829 (85-96)
agccugcucgagcagggcaaggagcccuggauggug

SEQ ID NO: 32066 - RNA, 42 nt, Artificial Sequence
  Renin receptor (241-254)
agccuguacggcgggaacgccguggucgagcucgugaccgug

SEQ ID NO: 32067 - RNA, 39 nt, Artificial Sequence
  Protein kinase C-binding protein 1 (470-482)
agccccgccuccaccaagaccggccaggccgggagccug

SEQ ID NO: 32068 - RNA, 42 nt, Artificial Sequence
  AT-rich interactive domain-containing protein 1A (233-246)
agcccccgcggcgggaccccgggcuccggggccgccgcggcc

SEQ ID NO: 32069 - RNA, 36 nt, Artificial Sequence
  E3 ubiquitin-protein ligase TRIP12 (1954-1965)
agcccccgccugccggugggcggguuccggucccuc

SEQ ID NO: 32070 - RNA, 36 nt, Artificial Sequence
  Msx2-interacting protein (1024-1035)
agcccccgcccguccggccccgggcccagcuccuuc

SEQ ID NO: 32071 - RNA, 36 nt, Artificial Sequence
  Long-chain-fatty-acid-CoA ligase 1 (687-698)
agccagaucgacgaccuguacuccaccaucaaggug

SEQ ID NO: 32072 - RNA, 54 nt, Artificial Sequence
  Keratin, type I cytoskeletal 9 (12-29)
agccgcuccggcgggggcgggggcgggggccugggcagcgggggcuccauccgg

SEQ ID NO: 32073 - RNA, 60 nt, Artificial Sequence
  Keratin, type I cytoskeletal 9 (12-31)
agccgcuccggcgggggcgggggcgggggccugggcagcgggggcuccauccggagcucc

SEQ ID NO: 32074 - RNA, 63 nt, Artificial Sequence
  Keratin, type I cytoskeletal 9 (12-32)
agccgcuccggcgggggcgggggcgggggccugggcagcgggggcuccauccggagcuccuac

SEQ ID NO: 32075 - RNA, 60 nt, Artificial Sequence
  Cytochrome c oxidase subunit 6A1, mitochondrial (2-21)
agcuccggcgcccacggggaggagggcagcgcccgcauguggaagacccugaccuucuuc

SEQ ID NO: 32076 - RNA, 42 nt, Artificial Sequence
  Glyceraldehyde-3-phosphate dehydrogenase (2-15)
agcaccuucgacgccggcgccgggaucgcgcugaacgaccac

SEQ ID NO: 32077 - RNA, 36 nt, Artificial Sequence
  HLA class I histocompatibility antigen, B-15 alpha chain (158-169)
accgccgccgacaccgcggcccagaucacgcagcgc

SEQ ID NO: 32078 - RNA, 36 nt, Artificial Sequence
  Intercellular adhesion molecule 3 (536-547)
accgaggccaugggcgaggagcccagccgcgccgag

SEQ ID NO: 32079 - RNA, 36 nt, Artificial Sequence
  Ragulator complex protein LAMTOR5 (36-47)
acccugagcgacgagcacgccggcgugaucuccguc

SEQ ID NO: 32080 - RNA, 36 nt, Artificial Sequence
  Treacle protein (102-113)
accccccgccuggccagcaccaacuccagcgugcuc

SEQ ID NO: 32081 - RNA, 36 nt, Artificial Sequence
  Neuropilin-2 (234-245)
acccccagcgagcugcgcuccagcaccggcauccuc

SEQ ID NO: 32082 - RNA, 66 nt, Artificial Sequence
  Cytochrome c oxidase subunit 7A2, mitochondrial (62-83)
accgugggcgggaccgccuacgccaucuacgagcuggcggucgccagcuuccccaagaagcaggag

SEQ ID NO: 32083 - RNA, 51 nt, Artificial Sequence
  HLA class I histocompatibility antigen, Cw-5 alpha chain (52-68)
guggacgacacccaguucguccaguucgacagcgacgccgccuccccccgc

SEQ ID NO: 32084 - RNA, 51 nt, Artificial Sequence
  HLA class I histocompatibility antigen, alpha chain E (49-65)
guggacgacacccaguucguccgcuucgacaacgacgccgccagcccccgg

SEQ ID NO: 32085 - RNA, 57 nt, Artificial Sequence
  HLA class I histocompatibility antigen, B-55 alpha chain (52-70)
guggacgacacccaguucguccgcuucgacagcgacgccgccuccccccgggaggag

SEQ ID NO: 32086 - RNA, 60 nt, Artificial Sequence
  HLA class I histocompatibility antigen, B-55 alpha chain (52-71)
guggacgacacccaguucguccgcuucgacagcgacgccgccuccccccgggaggagccg

SEQ ID NO: 32087 - RNA, 39 nt, Artificial Sequence
  butyrophilin subfamily 3 member A3 secreted isoform (174-186)
gugauccuggaccccgacaccgccaacgccauccuccug

SEQ ID NO: 32088 - RNA, 39 nt, Artificial Sequence
  Dihydropyrimidinase-related protein 2 (374-386)
gugaucugggaccccgacagcgucaagaccaucuccgcc

SEQ ID NO: 32089 - RNA, 36 nt, Artificial Sequence
  Exocyst complex component 4 (203-214)
gugcuggccgagaucaacaaggagaucgagggcguc

SEQ ID NO: 32090 - RNA, 36 nt, Artificial Sequence
  Deoxyuridine 5'-triphosphate nucleotidohydrolase, mitochondrial (112-123)
gugcuguucaacuucggcaaggagaaguucgagguc

SEQ ID NO: 32091 - RNA, 42 nt, Artificial Sequence
  Translocon-associated protein subunit alpha (19-32)
gugcuguuccgcggcgggccccggggccuccuggccgucgcc

SEQ ID NO: 32092 - RNA, 48 nt, Artificial Sequence
  Heat shock 70 kDa protein 1-like (171-186)
gugcugcgcaucaucaacgagcccaccgccgccgcgaucgccuacggc

SEQ ID NO: 32093 - RNA, 39 nt, Artificial Sequence
  G2/mitotic-specific cyclin-B1 (388-400)
gugauggucaaccagggccugaccaagcacaugaccgug

SEQ ID NO: 32094 - RNA, 39 nt, Artificial Sequence
  Endoplasmic reticulum resident protein 29 (5-17)
gugccccgcgccgccuuccugagcccgcuccugccccug

SEQ ID NO: 32095 - RNA, 36 nt, Artificial Sequence
  Lysosomal alpha-glucosidase (38-49)
gugccccgcgagcugagcggcuccagcccgguccuc

SEQ ID NO: 32096 - RNA, 42 nt, Artificial Sequence
  HLA class I histocompatibility antigen, B-15 alpha chain (241-254)
uggcagcgcgacggcgaggaccagacccaggacaccgagcug

SEQ ID NO: 32097 - RNA, 39 nt, Artificial Sequence
  V-type proton ATPase subunit S1 (77-89)
uaccuggaccccgcccucgagcugggcccgcgcaacgug

SEQ ID NO: 32098 - RNA, 36 nt, Artificial Sequence
  Armadillo repeat-containing protein 8 (306-317)
uaccugaucgagcccgacguggagcuccagcgcauc

SEQ ID NO: 32099 - RNA, 36 nt, Artificial Sequence
  F-actin-capping protein subunit beta (120-131)
uaccugugggaccucgaccacggcuucgccggggug

SEQ ID NO: 32100 - RNA, 36 nt, Artificial Sequence
  40S ribosomal protein S8 (188-199)
uacgugcuggagggcaaggagcucgaguucuaccug

SEQ ID NO: 32101 - RNA, 45 nt, Artificial Sequence
  DnaJ homolog subfamily C member 3 (3-17)
gcccccggcagcgugaccucccgccuggggagcgucuucccguuc

SEQ ID NO: 32102 - RNA, 27 nt, Artificial Sequence
  Pre-rRNA-processing protein TSR1 homolog (480-488)
gcccgcaucuuccaguuccagaacuuc

SEQ ID NO: 32103 - RNA, 27 nt, Artificial Sequence
  Protein FAM98B (250-258)
gcccgcaucuaccagcccaagcgguac

SEQ ID NO: 32104 - RNA, 27 nt, Artificial Sequence
  Acyl-CoA desaturase (130-138)
gcccgccugccccuccggcuguuccug

SEQ ID NO: 32105 - RNA, 27 nt, Artificial Sequence
  Serine/arginine-rich splicing factor 3 (42-50)
gcccgcaaccccccgggcuucgccuuc

SEQ ID NO: 32106 - RNA, 33 nt, Artificial Sequence
  ATP synthase F(0) complex subunit C1, mitochondrial (62-72)
gcccgcaaccccagccugaagcagcagcucuuc

SEQ ID NO: 32107 - RNA, 27 nt, Artificial Sequence
  40S ribosomal protein S28 (12-20)
gcccgcgugaccaagguccugggccgg

SEQ ID NO: 32108 - RNA, 27 nt, Artificial Sequence
  Rab GDP dissociation inhibitor alpha (217-225)
gcccgcuacggcaagagccccuaccug

SEQ ID NO: 32109 - RNA, 27 nt, Artificial Sequence
  Vacuolar fusion protein CCZ1 homolog (167-175)
gagcgccuggagaaguucuuccaccgg

SEQ ID NO: 32110 - RNA, 27 nt, Artificial Sequence
  Mitochondrial import receptor subunit TOM5 homolog (2-10)
uuccgcaucgagggccuggcccccaag

SEQ ID NO: 32111 - RNA, 33 nt, Artificial Sequence
  Lysosome-associated membraneoprotein 2 (4-14)
uuccgccuguuccccgugccgggcagcgggcuc

SEQ ID NO: 32112 - RNA, 30 nt, Artificial Sequence
  60S ribosomal protein L28 (38-47)
uuccgcuacaacggccugauccaccggaag

SEQ ID NO: 32113 - RNA, 30 nt, Artificial Sequence
  Menin (410-419)
ggccgcuucgaggggcaggugcggcagaag

SEQ ID NO: 32114 - RNA, 36 nt, Artificial Sequence
  Myelin basic protein (43-54)
ggccgcuucuucgggggcgaccggggggcccccaag

SEQ ID NO: 32115 - RNA, 27 nt, Artificial Sequence
  Rho guanine nucleotide exchange factor 2 (459-467)
ggccgcuucaaggacgugcugguccuc

SEQ ID NO: 32116 - RNA, 27 nt, Artificial Sequence
  Protein OS-9 (125-133)
ggccgccacauccagcaguaccacaug

SEQ ID NO: 32117 - RNA, 27 nt, Artificial Sequence
  26S protease regulatory subunit 4 (345-353)
ggccgcaucgaccggaagaucgaguuc

SEQ ID NO: 32118 - RNA, 27 nt, Artificial Sequence
  Uncharacterized protein C1orf131 (262-270)
ggccgcaucgggcaggugggcaaguuc

SEQ ID NO: 32119 - RNA, 27 nt, Artificial Sequence
  Glyceraldehyde-3-phosphate dehydrogenase (12-20)
ggccgcaucgggcggcuggugacccgc

SEQ ID NO: 32120 - RNA, 27 nt, Artificial Sequence
  Induced myeloid leukemia cell differentiation protein Mcl-1 (109-117)
ggccgcaucgugacccugaucagcuuc

SEQ ID NO: 32121 - RNA, 33 nt, Artificial Sequence
  60S ribosomal protein L13a (139-149)
ggccgccuggcccacgaggugggguggaaguac

SEQ ID NO: 32122 - RNA, 27 nt, Artificial Sequence
  Protein MON2 homolog (593-601)
ggccgccuggggcucgugaccagccgg

SEQ ID NO: 32123 - RNA, 27 nt, Artificial Sequence
  Protein transport protein Sec23B (152-160)
ggccgcauggugcagguccacgagcug

SEQ ID NO: 32124 - RNA, 27 nt, Artificial Sequence
  Major facilitator superfamily domain-containing protein 10 (356-364)
ggccgcagccugcccgugcucgggcug

SEQ ID NO: 32125 - RNA, 27 nt, Artificial Sequence
  Unconventional myosin-Ic (676-684)
ggccgcaccaagaucuucauccgguuc

SEQ ID NO: 32126 - RNA, 27 nt, Artificial Sequence
  Protein CNPPD1 (197-205)
ggccgcuggcgggggugguacaccuac

SEQ ID NO: 32127 - RNA, 27 nt, Artificial Sequence
  E3 ubiquitin-protein ligase MYCBP2 (3264-3272)
ggccgcuacgccgggggccagggguac

SEQ ID NO: 32128 - RNA, 27 nt, Artificial Sequence
  NEDD4 family-interacting protein 1 (145-153)
ggccgcuacggggccaucagcggcuuc

SEQ ID NO: 32129 - RNA, 33 nt, Artificial Sequence
  NEDD4 family-interacting protein 1 (145-155)
ggccgcuacggggccaucagcggcuucgggcug

SEQ ID NO: 32130 - RNA, 27 nt, Artificial Sequence
  Inositol hexakisphosphate kinase 2 (296-304)
ggccgcuaccugcggcgcgagcuccug

SEQ ID NO: 32131 - RNA, 27 nt, Artificial Sequence
  Translocon-associated protein subunit delta (84-92)
ggccgcuaccaggugagcuggucccug

SEQ ID NO: 32132 - RNA, 27 nt, Artificial Sequence
  Cleavage and polyadenylation specificity factor subunit 5 (89-97)
caccgccugccccacgugcuccugcug

SEQ ID NO: 32133 - RNA, 27 nt, Artificial Sequence
  Zinc finger protein 281 (55-63)
caccgccugcccccggugaccagcuuc

SEQ ID NO: 32134 - RNA, 30 nt, Artificial Sequence
  Calpain-1 catalytic subunit (132-141)
caccgcguggucccccacggccagagcuuc

SEQ ID NO: 32135 - RNA, 30 nt, Artificial Sequence
  X-ray repair cross-complementing protein 6 (338-347)
aagcgcuucgacgaccccggccugaugcuc

SEQ ID NO: 32136 - RNA, 30 nt, Artificial Sequence
  Copine-1 (190-199)
aagcgcuucagcgugcccguccagcacuuc

SEQ ID NO: 32137 - RNA, 27 nt, Artificial Sequence
  Ornithine decarboxylase antizyme 1 (58-66)
aagcgcaucaacuggcggaccgugcug

SEQ ID NO: 32138 - RNA, 27 nt, Artificial Sequence
  Bax inhibitor 1 (129-137)
aagcgccugggccuccuggccggguuc

SEQ ID NO: 32139 - RNA, 27 nt, Artificial Sequence
  Pre-rRNA-processing protein TSR1 homolog (726-734)
aagcgcguguuccccaaguggaccuac

SEQ ID NO: 32140 - RNA, 30 nt, Artificial Sequence
  Pre-mRNA-processing-splicing factor 8 (85-94)
aagcgcguguaccugggcgcccucaaguac

SEQ ID NO: 32141 - RNA, 30 nt, Artificial Sequence
  ER degradation-enhancing alpha-mannosidase-like protein 1 (467-476)
aagcgcuacggcgcccugcccgagcgguac

SEQ ID NO: 32142 - RNA, 27 nt, Artificial Sequence
  Mitochondrial import receptor subunit TOM5 homolog (38-46)
cugcgcgugacccccuucauccucaag

SEQ ID NO: 32143 - RNA, 27 nt, Artificial Sequence
  Interferon alpha-inducible protein 6 (1-9)
augcgccagaaggccgugagccuguuc

SEQ ID NO: 32144 - RNA, 30 nt, Artificial Sequence
  Interferon alpha-inducible protein 6 (1-10)
augcgccagaaggccgugagccuguuccuc

SEQ ID NO: 32145 - RNA, 27 nt, Artificial Sequence
  Double-strand-break repair protein rad21 homolog (383-391)
aaccgccugcucaagcuguucacccgg

SEQ ID NO: 32146 - RNA, 27 nt, Artificial Sequence
  ER degradation-enhancing alpha-mannosidase-like protein 1 (35-43)
cagcgcuucccccugagcuucggcuuc

SEQ ID NO: 32147 - RNA, 27 nt, Artificial Sequence
  B-cell receptor-associated protein 31 (100-108)
cagcgcaaccuguacaucgccggcuuc

SEQ ID NO: 32148 - RNA, 33 nt, Artificial Sequence
  Chondroitin sulfate glucuronyltransferase (434-444)
cgccgguucgaccccgcccgcggcauggaguac

SEQ ID NO: 32149 - RNA, 27 nt, Artificial Sequence
  Nuclear envelope integral membrane protein 1 (157-165)
cgccgguucgaccccaagcuguuccuc

SEQ ID NO: 32150 - RNA, 27 nt, Artificial Sequence
  ER membrane protein complex subunit 4 (13-21)
cgccgguucaagugggccaucgagcug

SEQ ID NO: 32151 - RNA, 27 nt, Artificial Sequence
  Ras GTPase-activating protein-binding protein 1 (106-114)
cgccgguucaugcagaccuucgugcug

SEQ ID NO: 32152 - RNA, 27 nt, Artificial Sequence
  Cullin-7 (439-447)
cgccgguuccgcccccggagcgaguuc

SEQ ID NO: 32153 - RNA, 27 nt, Artificial Sequence
  Ubiquitin carboxyl-terminal hydrolase 22 (367-375)
cgccgguucacccgccccgagcaccug

SEQ ID NO: 32154 - RNA, 27 nt, Artificial Sequence
  Cytochrome c oxidase subunit 7C, mitochondrial (7-15)
cgccgguucaccaccagcgugguccgc

SEQ ID NO: 32155 - RNA, 33 nt, Artificial Sequence
  40S ribosomal protein S30 (114-124)
cgccgguucgugaacgucgugcccaccuucggc

SEQ ID NO: 32156 - RNA, 27 nt, Artificial Sequence
  Acyl-CoA desaturase (174-182)
cgccggggcuucuucuucagccacgug

SEQ ID NO: 32157 - RNA, 27 nt, Artificial Sequence
  Store-operated calcium entry-associated regulatory factor (56-64)
cgccggcuggaccccaucccgcagcuc

SEQ ID NO: 32158 - RNA, 30 nt, Artificial Sequence
  Melanoma-associated antigen F1 (195-204)
cgccggcugggcgugcagcccagcaaguac

SEQ ID NO: 32159 - RNA, 27 nt, Artificial Sequence
  Transformation/transcription domain-associated protein (2920-2928)
cgccggcugccccacguggucagccac

SEQ ID NO: 32160 - RNA, 27 nt, Artificial Sequence
  Heat shock protein HSP 90-beta (375-383)
cgccggcugagcgagcuccugcgcuac

SEQ ID NO: 32161 - RNA, 27 nt, Artificial Sequence
  DNA-directed RNA polymerase II subunit RPB1 (1052-1060)
cgccggauggccgaggaguuccgccug

SEQ ID NO: 32162 - RNA, 30 nt, Artificial Sequence
  Signal-induced proliferation-associated 1-like protein 2 (954-963)
cgccggaacggccuggggcagcucggcuuc

SEQ ID NO: 32163 - RNA, 27 nt, Artificial Sequence
  NADH dehydrogenase (ubiquinone) 1 subunit C2 (4-12)
cgccggaaccccgagccgcugcgcuuc

SEQ ID NO: 32164 - RNA, 30 nt, Artificial Sequence
  Elongation factor 2 (341-350)
cgccgguggcugcccgccggcgacgcccuc

SEQ ID NO: 32165 - RNA, 27 nt, Artificial Sequence
  Eukaryotic initiation factor 4A-I (168-176)
cgccgguaccugagccccaaguacauc

SEQ ID NO: 32166 - RNA, 27 nt, Artificial Sequence
  60S ribosomal protein L17 (61-69)
cgccgguacaacggcggggugggccgc

SEQ ID NO: 32167 - RNA, 30 nt, Artificial Sequence
  Eukaryotic translation initiation factor 3 subunit L (327-336)
cgccgguaccaggacgccauccgcguguuc

SEQ ID NO: 32168 - RNA, 27 nt, Artificial Sequence
  Charged multivesicular body protein 2a (70-78)
cgccgguacgugcgcaaguucguccug

SEQ ID NO: 32169 - RNA, 27 nt, Artificial Sequence
  Histone H2A type 1-A (20-28)
agccgcgccggccugcaguuccccgug

SEQ ID NO: 32170 - RNA, 27 nt, Artificial Sequence
  Pre-mRNA cleavage complex 2 protein Pcf11 (1103-1111)
agccgcuucgacaucccccugggccuc

SEQ ID NO: 32171 - RNA, 27 nt, Artificial Sequence
  Pericentrin (1289-1297)
agccgcuucgagaaggaguucuccuuc

SEQ ID NO: 32172 - RNA, 27 nt, Artificial Sequence
  Myosin-7 (242-250)
agccgcuucggcaaguucauccggauc

SEQ ID NO: 32173 - RNA, 27 nt, Artificial Sequence
  Pre-mRNA-processing-splicing factor 8 (538-546)
agccgcuucggcaacgccuuccaccug

SEQ ID NO: 32174 - RNA, 33 nt, Artificial Sequence
  EH domain-containing protein 4 (129-139)
agccgcuucggcaacgccuuccugaaccgguuc

SEQ ID NO: 32175 - RNA, 27 nt, Artificial Sequence
  DNA replication licensing factor MCM7 (227-235)
agccgcuucaucaaguuccaggagaug

SEQ ID NO: 32176 - RNA, 27 nt, Artificial Sequence
  ATP-dependent RNA helicase DDX3X (591-599)
agccgcuucuccggcggguucggcgcc

SEQ ID NO: 32177 - RNA, 30 nt, Artificial Sequence
  NADH dehydrogenase (ubiquinone) 1 beta subcomplex subunit 5, mitochondrial (60-69)
agccgcuucuacgaccggcgcuuccugaag

SEQ ID NO: 32178 - RNA, 27 nt, Artificial Sequence
  Hypoxia-inducible factor 1-alpha (268-276)
agccgccacucccuggacaugaaguuc

SEQ ID NO: 32179 - RNA, 33 nt, Artificial Sequence
  Ubiquitin fusion degradation protein 1 homolog (57-67)
agccgccugaacaucaccuaccccaugcucuuc

SEQ ID NO: 32180 - RNA, 27 nt, Artificial Sequence
  Protein diaphanous homolog 3 (854-862)
agccgcaacgcccagaccuucggcuuc

SEQ ID NO: 32181 - RNA, 27 nt, Artificial Sequence
  Cytochrome b-c1 complex subunit 8 (9-17)
acccgcaugcggcacgugaucagcuac

SEQ ID NO: 32182 - RNA, 27 nt, Artificial Sequence
  WD repeat-containing protein 36 (383-391)
gugcgccugcccccgaucaccaaguuc

SEQ ID NO: 32183 - RNA, 42 nt, Artificial Sequence
  POTE ankyrin domain family member F (791-804)
uacaacgagcugcgcguggcccccgaggagcacccgguccuc

SEQ ID NO: 32184 - RNA, 27 nt, Artificial Sequence
  Dystonin (7305-7313)
uaccgcuucuuccugggcaaccaguuc

SEQ ID NO: 32185 - RNA, 27 nt, Artificial Sequence
  BTB/POZ domain-containing protein KCTD20 (192-200)
ggccgcagcgaggugaucuacaacuac

SEQ ID NO: 32186 - RNA, 27 nt, Artificial Sequence
  Filamin-B (2069-2077)
ggccgcgugaaggagagcaucacccgg

SEQ ID NO: 32187 - RNA, 27 nt, Artificial Sequence
  Intron-binding protein aquarius (896-904)
ggccgcgugaacuacguccuggcccgg

SEQ ID NO: 32188 - RNA, 33 nt, Artificial Sequence
  Integrin-linked protein kinase (149-159)
ggccgcuggcaggggaacgacaucguggucaag

SEQ ID NO: 32189 - RNA, 27 nt, Artificial Sequence
  Serine/threonine-protein kinase 38 (446-454)
aagcgcuucgagggccugaccgcccgg

SEQ ID NO: 32190 - RNA, 27 nt, Artificial Sequence
  39S ribosomal protein L43, mitochondrial (27-35)
cagcgccugagcuucuccgugagccgg

SEQ ID NO: 32191 - RNA, 27 nt, Artificial Sequence
  Protein diaphanous homolog 1 (967-975)
agccgcaacgccggcgccuucggguuc

SEQ ID NO: 32192 - RNA, 30 nt, Artificial Sequence
  WD repeat-containing protein 1 (55-64)
gugcgcuucagccccgacggcaaccgguuc

SEQ ID NO: 32193 - RNA, 39 nt, Artificial Sequence
  Elongation factor 1-beta (213-225)
uacgugcagagcauggacgucgccgccuucaacaagauc

SEQ ID NO: 32194 - RNA, 27 nt, Artificial Sequence
  T-complex protein 1 subunit zeta (2-10)
gccgccgugaagacccugaaccccaag

SEQ ID NO: 32195 - RNA, 33 nt, Artificial Sequence
  40S ribosomal protein S21 (73-83)
gccaaggccgacggcaucgugagcaagaacuuc

SEQ ID NO: 32196 - RNA, 33 nt, Artificial Sequence
  Alpha-enolase (13-23)
gacagccgcggcaaccccaccguggaggucgac

SEQ ID NO: 32197 - RNA, 27 nt, Artificial Sequence
  Triosephosphate isomerase (159-167)
uucguggacaucaucaacgccaagcag

SEQ ID NO: 32198 - RNA, 27 nt, Artificial Sequence
  60S ribosomal protein L37 (76-84)
cacggcuuccgcgaggggaccaccccc

SEQ ID NO: 32199 - RNA, 27 nt, Artificial Sequence
  Store-operated calcium entry-associated regulatory factor (103-111)
aucgccuacaaguucggcaagaccgug

SEQ ID NO: 32200 - RNA, 27 nt, Artificial Sequence
  Ubiquitin-60S ribosomal protein L40 (48-56)
aucaucgagcccagccugcgccagcuc

SEQ ID NO: 32201 - RNA, 27 nt, Artificial Sequence
  Eukaryotic translation initiation factor 4 gamma 1 (1452-1460)
aucaucuucgagaccccccugcgcgug

SEQ ID NO: 32202 - RNA, 27 nt, Artificial Sequence
  Vacuolar protein sorting-associated protein 4A (144-152)
auccugcccaucaaguucccgcaccuc

SEQ ID NO: 32203 - RNA, 30 nt, Artificial Sequence
  40S ribosomal protein S21 (74-83)
aaggccgacggcaucgugagcaagaacuuc

SEQ ID NO: 32204 - RNA, 27 nt, Artificial Sequence
  COMM domain-containing protein 3 (187-195)
aagagccuggagcgcgccacccagcuc

SEQ ID NO: 32205 - RNA, 27 nt, Artificial Sequence
  POTE ankyrin domain family member E (805-813)
cugaccgaggccccccucaacccgaag

SEQ ID NO: 32206 - RNA, 27 nt, Artificial Sequence
  DNA-dependent protein kinase catalytic subunit (1340-1348)
cgcaucauggaguucaccaccacgcug

SEQ ID NO: 32207 - RNA, 33 nt, Artificial Sequence
  TAR DNA-binding protein 43 (248-258)
agcauggacuccaagagcuccggcugggggaug

SEQ ID NO: 32208 - RNA, 33 nt, Artificial Sequence
  Vimentin (2-12)
agcacccgcuccgugagcuccagcuccuaccgg

SEQ ID NO: 32209 - RNA, 42 nt, Artificial Sequence
  Vimentin (446-459)
accguggagacccgcgacggccaggucaucaacgagacgagc

SEQ ID NO: 32210 - RNA, 30 nt, Artificial Sequence
  60S ribosomal protein L31 (106-115)
gugaccuacguccccgugaccacguucaag

SEQ ID NO: 32211 - RNA, 27 nt, Artificial Sequence
  Hemoglobin subunit delta (34-42)
guggucuaccccuggacccagcgcuuc

SEQ ID NO: 32212 - RNA, 27 nt, Artificial Sequence
  Guanine nucleotide-binding protein subunit beta-2-like 1 (192-200)
accggcuaccugaacaccgugacgguc

SEQ ID NO: 32213 - RNA, 24 nt, Artificial Sequence
  Ubiquitin-conjugating enzyme E2 D2 (59-66)
uaccccuucaagccgcccaaggug

SEQ ID NO: 32214 - RNA, 57 nt, Artificial Sequence
  Histone H2B type 2-E (83-101)
gccaagcacgccgugagcgagggcaccaaggcggucaccaaguacacguccagcaag

SEQ ID NO: 32215 - RNA, 30 nt, Artificial Sequence
  HLA class II histocompatibility antigen, DP beta 1 chain (9-18)
gccccccgcaccguggcccugaccgcgcuc

SEQ ID NO: 32216 - RNA, 27 nt, Artificial Sequence
  SWI/SNF-related matrix-associated actin-dependent regulator of chromatin subfamily E member 1 (114-122)
gccuaccacaacagccccgccuaccug

SEQ ID NO: 32217 - RNA, 27 nt, Artificial Sequence
  Chloride intracellular channel protein 4 (243-251)
gccuacagcgacguggccaagcgccug

SEQ ID NO: 32218 - RNA, 27 nt, Artificial Sequence
  CDK5 regulatory subunit-associated protein 1 (381-389)
gccuacguggagcugguccaccacauc

SEQ ID NO: 32219 - RNA, 30 nt, Artificial Sequence
  Exocyst complex component 2 (85-94)
gccuacgugaagggcgggcugagcaccuuc

SEQ ID NO: 32220 - RNA, 27 nt, Artificial Sequence
  60S ribosomal protein L23a (148-156)
gacguggccaacaagaucggcaucauc

SEQ ID NO: 32221 - RNA, 27 nt, Artificial Sequence
  Spectrin beta chain, non-erythrocytic 1 (1643-1651)
gacuacgccgagaccgugcaccagcug

SEQ ID NO: 32222 - RNA, 27 nt, Artificial Sequence
  Nuclear export mediator factor NEMF (234-242)
gacuacaugaagaccaccagcaacuuc

SEQ ID NO: 32223 - RNA, 27 nt, Artificial Sequence
  Formin-binding protein 1 (189-197)
gacuacagcuccauccugcagaaguuc

SEQ ID NO: 32224 - RNA, 27 nt, Artificial Sequence
  Myosin light polypeptide 6 (94-102)
gacuacguggagggccugcgcgucuuc

SEQ ID NO: 32225 - RNA, 27 nt, Artificial Sequence
  Sterol regulatory element-binding protein 2 (839-847)
gaguaccugaagcuccugcacagcuuc

SEQ ID NO: 32226 - RNA, 27 nt, Artificial Sequence
  Clathrin heavy chain 1 (1605-1613)
gaguaccugaccaagguggacaagcuc

SEQ ID NO: 32227 - RNA, 30 nt, Artificial Sequence
  Tubulin beta chain (158-167)
gaguaccccgaccgcaucaugaacaccuuc

SEQ ID NO: 32228 - RNA, 27 nt, Artificial Sequence
  Histone deacetylase 1 (86-94)
gaguacagcaagcagaugcagcgcuuc

SEQ ID NO: 32229 - RNA, 27 nt, Artificial Sequence
  DNA repair protein RAD50 (1281-1289)
gaguacguggagaaguucuaccgcauc

SEQ ID NO: 32230 - RNA, 30 nt, Artificial Sequence
  V-type proton ATPase catalytic subunit A (463-472)
gaguacuacgacaagcacuucaccgaguuc

SEQ ID NO: 32231 - RNA, 27 nt, Artificial Sequence
  Exostosin-2 (609-617)
uucuaccacaaguacuucaacuaccug

SEQ ID NO: 32232 - RNA, 27 nt, Artificial Sequence
  Late secretory pathway protein AVL9 homolog (280-288)
uucuacaucagccccgugaacaagcug

SEQ ID NO: 32233 - RNA, 33 nt, Artificial Sequence
  60S ribosomal protein L7 (81-91)
uucuacgugcccgccgagccgaagcuggccuuc

SEQ ID NO: 32234 - RNA, 48 nt, Artificial Sequence
  Elongation factor 1-beta (2-17)
ggcuucggggaccugaagagccccgccggccuccaggugcugaacgac

SEQ ID NO: 32235 - RNA, 36 nt, Artificial Sequence
  60S ribosomal protein L5 (2-13)
ggcuucgugaaggucgugaagaacaaggccuacuuc

SEQ ID NO: 32236 - RNA, 27 nt, Artificial Sequence
  Poly(A) RNA polymerase GLD2 (252-260)
ggcuacaucgagcgcccccagcugauc

SEQ ID NO: 32237 - RNA, 27 nt, Artificial Sequence
  Mannose-1-phosphate guanyltransferase alpha (166-174)
cacuacguggagaagcccagcaccuuc

SEQ ID NO: 32238 - RNA, 27 nt, Artificial Sequence
  Little elongation complex subunit 2 (341-349)
aucuuccacgaggugccccugaaguuc

SEQ ID NO: 32239 - RNA, 33 nt, Artificial Sequence
  Modulator of apoptosis 1 (92-102)
aucuucaagcccccggaccccgacaacaccuuc

SEQ ID NO: 32240 - RNA, 30 nt, Artificial Sequence
  DNA replication licensing factor MCM7 (276-285)
aucuuccugcccauccuccgcaccggcuuc

SEQ ID NO: 32241 - RNA, 27 nt, Artificial Sequence
  Putative eukaryotic translation initiation factor 2 subunit 3-like protein (314-322)
aucuucagcaagaucgugucccuguuc

SEQ ID NO: 32242 - RNA, 27 nt, Artificial Sequence
  X-ray repair cross-complementing protein 5 (134-142)
aucuucaccgaccugagcucccgcuuc

SEQ ID NO: 32243 - RNA, 27 nt, Artificial Sequence
  A-kinase anchor protein 11 (638-646)
aucuucaccaacaccguggcccgcuuc

SEQ ID NO: 32244 - RNA, 27 nt, Artificial Sequence
  Zinc finger protein 24 (103-111)
auccugcccaaggagcuccagaccugg

SEQ ID NO: 32245 - RNA, 30 nt, Artificial Sequence
  DNA polymerase epsilon catalytic subunit A (1791-1800)
aucuacgccgacaaccaggugaugcacuuc

SEQ ID NO: 32246 - RNA, 27 nt, Artificial Sequence
  G1/S-specific cyclin-E2 (202-210)
aucuacgcccccaagcugcaggaguuc

SEQ ID NO: 32247 - RNA, 27 nt, Artificial Sequence
  A-kinase anchor protein 1, mitochondrial (683-691)
aucuacgcccccccgcugcccagccuc

SEQ ID NO: 32248 - RNA, 27 nt, Artificial Sequence
  Signal peptidase complex subunit 1 (37-45)
aucuacggcuacguggccgagcaguuc

SEQ ID NO: 32249 - RNA, 30 nt, Artificial Sequence
  Lon protease homolog, mitochondrial (188-197)
aucuaccacaccggcaccuucgcccagauc

SEQ ID NO: 32250 - RNA, 27 nt, Artificial Sequence
  Heterogeneous nuclear ribonucleoprotein L (145-153)
aucuacaucgccggccaccccgccuuc

SEQ ID NO: 32251 - RNA, 27 nt, Artificial Sequence
  Tuftelin-interacting protein 11 (168-176)
aucuacaucgaccgcggcguggucuuc

SEQ ID NO: 32252 - RNA, 36 nt, Artificial Sequence
  Clathrin heavy chain 1 (882-893)
aucuacaucgacagcaacaacaaccccgagcgcuuc

SEQ ID NO: 32253 - RNA, 27 nt, Artificial Sequence
  Deoxynucleotidyltransferase terminal-interacting protein 1 (232-240)
aucuacaucaagcacccccaccuguuc

SEQ ID NO: 32254 - RNA, 27 nt, Artificial Sequence
  Retinoblastoma-like protein 2 (1012-1020)
aucuacaucaagcagaucaagaccuuc

SEQ ID NO: 32255 - RNA, 30 nt, Artificial Sequence
  Activator of 90 kDa heat shock protein ATPase homolog 1 (74-83)
aucuacaucagcacccugaagaccgaguuc

SEQ ID NO: 32256 - RNA, 33 nt, Artificial Sequence
  Ras-related GTP-binding protein C (99-109)
aucuacaaggacgacaucagcaacuccagcuuc

SEQ ID NO: 32257 - RNA, 27 nt, Artificial Sequence
  Leucine-rich PPR motif-containing protein, mitochondrial (1129-1137)
aucuacaagcccgugaccgacuucuuc

SEQ ID NO: 32258 - RNA, 30 nt, Artificial Sequence
  DNA-directed RNA polymerases I, II, and III subunit RPABC3 (11-20)
aucuaccccguggaccugggcgacaaguuc

SEQ ID NO: 32259 - RNA, 30 nt, Artificial Sequence
  Cullin-4B (362-371)
aucuaccaggacagcuucgagcagcgcuuc

SEQ ID NO: 32260 - RNA, 27 nt, Artificial Sequence
  Transmembrane protein 209 (509-517)
aucuaccagcgccacguguacaaccug

SEQ ID NO: 32261 - RNA, 27 nt, Artificial Sequence
  Coatomer subunit beta' (535-543)
aucuacaccagcuccgugaaccgccug

SEQ ID NO: 32262 - RNA, 27 nt, Artificial Sequence
  Retinoblastoma-like protein 1 (804-812)
aucuacgugggccgcgucaagagcuuc

SEQ ID NO: 32263 - RNA, 27 nt, Artificial Sequence
  Vam6/Vps39-like protein (97-105)
aucuacgugcacgaccugcucaccuuc

SEQ ID NO: 32264 - RNA, 33 nt, Artificial Sequence
  DDB1- and CUL4-associated factor 8 (337-347)
aucuacgugaaccccgccaacacccaccaguuc

SEQ ID NO: 32265 - RNA, 27 nt, Artificial Sequence
  60S ribosomal protein L3 (361-369)
aaguucaucgacaccaccagcaaguuc

SEQ ID NO: 32266 - RNA, 27 nt, Artificial Sequence
  Zyxin (193-201)
aaguucacccccguggccagcaaguuc

SEQ ID NO: 32267 - RNA, 27 nt, Artificial Sequence
  Protein SDA1 homolog (8-16)
aagcugcccagcaaccucccgcagcug

SEQ ID NO: 32268 - RNA, 27 nt, Artificial Sequence
  Protein sel-1 homolog 1 (504-512)
aagcaggcccugaaguacuucaaccuc

SEQ ID NO: 32269 - RNA, 27 nt, Artificial Sequence
  Muscleblind-like protein 3 (180-188)
aaguacuuccaccccccggcccaccug

SEQ ID NO: 32270 - RNA, 27 nt, Artificial Sequence
  Nardilysin (660-668)
aaguacaucgccaccgacuucacccug

SEQ ID NO: 32271 - RNA, 27 nt, Artificial Sequence
  U6 snRNA-associated Sm-like protein LSm7 (17-25)
aaguacaucgacaagaccauccgcgug

SEQ ID NO: 32272 - RNA, 30 nt, Artificial Sequence
  RuvB-like 1 (285-294)
aaguacaucgaccagggcaucgccgagcug

SEQ ID NO: 32273 - RNA, 27 nt, Artificial Sequence
  Short transient receptor potential channel 4-associated protein (594-602)
aaguacaucaacaccgacgccaaguuc

SEQ ID NO: 32274 - RNA, 27 nt, Artificial Sequence
  Interferon-induced GTP-binding protein Mx2 (223-231)
aaguacauccagcgccagcagaccauc

SEQ ID NO: 32275 - RNA, 27 nt, Artificial Sequence
  Centromere protein F (1270-1278)
aaguacaucagcggcccccacgagcug

SEQ ID NO: 32276 - RNA, 27 nt, Artificial Sequence
  Calcium-binding protein 39-like (247-255)
aaguacaucagcaagcccgagaaccug

SEQ ID NO: 32277 - RNA, 27 nt, Artificial Sequence
  Small subunit processome component 20 homolog (1425-1433)
aaguacaucaccgacguggucaagcug

SEQ ID NO: 32278 - RNA, 30 nt, Artificial Sequence
  Poly(A)-specific ribonuclease PARN (21-30)
aaguacaucaccaagagcuucaacuucuac

SEQ ID NO: 32279 - RNA, 33 nt, Artificial Sequence
  Elongation of very long chain fatty acids protein 5 (200-210)
aaguacaucacccagggccagcugcuccaguuc

SEQ ID NO: 32280 - RNA, 27 nt, Artificial Sequence
  Phosphate carrier protein, mitochondrial (97-105)
aaguacaagggcaucuucaacggguuc

SEQ ID NO: 32281 - RNA, 33 nt, Artificial Sequence
  S-adenosylmethionine synthase isoform type-2 (234-244)
aaguaccuggacgaggacaccaucuaccaccuc

SEQ ID NO: 32282 - RNA, 27 nt, Artificial Sequence
  Mitochondrial-processing peptidase subunit alpha (106-114)
aaguaccugagcggcaucgcccacuuc

SEQ ID NO: 32283 - RNA, 27 nt, Artificial Sequence
  DNA ligase 1 (566-574)
aaguaccccgacaucaucagccgcauc

SEQ ID NO: 32284 - RNA, 27 nt, Artificial Sequence
  Gamma-aminobutyric acid receptor-associated protein-like 1 (24-32)
aaguaccccgaccgcgugccggucauc

SEQ ID NO: 32285 - RNA, 27 nt, Artificial Sequence
  Rho guanine nucleotide exchange factor 2 (366-374)
aaguacccccugcucaucagccgcauc

SEQ ID NO: 32286 - RNA, 24 nt, Artificial Sequence
  ATP-dependent RNA helicase A (169-176)
aaguaccccagcccguucuucgug

SEQ ID NO: 32287 - RNA, 27 nt, Artificial Sequence
  Translocating chain-associated membrane protein 1 (245-253)
aaguaccagaagggcuucagccugugg

SEQ ID NO: 32288 - RNA, 27 nt, Artificial Sequence
  NADH dehydrogenase (ubiquinone) iron-sulfur protein 5 (91-99)
aaguacacccccccgccccaccacauc

SEQ ID NO: 32289 - RNA, 27 nt, Artificial Sequence
  Heme oxygenase 2 (124-132)
aaguacguggagcgcauccacuacauc

SEQ ID NO: 32290 - RNA, 27 nt, Artificial Sequence
  WD repeat-containing protein 35 (371-379)
aaguacgugaagggccugaucagcauc

SEQ ID NO: 32291 - RNA, 27 nt, Artificial Sequence
  Zinc finger protein 195 (148-156)
aaguacgugaagaucuucgacaacuuc

SEQ ID NO: 32292 - RNA, 30 nt, Artificial Sequence
  NADH dehydrogenase (ubiquinone) 1 alpha subcomplex subunit 12 (47-56)
aaguacuacgaggacaacaagcaguucuuc

SEQ ID NO: 32293 - RNA, 45 nt, Artificial Sequence
  Phosphoglycerate kinase 1 (403-417)
cuggagggcaaggugcuccccggggucgacgcccugagcaacauc

SEQ ID NO: 32294 - RNA, 24 nt, Artificial Sequence
  Superkiller viralicidic activity 2-like 2 (586-593)
cuggagaagagcuucuaccaguuc

SEQ ID NO: 32295 - RNA, 33 nt, Artificial Sequence
  Gamma-interferon-inducible lysosomal thiol reductase (15-25)
cugcuccuggacgugcccaccgccgccguccag

SEQ ID NO: 32296 - RNA, 45 nt, Artificial Sequence
  Polypyrimidine tract-binding protein 1 (359-373)
cuggugagcaaccucaaccccgagcgcgucaccccgcagucccug

SEQ ID NO: 32297 - RNA, 30 nt, Artificial Sequence
  Translocon-associated protein subunit delta (66-75)
cuguacgccgacgugggcgggaagcaguuc

SEQ ID NO: 32298 - RNA, 27 nt, Artificial Sequence
  Nuclear factor erythroid 2-related factor 3 (413-421)
cuguaccacgacaucuucagccgccuc

SEQ ID NO: 32299 - RNA, 27 nt, Artificial Sequence
  Rho GTPase-activating protein 1 (181-189)
cuguacaucgugcaccccaccauguuc

SEQ ID NO: 32300 - RNA, 30 nt, Artificial Sequence
  60S ribosomal protein L19 (104-113)
cuguaccucaaggugaagggcaacgucuuc

SEQ ID NO: 32301 - RNA, 33 nt, Artificial Sequence
  Signal transducer and activator of transcription 1-alpha/beta (667-677)
cuguaccccaacaucgacaaggaccacgccuuc

SEQ ID NO: 32302 - RNA, 27 nt, Artificial Sequence
  BTB/POZ domain-containing protein KCTD20 (142-150)
cuguacagcuccaagcucuaccgcuuc

SEQ ID NO: 32303 - RNA, 27 nt, Artificial Sequence
  Alpha-taxilin (389-397)
cuguacaccgagaaguucgaggaguuc

SEQ ID NO: 32304 - RNA, 27 nt, Artificial Sequence
  40S ribosomal protein S29 (6-14)
cuguacuggagccacccccgcaaguuc

SEQ ID NO: 32305 - RNA, 42 nt, Artificial Sequence
  Calmodulin (125-138)
augauccgcgaggccgacaucgacggcgacgggcaggugaac

SEQ ID NO: 32306 - RNA, 27 nt, Artificial Sequence
  Tubulin alpha-1C chain (172-180)
aacuacgcccgcggccacuacaccauc

SEQ ID NO: 32307 - RNA, 27 nt, Artificial Sequence
  Sorting nexin-4 (257-265)
aacuacggccgcguguucagcgagugg

SEQ ID NO: 32308 - RNA, 27 nt, Artificial Sequence
  Abl interactor 1 (434-442)
aacuacaucgagaagguggucgccauc

SEQ ID NO: 32309 - RNA, 27 nt, Artificial Sequence
  Unconventional myosin-Id (229-237)
aacuacauccacgugggcgcccagcug

SEQ ID NO: 32310 - RNA, 27 nt, Artificial Sequence
  CTD small phosphatase-like protein 2 (385-393)
aacuacaucaaggaccugaacauccuc

SEQ ID NO: 32311 - RNA, 27 nt, Artificial Sequence
  CWF19-like protein 1 (409-417)
aacuacaagagccaccaccugcagcuc

SEQ ID NO: 32312 - RNA, 27 nt, Artificial Sequence
  Polyadenylate-binding protein-interacting protein 1 (111-119)
aacuaccugagccaccaccucaccauc

SEQ ID NO: 32313 - RNA, 27 nt, Artificial Sequence
  Methionine-tRNA ligase, cytoplasmic (152-160)
aacuacacccuggugagccaccucauc

SEQ ID NO: 32314 - RNA, 27 nt, Artificial Sequence
  Ribosomal RNA processing protein 1 homolog B (648-656)
cccuuccugccgaagccccucuucuuc

SEQ ID NO: 32315 - RNA, 27 nt, Artificial Sequence
  Ribosome biogenesis protein BRX1 homolog (200-208)
cccuucguggaccacgucuucaccuuc

SEQ ID NO: 32316 - RNA, 36 nt, Artificial Sequence
  40S ribosomal protein S19 (2-13)
cccggcgugaccgucaaggacgugaaccagcaggag

SEQ ID NO: 32317 - RNA, 51 nt, Artificial Sequence
  Nuclease-sensitive element-binding protein 1 (304-320)
cccccggccgagaacagcuccgcccccgaggcggagcagggcggggccgag

SEQ ID NO: 32318 - RNA, 27 nt, Artificial Sequence
  Protein AATF (255-263)
ccccagccggacguguucccccuguuc

SEQ ID NO: 32319 - RNA, 30 nt, Artificial Sequence
  pre-mRNA 3' end processing protein WDR33 (495-504)
cccuacgccaagccgauccccgcccaguuc

SEQ ID NO: 32320 - RNA, 27 nt, Artificial Sequence
  Fatty acid desaturase 2 (227-235)
cccuacaaccaccagcacgaguacuuc

SEQ ID NO: 32321 - RNA, 27 nt, Artificial Sequence
  Methionine-tRNA ligase, cytoplasmic (273-281)
cccuacgugaacaacgucccgcaccug

SEQ ID NO: 32322 - RNA, 27 nt, Artificial Sequence
  Surfeit locus protein 4 (23-31)
caguaccugccccacguggcccgccuc

SEQ ID NO: 32323 - RNA, 33 nt, Artificial Sequence
  Moesin (48-58)
caguaccaggacaccaagggcuucagcaccugg

SEQ ID NO: 32324 - RNA, 27 nt, Artificial Sequence
  Protein BIVM-ERCC5 (1290-1298)
caguacguggacuuccacaaccagcug

SEQ ID NO: 32325 - RNA, 30 nt, Artificial Sequence
  Elongation factor 1-gamma (245-254)
cgcuuccccgaggagcugacccagaccuuc

SEQ ID NO: 32326 - RNA, 27 nt, Artificial Sequence
  60S ribosomal protein L17 (82-90)
cgcuggcccaagaagagcgccgaguuc

SEQ ID NO: 32327 - RNA, 30 nt, Artificial Sequence
  Elongation factor 2 (264-273)
cgcuacuucgaccccgccaacggcaaguuc

SEQ ID NO: 32328 - RNA, 27 nt, Artificial Sequence
  Casein kinase II subunit alpha (195-203)
cgcuacuucaagggccccgagcugcuc

SEQ ID NO: 32329 - RNA, 27 nt, Artificial Sequence
  Interferon-induced helicase C domain-containing protein 1 (806-814)
cgcuacggccuggugaccaacgagauc

SEQ ID NO: 32330 - RNA, 27 nt, Artificial Sequence
  Pre-mRNA-processing-splicing factor 8 (1090-1098)
cgcuacaucgaccggauccacaucuuc

SEQ ID NO: 32331 - RNA, 33 nt, Artificial Sequence
  Alpha-enolase (99-109)
cgcuacaucagccccgaccagcuggccgaccuc

SEQ ID NO: 32332 - RNA, 30 nt, Artificial Sequence
  E3 ubiquitin-protein ligase MGRN1 (24-33)
cgcuaccccccgaagagcggcaacuacuuc

SEQ ID NO: 32333 - RNA, 27 nt, Artificial Sequence
  Mitotic checkpoint protein BUB3 (274-282)
cgcuaccccaccagcaucgccucccug

SEQ ID NO: 32334 - RNA, 33 nt, Artificial Sequence
  Mitotic checkpoint protein BUB3 (274-284)
cgcuaccccaccagcaucgccucccuggccuuc

SEQ ID NO: 32335 - RNA, 27 nt, Artificial Sequence
  Tyrosine-protein kinase BAZ1B (609-617)
cgcuaccaggacaucauccacagcauc

SEQ ID NO: 32336 - RNA, 27 nt, Artificial Sequence
  Histone H3.1 (54-62)
cgcuaccagaagagcaccgagcugcuc

SEQ ID NO: 32337 - RNA, 27 nt, Artificial Sequence
  Thioredoxin-related transmembrane protein 2 (198-206)
cgcuacaccgacgugagcacccgguac

SEQ ID NO: 32338 - RNA, 30 nt, Artificial Sequence
  Suppressor of fused homolog (146-155)
cgcuacguguuccagagcgagaacaccuuc

SEQ ID NO: 32339 - RNA, 27 nt, Artificial Sequence
  WD repeat-containing protein 36 (350-358)
agcuucuccaccgugcacgagaaguuc

SEQ ID NO: 32340 - RNA, 27 nt, Artificial Sequence
  Astrocytic phosphoprotein PEA-15 (61-69)
agcuacaucgagcacaucuucgagauc

SEQ ID NO: 32341 - RNA, 27 nt, Artificial Sequence
  Protein ELYS (236-244)
agcuacaucucccgcaccaaccagcug

SEQ ID NO: 32342 - RNA, 27 nt, Artificial Sequence
  Solute carrier family 23 member 2 (617-625)
agcuaccugcccaucuccccgaccuuc

SEQ ID NO: 32343 - RNA, 27 nt, Artificial Sequence
  Splicing factor 3B subunit 5 (42-50)
agcuacaugggccacuucgaccugcuc

SEQ ID NO: 32344 - RNA, 27 nt, Artificial Sequence
  Lymphokine-activated killer T-cell-originated protein kinase (300-308)
agcuaccagaaggugaucgagcuguuc

SEQ ID NO: 32345 - RNA, 27 nt, Artificial Sequence
  Heterogeneous nuclear ribonucleoprotein F (193-201)
agcuacuccgaccccccgcugaaguuc

SEQ ID NO: 32346 - RNA, 24 nt, Artificial Sequence
  Signal transducer and activator of transcription 2 (259-266)
accgccggcgccaagcugcucuuc

SEQ ID NO: 32347 - RNA, 27 nt, Artificial Sequence
  Zinc finger protein 280C (189-197)
accuucagcgacguggaggcccacuuc

SEQ ID NO: 32348 - RNA, 27 nt, Artificial Sequence
  NADH dehydrogenase (ubiquinone) 1 subunit C2 (107-115)
accuacggcgagaucuucgagaaguuc

SEQ ID NO: 32349 - RNA, 27 nt, Artificial Sequence
  Peroxisomal acyl-coenzyme A oxidase 3 (142-150)
accuacauccagaagaucuuccgcaug

SEQ ID NO: 32350 - RNA, 27 nt, Artificial Sequence
  Oxidative stress-induced growth inhibitor 2 (326-334)
accuacaucaccagcgugucccgccug

SEQ ID NO: 32351 - RNA, 27 nt, Artificial Sequence
  Ubiquitin carboxyl-terminal hydrolase 7 (1092-1100)
accuaccuggagaaggccaucaagauc

SEQ ID NO: 32352 - RNA, 27 nt, Artificial Sequence
  Iron-responsive element-binding protein 2 (410-418)
accuaccugaaggccgugaagcucuuc

SEQ ID NO: 32353 - RNA, 30 nt, Artificial Sequence
  Cellular tumor antigen p53 (125-134)
accuacagccccgcccugaacaagauguuc

SEQ ID NO: 32354 - RNA, 30 nt, Artificial Sequence
  StAR-related lipid transfer protein 7, mitochondrial (95-104)
accuacaccgacgugacgccccgccaguuc

SEQ ID NO: 32355 - RNA, 33 nt, Artificial Sequence
  StAR-related lipid transfer protein 7, mitochondrial (95-105)
accuacaccgacgugacgccccgccaguucuuc

SEQ ID NO: 32356 - RNA, 27 nt, Artificial Sequence
  Nesprin-2 (590-598)
accuacguggagaaccugcgccuccug

SEQ ID NO: 32357 - RNA, 27 nt, Artificial Sequence
  Choline/ethanolaminephosphotransferase 1 (200-208)
accuacgugagcggcacccugcgcuuc

SEQ ID NO: 32358 - RNA, 33 nt, Artificial Sequence
  Bifunctional glutamate/proline-tRNA ligase (557-567)
guguucaucgagggcgccgacgccgagaccuuc

SEQ ID NO: 32359 - RNA, 27 nt, Artificial Sequence
  F-actin-capping protein subunit alpha-2 (30-38)
guguucaacgacguccgccugcuccug

SEQ ID NO: 32360 - RNA, 27 nt, Artificial Sequence
  Nucleolysin TIAR (236-244)
guguuccccgagaagggcuacagcuuc

SEQ ID NO: 32361 - RNA, 27 nt, Artificial Sequence
  3-hydroxy-3-methylglutaryl-coenzyme A reductase (105-113)
guguucagcaccgucgugauccacuuc

SEQ ID NO: 32362 - RNA, 33 nt, Artificial Sequence
  H/ACA ribonucleoprotein complex subunit 3 (54-64)
gugcugaugacccagcagccccgcccgguccuc

SEQ ID NO: 32363 - RNA, 27 nt, Artificial Sequence
  40S ribosomal protein S26 (63-71)
gugcugcccaagcucuacgucaagcug

SEQ ID NO: 32364 - RNA, 36 nt, Artificial Sequence
  60S ribosomal protein L31 (106-117)
gugaccuacguccccgugaccacguucaagaaccug

SEQ ID NO: 32365 - RNA, 27 nt, Artificial Sequence
  Mitochondrial folate transporter/carrier (299-307)
guguacgagaacgucagccacuuccug

SEQ ID NO: 32366 - RNA, 27 nt, Artificial Sequence
  Protein-lysine N-methyltransferase METTL10 (41-49)
guguacgagcgcgagcugcagaccuuc

SEQ ID NO: 32367 - RNA, 39 nt, Artificial Sequence
  Nuclear pore complex protein Nup153 (381-393)
guguacuucaagcccagccugaccccguccggcgaguuc

SEQ ID NO: 32368 - RNA, 27 nt, Artificial Sequence
  Cytochrome c oxidase subunit 4 isoform 1, mitochondrial (125-133)
guguacggcccccugccgcagagcuuc

SEQ ID NO: 32369 - RNA, 27 nt, Artificial Sequence
  26S proteasome non-ATPase regulatory subunit 8 (131-139)
guguacaucaagcaccccgucagccug

SEQ ID NO: 32370 - RNA, 30 nt, Artificial Sequence
  DNA replication licensing factor MCM3 (192-201)
guguacaaggaccaccagaccaucaccauc

SEQ ID NO: 32371 - RNA, 30 nt, Artificial Sequence
  Afadin (161-170)
guguacaaggacaugcccgagaccagcuuc

SEQ ID NO: 32372 - RNA, 27 nt, Artificial Sequence
  Guanine nucleotide-binding protein-like 3-like protein (293-301)
guguaccuggacaaguucauccgccuc

SEQ ID NO: 32373 - RNA, 27 nt, Artificial Sequence
  Rho-related BTB domain-containing protein 1 (526-534)
guguaccugcccaacaucaacaagauc

SEQ ID NO: 32374 - RNA, 30 nt, Artificial Sequence
  Pre-mRNA-splicing factor SPF27 (137-146)
guguacaacgagaaccugguccacaugauc

SEQ ID NO: 32375 - RNA, 27 nt, Artificial Sequence
  Splicing factor 3B subunit 3 (519-527)
guguaccccgacggcauccgccacauc

SEQ ID NO: 32376 - RNA, 30 nt, Artificial Sequence
  Proteasome-associated protein ECM29 homolog (682-691)
guguaccccgagaagcuggccaccaaguuc

SEQ ID NO: 32377 - RNA, 27 nt, Artificial Sequence
  AP-5 complex subunit zeta-1 (388-396)
guguaccagcaccuguucacccgcauc

SEQ ID NO: 32378 - RNA, 33 nt, Artificial Sequence
  Serine/arginine-rich splicing factor 1 (152-162)
guguaccgcgacggcaccggggucguggaguuc

SEQ ID NO: 32379 - RNA, 27 nt, Artificial Sequence
  Dynamin-2 (124-132)
guguacagcccccacguccugaaccuc

SEQ ID NO: 32380 - RNA, 33 nt, Artificial Sequence
  Dynamin-2 (124-134)
guguacagcccccacguccugaaccucacccug

SEQ ID NO: 32381 - RNA, 33 nt, Artificial Sequence
  E3 ubiquitin-protein ligase UBR5 (1809-1819)
guguacagccagauccccgccgccgucaagcug

SEQ ID NO: 32382 - RNA, 33 nt, Artificial Sequence
  Ribosome biogenesis protein BMS1 homolog (352-362)
guguacgucgaccugggcgggagccacguguuc

SEQ ID NO: 32383 - RNA, 27 nt, Artificial Sequence
  BRCA1-associated protein (237-245)
guguacgucgagcgcgccgaggugcug

SEQ ID NO: 32384 - RNA, 27 nt, Artificial Sequence
  AP-3 complex subunit mu-1 (274-282)
guguacgucaagcacagcaucuccuuc

SEQ ID NO: 32385 - RNA, 27 nt, Artificial Sequence
  Lipopolysaccharide-induced tumor necrosis factor-alpha factor (79-87)
guguacguccagcaccccaucaccuuc

SEQ ID NO: 32386 - RNA, 27 nt, Artificial Sequence
  AP-3 complex subunit delta-1 (521-529)
guguacguccagaacguggugaagcug

SEQ ID NO: 32387 - RNA, 27 nt, Artificial Sequence
  Signal transducer and activator of transcription 2 (828-836)
guguacgucagccgccccucccacuuc

SEQ ID NO: 32388 - RNA, 27 nt, Artificial Sequence
  TraB domain-containing protein (75-83)
guguacgucgugggcaccgcccacuuc

SEQ ID NO: 32389 - RNA, 24 nt, Artificial Sequence
  Dystonin (673-680)
uacgccgagaagcugcaccgccuc

SEQ ID NO: 32390 - RNA, 24 nt, Artificial Sequence
  Histone deacetylase 1 (87-94)
uacagcaagcagaugcagcgcuuc

SEQ ID NO: 32391 - RNA, 30 nt, Artificial Sequence
  Activator of 90 kDa heat shock protein ATPase homolog 1 (246-255)
uacuacuucgagggcaucaagcagaccuuc

SEQ ID NO: 32392 - RNA, 30 nt, Artificial Sequence
  Phosphatidylinositol 4-kinase alpha (328-337)
uacuacaugaaggaccugcccaccagcuuc

SEQ ID NO: 32393 - RNA, 27 nt, Artificial Sequence
  Eukaryotic translation initiation factor 3 subunit A (275-283)
uacuacaacaaggugagcaccgucuuc

SEQ ID NO: 32394 - RNA, 30 nt, Artificial Sequence
  Eukaryotic translation initiation factor 4 gamma 1 (169-178)
uacuaccccgcccagggcgugcagcaguuc

SEQ ID NO: 32395 - RNA, 27 nt, Artificial Sequence
  40S ribosomal protein S17 (20-28)
uacuacacccgccugggcaacgacuuc

SEQ ID NO: 32396 - RNA, 27 nt, Artificial Sequence
  Transmembrane protein 43 (102-110)
ggccgcuucuuccugagcuccgggcuc

SEQ ID NO: 32397 - RNA, 30 nt, Artificial Sequence
  Microsomal glutathione S-transferase 3 (82-91)
cacccccgcaucgccagcggccuggggcuc

SEQ ID NO: 32398 - RNA, 27 nt, Artificial Sequence
  Non-specific lipid-transfer protein (373-381)
aagaucggcgggaucuucgccuucaag

SEQ ID NO: 32399 - RNA, 24 nt, Artificial Sequence
  Cyclin-dependent kinase 11B (590-597)
uaccgcgcccccgagcugcuccug

SEQ ID NO: 32400 - RNA, 27 nt, Artificial Sequence
  Spectrin beta chain, non-erythrocytic 1 (1663-1671)
caccccgagagcgagcgcaucuccaug

SEQ ID NO: 32401 - RNA, 27 nt, Artificial Sequence
  Mitochondrial import receptor subunit TOM7 homolog (44-52)
augcccgagccgaccgugcugagccuc

SEQ ID NO: 32402 - RNA, 27 nt, Artificial Sequence
  Histidine triad nucleotide-binding protein 1 (8-16)
agcccccaggccccgacccacuuccug

SEQ ID NO: 32403 - RNA, 27 nt, Artificial Sequence
  Prolyl endopeptidase (534-542)
gccgaguaccugaucaaggagggcuac

SEQ ID NO: 32404 - RNA, 30 nt, Artificial Sequence
  Tuftelin-interacting protein 11 (216-225)
gaggaguuccagaaggagcugagccagugg

SEQ ID NO: 32405 - RNA, 30 nt, Artificial Sequence
  Protein unc-93 homolog B1 (315-324)
gaggagaucgaccugcgcagcgugggcugg

SEQ ID NO: 32406 - RNA, 27 nt, Artificial Sequence
  Spatacsin (901-909)
ggcgaguuccagacccagcacagcuac

SEQ ID NO: 32407 - RNA, 30 nt, Artificial Sequence
  HLA class I histocompatibility antigen, alpha chain E (109-118)
agcgaggccggcucccacacccugcagugg

SEQ ID NO: 32408 - RNA, 27 nt, Artificial Sequence
  Vacuolar protein sorting-associated protein 41 homolog (103-111)
agcgaggacggcaaggugcaggucuuc

SEQ ID NO: 32409 - RNA, 36 nt, Artificial Sequence
  Plastin-3 (65-76)
agcgagcuguccagcgagggcacccagcacuccuac

SEQ ID NO: 32410 - RNA, 21 nt, Artificial Sequence
  GTPase-activating protein and VPS9 domain-containing protein 1 (36-42)
gccuucagcauccuguucaag

SEQ ID NO: 32411 - RNA, 33 nt, Artificial Sequence
  40S ribosomal protein S3 (42-52)
gccaucgcccaggcggagagccugcgcuacaag

SEQ ID NO: 32412 - RNA, 27 nt, Artificial Sequence
  26S proteasome non-ATPase regulatory subunit 4 (282-290)
gccauccgcaacgccaugggcagccug

SEQ ID NO: 32413 - RNA, 33 nt, Artificial Sequence
  Exportin-2 (374-384)
gccaucuaccuggugaccagccucgccuccaag

SEQ ID NO: 32414 - RNA, 27 nt, Artificial Sequence
  DNA-dependent protein kinase catalytic subunit (28-36)
gcccuggccggccaccagcucauccgc

SEQ ID NO: 32415 - RNA, 27 nt, Artificial Sequence
  Coatomer subunit beta (905-913)
gcccuggccaacgugagcaucgagaag

SEQ ID NO: 32416 - RNA, 30 nt, Artificial Sequence
  Protein SDE2 homolog (346-355)
gcccuguucgccaagccccucaagggcaag

SEQ ID NO: 32417 - RNA, 27 nt, Artificial Sequence
  Cytochrome c oxidase subunit 2 (41-49)
gcccuguuccucacccugaccacgaag

SEQ ID NO: 32418 - RNA, 27 nt, Artificial Sequence
  ADP-ribosylation factor 5 (7-15)
gcccuguucagccgcaucuucggcaag

SEQ ID NO: 32419 - RNA, 27 nt, Artificial Sequence
  Similar to 60S ribosomal protein L7 (172-180)
gcccugaucgcccgcagccucggcaag

SEQ ID NO: 32420 - RNA, 30 nt, Artificial Sequence
  Regulation of nuclear pre-mRNA domain-containing protein 2 (166-175)
gcccugaucgaggagcuccugcuguacaag

SEQ ID NO: 32421 - RNA, 33 nt, Artificial Sequence
  Mitochondrial import receptor subunit TOM5 homolog (36-46)
gcccugcuccgcgugacccccuucauccugaag

SEQ ID NO: 32422 - RNA, 27 nt, Artificial Sequence
  ADP/ATP translocase 3 (38-46)
gcccugaacuucgccuucaaggacaag

SEQ ID NO: 32423 - RNA, 42 nt, Artificial Sequence
  Heat shock protein HSP 90-beta (536-549)
gcccugcgcgacaacagcaccaugggcuacaugauggccaag

SEQ ID NO: 32424 - RNA, 33 nt, Artificial Sequence
  Vimentin (43-53)
gcccugcgccccagcaccucccggagccucuac

SEQ ID NO: 32425 - RNA, 36 nt, Artificial Sequence
  60S ribosomal protein L36 (2-13)
gcccugcgcuaccccauggccgugggccucaacaag

SEQ ID NO: 32426 - RNA, 27 nt, Artificial Sequence
  Heterogeneous nuclear ribonucleoprotein U-like protein 1 (367-375)
gcccuguacccccacgugcucgucaag

SEQ ID NO: 32427 - RNA, 30 nt, Artificial Sequence
  60S ribosomal protein L6 (61-70)
gccauguacagccgcaaggccauguacaag

SEQ ID NO: 32428 - RNA, 27 nt, Artificial Sequence
  HCG15392, isoform CRA_b (43-51)
gcccccgccccgcccaaggcggaggcc

SEQ ID NO: 32429 - RNA, 33 nt, Artificial Sequence
  Myotrophin (63-73)
gcccccgacaagcaccacaucaccccgcugcuc

SEQ ID NO: 32430 - RNA, 24 nt, Artificial Sequence
  Actin, cytoplasmic 1 (14-21)
gcccccgaggagcacccggugcug

SEQ ID NO: 32431 - RNA, 27 nt, Artificial Sequence
  CCR4-NOT transcription complex subunit 1 (239-247)
gcccccuuccugcgcaacguggagcuc

SEQ ID NO: 32432 - RNA, 30 nt, Artificial Sequence
  Protein PRRC2A (692-701)
gccccccaggccccgcccccccccccgaag

SEQ ID NO: 32433 - RNA, 33 nt, Artificial Sequence
  60S ribosomal protein L13 (47-57)
gccccccgcccggccagcggccccauccggccc

SEQ ID NO: 32434 - RNA, 30 nt, Artificial Sequence
  NSFL1 cofactor p47 (66-75)
gcccccagcgacaaccgcgugaccuccuuc

SEQ ID NO: 32435 - RNA, 27 nt, Artificial Sequence
  60S ribosomal protein L13 (2-10)
gcccccagccgcaacggcauggugcug

SEQ ID NO: 32436 - RNA, 48 nt, Artificial Sequence
  Heat shock protein HSP 90-beta (534-549)
gcccaggcccugcgcgacaacagcaccaugggcuacaugauggcgaag

SEQ ID NO: 32437 - RNA, 24 nt, Artificial Sequence
  DNA-directed RNA polymerase II subunit RPB2 (365-372)
gcccgcggccccauccagauccug

SEQ ID NO: 32438 - RNA, 24 nt, Artificial Sequence
  Interferon regulatory factor 2-binding protein 1 (263-270)
gcccgccccccgggcuacgaguuc

SEQ ID NO: 32439 - RNA, 27 nt, Artificial Sequence
  Serine/threonine-protein kinase 4 (270-278)
gccaccgccacccagcugcuccagcac

SEQ ID NO: 32440 - RNA, 27 nt, Artificial Sequence
  DNA-dependent protein kinase catalytic subunit (4080-4088)
gccaccgaccccaacauccugggccgc

SEQ ID NO: 32441 - RNA, 30 nt, Artificial Sequence
  S-formylglutathione hydrolase (124-133)
gccaccgaggaccccuggaagaccaacuac

SEQ ID NO: 32442 - RNA, 27 nt, Artificial Sequence
  Probable ATP-dependent RNA helicase DDX6 (267-275)
gccaccuucccccugagcgugcagaag

SEQ ID NO: 32443 - RNA, 30 nt, Artificial Sequence
  General transcription factor II-I repeat domain-containing protein 2B (163-172)
gccacccugaaguggauccucgagaacaag

SEQ ID NO: 32444 - RNA, 30 nt, Artificial Sequence
  Phosphatidylinositol-binding clathrin assembly protein (29-38)
gccaccacccacgagaucaugggccccaag

SEQ ID NO: 32445 - RNA, 33 nt, Artificial Sequence
  Tubulin alpha-1C chain (340-350)
gccaccuacgcccccgugaucagcgcggagaag

SEQ ID NO: 32446 - RNA, 33 nt, Artificial Sequence
  E3 ubiquitin/ISG15 ligase TRIM25 (592-602)
gccguggccgacaagguccaccugauguacaag

SEQ ID NO: 32447 - RNA, 36 nt, Artificial Sequence
  Omega-amidase NIT2 (98-109)
gccguguucggccccgacgggacccugcucgccaag

SEQ ID NO: 32448 - RNA, 27 nt, Artificial Sequence
  Farnesyl pyrophosphate synthase (332-340)
gccguguuccugggccucgcccgcaag

SEQ ID NO: 32449 - RNA, 33 nt, Artificial Sequence
  COP9 signalosome complex subunit 8 (4-14)
gccgugauggccgagagcgcguucuccuucaag

SEQ ID NO: 32450 - RNA, 33 nt, Artificial Sequence
  Asparagine-tRNA ligase, cytoplasmic (180-190)
gccguguacggcaugcugaaccucacccccaag

SEQ ID NO: 32451 - RNA, 33 nt, Artificial Sequence
  Ras GTPase-activating protein-binding protein 2 (54-64)
gccguguacggccagaacgacauccaccacaag

SEQ ID NO: 32452 - RNA, 30 nt, Artificial Sequence
  ATP-dependent RNA helicase DHX8 (1045-1054)
gccguguacaacagcuggaagaacaacaag

SEQ ID NO: 32453 - RNA, 33 nt, Artificial Sequence
  E3 ubiquitin/ISG15 ligase TRIM25 (55-65)
gccguguaccaggcccgcccccagcugcacaag

SEQ ID NO: 32454 - RNA, 33 nt, Artificial Sequence
  DNA damage-binding protein 1 (869-879)
gccguguacagcauggucgaguucaacggcaag

SEQ ID NO: 32455 - RNA, 27 nt, Artificial Sequence
  Glucose-6-phosphate 1-dehydrogenase (246-254)
gccguguacaccaagaugaugaccaag

SEQ ID NO: 32456 - RNA, 30 nt, Artificial Sequence
  Glucose-6-phosphate 1-dehydrogenase (246-255)
gccguguacaccaagaugaugaccaagaag

SEQ ID NO: 32457 - RNA, 27 nt, Artificial Sequence
  COP9 signalosome complex subunit 3 (239-247)
gccuaccacgagcuggcccagguguac

SEQ ID NO: 32458 - RNA, 90 nt, Artificial Sequence
  60 kDa heat shock protein, mitochondrial (315-344)
gacauggccaucgccaccggcggggcgguguucggcgaggaggggcugacccucaaccuggaggacguccagccccacgaccugggcaag

SEQ ID NO: 32459 - RNA, 24 nt, Artificial Sequence
  Protein FAM136A (11-18)
gaggccguggagagcauggucaag

SEQ ID NO: 32460 - RNA, 27 nt, Artificial Sequence
  60S ribosomal protein L4 (213-221)
gaggacaacggcaucaucaaggccuuc

SEQ ID NO: 32461 - RNA, 33 nt, Artificial Sequence
  Basic leucine zipper and W2 domain-containing protein 2 (51-61)
uuccuggacagcaccggcucccgccucgacuac

SEQ ID NO: 32462 - RNA, 30 nt, Artificial Sequence
  Rab GDP dissociation inhibitor beta (29-38)
uucguguacaagggcgggaagaucuacaag

SEQ ID NO: 32463 - RNA, 27 nt, Artificial Sequence
  Protein PRRC2C (2390-2398)
uucuacauggacaccagccaccuguuc

SEQ ID NO: 32464 - RNA, 24 nt, Artificial Sequence
  Probable ATP-dependent RNA helicase DDX5 (58-65)
uucuaccaggagcaccccgaccug

SEQ ID NO: 32465 - RNA, 36 nt, Artificial Sequence
  Peroxisomal multifunctional enzyme type 2 (235-246)
ggccuguucgaggugggggccggcuggaucgggaag

SEQ ID NO: 32466 - RNA, 27 nt, Artificial Sequence
  RNA cytidine acetyltransferase (821-829)
ggccuguucaaccgcaucauccggaag

SEQ ID NO: 32467 - RNA, 36 nt, Artificial Sequence
  Transgelin-2 (142-153)
ggccuguucagcggggaccccaacugguucccgaag

SEQ ID NO: 32468 - RNA, 27 nt, Artificial Sequence
  Heterogeneous nuclear ribonucleoprotein Q (269-277)
ggccugaccgacgugauccucuaccac

SEQ ID NO: 32469 - RNA, 27 nt, Artificial Sequence
  Malignant T-cell-amplified sequence 1 (174-182)
ggccuguggcacaugaagaccuacaag

SEQ ID NO: 32470 - RNA, 30 nt, Artificial Sequence
  Synaptic vesicle membrane protein VAT-1 homolog (282-291)
ggcauggccaaccugcucaccgggcccaag

SEQ ID NO: 32471 - RNA, 27 nt, Artificial Sequence
  Reticulocalbin-2 (4-12)
ggcccccgcaccgccgcccuggggcuc

SEQ ID NO: 32472 - RNA, 30 nt, Artificial Sequence
  Superkiller viralicidic activity 2-like 2 (368-377)
ggcaccaaggggcccagcaacguguucaag

SEQ ID NO: 32473 - RNA, 30 nt, Artificial Sequence
  Calnexin (78-87)
ggcacccugagcggguggauccucuccaag

SEQ ID NO: 32474 - RNA, 27 nt, Artificial Sequence
  Parafibromin (313-321)
ggcaccuaccacgggaugacccugaag

SEQ ID NO: 32475 - RNA, 27 nt, Artificial Sequence
  Transcription factor 12 (417-425)
cacgccgugggccccagcaccucccug

SEQ ID NO: 32476 - RNA, 30 nt, Artificial Sequence
  GMP synthase (glutamine-hydrolyzing) (436-445)
caccccuucccgggccccgggcuggccauc

SEQ ID NO: 32477 - RNA, 27 nt, Artificial Sequence
  Superkiller viralicidic activity 2-like 2 (807-815)
cacccccugcacaacgacccgaaccuc

SEQ ID NO: 32478 - RNA, 27 nt, Artificial Sequence
  Staphylococcal nuclease domain-containing protein 1 (254-262)
caccccaacggcaacaucaccgagcug

SEQ ID NO: 32479 - RNA, 33 nt, Artificial Sequence
  Extended synaptotagmin-1 (652-662)
cacgugcuggaggcccaggaccucaucgccaag

SEQ ID NO: 32480 - RNA, 27 nt, Artificial Sequence
  Pre-mRNA-processing factor 19 (442-450)
aucuucgaccagagcggcaccuaccug

SEQ ID NO: 32481 - RNA, 30 nt, Artificial Sequence
  Heterogeneous nuclear ribonucleoprotein C-like 1 (20-29)
aucggcaaccugaacacccucguggucaag

SEQ ID NO: 32482 - RNA, 27 nt, Artificial Sequence
  Catenin alpha-1 (90-98)
auccugcagaagaacgugcccauccuc

SEQ ID NO: 32483 - RNA, 27 nt, Artificial Sequence
  60S ribosomal protein L10a (82-90)
aucccccacauggacaucgaggcccug

SEQ ID NO: 32484 - RNA, 33 nt, Artificial Sequence
  Spectrin beta chain, non-erythrocytic 1 (2247-2257)
auccccuaccacagcgaggugccggucucccug

SEQ ID NO: 32485 - RNA, 27 nt, Artificial Sequence
  Bifunctional glutamate/proline-tRNA ligase (415-423)
auccgcaagcccuacaucugggaguac

SEQ ID NO: 32486 - RNA, 27 nt, Artificial Sequence
  Histone deacetylase 1 (79-87)
auccgccccgacaacaugagcgaguac

SEQ ID NO: 32487 - RNA, 27 nt, Artificial Sequence
  DNA replication licensing factor MCM5 (289-297)
auccgcagcuccuacauccgggugcug

SEQ ID NO: 32488 - RNA, 30 nt, Artificial Sequence
  Spectrin beta chain, non-erythrocytic 4 (145-154)
aucguggacggcaaccaccgccugacccuc

SEQ ID NO: 32489 - RNA, 27 nt, Artificial Sequence
  Cytochrome c oxidase subunit 2 (209-217)
aucgugcuggagcucaucccccugaag

SEQ ID NO: 32490 - RNA, 27 nt, Artificial Sequence
  Mitotic checkpoint protein BUB3 (234-242)
aucuaccccgugaacgccaucagcuuc

SEQ ID NO: 32491 - RNA, 27 nt, Artificial Sequence
  Non-POU domain-containing octamer-binding protein (10-18)
aaggccggcgagguguucauccacaag

SEQ ID NO: 32492 - RNA, 45 nt, Artificial Sequence
  ATP synthase-coupling factor 6, mitochondrial (94-108)
aaguucgaggaccccaaguucgaggugaucgagaagccgcaggcc

SEQ ID NO: 32493 - RNA, 27 nt, Artificial Sequence
  60S ribosomal protein L10 (156-164)
aaguucaaguuccccggccgccagaag

SEQ ID NO: 32494 - RNA, 27 nt, Artificial Sequence
  Coatomer subunit beta' (413-421)
aagaucuucaagaacuucaaggagaag

SEQ ID NO: 32495 - RNA, 27 nt, Artificial Sequence
  Elongation factor 2 (571-579)
aagaagagcgaccccguggucuccuac

SEQ ID NO: 32496 - RNA, 27 nt, Artificial Sequence
  Apoptosis inhibitor 5 (238-246)
aagcuguucgacaagcuccuggaguac

SEQ ID NO: 32497 - RNA, 33 nt, Artificial Sequence
  COX assembly mitochondrial protein 2 homolog (69-79)
aagcuguucaaccccccggaggagagcgagaag

SEQ ID NO: 32498 - RNA, 27 nt, Artificial Sequence
  116 kDa U5 small nuclear ribonucleoprotein component (713-721)
aagcugggcgaguucuuccagaccaag

SEQ ID NO: 32499 - RNA, 27 nt, Artificial Sequence
  40S ribosomal protein S5 (86-94)
aagcugaugaccgugcgcaucgucaag

SEQ ID NO: 32500 - RNA, 27 nt, Artificial Sequence
  60S ribosomal protein L23a (115-123)
aagcuguacgacaucgacguggccaag

SEQ ID NO: 32501 - RNA, 39 nt, Artificial Sequence
  ATP-citrate synthase (650-662)
aagcuguaccgccccggcagcguggccuacgucucccgg

SEQ ID NO: 32502 - RNA, 30 nt, Artificial Sequence
  Signal recognition particle 54 kDa protein (433-442)
aagaugggcgggaucaagggccuguucaag

SEQ ID NO: 32503 - RNA, 27 nt, Artificial Sequence
  Charged multivesicular body protein 5 (9-17)
aagcccaaggccccgccccccagccug

SEQ ID NO: 32504 - RNA, 66 nt, Artificial Sequence
  60 kDa heat shock protein, mitochondrial (153-174)
aagccccuggugaucaucgccgaggacgucgacggcgaggcccucagcacccuggugcugaaccgc

SEQ ID NO: 32505 - RNA, 27 nt, Artificial Sequence
  Lysine-specific histone demethylase 1A (200-208)
aagcccgugagccugggccaggcccuc

SEQ ID NO: 32506 - RNA, 39 nt, Artificial Sequence
  Histone H4 (80-92)
aagaccgugaccgccauggacgucguguacgcccugaag

SEQ ID NO: 32507 - RNA, 36 nt, Artificial Sequence
  High mobility group protein B1 (76-87)
aagaccuacauccccccgaagggcgagaccaagaag

SEQ ID NO: 32508 - RNA, 27 nt, Artificial Sequence
  GMP synthase (glutamine-hydrolyzing) (112-120)
aagguguucggcgggaccguccacaag

SEQ ID NO: 32509 - RNA, 27 nt, Artificial Sequence
  Splicing factor 3B subunit 1 (554-562)
aaggugaucgaccgcauccuguacaag

SEQ ID NO: 32510 - RNA, 27 nt, Artificial Sequence
  SRSF protein kinase 1 (4-12)
aaggugcuggcccuccaggcccgcaag

SEQ ID NO: 32511 - RNA, 33 nt, Artificial Sequence
  RANBP2-like and GRIP domain-containing protein 2 (608-618)
aaggugcugccccuccugaagaucaucaagaag

SEQ ID NO: 32512 - RNA, 33 nt, Artificial Sequence
  Cytochrome c oxidase subunit 4 isoform 1, mitochondrial (149-159)
aaggugaaccccauccagggccuggccagcaag

SEQ ID NO: 32513 - RNA, 27 nt, Artificial Sequence
  PC4 and SFRS1-interacting protein (228-236)
aaggugagccaggucaucauggagaag

SEQ ID NO: 32514 - RNA, 30 nt, Artificial Sequence
  Rab GDP dissociation inhibitor alpha (103-112)
aagguggucgagggcagcuucguguacaag

SEQ ID NO: 32515 - RNA, 27 nt, Artificial Sequence
  Lymphocyte cytosolic protein 2 (468-476)
aagguguacaacauccagauccgcuac

SEQ ID NO: 32516 - RNA, 27 nt, Artificial Sequence
  ATP-dependent RNA helicase A (169-177)
aaguaccccagcccguucuucguguuc

SEQ ID NO: 32517 - RNA, 57 nt, Artificial Sequence
  Vimentin (79-97)
cugcuccaggacagcguggacuucucccuggccgacgccaucaacaccgaguucaag

SEQ ID NO: 32518 - RNA, 27 nt, Artificial Sequence
  Actin, gamma-enteric smooth muscle (200-208)
cugcccgacggccaggugaucaccauc

SEQ ID NO: 32519 - RNA, 27 nt, Artificial Sequence
  Polypyrimidine tract-binding protein 3 (123-131)
cugcccuucggcaaggugaccaaccuc

SEQ ID NO: 32520 - RNA, 27 nt, Artificial Sequence
  Histone deacetylase 1 (373-381)
cugccccacgccccgggcgugcagaug

SEQ ID NO: 32521 - RNA, 30 nt, Artificial Sequence
  Eukaryotic translation initiation factor 4B (90-99)
cugcccaagagcccgcccuacaccgccuuc

SEQ ID NO: 32522 - RNA, 27 nt, Artificial Sequence
  DNA polymerase epsilon subunit 3 (10-18)
cugcccaacgccgugaucacccgcauc

SEQ ID NO: 32523 - RNA, 30 nt, Artificial Sequence
  Sorting nexin-1 (270-279)
cugccccgcgccgugggcacccagacccuc

SEQ ID NO: 32524 - RNA, 27 nt, Artificial Sequence
  T-complex protein 1 subunit theta (260-268)
cugccccgccucaccccgcccgugcug

SEQ ID NO: 32525 - RNA, 27 nt, Artificial Sequence
  Phosphate carrier protein, mitochondrial (340-348)
cugccccgcccgcccccccccgagaug

SEQ ID NO: 32526 - RNA, 27 nt, Artificial Sequence
  Protein flightless-1 homolog (881-889)
cugccccgccagccgcccaugagccuc

SEQ ID NO: 32527 - RNA, 27 nt, Artificial Sequence
  Cytochrome c oxidase subunit 2 (78-86)
cugcccagccuccgcauccuguacaug

SEQ ID NO: 32528 - RNA, 27 nt, Artificial Sequence
  BAG family molecular chaperone regulator 3 (188-196)
cugcccagcuccggccgcagcucccuc

SEQ ID NO: 32529 - RNA, 27 nt, Artificial Sequence
  Staphylococcal nuclease domain-containing protein 1 (747-755)
cugcccagcacccgccucggcacccug

SEQ ID NO: 32530 - RNA, 27 nt, Artificial Sequence
  Beta-enolase (102-110)
cugcccgugccggccuucaacgucauc

SEQ ID NO: 32531 - RNA, 27 nt, Artificial Sequence
  RNA-binding protein 4 (186-194)
cugaccgagcaguacaacgagcaguac

SEQ ID NO: 32532 - RNA, 27 nt, Artificial Sequence
  60S ribosomal protein L13 (150-158)
cugaccggccccgugaugccgguccgc

SEQ ID NO: 32533 - RNA, 27 nt, Artificial Sequence
  Proteasome activator complex subunit 3 (29-37)
cugguggccaacuucuuccccaagaag

SEQ ID NO: 32534 - RNA, 27 nt, Artificial Sequence
  CD99 antigen (1-9)
auggcccgcggcgccgcgcuggcccuc

SEQ ID NO: 32535 - RNA, 33 nt, Artificial Sequence
  Destrin (115-125)
augaucuacgccagcuccaaggacgccaucaag

SEQ ID NO: 32536 - RNA, 36 nt, Artificial Sequence
  Destrin (115-126)
augaucuacgccagcuccaaggacgccaucaagaag

SEQ ID NO: 32537 - RNA, 33 nt, Artificial Sequence
  Peroxiredoxin-1 (21-31)
augcccgacggccaguucaaggacaucagccug

SEQ ID NO: 32538 - RNA, 27 nt, Artificial Sequence
  E3 ubiquitin-protein ligase HECTD1 (409-417)
augccccgcggcguggucgugacccug

SEQ ID NO: 32539 - RNA, 33 nt, Artificial Sequence
  Double-stranded RNA-binding protein Staufen homolog 1 (482-492)
augccccgcaccggcaacgggccgaugagcgug

SEQ ID NO: 32540 - RNA, 27 nt, Artificial Sequence
  60S acidic ribosomal protein P2 (1-9)
augcgcuacguggccagcuaccugcuc

SEQ ID NO: 32541 - RNA, 27 nt, Artificial Sequence
  Eukaryotic translation initiation factor 1A, Y-chromosomal (87-95)
aacaaggccgacgugauccugaaguac

SEQ ID NO: 32542 - RNA, 27 nt, Artificial Sequence
  ATP-dependent RNA helicase DDX24 (498-506)
aaccccaagcgccagacccugguguuc

SEQ ID NO: 32543 - RNA, 30 nt, Artificial Sequence
  Transgelin-2 (158-167)
aacccccgcaacuucagcgacaaccagcug

SEQ ID NO: 32544 - RNA, 27 nt, Artificial Sequence
  5'-3' exoribonuclease 2 (456-464)
aacccccgccaggccgccuacgagaug

SEQ ID NO: 32545 - RNA, 27 nt, Artificial Sequence
  Lysine-specific histone demethylase 1A (407-415)
aaccgccugcucgaggccaccagcuac

SEQ ID NO: 32546 - RNA, 27 nt, Artificial Sequence
  Nesprin-2 (5548-5556)
aaccgccccgaguucaucaccgaguuc

SEQ ID NO: 32547 - RNA, 27 nt, Artificial Sequence
  Protein DEK (115-123)
aaccgccccggcaccgugagcucccug

SEQ ID NO: 32548 - RNA, 27 nt, Artificial Sequence
  ATP-dependent RNA helicase DDX3X (644-652)
aacagcgacggcuacgggggcaacuac

SEQ ID NO: 32549 - RNA, 24 nt, Artificial Sequence
  40S ribosomal protein S26 (108-115)
ccccgcccgccccccaagcccaug

SEQ ID NO: 32550 - RNA, 27 nt, Artificial Sequence
  Tubulin beta chain (43-51)
cagcuggaccgcaucagcguguacuac

SEQ ID NO: 32551 - RNA, 27 nt, Artificial Sequence
  Isoleucine-tRNA ligase, cytoplasmic (165-173)
cagcuguacgacaagggccucguguac

SEQ ID NO: 32552 - RNA, 27 nt, Artificial Sequence
  Filamin-A (2017-2025)
cagcccgccagcuucgccgugucccug

SEQ ID NO: 32553 - RNA, 27 nt, Artificial Sequence
  Lysine-specific histone demethylase 1A (574-582)
cagcccaucaccccgggccccagcauc

SEQ ID NO: 32554 - RNA, 27 nt, Artificial Sequence
  Pericentriolar material 1 protein (1892-1900)
cagcccaacccgcugccccuccgccug

SEQ ID NO: 32555 - RNA, 30 nt, Artificial Sequence
  Cytochrome c oxidase subunit 4 isoform 1, mitochondrial (93-102)
cagagcuucgacaaggaguggguggccaag

SEQ ID NO: 32556 - RNA, 30 nt, Artificial Sequence
  Nucleoporin SEH1 (246-255)
cgcaucuucacccugaagcccgugcggaag

SEQ ID NO: 32557 - RNA, 30 nt, Artificial Sequence
  L-lactate dehydrogenase B chain (270-279)
cgcauccaccccgugagcaccauggucaag

SEQ ID NO: 32558 - RNA, 27 nt, Artificial Sequence
  DNA replication licensing factor MCM6 (131-139)
cgcaucaucgagaaggugauccaccgg

SEQ ID NO: 32559 - RNA, 36 nt, Artificial Sequence
  Reticulon-4 (62-73)
cgcaucuacaagggcgugauccaggccauccagaag

SEQ ID NO: 32560 - RNA, 27 nt, Artificial Sequence
  DNA (cytosine-5)-methyltransferase 1 (1459-1467)
cgccuguucggcaacauccucgacaag

SEQ ID NO: 32561 - RNA, 30 nt, Artificial Sequence
  26S protease regulatory subunit 6B (342-351)
cgccugaucuucagcaccaucaccuccaag

SEQ ID NO: 32562 - RNA, 33 nt, Artificial Sequence
  26S protease regulatory subunit 6A (11-21)
cgccugcucgacagcgagaucaagaucaugaag

SEQ ID NO: 32563 - RNA, 39 nt, Artificial Sequence
  Heat shock 70 kDa protein 4L (128-140)
cgccugaugaacgagaccaccgccguggcccucgcguac

SEQ ID NO: 32564 - RNA, 30 nt, Artificial Sequence
  DNA-dependent protein kinase catalytic subunit (659-668)
cgccugccccucaucagcggcuucuacaag

SEQ ID NO: 32565 - RNA, 30 nt, Artificial Sequence
  Vimentin (69-78)
cgccugcggagcuccgugcccggcguccgc

SEQ ID NO: 32566 - RNA, 27 nt, Artificial Sequence
  Cytoskeleton-associated protein 2 (369-377)
cgccugagcgaguggaaggccggcaag

SEQ ID NO: 32567 - RNA, 30 nt, Artificial Sequence
  Coiled-coil domain-containing protein 124 (192-201)
cgccugagccagcucaagcagcugcugaag

SEQ ID NO: 32568 - RNA, 27 nt, Artificial Sequence
  E3 ubiquitin-protein ligase HECTD1 (170-178)
cgccugguggaccuccccaucagcaag

SEQ ID NO: 32569 - RNA, 27 nt, Artificial Sequence
  Serine-threonine kinase receptor-associated protein (290-298)
cgccuguggcagaccguggucggcaag

SEQ ID NO: 32570 - RNA, 39 nt, Artificial Sequence
  Mitotic checkpoint protein BUB3 (40-52)
cgccuguacgacgugcccgccaacagcaugcggcucaag

SEQ ID NO: 32571 - RNA, 27 nt, Artificial Sequence
  DNA damage-binding protein 1 (889-897)
cgccuguacgaguggaccaccgagaag

SEQ ID NO: 32572 - RNA, 36 nt, Artificial Sequence
  60S ribosomal protein L23a (129-140)
cgccccgacggcgagaagaaggccuacgugcggcug

SEQ ID NO: 32573 - RNA, 27 nt, Artificial Sequence
  26S proteasome non-ATPase regulatory subunit 12 (417-425)
cgccccaaggacccgaacaaccugcuc

SEQ ID NO: 32574 - RNA, 27 nt, Artificial Sequence
  Ataxin-3 (188-196)
cgccccaagcugaucggcgaggagcuc

SEQ ID NO: 32575 - RNA, 33 nt, Artificial Sequence
  Poly(rC)-binding protein 2 (183-193)
cgccccaagccgagcuccagccccgugaucuuc

SEQ ID NO: 32576 - RNA, 27 nt, Artificial Sequence
  40S ribosomal protein S11 (132-140)
cgcccccugagcaagaccgugcgguuc

SEQ ID NO: 32577 - RNA, 27 nt, Artificial Sequence
  Splicing factor 3B subunit 2 (222-230)
cgcccccggggcccgcccccccccccg

SEQ ID NO: 32578 - RNA, 33 nt, Artificial Sequence
  Vimentin (23-33)
cgccccagcuccagccgguccuacgugaccacc

SEQ ID NO: 32579 - RNA, 27 nt, Artificial Sequence
  Elongation factor 1-alpha 1 (240-248)
cgccccaccgacaagccgcugcggcuc

SEQ ID NO: 32580 - RNA, 30 nt, Artificial Sequence
  Translation initiation factor eIF-2B subunit delta (385-394)
cgccccuggcuggagggccggcacacccuc

SEQ ID NO: 32581 - RNA, 30 nt, Artificial Sequence
  Polyglutamine-binding protein 1 (242-251)
cgccccuacccgagccccggcgccgugcug

SEQ ID NO: 32582 - RNA, 30 nt, Artificial Sequence
  Transcriptional repressor p66-alpha (257-266)
cgcagcaucccccaguccgccaccuggaag

SEQ ID NO: 32583 - RNA, 30 nt, Artificial Sequence
  Constitutive coactivator of PPAR-gamma-like protein 1 (313-322)
cgcaccgacgacaaggugauccgguucaag

SEQ ID NO: 32584 - RNA, 33 nt, Artificial Sequence
  Ras GTPase-activating protein-binding protein 1 (247-257)
cgcaccuucagcugggccuccgugaccagcaag

SEQ ID NO: 32585 - RNA, 27 nt, Artificial Sequence
  42 kda non-muscle cytoplasmic actin (2-10)
cgcguggcccccgaggagcacccgguc

SEQ ID NO: 32586 - RNA, 39 nt, Artificial Sequence
  Heterogeneous nuclear ribonucleoprotein C-like 1 (17-29)
cgcguguucaucggcaaccugaacacccucgucgugaag

SEQ ID NO: 32587 - RNA, 36 nt, Artificial Sequence
  Elongation factor 2 (415-426)
cgcguguucagcggccuggucuccaccgggcucaag

SEQ ID NO: 32588 - RNA, 27 nt, Artificial Sequence
  Paired amphipathic helix protein Sin3a (1263-1271)
cgcgugaaguacggcaccgucuucaag

SEQ ID NO: 32589 - RNA, 36 nt, Artificial Sequence
  Prohibitin (117-128)
cgcgugcugcccagcaucaccaccgagauccucaag

SEQ ID NO: 32590 - RNA, 39 nt, Artificial Sequence
  Coatomer subunit beta (327-339)
cgcgugcugagcacccccgaccucgagguccggaagaag

SEQ ID NO: 32591 - RNA, 27 nt, Artificial Sequence
  Filamin-A (2022-2030)
cgcgugcgggucagcggccaggggcug

SEQ ID NO: 32592 - RNA, 27 nt, Artificial Sequence
  Pre-mRNA-processing-splicing factor 8 (444-452)
cgcgugagcuaccagaagcugcucaag

SEQ ID NO: 32593 - RNA, 48 nt, Artificial Sequence
  Ribose-5-phosphate isomerase (219-234)
cgcguguacuucggcaugcaggacgggagcgucaacaugcgggagaag

SEQ ID NO: 32594 - RNA, 27 nt, Artificial Sequence
  Antigen KI-67 (420-428)
agcgagaaccugcucggcaagcaguuc

SEQ ID NO: 32595 - RNA, 30 nt, Artificial Sequence
  Heterogeneous nuclear ribonucleoproteins A2/B1 (73-82)
agcaucgacggccgcguggucgagcccaag

SEQ ID NO: 32596 - RNA, 30 nt, Artificial Sequence
  Transmembrane and coiled-coil domain-containing protein 1 (107-116)
agcaucuucgacggccgcguggucgccaag

SEQ ID NO: 32597 - RNA, 33 nt, Artificial Sequence
  Phosphoglycerate kinase 1 (87-97)
agccugcucggcaaggacgugcuguuccugaag

SEQ ID NO: 32598 - RNA, 27 nt, Artificial Sequence
  Dynein light chain roadblock-type 1 (51-59)
agccugaugcacuccuucauccucaag

SEQ ID NO: 32599 - RNA, 30 nt, Artificial Sequence
  Vimentin (430-439)
agccugccccucguggacacccacuccaag

SEQ ID NO: 32600 - RNA, 42 nt, Artificial Sequence
  Vimentin (51-64)
agccuguacgccuccagccccggcgggguguacgccacccgc

SEQ ID NO: 32601 - RNA, 27 nt, Artificial Sequence
  Fatty acid synthase (2326-2334)
agccccgccccgacccacaacucccug

SEQ ID NO: 32602 - RNA, 27 nt, Artificial Sequence
  Ataxin-2-like protein (516-524)
agccccgccuccccgaagaucagccug

SEQ ID NO: 32603 - RNA, 27 nt, Artificial Sequence
  Chromosome alignment-maintaining phosphoprotein 1 (618-626)
agccccgagcagucccgcaacgugcug

SEQ ID NO: 32604 - RNA, 27 nt, Artificial Sequence
  Rho guanine nucleotide exchange factor 1 (10-18)
agccccggcccgucccgccccgggcug

SEQ ID NO: 32605 - RNA, 30 nt, Artificial Sequence
  Isocitrate dehydrogenase (NADP) cytoplasmic (28-37)
agccccaacggcaccauccgcaacauccug

SEQ ID NO: 32606 - RNA, 27 nt, Artificial Sequence
  Trifunctional enzyme subunit alpha, mitochondrial (56-64)
agccccaacuccaaggugaacacccug

SEQ ID NO: 32607 - RNA, 27 nt, Artificial Sequence
  Cleavage stimulation factor subunit 2 (153-161)
agcccccaggaggcccgcaacaugcug

SEQ ID NO: 32608 - RNA, 27 nt, Artificial Sequence
  Poly(rC)-binding protein 1 (173-181)
agcccccagggccgcgugaugaccauc

SEQ ID NO: 32609 - RNA, 27 nt, Artificial Sequence
  E3 ubiquitin-protein ligase TRIP12 (1954-1962)
agcccccgccugccggugggcggguuc

SEQ ID NO: 32610 - RNA, 27 nt, Artificial Sequence
  Cytoplasmic dynein 1 light intermediate chain 1 (398-406)
agcccccgcgugccgggcggguccccc

SEQ ID NO: 32611 - RNA, 30 nt, Artificial Sequence
  Telomeric repeat-binding factor 2-interacting protein 1 (154-163)
agccccuccagcgugaccggcaacgcccug

SEQ ID NO: 32612 - RNA, 27 nt, Artificial Sequence
  Transketolase (386-394)
agccgccccgagaacgccaucaucuac

SEQ ID NO: 32613 - RNA, 24 nt, Artificial Sequence
  Heterogeneous nuclear ribonucleoprotein K (81-88)
agcuccggccccgagcgcauccug

SEQ ID NO: 32614 - RNA, 36 nt, Artificial Sequence
  RNA-binding protein FUS (44-55)
agcaccgacaccuccggcuacgggcagagcuccuac

SEQ ID NO: 32615 - RNA, 27 nt, Artificial Sequence
  DNA-dependent protein kinase catalytic subunit (1861-1869)
agcaccuucgacacccagaucacgaag

SEQ ID NO: 32616 - RNA, 27 nt, Artificial Sequence
  60S ribosomal protein L10a (153-161)
agcaccaucaaguuccagaugaagaag

SEQ ID NO: 32617 - RNA, 27 nt, Artificial Sequence
  Cytoskeleton-associated protein 5 (430-438)
agcacccugcccaagucccuccugaag

SEQ ID NO: 32618 - RNA, 33 nt, Artificial Sequence
  Dolichyl-diphosphooligosaccharide-proteinosyltransferase subunit 2 (254-264)
agcguggccuccgccgcggccguccugagccac

SEQ ID NO: 32619 - RNA, 27 nt, Artificial Sequence
  Cytoplasmic FMR1-interacting protein 1 (504-512)
agcguguucaaccacgccauccgccac

SEQ ID NO: 32620 - RNA, 27 nt, Artificial Sequence
  Far upstream element-binding protein 3 (77-85)
agcguguacggcuacgggguccagaag

SEQ ID NO: 32621 - RNA, 27 nt, Artificial Sequence
  YTH domain-containing protein 1 (570-578)
agcuacaacgacuacgugcgcgaguuc

SEQ ID NO: 32622 - RNA, 27 nt, Artificial Sequence
  RNA binding motif protein, X-linked-like-1 (280-288)
agcuaccgcgacuccuacgagagcuac

SEQ ID NO: 32623 - RNA, 27 nt, Artificial Sequence
  Nuclear pore complex protein Nup98-Nup96 (1516-1524)
accgccgacccccuggacuaccgccuc

SEQ ID NO: 32624 - RNA, 27 nt, Artificial Sequence
  Fatty acid synthase (1230-1238)
accgccguggagaacaugcccagccug

SEQ ID NO: 32625 - RNA, 30 nt, Artificial Sequence
  T-complex protein 1 subunit theta (13-22)
accgccuacggccccaacgggaugaacaag

SEQ ID NO: 32626 - RNA, 27 nt, Artificial Sequence
  Eukaryotic translation elongation factor 1 epsilon-1 (114-122)
acccuggccgacauccuccuguacuac

SEQ ID NO: 32627 - RNA, 27 nt, Artificial Sequence
  Coatomer subunit beta' (828-836)
acccccaacgaggagcgcaacgugaug

SEQ ID NO: 32628 - RNA, 27 nt, Artificial Sequence
  Extended synaptotagmin-1 (769-777)
accccccgcccgaccgccgccgagcug

SEQ ID NO: 32629 - RNA, 27 nt, Artificial Sequence
  Serine/arginine repetitive matrix protein 2 (2049-2057)
acccccguggccggcagccagucccug

SEQ ID NO: 32630 - RNA, 27 nt, Artificial Sequence
  Exportin-1 (61-69)
acccgcguggacaccauccuggaguuc

SEQ ID NO: 32631 - RNA, 30 nt, Artificial Sequence
  TATA-binding protein-associated factor 2N (41-50)
accaccgacagcuccuacggccagaacuac

SEQ ID NO: 32632 - RNA, 30 nt, Artificial Sequence
  Retinoblastoma-associated protein (408-417)
accgugaaccccaaggagagcauccugaag

SEQ ID NO: 32633 - RNA, 27 nt, Artificial Sequence
  Prosaposin (51-59)
accguguggaacaagcccaccgucaag

SEQ ID NO: 32634 - RNA, 24 nt, Artificial Sequence
  Zinc phosphodiesterase ELAC protein 2 (581-588)
guggagcgccugaucagcucccuc

SEQ ID NO: 32635 - RNA, 24 nt, Artificial Sequence
  Antigen KI-67 (75-82)
gugaucgacgagcccguccgccug

SEQ ID NO: 32636 - RNA, 39 nt, Artificial Sequence
  Myb-binding protein 1A (543-555)
gugauccgcagccccucccugcuccagagcggcgccaag

SEQ ID NO: 32637 - RNA, 30 nt, Artificial Sequence
  Filamin-A (331-340)
gugcuguucgccggccagcacaucgccaag

SEQ ID NO: 32638 - RNA, 27 nt, Artificial Sequence
  Barrier-to-autointegration factor (45-53)
gugcugggccaguuccucguccugaag

SEQ ID NO: 32639 - RNA, 27 nt, Artificial Sequence
  Protein flightless-1 homolog (179-187)
gugcugaacggcaacccccuccugcac

SEQ ID NO: 32640 - RNA, 27 nt, Artificial Sequence
  Signal recognition particle subunit SRP68 (453-461)
gugcuguacgaccgcguccucaaguac

SEQ ID NO: 32641 - RNA, 27 nt, Artificial Sequence
  60S ribosomal protein L7 (83-91)
gugcccgccgagccgaagcuggccuuc

SEQ ID NO: 32642 - RNA, 27 nt, Artificial Sequence
  Protein FAM219A (74-82)
gugcccaacaagggcuacagcucccug

SEQ ID NO: 32643 - RNA, 30 nt, Artificial Sequence
  Long-chain-fatty-acid-CoA ligase 4 (576-585)
gugcccaaccagaagcgccugacccuccug

SEQ ID NO: 32644 - RNA, 27 nt, Artificial Sequence
  ATP-dependent RNA helicase DDX24 (199-207)
gugccccgcccgguccugcgggcccuc

SEQ ID NO: 32645 - RNA, 27 nt, Artificial Sequence
  Ankyrin repeat and KH domain-containing protein 1 (748-756)
gugccccgcgucccgacccacacccug

SEQ ID NO: 32646 - RNA, 27 nt, Artificial Sequence
  Nuclear pore complex protein Nup153 (582-590)
gugcccgucgccaagaccgccgagcug

SEQ ID NO: 32647 - RNA, 27 nt, Artificial Sequence
  60S ribosomal protein L27a (104-112)
gugcgcagcggcuacuacaagguccug

SEQ ID NO: 32648 - RNA, 27 nt, Artificial Sequence
  RNA-binding protein 4 (197-205)
gugcgcacccccuacaccaugagcuac

SEQ ID NO: 32649 - RNA, 33 nt, Artificial Sequence
  Tripeptidyl-peptidase 1 (68-78)
gugagcgaccccuccagcccgcaguacggcaag

SEQ ID NO: 32650 - RNA, 33 nt, Artificial Sequence
  Vimentin (31-41)
gugaccaccagcacgcgcaccuacucccugggc

SEQ ID NO: 32651 - RNA, 30 nt, Artificial Sequence
  60S ribosomal protein L8 (15-24)
guggucuuccgcgaccccuaccgguucaag

SEQ ID NO: 32652 - RNA, 24 nt, Artificial Sequence
  Non-specific lipid-transfer protein (16-23)
guggucggcguggggaugaccaag

SEQ ID NO: 32653 - RNA, 30 nt, Artificial Sequence
  Filamin-A (391-400)
guggucauccaggaccccaugggccagaag

SEQ ID NO: 32654 - RNA, 30 nt, Artificial Sequence
  Barrier-to-autointegration factor (44-53)
gugguccugggccaguuccucgugcugaag

SEQ ID NO: 32655 - RNA, 63 nt, Artificial Sequence
  Glyceraldehyde-3-phosphate dehydrogenase (87-107)
uggggcgacgccggggccgaguacguggucgagagcaccggcguguucaccacgauggagaag

SEQ ID NO: 32656 - RNA, 27 nt, Artificial Sequence
  Tubulin beta chain (179-187)
uaccccgaccgcaucaugaacaccuuc

SEQ ID NO: 32657 - RNA, 27 nt, Artificial Sequence
  RNA-binding protein 14 (249-257)
uaccgcgcccagcccagcgccucccug

SEQ ID NO: 32658 - RNA, 27 nt, Artificial Sequence
  RNA-binding protein 14 (237-245)
uaccgcgcccagcccagcgugucccug

SEQ ID NO: 32659 - RNA, 27 nt, Artificial Sequence
  RNA-binding protein 14 (540-548)
uaccgcggccagcccgggaacgccuac

SEQ ID NO: 32660 - RNA, 24 nt, Artificial Sequence
  Cyclin-dependent kinase 9 (194-201)
uaccgccccccggagcugcuccug

SEQ ID NO: 32661 - RNA, 27 nt, Artificial Sequence
  Pre-mRNA-processing-splicing factor 8 (1470-1478)
uaccgcaccgacaugauccaggcccug

SEQ ID NO: 32662 - RNA, 36 nt, Artificial Sequence
  Plectin (3167-3178)
uacagcgaccccuccaccggcgagccggccaccuac

SEQ ID NO: 32663 - RNA, 27 nt, Artificial Sequence
  Protein SON (1132-1140)
uacaccgacagcuacaccgacacguac

SEQ ID NO: 32664 - RNA, 33 nt, Artificial Sequence
  HLA class I histocompatibility antigen, B-38 alpha chain (140-150)
uucgccuacgacggcaaggacuacaucgcccug

SEQ ID NO: 32665 - RNA, 27 nt, Artificial Sequence
  Proteasome subunit beta type-7 (202-210)
aucgccgccggcaucuucaacgaccug

SEQ ID NO: 32666 - RNA, 27 nt, Artificial Sequence
  40S ribosomal protein S17 (38-46)
aucgccaucauccccagcaagaagcug

SEQ ID NO: 32667 - RNA, 27 nt, Artificial Sequence
  Neudesin (21-29)
gcccuggcccccggccucccgaccgcg

SEQ ID NO: 32668 - RNA, 30 nt, Artificial Sequence
  TRAF2 and NCK-interacting protein kinase (1170-1179)
gccugggcccccaagccguaccacaaguuc

SEQ ID NO: 32669 - RNA, 27 nt, Artificial Sequence
  Neuroblast differentiation-associated protein AHNAK (739-747)
gacgugcacggccccgacuggcaccug

SEQ ID NO: 32670 - RNA, 27 nt, Artificial Sequence
  Prelamin-A/C (53-61)
gaggagcuggacuuccagaagaacauc

SEQ ID NO: 32671 - RNA, 27 nt, Artificial Sequence
  Protein flightless-1 homolog (1158-1166)
gaguacaugaagcacacccgccuguuc

SEQ ID NO: 32672 - RNA, 27 nt, Artificial Sequence
  Non-POU domain-containing octamer-binding protein (374-382)
uuccccgacgcccgcgagcaggagauc

SEQ ID NO: 32673 - RNA, 24 nt, Artificial Sequence
  Probable RNA-binding protein 23 (351-358)
uuccccgacggcgaccaggagcug

SEQ ID NO: 32674 - RNA, 27 nt, Artificial Sequence
  Tubulin beta-6 chain (159-167)
uuccccgaccgcaucaugaacaccuuc

SEQ ID NO: 32675 - RNA, 27 nt, Artificial Sequence
  Actin-related protein 2/3 complex subunit 3 (103-111)
uuccccaucccgggcgagcccggguuc

SEQ ID NO: 32676 - RNA, 27 nt, Artificial Sequence
  Solute carrier family 35 member F5 (288-296)
uuccccagcaacuccggcgaccgcuuc

SEQ ID NO: 32677 - RNA, 30 nt, Artificial Sequence
  Myoferlin (286-295)
uucguguacgacgagcccggccacgccguc

SEQ ID NO: 32678 - RNA, 30 nt, Artificial Sequence
  HLA class I histocompatibility antigen, B-44 alpha chain (216-225)
caccccaucagcgaccacgaggugacccug

SEQ ID NO: 32679 - RNA, 24 nt, Artificial Sequence
  Fructose-bisphosphate aldolase B (192-199)
auccccgacggcgaccacgaccug

SEQ ID NO: 32680 - RNA, 27 nt, Artificial Sequence
  Neutral cholesterol ester hydrolase 1 (34-42)
aaguacuuccugaagcccgaggugcuc

SEQ ID NO: 32681 - RNA, 27 nt, Artificial Sequence
  Vacuolar protein sorting-associated protein 13B (2853-2861)
cugcccgacccgaucaucauccaccuc

SEQ ID NO: 32682 - RNA, 27 nt, Artificial Sequence
  FERM domain-containing protein 6 (550-558)
cuguaccagaaggacuuccuccgcauc

SEQ ID NO: 32683 - RNA, 27 nt, Artificial Sequence
  Microtubule-associated protein RP/EB family member 1 (50-58)
augcuguuccccggcagcaucgcccuc

SEQ ID NO: 32684 - RNA, 27 nt, Artificial Sequence
  Cyclic AMP-dependent transcription factor ATF-4 (108-116)
augcccgacgaccugcucaccacccug

SEQ ID NO: 32685 - RNA, 24 nt, Artificial Sequence
  Neuroblast differentiation-associated protein AHNAK (820-827)
augcccgacguggaccugcaccuc

SEQ ID NO: 32686 - RNA, 27 nt, Artificial Sequence
  Transcription factor AP-1 (42-50)
augguggcccccgccgucgcgagcgug

SEQ ID NO: 32687 - RNA, 27 nt, Artificial Sequence
  Chloride intracellular channel protein 4 (190-198)
aaccugcuccccaagcugcacaucgug

SEQ ID NO: 32688 - RNA, 27 nt, Artificial Sequence
  Growth arrest and DNA damage-inducible protein GADD45 alpha (48-56)
aacguggaccccgacaacgucgugcug

SEQ ID NO: 32689 - RNA, 27 nt, Artificial Sequence
  Probable C-mannosyltransferase DPY19L4 (693-701)
aacuacagccccuacgugaacuacuuc

SEQ ID NO: 32690 - RNA, 33 nt, Artificial Sequence
  Integrin alpha-3 (412-422)
cagccccagcaggugauccacggcgagaagcug

SEQ ID NO: 32691 - RNA, 27 nt, Artificial Sequence
  Protein transport protein Sec61 subunit alpha isoform 2 (393-401)
cgcuacauccccaccgccgccgcguuc

SEQ ID NO: 32692 - RNA, 30 nt, Artificial Sequence
  Tumor suppressor candidate 3 (18-27)
cgcuaccugcccaccggcagcuucccguuc

SEQ ID NO: 32693 - RNA, 27 nt, Artificial Sequence
  Rho GTPase-activating protein 7 (915-923)
agcgagggccccccgcugcgccucugg

SEQ ID NO: 32694 - RNA, 27 nt, Artificial Sequence
  Exosome complex component RRP42 (222-230)
agccuggccucccuccuggugagcguc

SEQ ID NO: 32695 - RNA, 27 nt, Artificial Sequence
  AAC83183.1 (1386-1394)
agccugcucgaccccgugccggagguc

SEQ ID NO: 32696 - RNA, 27 nt, Artificial Sequence
  E3 ubiquitin-protein ligase BRE1A (312-320)
agccuguacggcgggaccaucaccauc

SEQ ID NO: 32697 - RNA, 27 nt, Artificial Sequence
  WD repeat-containing protein 48 (452-460)
agccccgacggcuccgacccgaagcug

SEQ ID NO: 32698 - RNA, 27 nt, Artificial Sequence
  Pericentriolar material 1 protein (1935-1943)
agccccgacaccgaguccccggugcug

SEQ ID NO: 32699 - RNA, 30 nt, Artificial Sequence
  Protein LDOC1 (73-82)
agcuacaugcuggugaacgagaaccgcuuc

SEQ ID NO: 32700 - RNA, 27 nt, Artificial Sequence
  Nardilysin (1115-1123)
accuaccugcccaccagcccgcuccug

SEQ ID NO: 32701 - RNA, 27 nt, Artificial Sequence
  Calnexin (12-20)
gugcugggcaccgccaucgucgaggcc

SEQ ID NO: 32702 - RNA, 27 nt, Artificial Sequence
  Cleft lip and palate transmembrane protein 1 (107-115)
guguacaucagcgagcacgagcacuuc

SEQ ID NO: 32703 - RNA, 27 nt, Artificial Sequence
  U5 small nuclear ribonucleoprotein 200 kDa helicase (1389-1397)
guguacauggacugguacgagaaguuc

SEQ ID NO: 32704 - RNA, 30 nt, Artificial Sequence
  BTB/POZ domain-containing protein KCTD4 (77-86)
uacuucaucgaccgcgacggccugcucuuc

SEQ ID NO: 32705 - RNA, 30 nt, Artificial Sequence
  DNA-binding protein SATB2 (639-648)
uaccccgaccaggaggccauccacacccug

SEQ ID NO: 32706 - RNA, 30 nt, Artificial Sequence
  Long-chain-fatty-acid-CoA ligase 4 (238-247)
uaccccgagggcuucgagauccacagcaug

SEQ ID NO: 32707 - RNA, 30 nt, Artificial Sequence
  Tribbles homolog 3 (259-268)
uaccccuuccaggacagcgagccggugcug

SEQ ID NO: 32708 - RNA, 27 nt, Artificial Sequence
  Protein LAP2 (483-491)
uaccccaccccguaccccgacgagcug

SEQ ID NO: 32709 - RNA, 27 nt, Artificial Sequence
  V-type proton ATPase catalytic subunit A (464-472)
uacuacgacaagcacuucaccgaguuc

SEQ ID NO: 32710 - RNA, 33 nt, Artificial Sequence
  Filamin-B (515-525)
uacuaccccagcaccccgggccgcuacuccauc

SEQ ID NO: 32711 - RNA, 27 nt, Artificial Sequence
  Polypyrimidine tract-binding protein 3 (113-121)
uacuacacccccaucaccccgcaccug

SEQ ID NO: 32712 - RNA, 27 nt, Artificial Sequence
  Small nuclear ribonucleoprotein E (28-36)
cgcagccggauccagguguggcuguac

SEQ ID NO: 32713 - RNA, 63 nt, Artificial Sequence
  60S ribosomal protein L30 (95-115)
gccaucaucgaccccggcgacagcgacaucauccgcuccaugccggagcagaccggggagaag

SEQ ID NO: 32714 - RNA, 30 nt, Artificial Sequence
  Catenin beta-1 (115-124)
gacgccgcccaccccaccaacgugcagcgc

SEQ ID NO: 32715 - RNA, 27 nt, Artificial Sequence
  HLA class I histocompatibility antigen, B-51 alpha chain (161-169)
gacaccgccgcccagaucacccagcgc

SEQ ID NO: 32716 - RNA, 27 nt, Artificial Sequence
  Heterogeneous nuclear ribonucleoproteins A2/B1 (139-147)
gacaccaucgagaucaucaccgaccgc

SEQ ID NO: 32717 - RNA, 27 nt, Artificial Sequence
  Translocon-associated protein subunit beta isoform X1 (107-115)
gacgugagccacaccgucgugcugcgc

SEQ ID NO: 32718 - RNA, 27 nt, Artificial Sequence
  Actin, aortic smooth muscle (366-374)
gaggccggccccagcaucgugcaccgc

SEQ ID NO: 32719 - RNA, 27 nt, Artificial Sequence
  Fructose-bisphosphate aldolase A (35-43)
gagagcaccggcuccaucgccaagcgc

SEQ ID NO: 32720 - RNA, 27 nt, Artificial Sequence
  SH3 domain-binding glutamic acid-rich-like protein 3 (23-31)
gaggugacccgcauccuggacggcaag

SEQ ID NO: 32721 - RNA, 48 nt, Artificial Sequence
  HLA class II histocompatibility antigen, DRB1-4 beta chain (62-77)
caccaggaggaguacgugcgcuucgacagcgacgucggcgaguaccgg

SEQ ID NO: 32722 - RNA, 45 nt, Artificial Sequence
  Sodium/potassium-transporting ATPase subunit alpha-1 (60-74)
aucguggucuacaccggcgaccgcaccgugauggggcggaucgcc

SEQ ID NO: 32723 - RNA, 48 nt, Artificial Sequence
  NEDD4 family-interacting protein 1 (63-78)
aagcccccgagcuacaacguggccaccacccugcccuccuacgacgag

SEQ ID NO: 32724 - RNA, 27 nt, Artificial Sequence
  Keratin, type I cytoskeletal 18 (32-40)
cgccuggccagcuaccucgaccgggug

SEQ ID NO: 32725 - RNA, 27 nt, Artificial Sequence
  60S ribosomal protein L24 (86-94)
agccuggccgacaucauggccaagcgc

SEQ ID NO: 32726 - RNA, 33 nt, Artificial Sequence
  HLA class I histocompatibility antigen, Cw-4 alpha chain (133-143)
accgccgccgacaccgcggcccagaucacgcgc

SEQ ID NO: 32727 - RNA, 30 nt, Artificial Sequence
  WD repeat-containing protein 6 (462-471)
acccuguuccccggcaaggugcacagccuc

SEQ ID NO: 32728 - RNA, 27 nt, Artificial Sequence
  Fatty acid-binding protein, liver (114-122)
acccugggcgacaucguguucaagcgc

SEQ ID NO: 32729 - RNA, 27 nt, Artificial Sequence
  Actin, aortic smooth muscle (204-212)
accaccgccgagcgcgagaucgugcgg

SEQ ID NO: 32730 - RNA, 27 nt, Artificial Sequence
  Polymeric immunoglobulin receptor (656-664)
guggccgucggcguggcccgcgcgcgg

SEQ ID NO: 32731 - RNA, 27 nt, Artificial Sequence
  DAZ-associated protein 2 (63-71)
gccgccuuccccggcgcgagccuguac

SEQ ID NO: 32732 - RNA, 27 nt, Artificial Sequence
  Kelch-like protein 24 (576-584)
gccgccaugccccgcccggugagcuac

SEQ ID NO: 32733 - RNA, 27 nt, Artificial Sequence
  Lck-interacting transmembrane adapter 1 (159-167)
gccgccagccccguggucgcggaguac

SEQ ID NO: 32734 - RNA, 27 nt, Artificial Sequence
  Cysteine-rich protein 2-binding protein (154-162)
gccuucaucgagaagcacuggaccuuc

SEQ ID NO: 32735 - RNA, 27 nt, Artificial Sequence
  Bifunctional 3'-phosphoadenosine 5'-phosphosulfate synthase 2 (479-487)
gccaucuuccccagcccgaugcuguac

SEQ ID NO: 32736 - RNA, 27 nt, Artificial Sequence
  Bifunctional 3'-phosphoadenosine 5'-phosphosulfate synthase 1 (488-496)
gccaucuuccccagcccgaugauguac

SEQ ID NO: 32737 - RNA, 27 nt, Artificial Sequence
  Phosphatidylinositol 5-phosphate 4-kinase type-2 alpha (356-364)
gccaucaucgacauccugacccacuac

SEQ ID NO: 32738 - RNA, 30 nt, Artificial Sequence
  Calsyntenin-3 (69-78)
gcccuggacaaggacgccccccuccgcuac

SEQ ID NO: 32739 - RNA, 27 nt, Artificial Sequence
  Ras-related protein Rab-20 (156-164)
gcccuguacaagaagauccucaaguac

SEQ ID NO: 32740 - RNA, 27 nt, Artificial Sequence
  Structure-specific endonuclease subunit SLX4 (1765-1773)
gcccuguaccagaaggugcuccuguac

SEQ ID NO: 32741 - RNA, 33 nt, Artificial Sequence
  Myosin regulatory light polypeptide 9 (24-34)
gccauguucgaccagagccagauccaggaguuc

SEQ ID NO: 32742 - RNA, 27 nt, Artificial Sequence
  60S ribosomal protein L6 (61-69)
gccauguacagccgcaaggccauguac

SEQ ID NO: 32743 - RNA, 27 nt, Artificial Sequence
  Junction plakoglobin (472-480)
gcccagaacagcgugcgccugaacuac

SEQ ID NO: 32744 - RNA, 27 nt, Artificial Sequence
  Protein transport protein Sec23B (125-133)
gcccagagcccccugaucuuccucuac

SEQ ID NO: 32745 - RNA, 27 nt, Artificial Sequence
  Centrosome-associated protein 350 (330-338)
gccaccgcccccccggcgcccgccuac

SEQ ID NO: 32746 - RNA, 27 nt, Artificial Sequence
  Protein transport protein Sec31A (61-69)
gccaccuucagcuccagccaccgcuac

SEQ ID NO: 32747 - RNA, 30 nt, Artificial Sequence
  E3 ubiquitin/ISG15 ligase TRIM25 (592-601)
gccguggccgacaagguccaccugauguac

SEQ ID NO: 32748 - RNA, 27 nt, Artificial Sequence
  StAR-related lipid transfer protein 5 (12-20)
gccguggccgagaagaugcugcaguac

SEQ ID NO: 32749 - RNA, 27 nt, Artificial Sequence
  WASH complex subunit 7 (624-632)
gccguggacgccgcgcgccugcacuac

SEQ ID NO: 32750 - RNA, 30 nt, Artificial Sequence
  Nuclear pore membraneoprotein 210 (497-506)
gccguggaccccaccagcggccagcuguac

SEQ ID NO: 32751 - RNA, 27 nt, Artificial Sequence
  Lysocardiolipin acyltransferase 1 (91-99)
gccgugcacgacaucaccgucgccuac

SEQ ID NO: 32752 - RNA, 30 nt, Artificial Sequence
  Methylsterol monooxygenase 1 (15-24)
gccgugaucgaggacaccuggcacuacuuc

SEQ ID NO: 32753 - RNA, 27 nt, Artificial Sequence
  V-type proton ATPase subunit d 1 (111-119)
gccuaccuggagagcuucuacaaguuc

SEQ ID NO: 32754 - RNA, 27 nt, Artificial Sequence
  Protein S100-A9 (67-75)
gacaccaacgccgacaagcagcugagc

SEQ ID NO: 32755 - RNA, 27 nt, Artificial Sequence
  Transcription elongation factor SPT6 (339-347)
gacguguacaaccacuuccugcucuac

SEQ ID NO: 32756 - RNA, 27 nt, Artificial Sequence
  MOB kinase activator 1A (175-183)
gaggaggcccaccugaacaccagcuuc

SEQ ID NO: 32757 - RNA, 27 nt, Artificial Sequence
  HLA class II histocompatibility antigen, DP alpha 1 chain (43-51)
gaggaguucggccaggccuucagcuuc

SEQ ID NO: 32758 - RNA, 27 nt, Artificial Sequence
  Protein arginine N-methyltransferase 1 (319-327)
gaggagaucuucggcaccaucgggaug

SEQ ID NO: 32759 - RNA, 30 nt, Artificial Sequence
  Puromycin-sensitive aminopeptidase-like protein (113-122)
gaggagauccacgccaccggcuucaacuac

SEQ ID NO: 32760 - RNA, 30 nt, Artificial Sequence
  Myocyte-specific enhancer factor 2D (127-136)
gaggagcuggacggccucuuccgccgguac

SEQ ID NO: 32761 - RNA, 27 nt, Artificial Sequence
  Ribosomal RNA processing protein 36 homolog (132-140)
gagguguucgacaagaccuaccaguuc

SEQ ID NO: 32762 - RNA, 27 nt, Artificial Sequence
  G1/S-specific cyclin-D3 (26-34)
gagguguucccccuggccaugaacuac

SEQ ID NO: 32763 - RNA, 27 nt, Artificial Sequence
  Golgi resident protein GCP60 (490-498)
gagguguacgccggcagccaccaguac

SEQ ID NO: 32764 - RNA, 27 nt, Artificial Sequence
  Dipeptidyl peptidase 1 (375-383)
gagguguacgacgacuuccugcacuac

SEQ ID NO: 32765 - RNA, 27 nt, Artificial Sequence
  Sphingolipid delta(4)-desaturase DES1 (176-184)
uucaucaaccccaagccgaucaccuac

SEQ ID NO: 32766 - RNA, 27 nt, Artificial Sequence
  Histone acetyltransferase KAT6A (600-608)
uuccuggaccacaagacccucuacuac

SEQ ID NO: 32767 - RNA, 27 nt, Artificial Sequence
  Putative ATP-dependent RNA helicase DHX57 (392-400)
uuccuguacgacaaggcccucaccuuc

SEQ ID NO: 32768 - RNA, 27 nt, Artificial Sequence
  Calnexin (230-238)
uucaccgacaagaagacccaccuguac

SEQ ID NO: 32769 - RNA, 30 nt, Artificial Sequence
  Histone-arginine methyltransferase CARM1 (584-593)
uucaccaugggcgggcccgccaucagcaug

SEQ ID NO: 32770 - RNA, 42 nt, Artificial Sequence
  Myosin regulatory light chain 12A (164-177)
uucacccgcauccugaagcacggcgccaaggacaaggacgac

SEQ ID NO: 32771 - RNA, 27 nt, Artificial Sequence
  Plastin-3 (324-332)
uucguggccaaccuguucaacaaguac

SEQ ID NO: 32772 - RNA, 33 nt, Artificial Sequence
  U5 small nuclear ribonucleoprotein 200 kDa helicase (1845-1855)
uucguggcccccgccaccggcgcgcacaacuac

SEQ ID NO: 32773 - RNA, 42 nt, Artificial Sequence
  Cytochrome c oxidase subunit NDUFA4 (19-32)
uucguguucaucggcaccggggccaccggcgccacgcuguac

SEQ ID NO: 32774 - RNA, 27 nt, Artificial Sequence
  Ras-related protein Rab-5B (92-100)
uucgugaagggccaguuccacgaguac

SEQ ID NO: 32775 - RNA, 27 nt, Artificial Sequence
  COP9 signalosome complex subunit 6 (275-283)
uucgugaacaaguucaacguccuguac

SEQ ID NO: 32776 - RNA, 30 nt, Artificial Sequence
  Probable ATP-dependent RNA helicase DDX5 (549-558)
uucgugagcgccggcauccagaccuccuuc

SEQ ID NO: 32777 - RNA, 30 nt, Artificial Sequence
  Transmembrane protein 258 (37-46)
uucguguacgaggucaccagcaccaaguac

SEQ ID NO: 32778 - RNA, 36 nt, Artificial Sequence
  Dermcidin (97-108)
ggcgccgugcacgacgucaaggacgugcuggacagc

SEQ ID NO: 32779 - RNA, 27 nt, Artificial Sequence
  Vacuolar protein sorting-associated protein 51 homolog (121-129)
ggcgccuacgggcaggccgugcgcuac

SEQ ID NO: 32780 - RNA, 27 nt, Artificial Sequence
  Histone H2B type 2-F (76-84)
ggcgaggccagccgccuggcccacuac

SEQ ID NO: 32781 - RNA, 27 nt, Artificial Sequence
  RING finger and transmembrane domain-containing protein 2 (264-272)
ggcaucgccgacuucgugcugaaguac

SEQ ID NO: 32782 - RNA, 36 nt, Artificial Sequence
  Myosin-9 (1952-1963)
ggcaaggccgacggggccgaggcgaagcccgccgag

SEQ ID NO: 32783 - RNA, 27 nt, Artificial Sequence
  Inositol 1,4,5-trisphosphate receptor type 3 (2333-2341)
ggccuguucgcccacgagcucuucuac

SEQ ID NO: 32784 - RNA, 27 nt, Artificial Sequence
  E3 ubiquitin-protein ligase TRIM56 (486-494)
ggccugcucccccgcccgaucuucuac

SEQ ID NO: 32785 - RNA, 27 nt, Artificial Sequence
  Protein transport protein Sec16A (1463-1471)
ggccugugggggcacgcccuccugcug

SEQ ID NO: 32786 - RNA, 27 nt, Artificial Sequence
  DNA repair protein complementing XP-C cells (639-647)
ggccuguacaagaaccacccccucuac

SEQ ID NO: 32787 - RNA, 42 nt, Artificial Sequence
  Heterogeneous nuclear ribonucleoproteins A2/B1 (241-254)
ggcaacuacgggagcggcaacuacaacgacuucgggaacuac

SEQ ID NO: 32788 - RNA, 24 nt, Artificial Sequence
  HLA class I histocompatibility antigen, B-15 alpha chain (25-32)
ggcagccacuccaugcgcuacuuc

SEQ ID NO: 32789 - RNA, 27 nt, Artificial Sequence
  HLA class I histocompatibility antigen, B-35 alpha chain (25-33)
ggcagccacuccaugcgcuacuucuac

SEQ ID NO: 32790 - RNA, 27 nt, Artificial Sequence
  Heterogeneous nuclear ribonucleoprotein A1 (310-318)
ggcagcuacaacgacuucgggaacuac

SEQ ID NO: 32791 - RNA, 27 nt, Artificial Sequence
  E3 ubiquitin-protein ligase MARCH6 (620-628)
ggcaccgccaagauccacgagcuguac

SEQ ID NO: 32792 - RNA, 27 nt, Artificial Sequence
  DNA topoisomerase 2-beta (560-568)
ggcaccgccaccaagcaccugacguac

SEQ ID NO: 32793 - RNA, 27 nt, Artificial Sequence
  Filamin-A (2181-2189)
ggcacccacaccgugagcgucaaguac

SEQ ID NO: 32794 - RNA, 27 nt, Artificial Sequence
  Ubiquitin-conjugating enzyme E2 C (71-79)
ggcaccguguacgaggaccugcgcuac

SEQ ID NO: 32795 - RNA, 30 nt, Artificial Sequence
  Cold shock domain-containing protein E1 (28-37)
ggcgugaucgagaagcugcucaccagcuac

SEQ ID NO: 32796 - RNA, 39 nt, Artificial Sequence
  ADP-ribosylation factor GTPase-activating protein 2 (469-481)
ggcgugaugaacagccugcaggaccgcuacggguccuac

SEQ ID NO: 32797 - RNA, 27 nt, Artificial Sequence
  Bardet-Biedl syndrome 2 protein (227-235)
ggcguguacgacaagaccagccgcuac

SEQ ID NO: 32798 - RNA, 27 nt, Artificial Sequence
  Coatomer subunit alpha (633-641)
ggcuaccccgagguggcccugcacuuc

SEQ ID NO: 32799 - RNA, 33 nt, Artificial Sequence
  Protein S100-A8 (27-37)
cacgccguguaccgcgacgaccugaagaagcuc

SEQ ID NO: 32800 - RNA, 27 nt, Artificial Sequence
  Zinc finger protein 608 (1347-1355)
cacgccuaccccuacccgcagauguac

SEQ ID NO: 32801 - RNA, 27 nt, Artificial Sequence
  Sphingolipid delta(4)-desaturase DES1 (228-236)
cacuucaucgccgagcacuacauguuc

SEQ ID NO: 32802 - RNA, 27 nt, Artificial Sequence
  BTB/POZ domain-containing protein KCTD1 (41-49)
cacaucgacgugggcgggcacauguac

SEQ ID NO: 32803 - RNA, 27 nt, Artificial Sequence
  RNA-binding protein with serine-rich domain 1 (176-184)
cacaucauggagaucuucagcaccuac

SEQ ID NO: 32804 - RNA, 27 nt, Artificial Sequence
  Laminin subunit beta-3 (1158-1166)
cacaucaacggccgcgugcuguacuac

SEQ ID NO: 32805 - RNA, 27 nt, Artificial Sequence
  UDP-N-acetylglucosamine-dolichyl-phosphate N-acetylglucosaminephosphotransferase (55-63)
caccuggaccucggcauccuguacuac

SEQ ID NO: 32806 - RNA, 27 nt, Artificial Sequence
  Nuclear pore complex protein Nup205 (240-248)
caccuguacggcagccuccuguacuac

SEQ ID NO: 32807 - RNA, 27 nt, Artificial Sequence
  DAZ-associated protein 1 (397-405)
cacaacgugcagggcuuccaccccuac

SEQ ID NO: 32808 - RNA, 27 nt, Artificial Sequence
  pre-mRNA 3' end processing protein WDR33 (19-27)
caccaggccccccgccagcuguucuac

SEQ ID NO: 32809 - RNA, 27 nt, Artificial Sequence
  Nuclear receptor corepressor 2 (34-42)
cacaccgacgugggccugcucgaguac

SEQ ID NO: 32810 - RNA, 27 nt, Artificial Sequence
  Ribosomal protein S6 kinase alpha-1 (517-525)
cacaccaucggcaagaccguggaguac

SEQ ID NO: 32811 - RNA, 27 nt, Artificial Sequence
  Type II inositol 3,4-bisphosphate 4-phosphatase (657-665)
cacaccgugggccugaucguccaguac

SEQ ID NO: 32812 - RNA, 30 nt, Artificial Sequence
  Zinc finger CCHC domain-containing protein 14 (172-181)
cacguggaccuggacagcggccuccgcuac

SEQ ID NO: 32813 - RNA, 33 nt, Artificial Sequence
  Prefoldin subunit 5 (94-104)
cacgugcugaucgacgucggcaccggguacuac

SEQ ID NO: 32814 - RNA, 27 nt, Artificial Sequence
  Erythroid differentiation-related factor 1 (370-378)
cacgugaacggcaucguccagaaguac

SEQ ID NO: 32815 - RNA, 30 nt, Artificial Sequence
  Protein prenyltransferase alpha subunit repeat-containing protein 1 (213-222)
cacgugagcgaccacuccggcuuccacuac

SEQ ID NO: 32816 - RNA, 27 nt, Artificial Sequence
  Peroxisomal membrane protein PEX14 (119-127)
aucgccuucggcuuccaccagcuguac

SEQ ID NO: 32817 - RNA, 27 nt, Artificial Sequence
  Protein FAM134C (153-161)
aucuucauccgcaacgugcugcucuuc

SEQ ID NO: 32818 - RNA, 27 nt, Artificial Sequence
  Probable ATP-dependent RNA helicase DDX5 (604-612)
aucggcuaccccaugccgaccggguac

SEQ ID NO: 32819 - RNA, 27 nt, Artificial Sequence
  Dolichol kinase (352-360)
aucaucuucgaccgcccccugcucuac

SEQ ID NO: 32820 - RNA, 27 nt, Artificial Sequence
  Dolichyl-diphosphooligosaccharide-proteinosyltransferase subunit 2 (410-418)
auccugagcccccuccugcugcucuuc

SEQ ID NO: 32821 - RNA, 33 nt, Artificial Sequence
  Beta-2-microglobulin (21-31)
auccagcgcacccccaagauccagguguacagc

SEQ ID NO: 32822 - RNA, 39 nt, Artificial Sequence
  Beta-2-microglobulin (21-33)
auccagcgcacccccaagauccagguguacagccggcac

SEQ ID NO: 32823 - RNA, 27 nt, Artificial Sequence
  HLA class I histocompatibility antigen, B-52 alpha chain (90-98)
aucagcaagaccaacacccagacguac

SEQ ID NO: 32824 - RNA, 33 nt, Artificial Sequence
  Eukaryotic peptide chain release factor subunit 1 (307-317)
aucguguacgagaaccuggacaucaugcgcuac

SEQ ID NO: 32825 - RNA, 27 nt, Artificial Sequence
  Cyclin-H (138-146)
aaggcccuggagcagauccucgaguac

SEQ ID NO: 32826 - RNA, 30 nt, Artificial Sequence
  Proliferating cell nuclear antigen (240-249)
aagaucgccgacaugggccaccugaaguac

SEQ ID NO: 32827 - RNA, 27 nt, Artificial Sequence
  Protein LAP2 (282-290)
aagaucgacgagaaccagcugauguac

SEQ ID NO: 32828 - RNA, 27 nt, Artificial Sequence
  Beta-2-microglobulin (90-98)
aagaucgugaagugggaccgcgacaug

SEQ ID NO: 32829 - RNA, 30 nt, Artificial Sequence
  Ras GTPase-activating-like protein IQGAP1 (94-103)
aagaucuacgaccgcgagcagacccgguac

SEQ ID NO: 32830 - RNA, 27 nt, Artificial Sequence
  Phosphorylated CTD-interacting factor 1 (363-371)
aagaucuaccacaucagccuggaguac

SEQ ID NO: 32831 - RNA, 27 nt, Artificial Sequence
  Cytoplasmic FMR1-interacting protein 1 (739-747)
aagcuggccgaccagaucuucgccuac

SEQ ID NO: 32832 - RNA, 30 nt, Artificial Sequence
  Cytoplasmic FMR1-interacting protein 1 (739-748)
aagcuggccgaccagaucuucgccuacuac

SEQ ID NO: 32833 - RNA, 27 nt, Artificial Sequence
  Golgi-associated PDZ and coiled-coil motif-containing protein (394-402)
aagcuggacgaccuccacacccuguac

SEQ ID NO: 32834 - RNA, 42 nt, Artificial Sequence
  Oxysterol-binding protein-related protein 8 (705-718)
aagcuguucgagcucgacccccugaccggcgaguggcacuac

SEQ ID NO: 32835 - RNA, 30 nt, Artificial Sequence
  SHC SH2 domain-binding protein 1 (262-271)
aagcugaucgagaacccccuccugcgcuac

SEQ ID NO: 32836 - RNA, 27 nt, Artificial Sequence
  Proteasome subunit alpha type (67-75)
aagcugaacgaguaccuccugcaguac

SEQ ID NO: 32837 - RNA, 27 nt, Artificial Sequence
  Protein farnesyltransferase/geranylgeranyltransferase type-1 subunit alpha (211-219)
aagcugugggacaacgagcuccaguac

SEQ ID NO: 32838 - RNA, 27 nt, Artificial Sequence
  Crooked neck-like protein 1 (615-623)
aagcuguacgagaaguuccucgaguuc

SEQ ID NO: 32839 - RNA, 27 nt, Artificial Sequence
  Tetratricopeptide repeat protein 21B (693-701)
aagauggccgacaucuaccugaagcac

SEQ ID NO: 32840 - RNA, 27 nt, Artificial Sequence
  SPRY domain-containing protein 3 (14-22)
aagauggacgaccugaaccuccacuac

SEQ ID NO: 32841 - RNA, 27 nt, Artificial Sequence
  Phosphatidylinositol 4-kinase alpha (321-329)
aagaugcugcgcgacacccucuacuac

SEQ ID NO: 32842 - RNA, 27 nt, Artificial Sequence
  Platelet-activating factor acetylhydrolase IB subunit alpha (95-103)
aagaugugggaggugcagaccggcuac

SEQ ID NO: 32843 - RNA, 30 nt, Artificial Sequence
  Clathrin heavy chain 1 (1209-1218)
aagauguacgacgccgccaagcugcucuac

SEQ ID NO: 32844 - RNA, 27 nt, Artificial Sequence
  Elongation factor Tu GTP-binding domain-containing protein 1 (71-79)
aagagcuccgccaucagccugcacuac

SEQ ID NO: 32845 - RNA, 27 nt, Artificial Sequence
  Elongation factor 2 (71-79)
aagagcaccgccaucucccuguucuac

SEQ ID NO: 32846 - RNA, 27 nt, Artificial Sequence
  Flotillin-2 (214-222)
aagaccgccgaggcccagcuggcguac

SEQ ID NO: 32847 - RNA, 27 nt, Artificial Sequence
  Cytoplasmic dynein 1 heavy chain 1 (2633-2641)
aagaccuucgaccacuacugcgaguac

SEQ ID NO: 32848 - RNA, 27 nt, Artificial Sequence
  Protein RMD5 homolog B (13-21)
aaggugcugcagaaguuccucaccuac

SEQ ID NO: 32849 - RNA, 27 nt, Artificial Sequence
  Probable E3 ubiquitin-protein ligase HECTD4 (700-708)
aaggugcugagccgcgcccucauguac

SEQ ID NO: 32850 - RNA, 27 nt, Artificial Sequence
  Cartilage-associated protein (329-337)
aaggugaugcagcagaaccuggucuac

SEQ ID NO: 32851 - RNA, 27 nt, Artificial Sequence
  KIF1-binding protein (205-213)
aagguguacacccacaaccuguacuac

SEQ ID NO: 32852 - RNA, 30 nt, Artificial Sequence
  Protein S100-A9 (66-75)
cuggacaccaacgccgacaagcagcucagc

SEQ ID NO: 32853 - RNA, 24 nt, Artificial Sequence
  Engulfment and cell motility protein 2 (574-581)
cugaaccacaaggugcuccacuac

SEQ ID NO: 32854 - RNA, 27 nt, Artificial Sequence
  CDNA FLJ25829 fis, clone TST08126 (128-136)
augaccgccaagcugcagacccccuac

SEQ ID NO: 32855 - RNA, 27 nt, Artificial Sequence
  HLA class II histocompatibility antigen, DQ alpha 1 chain (247-255)
aacgccgccgagcgccggggcccccug

SEQ ID NO: 32856 - RNA, 27 nt, Artificial Sequence
  Heat shock protein beta-1 (177-185)
aacgagaucaccauccccgugaccuuc

SEQ ID NO: 32857 - RNA, 27 nt, Artificial Sequence
  Serpin B12 (169-177)
aacaagacccagaccauccuguucuac

SEQ ID NO: 32858 - RNA, 27 nt, Artificial Sequence
  S1 RNA-binding domain-containing protein 1 (240-248)
aacaccauccccuucaucauccgcuac

SEQ ID NO: 32859 - RNA, 42 nt, Artificial Sequence
  Mediator of RNA polymerase II transcription subunit 12 (2010-2023)
aacacccagccccagccgagcaccaacaucuucggccgcuac

SEQ ID NO: 32860 - RNA, 27 nt, Artificial Sequence
  Agrin (56-64)
aacguggaccccguccagcacaccuac

SEQ ID NO: 32861 - RNA, 27 nt, Artificial Sequence
  Abhydrolase domain-containing protein 2 (306-314)
aacgugaugcgcaaguuccacggcuac

SEQ ID NO: 32862 - RNA, 30 nt, Artificial Sequence
  Tubulin beta chain (103-112)
cagaucuuccgccccgacaacuucguguuc

SEQ ID NO: 32863 - RNA, 27 nt, Artificial Sequence
  WD repeat-containing protein 19 (527-535)
cagcuguacgagaagggccucuacuac

SEQ ID NO: 32864 - RNA, 27 nt, Artificial Sequence
  Serine/threonine-protein phosphatase 2A 56 kDa regulatory subunit epsilon isoform (358-366)
cagguggccgagcgcgcccuguacuac

SEQ ID NO: 32865 - RNA, 30 nt, Artificial Sequence
  Muskelin (626-635)
cagguggacccccugagcgcccucaaguac

SEQ ID NO: 32866 - RNA, 27 nt, Artificial Sequence
  Coatomer subunit beta' (136-144)
cagguguucgagggccacacccacuac

SEQ ID NO: 32867 - RNA, 27 nt, Artificial Sequence
  DNA polymerase epsilon subunit 3 (39-47)
cgcgccgccagcguguucguccuguac

SEQ ID NO: 32868 - RNA, 27 nt, Artificial Sequence
  Histone H2B type 1-A (94-102)
cgcgagauccagaccgccgugcggcug

SEQ ID NO: 32869 - RNA, 27 nt, Artificial Sequence
  26S proteasome non-ATPase regulatory subunit 3 (294-302)
cgcaucaaggccauccagcuggaguac

SEQ ID NO: 32870 - RNA, 33 nt, Artificial Sequence
  DNA polymerase delta catalytic subunit (386-396)
cgcaucauggaccccgacgugaucaccggcuac

SEQ ID NO: 32871 - RNA, 27 nt, Artificial Sequence
  Protein TASOR (185-193)
cgccuggacgacaagaaguuccucuac

SEQ ID NO: 32872 - RNA, 27 nt, Artificial Sequence
  F-box only protein 7 (266-274)
cgccuguucaaggaccagcucguguac

SEQ ID NO: 32873 - RNA, 33 nt, Artificial Sequence
  Zinc finger protein 419 (43-53)
cgccugcucgacgacgcccagcggcugcuguac

SEQ ID NO: 32874 - RNA, 27 nt, Artificial Sequence
  Angiomotin (17-25)
cgccugcuccaggagcagcugcgguac

SEQ ID NO: 32875 - RNA, 27 nt, Artificial Sequence
  Protein Smaug homolog 2 (103-111)
cgccugcuccagaaggugcuggccuac

SEQ ID NO: 32876 - RNA, 27 nt, Artificial Sequence
  N-acetylgalactosamine-6-sulfatase (376-384)
cgccugauggaccggcccaucuucuac

SEQ ID NO: 32877 - RNA, 27 nt, Artificial Sequence
  Beta-catenin-like protein 1 (330-338)
cgccugauggagcuccacuucaaguac

SEQ ID NO: 32878 - RNA, 27 nt, Artificial Sequence
  Mitochondrial folate transporter/carrier (251-259)
cgccugcaggaccagcacauguucuac

SEQ ID NO: 32879 - RNA, 27 nt, Artificial Sequence
  Probable C-mannosyltransferase DPY19L3 (411-419)
cgccugagcgacacccuccuguucuac

SEQ ID NO: 32880 - RNA, 27 nt, Artificial Sequence
  Vacuolar protein sorting-associated protein 4A (30-38)
cgccuguaccagcacgccguggaguac

SEQ ID NO: 32881 - RNA, 33 nt, Artificial Sequence
  Src substrate cortactin (94-104)
cgcauggacaagagcgccgugggccacgaguac

SEQ ID NO: 32882 - RNA, 27 nt, Artificial Sequence
  ATP-dependent RNA helicase DDX42 (292-300)
cgcauguucgacaugggcuucgaguac

SEQ ID NO: 32883 - RNA, 27 nt, Artificial Sequence
  Signal peptidase complex catalytic subunit SEC11A (12-20)
cgcaugaacaagcggcagcuguacuac

SEQ ID NO: 32884 - RNA, 27 nt, Artificial Sequence
  60S ribosomal protein L24 (47-55)
cgccagaucaacuggaccgugcuguac

SEQ ID NO: 32885 - RNA, 39 nt, Artificial Sequence
  Annexin A5 (245-257)
cgcagcauccccgccuaccuggccgagacccucuacuac

SEQ ID NO: 32886 - RNA, 27 nt, Artificial Sequence
  Nuclear pore complex protein Nup160 (729-737)
cgcaccgccccccugcuccugagcuac

SEQ ID NO: 32887 - RNA, 30 nt, Artificial Sequence
  Matrin-3 (149-158)
cgcaccgaggagggccccacccugagcuac

SEQ ID NO: 32888 - RNA, 27 nt, Artificial Sequence
  26S proteasome non-ATPase regulatory subunit 2 (673-681)
cgcaccuucggccaccugcuccgguac

SEQ ID NO: 32889 - RNA, 27 nt, Artificial Sequence
  Tyrosine-protein phosphatase non-receptor type 23 (1272-1280)
cgcaccggcgccuucgcccugcucuac

SEQ ID NO: 32890 - RNA, 27 nt, Artificial Sequence
  Msx2-interacting protein (176-184)
cgcacccugcagcacggccucuacuac

SEQ ID NO: 32891 - RNA, 27 nt, Artificial Sequence
  NFX1-type zinc finger-containing protein 1 (334-342)
cgcaccaugcccaucuacccgaccuac

SEQ ID NO: 32892 - RNA, 27 nt, Artificial Sequence
  UPF0505 protein C16orf62 (929-937)
cgcaccauggugaagacccuggaguac

SEQ ID NO: 32893 - RNA, 36 nt, Artificial Sequence
  DNA damage-regulated autophagy modulator protein 2 (236-247)
cgcguggaggccaaccugcacggccucacccuguac

SEQ ID NO: 32894 - RNA, 39 nt, Artificial Sequence
  Eukaryotic translation initiation factor 3 subunit C-like protein (873-885)
cgcguguucgaccacaagcagggcaccuacgggggcuac

SEQ ID NO: 32895 - RNA, 30 nt, Artificial Sequence
  Semaphorin-4C (339-348)
cgcguguucgagggccccuacaaggaguac

SEQ ID NO: 32896 - RNA, 27 nt, Artificial Sequence
  Niemann-Pick C1 protein (1077-1085)
cgcguguuccccuacagcgucuucuac

SEQ ID NO: 32897 - RNA, 33 nt, Artificial Sequence
  26S protease regulatory subunit 4 (249-259)
cgcguggucggcagcgagcugauccagaaguac

SEQ ID NO: 32898 - RNA, 27 nt, Artificial Sequence
  HLA class II histocompatibility antigen, DRB1-4 beta chain (123-131)
cgcguguaccccgaggucaccguguac

SEQ ID NO: 32899 - RNA, 27 nt, Artificial Sequence
  Sorting nexin-17 (432-440)
agcgccuccgacgugcacggcaacuuc

SEQ ID NO: 32900 - RNA, 27 nt, Artificial Sequence
  Splicing factor 3B subunit 3 (351-359)
agcgaguucggcaaccacuaccuguac

SEQ ID NO: 32901 - RNA, 27 nt, Artificial Sequence
  Mitotic checkpoint protein BUB3 (241-249)
agcuuccacaacauccacaacaccuuc

SEQ ID NO: 32902 - RNA, 27 nt, Artificial Sequence
  Transmembrane 9 superfamily member 2 (545-553)
agcaucuggucccaccagauguacuac

SEQ ID NO: 32903 - RNA, 30 nt, Artificial Sequence
  Vimentin (87-96)
agccuggccgacgccaucaacaccgaguuc

SEQ ID NO: 32904 - RNA, 30 nt, Artificial Sequence
  Protein PRRC1 (47-56)
agcauggaguccuuccccccgcuggccuac

SEQ ID NO: 32905 - RNA, 27 nt, Artificial Sequence
  Heterogeneous nuclear ribonucleoprotein A1 (304-312)
agcaacuucggcgggggcggguccuac

SEQ ID NO: 32906 - RNA, 36 nt, Artificial Sequence
  Cyclin-dependent kinase 19 (490-501)
agccaguaccaccccucccaccaggcccaccgcuac

SEQ ID NO: 32907 - RNA, 27 nt, Artificial Sequence
  Pre-mRNA-splicing factor ATP-dependent RNA helicase DHX15 (227-235)
agcuccgccaagaccauccugaaguac

SEQ ID NO: 32908 - RNA, 27 nt, Artificial Sequence
  Probable glutamate-tRNA ligase, mitochondrial (249-257)
agcaccgccaagcaccugcuccuguac

SEQ ID NO: 32909 - RNA, 27 nt, Artificial Sequence
  Chondroitin sulfate proteoglycan 4 (745-753)
agcaccgacccccagcaccacgccuac

SEQ ID NO: 32910 - RNA, 27 nt, Artificial Sequence
  Peroxisomal carnitine O-octanoyltransferase (8-16)
agcaccgaggagcgcaccuuccaguac

SEQ ID NO: 32911 - RNA, 33 nt, Artificial Sequence
  WD repeat-containing protein 44 (34-44)
agcaccuucaaggagaccgagaacacggccuac

SEQ ID NO: 32912 - RNA, 27 nt, Artificial Sequence
  Serine/threonine-protein kinase mTOR (1766-1774)
agcaccauccccaaggugcugcaguac

SEQ ID NO: 32913 - RNA, 27 nt, Artificial Sequence
  ADP-ribosylation factor GTPase-activating protein 3 (97-105)
agcaccaacgacaccaacgccaaguac

SEQ ID NO: 32914 - RNA, 33 nt, Artificial Sequence
  Cytochrome c oxidase subunit 1 (9-19)
agcaccaaccacaaggacaucggcacccuguac

SEQ ID NO: 32915 - RNA, 27 nt, Artificial Sequence
  Syntaxin-binding protein 1 (511-519)
agcaccaccgccguguccgcccgcuac

SEQ ID NO: 32916 - RNA, 27 nt, Artificial Sequence
  Regulator of microtubule dynamics protein 1 (209-217)
agcaccuacgagaaggcccugggcuac

SEQ ID NO: 32917 - RNA, 27 nt, Artificial Sequence
  GPI transamidase component PIG-S (261-269)
agcguggacucccagauccuguacuac

SEQ ID NO: 32918 - RNA, 27 nt, Artificial Sequence
  Ubiquitin-protein ligase E3C (150-158)
agcgugaucgagcagauccugcacuac

SEQ ID NO: 32919 - RNA, 27 nt, Artificial Sequence
  Transcription elongation regulator 1 (419-427)
accgccgacggcaagaccuacuacuac

SEQ ID NO: 32920 - RNA, 27 nt, Artificial Sequence
  Sorting nexin-9 (146-154)
accgccuucggccacccccaggccuac

SEQ ID NO: 32921 - RNA, 27 nt, Artificial Sequence
  Heterogeneous nuclear ribonucleoprotein F (301-309)
accgagaacgacaucuacaacuucuuc

SEQ ID NO: 32922 - RNA, 36 nt, Artificial Sequence
  N-acetylglucosamine-6-sulfatase (192-203)
accaucgaccccgagcugcucggcaagaugaacuac

SEQ ID NO: 32923 - RNA, 33 nt, Artificial Sequence
  Thymosin beta-4 (34-44)
accaucgagcaggagaagcaggccggcgagagc

SEQ ID NO: 32924 - RNA, 27 nt, Artificial Sequence
  Integral membrane protein GPR155 (369-377)
accauggaccccaagccgcuggccuac

SEQ ID NO: 32925 - RNA, 27 nt, Artificial Sequence
  Intraflagellar transport protein 122 homolog (937-945)
accaugcugggcaaguucuaccacuuc

SEQ ID NO: 32926 - RNA, 33 nt, Artificial Sequence
  Cytochrome c oxidase subunit 2 (182-192)
accaccuucacggccacccgccccggcguguac

SEQ ID NO: 32927 - RNA, 36 nt, Artificial Sequence
  Cytochrome c oxidase subunit 2 (182-193)
accaccuucacggccacccgccccggcguguacuac

SEQ ID NO: 32928 - RNA, 27 nt, Artificial Sequence
  Calponin-3 (136-144)
accaccaucgacaucggcgugaaguac

SEQ ID NO: 32929 - RNA, 27 nt, Artificial Sequence
  E3 ubiquitin/ISG15 ligase TRIM25 (593-601)
guggccgacaagguccaccugauguac

SEQ ID NO: 32930 - RNA, 27 nt, Artificial Sequence
  T-complex protein 1 subunit eta (127-135)
guggccuucaagaagaccuucagcuac

SEQ ID NO: 32931 - RNA, 27 nt, Artificial Sequence
  General transcription factor II-I (324-332)
guggaggagcuguucgagcgcaaguac

SEQ ID NO: 32932 - RNA, 27 nt, Artificial Sequence
  Inactive hydroxysteroid dehydrogenase-like protein 1 (133-141)
guguucuaccccuacccgcaguacuuc

SEQ ID NO: 32933 - RNA, 27 nt, Artificial Sequence
  NADH dehydrogenase (ubiquinone) 1 alpha subcomplex subunit 3 (30-38)
gugauccugcccccgcucagccccuac

SEQ ID NO: 32934 - RNA, 27 nt, Artificial Sequence
  Tribbles homolog 3 (126-134)
gugcuggccggcacccagcuccuguac

SEQ ID NO: 32935 - RNA, 27 nt, Artificial Sequence
  Transketolase (50-58)
gugcuguucuuccacaccaugcgcuac

SEQ ID NO: 32936 - RNA, 27 nt, Artificial Sequence
  Unconventional myosin-Id (415-423)
gugcugaagcaggagcaggaggaguac

SEQ ID NO: 32937 - RNA, 27 nt, Artificial Sequence
  Calcyclin-binding protein (63-71)
guggucgcccccaucaccaccggcuac

SEQ ID NO: 32938 - RNA, 27 nt, Artificial Sequence
  Nischarin (324-332)
guggucgacaaccugcagcaccucuac

SEQ ID NO: 32939 - RNA, 27 nt, Artificial Sequence
  F-box only protein 31 (26-34)
guguacgccaagcugcuccaccgcuac

SEQ ID NO: 32940 - RNA, 27 nt, Artificial Sequence
  DNA replication licensing factor MCM7 (101-109)
guguacaucgagcaccgccugaugaug

SEQ ID NO: 32941 - RNA, 27 nt, Artificial Sequence
  MORN repeat-containing protein 1 (31-39)
guguaccccaacagcuucuuccgcuac

SEQ ID NO: 32942 - RNA, 30 nt, Artificial Sequence
  Glycoprotein endo-alpha-1,2-mannosidase-like protein (101-110)
guguacagcgaccugcacgccuucuacuac

SEQ ID NO: 32943 - RNA, 30 nt, Artificial Sequence
  Prolyl endopeptidase (178-187)
uggacccacgacggcaaggggauguucuac

SEQ ID NO: 32944 - RNA, 27 nt, Artificial Sequence
  Vimentin (53-61)
uacgccagcucccccggcgggguguac

SEQ ID NO: 32945 - RNA, 27 nt, Artificial Sequence
  NmrA-like family domain-containing protein 1 (73-81)
uacgccaccuucaucgugaccaacuac

SEQ ID NO: 32946 - RNA, 27 nt, Artificial Sequence
  Leukocyte receptor cluster member 8 (111-119)
uacgccuaccccuacagcuacuacuac

SEQ ID NO: 32947 - RNA, 36 nt, Artificial Sequence
  RNMT-activating mini protein (107-118)
uacggcuacaaccagcgccccccguacggguacuac

SEQ ID NO: 32948 - RNA, 27 nt, Artificial Sequence
  Serine/threonine-protein kinase NLK (415-423)
uaccuggacgagggccgccuccgguac

SEQ ID NO: 32949 - RNA, 27 nt, Artificial Sequence
  chromosome 1 open reading frame 9, isoform CRA_e (1086-1094)
uaccuggaggagcucagccagcgcuac

SEQ ID NO: 32950 - RNA, 27 nt, Artificial Sequence
  Chromodomain-helicase-DNA-binding protein 1-like (385-393)
uacauggacuaccgcggcuacagcuac

SEQ ID NO: 32951 - RNA, 30 nt, Artificial Sequence
  RNMT-activating mini protein (109-118)
uacaaccagcgccccccguacggcuacuac

SEQ ID NO: 32952 - RNA, 30 nt, Artificial Sequence
  ATP-dependent RNA helicase DDX3X (643-652)
uacaacagcgacggcuacgggggcaacuac

SEQ ID NO: 32953 - RNA, 27 nt, Artificial Sequence
  Histone acetyltransferase KAT6B (551-559)
uacagcucccccuacccgcaggaguac

SEQ ID NO: 32954 - RNA, 27 nt, Artificial Sequence
  RNA-binding protein EWS (21-29)
uacaccgcccagcccacccagggcuac

SEQ ID NO: 32955 - RNA, 30 nt, Artificial Sequence
  Protein FAM26F (92-101)
uacaccuucaaccccaagggccaguacuac

SEQ ID NO: 32956 - RNA, 27 nt, Artificial Sequence
  MORN repeat-containing protein 2 (30-38)
uacaccuuccccaacggcgccaaguac

SEQ ID NO: 32957 - RNA, 27 nt, Artificial Sequence
  Probable ATP-dependent RNA helicase YTHDC2 (389-397)
uacaccaacaaggagaugcugaaguac

SEQ ID NO: 32958 - RNA, 27 nt, Artificial Sequence
  Probable dolichyl pyrophosphate Glc1Man9GlcNAc2 alpha-1,3-glucosyltransferase (204-212)
uacguggcccccgccuacggcgucuac

SEQ ID NO: 32959 - RNA, 27 nt, Artificial Sequence
  Filamin-A (1581-1589)
uacgugcccgacgucaccggccgcuac

SEQ ID NO: 32960 - RNA, 27 nt, Artificial Sequence
  Leucine-rich repeat-containing protein 1 (26-34)
uacgugcccgaggagaucuaccgcuac

SEQ ID NO: 32961 - RNA, 27 nt, Artificial Sequence
  Ectopic P granules protein 5 homolog (664-672)
uacgugagcgaccacugggcccaguac

SEQ ID NO: 32962 - RNA, 27 nt, Artificial Sequence
  Sphingomyelin phosphodiesterase 2 (133-141)
uacgugacccaccugcacgccgaguac

SEQ ID NO: 32963 - RNA, 30 nt, Artificial Sequence
  MORN repeat-containing protein 1 (30-39)
uacguguaccccaacagcuucuuccgcuac

SEQ ID NO: 32964 - RNA, 27 nt, Artificial Sequence
  Protein polybromo-1 (132-140)
uacuacaagcccgacagcccggaguac

SEQ ID NO: 32965 - RNA, 27 nt, Artificial Sequence
  V-type proton ATPase subunit d 1 (7-15)
uacuaccccgaguacaagcugcucuuc

SEQ ID NO: 32966 - RNA, 51 nt, Artificial Sequence
  Calmodulin (133-149)
ggcgacgggcaggugaacuacgaggaguucguccagaugaugaccgccaag

SEQ ID NO: 32967 - RNA, 69 nt, Artificial Sequence
  Myosin regulatory light chain 12B (150-172)
aagaagggcaacuucaacuacaucgaguucacccgcauccugaagcacggggccaaggacaaggacgac

SEQ ID NO: 32968 - RNA, 63 nt, Artificial Sequence
  HLA class I histocompatibility antigen, B-55 alpha chain (52-72)
guggacgacacccaguucguccgcuucgacagcgacgccgccuccccccgggaggagccgcgc

SEQ ID NO: 32969 - RNA, 39 nt, Artificial Sequence
  Sorting nexin-6 (245-257)
gccgccgacgacuacaaccgcaucggcagcucccuguac

SEQ ID NO: 32970 - RNA, 27 nt, Artificial Sequence
  Peptidyl-prolyl cis-trans isomerase-like 2 (27-35)
gccaucgacgaggacgugcugcgcuac

SEQ ID NO: 32971 - RNA, 27 nt, Artificial Sequence
  Nucleolar GTP-binding protein 2 (416-424)
gcccuggacgagaagaucgccaaguac

SEQ ID NO: 32972 - RNA, 30 nt, Artificial Sequence
  Serine/threonine-protein kinase MRCK alpha (1203-1212)
gcccuggacggccgcgagaccgacuucuac

SEQ ID NO: 32973 - RNA, 36 nt, Artificial Sequence
  Cleavage stimulation factor subunit 3 (120-131)
gcccuggacaagaucggcauggagaucaugagcuac

SEQ ID NO: 32974 - RNA, 36 nt, Artificial Sequence
  2-oxoisovalerate dehydrogenase subunit alpha, mitochondrial (80-91)
gcccuggacaacaccgaccucguguucggccaguac

SEQ ID NO: 32975 - RNA, 39 nt, Artificial Sequence
  Structural maintenance of chromosomes protein 1A (1161-1173)
gcccuggacaacaccaacaucggcaagguggccaacuac

SEQ ID NO: 32976 - RNA, 27 nt, Artificial Sequence
  Ubiquitin-like modifier-activating enzyme 6 (331-339)
gcccuggaccaguuccaggagaaguac

SEQ ID NO: 32977 - RNA, 27 nt, Artificial Sequence
  SWI/SNF-related matrix-associated actin-dependent regulator of chromatin subfamily A member 5 (920-928)
gcccuggacaccaagaucggccgcuac

SEQ ID NO: 32978 - RNA, 27 nt, Artificial Sequence
  Eukaryotic translation initiation factor 3 subunit E (54-62)
gccauggacguguacaagaaccuguac

SEQ ID NO: 32979 - RNA, 27 nt, Artificial Sequence
  SAFB-like transcription modulator (735-743)
gcccgcuucggccacgggagcgacuac

SEQ ID NO: 32980 - RNA, 30 nt, Artificial Sequence
  Putative heat shock protein HSP 90-beta 2 (88-97)
gccagcgacgcccuggacaagauccgcuac

SEQ ID NO: 32981 - RNA, 30 nt, Artificial Sequence
  Gelsolin (362-371)
gccagcgacuucaucaccaagauggacuac

SEQ ID NO: 32982 - RNA, 27 nt, Artificial Sequence
  Ubiquitin-like protein 3 (32-40)
gccagcgacaucgccaagcacguguac

SEQ ID NO: 32983 - RNA, 33 nt, Artificial Sequence
  Proteasome-associated protein ECM29 homolog (1073-1083)
gccagcgaccugucccagcccgaccucguguac

SEQ ID NO: 32984 - RNA, 27 nt, Artificial Sequence
  Kelch repeat and BTB domain-containing protein 6 (147-155)
gccagcgacaugcugcagcucgaguac

SEQ ID NO: 32985 - RNA, 27 nt, Artificial Sequence
  GPN-loop GTPase 2 (210-218)
gccagcgaccccuucuuccgccacuac

SEQ ID NO: 32986 - RNA, 33 nt, Artificial Sequence
  WD repeat-containing protein 81 (817-827)
gccagcgaccccauccacaccuucgaccuguac

SEQ ID NO: 32987 - RNA, 27 nt, Artificial Sequence
  DNA-directed RNA polymerase II subunit RPB2 (1103-1111)
gccagcgaccccuaccaggugcacguc

SEQ ID NO: 32988 - RNA, 27 nt, Artificial Sequence
  DDB1- and CUL4-associated factor 13 (368-376)
gccagcgaccgcaacaucgugcuguac

SEQ ID NO: 32989 - RNA, 30 nt, Artificial Sequence
  Probable ATP-dependent RNA helicase DHX37 (105-114)
gccagcgaggccgagaugcgccuguucuac

SEQ ID NO: 32990 - RNA, 36 nt, Artificial Sequence
  Platelet-activating factor acetylhydrolase IB subunit alpha (4-15)
gccagcgaggacgccaccaucaaggugugggacuac

SEQ ID NO: 32991 - RNA, 30 nt, Artificial Sequence
  T-complex protein 11-like protein 1 (271-280)
gccagcgaggaccugaugacccagaaguac

SEQ ID NO: 32992 - RNA, 30 nt, Artificial Sequence
  Splicing factor 3B subunit 3 (350-359)
gccagcgaguucggcaaccacuaccuguac

SEQ ID NO: 32993 - RNA, 39 nt, Artificial Sequence
  Aspartate-tRNA ligase, cytoplasmic (226-238)
gccagcgagggcggggccaacguguucaccgucuccuac

SEQ ID NO: 32994 - RNA, 42 nt, Artificial Sequence
  MAP kinase-activated protein kinase 2 (163-176)
gccagcgagaucaugaaguccaucggcgaggccauccaguac

SEQ ID NO: 32995 - RNA, 39 nt, Artificial Sequence
  Thyroid receptor-interacting protein 11 (84-96)
gccagcgagauccagaucaagcagcaguccaccagcuac

SEQ ID NO: 32996 - RNA, 36 nt, Artificial Sequence
  Clusterin-associated protein 1 (160-171)
gccagcgagaucaccuccaagggcgccagccuguac

SEQ ID NO: 32997 - RNA, 27 nt, Artificial Sequence
  Cleavage stimulation factor subunit 3 (70-78)
gccagcgagcugaaggcccucggcuac

SEQ ID NO: 32998 - RNA, 36 nt, Artificial Sequence
  DNA-dependent protein kinase catalytic subunit (2173-2184)
gccagcgagaacaacggcggggagggcauccacuac

SEQ ID NO: 32999 - RNA, 30 nt, Artificial Sequence
  Exocyst complex component 4 (72-81)
gccagcgagcccuccgcccagcugagcuac

SEQ ID NO: 33000 - RNA, 36 nt, Artificial Sequence
  Nucleoporin NUP188 homolog (766-777)
gccagcgagcagcaggcccugcacaccgugcaguac

SEQ ID NO: 33001 - RNA, 33 nt, Artificial Sequence
  Ubiquitin carboxyl-terminal hydrolase 32 (141-151)
gccagcgagaccgccggcuccggguuccuguac

SEQ ID NO: 33002 - RNA, 30 nt, Artificial Sequence
  Low-density lipoprotein receptor class A domain-containing protein 3 (250-259)
gccagcgaggugggcucccccccgagcuac

SEQ ID NO: 33003 - RNA, 27 nt, Artificial Sequence
  Homeodomain-interacting protein kinase 2 (404-412)
gccagcgaguacgaccagauccgcuac

SEQ ID NO: 33004 - RNA, 36 nt, Artificial Sequence
  Amyloid protein-binding protein 2 (330-341)
gccaccgcccacgaggaccuggcguacagcuccuac

SEQ ID NO: 33005 - RNA, 39 nt, Artificial Sequence
  Zinc finger protein 318 (1381-1393)
gccaccgccaacgcgaaggaccuguacgacaucuucuac

SEQ ID NO: 33006 - RNA, 39 nt, Artificial Sequence
  E3 ubiquitin-protein ligase BRE1B (85-97)
gccaccgacgacgccacccugcucaucgugaaccgcuac

SEQ ID NO: 33007 - RNA, 27 nt, Artificial Sequence
  O-acetyl-ADP-ribose deacetylase 1 (142-150)
gccaccgacaucaagaucaccguguac

SEQ ID NO: 33008 - RNA, 27 nt, Artificial Sequence
  Coiled-coil domain-containing protein 141 (498-506)
gccaccgaccuggcccagcaccucuac

SEQ ID NO: 33009 - RNA, 30 nt, Artificial Sequence
  Endoribonuclease Dicer (239-248)
gccaccgaccuggugguccucgaccgcuac

SEQ ID NO: 33010 - RNA, 30 nt, Artificial Sequence
  EVI5-like protein (131-140)
gccaccgacaugcccgugaagaaccaguac

SEQ ID NO: 33011 - RNA, 27 nt, Artificial Sequence
  Dystonin (4021-4029)
gccaccgaccgcuuccggagccuguac

SEQ ID NO: 33012 - RNA, 39 nt, Artificial Sequence
  MAP kinase-interacting serine/threonine-protein kinase 2 (71-83)
gccaccgacagcuucuccggccgcuucgaggacguguac

SEQ ID NO: 33013 - RNA, 30 nt, Artificial Sequence
  Nicotinamide phosphoribosyltransferase (14-23)
gccaccgacagcuacaaggugacccacuac

SEQ ID NO: 33014 - RNA, 39 nt, Artificial Sequence
  Spectrin beta chain, non-erythrocytic 1 (6-18)
gccaccgacuacgacaacaucgagauccagcagcaguac

SEQ ID NO: 33015 - RNA, 27 nt, Artificial Sequence
  Fibronectin type III domain-containing protein 3B (348-356)
gccaccgacuaccacgugcgcgucuac

SEQ ID NO: 33016 - RNA, 33 nt, Artificial Sequence
  Coatomer subunit beta' (480-490)
gccaccgaggagagcuucuucauccugaaguac

SEQ ID NO: 33017 - RNA, 27 nt, Artificial Sequence
  Cytoplasmic dynein 1 heavy chain 1 (3596-3604)
gccaccgaguucaucaugaacgaguac

SEQ ID NO: 33018 - RNA, 39 nt, Artificial Sequence
  T-complex protein 1 subunit theta (414-426)
gccaccgagaucgagcuggccaagcagaucaccagcuac

SEQ ID NO: 33019 - RNA, 42 nt, Artificial Sequence
  Protein PRRC2A (1894-1907)
gccaccgagcugggcaagcuccccgccgggggcgugcuguac

SEQ ID NO: 33020 - RNA, 27 nt, Artificial Sequence
  Eukaryotic translation initiation factor 3 subunit D (422-430)
gccaccgagcugaagaacaacagcuac

SEQ ID NO: 33021 - RNA, 27 nt, Artificial Sequence
  Serine/threonine-protein kinase SMG1 (2701-2709)
gccaccgagaugacccugcagcgcuac

SEQ ID NO: 33022 - RNA, 36 nt, Artificial Sequence
  Protein phosphatase 1G (149-160)
gccaccaugaccaucgaggagcugcucacgcgcuac

SEQ ID NO: 33023 - RNA, 33 nt, Artificial Sequence
  Alpha-catulin (401-411)
gccacccagcuggccgcggaccuccugaaguac

SEQ ID NO: 33024 - RNA, 30 nt, Artificial Sequence
  60S ribosomal protein L8 (27-36)
gccguggacuucgccgagcgccacggcuac

SEQ ID NO: 33025 - RNA, 30 nt, Artificial Sequence
  Nuclear pore complex protein Nup160 (1036-1045)
gccguggaccugaugacccacaacuacuac

SEQ ID NO: 33026 - RNA, 27 nt, Artificial Sequence
  Chromodomain-helicase-DNA-binding protein 8 (2348-2356)
gccguggacccccgcuuccuggccuac

SEQ ID NO: 33027 - RNA, 36 nt, Artificial Sequence
  Short transient receptor potential channel 4-associated protein (530-541)
gccguggagagcuuccugcgcggcaccaccuccuac

SEQ ID NO: 33028 - RNA, 30 nt, Artificial Sequence
  TOX high mobility group box family member 4 (107-116)
gaccuggaccacagcaucggcacccaguac

SEQ ID NO: 33029 - RNA, 33 nt, Artificial Sequence
  Nuclear factor of activated T-cells 5 (12-22)
gaccuggaccucgagagccccaagucccuguac

SEQ ID NO: 33030 - RNA, 27 nt, Artificial Sequence
  Myocyte-specific enhancer factor 2A (61-69)
gacauggacaaggugcugcucaaguac

SEQ ID NO: 33031 - RNA, 30 nt, Artificial Sequence
  Elongator complex protein 5 (57-66)
gacagcgacaucaacaaccgccugguguac

SEQ ID NO: 33032 - RNA, 36 nt, Artificial Sequence
  Tubulin beta chain (39-50)
gacagcgaccugcagcucgaccgcaucuccguguac

SEQ ID NO: 33033 - RNA, 39 nt, Artificial Sequence
  Tubulin beta chain (39-51)
gacagcgaccugcagcucgaccgcaucuccguguacuac

SEQ ID NO: 33034 - RNA, 39 nt, Artificial Sequence
  Protein FAM13A (271-283)
gacagcgaccccaugcuguccccgcgcuucuacgccuac

SEQ ID NO: 33035 - RNA, 39 nt, Artificial Sequence
  Eukaryotic translation initiation factor 4B (229-241)
gacagcgaccgcuaccgggacggcuaccgcgacggguac

SEQ ID NO: 33036 - RNA, 36 nt, Artificial Sequence
  Eukaryotic translation initiation factor 4 gamma 3 (1501-1512)
gacagcgacaccgagaaggagcugcaggcccucuac

SEQ ID NO: 33037 - RNA, 36 nt, Artificial Sequence
  GPI transamidase component PIG-T (51-62)
gacagcgagcugcagcgcgagggcgugucccacuac

SEQ ID NO: 33038 - RNA, 30 nt, Artificial Sequence
  Inositol 1,4,5-trisphosphate receptor type 1 (2098-2107)
gacagcgagaacgccgagcgcauccuguac

SEQ ID NO: 33039 - RNA, 27 nt, Artificial Sequence
  Transcription factor E2F3 (290-298)
gacagcgagaaccagcgccuggccuac

SEQ ID NO: 33040 - RNA, 36 nt, Artificial Sequence
  Zinc finger MYND domain-containing protein 11 (140-151)
gacagcgagcaggccgacaucgcccgcaugcuguac

SEQ ID NO: 33041 - RNA, 27 nt, Artificial Sequence
  Tubulin-specific chaperone cofactor E-like protein (299-307)
gacagcgagcgcuucuucauccgguac

SEQ ID NO: 33042 - RNA, 33 nt, Artificial Sequence
  Matrin-3 (233-243)
gacagcuucuucggcgagaccucccacaacuac

SEQ ID NO: 33043 - RNA, 33 nt, Artificial Sequence
  Calcium and integrin-binding protein 1 (100-110)
gacaccgccacccccgacaucaagagccacuac

SEQ ID NO: 33044 - RNA, 36 nt, Artificial Sequence
  SAFB-like transcription modulator (732-743)
gacaccgacgcccgcuucggccacgggagcgacuac

SEQ ID NO: 33045 - RNA, 27 nt, Artificial Sequence
  Calnexin (92-100)
gacaccgacgacgagaucgccaaguac

SEQ ID NO: 33046 - RNA, 30 nt, Artificial Sequence
  Phospholipid scramblase 4 (159-168)
gacaccgacgacuucacccgcaacgccuac

SEQ ID NO: 33047 - RNA, 36 nt, Artificial Sequence
  Complex I intermediate-associated protein 30, mitochondrial (226-237)
gacaccgacuucuuccagcgcaccaaccagauguac

SEQ ID NO: 33048 - RNA, 30 nt, Artificial Sequence
  Aspartate-tRNA ligase, cytoplasmic (384-393)
gacaccgacuucuacauccuggacaaguac

SEQ ID NO: 33049 - RNA, 27 nt, Artificial Sequence
  Replication protein A 70 kDa DNA-binding subunit (504-512)
gacaccgaguuccccaacuucaaguac

SEQ ID NO: 33050 - RNA, 27 nt, Artificial Sequence
  Adenylyl cyclase-associated protein 1 (344-352)
gacaccgagcugaagcagguggccuac

SEQ ID NO: 33051 - RNA, 27 nt, Artificial Sequence
  Actin, cytoplasmic 2 (77-85)
gacguggacauccgcaaggaccuguac

SEQ ID NO: 33052 - RNA, 27 nt, Artificial Sequence
  Heterogeneous nuclear ribonucleoprotein C-like 1 (32-40)
gacguggaggccaucuucagcaaguac

SEQ ID NO: 33053 - RNA, 30 nt, Artificial Sequence
  Protein arginine N-methyltransferase 7 (368-377)
gaggccgagccccacccgcugugggaguac

SEQ ID NO: 33054 - RNA, 27 nt, Artificial Sequence
  Melanoma-associated antigen D2 (338-346)
gagaucgacaagaacgaccaccuguac

SEQ ID NO: 33055 - RNA, 33 nt, Artificial Sequence
  Annexin A1 (305-315)
gagaucgacaugaacgacaucaaggccuucuac

SEQ ID NO: 33056 - RNA, 30 nt, Artificial Sequence
  LIM domain kinase 2 (716-725)
gagcuggaccacaccgugagcaugcaguac

SEQ ID NO: 33057 - RNA, 33 nt, Artificial Sequence
  NADPH-cytochrome P450 reductase (304-314)
gagcuggacaucagcgacuccaagauccgcuac

SEQ ID NO: 33058 - RNA, 33 nt, Artificial Sequence
  Splicing factor 3B subunit 2 (811-821)
gagcuggaccccauggccaugacccagaaguac

SEQ ID NO: 33059 - RNA, 33 nt, Artificial Sequence
  Peptidyl-prolyl cis-trans isomerase D (301-311)
gagcuggaccccagcaacaccaaggcccucuac

SEQ ID NO: 33060 - RNA, 27 nt, Artificial Sequence
  Ankyrin repeat and IBR domain-containing protein 1 (229-237)
gagcuggaccgcuucaugcacuacuac

SEQ ID NO: 33061 - RNA, 27 nt, Artificial Sequence
  Plectin (502-510)
gagcuggaggacagcacccuccgcuac

SEQ ID NO: 33062 - RNA, 30 nt, Artificial Sequence
  Small G protein signaling modulator 2 (307-316)
gagcuggagaagagcguguacugggacuac

SEQ ID NO: 33063 - RNA, 30 nt, Artificial Sequence
  GPI transamidase component PIG-T (53-62)
gagcugcagcgcgagggcgugagccacuac

SEQ ID NO: 33064 - RNA, 33 nt, Artificial Sequence
  60S ribosomal protein L4 (254-264)
gagagcgccuuccgcaagcuggacgagcucuac

SEQ ID NO: 33065 - RNA, 30 nt, Artificial Sequence
  Protein-glutamate O-methyltransferase (101-110)
gagagcgacggcaagucccgcugguucuac

SEQ ID NO: 33066 - RNA, 27 nt, Artificial Sequence
  Guanine nucleotide-binding protein subunit beta-5 (239-247)
gagagcgacaucaacuccgugcgcuac

SEQ ID NO: 33067 - RNA, 27 nt, Artificial Sequence
  Zinc transporter 5 (26-34)
gagagcgacucccgccagaucuucuac

SEQ ID NO: 33068 - RNA, 42 nt, Artificial Sequence
  Proteasome activator complex subunit 3 (182-195)
gagagcgaggccgccuccuaccuggaccagaucagccgcuac

SEQ ID NO: 33069 - RNA, 36 nt, Artificial Sequence
  Myotubularin-related protein 5 (821-832)
gagagcgagaaccgcuccuacgagggcacccuguac

SEQ ID NO: 33070 - RNA, 30 nt, Artificial Sequence
  Asparagine synthetase (glutamine-hydrolyzing) (389-398)
gagagcgagcgccugcuccgggagcuguac

SEQ ID NO: 33071 - RNA, 33 nt, Artificial Sequence
  Peptidyl-prolyl cis-trans isomerase FKBP8 (167-177)
gagaccgccauggugaccgccgacagcaaguac

SEQ ID NO: 33072 - RNA, 30 nt, Artificial Sequence
  Eyes absent homolog 3 (87-96)
gagaccgccuaccccggccagacccaguac

SEQ ID NO: 33073 - RNA, 30 nt, Artificial Sequence
  ATP-dependent RNA helicase DDX24 (571-580)
gagaccgacgagaaggacuucuaccuguac

SEQ ID NO: 33074 - RNA, 33 nt, Artificial Sequence
  TFIIH basal transcription factor complex helicase XPD subunit (251-261)
gagaccgacgagcagcgccugcgggacgaguac

SEQ ID NO: 33075 - RNA, 30 nt, Artificial Sequence
  Nicotinamide riboside kinase 1 (46-55)
gagaccgacaagaacggcuuccugcaguac

SEQ ID NO: 33076 - RNA, 27 nt, Artificial Sequence
  RNA binding motif protein 22 (245-253)
gagaccgaccugcgcaaccacuucuac

SEQ ID NO: 33077 - RNA, 42 nt, Artificial Sequence
  PCNA-interacting partner (146-159)
gagaccgaccugagcauccccaccuccccgacgagcaaguac

SEQ ID NO: 33078 - RNA, 27 nt, Artificial Sequence
  Beta-mannosidase (118-126)
gagaccgacaacauguucaaccgcuac

SEQ ID NO: 33079 - RNA, 39 nt, Artificial Sequence
  Probable ATP-dependent RNA helicase DDX17 (61-73)
gagaccgaccgcgccggcuacgccaacgggagcggcuac

SEQ ID NO: 33080 - RNA, 27 nt, Artificial Sequence
  Synergin gamma (1198-1206)
gagaccgacagcuucaagcuggccuac

SEQ ID NO: 33081 - RNA, 33 nt, Artificial Sequence
  Probable ATP-dependent RNA helicase DDX56 (239-249)
gagaccgaggaggacaaguuccugcuccuguac

SEQ ID NO: 33082 - RNA, 30 nt, Artificial Sequence
  Kremen protein 2 (104-113)
gagaccgaggagggcaucuacuggcgcuac

SEQ ID NO: 33083 - RNA, 27 nt, Artificial Sequence
  Intron-binding protein aquarius (887-895)
gagaccgagaaggacuucagccgcuac

SEQ ID NO: 33084 - RNA, 36 nt, Artificial Sequence
  Guanine nucleotide exchange factor VAV3 (683-694)
gagaccgagcugaucaaccgcgugaacagcaccuac

SEQ ID NO: 33085 - RNA, 39 nt, Artificial Sequence
  DNA polymerase zeta catalytic subunit (827-839)
gagaccgagcagagcuucggccuguacgggaacaaguac

SEQ ID NO: 33086 - RNA, 33 nt, Artificial Sequence
  Protein transport protein Sec16A (1244-1254)
gagaccgagcgcuuccgggagcugcuccuguac

SEQ ID NO: 33087 - RNA, 27 nt, Artificial Sequence
  Dynamin-2 (455-463)
gagaccgagcgcaucgugaccacguac

SEQ ID NO: 33088 - RNA, 27 nt, Artificial Sequence
  Integrin alpha-3 (1043-1051)
gagaccgagcgccugaccgacgacuac

SEQ ID NO: 33089 - RNA, 33 nt, Artificial Sequence
  DnaJ homolog subfamily C member 7 (29-39)
gagaccuucaaggagcagggcaacgccuacuac

SEQ ID NO: 33090 - RNA, 33 nt, Artificial Sequence
  HLA class I histocompatibility antigen, B-8 alpha chain (21-31)
gagaccugggccggcagccacuccaugcgcuac

SEQ ID NO: 33091 - RNA, 30 nt, Artificial Sequence
  Lamin-B1 (229-238)
gagguggacagcggccgccagaucgaguac

SEQ ID NO: 33092 - RNA, 30 nt, Artificial Sequence
  Fatty acid synthase (1244-1253)
gaggugcuggccggccacgggcaccucuac

SEQ ID NO: 33093 - RNA, 33 nt, Artificial Sequence
  Histone acetyltransferase type B catalytic subunit (191-201)
uucaucgacguggacgacgagcgcuggcacuac

SEQ ID NO: 33094 - RNA, 33 nt, Artificial Sequence
  Protein Smaug homolog 2 (118-128)
uucaucgaggagagccgccagcugcucuccuac

SEQ ID NO: 33095 - RNA, 36 nt, Artificial Sequence
  Interferon regulatory factor 2-binding protein-like (420-431)
uucaucgaguaccccaccggcagcgggaacguguac

SEQ ID NO: 33096 - RNA, 39 nt, Artificial Sequence
  Protein YIF1B (69-81)
uuccuggccgaccccgugagcaacauggccauggcguac

SEQ ID NO: 33097 - RNA, 27 nt, Artificial Sequence
  Asparagine synthetase (glutamine-hydrolyzing) (337-345)
uuccuggaccaccgcuucagcuccuac

SEQ ID NO: 33098 - RNA, 30 nt, Artificial Sequence
  Phosphatidylinositol-binding clathrin assembly protein (109-118)
uuccuggacaagagcggccuccagggguac

SEQ ID NO: 33099 - RNA, 33 nt, Artificial Sequence
  Rho GTPase-activating protein 35 (733-743)
uuccuggaccccgccagcgccggcaucggguac

SEQ ID NO: 33100 - RNA, 33 nt, Artificial Sequence
  Ubiquitin carboxyl-terminal hydrolase 8 (552-562)
uuccuggaccccaucaccggcaccuuccgcuac

SEQ ID NO: 33101 - RNA, 36 nt, Artificial Sequence
  Group XV phospholipase A2 (126-137)
uuccuggaccccagcaaguccagcgugggcuccuac

SEQ ID NO: 33102 - RNA, 33 nt, Artificial Sequence
  Microtubule-associated protein 4 (103-113)
uuccuggaggagaagauggccuaccaggaguac

SEQ ID NO: 33103 - RNA, 36 nt, Artificial Sequence
  Histone H4 (31-42)
uuccuggagaacgugauccgcgacgccgucaccuac

SEQ ID NO: 33104 - RNA, 30 nt, Artificial Sequence
  Adenylate cyclase type 3 (615-624)
uucauggaccccgagauggagacccgcuac

SEQ ID NO: 33105 - RNA, 30 nt, Artificial Sequence
  Probable C-mannosyltransferase DPY19L1 (397-406)
uucauggagaaggagaccccccugcgcuac

SEQ ID NO: 33106 - RNA, 36 nt, Artificial Sequence
  Probable E3 ubiquitin-protein ligase HERC1 (402-413)
uucagcgacgcccagaccaucgaggccggccaguac

SEQ ID NO: 33107 - RNA, 30 nt, Artificial Sequence
  Iduronate 2-sulfatase (424-433)
uucagcgacauccacgccggcgagcuguac

SEQ ID NO: 33108 - RNA, 33 nt, Artificial Sequence
  Iduronate 2-sulfatase (424-434)
uucagcgacauccacgccggcgagcuguacuuc

SEQ ID NO: 33109 - RNA, 30 nt, Artificial Sequence
  Type 2 lactosamine alpha-2,3-sialyltransferase (283-292)
uucagcgaccugaaguccccccuccacuac

SEQ ID NO: 33110 - RNA, 33 nt, Artificial Sequence
  Type 2 lactosamine alpha-2,3-sialyltransferase (175-185)
uucagcgaccugaaguccccccuccacuacuac

SEQ ID NO: 33111 - RNA, 33 nt, Artificial Sequence
  Rab GTPase-activating protein 1-like (338-348)
uucagcgaccugaaccucgaggcccacauguac

SEQ ID NO: 33112 - RNA, 33 nt, Artificial Sequence
  DAZ-associated protein 1 (363-373)
uucagcgaccccucccagcagccgcccagcuac

SEQ ID NO: 33113 - RNA, 27 nt, Artificial Sequence
  Nipped-B-like protein (37-45)
uucagcgacuccaagauccagaaguac

SEQ ID NO: 33114 - RNA, 33 nt, Artificial Sequence
  Protein FAM65B (671-681)
uucagcgacaccgagaccgagaagcacuccuac

SEQ ID NO: 33115 - RNA, 33 nt, Artificial Sequence
  Probable E3 ubiquitin-protein ligase HERC1 (3591-3601)
uucagcgaggaccgccccuucgccgugggcuac

SEQ ID NO: 33116 - RNA, 30 nt, Artificial Sequence
  Programmed cell death protein 6 (82-91)
uucagcgaguucaccggcguguggaaguac

SEQ ID NO: 33117 - RNA, 27 nt, Artificial Sequence
  Ubiquitin carboxyl-terminal hydrolase 32 (135-143)
uucagcgagggcgagaaggugaacuac

SEQ ID NO: 33118 - RNA, 33 nt, Artificial Sequence
  Heat shock protein HSP 90-beta (342-352)
uucagcgagcuggccgaggacaaggagaacuac

SEQ ID NO: 33119 - RNA, 33 nt, Artificial Sequence
  Uncharacterized protein C14orf119 (120-130)
uucagcgagcccgacuucguggccaaguucuac

SEQ ID NO: 33120 - RNA, 33 nt, Artificial Sequence
  Fc receptor-like A (67-77)
uucagcgagcccuuccaccugaucguguccuac

SEQ ID NO: 33121 - RNA, 27 nt, Artificial Sequence
  cAMP-dependent protein kinase catalytic subunit alpha (131-139)
uucagcgagccccacgcccgcuucuac

SEQ ID NO: 33122 - RNA, 27 nt, Artificial Sequence
  Serine/threonine-protein kinase N1 (718-726)
uucagcgagccccgcgccaucuucuac

SEQ ID NO: 33123 - RNA, 33 nt, Artificial Sequence
  Protein C-ets-1 (175-185)
uucagcgagcccuccuucaucaccgagagcuac

SEQ ID NO: 33124 - RNA, 27 nt, Artificial Sequence
  Protein RCC2 (314-322)
uucagcgagcagguggccaugggcuac

SEQ ID NO: 33125 - RNA, 36 nt, Artificial Sequence
  DNA ligase 3 (127-138)
uucagcgaguccggcggggacaugaaggagugguac

SEQ ID NO: 33126 - RNA, 30 nt, Artificial Sequence
  ETS translocation variant 5 (318-327)
uucagcuccagccacgagggcuucuccuac

SEQ ID NO: 33127 - RNA, 27 nt, Artificial Sequence
  FAS-associated factor 1 (337-345)
uucaccgccgaguucagcucccgcuac

SEQ ID NO: 33128 - RNA, 27 nt, Artificial Sequence
  Staphylococcal nuclease domain-containing protein 1 (607-615)
uucaccgccgagcgcagcuccuacuac

SEQ ID NO: 33129 - RNA, 27 nt, Artificial Sequence
  LanC-like protein 1 (199-207)
uucaccgccaagagcccccugauguac

SEQ ID NO: 33130 - RNA, 27 nt, Artificial Sequence
  Cytochrome c oxidase subunit 2 (184-192)
uucaccgccacccgccccggcguguac

SEQ ID NO: 33131 - RNA, 33 nt, Artificial Sequence
  Splicing factor 3A subunit 3 (130-140)
uucaccgacgaggagggcuacgggcgcuaccug

SEQ ID NO: 33132 - RNA, 24 nt, Artificial Sequence
  Gem-associated protein 5 (895-902)
uucaccgaccgcgccacccuguac

SEQ ID NO: 33133 - RNA, 39 nt, Artificial Sequence
  Geranylgeranyl transferase type-2 subunit alpha (166-178)
uucaccgacagccugaucacccgcaacuucuccaacuac

SEQ ID NO: 33134 - RNA, 30 nt, Artificial Sequence
  CLIP-associating protein 2 (80-89)
uucaccgacgugcccagcauccagaucuac

SEQ ID NO: 33135 - RNA, 36 nt, Artificial Sequence
  Basic leucine zipper and W2 domain-containing protein 1 (149-160)
uucaccgaggccggccugaaggagcucagcgaguac

SEQ ID NO: 33136 - RNA, 33 nt, Artificial Sequence
  Heat shock protein HSP 90-alpha (546-556)
uucaccgagcuggccgaggacaaggagaacuac

SEQ ID NO: 33137 - RNA, 33 nt, Artificial Sequence
  Zinc finger protein 746 (547-557)
uucaccgagcgcagcaagcugaucgaccacuac

SEQ ID NO: 33138 - RNA, 36 nt, Artificial Sequence
  Coatomer subunit gamma-1 (402-413)
uucaccaugcugcgcgaggagggcggguucgaguac

SEQ ID NO: 33139 - RNA, 27 nt, Artificial Sequence
  Cytoplasmic dynein 1 heavy chain 1 (2784-2792)
uucacccaggacacccagccccacuac

SEQ ID NO: 33140 - RNA, 33 nt, Artificial Sequence
  Dolichyl-diphosphooligosaccharide-proteinosyltransferase subunit 2 (449-459)
uucguggccgagcccgacaacaagaacgucuac

SEQ ID NO: 33141 - RNA, 36 nt, Artificial Sequence
  G patch domain and KOW motifs-containing protein (365-376)
uucguggacaacauguacaagggcgggcaguacuac

SEQ ID NO: 33142 - RNA, 36 nt, Artificial Sequence
  Retinoid-inducible serine carboxypeptidase (63-74)
uucguggacaaccccgucggcaccggguucagcuac

SEQ ID NO: 33143 - RNA, 30 nt, Artificial Sequence
  Kelch-like protein 15 (325-334)
uucguggaccccuacccggucaacaaguac

SEQ ID NO: 33144 - RNA, 30 nt, Artificial Sequence
  Abhydrolase domain-containing protein 2 (146-155)
uucguggacuacgcccagaagaacggcuac

SEQ ID NO: 33145 - RNA, 39 nt, Artificial Sequence
  Trafficking protein particle complex subunit 3 (115-127)
uucguggagcugcccgacaaccacagcucccucaucuac

SEQ ID NO: 33146 - RNA, 36 nt, Artificial Sequence
  ADP-ribosylation factor 5 (24-35)
ggccuggacgccgccgggaagaccaccauccucuac

SEQ ID NO: 33147 - RNA, 27 nt, Artificial Sequence
  Exosome complex exonuclease RRP44 (757-765)
ggcauggacaacgacuuccaccacuac

SEQ ID NO: 33148 - RNA, 27 nt, Artificial Sequence
  Archaemetzincin-2 (148-156)
ggcagcgacuucuacuccaugcacuac

SEQ ID NO: 33149 - RNA, 39 nt, Artificial Sequence
  Xaa-Pro aminopeptidase 1 (256-268)
ggcagcgacguggagcacaaccccgucuucuucuccuac

SEQ ID NO: 33150 - RNA, 27 nt, Artificial Sequence
  Sorbitol dehydrogenase (46-54)
ggcagcgacgugcacuacugggaguac

SEQ ID NO: 33151 - RNA, 27 nt, Artificial Sequence
  Eukaryotic translation initiation factor 3 subunit D (443-451)
ggcagcgaguaccugaagcucggguac

SEQ ID NO: 33152 - RNA, 39 nt, Artificial Sequence
  PMS1 protein homolog 1 (39-51)
ggcaccgccgugaugaacaacauggagagcuuccaguac

SEQ ID NO: 33153 - RNA, 30 nt, Artificial Sequence
  SEC23-interacting protein (313-322)
ggcaccgacgggggccgcuacgacguguac

SEQ ID NO: 33154 - RNA, 27 nt, Artificial Sequence
  Syndetin (394-402)
ggcaccgaccugagcaucuucaaguac

SEQ ID NO: 33155 - RNA, 36 nt, Artificial Sequence
  X-ray repair cross-complementing protein 5 (63-74)
ggcaccgacaacccccugagcgggggcgaccaguac

SEQ ID NO: 33156 - RNA, 33 nt, Artificial Sequence
  DNA replication licensing factor MCM5 (45-55)
ggcaccgaccgcaccggguucacguucaaguac

SEQ ID NO: 33157 - RNA, 27 nt, Artificial Sequence
  WD repeat-containing protein 19 (157-165)
ggcaccgacaccggggugguccaguac

SEQ ID NO: 33158 - RNA, 42 nt, Artificial Sequence
  E3 ubiquitin-protein ligase MYCBP2 (1371-1384)
ggcaccgacgugaacgccgggcagaucccccagcugcucuac

SEQ ID NO: 33159 - RNA, 39 nt, Artificial Sequence
  CDK5 regulatory subunit-associated protein 3 (77-89)
ggcaccgaggccagcaccaagaacaucuucgggcgcuac

SEQ ID NO: 33160 - RNA, 30 nt, Artificial Sequence
  Endophilin-B1 (5-14)
ggcaccgaguucgggcccggcaccgccuac

SEQ ID NO: 33161 - RNA, 36 nt, Artificial Sequence
  GON-4-like protein (39-50)
ggcaccgaguuccccaacccgcugaucagcaaguac

SEQ ID NO: 33162 - RNA, 36 nt, Artificial Sequence
  Nucleolin (451-462)
ggcaccgagaucgacgggcgcagcaucucccuguac

SEQ ID NO: 33163 - RNA, 39 nt, Artificial Sequence
  Nucleolin (451-463)
ggcaccgagaucgacgggcgcagcaucucccuguacuac

SEQ ID NO: 33164 - RNA, 30 nt, Artificial Sequence
  MHC class I polypeptide-related sequence A (50-59)
caccuggacggccagcccuuccuccgcuac

SEQ ID NO: 33165 - RNA, 30 nt, Artificial Sequence
  Zinc finger protein with KRAB and SCAN domains 5 (234-243)
caccuggaccagagccagaagucccucuac

SEQ ID NO: 33166 - RNA, 27 nt, Artificial Sequence
  Zinc finger CW-type PWWP domain protein 1 (230-238)
caccuggacagccuccccuccaaguac

SEQ ID NO: 33167 - RNA, 36 nt, Artificial Sequence
  Conserved oligomeric Golgi complex subunit 6 (528-539)
caccuggacacccucaucaacgagcaggccagcuac

SEQ ID NO: 33168 - RNA, 30 nt, Artificial Sequence
  Unconventional myosin-Va (41-50)
caccuggaggagggcaaggaccucgaguac

SEQ ID NO: 33169 - RNA, 30 nt, Artificial Sequence
  N6-adenosine-methyltransferase 70 kDa subunit (322-331)
cacauggacaccugcaaguacgugcacuac

SEQ ID NO: 33170 - RNA, 30 nt, Artificial Sequence
  5'-nucleotidase domain-containing protein 1 (266-275)
cacagcgacaucuuccccgcccgccacuac

SEQ ID NO: 33171 - RNA, 27 nt, Artificial Sequence
  Endoribonuclease Dicer (118-126)
cacagcgaccugaaggugggcgaguac

SEQ ID NO: 33172 - RNA, 30 nt, Artificial Sequence
  Arylamine N-acetyltransferase 1 (177-186)
cacagcgaccugcucgaggacuccaaguac

SEQ ID NO: 33173 - RNA, 36 nt, Artificial Sequence
  Protein virilizer homolog (783-794)
cacagcgaccugcucggcacccugcacaaccuguac

SEQ ID NO: 33174 - RNA, 33 nt, Artificial Sequence
  CD82 antigen (257-267)
cacagcgaggacuacuccaaggugcccaaguac

SEQ ID NO: 33175 - RNA, 36 nt, Artificial Sequence
  Ribonucleoside-diphosphate reductase subunit M2 B (68-79)
cacagcgagauguacucccugcucaucgacaccuac

SEQ ID NO: 33176 - RNA, 27 nt, Artificial Sequence
  Histone deacetylase 5 (338-346)
cacagcgaguaccacacccugcucuac

SEQ ID NO: 33177 - RNA, 36 nt, Artificial Sequence
  Acyl-CoA desaturase (302-313)
cacagcuuccccuacgacuacuccgccagcgaguac

SEQ ID NO: 33178 - RNA, 30 nt, Artificial Sequence
  Elongation factor Tu, mitochondrial (124-133)
cacaccgacugccccggccacgccgacuac

SEQ ID NO: 33179 - RNA, 30 nt, Artificial Sequence
  Lathosterol oxidase (229-238)
cacaccgaccaccacauguucuucgacuac

SEQ ID NO: 33180 - RNA, 30 nt, Artificial Sequence
  NADPH-cytochrome P450 reductase (250-259)
cacaccgacaucgacgccgccaagguguac

SEQ ID NO: 33181 - RNA, 30 nt, Artificial Sequence
  Synembryn-B (153-162)
cacaccgacauccgcagccagcugcgguac

SEQ ID NO: 33182 - RNA, 30 nt, Artificial Sequence
  Mitochondrial enolase superfamily member 1 (29-38)
cacaccgaccccgacuacagcgccgccuac

SEQ ID NO: 33183 - RNA, 39 nt, Artificial Sequence
  Serine/threonine-protein kinase N2 (593-605)
cacaccgacguguucagcgagccccgcgccgucuucuac

SEQ ID NO: 33184 - RNA, 33 nt, Artificial Sequence
  RNA polymerase II subunit A C-terminal domain phosphatase (601-611)
cacaccgacuacuacgccaaguacgaccgcuac

SEQ ID NO: 33185 - RNA, 39 nt, Artificial Sequence
  Hermansky-Pudlak syndrome 1 protein (98-110)
cacaccgagagcgagggcgaccugcgccggaagcucuac

SEQ ID NO: 33186 - RNA, 27 nt, Artificial Sequence
  Protein 4.1 (461-469)
cacaccgagaccaagacgaucaccuac

SEQ ID NO: 33187 - RNA, 33 nt, Artificial Sequence
  Histone-lysine N-methyltransferase, H3 lysine-79 specific (273-283)
cacaccaucgaccgcaccauccuggagaacuac

SEQ ID NO: 33188 - RNA, 33 nt, Artificial Sequence
  Lysine-specific demethylase 2A (212-222)
cacguggacuucggcgggaccagcgucugguac

SEQ ID NO: 33189 - RNA, 36 nt, Artificial Sequence
  MICOS complex subunit MIC27 (90-101)
aucauggacaccgugcaguucggcaaggacgccuac

SEQ ID NO: 33190 - RNA, 39 nt, Artificial Sequence
  TP53-regulating kinase (188-200)
aucagcgcccugcccgaggacaagggcguggaccucuac

SEQ ID NO: 33191 - RNA, 39 nt, Artificial Sequence
  Tubulin beta-4B chain (24-36)
aucagcgacgagcacggcaucgaccccaccgggaccuac

SEQ ID NO: 33192 - RNA, 36 nt, Artificial Sequence
  Integrin alpha-V (214-225)
aucagcgaccagguggccgagaucgucuccaaguac

SEQ ID NO: 33193 - RNA, 27 nt, Artificial Sequence
  Reticulon-4 (90-98)
aucagcgaggagcuggugcagaaguac

SEQ ID NO: 33194 - RNA, 39 nt, Artificial Sequence
  Adenosylhomocysteinase (155-167)
aucagcgaggagaccaccacgggcgugcacaaccuguac

SEQ ID NO: 33195 - RNA, 27 nt, Artificial Sequence
  Protein disulfide-isomerase A5 (349-357)
aucagcgaguuccccacccugaaguac

SEQ ID NO: 33196 - RNA, 33 nt, Artificial Sequence
  ATP-citrate synthase (6-16)
aucagcgagcagaccggcaaggagcugcucuac

SEQ ID NO: 33197 - RNA, 33 nt, Artificial Sequence
  Oligoribonuclease, mitochondrial (168-178)
aucagcgaguccaucaaggagcugcaguucuac

SEQ ID NO: 33198 - RNA, 33 nt, Artificial Sequence
  Protein furry homolog-like (546-556)
aucagcgagacccccaucaucggcaacaaguac

SEQ ID NO: 33199 - RNA, 27 nt, Artificial Sequence
  Bone morphogenetic protein receptor type-2 (374-382)
aucagcgaggugggcaccauccgcuac

SEQ ID NO: 33200 - RNA, 33 nt, Artificial Sequence
  Beta-hexosaminidase subunit alpha (436-446)
aucagcuacggccccgacuggaaggacuucuac

SEQ ID NO: 33201 - RNA, 33 nt, Artificial Sequence
  N-alpha-acetyltransferase 16, NatA auxiliary subunit (155-165)
aucaccgacgaccaguucgacuuccacaccuac

SEQ ID NO: 33202 - RNA, 30 nt, Artificial Sequence
  Trophinin (580-589)
aucaccgacgaguucgugaagcagaaguac

SEQ ID NO: 33203 - RNA, 24 nt, Artificial Sequence
  Vacuolar protein sorting-associated protein 13C (155-162)
aucaccgacauccacaucaaguac

SEQ ID NO: 33204 - RNA, 39 nt, Artificial Sequence
  Filamin-A (1793-1805)
aucaccgacaacaaggacggcaccgugacgguccgcuac

SEQ ID NO: 33205 - RNA, 42 nt, Artificial Sequence
  Sorting nexin-1 (149-162)
aucaccgaccccgagaagaucggcgacgggaugaacgccuac

SEQ ID NO: 33206 - RNA, 36 nt, Artificial Sequence
  F-box/LRR-repeat protein 14 (130-141)
aucaccgacagcucccugggccgcaucgcccaguac

SEQ ID NO: 33207 - RNA, 39 nt, Artificial Sequence
  Coatomer subunit gamma-1 (131-143)
aucaccgacagcaccaugcugcaggccaucgagcgcuac

SEQ ID NO: 33208 - RNA, 36 nt, Artificial Sequence
  F-box/LRR-repeat protein 17 (206-217)
aucaccgacuacgcccugaucgccaucggccgcuac

SEQ ID NO: 33209 - RNA, 39 nt, Artificial Sequence
  T-complex protein 1 subunit gamma (291-303)
aucaccgagaagggcaucagcgaccuggcccagcacuac

SEQ ID NO: 33210 - RNA, 33 nt, Artificial Sequence
  Tubulin alpha-1C chain (58-68)
aucaccggcaaggaggacgccgccaacaacuac

SEQ ID NO: 33211 - RNA, 30 nt, Artificial Sequence
  Transmembrane protein 218 (3-12)
aucguggacgacuucuucaucggccgcuac

SEQ ID NO: 33212 - RNA, 27 nt, Artificial Sequence
  Protein unc-13 homolog B (372-380)
aucguggacgaguucgccaugcgcuac

SEQ ID NO: 33213 - RNA, 36 nt, Artificial Sequence
  116 kDa U5 small nuclear ribonucleoprotein component (281-292)
aucguggacgaggucaacggccugaucagcauguac

SEQ ID NO: 33214 - RNA, 27 nt, Artificial Sequence
  Putative eukaryotic translation initiation factor 2 subunit 3-like protein (421-429)
aaggccgaccugggcaagaucgugcuc

SEQ ID NO: 33215 - RNA, 42 nt, Artificial Sequence
  Heterogeneous nuclear ribonucleoprotein L (552-565)
aagagcgacgcccuggagacccucggcuuccugaaccacuac

SEQ ID NO: 33216 - RNA, 33 nt, Artificial Sequence
  Heterogeneous nuclear ribonucleoprotein C-like 1 (30-40)
aagagcgacguggaggccaucuucuccaaguac

SEQ ID NO: 33217 - RNA, 33 nt, Artificial Sequence
  RNA-binding protein Raly (35-45)
aagagcgacguggagaccaucuucuccaaguac

SEQ ID NO: 33218 - RNA, 30 nt, Artificial Sequence
  Interferon-induced protein with tetratricopeptide repeats 1 (393-402)
aagagcgacgugaacgccaucauccacuac

SEQ ID NO: 33219 - RNA, 33 nt, Artificial Sequence
  Ras GTPase-activating protein-binding protein 1 (353-363)
aagagcgagcugaaggacuucuuccaguccuac

SEQ ID NO: 33220 - RNA, 30 nt, Artificial Sequence
  Mitochondrial import receptor subunit TOM70 (576-585)
aagagcgagauggagauggcccaccuguac

SEQ ID NO: 33221 - RNA, 27 nt, Artificial Sequence
  Epidermal growth factor receptor substrate 15-like 1 (284-292)
aagaccgaccuggaccucgacggcuac

SEQ ID NO: 33222 - RNA, 36 nt, Artificial Sequence
  Myosin-9 (289-300)
aagaccgaccugcuccuggagcccuacaacaaguac

SEQ ID NO: 33223 - RNA, 33 nt, Artificial Sequence
  Unconventional myosin-Id (307-317)
aagaccgacaugguggagaaggcccugcucuac

SEQ ID NO: 33224 - RNA, 36 nt, Artificial Sequence
  RNA polymerase II-associated factor 1 homolog (123-134)
aagaccgaguacaucagcaccgaguucaaccgcuac

SEQ ID NO: 33225 - RNA, 33 nt, Artificial Sequence
  Cytokine receptor-like factor 3 (197-207)
aagguggacgacgacuucaccgcccaggacuac

SEQ ID NO: 33226 - RNA, 27 nt, Artificial Sequence
  X-ray repair cross-complementing protein 5 (221-229)
aagguggacgaggagcagaugaaguac

SEQ ID NO: 33227 - RNA, 27 nt, Artificial Sequence
  Dolichyl-diphosphooligosaccharide-proteinosyltransferase 48 kDa subunit (391-399)
aagguggacuacaaccgccugggcuac

SEQ ID NO: 33228 - RNA, 30 nt, Artificial Sequence
  Cytosol aminopeptidase (431-440)
cuggccgacgugaacaacaucggcaaguac

SEQ ID NO: 33229 - RNA, 33 nt, Artificial Sequence
  Double-stranded RNA-specific adenosine deaminase (334-344)
cugaucgacauggagcgccagggcgacguguac

SEQ ID NO: 33230 - RNA, 30 nt, Artificial Sequence
  Annexin A2 (190-199)
cugaucgaccaggacgcccgcgaccucuac

SEQ ID NO: 33231 - RNA, 33 nt, Artificial Sequence
  Protein zyg-11 homolog B (425-435)
cugaucgaggagggcgggcuccagcaccuguac

SEQ ID NO: 33232 - RNA, 42 nt, Artificial Sequence
  N-acetylglucosamine-1-phosphotransferase subunits alpha/beta (903-916)
cugcucgacgaggaggagagccugaagacccagcuggccuac

SEQ ID NO: 33233 - RNA, 30 nt, Artificial Sequence
  Protein transport protein Sec61 subunit alpha isoform 1 (164-173)
cugcucgacgagcugcugcagaagggcuac

SEQ ID NO: 33234 - RNA, 36 nt, Artificial Sequence
  Mitogen-activated protein kinase kinase kinase 7 (547-558)
cugcucgacgagaacaagagccuguccaccuacuac

SEQ ID NO: 33235 - RNA, 33 nt, Artificial Sequence
  Syntaxin-binding protein 2 (253-263)
cugcucgacaucgagcaggacaccuaccgcuac

SEQ ID NO: 33236 - RNA, 30 nt, Artificial Sequence
  Intraflagellar transport protein 43 homolog (4-13)
cugcucgaccuggacgaggagcugcgcuac

SEQ ID NO: 33237 - RNA, 30 nt, Artificial Sequence
  Zinc finger protein 627 (79-88)
cugcucgaccccagccagaagaaccuguac

SEQ ID NO: 33238 - RNA, 30 nt, Artificial Sequence
  Zinc finger protein 614 (24-33)
cugcucgacaccgcccagaagaaccuguac

SEQ ID NO: 33239 - RNA, 30 nt, Artificial Sequence
  Zinc finger protein 324B (17-26)
cugcucgacaccgcccagcgcgcccuguac

SEQ ID NO: 33240 - RNA, 36 nt, Artificial Sequence
  S100P-binding protein (91-102)
cugcucgacaccccccgcgagaagaacagcuccuac

SEQ ID NO: 33241 - RNA, 39 nt, Artificial Sequence
  Chromodomain-helicase-DNA-binding protein 4 (1078-1090)
cugcucgaggacuuccuggagcacgagggcuacaaguac

SEQ ID NO: 33242 - RNA, 27 nt, Artificial Sequence
  SWI/SNF-related matrix-associated actin-dependent regulator of chromatin subfamily A member 5 (784-792)
cugcucgagaaggagauccuguucuac

SEQ ID NO: 33243 - RNA, 30 nt, Artificial Sequence
  Early endosome antigen 1 (541-550)
cugcucgagaaggagcgcgaggaccuguac

SEQ ID NO: 33244 - RNA, 33 nt, Artificial Sequence
  E3 ubiquitin-protein ligase HUWE1 (982-992)
cugcucgagaacgacgugagcacccugggcuac

SEQ ID NO: 33245 - RNA, 36 nt, Artificial Sequence
  Ankyrin repeat and LEM domain-containing protein 2 (110-121)
cugcucgagcagggcgggcgccugagcuccuucuac

SEQ ID NO: 33246 - RNA, 42 nt, Artificial Sequence
  Phospholipid scramblase 1 (116-129)
cugcucgaggugcugaccggcuucgagaccaacaacaaguac

SEQ ID NO: 33247 - RNA, 30 nt, Artificial Sequence
  Signal recognition particle subunit SRP68 (128-137)
cugauggacgccgagcgcgccuggagcuac

SEQ ID NO: 33248 - RNA, 33 nt, Artificial Sequence
  Sialidase-1 (232-242)
cugagcgacgaccacggcgccuccuggcgcuac

SEQ ID NO: 33249 - RNA, 24 nt, Artificial Sequence
  Melanoma inhibitory activity protein 3 (136-143)
cugagcgacgaggccaucaaguac

SEQ ID NO: 33250 - RNA, 27 nt, Artificial Sequence
  FACT complex subunit SSRP1 (85-93)
cugagcgacuucuucaagacccacuac

SEQ ID NO: 33251 - RNA, 30 nt, Artificial Sequence
  Inhibitor of nuclear factor kappa-B kinase subunit beta (67-76)
cugagcgacaucgccuccgcccuccgcuac

SEQ ID NO: 33252 - RNA, 27 nt, Artificial Sequence
  Deoxyribose-phosphate aldolase (312-320)
cugagcgacaucgagcgccagaucuac

SEQ ID NO: 33253 - RNA, 30 nt, Artificial Sequence
  Inhibitor of nuclear factor kappa-B kinase subunit alpha (94-103)
cugagcgacaucggcuccgggauccgcuac

SEQ ID NO: 33254 - RNA, 27 nt, Artificial Sequence
  Rho-related BTB domain-containing protein 3 (340-348)
cugagcgacauccuccgcuucaucuac

SEQ ID NO: 33255 - RNA, 39 nt, Artificial Sequence
  DnaJ homolog subfamily C member 11 (69-81)
cugagcgacccccagacccgcgccaucuacgacaucuac

SEQ ID NO: 33256 - RNA, 30 nt, Artificial Sequence
  Ribosomal protein S6 kinase delta-1 (155-164)
cugagcgaccccuccggcccgaagagcuac

SEQ ID NO: 33257 - RNA, 36 nt, Artificial Sequence
  Nucleoporin NDC1 (58-69)
cugagcgacuccuucagcgaccucuacuccagcuac

SEQ ID NO: 33258 - RNA, 33 nt, Artificial Sequence
  Importin-7 (681-691)
cugagcgacaccaaguaccucgagaugaucuac

SEQ ID NO: 33259 - RNA, 36 nt, Artificial Sequence
  DNA polymerase zeta catalytic subunit (2423-2434)
cugagcgacugguucgacaacaagaccgaccucuac

SEQ ID NO: 33260 - RNA, 33 nt, Artificial Sequence
  Cyclin-dependent kinase 2-associated protein 1 (39-49)
cugagcgacuacggccccccgucccucggguac

SEQ ID NO: 33261 - RNA, 27 nt, Artificial Sequence
  PAS domain-containing serine/threonine-protein kinase (64-72)
cugagcgaggaccgcugguccagcuac

SEQ ID NO: 33262 - RNA, 27 nt, Artificial Sequence
  Vacuolar protein sorting-associated protein 18 homolog (306-314)
cugagcgaggagcgcgugugggaguac

SEQ ID NO: 33263 - RNA, 27 nt, Artificial Sequence
  Transmembrane and TPR repeat-containing protein 3 (84-92)
cugagcgagcucaagcccauguccuac

SEQ ID NO: 33264 - RNA, 36 nt, Artificial Sequence
  DmX-like protein 1 (783-794)
cugagcgagcucuccaaccccgagaucagcaaguac

SEQ ID NO: 33265 - RNA, 27 nt, Artificial Sequence
  Alpha/beta hydrolase domain-containing protein 17B (50-58)
cugagcgagcgcgccgacuggcaguac

SEQ ID NO: 33266 - RNA, 27 nt, Artificial Sequence
  Immediate early response gene 5-like protein (48-56)
cugagcgagcgcuacgccgagcucuac

SEQ ID NO: 33267 - RNA, 30 nt, Artificial Sequence
  Signal peptidase complex subunit 1 (5-14)
cugagcucccuccccacccagauggacuac

SEQ ID NO: 33268 - RNA, 45 nt, Artificial Sequence
  Coatomer subunit epsilon (43-57)
cugagcucccccgagcgcgacguggagcgggacgucuuccucuac

SEQ ID NO: 33269 - RNA, 33 nt, Artificial Sequence
  26S proteasome non-ATPase regulatory subunit 2 (391-401)
cugaccgacgacggcaacaaguggcucuacaag

SEQ ID NO: 33270 - RNA, 27 nt, Artificial Sequence
  Casein kinase II subunit alpha' (129-137)
cugaccgacuucgacauccgcuucuac

SEQ ID NO: 33271 - RNA, 24 nt, Artificial Sequence
  Lysine-tRNA ligase (133-140)
cugaccgacuucauccagaaguac

SEQ ID NO: 33272 - RNA, 27 nt, Artificial Sequence
  DNA excision repair protein ERCC-6-like 2 (214-222)
cugaccgacuuccagaaggccguguac

SEQ ID NO: 33273 - RNA, 30 nt, Artificial Sequence
  Thyroid adenoma-associated protein (45-54)
cugaccgacggcgugagccagauccacuac

SEQ ID NO: 33274 - RNA, 33 nt, Artificial Sequence
  3'(2'),5'-bisphosphate nucleotidase 1 (262-272)
cugaccgacauccacggcaacgugcuccaguac

SEQ ID NO: 33275 - RNA, 30 nt, Artificial Sequence
  Myotubularin-related protein 5 (70-79)
cugaccgacaucaacagcgagcgccacuac

SEQ ID NO: 33276 - RNA, 36 nt, Artificial Sequence
  E3 ubiquitin-protein ligase UBR4 (278-289)
cugaccgacaaggccgugaaggacuacagcgccuac

SEQ ID NO: 33277 - RNA, 33 nt, Artificial Sequence
  MAP kinase-activating death domain protein (81-91)
cugaccgacaaggacaccggcgugacgcgcuac

SEQ ID NO: 33278 - RNA, 30 nt, Artificial Sequence
  Dynactin subunit 2 (168-177)
cugaccgaccccgacggcgcccucgccaag

SEQ ID NO: 33279 - RNA, 30 nt, Artificial Sequence
  Mucosa-associated lymphoid tissue lymphoma translocation protein 1 (876-885)
cugaccgaccccauccagggcaccgaguac

SEQ ID NO: 33280 - RNA, 30 nt, Artificial Sequence
  Putative deoxyribonuclease TATDN1 (13-22)
cugaccgaccccauguuccgcggcaucuac

SEQ ID NO: 33281 - RNA, 27 nt, Artificial Sequence
  Interferon regulatory factor 3 (252-260)
cugaccgaccgcggcgugaugagcuac

SEQ ID NO: 33282 - RNA, 30 nt, Artificial Sequence
  Tubulin polyglutamylase complex subunit 2 (125-134)
cugaccgacaccuucacggccuacuaccgc

SEQ ID NO: 33283 - RNA, 39 nt, Artificial Sequence
  Peroxisomal multifunctional enzyme type 2 (493-505)
cugaccgacaccacgagccucaaccaggccgcccuguac

SEQ ID NO: 33284 - RNA, 27 nt, Artificial Sequence
  DNA polymerase zeta catalytic subunit (928-936)
cugaccgaggagaagauggagcucuac

SEQ ID NO: 33285 - RNA, 33 nt, Artificial Sequence
  Regulator of microtubule dynamics protein 3 (316-326)
cugaccgaggaggugagcgagaagaaguccuac

SEQ ID NO: 33286 - RNA, 33 nt, Artificial Sequence
  Protein FAM65B (122-132)
cugaccgagaucaaccgcagcuucaaggaguac

SEQ ID NO: 33287 - RNA, 39 nt, Artificial Sequence
  Probable histidine-tRNA ligase, mitochondrial (104-116)
cugaccgagaaguacggcgaggacagcgggcucauguac

SEQ ID NO: 33288 - RNA, 30 nt, Artificial Sequence
  ATP synthase subunit alpha, mitochondrial (467-476)
cugaccgagcuccugaagcagggccaguac

SEQ ID NO: 33289 - RNA, 27 nt, Artificial Sequence
  39S ribosomal protein L52, mitochondrial (43-51)
cugaccgagcuccccgacuggagcuac

SEQ ID NO: 33290 - RNA, 27 nt, Artificial Sequence
  Tectonin beta-propeller repeat-containing protein 2 (950-958)
cugaccgagcagcgcgcccuccuguac

SEQ ID NO: 33291 - RNA, 30 nt, Artificial Sequence
  7SK snRNA methylphosphate capping enzyme (629-638)
cugaccgagaccaucuacaagaacuacuac

SEQ ID NO: 33292 - RNA, 39 nt, Artificial Sequence
  HLA class I histocompatibility antigen, B-8 alpha chain (19-31)
cugaccgagaccugggccggcagccacuccaugcgcuac

SEQ ID NO: 33293 - RNA, 30 nt, Artificial Sequence
  Proline-rich nuclear receptor coactivator 1 (270-279)
cugaccgaggugagccagaaggagaacuac

SEQ ID NO: 33294 - RNA, 39 nt, Artificial Sequence
  TOX high mobility group box family member 4 (104-116)
cugaccauggaccucgaccacagcaucggcacccaguac

SEQ ID NO: 33295 - RNA, 33 nt, Artificial Sequence
  Ubiquinone biosynthesis protein COQ9, mitochondrial (105-115)
cugaccagcaugguggacgacauguggcacuac

SEQ ID NO: 33296 - RNA, 30 nt, Artificial Sequence
  Clustered mitochondria protein homolog (608-617)
cugguggacgccuucgucgagcaccgcuac

SEQ ID NO: 33297 - RNA, 36 nt, Artificial Sequence
  Poly (ADP-ribose) polymerase 1 (559-570)
cugguggacaucgucaagggcaccaacagcuacuac

SEQ ID NO: 33298 - RNA, 27 nt, Artificial Sequence
  Alsin (683-691)
cugguggacaagaacaucaugggcuac

SEQ ID NO: 33299 - RNA, 39 nt, Artificial Sequence
  Dexamethasone-induced protein (67-79)
cugguggaccucggcguccugagcgaccccggguccggc

SEQ ID NO: 33300 - RNA, 45 nt, Artificial Sequence
  Dexamethasone-induced protein (67-81)
cugguggaccucggcguccugagcgaccccggguccggccuguac

SEQ ID NO: 33301 - RNA, 27 nt, Artificial Sequence
  Zinc finger FYVE domain-containing protein 16 (1229-1237)
cugguggaccuccgcaacuaccaguac

SEQ ID NO: 33302 - RNA, 30 nt, Artificial Sequence
  Semaphorin-4F (69-78)
cugguggaccccgccagccacacccucuac

SEQ ID NO: 33303 - RNA, 30 nt, Artificial Sequence
  Fatty acid-binding protein, epidermal (13-22)
cugguggacagcaagggcuucgacgaguac

SEQ ID NO: 33304 - RNA, 27 nt, Artificial Sequence
  Probable C-mannosyltransferase DPY19L1 (398-406)
auggagaaggagaccccccugcgcuac

SEQ ID NO: 33305 - RNA, 30 nt, Artificial Sequence
  MICOS complex subunit MIC60 (261-270)
augaucgacgagacccgcaacagccuguac

SEQ ID NO: 33306 - RNA, 27 nt, Artificial Sequence
  SWI/SNF-related matrix-associated actin-dependent regulator of chromatin subfamily D member 2 (247-255)
augcuggaccaccagcccccgcaguac

SEQ ID NO: 33307 - RNA, 27 nt, Artificial Sequence
  Acylamino-acid-releasing enzyme (544-552)
augcuggacaagagccccauccgcuac

SEQ ID NO: 33308 - RNA, 27 nt, Artificial Sequence
  Cytoplasmic dynein 1 heavy chain 1 (3043-3051)
augcuggacagccacgaggagcucuac

SEQ ID NO: 33309 - RNA, 36 nt, Artificial Sequence
  Zinc finger MYM-type protein 4 (480-491)
augagcgacggcuccauccgcaacuucugcagcuac

SEQ ID NO: 33310 - RNA, 30 nt, Artificial Sequence
  YTH domain-containing family protein 3 (52-61)
augagcgaccccuacaugccguccuacuac

SEQ ID NO: 33311 - RNA, 24 nt, Artificial Sequence
  trabeculin-alpha (2316-2323)
augagcgacgugaaccugaaguac

SEQ ID NO: 33312 - RNA, 30 nt, Artificial Sequence
  A-kinase anchor protein 6 (990-999)
augagcgaggagcagcagcagcaccuguac

SEQ ID NO: 33313 - RNA, 27 nt, Artificial Sequence
  Lambda-crystallin homolog (224-232)
augagcgagggccuggggaugcgcuac

SEQ ID NO: 33314 - RNA, 30 nt, Artificial Sequence
  Talin-1 (289-298)
augagcgagaucgaggccaaggugcgcuac

SEQ ID NO: 33315 - RNA, 39 nt, Artificial Sequence
  Kelch-like protein 13 (423-435)
augagcgagccccacuacggccacgccgggaccguguac

SEQ ID NO: 33316 - RNA, 27 nt, Artificial Sequence
  Antigen KI-67 (1611-1619)
augaccgacgacaagaucaccgaggug

SEQ ID NO: 33317 - RNA, 33 nt, Artificial Sequence
  Telomerase protein component 1 (365-375)
augaccgacaaguucgcccaguucgacgaguac

SEQ ID NO: 33318 - RNA, 36 nt, Artificial Sequence
  DNA helicase B (287-298)
augaccgaccuggagaagaacgcccucaucauguac

SEQ ID NO: 33319 - RNA, 39 nt, Artificial Sequence
  TAR DNA-binding protein 43 (202-214)
augaccgaggacgagcugcgcgaguucuucagccaguac

SEQ ID NO: 33320 - RNA, 39 nt, Artificial Sequence
  Muskelin (98-110)
augaccgagcugcucagcuccggccugaagaacgacuac

SEQ ID NO: 33321 - RNA, 30 nt, Artificial Sequence
  Presenilin-1 (1-10)
augaccgagcugcccgccccgcucagcuac

SEQ ID NO: 33322 - RNA, 30 nt, Artificial Sequence
  Prolyl endopeptidase (67-76)
augaccgagcuguacgacuaccccaaguac

SEQ ID NO: 33323 - RNA, 27 nt, Artificial Sequence
  E3 ubiquitin-protein ligase UBR5 (2723-2731)
augaccgagcgccaggaccugguguac

SEQ ID NO: 33324 - RNA, 30 nt, Artificial Sequence
  Protein Spindly (51-60)
augaccgagagcuacgagcaggagaaguac

SEQ ID NO: 33325 - RNA, 39 nt, Artificial Sequence
  Zinc finger protein 428 (44-56)
augaccgagacccgcgagcccgccgagacgggcggguac

SEQ ID NO: 33326 - RNA, 36 nt, Artificial Sequence
  NF-kappa-B-repressing factor (190-201)
augaccagcggcuccgacaagaucaacuacaccuac

SEQ ID NO: 33327 - RNA, 27 nt, Artificial Sequence
  Probable ATP-dependent RNA helicase DHX35 (162-170)
augguggacccccugcucaccaaguac

SEQ ID NO: 33328 - RNA, 33 nt, Artificial Sequence
  Cytochrome c oxidase subunit 1 (484-494)
augguggaggagcccagcaugaaccuggagugg

SEQ ID NO: 33329 - RNA, 36 nt, Artificial Sequence
  Lysocardiolipin acyltransferase 1 (88-99)
aaccuggacgccgugcacgacaucaccgucgccuac

SEQ ID NO: 33330 - RNA, 36 nt, Artificial Sequence
  Prolyl 3-hydroxylase OGFOD1 (84-95)
aaccuggacuuccacgagaaguacaacgaccucuac

SEQ ID NO: 33331 - RNA, 27 nt, Artificial Sequence
  Tubulin alpha-1C chain (181-189)
aaccuggacaucgagcgccccaccuac

SEQ ID NO: 33332 - RNA, 36 nt, Artificial Sequence
  Splicing factor 3B subunit 4 (106-117)
aaccuggaccccgagaucgacgagaagcuccuguac

SEQ ID NO: 33333 - RNA, 27 nt, Artificial Sequence
  N-alpha-acetyltransferase 20 (7-15)
aaccuggacccccucaccgagaccuac

SEQ ID NO: 33334 - RNA, 30 nt, Artificial Sequence
  E3 ubiquitin-protein ligase RNF135 (381-390)
aaccuggaggagggcaagcucgccuucuac

SEQ ID NO: 33335 - RNA, 27 nt, Artificial Sequence
  Basigin (111-119)
aacauggaggccgaccccggccaguac

SEQ ID NO: 33336 - RNA, 42 nt, Artificial Sequence
  Ribonucleoside-diphosphate reductase large subunit (35-48)
aacagcgccaucaucuacgaccgcgacuucuccuacaacuac

SEQ ID NO: 33337 - RNA, 30 nt, Artificial Sequence
  Thrombospondin-3 (640-649)
aacagcgaccccggccuggccgugggguac

SEQ ID NO: 33338 - RNA, 36 nt, Artificial Sequence
  NADH-ubiquinone oxidoreductase chain 5 (109-120)
aacagcgaccccaacaucaaccaguucuucaaguac

SEQ ID NO: 33339 - RNA, 33 nt, Artificial Sequence
  52 kDa repressor of the inhibitor of the protein kinase (452-462)
aacagcgacaccaacauccgcuggaacaacuac

SEQ ID NO: 33340 - RNA, 27 nt, Artificial Sequence
  Homeodomain-interacting protein kinase 1 (604-612)
aacagcgacgugucccugcucaacuac

SEQ ID NO: 33341 - RNA, 30 nt, Artificial Sequence
  Serine/threonine-protein kinase RIO3 (378-387)
aacagcgaggagaugaaggaggccuacuac

SEQ ID NO: 33342 - RNA, 42 nt, Artificial Sequence
  Cerebellar degeneration-related protein 2 (286-299)
aacagcgagcuggagcagcagcucggcgccaccggggccuac

SEQ ID NO: 33343 - RNA, 30 nt, Artificial Sequence
  YY1-associated protein 1 (320-329)
aacagcgagcugggcuccgagacccgcuac

SEQ ID NO: 33344 - RNA, 27 nt, Artificial Sequence
  Myosin-14 (29-37)
aacagcgagcugcucaacgaccgcuac

SEQ ID NO: 33345 - RNA, 27 nt, Artificial Sequence
  Thymidylate synthase (205-213)
aacagcgagcuguccugccagcucuac

SEQ ID NO: 33346 - RNA, 42 nt, Artificial Sequence
  Neuroblastoma-amplified sequence (1978-1991)
aacagcgagcaggagacccugcagaaguacucccaccucuac

SEQ ID NO: 33347 - RNA, 39 nt, Artificial Sequence
  Cytochrome c oxidase subunit 1 (360-372)
aacagcucccuggacaucgugcuccacgacaccuacuac

SEQ ID NO: 33348 - RNA, 33 nt, Artificial Sequence
  LIM domain and actin-binding protein 1 (82-92)
aacaccgacgccagcggcaagaucgagaaguac

SEQ ID NO: 33349 - RNA, 33 nt, Artificial Sequence
  Zinc finger protein 462 (265-275)
aacaccgacuucggcgacagcgggcgccuguac

SEQ ID NO: 33350 - RNA, 36 nt, Artificial Sequence
  Zinc finger protein 462 (265-276)
aacaccgacuucggcgacagcgggcgccuguacuac

SEQ ID NO: 33351 - RNA, 27 nt, Artificial Sequence
  Protein YIPF5 (8-16)
aacaccgacuucuaccagaccagcuac

SEQ ID NO: 33352 - RNA, 27 nt, Artificial Sequence
  2-oxoisovalerate dehydrogenase subunit alpha, mitochondrial (83-91)
aacaccgaccugguguucggccaguac

SEQ ID NO: 33353 - RNA, 33 nt, Artificial Sequence
  Protein TASOR (346-356)
aacaccgaccgcaacaucgacaaguacaacuac

SEQ ID NO: 33354 - RNA, 36 nt, Artificial Sequence
  26S proteasome non-ATPase regulatory subunit 13 (227-238)
aacaccgaccgccaguggcugaucgacacccucuac

SEQ ID NO: 33355 - RNA, 33 nt, Artificial Sequence
  Pericentriolar material 1 protein (1414-1424)
aacaccgacuaccugcgccagcgggcccucuac

SEQ ID NO: 33356 - RNA, 36 nt, Artificial Sequence
  DnaJ homolog subfamily C member 3 (221-232)
aacaccgaggccuucuacaagaucagcacccuguac

SEQ ID NO: 33357 - RNA, 39 nt, Artificial Sequence
  Polypyrimidine tract-binding protein 1 (102-114)
aacaccgaggaggccgccaacaccauggugaacuacuac

SEQ ID NO: 33358 - RNA, 39 nt, Artificial Sequence
  DNA-directed RNA polymerase I subunit RPA1 (1579-1591)
aacaccgagggcaucaaccugcccgagcucuucaaguac

SEQ ID NO: 33359 - RNA, 27 nt, Artificial Sequence
  Putative SMEK homolog 3 (187-195)
aacaccgagggccugcaccaccucuac

SEQ ID NO: 33360 - RNA, 39 nt, Artificial Sequence
  Condensin complex subunit 1 (509-521)
aacaccgagaccacggaggacgugaagggccgcaucuac

SEQ ID NO: 33361 - RNA, 30 nt, Artificial Sequence
  Charged multivesicular body protein 4b (102-111)
aacaccgaggugcugaagaacaugggcuac

SEQ ID NO: 33362 - RNA, 39 nt, Artificial Sequence
  Solute carrier family 25 member 46 (374-386)
aacaccauccgccaggaggagggcguguucggguucuac

SEQ ID NO: 33363 - RNA, 39 nt, Artificial Sequence
  Microphthalmia-associated transcription factor (237-249)
aacacccugcccgugagcggcaaccucaucgaccuguac

SEQ ID NO: 33364 - RNA, 33 nt, Artificial Sequence
  AT-rich interactive domain-containing protein 1A (858-868)
aacaccagcgacaugaugggccgcauguccuac

SEQ ID NO: 33365 - RNA, 39 nt, Artificial Sequence
  Lysine-specific demethylase 5A (460-472)
aacguggacaucagcggcaugaagguccccuggcuguac

SEQ ID NO: 33366 - RNA, 36 nt, Artificial Sequence
  Anaphase-promoting complex subunit 7 (270-281)
aacguggaccugcucggcagccuggccgaccuguac

SEQ ID NO: 33367 - RNA, 27 nt, Artificial Sequence
  60S ribosomal protein L13a (184-192)
aacguggagaagaagaucgacaaguac

SEQ ID NO: 33368 - RNA, 30 nt, Artificial Sequence
  Unhealthy ribosome biogenesis protein 2 homolog (1354-1363)
ccccuggaccaccucaagccgcuggaguac

SEQ ID NO: 33369 - RNA, 30 nt, Artificial Sequence
  Nardilysin (107-116)
cccagcgacccgaagcaguaccgcuacauc

SEQ ID NO: 33370 - RNA, 33 nt, Artificial Sequence
  Probable 28S rRNA (cytosine-C(5))-methyltransferase (291-301)
cccagcgacccgcgcuaccacgaggugcacuac

SEQ ID NO: 33371 - RNA, 27 nt, Artificial Sequence
  Vesicle-associated membrane protein 7 (37-45)
cccagcgagaacaacaagcugaccuac

SEQ ID NO: 33372 - RNA, 36 nt, Artificial Sequence
  ELAV-like protein 1 (98-109)
cccagcuccgaggugaucaaggacgccaaccuguac

SEQ ID NO: 33373 - RNA, 27 nt, Artificial Sequence
  Copine-1 (299-307)
cccagcuccccggacagccugcacuac

SEQ ID NO: 33374 - RNA, 27 nt, Artificial Sequence
  Leucyl-cystinyl aminopeptidase (155-163)
cccaccgccguggucccgcugcgcuac

SEQ ID NO: 33375 - RNA, 36 nt, Artificial Sequence
  Mitogen-activated protein kinase kinase kinase kinase 2 (799-810)
cccaccgacaacccggaggcccacagcaaccuguac

SEQ ID NO: 33376 - RNA, 33 nt, Artificial Sequence
  GRAM domain-containing protein 4 (500-510)
cccaccgacuacauccgcaacggcgugcuguac

SEQ ID NO: 33377 - RNA, 30 nt, Artificial Sequence
  Vam6/Vps39-like protein (288-297)
cccaccgacuaccgcaagcagcugcaguac

SEQ ID NO: 33378 - RNA, 27 nt, Artificial Sequence
  Syntaxin-binding protein 5 (645-653)
cccaccgagauccagcgccugaccuac

SEQ ID NO: 33379 - RNA, 36 nt, Artificial Sequence
  Mitochondrial import receptor subunit TOM70 (145-156)
cccaccgagaagaacguggaccugagcaccuucuac

SEQ ID NO: 33380 - RNA, 36 nt, Artificial Sequence
  Nuclear factor erythroid 2-related factor 1 (309-320)
cccguggaggaguucaacgagcugcucagcaaguac

SEQ ID NO: 33381 - RNA, 33 nt, Artificial Sequence
  Uncharacterized protein KIAA2013 (534-544)
caggccgaccccgacgugcugcacaacagcuac

SEQ ID NO: 33382 - RNA, 30 nt, Artificial Sequence
  Lysophospholipid acyltransferase LPCAT4 (420-429)
caggccgagggccccaaccgccugcucuac

SEQ ID NO: 33383 - RNA, 39 nt, Artificial Sequence
  Actin-related protein 6 (44-56)
cagaucgacgagaucaaggaccccagcggccuguucuac

SEQ ID NO: 33384 - RNA, 27 nt, Artificial Sequence
  Hepatocyte growth factor-regulated tyrosine kinase substrate (459-467)
cagcuggacgagcgccggcucuacuac

SEQ ID NO: 33385 - RNA, 27 nt, Artificial Sequence
  Speriolin-like protein (48-56)
cagcuggaccgccggauccucgccuac

SEQ ID NO: 33386 - RNA, 30 nt, Artificial Sequence
  Zinc finger protein 74 (59-68)
cagcuggacagcccccagcgcgcccucuac

SEQ ID NO: 33387 - RNA, 27 nt, Artificial Sequence
  trabeculin-alpha (4357-4365)
cagcuggacacccacauggagcucuac

SEQ ID NO: 33388 - RNA, 33 nt, Artificial Sequence
  Phosphofurin acidic cluster sorting protein 1 (106-116)
cagcuggacguggccggccgcgucaugcaguac

SEQ ID NO: 33389 - RNA, 33 nt, Artificial Sequence
  Ubiquitin-40S ribosomal protein S27a (69-79)
cagcuggaggacggccgcacccucagcgacuac

SEQ ID NO: 33390 - RNA, 36 nt, Artificial Sequence
  PH domain leucine-rich repeat-containing protein phosphatase 2 (23-34)
cagcuggagcgccccggcgggcucgacacccuguac

SEQ ID NO: 33391 - RNA, 27 nt, Artificial Sequence
  Transketolase (102-110)
cagagcgaccccgccccgcugcagcac

SEQ ID NO: 33392 - RNA, 30 nt, Artificial Sequence
  HMG box-containing protein 1 (66-75)
cagagcgaccccacccaguccggcauguac

SEQ ID NO: 33393 - RNA, 30 nt, Artificial Sequence
  Aryl hydrocarbon receptor (150-159)
cagagcgacgugauccaccaguccgucuac

SEQ ID NO: 33394 - RNA, 39 nt, Artificial Sequence
  HLA class I histocompatibility antigen, A-1 alpha chain (86-98)
cagagcgaggacggcucccacaccauccagaucauguac

SEQ ID NO: 33395 - RNA, 33 nt, Artificial Sequence
  Pre-mRNA-splicing factor ISY1 homolog (275-285)
cagagcgaggaggcccgccggcugcucggcuac

SEQ ID NO: 33396 - RNA, 30 nt, Artificial Sequence
  LIM and SH3 domain protein 1 (77-86)
cagagcgagcugcagucccaggugcgcuac

SEQ ID NO: 33397 - RNA, 27 nt, Artificial Sequence
  Dynamin-1-like protein (672-680)
cagagcgagcuggugggccagcucuac

SEQ ID NO: 33398 - RNA, 36 nt, Artificial Sequence
  E3 ubiquitin-protein ligase synoviolin (163-174)
cagagcgagaaccccugggacaacaaggccguguac

SEQ ID NO: 33399 - RNA, 27 nt, Artificial Sequence
  Vacuolar protein sorting-associated protein 13D (1153-1161)
cagagcgagcgcgaguacauccgguac

SEQ ID NO: 33400 - RNA, 30 nt, Artificial Sequence
  Ubiquitin carboxyl-terminal hydrolase 25 (71-80)
cagaccgcccugcccggcaacgaccgcuac

SEQ ID NO: 33401 - RNA, 30 nt, Artificial Sequence
  Zinc finger MYM-type protein 2 (609-618)
cagaccgacgacaccuggcgcacggaguac

SEQ ID NO: 33402 - RNA, 27 nt, Artificial Sequence
  Disintegrin and metalloproteinase domain-containing protein 10 (227-235)
cagaccgaccaccuguucuucaaguac

SEQ ID NO: 33403 - RNA, 33 nt, Artificial Sequence
  RNA polymerase-associated protein CTR9 homolog (424-434)
cagaccgacauccagggcgcccugagcgccuac

SEQ ID NO: 33404 - RNA, 36 nt, Artificial Sequence
  AP-1 complex subunit beta-1 (59-70)
cagaccgacaaccuggagcucaagaagcugguguac

SEQ ID NO: 33405 - RNA, 30 nt, Artificial Sequence
  Charged multivesicular body protein 7 (274-283)
cagaccgaccagaugguguucaacgccuac

SEQ ID NO: 33406 - RNA, 33 nt, Artificial Sequence
  Midasin (362-372)
cagaccgacagcaagaugcugcucggcauguac

SEQ ID NO: 33407 - RNA, 30 nt, Artificial Sequence
  RAB6A-GEF complex partner protein 2 (260-269)
cagaccgaggagcgcgugcagcccgaguac

SEQ ID NO: 33408 - RNA, 33 nt, Artificial Sequence
  UDP-glucose:glycoprotein glucosyltransferase 1 (1328-1338)
cagaccgagaagcagcgcaucaucuggggcuac

SEQ ID NO: 33409 - RNA, 30 nt, Artificial Sequence
  Probable cation-transporting ATPase 13A3 (131-140)
cagaccgagagccagcagauccgcuacuuc

SEQ ID NO: 33410 - RNA, 36 nt, Artificial Sequence
  Intraflagellar transport protein 81 homolog (447-458)
cagaccauggaggagaagaagggcaucagcggguac

SEQ ID NO: 33411 - RNA, 27 nt, Artificial Sequence
  Importin subunit alpha-5 (516-524)
cagguggaccugaaccagcagcaguac

SEQ ID NO: 33412 - RNA, 30 nt, Artificial Sequence
  Protein PRR14L (815-824)
cagguggacaacagccugaucaccaaguac

SEQ ID NO: 33413 - RNA, 30 nt, Artificial Sequence
  DNA-directed RNA polymerase II subunit RPB9 (103-112)
cgcgccgaggacgccaugcggcuguacuac

SEQ ID NO: 33414 - RNA, 27 nt, Artificial Sequence
  CDK5 regulatory subunit-associated protein 2 (1335-1343)
cgcaucgaggaggacaaccugaccuac

SEQ ID NO: 33415 - RNA, 27 nt, Artificial Sequence
  Vacuole membrane protein 1 (105-113)
cgcaucgagaagcaguuccugcucuac

SEQ ID NO: 33416 - RNA, 27 nt, Artificial Sequence
  Lanosterol 14-alpha demethylase (418-426)
cgccuggacuucaaccccgaccgguac

SEQ ID NO: 33417 - RNA, 30 nt, Artificial Sequence
  Tubulin alpha-1C chain (355-364)
cgccuggaccacaaguucgaccucauguac

SEQ ID NO: 33418 - RNA, 36 nt, Artificial Sequence
  Nitric oxide synthase, endothelial (782-793)
cgccuggacaccggcgggcaggagggccuccaguac

SEQ ID NO: 33419 - RNA, 33 nt, Artificial Sequence
  Transmembrane emp24 domain-containing protein 7 (68-78)
cgccuggaggaccccgacggcaaggugcucuac

SEQ ID NO: 33420 - RNA, 30 nt, Artificial Sequence
  Peptidyl-prolyl cis-trans isomerase FKBP3 (189-198)
cgccuggagaucgagcccgagugggccuac

SEQ ID NO: 33421 - RNA, 33 nt, Artificial Sequence
  Ubiquitin carboxyl-terminal hydrolase 15 (403-413)
cgcauggacccccugaccaagccgaugcaguac

SEQ ID NO: 33422 - RNA, 36 nt, Artificial Sequence
  WASH complex subunit strumpellin (230-241)
cgcagcgacgacaucuacaaccagguguccgccuac

SEQ ID NO: 33423 - RNA, 30 nt, Artificial Sequence
  Selenocysteine insertion sequence-binding protein 2-like (379-388)
cgcagcgaccccaacuccgagagccuguac

SEQ ID NO: 33424 - RNA, 33 nt, Artificial Sequence
  Nuclear cap-binding protein subunit 2 (10-20)
cgcagcgacuccuacguggagcugagccaguac

SEQ ID NO: 33425 - RNA, 36 nt, Artificial Sequence
  Methyltransferase-like protein 22 (16-27)
cgcagcgacaccgugcuguccgacguccaccucuac

SEQ ID NO: 33426 - RNA, 45 nt, Artificial Sequence
  Eukaryotic translation initiation factor 3 subunit E (431-445)
cgcagcgaggcccccaacugggccacccaggacuccggcuucuac

SEQ ID NO: 33427 - RNA, 30 nt, Artificial Sequence
  F-box only protein 9 (210-219)
cgcaccgacgccauccugcucggccacuac

SEQ ID NO: 33428 - RNA, 33 nt, Artificial Sequence
  General transcription factor II-I repeat domain-containing protein 2B (69-79)
cgcaccgacuuccagaaggacuucgccaaguac

SEQ ID NO: 33429 - RNA, 27 nt, Artificial Sequence
  Cytoplasmic dynein 1 heavy chain 1 (3544-3552)
cgcaccgacaucgcccggaccgaguac

SEQ ID NO: 33430 - RNA, 36 nt, Artificial Sequence
  ERI1 exoribonuclease 3 (98-109)
cgcaccauggagaucgagagcaccuuccacauguac

SEQ ID NO: 33431 - RNA, 30 nt, Artificial Sequence
  U5 small nuclear ribonucleoprotein 200 kDa helicase (666-675)
cgcguggaccccgccaagggccuguucuac

SEQ ID NO: 33432 - RNA, 30 nt, Artificial Sequence
  DmX-like protein 2 (729-738)
cgcguggaccccaucggcccgcugagcuac

SEQ ID NO: 33433 - RNA, 27 nt, Artificial Sequence
  Serine/threonine-protein kinase SMG1 (32-40)
agcgccgaccccggcaaccugaaguac

SEQ ID NO: 33434 - RNA, 27 nt, Artificial Sequence
  DNA mismatch repair protein Msh6 (340-348)
agcgacucccuggugcagaagggcuac

SEQ ID NO: 33435 - RNA, 33 nt, Artificial Sequence
  GPI transamidase component PIG-T (52-62)
agcgagcugcagcgcgagggcgugucccacuac

SEQ ID NO: 33436 - RNA, 33 nt, Artificial Sequence
  Ectonucleotide pyrophosphatase/phosphodiesterase family member 2 (308-318)
agcgagcagcccgacuucuccggccacaaguac

SEQ ID NO: 33437 - RNA, 30 nt, Artificial Sequence
  Protein YIPF5 (17-26)
agcaucgacgaccagucccagcagagcuac

SEQ ID NO: 33438 - RNA, 30 nt, Artificial Sequence
  E3 ubiquitin-protein ligase HECTD1 (532-541)
agcaucgagcgccugccccuccaccuguac

SEQ ID NO: 33439 - RNA, 33 nt, Artificial Sequence
  Creatine kinase B-type (164-174)
agccuggacggcgaccucgccgggcgcuacuac

SEQ ID NO: 33440 - RNA, 33 nt, Artificial Sequence
  Protein FAM91A1 (206-216)
agccuggacuacaacgugguccacucccucuac

SEQ ID NO: 33441 - RNA, 27 nt, Artificial Sequence
  Cytochrome c oxidase subunit 4 isoform 1, mitochondrial (36-44)
agcauggacgagaagguggagcuguac

SEQ ID NO: 33442 - RNA, 30 nt, Artificial Sequence
  Paired box protein Pax-3 (312-321)
agcauggaccccgugaccggcuaccaguac

SEQ ID NO: 33443 - RNA, 30 nt, Artificial Sequence
  Heat shock protein HSP 90-alpha (174-183)
agcuccgacgcccuggacaagauccgcuac

SEQ ID NO: 33444 - RNA, 33 nt, Artificial Sequence
  Integrin beta-3 (536-546)
agcuccgacuucggcaagaucaccgggaaguac

SEQ ID NO: 33445 - RNA, 33 nt, Artificial Sequence
  Protein SEC13 homolog (124-134)
agcuccgacggcgccaucagccugcucaccuac

SEQ ID NO: 33446 - RNA, 30 nt, Artificial Sequence
  Nucleoporin GLE1 (16-25)
agcuccgacaagggccgccugugcuacuac

SEQ ID NO: 33447 - RNA, 27 nt, Artificial Sequence
  Histone-lysine N-methyltransferase SETDB2 (309-317)
agcuccgacaagaucaccaccggcuac

SEQ ID NO: 33448 - RNA, 30 nt, Artificial Sequence
  Scm-like with four MBT domains protein 1 (201-210)
agcuccgacaacuacgagcacuggcuguac

SEQ ID NO: 33449 - RNA, 30 nt, Artificial Sequence
  Forkhead box protein M1 (39-48)
agcuccgaccccgccagccagcuguccuac

SEQ ID NO: 33450 - RNA, 33 nt, Artificial Sequence
  Protein kinase C and casein kinase substrate in neurons protein 2 (14-24)
agcuccgacagcuucugggaggugggcaacuac

SEQ ID NO: 33451 - RNA, 36 nt, Artificial Sequence
  Vacuolar protein sorting-associated protein 51 homolog (377-388)
agcuccgacagcuccaagcgcaccuucagcguguac

SEQ ID NO: 33452 - RNA, 30 nt, Artificial Sequence
  Clathrin interactor 1 (163-172)
agcuccgacagcgugggcggguuccgcuac

SEQ ID NO: 33453 - RNA, 33 nt, Artificial Sequence
  Protein FAM189B (167-177)
agcuccgacaccgccgacuuccgcgaccuguac

SEQ ID NO: 33454 - RNA, 33 nt, Artificial Sequence
  WD40 repeat-containing protein SMU1 (7-17)
agcuccgacgugauccgccugaucaugcaguac

SEQ ID NO: 33455 - RNA, 30 nt, Artificial Sequence
  Archaemetzincin-2 (168-177)
agcuccgacuacagcaucuucgacaacuac

SEQ ID NO: 33456 - RNA, 27 nt, Artificial Sequence
  Nuclear receptor-interacting protein 1 (271-279)
agcuccgaggcccaccugcagcaguac

SEQ ID NO: 33457 - RNA, 27 nt, Artificial Sequence
  KIF1-binding protein (164-172)
agcuccgaggcccuguacaaccaguac

SEQ ID NO: 33458 - RNA, 39 nt, Artificial Sequence
  DNA-dependent protein kinase catalytic subunit (3366-3378)
agcuccgaggacagcgagaaggugaucgccggccuguac

SEQ ID NO: 33459 - RNA, 30 nt, Artificial Sequence
  Protein C-ets-1 (192-201)
agcuccgaggagcugcucagccugaaguac

SEQ ID NO: 33460 - RNA, 33 nt, Artificial Sequence
  UPF0769 protein C21orf59 (235-245)
agcuccgaggagcagaagcagcugaugcucuac

SEQ ID NO: 33461 - RNA, 33 nt, Artificial Sequence
  Protein-glutamate O-methyltransferase (271-281)
agcuccgagcuggccaccgaggugcacuucuac

SEQ ID NO: 33462 - RNA, 27 nt, Artificial Sequence
  Trafficking protein particle complex subunit 3 (15-23)
agcuccgagcuguucacccucaccuac

SEQ ID NO: 33463 - RNA, 30 nt, Artificial Sequence
  Centriole, cilia and spindle-associated protein (253-262)
agcuccgagaaccccuggaugaccgaguac

SEQ ID NO: 33464 - RNA, 33 nt, Artificial Sequence
  Proline and serine-rich protein 1 (34-44)
agcuccgagcagguggucgaccugcuccgcuac

SEQ ID NO: 33465 - RNA, 30 nt, Artificial Sequence
  Ubiquitin carboxyl-terminal hydrolase 38 (207-216)
agcuccgagagcggccacuacuacuccuac

SEQ ID NO: 33466 - RNA, 30 nt, Artificial Sequence
  DNA-dependent protein kinase catalytic subunit (556-565)
agcuccgagagccugaaccaccuccuguac

SEQ ID NO: 33467 - RNA, 42 nt, Artificial Sequence
  Single Ig IL-1-related receptor (382-395)
agcuccgagguggacgucagcgaccugggcucccgcaacuac

SEQ ID NO: 33468 - RNA, 33 nt, Artificial Sequence
  ELAV-like protein 1 (99-109)
agcuccgaggugaucaaggacgccaaccuguac

SEQ ID NO: 33469 - RNA, 33 nt, Artificial Sequence
  Protein FAM65B (857-867)
agcuccgagguggucaccguguuccaguacuac

SEQ ID NO: 33470 - RNA, 36 nt, Artificial Sequence
  Interferon-induced, double-stranded RNA-activated protein kinase (420-431)
agcucccaggacuacggcaaggagguggaccuguac

SEQ ID NO: 33471 - RNA, 36 nt, Artificial Sequence
  Histone-arginine methyltransferase CARM1 (405-416)
agcaccgcccccaccgagccgcugacgcacugguac

SEQ ID NO: 33472 - RNA, 39 nt, Artificial Sequence
  Protein HIRA (392-404)
agcaccgccgugaucgagaaccccgagaugcugaaguac

SEQ ID NO: 33473 - RNA, 33 nt, Artificial Sequence
  Nucleoprotein TPR (1876-1886)
agcaccgacggcgagguggagacccaggucuac

SEQ ID NO: 33474 - RNA, 30 nt, Artificial Sequence
  Recombining binding protein suppressor of hairless (318-327)
agcaccgacaaggccgaguacaccuucuac

SEQ ID NO: 33475 - RNA, 33 nt, Artificial Sequence
  Holliday junction recognition protein (523-533)
agcaccgacaaggccuccauggaggugcgcuac

SEQ ID NO: 33476 - RNA, 24 nt, Artificial Sequence
  Eukaryotic translation initiation factor 3 subunit I (111-118)
agcaccgacaagcagaugggcuac

SEQ ID NO: 33477 - RNA, 33 nt, Artificial Sequence
  Myocyte-specific enhancer factor 2A (59-69)
agcaccgacauggacaaggugcugcucaaguac

SEQ ID NO: 33478 - RNA, 33 nt, Artificial Sequence
  Integrin alpha-5 (179-189)
agcaccgacaacuucacccgcauccuggaguac

SEQ ID NO: 33479 - RNA, 30 nt, Artificial Sequence
  Nuclear pore complex protein Nup93 (541-550)
agcaccgacccccgcgaggcccugcaguac

SEQ ID NO: 33480 - RNA, 30 nt, Artificial Sequence
  Immunoglobulin superfamily member 8 (131-140)
agcaccgacacccgcuaccugggcuccuac

SEQ ID NO: 33481 - RNA, 45 nt, Artificial Sequence
  RNA-binding protein FUS (44-58)
agcaccgacaccuccggcuacgggcagagcuccuacagcuccuac

SEQ ID NO: 33482 - RNA, 30 nt, Artificial Sequence
  Signal-induced proliferation-associated 1-like protein 1 (909-918)
agcaccgacaccucccugaagaucuucuac

SEQ ID NO: 33483 - RNA, 36 nt, Artificial Sequence
  Eukaryotic translation initiation factor 2A (264-275)
agcaccgacguggacaagaccggcgccuccuacuac

SEQ ID NO: 33484 - RNA, 33 nt, Artificial Sequence
  26S proteasome non-ATPase regulatory subunit 8 (239-249)
agcaccgagcuggccaagcaggugaucgaguac

SEQ ID NO: 33485 - RNA, 27 nt, Artificial Sequence
  Asparagine-tRNA ligase, cytoplasmic (174-182)
agcaccgaguccagcguggccgucuac

SEQ ID NO: 33486 - RNA, 36 nt, Artificial Sequence
  Mitochondrial import inner membrane translocase subunit Tim17-A (156-167)
agcacccagcugcccuccagcccguucggcgacuac

SEQ ID NO: 33487 - RNA, 27 nt, Artificial Sequence
  Zinc finger protein 106 (662-670)
agcaccuccgagaucggcacccgcuac

SEQ ID NO: 33488 - RNA, 27 nt, Artificial Sequence
  Protein strawberry notch homolog 1 (1169-1177)
agcaccuccggccacguggagcuguac

SEQ ID NO: 33489 - RNA, 33 nt, Artificial Sequence
  T-complex protein 1 subunit epsilon (270-280)
agcguggaggacuacaaggcccugcagaaguac

SEQ ID NO: 33490 - RNA, 30 nt, Artificial Sequence
  Glutamine-fructose-6-phosphate aminotransferase (isomerizing) 1 (444-453)
accgccgacacccugaugggccuccgcuac

SEQ ID NO: 33491 - RNA, 36 nt, Artificial Sequence
  Splicing factor 3B subunit 6 (31-42)
accgccgaggagauguacgacaucuucggcaaguac

SEQ ID NO: 33492 - RNA, 30 nt, Artificial Sequence
  Annexin A11 (431-440)
accgaccugcucgacauccgcagcgaguac

SEQ ID NO: 33493 - RNA, 30 nt, Artificial Sequence
  RNA binding motif protein 22 (244-253)
accgagaccgaccugcgcaaccacuucuac

SEQ ID NO: 33494 - RNA, 33 nt, Artificial Sequence
  Glutamine-tRNA ligase (47-57)
accaucgacaaggccaccggcauccugcucuac

SEQ ID NO: 33495 - RNA, 30 nt, Artificial Sequence
  Pre-mRNA-splicing factor ATP-dependent RNA helicase DHX15 (294-303)
acccuggacgccggcaaguuccagaucuac

SEQ ID NO: 33496 - RNA, 30 nt, Artificial Sequence
  ATP-dependent RNA helicase DHX8 (717-726)
acccuggacgccgugaaguucagccaguac

SEQ ID NO: 33497 - RNA, 30 nt, Artificial Sequence
  BRCA2-interacting transcriptional repressor EMSY (945-954)
acccuggacccccagaccggccucuucuac

SEQ ID NO: 33498 - RNA, 39 nt, Artificial Sequence
  A-kinase anchor protein 11 (1443-1455)
acccuggaccccuaccgcaacgaggugagccagcucuac

SEQ ID NO: 33499 - RNA, 27 nt, Artificial Sequence
  E3 SUMO-protein ligase NSE2 (70-78)
acccuggaccgccagcucaaccacuac

SEQ ID NO: 33500 - RNA, 36 nt, Artificial Sequence
  TOX high mobility group box family member 4 (105-116)
accauggaccuggaccacagcaucggcacccaguac

SEQ ID NO: 33501 - RNA, 30 nt, Artificial Sequence
  Dynein light chain roadblock-type 1 (40-49)
accauggacaaccccaccacgacccaguac

SEQ ID NO: 33502 - RNA, 33 nt, Artificial Sequence
  Retinal dehydrogenase 1 (105-115)
accauggagagcaugaacggcgggaagcuguac

SEQ ID NO: 33503 - RNA, 42 nt, Artificial Sequence
  Alpha-N-acetylglucosaminidase (545-558)
accagcgcccccucccuggccaccagcccggcguuccgcuac

SEQ ID NO: 33504 - RNA, 30 nt, Artificial Sequence
  Cytoplasmic dynein 1 heavy chain 1 (1163-1172)
accagcgacgccgugaccuucaucacguac

SEQ ID NO: 33505 - RNA, 30 nt, Artificial Sequence
  G1/S-specific cyclin-E2 (81-90)
accagcgacuucucccgcuucaccaacuac

SEQ ID NO: 33506 - RNA, 33 nt, Artificial Sequence
  E3 SUMO-protein ligase RanBP2 (1071-1081)
accagcgacaagccccugcagggcgacggguac

SEQ ID NO: 33507 - RNA, 33 nt, Artificial Sequence
  Endoplasmic reticulum metallopeptidase 1 (361-371)
accagcgacaugcuggccgccgcguccaaguac

SEQ ID NO: 33508 - RNA, 33 nt, Artificial Sequence
  Fizzy-related protein homolog (81-91)
accagcgacaacggcaaggacgggcuggccuac

SEQ ID NO: 33509 - RNA, 27 nt, Artificial Sequence
  Beta-hexosaminidase subunit alpha (32-40)
accagcgaccagcgcuacgugcuguac

SEQ ID NO: 33510 - RNA, 30 nt, Artificial Sequence
  Leucine-rich repeat flightless-interacting protein 1 (241-250)
accagcgacacccugaacaacgugggcuac

SEQ ID NO: 33511 - RNA, 33 nt, Artificial Sequence
  Protein SDE2 homolog (58-68)
accagcgacaccgugcagcacggcgccgucuac

SEQ ID NO: 33512 - RNA, 36 nt, Artificial Sequence
  Uncharacterized protein C15orf41 (61-72)
accagcgaggccaucgaguccuacuaccagcgcuac

SEQ ID NO: 33513 - RNA, 27 nt, Artificial Sequence
  High affinity cAMP-specific and IBMX-insensitive 3',5'-cyclic phosphodiesterase 8A (115-123)
accagcgaggaccgcuucauccaguac

SEQ ID NO: 33514 - RNA, 36 nt, Artificial Sequence
  Caprin-1 (438-449)
accagcgagggcuacaccgccucccagccccuguac

SEQ ID NO: 33515 - RNA, 39 nt, Artificial Sequence
  Endoplasmin (188-200)
accagcgagcugaucggccaguucggggugggcuucuac

SEQ ID NO: 33516 - RNA, 33 nt, Artificial Sequence
  Sodium/potassium-transporting ATPase subunit alpha-2 (19-29)
accagcgagcagcuggacgacauccucaaguac

SEQ ID NO: 33517 - RNA, 27 nt, Artificial Sequence
  Putative pre-mRNA-splicing factor ATP-dependent RNA helicase DHX16 (487-495)
accagcgagcgcaccgugcugcgguac

SEQ ID NO: 33518 - RNA, 27 nt, Artificial Sequence
  Neuroplastin (57-65)
accagcuccagccacacccugacguac

SEQ ID NO: 33519 - RNA, 36 nt, Artificial Sequence
  Unconventional myosin-Va (1775-1786)
accaccgcccagaucgugaagguccugaaccucuac

SEQ ID NO: 33520 - RNA, 30 nt, Artificial Sequence
  Leukotriene A-4 hydrolase (421-430)
accaccgacgacuggaaggacuuccuguac

SEQ ID NO: 33521 - RNA, 33 nt, Artificial Sequence
  DNA-directed RNA polymerases I and III subunit RPAC1 (26-36)
accaccgacuuccccggcaacuacagcggguac

SEQ ID NO: 33522 - RNA, 27 nt, Artificial Sequence
  Mitotic spindle assembly checkpoint protein MAD2A (56-64)
accaccgaccuggagcucaucaaguac

SEQ ID NO: 33523 - RNA, 30 nt, Artificial Sequence
  Ubiquitin-like modifier-activating enzyme 6 (145-154)
accaccgaccugagcuuccucgacaaguac

SEQ ID NO: 33524 - RNA, 39 nt, Artificial Sequence
  Exosome complex component RRP4 (34-46)
accaccgacacgggcuucaugcgcgggcacggcaccuac

SEQ ID NO: 33525 - RNA, 27 nt, Artificial Sequence
  SET domain-containing protein 4 (60-68)
accaccgacacggugauccgcagcuac

SEQ ID NO: 33526 - RNA, 30 nt, Artificial Sequence
  Transmembrane protein 70, mitochondrial (28-37)
accaccgacacguacaaggccaucaccuac

SEQ ID NO: 33527 - RNA, 27 nt, Artificial Sequence
  Enhancer of filamentation 1 (432-440)
accaccgacuggcgcugcuacggcuac

SEQ ID NO: 33528 - RNA, 36 nt, Artificial Sequence
  Matrin-3 (444-455)
accaccgaggacgcccaggccgcgguggacuacuac

SEQ ID NO: 33529 - RNA, 30 nt, Artificial Sequence
  Superkiller viralicidic activity 2-like 2 (229-238)
accaccgagauccugcgcagcaugcucuac

SEQ ID NO: 33530 - RNA, 36 nt, Artificial Sequence
  TBCC domain-containing protein 1 (479-490)
accaccgagauccccggcgggcugccgagcguguac

SEQ ID NO: 33531 - RNA, 39 nt, Artificial Sequence
  DNA damage-binding protein 1 (894-906)
accaccgagaaggagcugcgcacggagugcaaccacuac

SEQ ID NO: 33532 - RNA, 36 nt, Artificial Sequence
  Mitotic spindle assembly checkpoint protein MAD1 (643-654)
accaccgagaaccaguaccgccugacgagccucuac

SEQ ID NO: 33533 - RNA, 39 nt, Artificial Sequence
  Akirin-2 (77-89)
accaccgagcagauccuguacaacaucaagcaggaguac

SEQ ID NO: 33534 - RNA, 30 nt, Artificial Sequence
  vacuolar protein sorting-associated protein 26A isoform 3 (217-226)
accaccgagacggagaccaucgccaaguac

SEQ ID NO: 33535 - RNA, 39 nt, Artificial Sequence
  BCL2/adenovirus E1B 19 kDa protein-interacting protein 2 (168-180)
accaccgaggugauccgcaagggcagcaucacggaguac

SEQ ID NO: 33536 - RNA, 27 nt, Artificial Sequence
  ADP-sugar pyrophosphatase (192-200)
accguggacgcccgcgucuacagcuac

SEQ ID NO: 33537 - RNA, 27 nt, Artificial Sequence
  U3 small nucleolar RNA-associated protein 15 homolog (108-116)
accguggacuucaccgccgacaaguac

SEQ ID NO: 33538 - RNA, 30 nt, Artificial Sequence
  Fascin (484-493)
accguggaccccgccagccugugggaguac

SEQ ID NO: 33539 - RNA, 30 nt, Artificial Sequence
  Proteasome subunit alpha type-7 (97-106)
accguggaggaccccgucaccguggaguac

SEQ ID NO: 33540 - RNA, 36 nt, Artificial Sequence
  14-3-3 protein epsilon (38-49)
accguggaggagcgcaaccugcucagcgucgccuac

SEQ ID NO: 33541 - RNA, 36 nt, Artificial Sequence
  Importin-11 (432-443)
accguggaggagaccggcggggacagcuggaaguac

SEQ ID NO: 33542 - RNA, 36 nt, Artificial Sequence
  Nodal modulator 2 (271-282)
accgugagccgcgaggacggcuccuucagcuucuac

SEQ ID NO: 33543 - RNA, 33 nt, Artificial Sequence
  Tetratricopeptide repeat protein 13 (506-516)
guggccgaccgccugggcagccucaugcaguac

SEQ ID NO: 33544 - RNA, 39 nt, Artificial Sequence
  Proteasome subunit beta type-4 (85-97)
gugaucgacgaggagcugcucggcgacgggcacagcuac

SEQ ID NO: 33545 - RNA, 30 nt, Artificial Sequence
  Tubulin alpha-1C chain (144-153)
gugaucgacgagguccgcaccggcaccuac

SEQ ID NO: 33546 - RNA, 36 nt, Artificial Sequence
  Spindlin-3 (381-392)
gugaucgacagccuggucggcaagcagguggaguac

SEQ ID NO: 33547 - RNA, 30 nt, Artificial Sequence
  Protein HIRA (395-404)
gugaucgagaaccccgagaugcugaaguac

SEQ ID NO: 33548 - RNA, 27 nt, Artificial Sequence
  Beta-hexosaminidase subunit alpha (60-68)
gugcuggacgaggccuuccagcgcuac

SEQ ID NO: 33549 - RNA, 27 nt, Artificial Sequence
  LETM1 and EF-hand domain-containing protein 1, mitochondrial (157-165)
gugcuggacgagcucaagcacuacuac

SEQ ID NO: 33550 - RNA, 27 nt, Artificial Sequence
  Activating signal cointegrator 1 complex subunit 2 (386-394)
gugcuggacgagacccgcaccgccuac

SEQ ID NO: 33551 - RNA, 36 nt, Artificial Sequence
  DNA-directed RNA polymerase I subunit RPA1 (748-759)
gugcuggacaaggcccacuacggcagcuccgccuac

SEQ ID NO: 33552 - RNA, 36 nt, Artificial Sequence
  Nucleolar protein 14 (322-333)
gugcuggacaaggacgaccgccggcuccugagcuac

SEQ ID NO: 33553 - RNA, 30 nt, Artificial Sequence
  ATP-binding cassette sub-family B member 10, mitochondrial (194-203)
gugcuggaccagggcaagaucaccgaguac

SEQ ID NO: 33554 - RNA, 27 nt, Artificial Sequence
  Kinesin-like protein KIF18B (102-110)
gugcuggacagcuuccuccagggcuac

SEQ ID NO: 33555 - RNA, 27 nt, Artificial Sequence
  Ubiquitin-conjugating enzyme E2 Z (270-278)
gugauggagaagagcuuccuggaguac

SEQ ID NO: 33556 - RNA, 27 nt, Artificial Sequence
  Elongator complex protein 1 (872-880)
gugagcgccgaggaggcccugaaguac

SEQ ID NO: 33557 - RNA, 36 nt, Artificial Sequence
  DNA repair protein XRCC4 (166-177)
gugagcgccaaggaggcccuggagaccgaccucuac

SEQ ID NO: 33558 - RNA, 27 nt, Artificial Sequence
  FERM domain-containing protein 4A (924-932)
gugagcgacgagcugcgccagugguac

SEQ ID NO: 33559 - RNA, 30 nt, Artificial Sequence
  Constitutive coactivator of peroxisome proliferator-activated receptor gamma (279-288)
gugagcgaccacaucuccaagguccuguac

SEQ ID NO: 33560 - RNA, 36 nt, Artificial Sequence
  Importin-5 (842-853)
gugagcgacauccugcacuccaucuucagcuccuac

SEQ ID NO: 33561 - RNA, 36 nt, Artificial Sequence
  Splicing factor 1 (136-147)
gugagcgacaaggucaugaucccccaggacgaguac

SEQ ID NO: 33562 - RNA, 27 nt, Artificial Sequence
  Phosphatidylinositol 4-phosphate 3-kinase C2 domain-containing subunit beta (917-925)
gugagcgaccugcgcgucacccacuac

SEQ ID NO: 33563 - RNA, 30 nt, Artificial Sequence
  Acetyl-coenzyme A transporter 1 (439-448)
gugagcgacccccugaucggcgggaccuac

SEQ ID NO: 33564 - RNA, 39 nt, Artificial Sequence
  Zinc finger protein 275 (31-43)
gugagcgaccccuccccgaacaccgaccccgccaaguac

SEQ ID NO: 33565 - RNA, 36 nt, Artificial Sequence
  Tripeptidyl-peptidase 1 (68-79)
gugagcgaccccuccagcccgcaguacggcaaguac

SEQ ID NO: 33566 - RNA, 39 nt, Artificial Sequence
  Tripeptidyl-peptidase 1 (68-80)
gugagcgaccccuccagcccgcaguacggcaaguaccug

SEQ ID NO: 33567 - RNA, 33 nt, Artificial Sequence
  Cleavage and polyadenylation specificity factor subunit 1 (1271-1281)
gugagcgaccgcgaccggaaccugauggucuac

SEQ ID NO: 33568 - RNA, 36 nt, Artificial Sequence
  TELO2-interacting protein 1 homolog (40-51)
gugagcgacuccgcccugcaggagcuccagcaguac

SEQ ID NO: 33569 - RNA, 30 nt, Artificial Sequence
  E3 ubiquitin-protein ligase HACE1 (749-758)
gugagcgacuggaucaagaacaccgaguac

SEQ ID NO: 33570 - RNA, 27 nt, Artificial Sequence
  AT-rich interactive domain-containing protein 2 (138-146)
gugagcgacuaccugcgccaguccuac

SEQ ID NO: 33571 - RNA, 33 nt, Artificial Sequence
  Dolichyl-diphosphooligosaccharide-proteinosyltransferase subunit 2 (116-126)
gugagcgaggacuccagcgucacccagaucuac

SEQ ID NO: 33572 - RNA, 33 nt, Artificial Sequence
  Histone H2B type 1-A (113-123)
gugagcgagggcaccaaggccgucaccaaguac

SEQ ID NO: 33573 - RNA, 36 nt, Artificial Sequence
  Tetraspanin-33 (126-137)
gugagcgagaucaucaacaacgccaucguccacuac

SEQ ID NO: 33574 - RNA, 27 nt, Artificial Sequence
  Peroxisome assembly factor 2 (962-970)
gugagcgagcaggagcugcuccgcuac

SEQ ID NO: 33575 - RNA, 30 nt, Artificial Sequence
  TraB domain-containing protein (260-269)
gugagcgagcgcgacgucuaccugaccuac

SEQ ID NO: 33576 - RNA, 39 nt, Artificial Sequence
  Paired amphipathic helix protein Sin3a (44-56)
gugagcgagaccaugcaguccgccaccggcauccaguac

SEQ ID NO: 33577 - RNA, 45 nt, Artificial Sequence
  Nuclear pore complex protein Nup160 (1171-1185)
gugagcgaguacgucgacgccgugcugggcaaggggcaccaguac

SEQ ID NO: 33578 - RNA, 36 nt, Artificial Sequence
  Oral-facial-digital syndrome 1 protein (787-798)
gugagcucccccccggagcagaaggucggccuguac

SEQ ID NO: 33579 - RNA, 33 nt, Artificial Sequence
  Zinc finger protein 106 (703-713)
gugagcuccaccagcgagaucggcacccgcuac

SEQ ID NO: 33580 - RNA, 39 nt, Artificial Sequence
  Nuclear factor of activated T-cells, cytoplasmic 1 (282-294)
gugaccgacgacagcuggcugggcaacaccacgcaguac

SEQ ID NO: 33581 - RNA, 36 nt, Artificial Sequence
  Mediator of RNA polymerase II transcription subunit 27 (204-215)
gugaccgaccacgccaccacggcccugcuccacuac

SEQ ID NO: 33582 - RNA, 30 nt, Artificial Sequence
  DnaJ homolog subfamily B member 12 (287-296)
gugaccgaccaccugggcgucguguacuac

SEQ ID NO: 33583 - RNA, 33 nt, Artificial Sequence
  Telomerase protein component 1 (1368-1378)
gugaccgaccaccugcgccucuucacccuguac

SEQ ID NO: 33584 - RNA, 36 nt, Artificial Sequence
  TBC1 domain family member 8 (757-768)
gugaccgacaucagcgaccugauccgcgacuccuac

SEQ ID NO: 33585 - RNA, 30 nt, Artificial Sequence
  Protein MEF2BNB (13-22)
gugaccgacaaguucaccgagagcgucuac

SEQ ID NO: 33586 - RNA, 36 nt, Artificial Sequence
  Complex I assembly factor TMEM126B, mitochondrial (46-57)
gugaccgacaagcuguucgucaucgacgcccucuac

SEQ ID NO: 33587 - RNA, 39 nt, Artificial Sequence
  Histone acetyltransferase type B catalytic subunit (339-351)
gugaccgacaugagcgacgccgagcaguaccgcuccuac

SEQ ID NO: 33588 - RNA, 36 nt, Artificial Sequence
  Afadin (762-773)
gugaccgaccccgacagcggccugugcucccacuac

SEQ ID NO: 33589 - RNA, 30 nt, Artificial Sequence
  Cation-independent mannose-6-phosphate receptor (769-778)
gugaccgaccccagcacccuggagcaguac

SEQ ID NO: 33590 - RNA, 30 nt, Artificial Sequence
  DNA polymerase delta subunit 3 (14-23)
gugaccgaccagaacaagaucgucaccuac

SEQ ID NO: 33591 - RNA, 33 nt, Artificial Sequence
  Gamma-secretase subunit APH-1A (59-69)
gugaccgaccgcagcgacgcccggcugcaguac

SEQ ID NO: 33592 - RNA, 30 nt, Artificial Sequence
  DNA topoisomerase 2-alpha (1118-1127)
gugaccgacagcggccccaccuucaacuac

SEQ ID NO: 33593 - RNA, 30 nt, Artificial Sequence
  Bcl-2-modifying factor (88-97)
gugaccgaggagccccagcgccuguucuac

SEQ ID NO: 33594 - RNA, 33 nt, Artificial Sequence
  Protein SET (135-145)
gugaccgaguucgaggacaucaagagcggcuac

SEQ ID NO: 33595 - RNA, 27 nt, Artificial Sequence
  Epididymis-specific alpha-mannosidase (660-668)
gugaccgagauccgccaguacuucuac

SEQ ID NO: 33596 - RNA, 33 nt, Artificial Sequence
  Ras association domain-containing protein 3 (64-74)
gugaccgagagccccgccaaguucgcccuguac

SEQ ID NO: 33597 - RNA, 30 nt, Artificial Sequence
  WD repeat-containing protein 63 (174-183)
gugaccgagagcaccaagcagaucacguac

SEQ ID NO: 33598 - RNA, 27 nt, Artificial Sequence
  Uncharacterized protein C15orf61 (132-140)
gugaccgagaccguccacacgagcuac

SEQ ID NO: 33599 - RNA, 36 nt, Artificial Sequence
  Nesprin-2 (266-277)
guggucgaccccgacgagaagagcaucaugaccuac

SEQ ID NO: 33600 - RNA, 36 nt, Artificial Sequence
  Spindlin-1 (194-205)
guggucgacagccuggugggcaagcagguggaguac

SEQ ID NO: 33601 - RNA, 39 nt, Artificial Sequence
  Protein transport protein Sec61 subunit alpha isoform 1 (324-336)
uggagcgacaccuccagcggcgggcccgcccgcgccuac

SEQ ID NO: 33602 - RNA, 30 nt, Artificial Sequence
  Cholinesterase (404-413)
uggguggacgaccagcgccccgagaacuac

SEQ ID NO: 33603 - RNA, 39 nt, Artificial Sequence
  Acetyl-CoA carboxylase 1 (1775-1787)
uggguggaccccgaggacccguacaagggcuaccgcuac

SEQ ID NO: 33604 - RNA, 30 nt, Artificial Sequence
  Proteasome subunit beta type-4 (129-138)
uacgccgacggcgagagcuuccugggguac

SEQ ID NO: 33605 - RNA, 30 nt, Artificial Sequence
  DNA polymerase epsilon catalytic subunit A (1792-1801)
uacgccgacaaccaggugaugcacuucuac

SEQ ID NO: 33606 - RNA, 33 nt, Artificial Sequence
  Sorting nexin-4 (300-310)
uacgccgaccagcugaaggaguaccucuucuac

SEQ ID NO: 33607 - RNA, 33 nt, Artificial Sequence
  Cleavage stimulation factor subunit 3 (337-347)
uacgccgacuacgaggagagccgcaugaaguac

SEQ ID NO: 33608 - RNA, 27 nt, Artificial Sequence
  Transmembrane protein 87A (216-224)
uacgccgaguuccagaacauccgcuac

SEQ ID NO: 33609 - RNA, 27 nt, Artificial Sequence
  Transcription elongation factor SPT6 (993-1001)
uacggcgacaagcacaucacccuguac

SEQ ID NO: 33610 - RNA, 33 nt, Artificial Sequence
  Lysyl oxidase homolog 3 (543-553)
uacaucgaggaccgcccccugcacaugcucuac

SEQ ID NO: 33611 - RNA, 36 nt, Artificial Sequence
  High mobility group protein 20A (39-50)
uaccuggacgaggccgaccgcgacaaggagcgguac

SEQ ID NO: 33612 - RNA, 36 nt, Artificial Sequence
  SWI/SNF-related matrix-associated actin-dependent regulator of chromatin subfamily E member 1-related (119-130)
uaccuggacgaggccgagcgcgagaagcagcaguac

SEQ ID NO: 33613 - RNA, 27 nt, Artificial Sequence
  Prostamide/prostaglandin F synthase (122-130)
uaccuggacgagagcaagcagcucuac

SEQ ID NO: 33614 - RNA, 27 nt, Artificial Sequence
  putative RHO/RAC effector protein (1124-1132)
uaccuggacauccccaacccgcgcuac

SEQ ID NO: 33615 - RNA, 24 nt, Artificial Sequence
  Proteasome activator complex subunit 3 (188-195)
uaccuggaccagaucagccgcuac

SEQ ID NO: 33616 - RNA, 36 nt, Artificial Sequence
  E3 ubiquitin-protein ligase TRIM4 (423-434)
uaccuggaccgcggcaccgggaacgugagcuucuac

SEQ ID NO: 33617 - RNA, 33 nt, Artificial Sequence
  U3 small nucleolar RNA-associated protein 6 homolog (480-490)
uaccuggacugggccuaccgcagcggcggguac

SEQ ID NO: 33618 - RNA, 33 nt, Artificial Sequence
  E3 ubiquitin-protein ligase UBR2 (1583-1593)
uaccuggagggcgagcgcgacgccauccgguac

SEQ ID NO: 33619 - RNA, 36 nt, Artificial Sequence
  MAGUK p55 subfamily member 2 (440-451)
uaccuggagcacggcgaguacgaggggaaccucuac

SEQ ID NO: 33620 - RNA, 39 nt, Artificial Sequence
  DNA-directed RNA polymerase II subunit RPB1 (657-669)
uaccuggagaugggccacgacaucacccgccucuucuac

SEQ ID NO: 33621 - RNA, 36 nt, Artificial Sequence
  KIF1-binding protein (161-172)
uaccuggagagcuccgaggcccucuacaaccaguac

SEQ ID NO: 33622 - RNA, 30 nt, Artificial Sequence
  Immediate early response gene 5-like protein (47-56)
uaccugagcgagcgcuacgccgagcucuac

SEQ ID NO: 33623 - RNA, 27 nt, Artificial Sequence
  Cullin-1 (42-50)
uacauggagcuguacacccacguguac

SEQ ID NO: 33624 - RNA, 27 nt, Artificial Sequence
  Far upstream element-binding protein 1 (632-640)
uacagcgccgccugggcggaguacuac

SEQ ID NO: 33625 - RNA, 39 nt, Artificial Sequence
  Nuclear factor erythroid 2-related factor 1 (12-24)
uacagcgcccccccgggcgacccccuguccaccaacuac

SEQ ID NO: 33626 - RNA, 39 nt, Artificial Sequence
  Cohesin subunit SA-2 (319-331)
uacagcgacgccuuccugaacgacuccuaccucaaguac

SEQ ID NO: 33627 - RNA, 30 nt, Artificial Sequence
  Dimethylaniline monooxygenase (N-oxide-forming) 4 (69-78)
uacagcgacuuccccuuccacgaggacuac

SEQ ID NO: 33628 - RNA, 36 nt, Artificial Sequence
  Dihydropyrimidine dehydrogenase (NADP(+)) (211-222)
uacagcgacaucaccaucuucgagaagcaggaguac

SEQ ID NO: 33629 - RNA, 36 nt, Artificial Sequence
  Cyclin-dependent kinases regulatory subunit 2 (8-19)
uacagcgacaaguacuucgacgagcacuacgaguac

SEQ ID NO: 33630 - RNA, 33 nt, Artificial Sequence
  Spermatogenesis-associated protein 20 (357-367)
uacagcgacguggccaagggcauccugcaguac

SEQ ID NO: 33631 - RNA, 33 nt, Artificial Sequence
  F-box only protein 3 (79-89)
uacagcgacgugggccgcuacaucgaccacuac

SEQ ID NO: 33632 - RNA, 27 nt, Artificial Sequence
  AN1-type zinc finger protein 6 (175-183)
uacagcgacgugcacaacugcuccuac

SEQ ID NO: 33633 - RNA, 36 nt, Artificial Sequence
  YTH domain-containing family protein 1 (300-311)
uacagcgaggacgacauccaccgcuccaucaaguac

SEQ ID NO: 33634 - RNA, 30 nt, Artificial Sequence
  Intraflagellar transport protein 122 homolog (415-424)
uacagcgaggaccuguccgacaugcacuac

SEQ ID NO: 33635 - RNA, 33 nt, Artificial Sequence
  SUN domain-containing protein 2 (38-48)
uacagcgaggaccgcaucggccuggccgacuac

SEQ ID NO: 33636 - RNA, 33 nt, Artificial Sequence
  MICOS complex subunit MIC60 (615-625)
uacagcgaggagacccugcgcgcccgguucuac

SEQ ID NO: 33637 - RNA, 39 nt, Artificial Sequence
  45 kDa calcium-binding protein (340-352)
uacagcgaguucuucaccggcuccaagcugguggacuac

SEQ ID NO: 33638 - RNA, 30 nt, Artificial Sequence
  Protein artemis (322-331)
uacagcgagaucaaggacuuccuguccuac

SEQ ID NO: 33639 - RNA, 30 nt, Artificial Sequence
  Integrator complex subunit 6 (86-95)
uacagcgagcugggccaccccuucggguac

SEQ ID NO: 33640 - RNA, 33 nt, Artificial Sequence
  Plectin (1309-1319)
uacagcgagcugaccacccucacgucccaguac

SEQ ID NO: 33641 - RNA, 30 nt, Artificial Sequence
  Vacuolar protein sorting-associated protein 13C (3362-3371)
uacagcgagcaguuccugaagcagauguac

SEQ ID NO: 33642 - RNA, 27 nt, Artificial Sequence
  Protein Lines homolog 1 (181-189)
uacagcgaguccaacaaggccaucuac

SEQ ID NO: 33643 - RNA, 36 nt, Artificial Sequence
  Proline-rich protein 7 (145-156)
uacagcgaggugcugaccgacacccgcggccucuac

SEQ ID NO: 33644 - RNA, 30 nt, Artificial Sequence
  Zinc finger MIZ domain-containing protein 2 (269-278)
uacagcgagguguaccccggccagcaguac

SEQ ID NO: 33645 - RNA, 36 nt, Artificial Sequence
  Annexin A4 (298-309)
uacagcuucaucaagggcgacaccuccggggacuac

SEQ ID NO: 33646 - RNA, 30 nt, Artificial Sequence
  Nucleoporin NUP188 homolog (239-248)
uacagcuuccuggacaagauguccuucuac

SEQ ID NO: 33647 - RNA, 27 nt, Artificial Sequence
  RNA-binding protein 5 (374-382)
uacagccaggacuaccagcaguucuac

SEQ ID NO: 33648 - RNA, 36 nt, Artificial Sequence
  Serine/arginine-rich splicing factor 10 (105-116)
uacagcuccagccgcuacgacgacuacgaccgguac

SEQ ID NO: 33649 - RNA, 27 nt, Artificial Sequence
  Interferon-induced helicase C domain-containing protein 1 (5-13)
uacagcaccgacgagaacuuccgcuac

SEQ ID NO: 33650 - RNA, 27 nt, Artificial Sequence
  Filamin-A (1685-1693)
uacaccgccccccagccgggcaaguac

SEQ ID NO: 33651 - RNA, 36 nt, Artificial Sequence
  DAZ-associated protein 2 (35-46)
uacaccgacgcccccccggccuacagcgagcuguac

SEQ ID NO: 33652 - RNA, 24 nt, Artificial Sequence
  Tetraspanin-4 (107-114)
uacaccgacaagaucgaccgcuac

SEQ ID NO: 33653 - RNA, 30 nt, Artificial Sequence
  Serine/threonine-protein phosphatase PP1-beta catalytic subunit (68-77)
uacaccgaccugcuccgccuguucgaguac

SEQ ID NO: 33654 - RNA, 36 nt, Artificial Sequence
  E3 ubiquitin-protein ligase HUWE1 (157-168)
uacaccgacauggagagcgaggacuaccacuucuac

SEQ ID NO: 33655 - RNA, 33 nt, Artificial Sequence
  Chromodomain-helicase-DNA-binding protein 8 (513-523)
uacaccgaggccgaggaguucuucgugaaguac

SEQ ID NO: 33656 - RNA, 30 nt, Artificial Sequence
  Protein transport protein Sec61 subunit beta (59-68)
uacaccgaggacagccccggccugaaggug

SEQ ID NO: 33657 - RNA, 39 nt, Artificial Sequence
  DNA-directed RNA polymerases I, II, and III subunit RPABC5 (29-41)
uacaccgagggcgacgcccuggacgcccucgggcugaag

SEQ ID NO: 33658 - RNA, 45 nt, Artificial Sequence
  DNA-directed RNA polymerases I, II, and III subunit RPABC5 (29-43)
uacaccgagggcgacgcccuggacgcccucgggcugaagcgcuac

SEQ ID NO: 33659 - RNA, 33 nt, Artificial Sequence
  Ribosomal RNA small subunit methyltransferase NEP1 (207-217)
uacaccgagaagauggugagcaucuccaacuac

SEQ ID NO: 33660 - RNA, 30 nt, Artificial Sequence
  Presenilin-2 (112-121)
uacaccgagaagaacggccagcugaucuac

SEQ ID NO: 33661 - RNA, 33 nt, Artificial Sequence
  Exocyst complex component 4 (66-76)
uacaccgagcugaccacggccauccgcaccuac

SEQ ID NO: 33662 - RNA, 30 nt, Artificial Sequence
  Prolyl 3-hydroxylase 2 (212-221)
uacaccgagcccaacuacuggauccgcuac

SEQ ID NO: 33663 - RNA, 33 nt, Artificial Sequence
  Mitogen-activated protein kinase kinase kinase 1 (1349-1359)
uacaccgagcagcugcuccgcggccugagcuac

SEQ ID NO: 33664 - RNA, 36 nt, Artificial Sequence
  Coiled-coil domain-containing protein 121 (212-223)
uacaccgagcagcccgagaagguguggaacagcuac

SEQ ID NO: 33665 - RNA, 30 nt, Artificial Sequence
  Gamma-secretase subunit PEN-2 (47-56)
uacaccgagcagagccagaucaagggcuac

SEQ ID NO: 33666 - RNA, 27 nt, Artificial Sequence
  Vacuolar protein sorting-associated protein 18 homolog (381-389)
uacaccgagcgcgccguguuccgguac

SEQ ID NO: 33667 - RNA, 36 nt, Artificial Sequence
  Osteoclast-stimulating factor 1 (21-32)
uacaccuucgagccccgcaccccggacgagcuguac

SEQ ID NO: 33668 - RNA, 30 nt, Artificial Sequence
  Cleavage and polyadenylation specificity factor subunit 5 (45-54)
uacaccuucggcaccaaggagccccuguac

SEQ ID NO: 33669 - RNA, 27 nt, Artificial Sequence
  Coatomer subunit alpha (543-551)
uacaccaccagcaaccacaucaaguac

SEQ ID NO: 33670 - RNA, 33 nt, Artificial Sequence
  Nodal modulator 2 (270-280)
uacaccgugagccgcgaggacggcuccuucagc

SEQ ID NO: 33671 - RNA, 39 nt, Artificial Sequence
  Nodal modulator 2 (270-282)
uacaccgugagccgcgaggacggcuccuucagcuucuac

SEQ ID NO: 33672 - RNA, 36 nt, Artificial Sequence
  Nuclear pore complex protein Nup160 (1174-1185)
uacguggacgccguccugggcaaggggcaccaguac

SEQ ID NO: 33673 - RNA, 30 nt, Artificial Sequence
  General transcription factor 3C polypeptide 1 (627-636)
uacguggacgacgccagcuggaugcgcuac

SEQ ID NO: 33674 - RNA, 27 nt, Artificial Sequence
  39S ribosomal protein L35, mitochondrial (172-180)
uacguggacgaccccuaccagaaguac

SEQ ID NO: 33675 - RNA, 30 nt, Artificial Sequence
  UDP-N-acetylhexosamine pyrophosphorylase-like protein 1 (277-286)
uacguggacgaggagggcaaccuggucaag

SEQ ID NO: 33676 - RNA, 36 nt, Artificial Sequence
  RNA-binding protein 39 (436-447)
uacguggacaagaacagcgcccagggcaacgucuac

SEQ ID NO: 33677 - RNA, 27 nt, Artificial Sequence
  Thioredoxin-like protein AAED1 (118-126)
uacguggaccccgagcgcgagaucuac

SEQ ID NO: 33678 - RNA, 33 nt, Artificial Sequence
  Transmembrane emp24 domain-containing protein 3 (68-78)
uacguggaggacccccagggcaacaccaucuac

SEQ ID NO: 33679 - RNA, 27 nt, Artificial Sequence
  Vacuole membrane protein 1 (94-102)
uacguggagggcguccaccagcaguac

SEQ ID NO: 33680 - RNA, 33 nt, Artificial Sequence
  Eukaryotic translation initiation factor 3 subunit K (32-42)
uacguggagacccaggccaaggagaacgccuac

SEQ ID NO: 33681 - RNA, 30 nt, Artificial Sequence
  Serine/threonine-protein kinase mTOR (89-98)
gccaucgccagccugaucggcguggagggg

SEQ ID NO: 33682 - RNA, 27 nt, Artificial Sequence
  Eukaryotic translation initiation factor 4 gamma 1 (1248-1256)
gccaucaucgaggaguaccugcaccuc

SEQ ID NO: 33683 - RNA, 27 nt, Artificial Sequence
  Protein timeless homolog (848-856)
gccauccuggcccaccucaacaccgug

SEQ ID NO: 33684 - RNA, 27 nt, Artificial Sequence
  Zinc finger and BTB domain-containing protein 6 (396-404)
gcccugaagaagcaccucaccagcgug

SEQ ID NO: 33685 - RNA, 27 nt, Artificial Sequence
  Small subunit processome component 20 homolog (626-634)
gcccugauggagcucuuccccaagcug

SEQ ID NO: 33686 - RNA, 27 nt, Artificial Sequence
  Ribosome-binding protein 1 (124-132)
gcccugcagaagcgccucgacgaggug

SEQ ID NO: 33687 - RNA, 30 nt, Artificial Sequence
  Cytochrome c oxidase subunit 7A2, mitochondrial (74-83)
gccguggccagcuuccccaagaagcaggag

SEQ ID NO: 33688 - RNA, 27 nt, Artificial Sequence
  DNA-dependent protein kinase catalytic subunit (145-153)
gacgaguucaagaucggcgagcuguuc

SEQ ID NO: 33689 - RNA, 27 nt, Artificial Sequence
  Exosome component 10 (58-66)
gacgaguacgacuucuaccgcagcuuc

SEQ ID NO: 33690 - RNA, 42 nt, Artificial Sequence
  Peptidyl-prolyl cis-trans isomerase A (9-22)
gacaucgccguggacggcgagccccuggggcgcgucagcuuc

SEQ ID NO: 33691 - RNA, 63 nt, Artificial Sequence
  Endoplasmin (783-803)
gacgugggcaccgacgaggaggaggagaccgccaaggagagcacggccgagaaggacgagcug

SEQ ID NO: 33692 - RNA, 27 nt, Artificial Sequence
  Zinc finger protein 638 (1756-1764)
gaggaggacgaggacagccuggccgac

SEQ ID NO: 33693 - RNA, 27 nt, Artificial Sequence
  Inner centromere protein (48-56)
gaguucagcaaggagcccgagcugaug

SEQ ID NO: 33694 - RNA, 27 nt, Artificial Sequence
  ATP-binding cassette sub-family A member 3 (1686-1694)
gagcagguguuccugagcuucgcccac

SEQ ID NO: 33695 - RNA, 30 nt, Artificial Sequence
  Vinculin (10-19)
gagagcauccuggagcccguggcccagcag

SEQ ID NO: 33696 - RNA, 27 nt, Artificial Sequence
  Microtubule-associated protein 1A (806-814)
gagaccgagcugaccuaccccacgaac

SEQ ID NO: 33697 - RNA, 30 nt, Artificial Sequence
  C-Jun-amino-terminal kinase-interacting protein 2 (683-692)
uucgacgugcaguuccugggcagcgucgag

SEQ ID NO: 33698 - RNA, 57 nt, Artificial Sequence
  Cytochrome c oxidase subunit 7C, mitochondrial (45-63)
uucggcagcgccuucgccacccccuuccuggugguccgccaccagcuccugaagacc

SEQ ID NO: 33699 - RNA, 75 nt, Artificial Sequence
  Peptidyl-prolyl cis-trans isomerase A (88-112)
uucauccugaagcacaccggccccgggauccucagcauggccaacgccggcccgaacaccaacgggucccaguuc

SEQ ID NO: 33700 - RNA, 30 nt, Artificial Sequence
  Elongation factor 1-alpha 1 (415-424)
uucagcgacuaccccccgcugggccgcuuc

SEQ ID NO: 33701 - RNA, 42 nt, Artificial Sequence
  Elongation factor 1-beta (2-15)
ggcuucggggaccugaagagccccgccggccuccaggugcug

SEQ ID NO: 33702 - RNA, 69 nt, Artificial Sequence
  Elongation factor 1-beta (2-24)
ggcuucggggaccugaagagccccgccggccuccaggugcugaacgacuaccuggccgacaaguccuac

SEQ ID NO: 33703 - RNA, 30 nt, Artificial Sequence
  Plakophilin-2 (581-590)
ggccugaucgacagccucgugcacuacguc

SEQ ID NO: 33704 - RNA, 45 nt, Artificial Sequence
  Peptidyl-prolyl cis-trans isomerase A (10-24)
aucgccguggacggcgagccccuggggcgcgucagcuucgagcuc

SEQ ID NO: 33705 - RNA, 27 nt, Artificial Sequence
  39S ribosomal protein L34, mitochondrial (58-66)
aucaagcgcaagaacaagcacggcugg

SEQ ID NO: 33706 - RNA, 27 nt, Artificial Sequence
  Centrosome-associated protein 350 (2297-2305)
auccugagcaagaaggaccucccccug

SEQ ID NO: 33707 - RNA, 48 nt, Artificial Sequence
  Glyceraldehyde-3-phosphate dehydrogenase (269-284)
aucagcugguacgacaacgaguucggcuacuccaaccgcguggucgac

SEQ ID NO: 33708 - RNA, 57 nt, Artificial Sequence
  Macrophage migration inhibitory factor (3-21)
aucgugaacaccaacgucccccgcgccagcgugccggacggcuuccuguccgagcuc

SEQ ID NO: 33709 - RNA, 27 nt, Artificial Sequence
  T-complex protein 1 subunit theta (234-242)
aaguacaacaucaugcuggugcgccuc

SEQ ID NO: 33710 - RNA, 27 nt, Artificial Sequence
  Ras-related protein Rab-27A (178-186)
cuggaccucaucaugaagcgcauggag

SEQ ID NO: 33711 - RNA, 27 nt, Artificial Sequence
  Uncharacterized protein C18orf8 (501-509)
cugcacgagcucgugaucaagacccug

SEQ ID NO: 33712 - RNA, 27 nt, Artificial Sequence
  ER membrane protein complex subunit 1 (641-649)
cugcucaucgacgacgaguacaaggug

SEQ ID NO: 33713 - RNA, 27 nt, Artificial Sequence
  DNA-dependent protein kinase catalytic subunit (2836-2844)
cugcuccaggacuucaaccgcuuccug

SEQ ID NO: 33714 - RNA, 27 nt, Artificial Sequence
  Acyl-CoA desaturase (132-140)
cugccccuccgccuguuccugaucauc

SEQ ID NO: 33715 - RNA, 27 nt, Artificial Sequence
  Serine/threonine-protein kinase tousled-like 1 (49-57)
auggacgagcuggccagccucgacccc

SEQ ID NO: 33716 - RNA, 42 nt, Artificial Sequence
  Protein S100-A4 (59-72)
augagcaaccuggacuccaaccgcgacaacgagguggacuuc

SEQ ID NO: 33717 - RNA, 27 nt, Artificial Sequence
  Centriolin (2174-2182)
aaccugaaccaguuccuccccgagcug

SEQ ID NO: 33718 - RNA, 27 nt, Artificial Sequence
  Transcriptional repressor CTCF (102-110)
aacauggaggagcagcccaucaacauc

SEQ ID NO: 33719 - RNA, 27 nt, Artificial Sequence
  Golgin subfamily A member 3 (875-883)
cgccuggacagcgagcucaaggagcug

SEQ ID NO: 33720 - RNA, 66 nt, Artificial Sequence
  Cytochrome c oxidase subunit 7C, mitochondrial (17-38)
agccacuacgaggagggccccgggaagaaccugccguucuccguggagaacaaguggagccuccug

SEQ ID NO: 33721 - RNA, 33 nt, Artificial Sequence
  Midasin (1471-1481)
agccuggccgacgacuccgugcucgagcgccug

SEQ ID NO: 33722 - RNA, 27 nt, Artificial Sequence
  Cullin-7 (999-1007)
agccugcacaccgagcucaacuccgug

SEQ ID NO: 33723 - RNA, 27 nt, Artificial Sequence
  Small subunit processome component 20 homolog (299-307)
agccugcucgaccugcacaccaaggug

SEQ ID NO: 33724 - RNA, 33 nt, Artificial Sequence
  Death-inducer obliterator 1 (941-951)
agcccccuggaggaccucuccccgugccccgcc

SEQ ID NO: 33725 - RNA, 33 nt, Artificial Sequence
  Glycogen debranching enzyme (980-990)
accaucgccgaggugggcaaguggcugcaggcc

SEQ ID NO: 33726 - RNA, 27 nt, Artificial Sequence
  Inositol 1,4,5-trisphosphate receptor type 3 (2354-2362)
acccuguucaacgugaucaagagcguc

SEQ ID NO: 33727 - RNA, 27 nt, Artificial Sequence
  Transmembrane protein 181 (304-312)
accuacaaccccgccuucagccgccug

SEQ ID NO: 33728 - RNA, 30 nt, Artificial Sequence
  A-kinase anchor protein 9 (1398-1407)
guggacagcgucgugaucaccgaguccgac

SEQ ID NO: 33729 - RNA, 27 nt, Artificial Sequence
  Signal peptidase complex catalytic subunit SEC11A (146-154)
gugcccuacaucggcaucgucaccauc

SEQ ID NO: 33730 - RNA, 27 nt, Artificial Sequence
  E3 ubiquitin-protein ligase MYLIP (431-439)
guguaccugcccacccacaccagccuc

SEQ ID NO: 33731 - RNA, 27 nt, Artificial Sequence
  Guanine nucleotide-binding protein G(i) subunit alpha-2 (155-163)
uacuaccugaacgaccucgagcgcauc

SEQ ID NO: 33732 - RNA, 27 nt, Artificial Sequence
  Peptidyl-prolyl cis-trans isomerase FKBP4 (372-380)
gcccgcgccgacuuccagaaggugcug

SEQ ID NO: 33733 - RNA, 27 nt, Artificial Sequence
  Metaxin-1 (300-308)
gcccgcgcccccggcacccggacccug

SEQ ID NO: 33734 - RNA, 27 nt, Artificial Sequence
  Exosome component 10 (437-445)
gcccgcgacgacacccacuaccugcuc

SEQ ID NO: 33735 - RNA, 33 nt, Artificial Sequence
  Annexin A2 (195-205)
gcccgcgaccuguacgacgccggcgugaagcgg

SEQ ID NO: 33736 - RNA, 27 nt, Artificial Sequence
  Coronin-1C (333-341)
gcccgcuucuucaagcugcacgagcgg

SEQ ID NO: 33737 - RNA, 27 nt, Artificial Sequence
  Uncharacterized protein KIAA1143 (19-27)
gcccgcuucaaggagcgggugggcuac

SEQ ID NO: 33738 - RNA, 30 nt, Artificial Sequence
  Disabled homolog 2 (41-50)
gcccgcuucaagggcgacggggugaaguac

SEQ ID NO: 33739 - RNA, 30 nt, Artificial Sequence
  Serine/threonine-protein kinase tousled-like 2 (17-26)
gcccgcuucaccggcgugggggucagcaag

SEQ ID NO: 33740 - RNA, 27 nt, Artificial Sequence
  ER degradation-enhancing alpha-mannosidase-like protein 1 (134-142)
gcccgcggcauguucguguucggguac

SEQ ID NO: 33741 - RNA, 36 nt, Artificial Sequence
  Lon protease homolog 2, peroxisomal (291-302)
gcccgcauccugcucgacaacgaccacuacgccaug

SEQ ID NO: 33742 - RNA, 27 nt, Artificial Sequence
  Chromodomain-helicase-DNA-binding protein 4 (1901-1909)
gcccgcauccccccgguggccguccgg

SEQ ID NO: 33743 - RNA, 30 nt, Artificial Sequence
  Actin-related protein 2/3 complex subunit 4 (157-166)
gcccgcaucguggccgaggaguuccugaag

SEQ ID NO: 33744 - RNA, 27 nt, Artificial Sequence
  Coiled-coil domain-containing protein 85B (34-42)
gcccgccuggccgcgcucgugcagcgg

SEQ ID NO: 33745 - RNA, 33 nt, Artificial Sequence
  THO complex subunit 5 homolog (189-199)
gcccgccuggacugggagcucgagcagcggaag

SEQ ID NO: 33746 - RNA, 30 nt, Artificial Sequence
  Squamous cell carcinoma antigen recognized by T-cells 3 (242-251)
gcccgccuggagaaggugcacagccucuuc

SEQ ID NO: 33747 - RNA, 27 nt, Artificial Sequence
  G patch domain-containing protein 4 (161-169)
gcccgccugggcaucaccaugaaggcc

SEQ ID NO: 33748 - RNA, 27 nt, Artificial Sequence
  Natural resistance-associated macrophage protein 2 (119-127)
gcccgccugggcguggucaccgggcuc

SEQ ID NO: 33749 - RNA, 30 nt, Artificial Sequence
  WD repeat-containing protein 36 (93-102)
gcccgcaacaaggagaucgugcacaccuuc

SEQ ID NO: 33750 - RNA, 27 nt, Artificial Sequence
  General transcription factor 3C polypeptide 1 (196-204)
gcccgcagcgagcugcucaccaccgug

SEQ ID NO: 33751 - RNA, 27 nt, Artificial Sequence
  Nucleolin (392-400)
gcccgcacccugcucgccaagaaccug

SEQ ID NO: 33752 - RNA, 27 nt, Artificial Sequence
  S-adenosyl-L-methionine-dependent tRNA 4-demethylwyosine synthase (634-642)
gcccgcaccccccacugggcccuguuc

SEQ ID NO: 33753 - RNA, 27 nt, Artificial Sequence
  Puromycin-sensitive aminopeptidase (236-244)
gcccgcacccccgugaugagcaccuac

SEQ ID NO: 33754 - RNA, 27 nt, Artificial Sequence
  Puromycin-sensitive aminopeptidase-like protein (236-244)
gcccgcacccccgugaccagcacguac

SEQ ID NO: 33755 - RNA, 27 nt, Artificial Sequence
  Protocadherin gamma-A11 (880-888)
gcccgcuacggcccccaguucacccug

SEQ ID NO: 33756 - RNA, 27 nt, Artificial Sequence
  Protein ELYS (743-751)
gagcgcaucgagaagcuguggaagcgg

SEQ ID NO: 33757 - RNA, 27 nt, Artificial Sequence
  Unconventional myosin-Ic (223-231)
gagcgcaacccccagagcuaccuguac

SEQ ID NO: 33758 - RNA, 27 nt, Artificial Sequence
  TRPM8 channel-associated factor 1 (164-172)
uuccgcggcccccuggugaucaaccgg

SEQ ID NO: 33759 - RNA, 27 nt, Artificial Sequence
  Translocon-associated protein subunit alpha (124-132)
uuccgcuacccccaggacuaccaguuc

SEQ ID NO: 33760 - RNA, 30 nt, Artificial Sequence
  Protein DEK (128-137)
ggccaguucagcggguuccccuucgagaag

SEQ ID NO: 33761 - RNA, 27 nt, Artificial Sequence
  DAZ-associated protein 2 (5-13)
ggccaguaccccacccagccgaccuac

SEQ ID NO: 33762 - RNA, 30 nt, Artificial Sequence
  Sorting and assembly machinery component 50 homolog (154-163)
ggccgcgccgagaaggugaccuuccaguuc

SEQ ID NO: 33763 - RNA, 30 nt, Artificial Sequence
  Replication protein A 32 kDa subunit (83-92)
ggccgcgcccccaucagcaacccggggaug

SEQ ID NO: 33764 - RNA, 27 nt, Artificial Sequence
  Eukaryotic peptide chain release factor GTP-binding subunit ERF3A (142-150)
ggccgcgccuacuucgagaccgagaag

SEQ ID NO: 33765 - RNA, 27 nt, Artificial Sequence
  Actin, gamma-enteric smooth muscle (140-148)
ggccgcgaccugaccgacuaccucaug

SEQ ID NO: 33766 - RNA, 27 nt, Artificial Sequence
  Protocadherin Fat 1 (1957-1965)
ggccgcuucgccgggcugaccagcgug

SEQ ID NO: 33767 - RNA, 30 nt, Artificial Sequence
  H(+)/Cl(-) exchange transporter 7 (345-354)
ggccgcuucgacagcgagaagauggccuac

SEQ ID NO: 33768 - RNA, 30 nt, Artificial Sequence
  Zinc finger protein 407 (271-280)
ggccgcuucgacagcuccaucauccggauc

SEQ ID NO: 33769 - RNA, 30 nt, Artificial Sequence
  U2 small nuclear ribonucleoprotein B'' (185-194)
ggccgccacgacaucgccuucguggaguuc

SEQ ID NO: 33770 - RNA, 33 nt, Artificial Sequence
  40S ribosomal protein S4, X isoform (171-181)
ggccgcaucggggugaucaccaaccgggagcgc

SEQ ID NO: 33771 - RNA, 33 nt, Artificial Sequence
  40S ribosomal protein S11 (70-80)
ggccgcauccugagcgggguggucaccaagaug

SEQ ID NO: 33772 - RNA, 33 nt, Artificial Sequence
  Desmoplakin (1624-1634)
ggccgcaucagcaccgaggaggccauccggaag

SEQ ID NO: 33773 - RNA, 27 nt, Artificial Sequence
  Protein PML (295-303)
ggccgccuggacgccgugcuccagcgg

SEQ ID NO: 33774 - RNA, 30 nt, Artificial Sequence
  Plectin (581-590)
ggccgccuggaccuccaguacgccaagcug

SEQ ID NO: 33775 - RNA, 27 nt, Artificial Sequence
  Kelch-like protein 7 (492-500)
ggccgccuggggcacauccucgaguac

SEQ ID NO: 33776 - RNA, 27 nt, Artificial Sequence
  H(+)/Cl(-) exchange transporter 3 (772-780)
ggccgccugcucgggaucaucaccaag

SEQ ID NO: 33777 - RNA, 33 nt, Artificial Sequence
  Heat shock cognate 71 kDa protein (508-518)
ggccgccugagcaaggaggacaucgagcggaug

SEQ ID NO: 33778 - RNA, 30 nt, Artificial Sequence
  Protein phosphatase 1 regulatory subunit 3C (303-312)
ggccgcauggagaaccuggccagcuaccgg

SEQ ID NO: 33779 - RNA, 27 nt, Artificial Sequence
  Integrin-linked protein kinase (45-53)
ggccgcagcgccguggucgagaugcug

SEQ ID NO: 33780 - RNA, 27 nt, Artificial Sequence
  Interleukin-17 receptor C (13-21)
ggccgcagccccgugguccugucccuc

SEQ ID NO: 33781 - RNA, 30 nt, Artificial Sequence
  Solute carrier family 22 member 18 (21-30)
ggccgcagcuccgugauccugcucaccuac

SEQ ID NO: 33782 - RNA, 33 nt, Artificial Sequence
  Insulin receptor substrate 2 (717-727)
ggccgcaccuuccccgccagcgggggcggguac

SEQ ID NO: 33783 - RNA, 27 nt, Artificial Sequence
  Sodium/potassium-transporting ATPase subunit beta-1 (26-34)
ggccgcaccgggggcagcugguucaag

SEQ ID NO: 33784 - RNA, 27 nt, Artificial Sequence
  ATP-binding cassette sub-family B member 8, mitochondrial (643-651)
ggccgcaccgugcuggucaucgcccac

SEQ ID NO: 33785 - RNA, 27 nt, Artificial Sequence
  ATP-dependent RNA helicase A (565-573)
ggccgcaccuaccccgugcaggaguac

SEQ ID NO: 33786 - RNA, 30 nt, Artificial Sequence
  Sorbin and SH3 domain-containing protein 2 (299-308)
ggccgcguggggaucuuccccaucagcuac

SEQ ID NO: 33787 - RNA, 33 nt, Artificial Sequence
  Poly (ADP-ribose) polymerase 1 (590-600)
ggccgcguggggaccgucaucggcagcaacaag

SEQ ID NO: 33788 - RNA, 27 nt, Artificial Sequence
  Intraflagellar transport protein 172 homolog (293-301)
ggccgcugggagcaggcccacaagcug

SEQ ID NO: 33789 - RNA, 27 nt, Artificial Sequence
  Histidine-tRNA ligase, cytoplasmic (247-255)
ggccgcuacgacgggcuggugggcaug

SEQ ID NO: 33790 - RNA, 30 nt, Artificial Sequence
  DNA mismatch repair protein Msh6 (337-346)
ggccgcuacagcgacucccuggugcagaag

SEQ ID NO: 33791 - RNA, 33 nt, Artificial Sequence
  Anion exchange protein 2 (262-272)
caccgcuucgaggacgugcccggcguccggcgc

SEQ ID NO: 33792 - RNA, 27 nt, Artificial Sequence
  Probable cation-transporting ATPase 13A2 (626-634)
caccgcuuccccuucagcuccgcccug

SEQ ID NO: 33793 - RNA, 27 nt, Artificial Sequence
  26S proteasome non-ATPase regulatory subunit 13 (23-31)
caccgccuggaggagcucuacaccaag

SEQ ID NO: 33794 - RNA, 30 nt, Artificial Sequence
  26S proteasome non-ATPase regulatory subunit 13 (23-32)
caccgccuggaggagcucuacaccaagaag

SEQ ID NO: 33795 - RNA, 27 nt, Artificial Sequence
  40S ribosomal protein S16 (83-91)
auccgccagagcaucuccaaggcccug

SEQ ID NO: 33796 - RNA, 27 nt, Artificial Sequence
  RNA-binding motif protein 22 (258-266)
auccgcaccaucaccgugguccagcgg

SEQ ID NO: 33797 - RNA, 27 nt, Artificial Sequence
  Protein MCM10 homolog (426-434)
aagcgcgccgaccugcagagcaccuuc

SEQ ID NO: 33798 - RNA, 30 nt, Artificial Sequence
  Signal peptidase complex subunit 2 (164-173)
aagcgcuucgacgacaaguacacccugaag

SEQ ID NO: 33799 - RNA, 33 nt, Artificial Sequence
  Unconventional myosin-Ib (37-47)
aagcgcuucgaccacagcgagaucuacaccuac

SEQ ID NO: 33800 - RNA, 27 nt, Artificial Sequence
  Eukaryotic translation initiation factor 3 subunit C-like protein (55-63)
aagcgcuucgaggagcugaccaaccuc

SEQ ID NO: 33801 - RNA, 27 nt, Artificial Sequence
  KIF1-binding protein (201-209)
aagcgcuucgagaagguguacacccac

SEQ ID NO: 33802 - RNA, 27 nt, Artificial Sequence
  NADH dehydrogenase (ubiquinone) iron-sulfur protein 5 (8-16)
aagcgcuucggccugaacaucgaccgg

SEQ ID NO: 33803 - RNA, 27 nt, Artificial Sequence
  Peptidyl-prolyl cis-trans isomerase FKBP3 (70-78)
aagcgcuucaagggcaccgagagcauc

SEQ ID NO: 33804 - RNA, 30 nt, Artificial Sequence
  Intron-binding protein aquarius (24-33)
aagcgccacgaccuggugaagcucggcuuc

SEQ ID NO: 33805 - RNA, 27 nt, Artificial Sequence
  THO complex subunit 5 homolog (342-350)
aagcgccacccccugagcgugaugcuc

SEQ ID NO: 33806 - RNA, 27 nt, Artificial Sequence
  MAP/microtubule affinity-regulating kinase 3 (330-338)
aagcgcaucgacaucauggugggcaug

SEQ ID NO: 33807 - RNA, 30 nt, Artificial Sequence
  NADH dehydrogenase (ubiquinone) flavoprotein 2, mitochondrial (61-70)
aagcgcaucgaggccaucgugaagaacuac

SEQ ID NO: 33808 - RNA, 27 nt, Artificial Sequence
  ATP-binding cassette sub-family F member 2 (275-283)
aagcgcauccuggugcucgucagccac

SEQ ID NO: 33809 - RNA, 27 nt, Artificial Sequence
  Ceramide synthase 5 (210-218)
aagcgcaaggacuuccugaucauguuc

SEQ ID NO: 33810 - RNA, 27 nt, Artificial Sequence
  Probable ATP-dependent RNA helicase DDX47 (296-304)
aagcgccugggcagccucaacaaguuc

SEQ ID NO: 33811 - RNA, 27 nt, Artificial Sequence
  Transcription intermediary factor 1-beta (207-215)
aagcgcgugcaggucgacgugaagaug

SEQ ID NO: 33812 - RNA, 27 nt, Artificial Sequence
  Arginine-tRNA ligase, cytoplasmic (579-587)
cugcgcuuccccgagauccuccagaag

SEQ ID NO: 33813 - RNA, 27 nt, Artificial Sequence
  Neurosecretory protein VGF (4-12)
cugcgccucagcgccuccgcccuguuc

SEQ ID NO: 33814 - RNA, 27 nt, Artificial Sequence
  Large proline-rich protein BAG6 (1102-1110)
cugcgcagcgacauccagaagcggcuc

SEQ ID NO: 33815 - RNA, 33 nt, Artificial Sequence
  Ribonucleoside-diphosphate reductase subunit M2 (271-281)
cugcgcuggaucggcgacaaggaggccaccuac

SEQ ID NO: 33816 - RNA, 30 nt, Artificial Sequence
  T-complex protein 1 subunit gamma (305-314)
augcgcgccaacaucaccgccauccggcgc

SEQ ID NO: 33817 - RNA, 27 nt, Artificial Sequence
  U8 snoRNA-decapping enzyme (48-56)
augcgcuucgacggccggcugggguuc

SEQ ID NO: 33818 - RNA, 27 nt, Artificial Sequence
  Epididymal secretory protein E1 (1-9)
augcgcuuccuggccgccaccuuccuc

SEQ ID NO: 33819 - RNA, 27 nt, Artificial Sequence
  26S proteasome non-ATPase regulatory subunit 2 (477-485)
augcgccugggcagcaucuucgggcuc

SEQ ID NO: 33820 - RNA, 27 nt, Artificial Sequence
  Translocon-associated protein subunit alpha (1-9)
augcgccugcucccccggcugcugcuc

SEQ ID NO: 33821 - RNA, 30 nt, Artificial Sequence
  Phenylalanine-tRNA ligase alpha subunit (94-103)
augcgccugcccagcggcaaggugggguuc

SEQ ID NO: 33822 - RNA, 27 nt, Artificial Sequence
  Dipeptidyl peptidase 8 (31-39)
aaccgcuucaagggcgugaaguacuuc

SEQ ID NO: 33823 - RNA, 27 nt, Artificial Sequence
  E3 ubiquitin-protein ligase UHRF1 (553-561)
aaccgcuacgacggcaucuacaaggug

SEQ ID NO: 33824 - RNA, 27 nt, Artificial Sequence
  ATP-dependent RNA helicase DDX19B (371-379)
cagcgcgccgccgugaucgagcgguuc

SEQ ID NO: 33825 - RNA, 27 nt, Artificial Sequence
  V-type proton ATPase subunit H (106-114)
cagcgcgugagcaucuucuucgacuac

SEQ ID NO: 33826 - RNA, 27 nt, Artificial Sequence
  Zinc finger protein 536 (380-388)
cgccgguucaaggagcccugguuccug

SEQ ID NO: 33827 - RNA, 27 nt, Artificial Sequence
  F-box only protein 25 (53-61)
cgccgguucaacuacguggucaagcug

SEQ ID NO: 33828 - RNA, 27 nt, Artificial Sequence
  Myosin-9 (1209-1217)
cgccggggcgaccugcccuucgugguc

SEQ ID NO: 33829 - RNA, 33 nt, Artificial Sequence
  Plectin (1853-1863)
cgccggcuggccgaggacgaggccuuccagcgc

SEQ ID NO: 33830 - RNA, 33 nt, Artificial Sequence
  60S ribosomal protein L15 (143-153)
cgccggaaccccgacacccaguggaucaccaag

SEQ ID NO: 33831 - RNA, 27 nt, Artificial Sequence
  E3 SUMO-protein ligase RanBP2 (1126-1134)
cgccggagcgacgacauguucaccuuc

SEQ ID NO: 33832 - RNA, 27 nt, Artificial Sequence
  F-box only protein 21 (295-303)
cgccggaccggcauccccaucagcaug

SEQ ID NO: 33833 - RNA, 27 nt, Artificial Sequence
  Prelamin-A/C (40-48)
cgccggguggacgccgagaaccgccug

SEQ ID NO: 33834 - RNA, 30 nt, Artificial Sequence
  Polymerase I and transcript release factor (137-146)
cgccggguggacgacuucaagaaggccuuc

SEQ ID NO: 33835 - RNA, 36 nt, Artificial Sequence
  Polymerase I and transcript release factor (137-148)
cgccggguggacgacuucaagaaggccuucagcaag

SEQ ID NO: 33836 - RNA, 30 nt, Artificial Sequence
  Hsp90 co-chaperone Cdc37 (166-175)
cgccggugggacgacagccagaaguaccug

SEQ ID NO: 33837 - RNA, 27 nt, Artificial Sequence
  Vascular endothelial growth factor A (62-70)
agccgcuucggcggggccgugguccgg

SEQ ID NO: 33838 - RNA, 27 nt, Artificial Sequence
  Lysosomal protective protein (472-480)
agccgcuuccugaacaagcagcccuac

SEQ ID NO: 33839 - RNA, 27 nt, Artificial Sequence
  Decapping and exoribonuclease protein (154-162)
agccgcuuccagggcacccuguaccuc

SEQ ID NO: 33840 - RNA, 30 nt, Artificial Sequence
  Glia-derived nexin (207-216)
agccgcuuccagcccgagaacaccaagaag

SEQ ID NO: 33841 - RNA, 27 nt, Artificial Sequence
  Signal transducer and activator of transcription 1-alpha/beta (69-77)
agccgcuucucccuggagaacaacuuc

SEQ ID NO: 33842 - RNA, 27 nt, Artificial Sequence
  PITH domain-containing protein 1 (143-151)
agccgcuucuccaacguguaccaccug

SEQ ID NO: 33843 - RNA, 27 nt, Artificial Sequence
  Gamma-aminobutyric acid receptor subunit beta-3 (452-460)
agccgcaucguguuccccuucaccuuc

SEQ ID NO: 33844 - RNA, 24 nt, Artificial Sequence
  Probable dolichyl pyrophosphate Glc1Man9GlcNAc2 alpha-1,3-glucosyltransferase (267-274)
agccgccuguuccccuucaagcgg

SEQ ID NO: 33845 - RNA, 27 nt, Artificial Sequence
  Lysine-specific demethylase 3B (1181-1189)
agccgccugcccuccuacuucgugcgg

SEQ ID NO: 33846 - RNA, 27 nt, Artificial Sequence
  Arginine-tRNA ligase, cytoplasmic (78-86)
agccgccugcaggagguguucggccac

SEQ ID NO: 33847 - RNA, 30 nt, Artificial Sequence
  Myeloid leukemia factor 2 (28-37)
agccgcaugcuguccggcggguucggcuac

SEQ ID NO: 33848 - RNA, 27 nt, Artificial Sequence
  Protein diaphanous homolog 2 (855-863)
agccgcaacgcccagucccugggcuuc

SEQ ID NO: 33849 - RNA, 27 nt, Artificial Sequence
  Catenin beta-1 (646-654)
agccgcaacgagggcguggccaccuac

SEQ ID NO: 33850 - RNA, 27 nt, Artificial Sequence
  Nuclear protein localization protein 4 homolog (328-336)
agccgcaacaaggacaccuacuuccug

SEQ ID NO: 33851 - RNA, 33 nt, Artificial Sequence
  TOX high mobility group box family member 4 (588-598)
agccgcaacuccaacaccguggucuucgugaag

SEQ ID NO: 33852 - RNA, 27 nt, Artificial Sequence
  Spectrin beta chain, non-erythrocytic 1 (903-911)
agccgcguggccgucgugaaccagauc

SEQ ID NO: 33853 - RNA, 30 nt, Artificial Sequence
  Aldehyde dehydrogenase family 1 member A3 (318-327)
agccgcguguucgucgaggagcagguguac

SEQ ID NO: 33854 - RNA, 27 nt, Artificial Sequence
  Dystonin (6683-6691)
agccgcugggagaaggugguccagcgg

SEQ ID NO: 33855 - RNA, 33 nt, Artificial Sequence
  Phosphatidylinositol-binding clathrin assembly protein (128-138)
agccgcuaccugaacgagaaggccguguccuac

SEQ ID NO: 33856 - RNA, 30 nt, Artificial Sequence
  TRPM8 channel-associated factor 1 (46-55)
agccgcuaccggcugcccguggccacccgc

SEQ ID NO: 33857 - RNA, 27 nt, Artificial Sequence
  Protein yippee-like 5 (33-41)
acccgcuucaccggcgccacggggcgg

SEQ ID NO: 33858 - RNA, 27 nt, Artificial Sequence
  78 kDa glucose-regulated protein (364-372)
acccgcauccccaagauccagcagcug

SEQ ID NO: 33859 - RNA, 27 nt, Artificial Sequence
  Ubiquitin-like protein 5 (37-45)
acccgcuggaacaagaucgugcugaag

SEQ ID NO: 33860 - RNA, 27 nt, Artificial Sequence
  Zinc finger BED domain-containing protein 5 (574-582)
gugcgcaaccccuucaccgucaccgug

SEQ ID NO: 33861 - RNA, 30 nt, Artificial Sequence
  Proteasome subunit beta type-4 (223-232)
uaccgcgacgcccggagcuacaaccgcuuc

SEQ ID NO: 33862 - RNA, 30 nt, Artificial Sequence
  Proteasome subunit beta type-4 (22-31)
uaccgcauccccagcaccccggacuccuuc

SEQ ID NO: 33863 - RNA, 30 nt, Artificial Sequence
  Rho GTPase-activating protein 5 (1010-1019)
uaccgccuggaccucgagggcaacgaguac

SEQ ID NO: 33864 - RNA, 27 nt, Artificial Sequence
  Pre-mRNA-processing-splicing factor 8 (1786-1794)
uaccgcgugaccauccacaagaccuuc

SEQ ID NO: 33865 - RNA, 27 nt, Artificial Sequence
  Arginine-glutamic acid dipeptide repeats protein (336-344)
gccgccgcguacccccacaccagccug

SEQ ID NO: 33866 - RNA, 30 nt, Artificial Sequence
  Lon protease homolog 2, peroxisomal (789-798)
gccgccuucgacggcggguucaccgugaag

SEQ ID NO: 33867 - RNA, 27 nt, Artificial Sequence
  Double-stranded RNA-binding protein Staufen homolog 2 (139-147)
gccgccaugaaggcgcugcaggcccuc

SEQ ID NO: 33868 - RNA, 30 nt, Artificial Sequence
  26S proteasome non-ATPase regulatory subunit 14 (301-310)
gccgccaugcuggacaccguggucuucaag

SEQ ID NO: 33869 - RNA, 27 nt, Artificial Sequence
  40S ribosomal protein S17 (12-20)
gccgcccgcgugaucaucgagaaguac

SEQ ID NO: 33870 - RNA, 27 nt, Artificial Sequence
  Endoplasmic reticulum resident protein 29 (3-11)
gccgccgugccccgcgcggccuuccug

SEQ ID NO: 33871 - RNA, 27 nt, Artificial Sequence
  Tyrosine-protein phosphatase non-receptor type 1 (264-272)
gccgaccagcugcgcuucagcuaccuc

SEQ ID NO: 33872 - RNA, 27 nt, Artificial Sequence
  ATP-dependent RNA helicase DDX18 (335-343)
gccgaccgcauccuggacgugggcuuc

SEQ ID NO: 33873 - RNA, 27 nt, Artificial Sequence
  Spectrin alpha chain, non-erythrocytic 1 (781-789)
gccgacagccugcgccuccagcagcug

SEQ ID NO: 33874 - RNA, 24 nt, Artificial Sequence
  Exosome complex exonuclease RRP44 (753-760)
gccgacgugaucguccaccgccug

SEQ ID NO: 33875 - RNA, 27 nt, Artificial Sequence
  Trafficking protein particle complex subunit 4 (26-34)
gccgaggccgagaagaccuucagcuac

SEQ ID NO: 33876 - RNA, 27 nt, Artificial Sequence
  Plectin (2624-2632)
gccgaggccgagcccgagcacagcuuc

SEQ ID NO: 33877 - RNA, 30 nt, Artificial Sequence
  Spectrin beta chain, non-erythrocytic 1 (1181-1190)
gccgaggccuuccugaacaaccaggaguac

SEQ ID NO: 33878 - RNA, 33 nt, Artificial Sequence
  Structural maintenance of chromosomes protein 2 (370-380)
gccgaggcccuggcggccgcccagcagcacuuc

SEQ ID NO: 33879 - RNA, 27 nt, Artificial Sequence
  Coatomer subunit alpha (1048-1056)
gccgaggcccagcagcugaucaccauc

SEQ ID NO: 33880 - RNA, 33 nt, Artificial Sequence
  Dihydropyrimidinase-related protein 1 (233-243)
gccgaggccguguuccgcgcgaucaccaucgcc

SEQ ID NO: 33881 - RNA, 27 nt, Artificial Sequence
  Mitochondrial import receptor subunit TOM20 homolog (63-71)
gccgaggccgugcagaaguucuuccug

SEQ ID NO: 33882 - RNA, 33 nt, Artificial Sequence
  ADP-ribosylation factor 3 (112-122)
gccgaggacgagcugcgcgacgccgugcuccug

SEQ ID NO: 33883 - RNA, 30 nt, Artificial Sequence
  WD repeat-containing protein 26 (246-255)
gccgaggaccugcgcgccaaggcggagugg

SEQ ID NO: 33884 - RNA, 27 nt, Artificial Sequence
  Mitogen-activated protein kinase kinase kinase 3 (613-621)
gccgaggagcugcucacccaccacuuc

SEQ ID NO: 33885 - RNA, 30 nt, Artificial Sequence
  LisH domain-containing protein ARMC9 (22-31)
gccgaguucgaggacacccugaagaccuuc

SEQ ID NO: 33886 - RNA, 30 nt, Artificial Sequence
  RNA-binding protein 28 (545-554)
gccgaguuccaggagcacgagcacgcccug

SEQ ID NO: 33887 - RNA, 27 nt, Artificial Sequence
  Tubulin alpha-1C chain (243-251)
gccgagaaggccuaccacgagcagcug

SEQ ID NO: 33888 - RNA, 27 nt, Artificial Sequence
  Junction plakoglobin (137-145)
gccgagcuggccacccgcgcgcucccc

SEQ ID NO: 33889 - RNA, 27 nt, Artificial Sequence
  Zinc finger protein 579 (465-473)
gccgagcuggagcgcgccgcggcccuc

SEQ ID NO: 33890 - RNA, 30 nt, Artificial Sequence
  Myosin-9 (780-789)
gccgagcuggagcgccucaacaagcaguuc

SEQ ID NO: 33891 - RNA, 27 nt, Artificial Sequence
  F-box/LRR-repeat protein 5 (165-173)
gccgagcugcuccgcggccugagccug

SEQ ID NO: 33892 - RNA, 33 nt, Artificial Sequence
  Cyclin-dependent kinase inhibitor 1C (51-61)
gccgagcugaacgccgaggaccagaaccgcugg

SEQ ID NO: 33893 - RNA, 30 nt, Artificial Sequence
  Calmodulin (104-113)
gccgagcugcgccacgugaugaccaaccuc

SEQ ID NO: 33894 - RNA, 27 nt, Artificial Sequence
  Uridine phosphorylase 1 (195-203)
gccgagcugagcgaguucaccaccgug

SEQ ID NO: 33895 - RNA, 27 nt, Artificial Sequence
  U5 small nuclear ribonucleoprotein 200 kDa helicase (318-326)
gccgagcugaccggcgaccaccagcuc

SEQ ID NO: 33896 - RNA, 27 nt, Artificial Sequence
  E3 ubiquitin/ISG15 ligase TRIM25 (482-490)
gccgagaugccccagaacuaccgcccg

SEQ ID NO: 33897 - RNA, 27 nt, Artificial Sequence
  Heterogeneous nuclear ribonucleoprotein U (399-407)
gccgagaaccccggcaaguacaacauc

SEQ ID NO: 33898 - RNA, 27 nt, Artificial Sequence
  Nuclear pore complex protein Nup160 (377-385)
gccgagaaccagaccguggucaaguac

SEQ ID NO: 33899 - RNA, 27 nt, Artificial Sequence
  MORF4 family-associated protein 1 (10-18)
gccgagcccgaggagguggagguccug

SEQ ID NO: 33900 - RNA, 30 nt, Artificial Sequence
  Matrin-3 (229-238)
gccgagcccuacggcaagaucaagaacuac

SEQ ID NO: 33901 - RNA, 27 nt, Artificial Sequence
  Exocyst complex component 1 (513-521)
gccgagcaggacuucaucagcaaguuc

SEQ ID NO: 33902 - RNA, 33 nt, Artificial Sequence
  Keratin, type I cytoskeletal 10 (133-143)
gccgagcagaaccgcaaggacgccgaggcgugg

SEQ ID NO: 33903 - RNA, 30 nt, Artificial Sequence
  14 kDa phosphohistidine phosphatase (38-47)
gccgagagcaaggagaucgugcgcggcuac

SEQ ID NO: 33904 - RNA, 27 nt, Artificial Sequence
  Heterogeneous nuclear ribonucleoproteins A2/B1 (61-69)
gccgagguggacgccgcgauggccgcc

SEQ ID NO: 33905 - RNA, 27 nt, Artificial Sequence
  Rho GTPase-activating protein 18 (654-662)
gccgagugggugaucaagagcaagccc

SEQ ID NO: 33906 - RNA, 27 nt, Artificial Sequence
  RNA-binding protein 8A (94-102)
gccgaguacggcgagaucaagaacauc

SEQ ID NO: 33907 - RNA, 30 nt, Artificial Sequence
  Mitotic checkpoint serine/threonine-protein kinase BUB1 (76-85)
gccgaguacaacagcgaccugcaccaguuc

SEQ ID NO: 33908 - RNA, 33 nt, Artificial Sequence
  T-complex protein 1 subunit eta (249-259)
gccggcuucgacgccaccaacauccugaacaag

SEQ ID NO: 33909 - RNA, 27 nt, Artificial Sequence
  Eukaryotic translation initiation factor 4 gamma 1 (1268-1276)
gccggccaccugagcaccgcccaguac

SEQ ID NO: 33910 - RNA, 36 nt, Artificial Sequence
  Cytoplasmic dynein 1 heavy chain 1 (3396-3407)
gccaucgcccagcugaacuacgcggacaugcucaag

SEQ ID NO: 33911 - RNA, 33 nt, Artificial Sequence
  Transmembrane protein 131 (804-814)
gccaucuucgaggugaacaccgaccugcagaag

SEQ ID NO: 33912 - RNA, 27 nt, Artificial Sequence
  Mortality factor 4-like protein 1 (34-42)
gccaucaaggacaagcaggugaaguac

SEQ ID NO: 33913 - RNA, 27 nt, Artificial Sequence
  Endoribonuclease Dicer (608-616)
gccauccuggacuaccucaucaccaag

SEQ ID NO: 33914 - RNA, 27 nt, Artificial Sequence
  Ceramide synthase 6 (81-89)
gccauccuggagaagguguucaccgcc

SEQ ID NO: 33915 - RNA, 33 nt, Artificial Sequence
  Aryl hydrocarbon receptor (422-432)
gccaucauggacccccugccgcuccgcaccaag

SEQ ID NO: 33916 - RNA, 27 nt, Artificial Sequence
  MICOS complex subunit MIC25 (96-104)
gccauccaggacaagcuguuccaggug

SEQ ID NO: 33917 - RNA, 27 nt, Artificial Sequence
  DNA mismatch repair protein Msh2 (765-773)
gccaucagcgaguacaucgccaccaag

SEQ ID NO: 33918 - RNA, 30 nt, Artificial Sequence
  Cytochrome b-c1 complex subunit 9 (42-51)
gccaucuacgaccacaucaacgagggcaag

SEQ ID NO: 33919 - RNA, 36 nt, Artificial Sequence
  Cytochrome c oxidase subunit 7A2, mitochondrial (69-80)
gccaucuacgagcuggccguggcgagcuuccccaag

SEQ ID NO: 33920 - RNA, 33 nt, Artificial Sequence
  BCL-6 corepressor (147-157)
gccaucuacaagacccccccgggcauccagaag

SEQ ID NO: 33921 - RNA, 27 nt, Artificial Sequence
  Apolipoprotein L2 (101-109)
gcccuggccgaggagguggagcagguc

SEQ ID NO: 33922 - RNA, 30 nt, Artificial Sequence
  Epidermal growth factor receptor substrate 15 (283-292)
gcccuggccuuccaccucaucagccagaag

SEQ ID NO: 33923 - RNA, 27 nt, Artificial Sequence
  E3 ubiquitin-protein ligase RNF114 (70-78)
gcccuggcccccggcgugcgcgcgguc

SEQ ID NO: 33924 - RNA, 27 nt, Artificial Sequence
  Neudesin (124-132)
gcccuggacgagguguucaccaagguc

SEQ ID NO: 33925 - RNA, 27 nt, Artificial Sequence
  JNK1/MAPK8-associated membrane protein (109-117)
gcccuguuccagcacaucaccgcccuc

SEQ ID NO: 33926 - RNA, 27 nt, Artificial Sequence
  Set1/Ash2 histone methyltransferase complex subunit ASH2 (290-298)
gcccugcacgaccgcgccccccagcuc

SEQ ID NO: 33927 - RNA, 27 nt, Artificial Sequence
  Coiled-coil domain-containing protein 14 (24-32)
gcccugaucgaggacgagcacaaccuc

SEQ ID NO: 33928 - RNA, 27 nt, Artificial Sequence
  Clustered mitochondria protein homolog (826-834)
gcccugcucgacaacaacaucggccug

SEQ ID NO: 33929 - RNA, 30 nt, Artificial Sequence
  Lysine-specific demethylase 5C (683-692)
gcccugcucgagaagggcaucaccgaggcc

SEQ ID NO: 33930 - RNA, 27 nt, Artificial Sequence
  Cleft lip and palate transmembrane protein 1 (348-356)
gcccugcucgagaccaaccccuaccug

SEQ ID NO: 33931 - RNA, 27 nt, Artificial Sequence
  S100P-binding protein (349-357)
gcccugauggaccaggugcaccacaug

SEQ ID NO: 33932 - RNA, 27 nt, Artificial Sequence
  Brefeldin A-inhibited guanine nucleotide-exchange protein 2 (869-877)
gcccugauggaggccgugagccacgcg

SEQ ID NO: 33933 - RNA, 27 nt, Artificial Sequence
  Exosome complex component MTR3 (214-222)
gcccugaugcccgugcucaaccagguc

SEQ ID NO: 33934 - RNA, 33 nt, Artificial Sequence
  Endoplasmic reticulum resident protein 29 (38-48)
gcccugccccucgacaccgugaccuucuacaag

SEQ ID NO: 33935 - RNA, 27 nt, Artificial Sequence
  Vimentin (268-276)
gcccugcgcgacgugcggcagcaguac

SEQ ID NO: 33936 - RNA, 27 nt, Artificial Sequence
  Interferon regulatory factor 2-binding protein 1 (300-308)
gcccugcgcgagcccggcaaggcccuc

SEQ ID NO: 33937 - RNA, 27 nt, Artificial Sequence
  PR domain zinc finger protein 4 (284-292)
gcccugagcgacuccauccacaccgug

SEQ ID NO: 33938 - RNA, 27 nt, Artificial Sequence
  Annexin A2 (108-116)
gcccugagcggccaccucgagaccgug

SEQ ID NO: 33939 - RNA, 27 nt, Artificial Sequence
  Protein CutA (89-97)
gcccugaccgacuucgugcgcagcguc

SEQ ID NO: 33940 - RNA, 30 nt, Artificial Sequence
  Trafficking protein particle complex subunit 2-like protein (19-28)
gcccugguggaccagcgcgagcucuaccug

SEQ ID NO: 33941 - RNA, 27 nt, Artificial Sequence
  Flap endonuclease 1 (165-173)
gcccuggugaaggccggcaaggucuac

SEQ ID NO: 33942 - RNA, 30 nt, Artificial Sequence
  Cofilin-1 (83-92)
gcccuguacgacgccaccuacgagaccaag

SEQ ID NO: 33943 - RNA, 27 nt, Artificial Sequence
  COP9 signalosome complex subunit 2 (216-224)
gcccuguacgagcagagccuccacauc

SEQ ID NO: 33944 - RNA, 39 nt, Artificial Sequence
  TGF-beta-activated kinase 1 and MAP3K7-binding protein 1 (311-323)
gccaugaucgacaccgaguucgccaagcagaccagccug

SEQ ID NO: 33945 - RNA, 42 nt, Artificial Sequence
  Cyclin-dependent kinase 2-associated protein 2 (6-19)
gccaugaagcccccgggcgcccaggggagccaguccaccuac

SEQ ID NO: 33946 - RNA, 27 nt, Artificial Sequence
  Poly(rC)-binding protein 1 (249-257)
gccaugaugcacggcgggaccggcuuc

SEQ ID NO: 33947 - RNA, 27 nt, Artificial Sequence
  Eyes absent homolog 3 (200-208)
gcccccgccccggcggcccagcgccug

SEQ ID NO: 33948 - RNA, 27 nt, Artificial Sequence
  Homocysteine-responsive endoplasmic reticulum-resident ubiquitin-like domain member 1 protein (211-219)
gcccccgccccgauccacaaccaguuc

SEQ ID NO: 33949 - RNA, 27 nt, Artificial Sequence
  Wings apart-like protein homolog (598-606)
gcccccgccccgcccagcaaggugauc

SEQ ID NO: 33950 - RNA, 27 nt, Artificial Sequence
  Pre-mRNA-splicing factor ATP-dependent RNA helicase PRP16 (41-49)
gcccccgccccgcgccccagccugcuc

SEQ ID NO: 33951 - RNA, 27 nt, Artificial Sequence
  Two pore calcium channel protein 1 (59-67)
gcccccgccgugccggcgcugcgccuc

SEQ ID NO: 33952 - RNA, 27 nt, Artificial Sequence
  Structural maintenance of chromosomes protein 3 (150-158)
gcccccgacagccagcgccugaagcuc

SEQ ID NO: 33953 - RNA, 27 nt, Artificial Sequence
  Integrator complex subunit 3 (30-38)
gcccccggcgggggccgccugcuccug

SEQ ID NO: 33954 - RNA, 51 nt, Artificial Sequence
  Fructose-bisphosphate aldolase A (79-95)
gcccccggcaaggggauccuggccgcggacgagagcaccggcuccaucgcc

SEQ ID NO: 33955 - RNA, 27 nt, Artificial Sequence
  DNA/RNA-binding protein KIN17 (338-346)
gcccccggcaagcgcauccuggugcuc

SEQ ID NO: 33956 - RNA, 30 nt, Artificial Sequence
  Ribonucleoprotein PTB-binding 1 (298-307)
gcccccggcccgcccgggcgcagcaugcug

SEQ ID NO: 33957 - RNA, 27 nt, Artificial Sequence
  Sterol regulatory element-binding protein 1 (1104-1112)
gcccccggccagcgcguggggaugcug

SEQ ID NO: 33958 - RNA, 27 nt, Artificial Sequence
  E3 ubiquitin-protein ligase RNF114 (72-80)
gcccccggcgugcgcgccgucgagcug

SEQ ID NO: 33959 - RNA, 27 nt, Artificial Sequence
  LIM domain and actin-binding protein 1 (397-405)
gcccccaucgccaaggugggcguccug

SEQ ID NO: 33960 - RNA, 27 nt, Artificial Sequence
  Destrin (109-117)
gccccccugaagagcaagaugaucuac

SEQ ID NO: 33961 - RNA, 33 nt, Artificial Sequence
  Talin-1 (1688-1698)
gccccccgcgagggcaucagccaggaggcccug

SEQ ID NO: 33962 - RNA, 30 nt, Artificial Sequence
  NADH dehydrogenase (ubiquinone) 1 alpha subcomplex assembly factor 4 (30-39)
gccccccgccacccgagcaccaacucccug

SEQ ID NO: 33963 - RNA, 33 nt, Artificial Sequence
  Proline-rich nuclear receptor coactivator 2 (5-15)
gccccccgccugaacagcgccgaccggccgaug

SEQ ID NO: 33964 - RNA, 27 nt, Artificial Sequence
  Zinc finger protein 526 (559-567)
gccccccgccugccgaucaccggccuc

SEQ ID NO: 33965 - RNA, 27 nt, Artificial Sequence
  Protein Wiz (126-134)
gccccccgcccgggccugcucagccug

SEQ ID NO: 33966 - RNA, 33 nt, Artificial Sequence
  Coiled-coil-helix-coiled-coil-helix domain-containing protein 2 (49-59)
gccccccgccagccgggccugauggcccagaug

SEQ ID NO: 33967 - RNA, 33 nt, Artificial Sequence
  PHD finger protein 23 (80-90)
gcccccagcgaccugcgcaccauccagaccuuc

SEQ ID NO: 33968 - RNA, 30 nt, Artificial Sequence
  Aladin (253-262)
gcccccagcggcgggcgccugcucuccgcc

SEQ ID NO: 33969 - RNA, 27 nt, Artificial Sequence
  SWI/SNF-related matrix-associated actin-dependent regulator of chromatin subfamily A member 5 (16-24)
gcccccagcaagccggccgcguccauc

SEQ ID NO: 33970 - RNA, 27 nt, Artificial Sequence
  Pre-mRNA-processing-splicing factor 8 (2018-2026)
gcccccagccagcagcgccagcagauc

SEQ ID NO: 33971 - RNA, 30 nt, Artificial Sequence
  Dolichyl-diphosphooligosaccharide-proteinosyltransferase 48 kDa subunit (183-192)
gcccccaccaucgugggcaagagcucccug

SEQ ID NO: 33972 - RNA, 39 nt, Artificial Sequence
  Eukaryotic initiation factor 4A-II (75-87)
gcccaggcccagagcggcaccgggaagaccgcgacguuc

SEQ ID NO: 33973 - RNA, 45 nt, Artificial Sequence
  Crooked neck-like protein 1 (704-718)
gcccaguucgagcugagcuccggcaaggaggggagccucaccaag

SEQ ID NO: 33974 - RNA, 27 nt, Artificial Sequence
  Carboxymethylenebutenolidase homolog (123-131)
gcccagaagaucggcaucgugggguuc

SEQ ID NO: 33975 - RNA, 27 nt, Artificial Sequence
  Suppressor of SWI4 1 homolog (17-25)
gcccagcugcgcaaccucgaggccuac

SEQ ID NO: 33976 - RNA, 30 nt, Artificial Sequence
  Hsc70-interacting protein (339-348)
gcccagaaccccgccaacaugagcaaguac

SEQ ID NO: 33977 - RNA, 27 nt, Artificial Sequence
  Protein phosphatase 1 regulatory subunit 15B (54-62)
gcccagcccgagacccgcgugagcuac

SEQ ID NO: 33978 - RNA, 36 nt, Artificial Sequence
  Putative PIP5K1A and PSMD4-like protein (282-293)
gcccagcgcgagccccugagcuccgagacccaguac

SEQ ID NO: 33979 - RNA, 27 nt, Artificial Sequence
  Ras-related C3 botulinum toxin substrate 1 (44-52)
gccagcuucgagaacgugcgcgccaag

SEQ ID NO: 33980 - RNA, 30 nt, Artificial Sequence
  Dynein light chain roadblock-type 1 (43-52)
gccagccugaugcacuccuucauccucaag

SEQ ID NO: 33981 - RNA, 33 nt, Artificial Sequence
  Heterogeneous nuclear ribonucleoprotein H (160-170)
gccagccaggagaucgccgagaaggcgcugaag

SEQ ID NO: 33982 - RNA, 27 nt, Artificial Sequence
  (19-27)
gccagcuacaccaagaucguggucaag

SEQ ID NO: 33983 - RNA, 33 nt, Artificial Sequence
  Catenin alpha-1 (826-836)
gccagcuacguggccuccaccaaguaccagaag

SEQ ID NO: 33984 - RNA, 27 nt, Artificial Sequence
  Acyl-protein thioesterase 1 (20-28)
gccaccgccgcggugaucuuccugcac

SEQ ID NO: 33985 - RNA, 36 nt, Artificial Sequence
  Prohibitin (229-240)
gccaccgccggcgacgggcugaucgagcuccgcaag

SEQ ID NO: 33986 - RNA, 30 nt, Artificial Sequence
  Major facilitator superfamily domain-containing protein 10 (72-81)
gccaccgccaucggcaugcccguggagaag

SEQ ID NO: 33987 - RNA, 27 nt, Artificial Sequence
  Biogenesis of lysosome-related organelles complex 1 subunit 1 (109-117)
gccaccgcccuggaguacguguacaag

SEQ ID NO: 33988 - RNA, 39 nt, Artificial Sequence
  E3 ubiquitin-protein ligase BRE1A (84-96)
gccaccgacgacgccagccugcucaucgugaaccgcuac

SEQ ID NO: 33989 - RNA, 27 nt, Artificial Sequence
  Alpha-1,2-mannosyltransferase ALG9 (450-458)
gccaccgaccccaccauccacacggug

SEQ ID NO: 33990 - RNA, 33 nt, Artificial Sequence
  Probable ATP-dependent RNA helicase DDX56 (198-208)
gccaccuucaacgaggacgugcaggcccugaag

SEQ ID NO: 33991 - RNA, 27 nt, Artificial Sequence
  Major facilitator superfamily domain-containing protein 10 (320-328)
gccaccauccagggcgccuacgcgcgc

SEQ ID NO: 33992 - RNA, 27 nt, Artificial Sequence
  E3 ubiquitin-protein ligase MYLIP (151-159)
gccacccugaacagcaucguggccaag

SEQ ID NO: 33993 - RNA, 27 nt, Artificial Sequence
  Ankyrin repeat domain-containing protein 10 (82-90)
gccacccugaacgugagcaccacgcgc

SEQ ID NO: 33994 - RNA, 30 nt, Artificial Sequence
  Filamin-A (829-838)
gccacccccaccagcccgauccgcgugaag

SEQ ID NO: 33995 - RNA, 33 nt, Artificial Sequence
  Nucleolar protein 14 (841-851)
gccacccaggagggcgaguggaaggcccugaag

SEQ ID NO: 33996 - RNA, 27 nt, Artificial Sequence
  Cullin-7 (1690-1698)
gccacccagagcuucuccaccuuccgc

SEQ ID NO: 33997 - RNA, 30 nt, Artificial Sequence
  Gamma-interferon-inducible protein 16 (234-243)
gccacccagacccaguucuuccacgugaag

SEQ ID NO: 33998 - RNA, 27 nt, Artificial Sequence
  Vesicle transport protein SEC20 (257-265)
gccaccgugcuguacaucgucaagaag

SEQ ID NO: 33999 - RNA, 36 nt, Artificial Sequence
  Glycerol-3-phosphate dehydrogenase, mitochondrial (373-384)
gccaccuacggcgacaaggccuucgagguggcgaag

SEQ ID NO: 34000 - RNA, 27 nt, Artificial Sequence
  DNA (cytosine-5)-methyltransferase 3A (168-176)
gccaccuacaacaagcagcccauguac

SEQ ID NO: 34001 - RNA, 27 nt, Artificial Sequence
  Cytoplasmic dynein 1 heavy chain 1 (156-164)
gccguggcccccuucuucaagagcuac

SEQ ID NO: 34002 - RNA, 27 nt, Artificial Sequence
  Triple functional domain protein (2585-2593)
gccguggccaccaaguucgucaacaag

SEQ ID NO: 34003 - RNA, 27 nt, Artificial Sequence
  Cleavage stimulation factor subunit 1 (359-367)
gccguguucaaccacaccgaggacuac

SEQ ID NO: 34004 - RNA, 30 nt, Artificial Sequence
  Inositol hexakisphosphate and diphosphoinositol-pentakisphosphate kinase 1 (189-198)
gccguguuccccaagccguucgucgagaag

SEQ ID NO: 34005 - RNA, 33 nt, Artificial Sequence
  POTE ankyrin domain family member F (729-739)
gccguguuccccagcaucgucggccgcccgcgg

SEQ ID NO: 34006 - RNA, 27 nt, Artificial Sequence
  Probable ATP-dependent RNA helicase DDX10 (63-71)
gccgugaucgagaaccugcccaagaag

SEQ ID NO: 34007 - RNA, 33 nt, Artificial Sequence
  Zinc finger protein 292 (1897-1907)
gccgugauccccgagaagcagcuggucgagaag

SEQ ID NO: 34008 - RNA, 27 nt, Artificial Sequence
  Leucine-rich repeat and calponin homology domain-containing protein 3 (504-512)
gccgugcuggacuucgucaagcagaag

SEQ ID NO: 34009 - RNA, 33 nt, Artificial Sequence
  Calcium-binding protein 39 (24-34)
gccgugcuggagaagcaggacaucagcgacaag

SEQ ID NO: 34010 - RNA, 27 nt, Artificial Sequence
  Small integral membrane protein 15 (38-46)
gccgugcugagcuggaagcucgccaag

SEQ ID NO: 34011 - RNA, 33 nt, Artificial Sequence
  Cytoskeleton-associated protein 5 (403-413)
gccgugauggacaacaagaaccccaccaucaag

SEQ ID NO: 34012 - RNA, 39 nt, Artificial Sequence
  MICOS complex subunit MIC60 (234-246)
gccgugcaggccgucaacgcgcacagcaacauccugaag

SEQ ID NO: 34013 - RNA, 36 nt, Artificial Sequence
  Ran GTPase-activating protein 1 (489-500)
gccgugcaggacgccgucgacgcgcugaugcagaag

SEQ ID NO: 34014 - RNA, 27 nt, Artificial Sequence
  PRELI domain-containing protein 1, mitochondrial (142-150)
gccgugcaggaguucggccuggcccgc

SEQ ID NO: 34015 - RNA, 30 nt, Artificial Sequence
  V-type proton ATPase subunit E 1 (147-156)
gccgugcagaaggccauccccauguacaag

SEQ ID NO: 34016 - RNA, 27 nt, Artificial Sequence
  Lamin-B receptor (364-372)
gccguguacgacuucuucaucggccgc

SEQ ID NO: 34017 - RNA, 39 nt, Artificial Sequence
  Protein phosphatase 1A (57-69)
gccguguacgacggccacgccgggagccaggucgcgaag

SEQ ID NO: 34018 - RNA, 27 nt, Artificial Sequence
  ATPase family AAA domain-containing protein 2 (1085-1093)
gccuacgccaucaucaaggaggagcug

SEQ ID NO: 34019 - RNA, 27 nt, Artificial Sequence
  ATP-dependent RNA helicase DHX29 (855-863)
gccuaccuggacaagagcccccaguuc

SEQ ID NO: 34020 - RNA, 27 nt, Artificial Sequence
  Structural maintenance of chromosomes protein 6 (494-502)
gccuaccgccagggccacuucaccuac

SEQ ID NO: 34021 - RNA, 27 nt, Artificial Sequence
  Protein PRRC2C (846-854)
gccuacagcguggagcacaaccagcug

SEQ ID NO: 34022 - RNA, 24 nt, Artificial Sequence
  Coatomer subunit alpha (194-201)
gacgccguggucaagcacgugcug

SEQ ID NO: 34023 - RNA, 24 nt, Artificial Sequence
  Talin-1 (1943-1950)
gacgccuacaccaagaaggagcug

SEQ ID NO: 34024 - RNA, 24 nt, Artificial Sequence
  Spindlin-1 (249-256)
gacgacuuccacaucuacguguac

SEQ ID NO: 34025 - RNA, 27 nt, Artificial Sequence
  Caldesmon (92-100)
gacgaggccgccuuccuggagcgccuc

SEQ ID NO: 34026 - RNA, 33 nt, Artificial Sequence
  E3 ubiquitin-protein ligase CHIP (39-49)
gacgaggccaucgccaaccugcagcgcgcguac

SEQ ID NO: 34027 - RNA, 30 nt, Artificial Sequence
  REST corepressor 1 (472-481)
gacgaggcccccgugcuggacguccgcuac

SEQ ID NO: 34028 - RNA, 27 nt, Artificial Sequence
  Peptidyl-prolyl cis-trans isomerase-like 2 (267-275)
gacgaggacgugcugcgcuaccaguuc

SEQ ID NO: 34029 - RNA, 27 nt, Artificial Sequence
  Annexin A5 (190-198)
gacgaggagaaguucaucaccaucuuc

SEQ ID NO: 34030 - RNA, 27 nt, Artificial Sequence
  Coatomer subunit gamma-1 (781-789)
gacgaguucgagaaggaggagaccuuc

SEQ ID NO: 34031 - RNA, 27 nt, Artificial Sequence
  Pre-mRNA-splicing factor ATP-dependent RNA helicase PRP16 (334-342)
gacgaguuccacaacccccuggccuac

SEQ ID NO: 34032 - RNA, 27 nt, Artificial Sequence
  Calmodulin-like protein 4 (136-144)
gacgaguucauccacaagaucacccug

SEQ ID NO: 34033 - RNA, 24 nt, Artificial Sequence
  Coatomer subunit gamma-1 (373-380)
gacgaguucaagguggucguggug

SEQ ID NO: 34034 - RNA, 27 nt, Artificial Sequence
  Eukaryotic translation initiation factor 4 gamma 3 (1231-1239)
gacgaguuccugcacaucaacgacuuc

SEQ ID NO: 34035 - RNA, 27 nt, Artificial Sequence
  F-box/WD repeat-containing protein 5 (42-50)
gacgaguuccuguggcgcgagcaguuc

SEQ ID NO: 34036 - RNA, 27 nt, Artificial Sequence
  Calreticulin (166-174)
gacgaguucacccaccuguacacccuc

SEQ ID NO: 34037 - RNA, 24 nt, Artificial Sequence
  Zinc finger RNA-binding protein (575-582)
gacgagggcaaggugauccgcuuc

SEQ ID NO: 34038 - RNA, 27 nt, Artificial Sequence
  Sterol O-acyltransferase 1 (163-171)
gacgagggccgccuggugcucgaguuc

SEQ ID NO: 34039 - RNA, 24 nt, Artificial Sequence
  L-aminoadipate-semialdehyde dehydrogenase-phosphopantetheinyl transferase (236-243)
gacgagcaccacuucguggccguc

SEQ ID NO: 34040 - RNA, 27 nt, Artificial Sequence
  Menin (320-328)
gacgagcacaucuaccccuacauguac

SEQ ID NO: 34041 - RNA, 24 nt, Artificial Sequence
  U5 small nuclear ribonucleoprotein 200 kDa helicase (1248-1255)
gacgagcaccugaucaccuucuuc

SEQ ID NO: 34042 - RNA, 24 nt, Artificial Sequence
  Oxysterol-binding protein-related protein 9 (560-567)
gacgagcacuacauccugaccuuc

SEQ ID NO: 34043 - RNA, 30 nt, Artificial Sequence
  Ras GTPase-activating-like protein IQGAP1 (124-133)
gacgagaucggccugcccaagaucuucuac

SEQ ID NO: 34044 - RNA, 27 nt, Artificial Sequence
  Hom s 5 (293-301)
gacgagaucaacuuccugcgcgcccuc

SEQ ID NO: 34045 - RNA, 30 nt, Artificial Sequence
  Hom s 5 (293-302)
gacgagaucaacuuccugcgcgcccucuac

SEQ ID NO: 34046 - RNA, 27 nt, Artificial Sequence
  Harmonin (132-140)
gacgagaucgugcgcaucaacggcuac

SEQ ID NO: 34047 - RNA, 27 nt, Artificial Sequence
  Splicing factor 3B subunit 4 (112-120)
gacgagaagcugcucuacgacaccuuc

SEQ ID NO: 34048 - RNA, 24 nt, Artificial Sequence
  Plectin (380-387)
gacgagaagagcaucaucaccuac

SEQ ID NO: 34049 - RNA, 33 nt, Artificial Sequence
  60 kDa heat shock protein, mitochondrial (209-219)
gacgagcuggagaucaucgagggcaugaaguuc

SEQ ID NO: 34050 - RNA, 27 nt, Artificial Sequence
  tRNA selenocysteine 1-associated protein 1 (146-154)
gacgagcuggagcagaagcgcgcccuc

SEQ ID NO: 34051 - RNA, 27 nt, Artificial Sequence
  Vacuolar protein sorting-associated protein 35 (72-80)
gacgagcugcacuaccucgagguguac

SEQ ID NO: 34052 - RNA, 24 nt, Artificial Sequence
  Exocyst complex component 4 (59-66)
gacgagcugaucgugcagcacuac

SEQ ID NO: 34053 - RNA, 27 nt, Artificial Sequence
  Signal transducer and activator of transcription 2 (704-712)
gacgagcugcagcagccccucgagcug

SEQ ID NO: 34054 - RNA, 24 nt, Artificial Sequence
  Spectrin beta chain, non-erythrocytic 1 (545-552)
gacgagaugaaggugcugguccuc

SEQ ID NO: 34055 - RNA, 24 nt, Artificial Sequence
  Eukaryotic initiation factor 4A-I (185-192)
gacgagaugcugagccgcggcuuc

SEQ ID NO: 34056 - RNA, 24 nt, Artificial Sequence
  Myosin light polypeptide 6 (58-65)
gacgagaugaacgugaagguccug

SEQ ID NO: 34057 - RNA, 27 nt, Artificial Sequence
  Ras GTPase-activating protein-binding protein 2 (343-351)
gacgagaacgagcugaaggaguucuuc

SEQ ID NO: 34058 - RNA, 27 nt, Artificial Sequence
  Pyruvate kinase PKM (153-161)
gacgagaacauccuguggcucgacuac

SEQ ID NO: 34059 - RNA, 27 nt, Artificial Sequence
  Argininosuccinate synthase (182-190)
gacgagaaccugaugcacaucagcuac

SEQ ID NO: 34060 - RNA, 30 nt, Artificial Sequence
  HLA class II histocompatibility antigen, DR alpha chain (196-205)
gacgagccccugcucaagcacugggaguuc

SEQ ID NO: 34061 - RNA, 27 nt, Artificial Sequence
  RNA-binding protein 3 (18-26)
gacgagcaggcccuggaggaccacuuc

SEQ ID NO: 34062 - RNA, 27 nt, Artificial Sequence
  40S ribosomal protein S6 (20-28)
gacgagcgcaagcugcggaccuucuac

SEQ ID NO: 34063 - RNA, 27 nt, Artificial Sequence
  Myosin-11 (1867-1875)
gacgagcgcaagauggccgagcaguac

SEQ ID NO: 34064 - RNA, 27 nt, Artificial Sequence
  Carbonic anhydrase 12 (281-289)
gacgagcgccugguguacaccagcuuc

SEQ ID NO: 34065 - RNA, 27 nt, Artificial Sequence
  Myosin-10 (277-285)
gacgagcgcaccuuccacaucuucuac

SEQ ID NO: 34066 - RNA, 27 nt, Artificial Sequence
  Carboxy-terminal domain RNA polymerase II polypeptide A small phosphatase 2 (109-117)
gacgagacccuggugcacagcuccuuc

SEQ ID NO: 34067 - RNA, 33 nt, Artificial Sequence
  Alpha-ketoglutarate-dependent dioxygenase FTO (189-199)
gacgagguggacaucaagagccgcgccgccuac

SEQ ID NO: 34068 - RNA, 24 nt, Artificial Sequence
  FACT complex subunit SPT16 (838-845)
gacgagguggagcugauccacuuc

SEQ ID NO: 34069 - RNA, 27 nt, Artificial Sequence
  Electrogenic sodium bicarbonate cotransporter 1 (306-314)
gacgagguguuccacgacaucgccuac

SEQ ID NO: 34070 - RNA, 24 nt, Artificial Sequence
  Annexin A4 (191-198)
gacgaggugaaguuccugaccguc

SEQ ID NO: 34071 - RNA, 27 nt, Artificial Sequence
  Annexin A4 (191-199)
gacgaggugaaguuccugaccguccuc

SEQ ID NO: 34072 - RNA, 27 nt, Artificial Sequence
  Polymerase I and transcript release factor (158-166)
gacgaggugaagcugcccgccaagcuc

SEQ ID NO: 34073 - RNA, 24 nt, Artificial Sequence
  Protein arginine N-methyltransferase 1 (69-76)
gacgaggugcgcacccugaccuac

SEQ ID NO: 34074 - RNA, 42 nt, Artificial Sequence
  Annexin A2 (52-65)
gacgaggugaccaucgucaacauccugaccaaccgcagcaac

SEQ ID NO: 34075 - RNA, 27 nt, Artificial Sequence
  Deoxyribose-phosphate aldolase (278-286)
gacgaguggcugaagcccgagcucuuc

SEQ ID NO: 34076 - RNA, 27 nt, Artificial Sequence
  Cell cycle progression protein 1 (726-734)
gacgaguacaucuaccgccacuucuuc

SEQ ID NO: 34077 - RNA, 30 nt, Artificial Sequence
  Epidermal growth factor receptor (1014-1023)
gacgaguaccugaucccccagcagggcuuc

SEQ ID NO: 34078 - RNA, 27 nt, Artificial Sequence
  39S ribosomal protein L49, mitochondrial (43-51)
gacgaguaccaguucguggagcgccug

SEQ ID NO: 34079 - RNA, 27 nt, Artificial Sequence
  Talin-1 (125-133)
gacgaguacagccuggugcgcgagcuc

SEQ ID NO: 34080 - RNA, 45 nt, Artificial Sequence
  Peptidyl-prolyl cis-trans isomerase A (9-23)
gacaucgccguggacggcgagccccuggggcgcgucagcuucgag

SEQ ID NO: 34081 - RNA, 27 nt, Artificial Sequence
  DNA (cytosine-5)-methyltransferase 1 (811-819)
gaccuggacagccgcgugcucuacuac

SEQ ID NO: 34082 - RNA, 27 nt, Artificial Sequence
  ELKS/Rab6-interacting/CAST family member 1 (356-364)
gaccugaaggagaaggugagccuccug

SEQ ID NO: 34083 - RNA, 27 nt, Artificial Sequence
  Alpha-taxilin (480-488)
gaccugaacaagcgcgugcaggaccuc

SEQ ID NO: 34084 - RNA, 24 nt, Artificial Sequence
  DnaJ homolog subfamily A member 1 (244-251)
gaccagaaggaccacgccguguuc

SEQ ID NO: 34085 - RNA, 27 nt, Artificial Sequence
  Statherin (20-28)
gacagcuccgaggagaaguuccugcgc

SEQ ID NO: 34086 - RNA, 30 nt, Artificial Sequence
  Protein S100-A9 (67-76)
gacaccaacgccgacaagcagcugagcuuc

SEQ ID NO: 34087 - RNA, 24 nt, Artificial Sequence
  Myosin light polypeptide 6 (148-155)
gaggccuucgugcgccacauccug

SEQ ID NO: 34088 - RNA, 30 nt, Artificial Sequence
  ATP-dependent RNA helicase DDX1 (481-490)
gaggccaucaagauccugaagggcgaguac

SEQ ID NO: 34089 - RNA, 27 nt, Artificial Sequence
  6-phosphofructo-2-kinase/fructose-2,6-bisphosphatase 3 (57-65)
gaggccgugaagcaguacagcuccuac

SEQ ID NO: 34090 - RNA, 27 nt, Artificial Sequence
  Formin-like protein 3 (893-901)
gaggccuacaacgccgugguccgcuac

SEQ ID NO: 34091 - RNA, 27 nt, Artificial Sequence
  Elongator complex protein 2 (246-254)
gaggacuggauccgcggcguggagugg

SEQ ID NO: 34092 - RNA, 30 nt, Artificial Sequence
  Vimentin (197-206)
gaggaggccgagaacacccugcagagcuuc

SEQ ID NO: 34093 - RNA, 27 nt, Artificial Sequence
  X-ray repair cross-complementing protein 5 (699-707)
gaggaggccaagaaguuccuggccccc

SEQ ID NO: 34094 - RNA, 27 nt, Artificial Sequence
  Prostaglandin G/H synthase 1 (266-274)
gaggaggcccccgugcugaugcacuac

SEQ ID NO: 34095 - RNA, 30 nt, Artificial Sequence
  ATP-dependent DNA helicase Q5 (961-970)
gaggaggcccagaaccugauccgccacuuc

SEQ ID NO: 34096 - RNA, 30 nt, Artificial Sequence
  Chromodomain-helicase-DNA-binding protein 4 (166-175)
gaggaggacuaccgcacccugaccaacuac

SEQ ID NO: 34097 - RNA, 30 nt, Artificial Sequence
  Nucleolar protein 10 (434-443)
gaggaggaggagaagcagaagagcaccugg

SEQ ID NO: 34098 - RNA, 27 nt, Artificial Sequence
  Thioredoxin-like protein 1 (254-262)
gaggaggagaccacccgcaucagcuac

SEQ ID NO: 34099 - RNA, 27 nt, Artificial Sequence
  ETS translocation variant 3 (48-56)
gaggaguuccgccacgugaucgccugg

SEQ ID NO: 34100 - RNA, 30 nt, Artificial Sequence
  Pre-mRNA-processing-splicing factor 8 (1205-1214)
gaggaguucacccacaaggacggcgugugg

SEQ ID NO: 34101 - RNA, 24 nt, Artificial Sequence
  Interferon-induced transmembrane protein 1 (4-11)
gaggagcacgagguggccguccug

SEQ ID NO: 34102 - RNA, 30 nt, Artificial Sequence
  Actin, alpha skeletal muscle (101-110)
gaggagcaccccacccugcucaccgaggcc

SEQ ID NO: 34103 - RNA, 27 nt, Artificial Sequence
  KAT8 regulatory NSL complex subunit 3 (37-45)
gaggagcacgugaaccgcaccggcugg

SEQ ID NO: 34104 - RNA, 24 nt, Artificial Sequence
  General transcription factor II-I (535-542)
gaggagaucuucaaccugaaguuc

SEQ ID NO: 34105 - RNA, 27 nt, Artificial Sequence
  Neutral and basic amino acid transport protein rBAT (294-302)
gaggagaucaaggagauccugcgcuuc

SEQ ID NO: 34106 - RNA, 30 nt, Artificial Sequence
  Calmodulin (87-96)
gaggagauccgcgaggccuuccggguguuc

SEQ ID NO: 34107 - RNA, 27 nt, Artificial Sequence
  Protein PRR14L (198-206)
gaggagaucuacaccaacaagaacuac

SEQ ID NO: 34108 - RNA, 33 nt, Artificial Sequence
  Choline-phosphate cytidylyltransferase A (268-278)
gaggagaagagcaucgaccugauccagaagugg

SEQ ID NO: 34109 - RNA, 27 nt, Artificial Sequence
  Myotubularin-related protein 2 (253-261)
gaggagcugaagcgcguggccagcuuc

SEQ ID NO: 34110 - RNA, 30 nt, Artificial Sequence
  Glutathione S-transferase Mu 4 (129-138)
gaggagcugcccaccaugaugcagcacuuc

SEQ ID NO: 34111 - RNA, 24 nt, Artificial Sequence
  DNA polymerase epsilon subunit 3 (74-81)
gaggagauggaguuccagcgcuuc

SEQ ID NO: 34112 - RNA, 27 nt, Artificial Sequence
  DNA replication licensing factor MCM3 (760-768)
gaggagaugccccaggugcacaccccg

SEQ ID NO: 34113 - RNA, 27 nt, Artificial Sequence
  Serine hydroxymethyltransferase, cytosolic (187-195)
gaggagaacgcccgccuguuccacccc

SEQ ID NO: 34114 - RNA, 24 nt, Artificial Sequence
  Vimentin (348-355)
gaggagaacuucgccguggaggcc

SEQ ID NO: 34115 - RNA, 27 nt, Artificial Sequence
  ADP-ribosylation factor-like protein 2-binding protein (56-64)
gaggagaacaagcugaucuacaccccc

SEQ ID NO: 34116 - RNA, 24 nt, Artificial Sequence
  Signal transducer and activator of transcription 3 (306-313)
gaggagcgcaucguggagcuguuc

SEQ ID NO: 34117 - RNA, 27 nt, Artificial Sequence
  A-kinase-interacting protein 1 (76-84)
gaggagcgccccccgacccugagcgcc

SEQ ID NO: 34118 - RNA, 27 nt, Artificial Sequence
  Calnexin (478-486)
gaggagcgccccuggcugugggugguc

SEQ ID NO: 34119 - RNA, 27 nt, Artificial Sequence
  WASH complex subunit strumpellin (506-514)
gaggaggugcaggaguuccaccagcug

SEQ ID NO: 34120 - RNA, 27 nt, Artificial Sequence
  Cytoplasmic FMR1-interacting protein 2 (432-440)
gaggaguacgagcgcgccacccgguac

SEQ ID NO: 34121 - RNA, 33 nt, Artificial Sequence
  Sorting nexin-7 (294-304)
gagcuggacagcaagguggagguccucaccuac

SEQ ID NO: 34122 - RNA, 27 nt, Artificial Sequence
  Serine-protein kinase ATM (744-752)
gagcuguuccagaaggccaagagccuc

SEQ ID NO: 34123 - RNA, 45 nt, Artificial Sequence
  Heat shock cognate 71 kDa protein (446-460)
gagcgcgccaugaccaaggacaacaaccugcucggcaaguucgag

SEQ ID NO: 34124 - RNA, 60 nt, Artificial Sequence
  Heat shock protein beta-1 (186-205)
gagagccgcgcccagcugggcgggcccgaggccgcgaaguccgacgagaccgccgccaag

SEQ ID NO: 34125 - RNA, 27 nt, Artificial Sequence
  40S ribosomal protein S7 (169-177)
gagaccuucagcggcguguacaagaag

SEQ ID NO: 34126 - RNA, 27 nt, Artificial Sequence
  Kelch-like protein 15 (308-316)
gagaccuucuacagcaccgagcgcuac

SEQ ID NO: 34127 - RNA, 27 nt, Artificial Sequence
  Poly (ADP-ribose) polymerase (202-210)
gaguacaacaccaucaaggacaaguuc

SEQ ID NO: 34128 - RNA, 27 nt, Artificial Sequence
  Dynamin-like 120 kDa protein, mitochondrial (717-725)
uucgccgaggacagccugcgcgugauc

SEQ ID NO: 34129 - RNA, 27 nt, Artificial Sequence
  Transcription factor AP-1 (110-118)
uucgccgagggcuucgugcgcgcccug

SEQ ID NO: 34130 - RNA, 27 nt, Artificial Sequence
  Piezo-type mechanosensitive ion channel component 1 (1665-1673)
uucgccgagggccaggggcgcgcccug

SEQ ID NO: 34131 - RNA, 27 nt, Artificial Sequence
  Sister chromatid cohesion protein PDS5 homolog A (273-281)
uucgccaucgacccccaccugcuccug

SEQ ID NO: 34132 - RNA, 27 nt, Artificial Sequence
  Spermatid perinuclear RNA-binding protein (7-15)
uucgccaacgacgaccgccacgugaug

SEQ ID NO: 34133 - RNA, 27 nt, Artificial Sequence
  Multidrug resistance-associated protein 1 (1201-1209)
uucgccgugaucagccgccacucccug

SEQ ID NO: 34134 - RNA, 30 nt, Artificial Sequence
  Glutathione-specific gamma-glutamylcyclotransferase 1 (89-98)
uucgccuacagcgacucccgcgugggcuuc

SEQ ID NO: 34135 - RNA, 45 nt, Artificial Sequence
  Peptidyl-prolyl cis-trans isomerase A (8-22)
uucgacaucgccguggacggcgagccccuggggcgcgucagcuuc

SEQ ID NO: 34136 - RNA, 51 nt, Artificial Sequence
  Peptidyl-prolyl cis-trans isomerase A (8-24)
uucgacaucgccguggacggcgagccccuggggcgcgucagcuucgagcuc

SEQ ID NO: 34137 - RNA, 30 nt, Artificial Sequence
  Probable ATP-dependent RNA helicase DDX56 (464-473)
uucgaggacaacccccgcgaccugcagcuc

SEQ ID NO: 34138 - RNA, 27 nt, Artificial Sequence
  Inhibitor of growth protein 4 (19-27)
uucgagcugcagcgcaacuuccagcuc

SEQ ID NO: 34139 - RNA, 30 nt, Artificial Sequence
  Macrophage metalloelastase (449-458)
uucgaguacgacuuccugcuccagcgcauc

SEQ ID NO: 34140 - RNA, 27 nt, Artificial Sequence
  SURP and G-patch domain-containing protein 1 (604-612)
uucggcaucgaccgccccgccgagcug

SEQ ID NO: 34141 - RNA, 27 nt, Artificial Sequence
  Signal-induced proliferation-associated 1-like protein 2 (760-768)
uucggccccccgauccccaagggggug

SEQ ID NO: 34142 - RNA, 24 nt, Artificial Sequence
  Factor VIII intron 22 protein (50-57)
uucggccagcuggggcgcgagcuc

SEQ ID NO: 34143 - RNA, 27 nt, Artificial Sequence
  Disintegrin and metalloproteinase domain-containing protein 10 (19-27)
uucauccagacccgcggcgggaccuuc

SEQ ID NO: 34144 - RNA, 27 nt, Artificial Sequence
  2'-5'-oligoadenylate synthase 1 (278-286)
uucaagaaccccaucaucgagaaguac

SEQ ID NO: 34145 - RNA, 57 nt, Artificial Sequence
  Alpha-enolase (261-279)
uucaagagccccgacgacccgucccgcuacaucagccccgaccagcuggccgaccuc

SEQ ID NO: 34146 - RNA, 27 nt, Artificial Sequence
  Sacsin (89-97)
uuccuggccgacaucgugcagaagcuc

SEQ ID NO: 34147 - RNA, 27 nt, Artificial Sequence
  Serine-protein kinase ATM (1077-1085)
uuccuggccgacaaccaccaccaggug

SEQ ID NO: 34148 - RNA, 30 nt, Artificial Sequence
  Epithelial discoidin domain-containing receptor 1 (885-894)
uuccuggccgaggacgcccucaacaccgug

SEQ ID NO: 34149 - RNA, 27 nt, Artificial Sequence
  T-complex protein 1 subunit theta (105-113)
uuccuggccaagcucaucgcccaggcg

SEQ ID NO: 34150 - RNA, 30 nt, Artificial Sequence
  Phospholipid transfer protein (8-17)
uuccuggcccuccuggccggcgcgcacgcc

SEQ ID NO: 34151 - RNA, 27 nt, Artificial Sequence
  Pseudouridylate synthase 7 homolog-like protein (128-136)
uuccuggacgagaagacccacgagcuc

SEQ ID NO: 34152 - RNA, 33 nt, Artificial Sequence
  RuvB-like 2 (433-443)
uuccuggacgagagccgcuccacccaguacaug

SEQ ID NO: 34153 - RNA, 30 nt, Artificial Sequence
  La-related protein 1 (530-539)
uuccuguucgacgaggagauggagcagaug

SEQ ID NO: 34154 - RNA, 27 nt, Artificial Sequence
  Alpha-2-macroglobulin receptor-associated protein (22-30)
uuccugggccccuggccggccgccagc

SEQ ID NO: 34155 - RNA, 27 nt, Artificial Sequence
  Sterol regulatory element-binding protein 2 (1033-1041)
uuccugcacgaggccaccgugcgccuc

SEQ ID NO: 34156 - RNA, 30 nt, Artificial Sequence
  Adenylate kinase 2, mitochondrial (96-105)
uuccugcucgacggcuucccccgcaccgug

SEQ ID NO: 34157 - RNA, 33 nt, Artificial Sequence
  ATR-interacting protein (164-174)
uuccugcucgagcaggagaagacccaggcccug

SEQ ID NO: 34158 - RNA, 27 nt, Artificial Sequence
  YY1-associated protein 1 (323-331)
uuccugaacccccucaucagcaaguac

SEQ ID NO: 34159 - RNA, 33 nt, Artificial Sequence
  BRCA1-A complex subunit BRE (92-102)
uuccugcccgacccgagcgcccuccagaaccug

SEQ ID NO: 34160 - RNA, 27 nt, Artificial Sequence
  Nesprin-2 (5714-5722)
uuccugaccgacaccagccaccuccug

SEQ ID NO: 34161 - RNA, 27 nt, Artificial Sequence
  Transmembrane protein 41B (141-149)
uuccuguaccccuucccgcucgcccug

SEQ ID NO: 34162 - RNA, 27 nt, Artificial Sequence
  Zinc finger RNA-binding protein (569-577)
uucaacgaccccaacgccaaggagaug

SEQ ID NO: 34163 - RNA, 27 nt, Artificial Sequence
  Fc receptor-like A (169-177)
uuccccgccccgauccugcgcgccgug

SEQ ID NO: 34164 - RNA, 27 nt, Artificial Sequence
  Sphingolipid delta(4)-desaturase DES1 (265-273)
uuccccaacaucccgggcaagagccug

SEQ ID NO: 34165 - RNA, 33 nt, Artificial Sequence
  Protein SZT2 (903-913)
uucccccgcagcccgggccagcccuccagccug

SEQ ID NO: 34166 - RNA, 30 nt, Artificial Sequence
  Dipeptidyl peptidase 8 (180-189)
uuccaggccggcagcgggaucuaccacgug

SEQ ID NO: 34167 - RNA, 27 nt, Artificial Sequence
  Transient receptor potential cation channel subfamily V member 2 (517-525)
uuccagcacaccggcaucuacagcgug

SEQ ID NO: 34168 - RNA, 24 nt, Artificial Sequence
  Elongation factor 1-gamma (423-430)
uuccagcacgugggcaaggccuuc

SEQ ID NO: 34169 - RNA, 27 nt, Artificial Sequence
  Phosphatidylcholine translocator ABCB4 (241-249)
uucagcgacaaggagcuggccgccuac

SEQ ID NO: 34170 - RNA, 24 nt, Artificial Sequence
  Ras GTPase-activating-like protein IQGAP2 (196-203)
uucagcaagaucggcgggauccug

SEQ ID NO: 34171 - RNA, 27 nt, Artificial Sequence
  RNA-binding protein 4B (186-194)
uucaccgagcaguacaacgagcaguac

SEQ ID NO: 34172 - RNA, 27 nt, Artificial Sequence
  F-box DNA helicase 1 (553-561)
uucaccgugccccacacccacgucuuc

SEQ ID NO: 34173 - RNA, 30 nt, Artificial Sequence
  Fas apoptotic inhibitory molecule 1 (167-176)
uucguggacgacggcaccgagacccacuuc

SEQ ID NO: 34174 - RNA, 27 nt, Artificial Sequence
  DNA damage-binding protein 1 (451-459)
uucguggacgaccagcagaccuucuuc

SEQ ID NO: 34175 - RNA, 27 nt, Artificial Sequence
  Interferon regulatory factor 2-binding protein 2 (51-59)
uucgugaucgagaccgcccgccagcug

SEQ ID NO: 34176 - RNA, 27 nt, Artificial Sequence
  Inactive serine/threonine-protein kinase VRK3 (37-45)
uucgugaacccccacgucagcuccuuc

SEQ ID NO: 34177 - RNA, 27 nt, Artificial Sequence
  DNA polymerase epsilon catalytic subunit A (732-740)
uucuacguggacaccguccgcgccuuc

SEQ ID NO: 34178 - RNA, 33 nt, Artificial Sequence
  NADH dehydrogenase (ubiquinone) flavoprotein 2, mitochondrial (33-43)
ggcgccgggggcgcccuguucgugcaccgcgac

SEQ ID NO: 34179 - RNA, 27 nt, Artificial Sequence
  Complement C1q tumor necrosis factor-related protein 3 (229-237)
ggcgaccaccagcgcuucagcaccuuc

SEQ ID NO: 34180 - RNA, 27 nt, Artificial Sequence
  Deoxyribose-phosphate aldolase (201-209)
ggcgaggcccaccugaagaccauccuc

SEQ ID NO: 34181 - RNA, 33 nt, Artificial Sequence
  ATPase family AAA domain-containing protein 2 (286-296)
ggcgaggaggagaaccagaagcgcuacuaccug

SEQ ID NO: 34182 - RNA, 27 nt, Artificial Sequence
  Interferon regulatory factor 2-binding protein-like (561-569)
ggcgaggagcagcagcgccagcagugg

SEQ ID NO: 34183 - RNA, 27 nt, Artificial Sequence
  NADPH-cytochrome P450 reductase (240-248)
ggcgaggagagcuccauccgccaguac

SEQ ID NO: 34184 - RNA, 30 nt, Artificial Sequence
  Coiled-coil domain-containing protein 106 (234-243)
ggcgaguucgaccccagcaaggagcgccug

SEQ ID NO: 34185 - RNA, 27 nt, Artificial Sequence
  LIM and senescent cell antigen-like-containing domain protein 1 (75-83)
ggcgaguucaucaucgggcgcgugauc

SEQ ID NO: 34186 - RNA, 33 nt, Artificial Sequence
  Thioredoxin (66-76)
ggcgaguucagcggggccaacaaggagaagcug

SEQ ID NO: 34187 - RNA, 36 nt, Artificial Sequence
  Fibrinogen alpha chain (23-34)
ggcgagggggacuuccuggccgagggcgggggcgug

SEQ ID NO: 34188 - RNA, 27 nt, Artificial Sequence
  Cytospin-B (579-587)
ggcgagaucaagcacgugagcucccug

SEQ ID NO: 34189 - RNA, 27 nt, Artificial Sequence
  Filamin-B (1758-1766)
ggcgagaucaccggggaggugcacaug

SEQ ID NO: 34190 - RNA, 27 nt, Artificial Sequence
  DNA-directed RNA polymerase III subunit RPC7 (24-32)
ggcgagaagcugcccgacgugguccuc

SEQ ID NO: 34191 - RNA, 33 nt, Artificial Sequence
  Regulator of nonsense transcripts 1 (585-595)
ggcgagcugagcuccgccgacgagaagcgcuac

SEQ ID NO: 34192 - RNA, 36 nt, Artificial Sequence
  Heat shock protein HSP 90-beta (172-183)
ggcgagcccaucgggcgcggcaccaaggugauccug

SEQ ID NO: 34193 - RNA, 30 nt, Artificial Sequence
  60S ribosomal protein L4 (15-24)
ggcgagagcuccgggaagaacgugacccug

SEQ ID NO: 34194 - RNA, 27 nt, Artificial Sequence
  Prefoldin subunit 6 (11-19)
ggcgagguggagaaguaccagcagcug

SEQ ID NO: 34195 - RNA, 30 nt, Artificial Sequence
  60S ribosomal protein L3 (319-328)
ggcgaggugaccaacgacuucgucaugcug

SEQ ID NO: 34196 - RNA, 27 nt, Artificial Sequence
  Eukaryotic translation initiation factor 3 subunit L (258-266)
ggcgaguacgggcgccacagccuguac

SEQ ID NO: 34197 - RNA, 48 nt, Artificial Sequence
  Keratin, type II cytoskeletal 2 epidermal (142-157)
ggcgggcccggcggguucggcccggggggcuaccccggcgggauccac

SEQ ID NO: 34198 - RNA, 33 nt, Artificial Sequence
  Actin, cytoplasmic 2 (12-22)
ggcauccacgagaccaccuucaacagcaucaug

SEQ ID NO: 34199 - RNA, 33 nt, Artificial Sequence
  Glyceraldehyde-3-phosphate dehydrogenase (2-12)
ggcaaggugaaggucggggugaacggcuucggg

SEQ ID NO: 34200 - RNA, 27 nt, Artificial Sequence
  E3 ubiquitin-protein ligase RNF213 (2847-2855)
ggccuggccgaggacagccccaagaug

SEQ ID NO: 34201 - RNA, 27 nt, Artificial Sequence
  Gem-associated protein 4 (541-549)
ggccuggccaaggccguggcgagcguc

SEQ ID NO: 34202 - RNA, 27 nt, Artificial Sequence
  Histone-lysine N-methyltransferase ASH1L (2026-2034)
ggccuguuccccgccccgauccacgug

SEQ ID NO: 34203 - RNA, 27 nt, Artificial Sequence
  Signal-induced proliferation-associated 1-like protein 2 (957-965)
ggccuggggcagcucggcuuccacgug

SEQ ID NO: 34204 - RNA, 27 nt, Artificial Sequence
  Plectin (4147-4155)
ggccugaucgaccaccagaccuaccuc

SEQ ID NO: 34205 - RNA, 30 nt, Artificial Sequence
  Protein strawberry notch homolog 1 (1078-1087)
ggccugaucggggugggccucaucaacguc

SEQ ID NO: 34206 - RNA, 27 nt, Artificial Sequence
  Elongation factor 2 (343-351)
ggccugaaggaggggauccccgcccuc

SEQ ID NO: 34207 - RNA, 27 nt, Artificial Sequence
  Coatomer subunit alpha (991-999)
ggccugaagaacggggugcccgccguc

SEQ ID NO: 34208 - RNA, 27 nt, Artificial Sequence
  Serine/threonine-protein kinase 17A (41-49)
ggccugcucaccgagauccgcgccgug

SEQ ID NO: 34209 - RNA, 27 nt, Artificial Sequence
  Nuclear receptor corepressor 2 (413-421)
ggccugauggccgaccccaugaaggug

SEQ ID NO: 34210 - RNA, 27 nt, Artificial Sequence
  Serine/threonine-protein kinase Sgk1 (62-70)
ggccugaacgacuucauccagaagauc

SEQ ID NO: 34211 - RNA, 27 nt, Artificial Sequence
  MORC family CW-type zinc finger protein 4 (519-527)
ggccugaacaacaagaccaucggguac

SEQ ID NO: 34212 - RNA, 33 nt, Artificial Sequence
  DNA polymerase alpha subunit B (470-480)
ggccugaccagcaccgaccuccuguuccaccug

SEQ ID NO: 34213 - RNA, 33 nt, Artificial Sequence
  C-terminal-binding protein 2 (814-824)
ggccugguggacgagaaggcccucgcccaggcg

SEQ ID NO: 34214 - RNA, 30 nt, Artificial Sequence
  Staphylococcal nuclease domain-containing protein 1 (829-838)
ggccuggugaaggaggggcucgucauggug

SEQ ID NO: 34215 - RNA, 30 nt, Artificial Sequence
  Basic salivary proline-rich protein 2 (70-79)
ggccccccgcccccccccgggaagccgcag

SEQ ID NO: 34216 - RNA, 33 nt, Artificial Sequence
  Salivary acidic proline-rich phosphoprotein 1/2 (137-147)
ggccccccgcccccccccccggggaagccccag

SEQ ID NO: 34217 - RNA, 36 nt, Artificial Sequence
  Salivary acidic proline-rich phosphoprotein 1/2 (110-121)
ggccccccgcagcaggggggccacccccgccccccc

SEQ ID NO: 34218 - RNA, 27 nt, Artificial Sequence
  Nuclear receptor corepressor 1 (1455-1463)
ggccccagcgugcugcgcuccacccuc

SEQ ID NO: 34219 - RNA, 27 nt, Artificial Sequence
  Histone chaperone ASF1A (103-111)
ggccaggaguucauccgcgugggguac

SEQ ID NO: 34220 - RNA, 27 nt, Artificial Sequence
  Beclin-1 (280-288)
ggccaguucgggaccaucaacaacuuc

SEQ ID NO: 34221 - RNA, 36 nt, Artificial Sequence
  Putative methyltransferase-like protein 15P1 (77-88)
ggccaguucagccaggccgaggcccugcucaugaag

SEQ ID NO: 34222 - RNA, 27 nt, Artificial Sequence
  Dual specificity tyrosine-phosphorylation-regulated kinase 1A (32-40)
ggccagaugccccacagccaccaguac

SEQ ID NO: 34223 - RNA, 33 nt, Artificial Sequence
  Myosin light polypeptide 6 (46-56)
ggccagaaccccaccaacgccgaggugcugaag

SEQ ID NO: 34224 - RNA, 36 nt, Artificial Sequence
  RNA-binding protein EWS (221-232)
ggccagcagagcuccuacgggcagcagagcuccuac

SEQ ID NO: 34225 - RNA, 27 nt, Artificial Sequence
  Putative peripheral benzodiazepine receptor-related protein (21-29)
ggccagugggggggcgggagccacuac

SEQ ID NO: 34226 - RNA, 33 nt, Artificial Sequence
  Store-operated calcium entry-associated regulatory factor (197-207)
ggccaguacagccccccgcccuacuccgaguac

SEQ ID NO: 34227 - RNA, 30 nt, Artificial Sequence
  EH domain-containing protein 1 (65-74)
ggccaguacagcaccgggaagaccacguuc

SEQ ID NO: 34228 - RNA, 27 nt, Artificial Sequence
  Protein FAM216A (60-68)
ggcagcgaccgcaucaaggacggguac

SEQ ID NO: 34229 - RNA, 27 nt, Artificial Sequence
  Splicing factor 3B subunit 1 (46-54)
ggcagcgacucccgcuucgccggguac

SEQ ID NO: 34230 - RNA, 27 nt, Artificial Sequence
  AP-2 complex subunit beta (568-576)
ggcagccuggccuccguguaccacaag

SEQ ID NO: 34231 - RNA, 27 nt, Artificial Sequence
  L-lactate dehydrogenase A chain (68-76)
ggcagccuguuccuccgcacccccaag

SEQ ID NO: 34232 - RNA, 27 nt, Artificial Sequence
  PHD and RING finger domain-containing protein 1 (519-527)
ggcagcuccgacgugaucauccaccgc

SEQ ID NO: 34233 - RNA, 30 nt, Artificial Sequence
  E3 ubiquitin-protein ligase TRAF7 (378-387)
ggcagcuacgacccccagcagaucuucaag

SEQ ID NO: 34234 - RNA, 33 nt, Artificial Sequence
  Voltage-dependent anion-selective channel protein 3 (187-197)
ggcaccgaguucgggggcagcaucuaccagaag

SEQ ID NO: 34235 - RNA, 33 nt, Artificial Sequence
  Iron-responsive element-binding protein 2 (740-750)
ggcaccuucgccaacaucaagcuguucaacaag

SEQ ID NO: 34236 - RNA, 33 nt, Artificial Sequence
  Cyclin-dependent kinase 1 (191-201)
ggcaccaucuucgccgagcuggccaccaagaag

SEQ ID NO: 34237 - RNA, 27 nt, Artificial Sequence
  AP-1 complex subunit beta-1 (568-576)
ggcacccuggccagcguguaccacaag

SEQ ID NO: 34238 - RNA, 27 nt, Artificial Sequence
  Alpha-ketoglutarate-dependent dioxygenase FTO (329-337)
ggcacccuggacuacauccuccagcgc

SEQ ID NO: 34239 - RNA, 36 nt, Artificial Sequence
  Structural maintenance of chromosomes protein 4 (663-674)
ggcaccaugaccgggggcgggagcaaggugaugaag

SEQ ID NO: 34240 - RNA, 27 nt, Artificial Sequence
  Sigma non-opioid intracellular receptor 1 (31-39)
ggcacccagagcuucguguuccagcgc

SEQ ID NO: 34241 - RNA, 27 nt, Artificial Sequence
  F-box/WD repeat-containing protein 11 (19-27)
ggcaccagcuccgugaucgucagccgc

SEQ ID NO: 34242 - RNA, 33 nt, Artificial Sequence
  Protein O-GlcNAcase (729-739)
ggcaccguggacgucacccccuucaucaagaag

SEQ ID NO: 34243 - RNA, 30 nt, Artificial Sequence
  Transcription factor BTF3 (75-84)
ggcaccgugauccacuucaacaaccccaag

SEQ ID NO: 34244 - RNA, 27 nt, Artificial Sequence
  Peptidyl-prolyl cis-trans isomerase FKBP4 (277-285)
ggcaccguguacuucaaggaggggaag

SEQ ID NO: 34245 - RNA, 27 nt, Artificial Sequence
  Tubulin-folding cofactor B (7-15)
ggcguggacgacaaguucuacagcaag

SEQ ID NO: 34246 - RNA, 33 nt, Artificial Sequence
  Activating signal cointegrator 1 complex subunit 1 (166-176)
ggcguggacagcuccaucuuccagaaccccaag

SEQ ID NO: 34247 - RNA, 27 nt, Artificial Sequence
  Eukaryotic translation initiation factor 4 gamma 1 (757-765)
ggcgugaucgaccugaucuucgagaag

SEQ ID NO: 34248 - RNA, 27 nt, Artificial Sequence
  40S ribosomal protein S19 (86-94)
ggcgugaugcccagccacuucucccgc

SEQ ID NO: 34249 - RNA, 27 nt, Artificial Sequence
  Heat shock cognate 71 kDa protein (408-416)
ggcgugaugaccguccugaucaagcgc

SEQ ID NO: 34250 - RNA, 27 nt, Artificial Sequence
  Polypyrimidine tract-binding protein 3 (285-293)
ggcguguacggggacguccaccgcgug

SEQ ID NO: 34251 - RNA, 30 nt, Artificial Sequence
  Polypyrimidine tract-binding protein 2 (308-317)
ggcguguacggggacguccagcgcgugaag

SEQ ID NO: 34252 - RNA, 27 nt, Artificial Sequence
  Mitochondrial genome maintenance exonuclease 1 (204-212)
ggcuacaucgagagcgugcagcacauc

SEQ ID NO: 34253 - RNA, 27 nt, Artificial Sequence
  Catenin beta-1 (186-194)
cacgccaucaugcgcagcccccagaug

SEQ ID NO: 34254 - RNA, 27 nt, Artificial Sequence
  Adenylyl cyclase-associated protein 1 (417-425)
cacgccuaccugagcaagaacucccuc

SEQ ID NO: 34255 - RNA, 27 nt, Artificial Sequence
  Surfeit locus protein 4 (232-240)
cacgacuuccugaaguacgacuucuuc

SEQ ID NO: 34256 - RNA, 27 nt, Artificial Sequence
  NEDD4-binding protein 2-like 1 (64-72)
cacgacuucccccgcgcccugaucuuc

SEQ ID NO: 34257 - RNA, 27 nt, Artificial Sequence
  Cold shock domain-containing protein E1 (507-515)
cacgacaaggagaucuucuuccacuac

SEQ ID NO: 34258 - RNA, 27 nt, Artificial Sequence
  Protein Niban (200-208)
cacgacuacaugaagcagaugaccuuc

SEQ ID NO: 34259 - RNA, 27 nt, Artificial Sequence
  Zinc finger and BTB domain-containing protein 38 (210-218)
cacgaggccgagcccgugcgcacccug

SEQ ID NO: 34260 - RNA, 30 nt, Artificial Sequence
  Synaptic vesicle membrane protein VAT-1 homolog (222-231)
cacgaggcccugaaggagaacggcgugacc

SEQ ID NO: 34261 - RNA, 27 nt, Artificial Sequence
  Protein sel-1 homolog 3 (891-899)
cacgaggcccugcucuacuacgugcug

SEQ ID NO: 34262 - RNA, 30 nt, Artificial Sequence
  Nuclear migration protein nudC (79-88)
cacgaggcccagcugaagaacggcagccuc

SEQ ID NO: 34263 - RNA, 27 nt, Artificial Sequence
  EH domain-containing protein 1 (210-218)
cacgaggacaagauccgcgugguccug

SEQ ID NO: 34264 - RNA, 27 nt, Artificial Sequence
  Exosome complex exonuclease RRP44 (679-687)
cacgaggaguucagcgagcacgcccug

SEQ ID NO: 34265 - RNA, 27 nt, Artificial Sequence
  Repressor of RNA polymerase III transcription MAF1 homolog (116-124)
cacgaguucagccgcgagcccucccug

SEQ ID NO: 34266 - RNA, 27 nt, Artificial Sequence
  Versican core protein (1534-1542)
cacgagcacaccgagcccgugagccug

SEQ ID NO: 34267 - RNA, 27 nt, Artificial Sequence
  Sphingolipid delta(4)-desaturase DES1 (89-97)
cacgagaucgcccacaacgccgcguuc

SEQ ID NO: 34268 - RNA, 30 nt, Artificial Sequence
  Histone-lysine N-methyltransferase 2E (353-362)
cacgagauccaggacggcaccauccaccug

SEQ ID NO: 34269 - RNA, 27 nt, Artificial Sequence
  Endothelial PAS domain-containing protein 1 (39-47)
cacgagcugccccucccgcacagcgug

SEQ ID NO: 34270 - RNA, 30 nt, Artificial Sequence
  ATP-dependent RNA helicase DHX8 (1152-1161)
cacgagcuggugcucaccaccaaggaguac

SEQ ID NO: 34271 - RNA, 24 nt, Artificial Sequence
  E3 ubiquitin-protein ligase RNF213 (1247-1254)
cacgagaugaucauccugaagcuc

SEQ ID NO: 34272 - RNA, 27 nt, Artificial Sequence
  Histone-lysine N-methyltransferase NSD2 (449-457)
cacgagaacgacaucacccacuucuac

SEQ ID NO: 34273 - RNA, 27 nt, Artificial Sequence
  Sorting nexin-6 (212-220)
cacgagcgcaccuuccugcucgaguac

SEQ ID NO: 34274 - RNA, 27 nt, Artificial Sequence
  Heterogeneous nuclear ribonucleoprotein K (415-423)
cacgagagcggcgccuccaucaagauc

SEQ ID NO: 34275 - RNA, 27 nt, Artificial Sequence
  Amyloid-like protein 2 (692-700)
cacggcuacgagaaccccaccuacaag

SEQ ID NO: 34276 - RNA, 27 nt, Artificial Sequence
  Transcription initiation factor TFIID subunit 4 (42-50)
caccuggccccccgcaccccggaggug

SEQ ID NO: 34277 - RNA, 27 nt, Artificial Sequence
  Cysteine and histidine-rich protein 1 (106-114)
caccugggccccgaggggcgcagcgug

SEQ ID NO: 34278 - RNA, 30 nt, Artificial Sequence
  Formin-like protein 2 (244-253)
cacccccacgccgugaacgagaucgcccug

SEQ ID NO: 34279 - RNA, 27 nt, Artificial Sequence
  KRR1 small subunit processome component homolog (214-222)
caccccaucuacaacaucaagagccug

SEQ ID NO: 34280 - RNA, 30 nt, Artificial Sequence
  HLA class I histocompatibility antigen, Cw-7 alpha chain (216-225)
cacccccugagcgaccacgaggccacccuc

SEQ ID NO: 34281 - RNA, 27 nt, Artificial Sequence
  V-type proton ATPase 116 kDa subunit a isoform 3 (715-723)
caccaggccauccacaccaucgaguuc

SEQ ID NO: 34282 - RNA, 27 nt, Artificial Sequence
  Dymeclin (278-286)
caccagaacagcaacauccgcaccuac

SEQ ID NO: 34283 - RNA, 24 nt, Artificial Sequence
  WD repeat-containing protein 1 (59-66)
caccagguggucguggccaaguac

SEQ ID NO: 34284 - RNA, 27 nt, Artificial Sequence
  HLA class I histocompatibility antigen, A-2 alpha chain (73-81)
caccgcguggaccugggcacccuccgg

SEQ ID NO: 34285 - RNA, 24 nt, Artificial Sequence
  Endoplasmic reticulum resident protein 44 (95-102)
cacagcgacaucgcccagcgcuac

SEQ ID NO: 34286 - RNA, 27 nt, Artificial Sequence
  Histone deacetylase 4 (715-723)
cacagcgaggcccacacccugcucuac

SEQ ID NO: 34287 - RNA, 27 nt, Artificial Sequence
  Nucleolar protein 10 (122-130)
cacagccaguccggcuucuacuacaag

SEQ ID NO: 34288 - RNA, 24 nt, Artificial Sequence
  Eukaryotic translation initiation factor 3 subunit F (182-189)
cacagcgugcugauccacgaguac

SEQ ID NO: 34289 - RNA, 27 nt, Artificial Sequence
  Dual specificity protein phosphatase 5 (234-242)
cacaccgccgacaucagcucccacuuc

SEQ ID NO: 34290 - RNA, 30 nt, Artificial Sequence
  AP-3 complex subunit delta-1 (383-392)
cacguggacaaggccgagggcaccaccuac

SEQ ID NO: 34291 - RNA, 27 nt, Artificial Sequence
  Rac GTPase-activating protein 1 (480-488)
cacgugaucgagaacagcaacgccuuc

SEQ ID NO: 34292 - RNA, 27 nt, Artificial Sequence
  T-complex protein 1 subunit epsilon (135-143)
cacgugaucgagacccugaucggcaag

SEQ ID NO: 34293 - RNA, 27 nt, Artificial Sequence
  Triple functional domain protein (477-485)
cacgugcuggacgucauccacgaggug

SEQ ID NO: 34294 - RNA, 27 nt, Artificial Sequence
  Manganese-transporting ATPase 13A1 (956-964)
aucgccgcccccuucaccagcaagcug

SEQ ID NO: 34295 - RNA, 45 nt, Artificial Sequence
  Solute carrier family 2, facilitated glucose transporter member 1 (21-35)
aucgcccagguguucggccuggacagcaucauggggaacaaggac

SEQ ID NO: 34296 - RNA, 24 nt, Artificial Sequence
  Insulin receptor substrate 2 (1323-1330)
aucgacuuccugagccaccaccuc

SEQ ID NO: 34297 - RNA, 24 nt, Artificial Sequence
  Neuroblast differentiation-associated protein AHNAK (4419-4426)
aucgacaucaagggccccagccug

SEQ ID NO: 34298 - RNA, 27 nt, Artificial Sequence
  Tripeptidyl-peptidase 2 (1087-1095)
aucgaccagaccgcccuggccguguac

SEQ ID NO: 34299 - RNA, 33 nt, Artificial Sequence
  U5 small nuclear ribonucleoprotein 200 kDa helicase (803-813)
aucgaggagcccagcgccaagaucaacgugcug

SEQ ID NO: 34300 - RNA, 27 nt, Artificial Sequence
  Structural maintenance of chromosomes protein 1A (7-15)
aucgagaucgagaacuucaagagcuac

SEQ ID NO: 34301 - RNA, 24 nt, Artificial Sequence
  Casein kinase I isoform delta (51-58)
aucgagagcaagaucuacaagaug

SEQ ID NO: 34302 - RNA, 24 nt, Artificial Sequence
  Protein S100-A9 (12-19)
aucgagaccaucaucaacaccuuc

SEQ ID NO: 34303 - RNA, 30 nt, Artificial Sequence
  Probable UDP-sugar transporter protein SLC35A5 (264-273)
aucuucauccagaacagcaagcuguacuuc

SEQ ID NO: 34304 - RNA, 30 nt, Artificial Sequence
  Pre-mRNA-processing-splicing factor 8 (1809-1818)
aucuucaacccccgcaccggccagcuguuc

SEQ ID NO: 34305 - RNA, 39 nt, Artificial Sequence
  ATP synthase-coupling factor 6, mitochondrial (25-37)
aucggcgugaccgccgucgccuucaacaaggagcuggac

SEQ ID NO: 34306 - RNA, 27 nt, Artificial Sequence
  DNA damage-binding protein 1 (793-801)
aucaucgaccagcacaccuucgaggug

SEQ ID NO: 34307 - RNA, 27 nt, Artificial Sequence
  26S proteasome non-ATPase regulatory subunit 2 (809-817)
aucauccugggcaagagccacuacgug

SEQ ID NO: 34308 - RNA, 36 nt, Artificial Sequence
  Elongation factor 1-alpha 1 (178-189)
aucaagaagaucggcuacaaccccgacaccguggcc

SEQ ID NO: 34309 - RNA, 33 nt, Artificial Sequence
  Probable ATP-dependent RNA helicase DDX60-like (1497-1507)
auccuggccgagcuccccgaggacuucaaggcc

SEQ ID NO: 34310 - RNA, 27 nt, Artificial Sequence
  Interferon-induced GTP-binding protein Mx2 (436-444)
auccuggccaccaacacccagaaggug

SEQ ID NO: 34311 - RNA, 33 nt, Artificial Sequence
  Eukaryotic translation initiation factor 4 gamma 3 (389-399)
auccuggagaaccccccggaggagaugaagcuc

SEQ ID NO: 34312 - RNA, 27 nt, Artificial Sequence
  ATP-dependent RNA helicase DDX42 (333-341)
auccugaucgaccccauccgcgugguc

SEQ ID NO: 34313 - RNA, 27 nt, Artificial Sequence
  Phosphorylated CTD-interacting factor 1 (267-275)
aucaugaacgacauccccauccgccug

SEQ ID NO: 34314 - RNA, 27 nt, Artificial Sequence
  RNA polymerase-associated protein CTR9 homolog (124-132)
aucauguacgaccagaaccaccugcuc

SEQ ID NO: 34315 - RNA, 51 nt, Artificial Sequence
  Cystatin-A (2-18)
auccccggcgggcugagcgaggccaagccggccacccccgagauccaggag

SEQ ID NO: 34316 - RNA, 30 nt, Artificial Sequence
  Splicing factor U2AF 65 kDa subunit (413-422)
aucccccgcccgguggacggcgucgaggug

SEQ ID NO: 34317 - RNA, 27 nt, Artificial Sequence
  Membrane-bound transcription factor site-1 protease (189-197)
aucccccgccagguggcccagacccug

SEQ ID NO: 34318 - RNA, 33 nt, Artificial Sequence
  Cytospin-A (862-872)
aucccccgcaccccgcugagccccucccccaug

SEQ ID NO: 34319 - RNA, 33 nt, Artificial Sequence
  Filamin-A (1569-1579)
auccaggacaaccacgacggcaccuacaccgug

SEQ ID NO: 34320 - RNA, 33 nt, Artificial Sequence
  UBX domain-containing protein 4 (322-332)
auccaguuccgccugcccgacggcagcuccuuc

SEQ ID NO: 34321 - RNA, 30 nt, Artificial Sequence
  Thyroid receptor-interacting protein 11 (87-96)
auccagaucaagcagcagagcaccuccuac

SEQ ID NO: 34322 - RNA, 27 nt, Artificial Sequence
  Coatomer subunit delta (393-401)
auccaggugaccaaggucacccaggug

SEQ ID NO: 34323 - RNA, 27 nt, Artificial Sequence
  Kinesin-like protein KIF11 (400-408)
aucagcgaggagaacuuccgcgugaug

SEQ ID NO: 34324 - RNA, 42 nt, Artificial Sequence
  FAST kinase domain-containing protein 2 (542-555)
aucagcgagcugcucaccuccgacgacaugaagaacgccuac

SEQ ID NO: 34325 - RNA, 27 nt, Artificial Sequence
  LEM domain-containing protein 2 (23-31)
aucaccgacaccacgcgcgacguguac

SEQ ID NO: 34326 - RNA, 48 nt, Artificial Sequence
  Galectin-3 (132-147)
aucaccauccugggcaccgugaagcccaacgccaaccgcaucgcccuc

SEQ ID NO: 34327 - RNA, 27 nt, Artificial Sequence
  NADH dehydrogenase (ubiquinone) 1 beta subcomplex subunit 10 (34-42)
aucguggaccgccccgucacccuggug

SEQ ID NO: 34328 - RNA, 27 nt, Artificial Sequence
  Cell division cycle protein 27 homolog (695-703)
aucgugaucgaccccaagaacccgcug

SEQ ID NO: 34329 - RNA, 42 nt, Artificial Sequence
  Macrophage migration inhibitory factor (3-16)
aucgugaacaccaacgucccccgcgccagcgugccggacggc

SEQ ID NO: 34330 - RNA, 30 nt, Artificial Sequence
  Solute carrier family 12 member 6 (219-228)
aucuacgccggcgccaucaagagcuccuuc

SEQ ID NO: 34331 - RNA, 27 nt, Artificial Sequence
  ATP-dependent RNA helicase DHX29 (1317-1325)
aucuacuuccaggcccccgugaagauc

SEQ ID NO: 34332 - RNA, 27 nt, Artificial Sequence
  Tripeptidyl-peptidase 2 (478-486)
aucuaccugcgcgaccccgugcagguc

SEQ ID NO: 34333 - RNA, 27 nt, Artificial Sequence
  BCL2/adenovirus E1B 19 kDa protein-interacting protein 3 (38-46)
aucuacaacggcgacauggagaagauc

SEQ ID NO: 34334 - RNA, 27 nt, Artificial Sequence
  Serine/threonine-protein phosphatase 2A 56 kDa regulatory subunit gamma isoform (91-99)
aucuaccccgaggugguccacauguuc

SEQ ID NO: 34335 - RNA, 33 nt, Artificial Sequence
  Flotillin-2 (104-114)
aucuaccaggaccgcgaccaguucgccaagcug

SEQ ID NO: 34336 - RNA, 27 nt, Artificial Sequence
  Bardet-Biedl syndrome 4 protein (45-53)
aucuaccagaaggccuucgagcaccug

SEQ ID NO: 34337 - RNA, 27 nt, Artificial Sequence
  Signal transducer and activator of transcription 6 (87-95)
aucuaccagcgcgacccccugaagcuc

SEQ ID NO: 34338 - RNA, 27 nt, Artificial Sequence
  Progestin and adipoQ receptor family member 4 (52-60)
aucuacacccacggccuggcccuccug

SEQ ID NO: 34339 - RNA, 24 nt, Artificial Sequence
  40S ribosomal protein S23 (29-36)
aaggcccaccugggcaccgcccuc

SEQ ID NO: 34340 - RNA, 27 nt, Artificial Sequence
  Peroxisomal membrane protein PMP34 (213-221)
aaggccaucgccaccaccgugacguac

SEQ ID NO: 34341 - RNA, 27 nt, Artificial Sequence
  Protein PRRC2C (2255-2263)
aaggccugggagaacagccccaacgug

SEQ ID NO: 34342 - RNA, 30 nt, Artificial Sequence
  Polycystic kidney disease and receptor for egg jelly-related protein (701-710)
aaggacuuccugcccgccggcuaccuccug

SEQ ID NO: 34343 - RNA, 27 nt, Artificial Sequence
  FERM domain-containing protein 6 (545-553)
aaggacuuccugcgcaucgccggccuc

SEQ ID NO: 34344 - RNA, 33 nt, Artificial Sequence
  Microtubule-actin cross-linking factor 1, isoforms 1/2/3/5 (2405-2415)
aaggacaagcugaaggacgccaccgagcgcuac

SEQ ID NO: 34345 - RNA, 27 nt, Artificial Sequence
  Calcium-binding protein 39 (189-197)
aaggaccugcucacccgccacaagcug

SEQ ID NO: 34346 - RNA, 27 nt, Artificial Sequence
  Ribonucleoside-diphosphate reductase subunit M2 B (73-81)
aaggaccugccccacuggaacaagcuc

SEQ ID NO: 34347 - RNA, 27 nt, Artificial Sequence
  Spectrin beta chain, non-erythrocytic 1 (655-663)
aaggaccugaccagcgugaugcgccuc

SEQ ID NO: 34348 - RNA, 27 nt, Artificial Sequence
  Plastin-3 (18-26)
aaggaggccuucgccaagguggaccug

SEQ ID NO: 34349 - RNA, 27 nt, Artificial Sequence
  Protein Red (496-504)
aaggaggcccugcccaaggccgcguuc

SEQ ID NO: 34350 - RNA, 30 nt, Artificial Sequence
  Protein KHNYN (158-167)
aaggaggcccugcaggaccccuucacccuc

SEQ ID NO: 34351 - RNA, 27 nt, Artificial Sequence
  40S ribosomal protein S15 (65-73)
aaggaggcccccccgauggagaagccc

SEQ ID NO: 34352 - RNA, 27 nt, Artificial Sequence
  Protein transport protein Sec23B (564-572)
aaggaggaccccaccagcuuccgccug

SEQ ID NO: 34353 - RNA, 33 nt, Artificial Sequence
  Tropomyosin alpha-4 chain (228-238)
aaggaggagaacgugggccugcaccagacccuc

SEQ ID NO: 34354 - RNA, 30 nt, Artificial Sequence
  Putative methyltransferase NSUN6 (163-172)
aaggaguucgacggcaccaagguguuccug

SEQ ID NO: 34355 - RNA, 30 nt, Artificial Sequence
  Sin3 histone deacetylase corepressor complex component SDS3 (137-146)
aaggaguucgaggacaagaagguggagcug

SEQ ID NO: 34356 - RNA, 27 nt, Artificial Sequence
  Heat shock protein HSP 90-alpha (656-664)
aaggaguucgagggcaagacccuggug

SEQ ID NO: 34357 - RNA, 27 nt, Artificial Sequence
  Protein S100-A10 (37-45)
aaggaguuccccggcuuccuggagaac

SEQ ID NO: 34358 - RNA, 36 nt, Artificial Sequence
  Serine palmitoyltransferase 2 (526-537)
aaggagaucgacgaggugggcgaccugcuccagcug

SEQ ID NO: 34359 - RNA, 27 nt, Artificial Sequence
  Melanoma-associated antigen D4 (471-479)
aaggagaucgacaaggaggagcaccug

SEQ ID NO: 34360 - RNA, 39 nt, Artificial Sequence
  Spectrin beta chain, non-erythrocytic 1 (1434-1446)
aaggagaucgaggagcugcagagccaggcccaggcccuc

SEQ ID NO: 34361 - RNA, 36 nt, Artificial Sequence
  Calcium/calmodulin-dependent protein kinase type IV (135-146)
aaggagaucuucgagacccccaccgagaucagccug

SEQ ID NO: 34362 - RNA, 27 nt, Artificial Sequence
  E3 ubiquitin-protein ligase RNF19B (187-195)
aaggagaucagcgaccugcacuaccuc

SEQ ID NO: 34363 - RNA, 27 nt, Artificial Sequence
  Centromere protein F (392-400)
aaggagaaggaguuccaggaggagcug

SEQ ID NO: 34364 - RNA, 30 nt, Artificial Sequence
  Girdin (728-737)
aaggagcuggagagcgagaaggagcagcuc

SEQ ID NO: 34365 - RNA, 30 nt, Artificial Sequence
  Testin (173-182)
aaggagauggagcaguucgugaagaaguac

SEQ ID NO: 34366 - RNA, 30 nt, Artificial Sequence
  Leucine-tRNA ligase, cytoplasmic (775-784)
aaggagaugguggccaacugggacagccug

SEQ ID NO: 34367 - RNA, 30 nt, Artificial Sequence
  SWI/SNF-related matrix-associated actin-dependent regulator of chromatin subfamily B member 1 (277-286)
aaggagaacagccccgagaaguucgcccug

SEQ ID NO: 34368 - RNA, 33 nt, Artificial Sequence
  Squalene monooxygenase (157-167)
aaggagcccgaccgcaucgugggcgaguuccug

SEQ ID NO: 34369 - RNA, 27 nt, Artificial Sequence
  Calcium uptake protein 2, mitochondrial (204-212)
aaggagcccgagaucaacaccacccug

SEQ ID NO: 34370 - RNA, 27 nt, Artificial Sequence
  Farnesyl pyrophosphate synthase (39-47)
aaggaggugcuggaguacaacgccauc

SEQ ID NO: 34371 - RNA, 24 nt, Artificial Sequence
  Tetratricopeptide repeat protein 25 (351-358)
aaggaguacgaccugcccgacgcc

SEQ ID NO: 34372 - RNA, 30 nt, Artificial Sequence
  Inhibitor of growth protein 5 (76-85)
aaggaguacagcgacgacaaggugcagcug

SEQ ID NO: 34373 - RNA, 27 nt, Artificial Sequence
  Son of sevenless homolog 2 (677-685)
aaggaguacgugcagcccguccagcug

SEQ ID NO: 34374 - RNA, 27 nt, Artificial Sequence
  Nodal modulator 2 (392-400)
aagaucgcccccaacaccccgcagcug

SEQ ID NO: 34375 - RNA, 30 nt, Artificial Sequence
  Trans-Golgi network integral membrane protein 2 (408-417)
aagaucaucgccuucgugcuggagggcaag

SEQ ID NO: 34376 - RNA, 27 nt, Artificial Sequence
  Interleukin enhancer-binding factor 2 (127-135)
aagauccugcccacccucgaggccgug

SEQ ID NO: 34377 - RNA, 27 nt, Artificial Sequence
  Insulin-like growth factor 2 mRNA-binding protein 3 (552-560)
aagauccaggagauccugacccaggug

SEQ ID NO: 34378 - RNA, 30 nt, Artificial Sequence
  WD repeat-containing protein 1 (119-128)
aagaucugggacgugagcgucaacuccgug

SEQ ID NO: 34379 - RNA, 27 nt, Artificial Sequence
  Transcription factor SOX-8 (1-9)
aagcuggccgaccaguacccccaccuc

SEQ ID NO: 34380 - RNA, 27 nt, Artificial Sequence
  14-3-3 protein theta (11-19)
aagcuggccgagcaggccgagcgcuac

SEQ ID NO: 34381 - RNA, 27 nt, Artificial Sequence
  Akirin-1 (163-171)
aagcuggccgagcaguacgagagcuuc

SEQ ID NO: 34382 - RNA, 33 nt, Artificial Sequence
  Akirin-1 (163-173)
aagcuggccgagcaguacgagagcuucgugaag

SEQ ID NO: 34383 - RNA, 27 nt, Artificial Sequence
  V-type proton ATPase subunit C 1 (25-33)
aagcuggacgccuucguggagggcguc

SEQ ID NO: 34384 - RNA, 27 nt, Artificial Sequence
  Kinetochore-associated protein 1 (1298-1306)
aagcuguucggcgagaccacccucgug

SEQ ID NO: 34385 - RNA, 27 nt, Artificial Sequence
  Heterogeneous nuclear ribonucleoprotein A0 (8-16)
aagcuguucaucggcgggcucaacgug

SEQ ID NO: 34386 - RNA, 27 nt, Artificial Sequence
  Heterogeneous nuclear ribonucleoprotein A1 (15-23)
aagcuguucaucggcgggcucagcuuc

SEQ ID NO: 34387 - RNA, 30 nt, Artificial Sequence
  Serine/threonine-protein kinase DCLK2 (534-543)
aagcugggcgacuucgggcucgccaccgug

SEQ ID NO: 34388 - RNA, 27 nt, Artificial Sequence
  TRPM8 channel-associated factor 1 (199-207)
aagcugggcagcgugcccgucaccgug

SEQ ID NO: 34389 - RNA, 27 nt, Artificial Sequence
  Transformation/transcription domain-associated protein (911-919)
aagcugcacuacguggucaccgaggug

SEQ ID NO: 34390 - RNA, 33 nt, Artificial Sequence
  E3 ubiquitin-protein ligase UBR4 (1375-1385)
aagcugaucgacgagacccaggacaugcuccug

SEQ ID NO: 34391 - RNA, 27 nt, Artificial Sequence
  Pericentriolar material 1 protein (412-420)
aagcugcucggcgagcugcacacccug

SEQ ID NO: 34392 - RNA, 27 nt, Artificial Sequence
  Peptidyl-prolyl cis-trans isomerase FKBP3 (42-50)
aagcugcucggcaacaucaagaacgug

SEQ ID NO: 34393 - RNA, 27 nt, Artificial Sequence
  Calnexin (166-174)
aagcugcucagcaagacccccgagcug

SEQ ID NO: 34394 - RNA, 27 nt, Artificial Sequence
  Golgin subfamily A member 5 (484-492)
aagcugaugggccagauccaccagcuc

SEQ ID NO: 34395 - RNA, 27 nt, Artificial Sequence
  TBC1 domain family member 13 (39-47)
aagcugaaccccggcaucgccuacgug

SEQ ID NO: 34396 - RNA, 27 nt, Artificial Sequence
  E3 ubiquitin-protein ligase TRIP12 (912-920)
aagcugcccgacaucuucagcguguac

SEQ ID NO: 34397 - RNA, 30 nt, Artificial Sequence
  Kelch-like protein 24 (347-356)
aagcugcccgaguucaccaagagcgaguac

SEQ ID NO: 34398 - RNA, 27 nt, Artificial Sequence
  Transmembrane and coiled-coil domain-containing protein 1 (116-124)
aagcugcccuucaccccgcucagcuac

SEQ ID NO: 34399 - RNA, 30 nt, Artificial Sequence
  HLA class II histocompatibility antigen, DR beta 5 chain (5-14)
aagcugcccggcgggagcuacauggccaag

SEQ ID NO: 34400 - RNA, 27 nt, Artificial Sequence
  Fanconi anemia group I protein (16-24)
aagcugcaggaguuccuccagacccug

SEQ ID NO: 34401 - RNA, 27 nt, Artificial Sequence
  Tyrosine-protein kinase BAZ1B (379-387)
aagcugagcgagaucccccucacccug

SEQ ID NO: 34402 - RNA, 27 nt, Artificial Sequence
  E3 SUMO-protein ligase CBX4 (347-355)
aagcugagccccaccaaggaggccuuc

SEQ ID NO: 34403 - RNA, 27 nt, Artificial Sequence
  PWWP domain-containing protein MUM1 (574-582)
aagcugguggaguacaucgucaaggcc

SEQ ID NO: 34404 - RNA, 27 nt, Artificial Sequence
  Minor histocompatibility protein HA-1 (532-540)
aagcuguacgaccccggccagcaguac

SEQ ID NO: 34405 - RNA, 27 nt, Artificial Sequence
  Replication factor C subunit 5 (304-312)
aagauggccgacaucgaguaccgccug

SEQ ID NO: 34406 - RNA, 36 nt, Artificial Sequence
  Interferon-induced transmembrane protein 2 (87-98)
aagauggugggcgacgucaccggggcccaggccuac

SEQ ID NO: 34407 - RNA, 33 nt, Artificial Sequence
  U1 small nuclear ribonucleoprotein 70 kDa (87-97)
aagaugugggacccccacaacgacccgaacgcc

SEQ ID NO: 34408 - RNA, 33 nt, Artificial Sequence
  Myosin-9 (517-527)
aagcccgccggcccgcccgggauccuggcccuc

SEQ ID NO: 34409 - RNA, 30 nt, Artificial Sequence
  Transketolase (6-15)
aagcccgaccagcagaagcugcaggcccuc

SEQ ID NO: 34410 - RNA, 30 nt, Artificial Sequence
  Calponin-3 (156-165)
aagcccuucgaccagaccaccaucagccug

SEQ ID NO: 34411 - RNA, 33 nt, Artificial Sequence
  DNA polymerase kappa (36-46)
aagcccaucgccgugggcagcauguccaugcug

SEQ ID NO: 34412 - RNA, 27 nt, Artificial Sequence
  Elongation factor 2 (445-453)
aagcccauccagcgcaccauccugaug

SEQ ID NO: 34413 - RNA, 27 nt, Artificial Sequence
  Galectin-3 (139-147)
aagcccaacgccaaccgcaucgcccug

SEQ ID NO: 34414 - RNA, 33 nt, Artificial Sequence
  Spectrin beta chain, non-erythrocytic 1 (1939-1949)
aagccccgcgacgugagcuccgucgagcugcuc

SEQ ID NO: 34415 - RNA, 30 nt, Artificial Sequence
  Methionine synthase (342-351)
aagccccgcgugccgcccgccaccgccuuc

SEQ ID NO: 34416 - RNA, 27 nt, Artificial Sequence
  Peroxisomal multifunctional enzyme type 2 (565-573)
aagcccguguacccgggccagacccug

SEQ ID NO: 34417 - RNA, 24 nt, Artificial Sequence
  SWI/SNF-related matrix-associated actin-dependent regulator of chromatin subfamily A containing DEAD/H box 1 (68-75)
aagcccuaccagaaggugggccug

SEQ ID NO: 34418 - RNA, 27 nt, Artificial Sequence
  Programmed cell death protein 6 (116-124)
aagcaggcccugagcggcuucggguac

SEQ ID NO: 34419 - RNA, 27 nt, Artificial Sequence
  Ubiquitin-associated protein 2-like (939-947)
aagcagcacggcgugaacgucagcgug

SEQ ID NO: 34420 - RNA, 27 nt, Artificial Sequence
  DnaJ homolog subfamily A member 1 (46-54)
aagcagaucagccaggccuacgaggug

SEQ ID NO: 34421 - RNA, 27 nt, Artificial Sequence
  E3 ubiquitin-protein ligase MGRN1 (240-248)
aagcagaucguggaccgcgucagcuac

SEQ ID NO: 34422 - RNA, 30 nt, Artificial Sequence
  MICOS complex subunit MIC60 (724-733)
aagcagaucguggagauccugaccgccuac

SEQ ID NO: 34423 - RNA, 27 nt, Artificial Sequence
  Transgelin-2 (88-96)
aagcagauggagcagaucagccaguuc

SEQ ID NO: 34424 - RNA, 30 nt, Artificial Sequence
  Transgelin-2 (88-97)
aagcagauggagcagaucagccaguuccug

SEQ ID NO: 34425 - RNA, 27 nt, Artificial Sequence
  Zinc finger MIZ domain-containing protein 2 (174-182)
aagcagagccaggagcugucccaguac

SEQ ID NO: 34426 - RNA, 27 nt, Artificial Sequence
  Heat shock cognate 71 kDa protein (423-431)
aagcagacccagaccuucacgaccuac

SEQ ID NO: 34427 - RNA, 27 nt, Artificial Sequence
  Heterogeneous nuclear ribonucleoprotein K (456-464)
aagcaguacgccgacguggagggcuuc

SEQ ID NO: 34428 - RNA, 27 nt, Artificial Sequence
  T-complex protein 1 subunit theta (98-106)
aagcaguacggcaacgagguguuccug

SEQ ID NO: 34429 - RNA, 27 nt, Artificial Sequence
  Coatomer subunit beta' (386-394)
aagagcuucggcuccgcccaggaguuc

SEQ ID NO: 34430 - RNA, 33 nt, Artificial Sequence
  Elongation factor 1-alpha 1 (20-30)
aagagcaccaccacgggccaccugaucuacaag

SEQ ID NO: 34431 - RNA, 27 nt, Artificial Sequence
  Translocation protein SEC63 homolog (95-103)
aagaccgaccgcgaguaccaggaguac

SEQ ID NO: 34432 - RNA, 27 nt, Artificial Sequence
  E3 ubiquitin-protein ligase RBBP6 (1474-1482)
aagaccgacuacgacacccgcgaguac

SEQ ID NO: 34433 - RNA, 33 nt, Artificial Sequence
  Probable ATP-dependent RNA helicase DDX47 (195-205)
aagaccuuccuguucagcgccaccaugacgaag

SEQ ID NO: 34434 - RNA, 27 nt, Artificial Sequence
  Cytoplasmic dynein 1 heavy chain 1 (872-880)
aagaccuucagcgagauccugaaccgc

SEQ ID NO: 34435 - RNA, 27 nt, Artificial Sequence
  Chromodomain Y-like protein (93-101)
aagaccagccccaaggcccuggugauc

SEQ ID NO: 34436 - RNA, 36 nt, Artificial Sequence
  Protein polybromo-1 (260-271)
aagaccuacaacgagcccggcagccagguguucaag

SEQ ID NO: 34437 - RNA, 27 nt, Artificial Sequence
  60S ribosomal protein L7a (11-19)
aagguggcccccgccccggcggucgug

SEQ ID NO: 34438 - RNA, 27 nt, Artificial Sequence
  Procollagen-lysine,2-oxoglutarate 5-dioxygenase 2 (109-117)
aagguguucgccggcuacuacaccaag

SEQ ID NO: 34439 - RNA, 27 nt, Artificial Sequence
  Nucleolin (370-378)
aagguguucggcaacgagaucaagcug

SEQ ID NO: 34440 - RNA, 27 nt, Artificial Sequence
  F-box only protein 28 (103-111)
aaggugaucgacgagaucuaccgcguc

SEQ ID NO: 34441 - RNA, 27 nt, Artificial Sequence
  Trafficking protein particle complex subunit 5 (81-89)
aaggugcugggcgcccuccuguucguc

SEQ ID NO: 34442 - RNA, 30 nt, Artificial Sequence
  Long-chain-fatty-acid-CoA ligase 4 (347-356)
aaggugcaggagaugaacuacauccagaag

SEQ ID NO: 34443 - RNA, 27 nt, Artificial Sequence
  78 kDa glucose-regulated protein (146-154)
aaggugacccacgccgucgugaccgug

SEQ ID NO: 34444 - RNA, 27 nt, Artificial Sequence
  26S proteasome non-ATPase regulatory subunit 11 (409-417)
aagguggucgacagccuguacaacaag

SEQ ID NO: 34445 - RNA, 27 nt, Artificial Sequence
  Tripartite motif-containing protein 34 (162-170)
aaguacggcguguucgaggagagccug

SEQ ID NO: 34446 - RNA, 27 nt, Artificial Sequence
  Tubulin-tyrosine ligase (184-192)
aaguaccuggagcacccccuccugcug

SEQ ID NO: 34447 - RNA, 27 nt, Artificial Sequence
  DNA topoisomerase 3-beta-1 (425-433)
aaguaccugcagagcaccaucuccuuc

SEQ ID NO: 34448 - RNA, 27 nt, Artificial Sequence
  Lysine-specific demethylase 2A (48-56)
aaguacaacgccaacuucgugaccuuc

SEQ ID NO: 34449 - RNA, 27 nt, Artificial Sequence
  Hermansky-Pudlak syndrome 3 protein (16-24)
aaguaccagaucaucaacgaggaguuc

SEQ ID NO: 34450 - RNA, 27 nt, Artificial Sequence
  G/T mismatch-specific thymine DNAosylase (221-229)
aaguaccagccccgcaucgccguguuc

SEQ ID NO: 34451 - RNA, 27 nt, Artificial Sequence
  Casein kinase II subunit alpha (49-57)
aaguacagcgagguguucgaggccauc

SEQ ID NO: 34452 - RNA, 36 nt, Artificial Sequence
  Eukaryotic translation initiation factor 3 subunit D (58-69)
aaguacagcucccaguucggcgggggcagccaguac

SEQ ID NO: 34453 - RNA, 27 nt, Artificial Sequence
  E3 ubiquitin-protein ligase listerin (1408-1416)
aaguacgugagcuccguccugagcuuc

SEQ ID NO: 34454 - RNA, 51 nt, Artificial Sequence
  Glutathione S-transferase P (194-210)
cuggccagccccgaguacgugaaccucccgaucaacggcaacgggaagcag

SEQ ID NO: 34455 - RNA, 27 nt, Artificial Sequence
  Msx2-interacting protein (2085-2093)
cuggccguggacaagagcgccucccuc

SEQ ID NO: 34456 - RNA, 24 nt, Artificial Sequence
  Transducin beta-like protein 3 (781-788)
cuggacuuccucuggcacaacaug

SEQ ID NO: 34457 - RNA, 27 nt, Artificial Sequence
  Negative regulator of reactive oxygen species (186-194)
cuggaccuccagcgcaacuacaucuuc

SEQ ID NO: 34458 - RNA, 27 nt, Artificial Sequence
  Protein S100-A9 (66-74)
cuggacaccaacgccgacaagcagcuc

SEQ ID NO: 34459 - RNA, 30 nt, Artificial Sequence
  Ubiquitin-60S ribosomal protein L40 (55-64)
cuggaggacggccgcacccucagcgacuac

SEQ ID NO: 34460 - RNA, 27 nt, Artificial Sequence
  Microtubule-actin cross-linking factor 1 isoform X1 (2426-2434)
cuggaggaggacagcgcccgcgagauc

SEQ ID NO: 34461 - RNA, 24 nt, Artificial Sequence
  Coatomer subunit zeta-1 (62-69)
cuggagggccucaccguggucuac

SEQ ID NO: 34462 - RNA, 27 nt, Artificial Sequence
  Phosphatidylinositol 4-kinase alpha (113-121)
cuggagauccaggacaaggaguaccuc

SEQ ID NO: 34463 - RNA, 24 nt, Artificial Sequence
  Vimentin (220-227)
cuggagcgcaagguggagagccuc

SEQ ID NO: 34464 - RNA, 27 nt, Artificial Sequence
  BAG family molecular chaperone regulator 2 (29-37)
cuggagagccucgaccagcuggagcug

SEQ ID NO: 34465 - RNA, 27 nt, Artificial Sequence
  Ubiquitin carboxyl-terminal hydrolase 11 (266-274)
cuggagaccggccagcucaucaucaug

SEQ ID NO: 34466 - RNA, 27 nt, Artificial Sequence
  ATP-dependent RNA helicase DDX1 (284-292)
cugaucguggagcccagccgcgagcuc

SEQ ID NO: 34467 - RNA, 27 nt, Artificial Sequence
  60S acidic ribosomal protein P0 (102-110)
cugcucgccaacaaggugcccgccgcg

SEQ ID NO: 34468 - RNA, 27 nt, Artificial Sequence
  Ras GTPase-activating-like protein IQGAP2 (984-992)
cugcucgcccccguggucaaggagauc

SEQ ID NO: 34469 - RNA, 27 nt, Artificial Sequence
  Nucleolar complex protein 4 homolog (333-341)
cugcucgaccccagcguguuccacguc

SEQ ID NO: 34470 - RNA, 27 nt, Artificial Sequence
  Inositol hexakisphosphate kinase 2 (76-84)
cugcucgagcccuucgugcaccagguc

SEQ ID NO: 34471 - RNA, 27 nt, Artificial Sequence
  TBC1 domain family member 9B (211-219)
cugcucuuccccgagagcauccgcgug

SEQ ID NO: 34472 - RNA, 27 nt, Artificial Sequence
  Ganglioside GM2 activator (15-23)
cugcuccuggccgcccccgcgcaggcc

SEQ ID NO: 34473 - RNA, 27 nt, Artificial Sequence
  DNA damage-binding protein 1 (1050-1058)
cugcuccuggacaugcagaaccgccug

SEQ ID NO: 34474 - RNA, 27 nt, Artificial Sequence
  Retinoblastoma-associated protein (476-484)
cugcucaacgacaacaucuuccacaug

SEQ ID NO: 34475 - RNA, 30 nt, Artificial Sequence
  RNA-binding protein 12B (432-441)
cugcucuacgacgacaagggcguggggcug

SEQ ID NO: 34476 - RNA, 27 nt, Artificial Sequence
  Beta-galactoside alpha-2,6-sialyltransferase 1 (371-379)
cugcucuacgagaagaaccuggugaag

SEQ ID NO: 34477 - RNA, 33 nt, Artificial Sequence
  Junction plakoglobin (16-26)
cugcucuaccaggagggcgccaagauggccgug

SEQ ID NO: 34478 - RNA, 36 nt, Artificial Sequence
  General transcription factor IIH subunit 5 (60-71)
cugauggaccagaacgccuucagccucacccagaag

SEQ ID NO: 34479 - RNA, 30 nt, Artificial Sequence
  Dynactin subunit 5 (164-173)
cugaugaucgacgugaccaagagcuacuac

SEQ ID NO: 34480 - RNA, 27 nt, Artificial Sequence
  Protein SSXT (79-87)
cugcccgccccgcccacccagaacaug

SEQ ID NO: 34481 - RNA, 27 nt, Artificial Sequence
  N-terminal Xaa-Pro-Lys N-methyltransferase 1 (211-219)
cugcccgacgagaucuaccacguguac

SEQ ID NO: 34482 - RNA, 27 nt, Artificial Sequence
  Ran-binding protein 9 (350-358)
cugcccaagcagccgccccucgcccug

SEQ ID NO: 34483 - RNA, 27 nt, Artificial Sequence
  E3 ubiquitin-protein ligase RNF216 (406-414)
cugccccgcccggugccccagaaccuc

SEQ ID NO: 34484 - RNA, 30 nt, Artificial Sequence
  SET domain-containing protein 5 (1382-1391)
cugcccagcgaccuccgcaccaucucccug

SEQ ID NO: 34485 - RNA, 27 nt, Artificial Sequence
  Anaphase-promoting complex subunit 7 (132-140)
cugcccagcgagaucgaggugaaguac

SEQ ID NO: 34486 - RNA, 27 nt, Artificial Sequence
  F-box/WD repeat-containing protein 7 (467-475)
cugcaguucgacggcauccacgugguc

SEQ ID NO: 34487 - RNA, 39 nt, Artificial Sequence
  Keratin, type I cytoskeletal 10 (222-234)
cugcagaucgacaacgcccgccucgccgcggacgacuuc

SEQ ID NO: 34488 - RNA, 30 nt, Artificial Sequence
  Double-stranded RNA-binding protein Staufen homolog 1 (119-128)
cugcagaacgagccccucccggagcgccug

SEQ ID NO: 34489 - RNA, 45 nt, Artificial Sequence
  HLA class I histocompatibility antigen, Cw-3 alpha chain (296-310)
cugcgcugggagcccagcucccagccgaccauccccaucgugggc

SEQ ID NO: 34490 - RNA, 24 nt, Artificial Sequence
  TRIO and F-actin-binding protein (42-49)
cugaccgacagcucccucaaguac

SEQ ID NO: 34491 - RNA, 27 nt, Artificial Sequence
  Pleckstrin homology domain-containing family A member 2 (315-323)
cugacccgccccggcagcuccagccuc

SEQ ID NO: 34492 - RNA, 27 nt, Artificial Sequence
  DNA topoisomerase 2-beta (566-574)
cugaccuacaacgacuucaucaacaag

SEQ ID NO: 34493 - RNA, 27 nt, Artificial Sequence
  Suppressor of SWI4 1 homolog (117-125)
cuggugcgcgacgucgugagcucccuc

SEQ ID NO: 34494 - RNA, 30 nt, Artificial Sequence
  Leucine-rich repeat-containing protein 20 (34-43)
cuggugagcuuccccaucggcaucuacaag

SEQ ID NO: 34495 - RNA, 33 nt, Artificial Sequence
  Beta-actin-like protein 2 (9-19)
cugguggucgacaacggcagcgggaugugcaag

SEQ ID NO: 34496 - RNA, 27 nt, Artificial Sequence
  Peptidyl-prolyl cis-trans isomerase FKBP4 (410-418)
cuguacgccaacauguucgagcgccuc

SEQ ID NO: 34497 - RNA, 27 nt, Artificial Sequence
  AKT-interacting protein (201-209)
cuguacgagaaggacauccagcucuuc

SEQ ID NO: 34498 - RNA, 27 nt, Artificial Sequence
  Serine palmitoyltransferase 2 (282-290)
cuguaccucgacgaggcccacagcauc

SEQ ID NO: 34499 - RNA, 27 nt, Artificial Sequence
  DNA-dependent protein kinase catalytic subunit (3377-3385)
cuguaccagcgcgccuuccagcaccuc

SEQ ID NO: 34500 - RNA, 27 nt, Artificial Sequence
  Stimulator of interferon genes protein (214-222)
auggccgaccccaacauccgcuuccug

SEQ ID NO: 34501 - RNA, 24 nt, Artificial Sequence
  Putative V-set and immunoglobulin domain-containing-like protein IGHV4OR15-8 (1-8)
auggaccugcuccacaagaacaug

SEQ ID NO: 34502 - RNA, 27 nt, Artificial Sequence
  Ig kappa chain V-I region HK102 (1-9)
auggacaugcgcgugcccgcccagcug

SEQ ID NO: 34503 - RNA, 27 nt, Artificial Sequence
  Hypoxia-inducible factor 1-alpha (632-640)
auggaggacaucaagauccugaucgcc

SEQ ID NO: 34504 - RNA, 24 nt, Artificial Sequence
  Ras GTPase-activating protein-binding protein 1 (183-190)
auggaggagcaccuggaggagccc

SEQ ID NO: 34505 - RNA, 27 nt, Artificial Sequence
  Vimentin (347-355)
auggaggagaacuucgccguggaggcc

SEQ ID NO: 34506 - RNA, 30 nt, Artificial Sequence
  Protein S100-A10 (5-14)
auggagcacgccauggagaccaugauguuc

SEQ ID NO: 34507 - RNA, 27 nt, Artificial Sequence
  Actin, alpha skeletal muscle (84-92)
auggagaagaucuggcaccacaccuuc

SEQ ID NO: 34508 - RNA, 27 nt, Artificial Sequence
  Arachidonate 5-lipoxygenase (186-194)
auggagaaccuguucaucaaccgcuuc

SEQ ID NO: 34509 - RNA, 27 nt, Artificial Sequence
  Protein diaphanous homolog 1 (496-504)
auggagagcgacuucgagcagaagcug

SEQ ID NO: 34510 - RNA, 27 nt, Artificial Sequence
  Cytochrome c oxidase subunit 2 (20-28)
auggagaccguguggaccauccugccc

SEQ ID NO: 34511 - RNA, 27 nt, Artificial Sequence
  Poly(A)-specific ribonuclease PARN (243-251)
augcugcucgacgugaugcacaccguc

SEQ ID NO: 34512 - RNA, 27 nt, Artificial Sequence
  DNA ligase 1 (393-401)
augcugcccccgcccccccucaccgcc

SEQ ID NO: 34513 - RNA, 30 nt, Artificial Sequence
  Eukaryotic translation initiation factor 3 subunit A (514-523)
augcccagcgagcagauccgcaaccagcug

SEQ ID NO: 34514 - RNA, 27 nt, Artificial Sequence
  U2 snRNP-associated SURP motif-containing protein (392-400)
augaccgagagcaaguucuccaaguac

SEQ ID NO: 34515 - RNA, 27 nt, Artificial Sequence
  Probable ATP-dependent RNA helicase DDX6 (168-176)
auggugaucguccccacccgcgagcug

SEQ ID NO: 34516 - RNA, 27 nt, Artificial Sequence
  Staphylococcal nuclease domain-containing protein 1 (327-335)
aacgccgacgccaucguggucaagcug

SEQ ID NO: 34517 - RNA, 30 nt, Artificial Sequence
  Ceruloplasmin (651-660)
aacgaggccgacgugcacggcaucuacuuc

SEQ ID NO: 34518 - RNA, 27 nt, Artificial Sequence
  HLA class I histocompatibility antigen, A-3 alpha chain (151-159)
aacgaggaccugcgcagcuggaccgcc

SEQ ID NO: 34519 - RNA, 33 nt, Artificial Sequence
  Nuclear pore complex protein Nup50 (371-381)
aacgaguucaaggagaagggcaucgggacccug

SEQ ID NO: 34520 - RNA, 24 nt, Artificial Sequence
  40S ribosomal protein S3 (22-29)
aacgaguuccugacccgcgagcuc

SEQ ID NO: 34521 - RNA, 27 nt, Artificial Sequence
  Adenylyl cyclase-associated protein 1 (449-457)
aacgaguuccccgugccggagcaguuc

SEQ ID NO: 34522 - RNA, 30 nt, Artificial Sequence
  Protein C-ets-1 (86-95)
aacgaguucagccugaagggcguggacuuc

SEQ ID NO: 34523 - RNA, 27 nt, Artificial Sequence
  Midasin (329-337)
aacgagauccugggcagccuccgcugg

SEQ ID NO: 34524 - RNA, 24 nt, Artificial Sequence
  Guanine nucleotide-binding protein-like 3-like protein (192-199)
aacgagcugcccaccguggccuuc

SEQ ID NO: 34525 - RNA, 30 nt, Artificial Sequence
  Trinucleotide repeat-containing gene 6B protein (723-732)
aacgagaaccccagcaaggaccagggcugg

SEQ ID NO: 34526 - RNA, 30 nt, Artificial Sequence
  DNA dC-dU-editing enzyme APOBEC-3B (23-32)
aacgagcccauccuguacggccgcagcuac

SEQ ID NO: 34527 - RNA, 27 nt, Artificial Sequence
  Catenin alpha-1 (169-177)
aacgagcaggaccugggcauccaguac

SEQ ID NO: 34528 - RNA, 30 nt, Artificial Sequence
  Cytoplasmic FMR1-interacting protein 2 (99-108)
aacgagcagcccaaccgcguggagaucuac

SEQ ID NO: 34529 - RNA, 27 nt, Artificial Sequence
  Four and a half LIM domains protein 2 (121-129)
aacgagagccuguucggcaagaaguac

SEQ ID NO: 34530 - RNA, 24 nt, Artificial Sequence
  Protein disulfide-isomerase (430-437)
aacgagguggaggccgucaaggug

SEQ ID NO: 34531 - RNA, 27 nt, Artificial Sequence
  Radial spoke head protein 3 homolog (440-448)
aacgagguggagaagaccauggaguac

SEQ ID NO: 34532 - RNA, 24 nt, Artificial Sequence
  Nucleosome assembly protein 1-like 1 (226-233)
aacgaggugcugaccaagaccuac

SEQ ID NO: 34533 - RNA, 27 nt, Artificial Sequence
  Collagen alpha-3(VI) chain (2246-2254)
aacgaggugaccaccgagauccgcuuc

SEQ ID NO: 34534 - RNA, 24 nt, Artificial Sequence
  60S ribosomal protein L31 (18-25)
aacgagguggucacccgcgaguac

SEQ ID NO: 34535 - RNA, 27 nt, Artificial Sequence
  Synaptobrevin homolog YKT6 (83-91)
aacgaguaccccagccgcguggccuuc

SEQ ID NO: 34536 - RNA, 27 nt, Artificial Sequence
  26S proteasome non-ATPase regulatory subunit 4 (18-26)
aacggcgacuuccugcccacccgccuc

SEQ ID NO: 34537 - RNA, 39 nt, Artificial Sequence
  Eukaryotic translation initiation factor 3 subunit D (57-69)
aacaaguacagcucccaguucggcgggggcagccaguac

SEQ ID NO: 34538 - RNA, 30 nt, Artificial Sequence
  Structural maintenance of chromosomes protein 4 (634-643)
aaccuggaccaggccacccgcguggccuac

SEQ ID NO: 34539 - RNA, 27 nt, Artificial Sequence
  Heterogeneous nuclear ribonucleoprotein U-like protein 2 (358-366)
aaccccgagaagcgcuacaacgugcug

SEQ ID NO: 34540 - RNA, 27 nt, Artificial Sequence
  2'-5'-oligoadenylate synthase 1 (128-136)
aacccccgcgcccugagcuucgugcuc

SEQ ID NO: 34541 - RNA, 30 nt, Artificial Sequence
  Cleavage and polyadenylation specificity factor subunit 3 (308-317)
aacccccgcaacaccgaggccgugacccug

SEQ ID NO: 34542 - RNA, 27 nt, Artificial Sequence
  ETS translocation variant 5 (210-218)
aaccaguaccccagcgagcagcgcuuc

SEQ ID NO: 34543 - RNA, 27 nt, Artificial Sequence
  Protein TASOR (346-354)
aacaccgaccgcaacaucgacaaguac

SEQ ID NO: 34544 - RNA, 51 nt, Artificial Sequence
  Actin, cytoplasmic 2 (35-51)
aacaccgugcugagcggcgggaccacgauguaccccggcaucgccgaccgc

SEQ ID NO: 34545 - RNA, 27 nt, Artificial Sequence
  ORM1-like protein 2 (53-61)
aacgugauccacaaccuggccaccuac

SEQ ID NO: 34546 - RNA, 27 nt, Artificial Sequence
  Unconventional myosin-Ic (852-860)
aacuacccccagagcgugccgcgccug

SEQ ID NO: 34547 - RNA, 27 nt, Artificial Sequence
  Myotubularin-related protein 6 (104-112)
aacuacagcaacauccgcuuccaguuc

SEQ ID NO: 34548 - RNA, 27 nt, Artificial Sequence
  Actin-related protein 2/3 complex subunit 3 (2-10)
cccgccuaccacagcucccugauggac

SEQ ID NO: 34549 - RNA, 30 nt, Artificial Sequence
  NADH dehydrogenase (ubiquinone) 1 beta subcomplex subunit 11, mitochondrial (144-153)
cccagcaagauccagcugccggaggacgag

SEQ ID NO: 34550 - RNA, 27 nt, Artificial Sequence
  Probable helicase with zinc finger domain (955-963)
cccuacgccgaccagguguuccgcauc

SEQ ID NO: 34551 - RNA, 27 nt, Artificial Sequence
  Polypeptide N-acetylgalactosaminyltransferase 2 (407-415)
cccuacggcaacauccagagccgccug

SEQ ID NO: 34552 - RNA, 27 nt, Artificial Sequence
  Nucleolin (401-409)
cccuacaaggugacccaggacgagcug

SEQ ID NO: 34553 - RNA, 48 nt, Artificial Sequence
  Cytochrome c oxidase subunit 5B, mitochondrial (61-76)
cccuacaacgugcuggccccgaagggcgccagcgggacccgcgaggac

SEQ ID NO: 34554 - RNA, 27 nt, Artificial Sequence
  Dol-P-Man:Man(7)GlcNAc(2)-PP-Dol alpha-1,6-mannosyltransferase (29-37)
cccuacaccaagguggaggagagcuuc

SEQ ID NO: 34555 - RNA, 27 nt, Artificial Sequence
  Serglycin (81-89)
caggaccugaaccgcaucuucccccuc

SEQ ID NO: 34556 - RNA, 27 nt, Artificial Sequence
  Paraneoplastic antigen Ma1 (117-125)
caggacguggcccgcguccugggcuuc

SEQ ID NO: 34557 - RNA, 27 nt, Artificial Sequence
  UDP-glucuronic acid decarboxylase 1 (248-256)
caggagggcguggagguccgcguggcc

SEQ ID NO: 34558 - RNA, 27 nt, Artificial Sequence
  Talin-1 (1707-1715)
caggagaucagccaccugaucgagccc

SEQ ID NO: 34559 - RNA, 27 nt, Artificial Sequence
  Integrin beta-2 (422-430)
caggagcagagcuucgugauccgcgcc

SEQ ID NO: 34560 - RNA, 27 nt, Artificial Sequence
  Forkhead-associated domain-containing protein 1 (519-527)
cagcugaucgagaagaucacccaggug

SEQ ID NO: 34561 - RNA, 27 nt, Artificial Sequence
  Integrin alpha-V (217-225)
cagguggccgagaucgucagcaaguac

SEQ ID NO: 34562 - RNA, 27 nt, Artificial Sequence
  Biogenesis of lysosome-related organelles complex 1 subunit 1 (64-72)
caggugcaggccgcccaguucgcgaag

SEQ ID NO: 34563 - RNA, 27 nt, Artificial Sequence
  CCR4-NOT transcription complex subunit 1 (465-473)
caguacgagcaggugaagcagcuguuc

SEQ ID NO: 34564 - RNA, 27 nt, Artificial Sequence
  Phosphatidylinositol 3,4,5-trisphosphate-dependent Rac exchanger 1 protein (1095-1103)
caguacgugacccagaucaaccgccug

SEQ ID NO: 34565 - RNA, 36 nt, Artificial Sequence
  Non-POU domain-containing octamer-binding protein (367-378)
cgcgccgcccccggcgcggaguucgccccgaacaag

SEQ ID NO: 34566 - RNA, 27 nt, Artificial Sequence
  SWI/SNF-related matrix-associated actin-dependent regulator of chromatin subfamily E member 1-related (135-143)
cgcgccuaccagcagagcgaggccuac

SEQ ID NO: 34567 - RNA, 24 nt, Artificial Sequence
  Zinc finger protein 36, C3H1 type-like 2 (239-246)
cgcgacgcccugcaccucggcuuc

SEQ ID NO: 34568 - RNA, 27 nt, Artificial Sequence
  Chloride intracellular channel protein 6 (640-648)
cgcgacuucgaguuccccagcgagaug

SEQ ID NO: 34569 - RNA, 24 nt, Artificial Sequence
  Rab3 GTPase-activating protein non-catalytic subunit (18-25)
cgcgacuuccuguucccccaccuc

SEQ ID NO: 34570 - RNA, 24 nt, Artificial Sequence
  60S ribosomal protein L9 (36-43)
cgcgacuucaaccacaucaacgug

SEQ ID NO: 34571 - RNA, 27 nt, Artificial Sequence
  Guanylate-binding protein 4 (196-204)
cgcgacuucacccuggagcucaagcug

SEQ ID NO: 34572 - RNA, 27 nt, Artificial Sequence
  Alkyldihydroxyacetonephosphate synthase, peroxisomal (515-523)
cgcgaccuggcccucgaguacuacgug

SEQ ID NO: 34573 - RNA, 24 nt, Artificial Sequence
  Cell division control protein 42 homolog (147-154)
cgcgaccugaaggccgugaaguac

SEQ ID NO: 34574 - RNA, 24 nt, Artificial Sequence
  40S ribosomal protein S27-like (5-12)
cgcgaccugcuccaccccagccug

SEQ ID NO: 34575 - RNA, 27 nt, Artificial Sequence
  Septin-9 (519-527)
cgcgaccugcucauccggacccacaug

SEQ ID NO: 34576 - RNA, 27 nt, Artificial Sequence
  Eukaryotic translation initiation factor 3 subunit C (586-594)
cgcgaccugaugcucaugagccaccug

SEQ ID NO: 34577 - RNA, 33 nt, Artificial Sequence
  Macrosialin (238-248)
cgcgaccugcaggccccccucggccagagcuuc

SEQ ID NO: 34578 - RNA, 27 nt, Artificial Sequence
  E3 ubiquitin-protein ligase RNF213 (160-168)
cgcgaccugagccacauccucggcauc

SEQ ID NO: 34579 - RNA, 27 nt, Artificial Sequence
  Serine/threonine-protein kinase RIO1 (201-209)
cgcgacauggacaucaucaugaagcug

SEQ ID NO: 34580 - RNA, 27 nt, Artificial Sequence
  Transcription factor 25 (650-658)
cgcgacaugauggccaacuuccaccug

SEQ ID NO: 34581 - RNA, 24 nt, Artificial Sequence
  Transcription elongation factor A protein 1 (123-130)
cgcgacaccuacgugagcuccuuc

SEQ ID NO: 34582 - RNA, 27 nt, Artificial Sequence
  Growth arrest and DNA damage-inducible protein GADD45 alpha (67-75)
cgcgacguggcccugcagauccacuuc

SEQ ID NO: 34583 - RNA, 24 nt, Artificial Sequence
  Transmembrane protein 14A (51-58)
cgcgacgugaaggucagccuguuc

SEQ ID NO: 34584 - RNA, 27 nt, Artificial Sequence
  TraB domain-containing protein (259-267)
cgcgacguguaccugaccuacaugcuc

SEQ ID NO: 34585 - RNA, 30 nt, Artificial Sequence
  Pyruvate kinase PKM (383-392)
cgcgaggccgaggccgcgaucuaccaccug

SEQ ID NO: 34586 - RNA, 27 nt, Artificial Sequence
  Protein nepro homolog (226-234)
cgcgaggccgagagcuucacccagcug

SEQ ID NO: 34587 - RNA, 30 nt, Artificial Sequence
  40S ribosomal protein S4, X isoform (39-48)
cgcgagugccugccccucaucaucuuccug

SEQ ID NO: 34588 - RNA, 27 nt, Artificial Sequence
  T-complex protein 1 subunit gamma (260-268)
cgcgaggaggacuucacccggauccug

SEQ ID NO: 34589 - RNA, 33 nt, Artificial Sequence
  Transcription factor E2F7 (433-443)
cgcgaggagcagggcagcgggggcuacucccug

SEQ ID NO: 34590 - RNA, 24 nt, Artificial Sequence
  Ribonucleoside-diphosphate reductase subunit M2 (190-197)
cgcgaguuccuguucaacgccauc

SEQ ID NO: 34591 - RNA, 27 nt, Artificial Sequence
  DNA-dependent protein kinase catalytic subunit (1087-1095)
cgcgaguuccgggaggaggagagccug

SEQ ID NO: 34592 - RNA, 24 nt, Artificial Sequence
  Vacuolar protein sorting-associated protein 51 homolog (490-497)
cgcgagggccugaucgugggguuc

SEQ ID NO: 34593 - RNA, 27 nt, Artificial Sequence
  Torsin-4A (350-358)
cgcgagcacccccuguggcaggccgcc

SEQ ID NO: 34594 - RNA, 27 nt, Artificial Sequence
  Vimentin (186-194)
cgcgagaagcugcaggaggagaugcuc

SEQ ID NO: 34595 - RNA, 27 nt, Artificial Sequence
  Protein CEBPZOS (68-76)
cgcgagcuggaccagaagaccuggcuc

SEQ ID NO: 34596 - RNA, 27 nt, Artificial Sequence
  Extended synaptotagmin-1 (125-133)
cgcgagcugcccgccugggugagcuuc

SEQ ID NO: 34597 - RNA, 27 nt, Artificial Sequence
  DNA-directed RNA polymerase II subunit RPB1 (1380-1388)
cgcgagcuguaccacgugaucagcuuc

SEQ ID NO: 34598 - RNA, 24 nt, Artificial Sequence
  HLA class I histocompatibility antigen, B-57 alpha chain (99-106)
cgcgagaaccugcggaucgcccuc

SEQ ID NO: 34599 - RNA, 27 nt, Artificial Sequence
  Ras-related protein M-Ras (116-124)
cgcgagagcuuccccaugauccuggug

SEQ ID NO: 34600 - RNA, 27 nt, Artificial Sequence
  Large proline-rich protein BAG6 (814-822)
cgcgagagcuucucccuggugcagguc

SEQ ID NO: 34601 - RNA, 27 nt, Artificial Sequence
  Vimentin (424-432)
cgcgagaccaaccuggacagccucccc

SEQ ID NO: 34602 - RNA, 30 nt, Artificial Sequence
  DNA polymerase delta subunit 2 (109-118)
cgcgaggugagcgaggagcacaaccugcuc

SEQ ID NO: 34603 - RNA, 27 nt, Artificial Sequence
  Zinc finger protein 343 (243-251)
cgcgaguacgagcccgaccacaaccug

SEQ ID NO: 34604 - RNA, 27 nt, Artificial Sequence
  Desmin (386-394)
cgcgaguaccaggaccugcucaacgug

SEQ ID NO: 34605 - RNA, 27 nt, Artificial Sequence
  ADP-ribosylation factor 6 (95-103)
cgcaucgacgaggcccggcaggagcug

SEQ ID NO: 34606 - RNA, 42 nt, Artificial Sequence
  Heat shock 70 kDa protein 1-like (173-186)
cgcaucaucaacgagcccaccgccgccgcgaucgccuacggc

SEQ ID NO: 34607 - RNA, 27 nt, Artificial Sequence
  Chromobox protein homolog 6 (91-99)
cgcaucagcgacgugcacuucuccguc

SEQ ID NO: 34608 - RNA, 27 nt, Artificial Sequence
  Vimentin (410-418)
cgcaucagccugccccucccgaacuuc

SEQ ID NO: 34609 - RNA, 30 nt, Artificial Sequence
  Discoidin, CUB and LCCL domain-containing protein 2 (86-95)
cgcaucuacaacggcaucggggugagccgg

SEQ ID NO: 34610 - RNA, 27 nt, Artificial Sequence
  Polyribonucleotide 5'-hydroxyl-kinase Clp1 (206-214)
cgccuggccgacguguucaaccagcgg

SEQ ID NO: 34611 - RNA, 27 nt, Artificial Sequence
  Clathrin heavy chain 1 (1226-1234)
cgccuggccagcacccucgugcaccug

SEQ ID NO: 34612 - RNA, 27 nt, Artificial Sequence
  Transcription elongation factor SPT6 (292-300)
cgccuguucgagaagaugcaggccuac

SEQ ID NO: 34613 - RNA, 33 nt, Artificial Sequence
  Deoxyhypusine synthase (263-273)
cgccugaucaacacccaggccaucuucgccaag

SEQ ID NO: 34614 - RNA, 27 nt, Artificial Sequence
  Lysophospholipid acyltransferase 5 (293-301)
cgccugauccaggagagccccacccuc

SEQ ID NO: 34615 - RNA, 27 nt, Artificial Sequence
  trabeculin-alpha (476-484)
cgccugcaggacgagcucgugacccug

SEQ ID NO: 34616 - RNA, 27 nt, Artificial Sequence
  Gamma-tubulin complex component 5 (326-334)
cgccugcaggaguucaucgacgaggug

SEQ ID NO: 34617 - RNA, 27 nt, Artificial Sequence
  Nuclear cap-binding protein subunit 1 (694-702)
cgccugcaggagaagguggagagcgcc

SEQ ID NO: 34618 - RNA, 27 nt, Artificial Sequence
  Integrin beta-7 (181-189)
cgccugcaggaggugacccacagcguc

SEQ ID NO: 34619 - RNA, 27 nt, Artificial Sequence
  40S ribosomal protein S27 (87-95)
cgccuggugcagagccccaacuccuac

SEQ ID NO: 34620 - RNA, 30 nt, Artificial Sequence
  Serpin H1 (133-142)
cgccuguacggccccagcuccgugagcuuc

SEQ ID NO: 34621 - RNA, 27 nt, Artificial Sequence
  Tetratricopeptide repeat protein 30A (82-90)
cgccuguaccaggcccaggcccucuac

SEQ ID NO: 34622 - RNA, 27 nt, Artificial Sequence
  DNA mismatch repair protein Msh2 (406-414)
cgccuguaccagggcaucaaccagcuc

SEQ ID NO: 34623 - RNA, 27 nt, Artificial Sequence
  Probable 18S rRNA (guanine-N(7))-methyltransferase (31-39)
cgcaugaucgacauccagacccggaug

SEQ ID NO: 34624 - RNA, 27 nt, Artificial Sequence
  26S protease regulatory subunit 4 (411-419)
cgcaugaaggugaccaacgaggacuuc

SEQ ID NO: 34625 - RNA, 27 nt, Artificial Sequence
  A-kinase anchor protein 8-like (199-207)
cgcaugugggaggaccccaugggcgcc

SEQ ID NO: 34626 - RNA, 33 nt, Artificial Sequence
  Keratin, type I cytoskeletal 10 (99-109)
cgcaacgugagcaccggcgacgucaacguggag

SEQ ID NO: 34627 - RNA, 27 nt, Artificial Sequence
  Ubiquitin-like modifier-activating enzyme 1 (325-333)
cgccccgcccagcugcacaucggcuuc

SEQ ID NO: 34628 - RNA, 33 nt, Artificial Sequence
  Eukaryotic translation initiation factor 4 gamma 1 (191-201)
cgccccgacgaccggagccagggcgccaucauc

SEQ ID NO: 34629 - RNA, 27 nt, Artificial Sequence
  Microtubule-associated protein 4 (670-678)
cgccccgaggagggccggccggugguc

SEQ ID NO: 34630 - RNA, 27 nt, Artificial Sequence
  Syntenin-1 (193-201)
cgccccuucgagcggaccaucaccaug

SEQ ID NO: 34631 - RNA, 27 nt, Artificial Sequence
  Cellular tumor antigen p53 (25-33)
cgccccauccugaccaucaucacccuc

SEQ ID NO: 34632 - RNA, 27 nt, Artificial Sequence
  Methionine adenosyltransferase 2 subunit beta (277-285)
cgccccaucaccgacagcccggugcug

SEQ ID NO: 34633 - RNA, 27 nt, Artificial Sequence
  U2 snRNP-associated SURP motif-containing protein (430-438)
cgccccaagaagccgggccagagcuuc

SEQ ID NO: 34634 - RNA, 27 nt, Artificial Sequence
  Methionine-tRNA ligase, cytoplasmic (45-53)
cgccccaaggugccgguccugcagcuc

SEQ ID NO: 34635 - RNA, 27 nt, Artificial Sequence
  Actin-related protein 3 (262-270)
cgcccccuguacaagaacaucgugcuc

SEQ ID NO: 34636 - RNA, 24 nt, Artificial Sequence
  Proline-rich nuclear receptor coactivator 2 (13-20)
cgccccaugaagaccagcgugcug

SEQ ID NO: 34637 - RNA, 27 nt, Artificial Sequence
  DNA damage-binding protein 1 (753-761)
cgccccagcgccuccacccaggcccug

SEQ ID NO: 34638 - RNA, 30 nt, Artificial Sequence
  Inositol-tetrakisphosphate 1-kinase (256-265)
cgccccagcgacgaggugauccgggagcug

SEQ ID NO: 34639 - RNA, 27 nt, Artificial Sequence
  Nucleoprotein TPR (1808-1816)
cgccccagcaccuccaccgccguguuc

SEQ ID NO: 34640 - RNA, 30 nt, Artificial Sequence
  Nuclear pore complex protein Nup214 (1284-1293)
cgccccguggccccgagcggcaccgcccug

SEQ ID NO: 34641 - RNA, 27 nt, Artificial Sequence
  60S ribosomal protein L15 (73-81)
cgccccgugccgaagggcgccaccuac

SEQ ID NO: 34642 - RNA, 27 nt, Artificial Sequence
  STE20-related kinase adapter protein alpha (358-366)
cgccccgugaccccgaucaccaacuuc

SEQ ID NO: 34643 - RNA, 27 nt, Artificial Sequence
  Grancalcin (145-153)
cgccaggccaucggccugaugggguac

SEQ ID NO: 34644 - RNA, 30 nt, Artificial Sequence
  Transcriptional repressor p66-beta (415-424)
cgccaggccccccagccgcagagcucccug

SEQ ID NO: 34645 - RNA, 36 nt, Artificial Sequence
  UBX domain-containing protein 4 (346-357)
cgccaguucgccgcccagaccgugggcaacaccuac

SEQ ID NO: 34646 - RNA, 27 nt, Artificial Sequence
  Spectrin alpha chain, non-erythrocytic 1 (1012-1020)
cgccagggcuucgugcccgccgccuac

SEQ ID NO: 34647 - RNA, 24 nt, Artificial Sequence
  Fragile X mental retardation syndrome-related protein 1 (376-383)
cgccagaucggcagccgguccuac

SEQ ID NO: 34648 - RNA, 27 nt, Artificial Sequence
  Sialidase-1 (69-77)
cgccagaucggcagcguggacaccuuc

SEQ ID NO: 34649 - RNA, 27 nt, Artificial Sequence
  Cytochrome b-245 heavy chain (92-100)
cgccagcuggaccggaaccucaccuuc

SEQ ID NO: 34650 - RNA, 27 nt, Artificial Sequence
  Vacuole membrane protein 1 (48-56)
cgccagccccugaucacccuccaguac

SEQ ID NO: 34651 - RNA, 27 nt, Artificial Sequence
  Lanosterol synthase (234-242)
cgccagguguaccugcccaugagcuac

SEQ ID NO: 34652 - RNA, 24 nt, Artificial Sequence
  Eukaryotic translation initiation factor 3 subunit L (38-45)
cgccaguacgagcagcagaccuac

SEQ ID NO: 34653 - RNA, 27 nt, Artificial Sequence
  Protein CDV3 homolog (7-15)
cgcagccuggacaacuucuucgccaag

SEQ ID NO: 34654 - RNA, 33 nt, Artificial Sequence
  Cation-independent mannose-6-phosphate receptor (2345-2355)
cgcagcuccaacgugagcuacaaguacuccaag

SEQ ID NO: 34655 - RNA, 27 nt, Artificial Sequence
  Protein phosphatase 1 regulatory subunit 12A (704-712)
cgcaccuacgacgagaccuaccagcgg

SEQ ID NO: 34656 - RNA, 33 nt, Artificial Sequence
  Protein FAM168A (83-93)
cgcaccuaccaggccagcuccgccgcguuccgg

SEQ ID NO: 34657 - RNA, 27 nt, Artificial Sequence
  Manganese-transporting ATPase 13A1 (839-847)
cgcguggcccccaagcagaaggaguuc

SEQ ID NO: 34658 - RNA, 27 nt, Artificial Sequence
  Alpha-adducin (27-35)
cgcguggacgagaacaaccccgaguac

SEQ ID NO: 34659 - RNA, 27 nt, Artificial Sequence
  DNA damage-binding protein 1 (263-271)
cgcguggaccccaacggcagccgguac

SEQ ID NO: 34660 - RNA, 30 nt, Artificial Sequence
  Eukaryotic translation initiation factor 3 subunit C-like protein (873-882)
cgcguguucgaccacaagcagggcaccuac

SEQ ID NO: 34661 - RNA, 39 nt, Artificial Sequence
  LIM and senescent cell antigen-like-containing domain protein 1 (319-331)
cgcgugaucgagggcgacgucgugagcgcccugaacaag

SEQ ID NO: 34662 - RNA, 27 nt, Artificial Sequence
  Ran GTPase-activating protein 1 (205-213)
cgcgugaucggcacccuggaggagguc

SEQ ID NO: 34663 - RNA, 27 nt, Artificial Sequence
  HLA class II histocompatibility antigen, DRB1-16 beta chain (89-97)
cgcgugcagcccaaggucaccguguac

SEQ ID NO: 34664 - RNA, 33 nt, Artificial Sequence
  Glucose-6-phosphate 1-dehydrogenase (240-250)
cgcgugcagcccaacgaggccgucuacaccaag

SEQ ID NO: 34665 - RNA, 27 nt, Artificial Sequence
  Rotatin (803-811)
cgcgugaccgaccuguucaucggcaag

SEQ ID NO: 34666 - RNA, 45 nt, Artificial Sequence
  Histone H2A type 1-B/E (100-114)
cgcgugaccaucgcccagggcgggguccugcccaacauccaggcc

SEQ ID NO: 34667 - RNA, 42 nt, Artificial Sequence
  SH3 domain-binding glutamic acid-rich-like protein (4-17)
cgcguguacaucgccagcuccagcggcuccaccgccaucaag

SEQ ID NO: 34668 - RNA, 33 nt, Artificial Sequence
  WD repeat domain phosphoinositide-interacting protein 3 (34-44)
cgcguguacaacaccgacccccugaaggagaag

SEQ ID NO: 34669 - RNA, 30 nt, Artificial Sequence
  Serine/arginine-rich splicing factor 9 (181-190)
cgcguguaccccgagcggagcaccuccuac

SEQ ID NO: 34670 - RNA, 27 nt, Artificial Sequence
  Lysine-specific demethylase 6B (135-143)
cgcuacggcgggagcuucgccgagcug

SEQ ID NO: 34671 - RNA, 27 nt, Artificial Sequence
  Ras GTPase-activating protein-binding protein 2 (293-301)
cgcuaccccgacagccaccagcuguuc

SEQ ID NO: 34672 - RNA, 27 nt, Artificial Sequence
  Eukaryotic translation initiation factor 3 subunit L (328-336)
cgcuaccaggacgccauccggguguuc

SEQ ID NO: 34673 - RNA, 27 nt, Artificial Sequence
  Poly (ADP-ribose) polymerase 8 (33-41)
cgcuacagcgacuccaccuucaccuuc

SEQ ID NO: 34674 - RNA, 33 nt, Artificial Sequence
  ATPase family AAA domain-containing protein 2 (163-173)
cgcuacagcggcgugaaccaguccaugcuguuc

SEQ ID NO: 34675 - RNA, 27 nt, Artificial Sequence
  Heterogeneous nuclear ribonucleoprotein H (23-31)
agcgccgacgaggugcagcgcuucuuc

SEQ ID NO: 34676 - RNA, 27 nt, Artificial Sequence
  Intraflagellar transport protein 25 homolog (121-129)
agcgccuucgaccacuucgccuccgug

SEQ ID NO: 34677 - RNA, 27 nt, Artificial Sequence
  Histone-lysine N-methyltransferase setd3 (403-411)
agcgccaucgaccgcaucuucacccug

SEQ ID NO: 34678 - RNA, 27 nt, Artificial Sequence
  Rho guanine nucleotide exchange factor 12 (613-621)
agcgccaucggccgcgccauggagcug

SEQ ID NO: 34679 - RNA, 27 nt, Artificial Sequence
  Cell division cycle protein 16 homolog (483-491)
agcgccaucggcuacauccacucccug

SEQ ID NO: 34680 - RNA, 27 nt, Artificial Sequence
  Transient receptor potential cation channel subfamily V member 2 (165-173)
agcgcccugcacaucgccaucgagaag

SEQ ID NO: 34681 - RNA, 27 nt, Artificial Sequence
  ATP-dependent zinc metalloprotease YME1L1 (158-166)
agcgcccaguccuucuucgagaacaag

SEQ ID NO: 34682 - RNA, 27 nt, Artificial Sequence
  Putative annexin A2-like protein (22-30)
agcgccuacggcuccgugaaggccuac

SEQ ID NO: 34683 - RNA, 27 nt, Artificial Sequence
  Guanine nucleotide-binding protein G(I)/G(S)/G(T) subunit beta-1 (245-253)
agcgacgacgccaccugccgccuguuc

SEQ ID NO: 34684 - RNA, 27 nt, Artificial Sequence
  Ubiquitin thioesterase OTUB1 (215-223)
agcgaccacauccacaucaucgcccug

SEQ ID NO: 34685 - RNA, 27 nt, Artificial Sequence
  Homeobox-containing protein 1 (316-324)
agcgaccuggagcgcgugaccucccuc

SEQ ID NO: 34686 - RNA, 27 nt, Artificial Sequence
  Protein FAM162A (32-40)
agcgaccugaagcgcaucaacggcuuc

SEQ ID NO: 34687 - RNA, 27 nt, Artificial Sequence
  Group XIIB secretory phospholipase A2-like protein (142-150)
agcgaccugaagcgcucccucggcuuc

SEQ ID NO: 34688 - RNA, 27 nt, Artificial Sequence
  SH3 domain-binding protein 2 (218-226)
agcgacaugccccgcgcccacuccuuc

SEQ ID NO: 34689 - RNA, 33 nt, Artificial Sequence
  Vimentin (299-309)
agcgaggccgccaaccgcaacaacgacgcgcug

SEQ ID NO: 34690 - RNA, 27 nt, Artificial Sequence
  14-3-3 protein eta (80-88)
agcgaggccgccuacaaggaggcguuc

SEQ ID NO: 34691 - RNA, 27 nt, Artificial Sequence
  WD repeat-containing protein 6 (1032-1040)
agcgaggacggcucccugcacguguuc

SEQ ID NO: 34692 - RNA, 30 nt, Artificial Sequence
  60S ribosomal protein L7a (85-94)
agcgaggacaagggcgcccuggccaagcuc

SEQ ID NO: 34693 - RNA, 27 nt, Artificial Sequence
  Cofilin-1 (41-49)
agcgaggacaagaagaacaucauccug

SEQ ID NO: 34694 - RNA, 27 nt, Artificial Sequence
  Coatomer subunit alpha (268-276)
agcgaggacaaguccauccgcgugugg

SEQ ID NO: 34695 - RNA, 33 nt, Artificial Sequence
  26S proteasome non-ATPase regulatory subunit 2 (436-446)
agcgaggacuacaucaaguccggcgcccugcuc

SEQ ID NO: 34696 - RNA, 27 nt, Artificial Sequence
  Calmodulin (82-90)
agcgaggaggagauccgcgaggccuuc

SEQ ID NO: 34697 - RNA, 30 nt, Artificial Sequence
  Nucleolar transcription factor 1 (115-124)
agcgaggagggcaucaccaaguccacccug

SEQ ID NO: 34698 - RNA, 27 nt, Artificial Sequence
  Nucleoside diphosphate kinase 3 (61-69)
agcgaggagcugcuccgcgagcacuac

SEQ ID NO: 34699 - RNA, 27 nt, Artificial Sequence
  A-kinase anchor protein 6 (991-999)
agcgaggagcagcagcagcaccuguac

SEQ ID NO: 34700 - RNA, 30 nt, Artificial Sequence
  14-3-3 protein zeta/delta (227-236)
agcgaggaguccuacaaggacagcacccug

SEQ ID NO: 34701 - RNA, 30 nt, Artificial Sequence
  CTTNBP2 N-terminal-like protein (259-268)
agcgaguucgacaucgagcgcgagcagcug

SEQ ID NO: 34702 - RNA, 27 nt, Artificial Sequence
  Alpha-enolase (79-87)
agcgaguucuuccgcuccggcaaguac

SEQ ID NO: 34703 - RNA, 27 nt, Artificial Sequence
  Dynamin-like 120 kDa protein, mitochondrial (351-359)
agcgagggcccccaccacguggcccug

SEQ ID NO: 34704 - RNA, 30 nt, Artificial Sequence
  Cyclic AMP-dependent transcription factor ATF-6 beta (8-17)
agcgagaucgccgaccccacccgcuucuuc

SEQ ID NO: 34705 - RNA, 27 nt, Artificial Sequence
  Claspin (704-712)
agcgagaucggcaaggccgugggguuc

SEQ ID NO: 34706 - RNA, 27 nt, Artificial Sequence
  ATP-dependent zinc metalloprotease YME1L1 (695-703)
agcgagaagcugggcgugaugaccuac

SEQ ID NO: 34707 - RNA, 24 nt, Artificial Sequence
  Protein yippee-like 5 (28-35)
agcgagcugaucuccacccgcuuc

SEQ ID NO: 34708 - RNA, 27 nt, Artificial Sequence
  Ubiquitin carboxyl-terminal hydrolase 7 (778-786)
agcgagcugcccaccgccaaggaguac

SEQ ID NO: 34709 - RNA, 27 nt, Artificial Sequence
  Mitochondrial import receptor subunit TOM70 (577-585)
agcgagauggagauggcccaccuguac

SEQ ID NO: 34710 - RNA, 27 nt, Artificial Sequence
  ADP-ribosylation factor 4 (137-145)
agcgagaugaccgacaagcugggccuc

SEQ ID NO: 34711 - RNA, 27 nt, Artificial Sequence
  Geranylgeranyl transferase type-1 subunit beta (168-176)
agcgagaacgacaugcgcuucguguac

SEQ ID NO: 34712 - RNA, 27 nt, Artificial Sequence
  Nuclear pore complex protein Nup153 (1194-1202)
agcgagcagcccgccaaggccaccuuc

SEQ ID NO: 34713 - RNA, 27 nt, Artificial Sequence
  Coatomer subunit gamma-1 (353-361)
agcgaguccagcaucgaccgccugaug

SEQ ID NO: 34714 - RNA, 24 nt, Artificial Sequence
  T-complex protein 1 subunit zeta (155-162)
agcgagaccgacaccucccugauc

SEQ ID NO: 34715 - RNA, 24 nt, Artificial Sequence
  Caprin-1 (287-294)
agcgagguggaguccaccgaguac

SEQ ID NO: 34716 - RNA, 27 nt, Artificial Sequence
  Galectin-2 (80-88)
agcgaggugaaguucaccgucaccuuc

SEQ ID NO: 34717 - RNA, 30 nt, Artificial Sequence
  Serpin B8 (75-84)
agcgaggugaaccgcaccggcacccaguac

SEQ ID NO: 34718 - RNA, 27 nt, Artificial Sequence
  Protein yippee-like 5 (54-62)
agcgaggugcaggaccgcgucaugcug

SEQ ID NO: 34719 - RNA, 39 nt, Artificial Sequence
  Heterogeneous nuclear ribonucleoproteins A2/B1 (266-278)
agcggcaacuucgggggcucccgcaacauggggggcccc

SEQ ID NO: 34720 - RNA, 27 nt, Artificial Sequence
  Protein PRRC2C (661-669)
agcggcuacuucaagcaguuccagaag

SEQ ID NO: 34721 - RNA, 27 nt, Artificial Sequence
  CAAX prenyl protease 1 homolog (244-252)
agcaucgacuucccccugaccaaggug

SEQ ID NO: 34722 - RNA, 27 nt, Artificial Sequence
  Signal transducer and activator of transcription 2 (358-366)
agcaucgaccgcaaccccccgcagcug

SEQ ID NO: 34723 - RNA, 36 nt, Artificial Sequence
  Phospholipase D1 (579-590)
agcaucgacuccaccagcuccuacuucaaccacuac

SEQ ID NO: 34724 - RNA, 33 nt, Artificial Sequence
  Double-stranded RNA-specific adenosine deaminase (938-948)
agcaucuucgagcccgccaagggcggggagaag

SEQ ID NO: 34725 - RNA, 36 nt, Artificial Sequence
  DNA-directed RNA polymerase III subunit RPC4 (107-118)
agcaucuucgagcagggccccgccgagaugaugaag

SEQ ID NO: 34726 - RNA, 27 nt, Artificial Sequence
  Serine/threonine-protein kinase MARK2 (578-586)
agcaucuucuccaaguucaccagcaag

SEQ ID NO: 34727 - RNA, 30 nt, Artificial Sequence
  Mortality factor 4-like protein 1 (192-201)
agcauccuggaggacuacgccaacuacaag

SEQ ID NO: 34728 - RNA, 27 nt, Artificial Sequence
  Transmembrane protein 41B (276-284)
agcauccugcccgccaucuuccagaag

SEQ ID NO: 34729 - RNA, 27 nt, Artificial Sequence
  DNA polymerase delta subunit 3 (419-427)
agcaucaccggcuucuuccagcgcaag

SEQ ID NO: 34730 - RNA, 36 nt, Artificial Sequence
  Double-stranded RNA-specific adenosine deaminase (134-145)
agcaucuaccaggaccaggagcagcgcauccugaag

SEQ ID NO: 34731 - RNA, 27 nt, Artificial Sequence
  Histone H2B type 2-E (14-22)
agcaucuacguguacaagguccugaag

SEQ ID NO: 34732 - RNA, 27 nt, Artificial Sequence
  Serine/threonine-protein kinase Nek6 (66-74)
agccuggccgacuuccagaucgagaag

SEQ ID NO: 34733 - RNA, 27 nt, Artificial Sequence
  Poly(rC)-binding protein 2 (315-323)
agccuggcccaguaccucaucaacgug

SEQ ID NO: 34734 - RNA, 27 nt, Artificial Sequence
  Eukaryotic translation initiation factor 3 subunit C-like protein (835-843)
agccuggaccagcccacccagaccgug

SEQ ID NO: 34735 - RNA, 27 nt, Artificial Sequence
  FGFR1 oncogene partner 2 (28-36)
agccugaucgagcagaccaccgcccuc

SEQ ID NO: 34736 - RNA, 27 nt, Artificial Sequence
  60S ribosomal protein L10a (115-123)
agccugaucaagcagaucccccgcauc

SEQ ID NO: 34737 - RNA, 27 nt, Artificial Sequence
  Protein zyg-11 homolog B (362-370)
agccugcucgacgaccugcacuccgcc

SEQ ID NO: 34738 - RNA, 33 nt, Artificial Sequence
  4F2 cell-surface antigen heavy chain (289-299)
agccugcucgaguccaacaaggaccugcugcuc

SEQ ID NO: 34739 - RNA, 30 nt, Artificial Sequence
  Homocysteine-responsive endoplasmic reticulum-resident ubiquitin-like domain member 1 protein (221-230)
agccugcuccccgagggcccgcccgccauc

SEQ ID NO: 34740 - RNA, 27 nt, Artificial Sequence
  Bromodomain-containing protein 8 (139-147)
agccugcuccccaccuccccgcgccug

SEQ ID NO: 34741 - RNA, 39 nt, Artificial Sequence
  Mitochondrial coenzyme A transporter SLC25A42 (36-48)
agccugcucuccggcgcccuggccggggcgcuggccaag

SEQ ID NO: 34742 - RNA, 27 nt, Artificial Sequence
  Mediator of RNA polymerase II transcription subunit 12 (1321-1329)
agccugcucucccagcagcccuuccug

SEQ ID NO: 34743 - RNA, 30 nt, Artificial Sequence
  Ganglioside GM2 activator (3-12)
agccugaugcaggccccccuccugaucgcc

SEQ ID NO: 34744 - RNA, 27 nt, Artificial Sequence
  Terminal uridylyltransferase 7 (826-834)
agccugaaccacuucacccacuccgug

SEQ ID NO: 34745 - RNA, 27 nt, Artificial Sequence
  Signal transducer and activator of transcription 6 (256-264)
agccugaccggccgccucgacgaggug

SEQ ID NO: 34746 - RNA, 27 nt, Artificial Sequence
  Hyccin (36-44)
agccugguguccagccucuacaagguc

SEQ ID NO: 34747 - RNA, 30 nt, Artificial Sequence
  Keratin, type II cytoskeletal 2 epidermal (342-351)
agcauggacaacucccgcaaccuggaccuc

SEQ ID NO: 34748 - RNA, 30 nt, Artificial Sequence
  Serine/threonine-protein phosphatase 2B catalytic subunit beta isoform (116-125)
agccccgccaacacccgcuaccuguuccuc

SEQ ID NO: 34749 - RNA, 27 nt, Artificial Sequence
  Treacle protein (700-708)
agccccgcccaggugaagaccuccguc

SEQ ID NO: 34750 - RNA, 51 nt, Artificial Sequence
  Alpha-enolase (263-279)
agccccgacgacccgucccgcuacaucagccccgaccagcuggccgaccuc

SEQ ID NO: 34751 - RNA, 27 nt, Artificial Sequence
  LIM domain and actin-binding protein 1 (264-272)
agccccgacucccgcgccagcucccug

SEQ ID NO: 34752 - RNA, 27 nt, Artificial Sequence
  Sterol regulatory element-binding protein 2 (1098-1106)
agccccggccagcgcgccgugcugcuc

SEQ ID NO: 34753 - RNA, 27 nt, Artificial Sequence
  Midasin (1754-1762)
agccccggcguggggaagaccucccug

SEQ ID NO: 34754 - RNA, 30 nt, Artificial Sequence
  Nucleophosmin (70-79)
agccccaucaaggugacccuggccacccuc

SEQ ID NO: 34755 - RNA, 33 nt, Artificial Sequence
  Cation-independent mannose-6-phosphate receptor (554-564)
agccccaugaaggagaagggcaacauccagcug

SEQ ID NO: 34756 - RNA, 27 nt, Artificial Sequence
  Transcription factor SOX-9 (199-207)
agccccaacgccaucuucaaggcccug

SEQ ID NO: 34757 - RNA, 27 nt, Artificial Sequence
  F-box/LRR-repeat protein 6 (377-385)
agccccaaccugcgccuccuggaccug

SEQ ID NO: 34758 - RNA, 27 nt, Artificial Sequence
  Adiponectin receptor protein 1 (231-239)
agcccccagccgcgccugaucuaccuc

SEQ ID NO: 34759 - RNA, 33 nt, Artificial Sequence
  Ribosomal protein S6 kinase beta-1 (418-428)
agcccccgcaccccggugucccccgucaaguuc

SEQ ID NO: 34760 - RNA, 27 nt, Artificial Sequence
  Zinc finger protein 655 (12-20)
agcccccgcgugcaguuccagucccug

SEQ ID NO: 34761 - RNA, 33 nt, Artificial Sequence
  Probable aminopeptidase NPEPL1 (88-98)
agccccuccgccgcccacuucaucacccgccug

SEQ ID NO: 34762 - RNA, 33 nt, Artificial Sequence
  Activating transcription factor 7-interacting protein 1 (907-917)
agccccuccaccaaccgcggcccgauccagaug

SEQ ID NO: 34763 - RNA, 30 nt, Artificial Sequence
  Protein transport protein Sec24A (613-622)
agccccaccggcgggcgcauguccguguuc

SEQ ID NO: 34764 - RNA, 24 nt, Artificial Sequence
  Exportin-5 (826-833)
agccccguguucaagaccguccug

SEQ ID NO: 34765 - RNA, 33 nt, Artificial Sequence
  Vacuolar protein sorting-associated protein 41 homolog (371-381)
agccccuaccugccgcgcggcgaccccgugcuc

SEQ ID NO: 34766 - RNA, 30 nt, Artificial Sequence
  Dolichyl-diphosphooligosaccharide-proteinosyltransferase subunit 1 (164-173)
agccccuacccgaccaagacccagacgaug

SEQ ID NO: 34767 - RNA, 33 nt, Artificial Sequence
  Cell division control protein 6 homolog (6-16)
agccaggcccaggccaccaucuccuuccccaag

SEQ ID NO: 34768 - RNA, 30 nt, Artificial Sequence
  Nuclear transcription factor Y subunit gamma (290-299)
agccaguucaccgacggccagcagcuguac

SEQ ID NO: 34769 - RNA, 27 nt, Artificial Sequence
  Inactive serine/threonine-protein kinase VRK3 (34-42)
agccagaccuucgugaacccccacguc

SEQ ID NO: 34770 - RNA, 27 nt, Artificial Sequence
  Vacuolar protein sorting-associated protein 13B (2936-2944)
agccagugggacucccccaugcgcgug

SEQ ID NO: 34771 - RNA, 36 nt, Artificial Sequence
  Zinc finger MIZ domain-containing protein 2 (180-191)
agccaguacggcgccaugggggccggccaguccuuc

SEQ ID NO: 34772 - RNA, 27 nt, Artificial Sequence
  Methylsterol monooxygenase 1 (145-153)
agccaguacaacgccuacaacgagaag

SEQ ID NO: 34773 - RNA, 30 nt, Artificial Sequence
  COUP transcription factor 2 (198-207)
agccaguaccccaaccagccgacccgcuuc

SEQ ID NO: 34774 - RNA, 27 nt, Artificial Sequence
  SUN domain-containing protein 2 (62-70)
agcuccgacgcccacaccagcuacuac

SEQ ID NO: 34775 - RNA, 27 nt, Artificial Sequence
  E3 ISG15-protein ligase HERC5 (113-121)
agcuccgacggcaagcccuucgaguac

SEQ ID NO: 34776 - RNA, 27 nt, Artificial Sequence
  Serrate RNA effector molecule homolog (88-96)
agcuccgaccccuaccacagcggcuac

SEQ ID NO: 34777 - RNA, 27 nt, Artificial Sequence
  Chromodomain-helicase-DNA-binding protein 1 (1545-1553)
agcuccgaccgccaccugacccaguac

SEQ ID NO: 34778 - RNA, 27 nt, Artificial Sequence
  Glycogen phosphorylase, brain form (813-821)
agcuccgaccgcaccaucaccgaguac

SEQ ID NO: 34779 - RNA, 27 nt, Artificial Sequence
  HMG box-containing protein 1 (78-86)
agcuccgacgugagccaccaggaguac

SEQ ID NO: 34780 - RNA, 27 nt, Artificial Sequence
  Disintegrin and metalloproteinase domain-containing protein 23 (174-182)
agcuccgacuacguggagauccacuac

SEQ ID NO: 34781 - RNA, 27 nt, Artificial Sequence
  Insulin-like growth factor I (5-13)
agcucccugcccacccagcucuucaag

SEQ ID NO: 34782 - RNA, 33 nt, Artificial Sequence
  Keratin, type I cytoskeletal 10 (37-47)
agcuccagcaagggcucccuggggggcggguuc

SEQ ID NO: 34783 - RNA, 63 nt, Artificial Sequence
  Keratin, type I cytoskeletal 10 (37-57)
agcuccagcaagggcucccuggggggcggguucagcuccggcggguucagcggcggcuccuuc

SEQ ID NO: 34784 - RNA, 45 nt, Artificial Sequence
  Keratin, type I cytoskeletal 10 (568-582)
agcuccagcuccggcagcgugggggaguccagcuccaagggcccc

SEQ ID NO: 34785 - RNA, 27 nt, Artificial Sequence
  40S ribosomal protein S19 (59-67)
agcaccgcccgccaccuguaccuccgg

SEQ ID NO: 34786 - RNA, 27 nt, Artificial Sequence
  Putative elongation factor 1-alpha-like 3 (157-165)
agcaccgagcccccguacucccagaag

SEQ ID NO: 34787 - RNA, 30 nt, Artificial Sequence
  DNA-dependent protein kinase catalytic subunit (1861-1870)
agcaccuucgacacccagaucacgaagaag

SEQ ID NO: 34788 - RNA, 27 nt, Artificial Sequence
  Sentrin-specific protease 2 (440-448)
agcaccuucuucuaccccaagcugaag

SEQ ID NO: 34789 - RNA, 30 nt, Artificial Sequence
  Actin, alpha cardiac muscle 1 (22-31)
agcaccuuccagcagauguggaucuccaag

SEQ ID NO: 34790 - RNA, 27 nt, Artificial Sequence
  Transketolase (258-266)
agcaccuucuccgagaucuucaagaag

SEQ ID NO: 34791 - RNA, 30 nt, Artificial Sequence
  Syntenin-1 (205-214)
agcaccggccacgugggguucaucuucaag

SEQ ID NO: 34792 - RNA, 27 nt, Artificial Sequence
  E3 ubiquitin-protein ligase HECTD1 (455-463)
agcaccaucuucuacuacgugcagaag

SEQ ID NO: 34793 - RNA, 33 nt, Artificial Sequence
  Hexokinase-2 (408-418)
agcaccaucggcguggacggguccgucuacaag

SEQ ID NO: 34794 - RNA, 27 nt, Artificial Sequence
  Heat shock protein HSP 90-beta (541-549)
agcaccaugggcuacaugauggccaag

SEQ ID NO: 34795 - RNA, 33 nt, Artificial Sequence
  Actin-related protein 2 (307-317)
agcaccauguaccccggccugccgucccgccuc

SEQ ID NO: 34796 - RNA, 36 nt, Artificial Sequence
  Adenosylhomocysteinase (85-96)
agcacccaggaccacgccgccgcggccaucgccaag

SEQ ID NO: 34797 - RNA, 33 nt, Artificial Sequence
  Apoptosis-inducing factor 1, mitochondrial (76-86)
agcaccgugggcgccggggccuacgcguacaag

SEQ ID NO: 34798 - RNA, 27 nt, Artificial Sequence
  Denticleless protein homolog (404-412)
agcaccgugggcugggccucccagaag

SEQ ID NO: 34799 - RNA, 27 nt, Artificial Sequence
  WD repeat-containing protein 48 (319-327)
agcaccgugaacaaguggacccugaag

SEQ ID NO: 34800 - RNA, 33 nt, Artificial Sequence
  Sarcoplasmic/endoplasmic reticulum calcium ATPase 2 (387-397)
agcaccuacgcccccaucggcgaggugcacaag

SEQ ID NO: 34801 - RNA, 33 nt, Artificial Sequence
  Integrator complex subunit 11 (175-185)
agcaccuacgccaccacgauccgcgacuccaag

SEQ ID NO: 34802 - RNA, 33 nt, Artificial Sequence
  Nucleolar RNA helicase 2 (324-334)
agcaccuacgagcagguggaccugaucggcaag

SEQ ID NO: 34803 - RNA, 30 nt, Artificial Sequence
  Eukaryotic translation initiation factor 3 subunit H (119-128)
agcaccuacuacggcuccuucgugacccgc

SEQ ID NO: 34804 - RNA, 27 nt, Artificial Sequence
  Heterogeneous nuclear ribonucleoprotein A1-like 2 (5-13)
agcguggacaagaucgucauccagaag

SEQ ID NO: 34805 - RNA, 30 nt, Artificial Sequence
  Mitochondrial import inner membrane translocase subunit TIM50 (213-222)
agcguggacccccacggcuucaucuccuac

SEQ ID NO: 34806 - RNA, 27 nt, Artificial Sequence
  Lysine-tRNA ligase (98-106)
agcguggaccccaaccaguacuacaag

SEQ ID NO: 34807 - RNA, 33 nt, Artificial Sequence
  39S ribosomal protein L43, mitochondrial (93-103)
agcguggaggagaucuccacccugguccagaag

SEQ ID NO: 34808 - RNA, 33 nt, Artificial Sequence
  Chromodomain-helicase-DNA-binding protein 3 (1189-1199)
agcguggaggagcgcaucacccaggucgccaag

SEQ ID NO: 34809 - RNA, 39 nt, Artificial Sequence
  Cirhin (180-192)
agcguguucgacgucaaguccggcagcgccgugcacaag

SEQ ID NO: 34810 - RNA, 36 nt, Artificial Sequence
  Histone-lysine N-methyltransferase EHMT1 (87-98)
agcgugaucggcuccaacggguacauccugaacaag

SEQ ID NO: 34811 - RNA, 30 nt, Artificial Sequence
  Integrin alpha-4 (81-90)
agcgugaucaaccccggcgccaucuaccgc

SEQ ID NO: 34812 - RNA, 48 nt, Artificial Sequence
  Protein S100-A9 (23-38)
agcgugaagcugggccaccccgacacccucaaccagggggaguucaag

SEQ ID NO: 34813 - RNA, 27 nt, Artificial Sequence
  Mediator of RNA polymerase II transcription subunit 6 (28-36)
agcgugcuggacuacuucuccgagcgc

SEQ ID NO: 34814 - RNA, 39 nt, Artificial Sequence
  Gelsolin (378-390)
agcgugcugcccgagggcggggagaccccgcucuucaag

SEQ ID NO: 34815 - RNA, 33 nt, Artificial Sequence
  Heat shock 70 kDa protein 14 (206-216)
agcgugauggaggucaacuccggcaucuaccgc

SEQ ID NO: 34816 - RNA, 30 nt, Artificial Sequence
  Basic leucine zipper and W2 domain-containing protein 1 (215-224)
agcgugauguccaccgucgaguggaacaag

SEQ ID NO: 34817 - RNA, 27 nt, Artificial Sequence
  60S ribosomal protein L7 (149-157)
agcgugaacgagcugaucuacaagcgc

SEQ ID NO: 34818 - RNA, 36 nt, Artificial Sequence
  Chromatin complexes subunit BAP18 (122-133)
agcgugcccgaggccggcgggccgcccaucaagaag

SEQ ID NO: 34819 - RNA, 27 nt, Artificial Sequence
  ADP/ATP translocase 2 (180-188)
agcgugcagggcaucaucaucuaccgc

SEQ ID NO: 34820 - RNA, 27 nt, Artificial Sequence
  Anaphase-promoting complex subunit 16 (24-32)
agcguguccgaccuggcccccccgcgc

SEQ ID NO: 34821 - RNA, 27 nt, Artificial Sequence
  Nesprin-2 (1819-1827)
agcguguccgaccuguucaacaccaag

SEQ ID NO: 34822 - RNA, 36 nt, Artificial Sequence
  A-kinase anchor protein 1, mitochondrial (874-885)
agcguggucggcgacgagguggugcugaucaaccgc

SEQ ID NO: 34823 - RNA, 36 nt, Artificial Sequence
  Exocyst complex component 6 (35-46)
agcguguacgacgaccagcccaacgcccacaagaag

SEQ ID NO: 34824 - RNA, 30 nt, Artificial Sequence
  Dehydrodolichyl diphosphate syntase complex subunit NUS1 (133-142)
agcguguacgaccaccagggcaucuucaag

SEQ ID NO: 34825 - RNA, 33 nt, Artificial Sequence
  Dehydrodolichyl diphosphate syntase complex subunit NUS1 (133-143)
agcguguacgaccaccagggcaucuucaagcgc

SEQ ID NO: 34826 - RNA, 48 nt, Artificial Sequence
  Actin, alpha skeletal muscle (35-50)
agcuacgagcugcccgacggccaggugaucaccaucgggaacgagcgc

SEQ ID NO: 34827 - RNA, 30 nt, Artificial Sequence
  Tetratricopeptide repeat protein 27 (18-27)
agcuaccuggagaagcagguggucaccuuc

SEQ ID NO: 34828 - RNA, 27 nt, Artificial Sequence
  U5 small nuclear ribonucleoprotein 200 kDa helicase (1958-1966)
agcuaccugaagcagcucccccacuuc

SEQ ID NO: 34829 - RNA, 27 nt, Artificial Sequence
  Intraflagellar transport protein 122 homolog (100-108)
agcuacaaccccaucacccaccagcug

SEQ ID NO: 34830 - RNA, 27 nt, Artificial Sequence
  Constitutive coactivator of peroxisome proliferator-activated receptor gamma (261-269)
agcuacaccuccgugaaggagaacuuc

SEQ ID NO: 34831 - RNA, 24 nt, Artificial Sequence
  60S ribosomal protein L24 (24-31)
accgacggcaagguguuccaguuc

SEQ ID NO: 34832 - RNA, 27 nt, Artificial Sequence
  DNA-directed RNA polymerase II subunit RPB11-b2 (113-121)
accgaccugauccgcgagcucagccug

SEQ ID NO: 34833 - RNA, 27 nt, Artificial Sequence
  WD repeat-containing protein (630-638)
accgaccugaugcgccucaaggagauc

SEQ ID NO: 34834 - RNA, 27 nt, Artificial Sequence
  Protein disulfide-isomerase (296-304)
accgacaaccagcgcauccuggaguuc

SEQ ID NO: 34835 - RNA, 27 nt, Artificial Sequence
  Tensin-1 (1649-1657)
accgacaaccagcgcaagcuguucuuc

SEQ ID NO: 34836 - RNA, 27 nt, Artificial Sequence
  Keratin, type I cytoskeletal 19 (327-335)
accgaggcccgcuucggcgcccagcug

SEQ ID NO: 34837 - RNA, 27 nt, Artificial Sequence
  Nucleolin (584-592)
accgaggagacccugaaggagagcuuc

SEQ ID NO: 34838 - RNA, 27 nt, Artificial Sequence
  UPF0568 protein C14orf166 (23-31)
accgaguuccgcaacuucaucgugugg

SEQ ID NO: 34839 - RNA, 27 nt, Artificial Sequence
  Cytoplasmic dynein 1 heavy chain 1 (1693-1701)
accgagcaccccaagaucaacgagugg

SEQ ID NO: 34840 - RNA, 27 nt, Artificial Sequence
  Disheveled-associated activator of morphogenesis 1 (629-637)
accgagaucgacgacaccaagguguuc

SEQ ID NO: 34841 - RNA, 27 nt, Artificial Sequence
  Proteasome activator complex subunit 3 (207-215)
accgagaucgacgagaaggaguacauc

SEQ ID NO: 34842 - RNA, 33 nt, Artificial Sequence
  Nucleolin (452-462)
accgagaucgacggccgcagcaucucccuguac

SEQ ID NO: 34843 - RNA, 30 nt, Artificial Sequence
  Coatomer subunit alpha (1207-1216)
accgagaucggcaaggacgugaucgggcug

SEQ ID NO: 34844 - RNA, 27 nt, Artificial Sequence
  Thiopurine S-methyltransferase (113-121)
accgagauccccggcaccaagguguuc

SEQ ID NO: 34845 - RNA, 30 nt, Artificial Sequence
  Angiomotin (467-476)
accgagauccagcgcgugagcgaggccuac

SEQ ID NO: 34846 - RNA, 27 nt, Artificial Sequence
  Eukaryotic translation initiation factor 3 subunit C-like protein (323-331)
accgagaucacccacgccguggucauc

SEQ ID NO: 34847 - RNA, 27 nt, Artificial Sequence
  Fructose-bisphosphate aldolase A (206-214)
accgagaaggugcuggccgccgucuac

SEQ ID NO: 34848 - RNA, 27 nt, Artificial Sequence
  Staphylococcal nuclease domain-containing protein 1 (260-268)
accgagcugcuccugaaggagggcuuc

SEQ ID NO: 34849 - RNA, 27 nt, Artificial Sequence
  Sorting nexin-5 (292-300)
accgagcugcuccgcuacuacaugcug

SEQ ID NO: 34850 - RNA, 27 nt, Artificial Sequence
  Tuftelin (365-373)
accgagaaccccggcagcauccgcauc

SEQ ID NO: 34851 - RNA, 27 nt, Artificial Sequence
  KN motif and ankyrin repeat domain-containing protein 2 (612-620)
accgagcgcgagcugaagguggccuac

SEQ ID NO: 34852 - RNA, 27 nt, Artificial Sequence
  Tensin-1 (19-27)
accgagcgcaucaucgccgugagcuuc

SEQ ID NO: 34853 - RNA, 30 nt, Artificial Sequence
  Microtubule-actin cross-linking factor 1, isoforms 1/2/3/5 (327-336)
accgagguggacagccgcuggcaggaguac

SEQ ID NO: 34854 - RNA, 27 nt, Artificial Sequence
  Melanoma-associated antigen D2 (67-75)
accgaggugagcaagacccccgaggcc

SEQ ID NO: 34855 - RNA, 33 nt, Artificial Sequence
  Cytoplasmic dynein 1 heavy chain 1 (3550-3560)
accgaguaccugagcaacgccgacgagcgccuc

SEQ ID NO: 34856 - RNA, 30 nt, Artificial Sequence
  Autophagy-related protein 9A (6-15)
accgaguaccagcgccuggaggccagcuac

SEQ ID NO: 34857 - RNA, 39 nt, Artificial Sequence
  Glyceraldehyde-3-phosphate dehydrogenase (3-15)
accuucgacgccggcgccgggaucgcgcugaacgaccac

SEQ ID NO: 34858 - RNA, 27 nt, Artificial Sequence
  Hydroxymethylglutaryl-CoA synthase, cytoplasmic (131-139)
accaucaucgacaagagcaaguccgug

SEQ ID NO: 34859 - RNA, 33 nt, Artificial Sequence
  Histone H3.3 (119-129)
accaucaugcccaaggacauccagcuggcccgc

SEQ ID NO: 34860 - RNA, 30 nt, Artificial Sequence
  NADH dehydrogenase (ubiquinone) iron-sulfur protein 5 (19-28)
accauccagagcggcgagcagcccuacaag

SEQ ID NO: 34861 - RNA, 30 nt, Artificial Sequence
  T-complex protein 1 subunit zeta-2 (204-213)
accaaggaggugaacagcggcuucuucuac

SEQ ID NO: 34862 - RNA, 27 nt, Artificial Sequence
  Serine/threonine-protein phosphatase 6 regulatory ankyrin repeat subunit C (603-611)
acccuggccgagacccucgugaaccug

SEQ ID NO: 34863 - RNA, 27 nt, Artificial Sequence
  Leucine-rich repeat-containing protein 41 (19-27)
acccuggccagcucccuccacacccug

SEQ ID NO: 34864 - RNA, 27 nt, Artificial Sequence
  MOB kinase activator 1A (130-138)
acccuguuccccagcaagaucggcgug

SEQ ID NO: 34865 - RNA, 27 nt, Artificial Sequence
  A-kinase anchor protein 11 (1555-1563)
acccugggcagcaccguguuccgcguc

SEQ ID NO: 34866 - RNA, 27 nt, Artificial Sequence
  Nucleosome-remodeling factor subunit BPTF (281-289)
acccugauggccgagaugcacgugguc

SEQ ID NO: 34867 - RNA, 27 nt, Artificial Sequence
  WD repeat-containing protein 81 (157-165)
acccugauggacauccucccccgcauc

SEQ ID NO: 34868 - RNA, 27 nt, Artificial Sequence
  Exportin-1 (346-354)
acccugauggaggcccuccacuacaug

SEQ ID NO: 34869 - RNA, 27 nt, Artificial Sequence
  Splicing factor 3A subunit 1 (521-529)
acccugcaggagcagaucgaggccauc

SEQ ID NO: 34870 - RNA, 27 nt, Artificial Sequence
  Replication protein A 32 kDa subunit (58-66)
acccugguggacgaggucuuccgcauc

SEQ ID NO: 34871 - RNA, 27 nt, Artificial Sequence
  Elongator complex protein 2 (406-414)
acccuguggcccgaggugcagaagcuc

SEQ ID NO: 34872 - RNA, 27 nt, Artificial Sequence
  Exosome complex component RRP42 (108-116)
acccuguaccgcaucuucaacaacaag

SEQ ID NO: 34873 - RNA, 27 nt, Artificial Sequence
  Transmembrane protein 50A (48-56)
accaugaaggacuucaaccacagcuac

SEQ ID NO: 34874 - RNA, 27 nt, Artificial Sequence
  snRNA-activating protein complex subunit 4 (1152-1160)
acccccgccccgcccacccacgcccug

SEQ ID NO: 34875 - RNA, 30 nt, Artificial Sequence
  Spectrin beta chain, non-erythrocytic 1 (2320-2329)
acccccgccagcucccgcgcccagacccug

SEQ ID NO: 34876 - RNA, 33 nt, Artificial Sequence
  26S proteasome non-ATPase regulatory subunit 4 (65-75)
acccccgacaccggccgcauccugagcaagcuc

SEQ ID NO: 34877 - RNA, 27 nt, Artificial Sequence
  ATP-dependent zinc metalloprotease YME1L1 (25-33)
acccccaagaacaccagcgugucccug

SEQ ID NO: 34878 - RNA, 27 nt, Artificial Sequence
  Galectin-8 (193-201)
acccccaugggcccggggcgcaccgug

SEQ ID NO: 34879 - RNA, 27 nt, Artificial Sequence
  WAS/WASL-interacting protein family member 1 (331-339)
accccccgccugccgcagcggaaccuc

SEQ ID NO: 34880 - RNA, 33 nt, Artificial Sequence
  ATP synthase F(0) complex subunit C2, mitochondrial (26-36)
acccccagccuggugaaguccaccagccagcuc

SEQ ID NO: 34881 - RNA, 27 nt, Artificial Sequence
  Ubiquitin carboxyl-terminal hydrolase 48 (860-868)
acccaggccaccaucuacgugcacaag

SEQ ID NO: 34882 - RNA, 33 nt, Artificial Sequence
  HLA class I histocompatibility antigen, B-13 alpha chain (63-73)
acccagaucagcaagaccaacacgcagaccuac

SEQ ID NO: 34883 - RNA, 30 nt, Artificial Sequence
  rRNA-processing protein FCF1 homolog (61-70)
acccagcugggccccccguaccacauccuc

SEQ ID NO: 34884 - RNA, 27 nt, Artificial Sequence
  14-3-3 protein gamma (115-123)
acccaguacgagagcaagguguucuac

SEQ ID NO: 34885 - RNA, 27 nt, Artificial Sequence
  Gamma-interferon-inducible protein 16 (419-427)
accaccuuccccgagagccaccugcgc

SEQ ID NO: 34886 - RNA, 27 nt, Artificial Sequence
  MIT domain-containing protein 1 (236-244)
accaccguggacaucuuccacaagaag

SEQ ID NO: 34887 - RNA, 27 nt, Artificial Sequence
  Lys-63-specific deubiquitinase BRCC36 (66-74)
accguggccgagaaggucgacgccgug

SEQ ID NO: 34888 - RNA, 27 nt, Artificial Sequence
  28S ribosomal protein S24, mitochondrial (78-86)
accguggaggacgucuuccugcgcaag

SEQ ID NO: 34889 - RNA, 36 nt, Artificial Sequence
  Phosphatidylinositol-4,5-bisphosphate 4-phosphatase 2 (39-50)
accguggagagccccgagcugcaggucccguacaag

SEQ ID NO: 34890 - RNA, 27 nt, Artificial Sequence
  Glycine-tRNA ligase (533-541)
accguguucgagcacaccuuccacguc

SEQ ID NO: 34891 - RNA, 33 nt, Artificial Sequence
  Tubulin alpha-1C chain (38-48)
accgugaucgacgagguccgcaccggcacguac

SEQ ID NO: 34892 - RNA, 27 nt, Artificial Sequence
  Transcription factor BTF3 (76-84)
accgugauccacuucaacaaccccaag

SEQ ID NO: 34893 - RNA, 33 nt, Artificial Sequence
  DNA replication licensing factor MCM6 (163-173)
accgugauccgcgacgucgagcagcaguucaag

SEQ ID NO: 34894 - RNA, 33 nt, Artificial Sequence
  Dolichyl-diphosphooligosaccharide-proteinosyltransferase subunit 2 (165-175)
accgugcuggagagccgcucccucuucagcaag

SEQ ID NO: 34895 - RNA, 48 nt, Artificial Sequence
  Actin, cytoplasmic 2 (36-51)
accgugcugagcggcgggaccacgauguaccccggcaucgccgaccgc

SEQ ID NO: 34896 - RNA, 27 nt, Artificial Sequence
  Ubiquitin-protein ligase E3A (325-333)
accuacaaggugaucagcaacgaguuc

SEQ ID NO: 34897 - RNA, 27 nt, Artificial Sequence
  Vacuolar protein sorting-associated protein 51 homolog (480-488)
guggccgacgaggagcugguccaccuc

SEQ ID NO: 34898 - RNA, 24 nt, Artificial Sequence
  Eukaryotic translation initiation factor 3 subunit H (221-228)
guggccgacaagcacgagcugcuc

SEQ ID NO: 34899 - RNA, 27 nt, Artificial Sequence
  Bifunctional polynucleotide phosphatase/kinase (54-62)
guggccgaccccgagacccgcaccguc

SEQ ID NO: 34900 - RNA, 27 nt, Artificial Sequence
  Serine/threonine-protein kinase PLK2 (471-479)
guggccgacaccgucgcccgcgugcug

SEQ ID NO: 34901 - RNA, 27 nt, Artificial Sequence
  Ubiquitin carboxyl-terminal hydrolase 16 (733-741)
guggccgaggagaacacccgcguccug

SEQ ID NO: 34902 - RNA, 27 nt, Artificial Sequence
  HLA class I histocompatibility antigen, B-8 alpha chain (151-159)
guggccgagcaggaccgcgccuaccug

SEQ ID NO: 34903 - RNA, 27 nt, Artificial Sequence
  Mitochondrial import receptor subunit TOM5 homolog (35-43)
guggcccugcuccgcgucacccccuuc

SEQ ID NO: 34904 - RNA, 54 nt, Artificial Sequence
  Actin, cytoplasmic 1 (13-30)
guggcccccgaggagcacccgguccugcucaccgaggccccccugaaccccaag

SEQ ID NO: 34905 - RNA, 24 nt, Artificial Sequence
  Polymerase I and transcript release factor (229-236)
guggacgacuucaagaaggccuuc

SEQ ID NO: 34906 - RNA, 27 nt, Artificial Sequence
  Cholesteryl ester transfer protein (230-238)
guggacaucagccugaccggcgacccc

SEQ ID NO: 34907 - RNA, 24 nt, Artificial Sequence
  Heterogeneous nuclear ribonucleoproteins C1/C2 (33-40)
guggaggccaucuucagcaaguac

SEQ ID NO: 34908 - RNA, 27 nt, Artificial Sequence
  Sodium/potassium-transporting ATPase subunit alpha-1 (701-709)
guggaggacagcuacggccagcagugg

SEQ ID NO: 34909 - RNA, 30 nt, Artificial Sequence
  116 kDa U5 small nuclear ribonucleoprotein component (621-630)
guggaggagagcggcgagcacgucauccug

SEQ ID NO: 34910 - RNA, 33 nt, Artificial Sequence
  Adenosylhomocysteinase 2 (222-232)
guggaggagagcgucaccggcgugcaccgccug

SEQ ID NO: 34911 - RNA, 36 nt, Artificial Sequence
  ATP synthase subunit alpha, mitochondrial (96-107)
guggaguucagcuccggccugaaggggaugagccuc

SEQ ID NO: 34912 - RNA, 27 nt, Artificial Sequence
  HLA class II histocompatibility antigen, DRB1-4 beta chain (204-212)
guggagcaccccagccugaccuccccg

SEQ ID NO: 34913 - RNA, 33 nt, Artificial Sequence
  Protein disulfide-isomerase A6 (411-421)
guggagcuggacgaccucggcaaggacgagcug

SEQ ID NO: 34914 - RNA, 27 nt, Artificial Sequence
  Galectin-3 (204-212)
guggagcccgaccacuucaaggucgcc

SEQ ID NO: 34915 - RNA, 24 nt, Artificial Sequence
  SARM1 protein (269-276)
guggagcgcgaggucgagcaggug

SEQ ID NO: 34916 - RNA, 24 nt, Artificial Sequence
  N6-adenosine-methyltransferase 70 kDa subunit (116-123)
guggagagccugcuccagaaguuc

SEQ ID NO: 34917 - RNA, 27 nt, Artificial Sequence
  Protein RMD5 homolog B (280-288)
guggagagcccccuguccgucagcuuc

SEQ ID NO: 34918 - RNA, 33 nt, Artificial Sequence
  Nucleosome assembly protein 1-like 1 (60-70)
guggagacccccaccggcuacaucgagagccug

SEQ ID NO: 34919 - RNA, 27 nt, Artificial Sequence
  Influenza virus NS1A-binding protein (83-91)
guggagguccugcucaacuacgccuac

SEQ ID NO: 34920 - RNA, 27 nt, Artificial Sequence
  Rho GDP-dissociation inhibitor 1 (108-116)
guggaguaccgcaucaagaucagcuuc

SEQ ID NO: 34921 - RNA, 51 nt, Artificial Sequence
  40S ribosomal protein S3a (66-82)
guguucgaggucagccuggccgaccuccagaacgacgagguggccuuccgc

SEQ ID NO: 34922 - RNA, 27 nt, Artificial Sequence
  40S ribosomal protein S23 (112-120)
gugggcgacauccccgggguccgcuuc

SEQ ID NO: 34923 - RNA, 27 nt, Artificial Sequence
  AT-rich interactive domain-containing protein 1A (1378-1386)
gugggcgaccccgggcagcgcacccug

SEQ ID NO: 34924 - RNA, 27 nt, Artificial Sequence
  Bromodomain-containing protein 8 (239-247)
gugggcgacccccacaccgucaccgug

SEQ ID NO: 34925 - RNA, 27 nt, Artificial Sequence
  F-box/LRR-repeat protein 19 (440-448)
gugggcgaccccagcguccaccugcuc

SEQ ID NO: 34926 - RNA, 27 nt, Artificial Sequence
  Nucleolar protein 56 (117-125)
gugaucgccgagauccugcgcggcguc

SEQ ID NO: 34927 - RNA, 27 nt, Artificial Sequence
  Kelch-like ECH-associated protein 1 (420-428)
gugaucgacggccacaucuacgccguc

SEQ ID NO: 34928 - RNA, 27 nt, Artificial Sequence
  Eukaryotic translation initiation factor 3 subunit L (83-91)
gugaucgaccagaaggucuacgagauc

SEQ ID NO: 34929 - RNA, 27 nt, Artificial Sequence
  E3 ubiquitin-protein ligase RNF213 (1305-1313)
gugaucuucaaggacuucgucaacaag

SEQ ID NO: 34930 - RNA, 27 nt, Artificial Sequence
  MICOS complex subunit MIC27 (158-166)
gugaucaucgccaaggucaccgccaag

SEQ ID NO: 34931 - RNA, 39 nt, Artificial Sequence
  Elongation factor 1-alpha 1 (344-356)
gugaucauccugaaccaccccggccagaucagcgccggg

SEQ ID NO: 34932 - RNA, 27 nt, Artificial Sequence
  Plectin (1820-1828)
gugcuggccgagaagcucgccgcgauc

SEQ ID NO: 34933 - RNA, 24 nt, Artificial Sequence
  Lysine-specific demethylase 5A (1593-1600)
gugcuggacauccccagcaaguac

SEQ ID NO: 34934 - RNA, 27 nt, Artificial Sequence
  Integrin-linked protein kinase (219-227)
gugcugcacgagggcaccaacuucguc

SEQ ID NO: 34935 - RNA, 27 nt, Artificial Sequence
  Interleukin-12 subunit alpha (14-22)
gugcugcucgaccaccugagccuggcc

SEQ ID NO: 34936 - RNA, 33 nt, Artificial Sequence
  Tumor necrosis factor receptor superfamily member 19 (5-15)
gugcugcucgagcaggagaagaccuucuucacc

SEQ ID NO: 34937 - RNA, 30 nt, Artificial Sequence
  Protein CNPPD1 (210-219)
gugcugcucgagcagcccaccuggcagcug

SEQ ID NO: 34938 - RNA, 30 nt, Artificial Sequence
  Fatty acid synthase (2105-2114)
gugcugagcuccuucguccucgccgagaag

SEQ ID NO: 34939 - RNA, 27 nt, Artificial Sequence
  2'-deoxynucleoside 5'-phosphate N-hydrolase 1 (52-60)
gugcugaccgagcacgucgccgccgcg

SEQ ID NO: 34940 - RNA, 30 nt, Artificial Sequence
  AKT-interacting protein (200-209)
gugcuguacgagaaggacauccagcucuuc

SEQ ID NO: 34941 - RNA, 27 nt, Artificial Sequence
  Thioredoxin-like protein 4A (44-52)
gugcuguacagcaucgccgagaagguc

SEQ ID NO: 34942 - RNA, 33 nt, Artificial Sequence
  Putative PIP5K1A and PSMD4-like protein (813-823)
gugaugcaggaccccgaguuccugcagagcguc

SEQ ID NO: 34943 - RNA, 48 nt, Artificial Sequence
  78 kDa glucose-regulated protein (177-192)
gugaugcgcaucaucaacgagcccaccgccgccgcgaucgccuacggc

SEQ ID NO: 34944 - RNA, 33 nt, Artificial Sequence
  Glutathione S-transferase P (200-210)
gugaaccugcccaucaacggcaacgggaagcag

SEQ ID NO: 34945 - RNA, 27 nt, Artificial Sequence
  Eukaryotic translation initiation factor 3 subunit E (109-117)
gugcccgccaccgaccgcaacgcccug

SEQ ID NO: 34946 - RNA, 33 nt, Artificial Sequence
  Protein UXT (95-105)
gugcccgacaccagccgcaucuacgucgcccug

SEQ ID NO: 34947 - RNA, 33 nt, Artificial Sequence
  A-kinase-interacting protein 1 (107-117)
gugcccgaggagggcggggccacccacgucuac

SEQ ID NO: 34948 - RNA, 27 nt, Artificial Sequence
  N-alpha-acetyltransferase 10 (67-75)
gugccccacggccacaucaccagccug

SEQ ID NO: 34949 - RNA, 27 nt, Artificial Sequence
  Tubulin beta chain (80-88)
gugccccgcgccauccuggucgaccuc

SEQ ID NO: 34950 - RNA, 27 nt, Artificial Sequence
  Protein phosphatase 1 regulatory subunit 15A (126-134)
gugccccgcggccaggggagccaguuc

SEQ ID NO: 34951 - RNA, 27 nt, Artificial Sequence
  Protein Wiz (759-767)
gugccccgcccgccccagaccagccug

SEQ ID NO: 34952 - RNA, 24 nt, Artificial Sequence
  Transmembrane protein 140 (75-82)
gugccccgcgucggccuggggcuc

SEQ ID NO: 34953 - RNA, 27 nt, Artificial Sequence
  Nucleolar transcription factor 1 (161-169)
gugcccagcaccgagcgcaugguccug

SEQ ID NO: 34954 - RNA, 27 nt, Artificial Sequence
  Replication protein A 70 kDa DNA-binding subunit (383-391)
gugagcgacuucggcgggcgcucccug

SEQ ID NO: 34955 - RNA, 27 nt, Artificial Sequence
  Cytosolic non-specific dipeptidase (386-394)
gugagcgacuucucccacccccacuac

SEQ ID NO: 34956 - RNA, 27 nt, Artificial Sequence
  Sister chromatid cohesion protein PDS5 homolog A (258-266)
gugagcgaccuguccgagcacgucuuc

SEQ ID NO: 34957 - RNA, 24 nt, Artificial Sequence
  DNA damage-inducible transcript 4 protein (124-131)
gugagccaggucggcaaggagcug

SEQ ID NO: 34958 - RNA, 30 nt, Artificial Sequence
  Tetratricopeptide repeat protein 28 (985-994)
gugaccgaccccaccggcuuccugcgcaug

SEQ ID NO: 34959 - RNA, 27 nt, Artificial Sequence
  Beta-2-syntrophin (352-360)
gugaccgagaaggaccugcuccuguac

SEQ ID NO: 34960 - RNA, 30 nt, Artificial Sequence
  T-complex protein 1 subunit epsilon (13-22)
gugaccaucuucauccgcggcgggaacaag

SEQ ID NO: 34961 - RNA, 30 nt, Artificial Sequence
  NHP2-like protein 1 (104-113)
gugaccaucaaggagggcagccagcugaag

SEQ ID NO: 34962 - RNA, 36 nt, Artificial Sequence
  T-complex protein 1 subunit delta (68-79)
gugaccaucaccaacgacggcgccacgauccugaag

SEQ ID NO: 34963 - RNA, 27 nt, Artificial Sequence
  HLA class I histocompatibility antigen, alpha chain E (313-321)
guggucgccgccgugaucuggcgcaag

SEQ ID NO: 34964 - RNA, 27 nt, Artificial Sequence
  Jouberin (370-378)
guggucgacgagcacaccggccaguac

SEQ ID NO: 34965 - RNA, 27 nt, Artificial Sequence
  WASH complex subunit 7 (157-165)
guggucaugaacguggugcaccagcug

SEQ ID NO: 34966 - RNA, 33 nt, Artificial Sequence
  Cyclin-G-associated kinase (580-590)
guggucaugacccccgugccgcuguucagcaag

SEQ ID NO: 34967 - RNA, 30 nt, Artificial Sequence
  Exportin-6 (715-724)
gugguccaggagcccggccagguguucaag

SEQ ID NO: 34968 - RNA, 27 nt, Artificial Sequence
  DNA damage-binding protein 1 (508-516)
guggucguggccgugggccgcgcccug

SEQ ID NO: 34969 - RNA, 33 nt, Artificial Sequence
  rRNA 2'-O-methyltransferase fibrillarin (305-315)
guggucgugggcguguaccgccccccgcccaag

SEQ ID NO: 34970 - RNA, 27 nt, Artificial Sequence
  Transmembrane protein 41B (174-182)
guggucuacaaguaccugaccgagaag

SEQ ID NO: 34971 - RNA, 27 nt, Artificial Sequence
  Ribose-phosphate pyrophosphokinase 1 (40-48)
guguacgccauccugacccacggcauc

SEQ ID NO: 34972 - RNA, 30 nt, Artificial Sequence
  ATP synthase mitochondrial F1 complex assembly factor 1 (87-96)
guguacgccgucauccccgccgagaaguuc

SEQ ID NO: 34973 - RNA, 27 nt, Artificial Sequence
  Antizyme inhibitor 1 (320-328)
guguacggcagcuucgccuccaagcug

SEQ ID NO: 34974 - RNA, 30 nt, Artificial Sequence
  ATP-dependent RNA helicase DHX8 (1133-1142)
guguacauccaccccagcuccgcccuguuc

SEQ ID NO: 34975 - RNA, 27 nt, Artificial Sequence
  Adenosylhomocysteinase 2 (207-215)
guguacaagaaguaccccaacgucuuc

SEQ ID NO: 34976 - RNA, 27 nt, Artificial Sequence
  Inactive tyrosine-protein kinase 7 (955-963)
guguacaacagcgaguacuaccacuuc

SEQ ID NO: 34977 - RNA, 27 nt, Artificial Sequence
  2'-5'-oligoadenylate synthase 3 (865-873)
ugggagaacccccgcgugcugagcuuc

SEQ ID NO: 34978 - RNA, 21 nt, Artificial Sequence
  Actin, aortic smooth muscle (358-364)
uggaucagcaagcaggaguac

SEQ ID NO: 34979 - RNA, 27 nt, Artificial Sequence
  Protein LYRIC (404-412)
uggguggacgaggagcgcgccagccug

SEQ ID NO: 34980 - RNA, 30 nt, Artificial Sequence
  General transcription factor 3C polypeptide 5 (51-60)
uacgccgaccccaccaagcgccuggagcuc

SEQ ID NO: 34981 - RNA, 27 nt, Artificial Sequence
  Translocon-associated protein subunit delta (67-75)
uacgccgacgugggcgggaagcaguuc

SEQ ID NO: 34982 - RNA, 30 nt, Artificial Sequence
  U5 small nuclear ribonucleoprotein 200 kDa helicase (1245-1254)
uacgcccaggacgagcaccugaucaccuuc

SEQ ID NO: 34983 - RNA, 33 nt, Artificial Sequence
  HLA class I histocompatibility antigen, alpha chain G (137-147)
uacgccuacgacggcaaggacuaccuggcccuc

SEQ ID NO: 34984 - RNA, 45 nt, Artificial Sequence
  Cofilin-1 (85-99)
uacgacgccaccuacgagaccaaggagagcaagaaggaggaccug

SEQ ID NO: 34985 - RNA, 27 nt, Artificial Sequence
  Transcriptional adapter 2-alpha (431-439)
uacgacuuccugauccgcgagggcuac

SEQ ID NO: 34986 - RNA, 27 nt, Artificial Sequence
  Myeloid cell nuclear differentiation antigen (31-39)
uacgaccugggccucaccaccaagaug

SEQ ID NO: 34987 - RNA, 27 nt, Artificial Sequence
  Dual specificity tyrosine-phosphorylation-regulated kinase 1A (246-254)
uacgaccugcuccgcaacaccaacuuc

SEQ ID NO: 34988 - RNA, 24 nt, Artificial Sequence
  Renin receptor (335-342)
uacgacagcaucaucuaccgcaug

SEQ ID NO: 34989 - RNA, 27 nt, Artificial Sequence
  Integrin beta-1 (314-322)
uacgacuaccccagcaucgcccaccug

SEQ ID NO: 34990 - RNA, 27 nt, Artificial Sequence
  ATP-dependent RNA helicase DDX3X (283-291)
uacgaggaggcccgcaaguucagcuac

SEQ ID NO: 34991 - RNA, 27 nt, Artificial Sequence
  Cytochrome c oxidase subunit 7C, mitochondrial (19-27)
uacgaggagggccccgggaagaaccug

SEQ ID NO: 34992 - RNA, 27 nt, Artificial Sequence
  Spectrin beta chain, non-erythrocytic 1 (461-469)
uacgaggagcgcgugcaggccgucgug

SEQ ID NO: 34993 - RNA, 33 nt, Artificial Sequence
  La-related protein 1 (633-643)
uacgagaucgacgaccgcgacgugaacaagauc

SEQ ID NO: 34994 - RNA, 30 nt, Artificial Sequence
  Nodal modulator 2 (181-190)
uacgagauccuggccacccaccccaccugg

SEQ ID NO: 34995 - RNA, 27 nt, Artificial Sequence
  Keratin, type I cytoskeletal 10 (42-50)
uacgagaacgagguggcccugcgccag

SEQ ID NO: 34996 - RNA, 27 nt, Artificial Sequence
  Ubiquitin carboxyl-terminal hydrolase 22 (258-266)
uacgagcagcaggacgcccacgaguuc

SEQ ID NO: 34997 - RNA, 30 nt, Artificial Sequence
  Regulator of microtubule dynamics protein 1 (94-103)
uacgagagcggcgagaccgagaagcuguac

SEQ ID NO: 34998 - RNA, 27 nt, Artificial Sequence
  Thioredoxin-interacting protein (97-105)
uacgaguacaaguucggcuucgagcug

SEQ ID NO: 34999 - RNA, 33 nt, Artificial Sequence
  Hemoglobin subunit alpha (25-35)
uacggcgccgaggcccuggagcgcauguuccuc

SEQ ID NO: 35000 - RNA, 27 nt, Artificial Sequence
  Solute carrier family 25 member 43 (300-308)
uacauccugagcccccucuccuacaag

SEQ ID NO: 35001 - RNA, 30 nt, Artificial Sequence
  UDP-N-acetylglucosamine transporter (266-275)
uacaucuacgacggcgagcuggugagcaag

SEQ ID NO: 35002 - RNA, 30 nt, Artificial Sequence
  Zinc finger protein 573 (42-51)
uaccuggaccccaaccagcgcgaccucuac

SEQ ID NO: 35003 - RNA, 27 nt, Artificial Sequence
  Splicing factor 3A subunit 3 (192-200)
uaccugcaggacuacaccgaccgcgug

SEQ ID NO: 35004 - RNA, 33 nt, Artificial Sequence
  Regulator of microtubule dynamics protein 1 (92-102)
uaccuguacgagagcggcgagaccgagaagcuc

SEQ ID NO: 35005 - RNA, 27 nt, Artificial Sequence
  Myc proto-oncogene protein (334-342)
uaccccgccgccaagcgcgugaagcug

SEQ ID NO: 35006 - RNA, 27 nt, Artificial Sequence
  Exportin-T (608-616)
uaccccgccgagcgcaagcaggcccug

SEQ ID NO: 35007 - RNA, 30 nt, Artificial Sequence
  Ubiquitin-conjugating enzyme E2 D2 (59-68)
uaccccuucaagccgcccaagguggccuuc

SEQ ID NO: 35008 - RNA, 30 nt, Artificial Sequence
  Ubiquitin-conjugating enzyme E2 E1 (89-98)
uaccccuucaagccgcccaaggugaccuuc

SEQ ID NO: 35009 - RNA, 27 nt, Artificial Sequence
  ATP-dependent RNA helicase DDX24 (383-391)
uaccccaagcgcccgcugcucggccug

SEQ ID NO: 35010 - RNA, 27 nt, Artificial Sequence
  All-trans-retinol 13,14-reductase (15-23)
uacccccgcggcgggagcuccgagauc

SEQ ID NO: 35011 - RNA, 27 nt, Artificial Sequence
  Laminin subunit gamma-1 (615-623)
uaccccagcgagaccaccgugaaguac

SEQ ID NO: 35012 - RNA, 27 nt, Artificial Sequence
  Eukaryotic translation initiation factor 3 subunit E (62-70)
uacagcgacgacaucccccacgcccug

SEQ ID NO: 35013 - RNA, 36 nt, Artificial Sequence
  Bromodomain and WD repeat-containing protein 1 (854-865)
uacagcgaguccagcuccgacagcuccagccgcuac

SEQ ID NO: 35014 - RNA, 27 nt, Artificial Sequence
  Nuclear pore complex protein Nup160 (345-353)
uacagccuggaccacaucuccagccuc

SEQ ID NO: 35015 - RNA, 27 nt, Artificial Sequence
  ATP-dependent RNA helicase DDX51 (304-312)
uacaccgacgccaccccccugcgcgug

SEQ ID NO: 35016 - RNA, 24 nt, Artificial Sequence
  Cytosolic purine 5'-nucleotidase (255-262)
uacaccgacaagaucaugaccuac

SEQ ID NO: 35017 - RNA, 30 nt, Artificial Sequence
  Sterol regulatory element-binding protein cleavage-activating protein (160-169)
uacaccgaccccgccggccugcgcaacuac

SEQ ID NO: 35018 - RNA, 27 nt, Artificial Sequence
  General transcription factor 3C polypeptide 2 (787-795)
uacaccgagaccgugaaccaccacuac

SEQ ID NO: 35019 - RNA, 27 nt, Artificial Sequence
  Cytochrome c oxidase subunit 1 (403-411)
uacacccuggaccagaccuacgccaag

SEQ ID NO: 35020 - RNA, 27 nt, Artificial Sequence
  3-phosphoinositide-dependent protein kinase 1 (486-494)
uacguggaccccgucaacaaggugcug

SEQ ID NO: 35021 - RNA, 30 nt, Artificial Sequence
  Alanine-tRNA ligase, cytoplasmic (497-506)
uacguguucgagaacaccgucgccaccgug

SEQ ID NO: 35022 - RNA, 42 nt, Artificial Sequence
  Actin, aortic smooth muscle (55-68)
uacgugggcgacgaggcccagagcaagcgcgggauccugacc

SEQ ID NO: 35023 - RNA, 27 nt, Artificial Sequence
  Exocyst complex component 2 (206-214)
uacuacgccgagguggagacccgcauc

SEQ ID NO: 35024 - RNA, 27 nt, Artificial Sequence
  Nuclear receptor corepressor 2 (332-340)
uacuacgagaagcaguuccccgagauc

SEQ ID NO: 35025 - RNA, 27 nt, Artificial Sequence
  Plexin-B2 (1-9)
uacuacaccgacaucaugcacacccug

SEQ ID NO: 35026 - RNA, 27 nt, Artificial Sequence
  Tankyrase-1 (100-108)
gccgccgcgcccguggucccggccgug

SEQ ID NO: 35027 - RNA, 27 nt, Artificial Sequence
  Ubiquitin-conjugating enzyme E2 J2 (242-250)
gccgccuucgcguacaccgugaaguac

SEQ ID NO: 35028 - RNA, 27 nt, Artificial Sequence
  DNA replication licensing factor MCM5 (326-334)
gccgcccugcccaacguguacgagguc

SEQ ID NO: 35029 - RNA, 27 nt, Artificial Sequence
  Heterogeneous nuclear ribonucleoprotein Q (215-223)
gccgcccaggaggcggugaagcuguac

SEQ ID NO: 35030 - RNA, 27 nt, Artificial Sequence
  Zinc finger protein 609 (360-368)
gccgaggccgacaagaucuacagcuuc

SEQ ID NO: 35031 - RNA, 27 nt, Artificial Sequence
  M-phase inducer phosphatase 2 (285-293)
gccgaggagcccaaggcccgcgugcug

SEQ ID NO: 35032 - RNA, 30 nt, Artificial Sequence
  SHC SH2 domain-binding protein 1 (437-446)
gccgaguuccugaugaagaacagcgaccuc

SEQ ID NO: 35033 - RNA, 27 nt, Artificial Sequence
  Pre-mRNA-splicing factor ATP-dependent RNA helicase DHX15 (563-571)
gccgaguucccccuggacccgcagcuc

SEQ ID NO: 35034 - RNA, 33 nt, Artificial Sequence
  Intraflagellar transport protein 81 homolog (43-53)
gccgagaucgaccccaagcagcugguggacauc

SEQ ID NO: 35035 - RNA, 27 nt, Artificial Sequence
  Clathrin heavy chain 1 (493-501)
gccgagaccggccaggugcagaagauc

SEQ ID NO: 35036 - RNA, 27 nt, Artificial Sequence
  Uncharacterized protein C8orf59 (62-70)
gcccacuucgccaagagcaucucccug

SEQ ID NO: 35037 - RNA, 27 nt, Artificial Sequence
  60S ribosomal protein L9 (97-105)
gcccacuuccccaucaacguggucauc

SEQ ID NO: 35038 - RNA, 27 nt, Artificial Sequence
  Intraflagellar transport protein 27 homolog (30-38)
gcccacuuccagaagagcuacacccug

SEQ ID NO: 35039 - RNA, 27 nt, Artificial Sequence
  Xaa-Pro aminopeptidase 1 (333-341)
gcccacaucaaggacgccguggcgcug

SEQ ID NO: 35040 - RNA, 27 nt, Artificial Sequence
  CCR4-NOT transcription complex subunit 1 (2246-2254)
gcccacauggacaucuuccagaaccug

SEQ ID NO: 35041 - RNA, 27 nt, Artificial Sequence
  NEDD8 ultimate buster 1 (148-156)
gcccacaacgugaaggccaugguccug

SEQ ID NO: 35042 - RNA, 30 nt, Artificial Sequence
  Peptidyl-prolyl cis-trans isomerase FKBP8 (230-239)
gcccacuaccagcgcgccgacuucgugcug

SEQ ID NO: 35043 - RNA, 27 nt, Artificial Sequence
  Zinc phosphodiesterase ELAC protein 2 (230-238)
gccaucgcccccaucaucgcggccgug

SEQ ID NO: 35044 - RNA, 30 nt, Artificial Sequence
  Sister chromatid cohesion protein PDS5 homolog A (274-283)
gccaucgacccccaccugcuccugagcgug

SEQ ID NO: 35045 - RNA, 27 nt, Artificial Sequence
  RNA-binding motif, single-stranded-interacting protein 2 (87-95)
gccauccuggacaagaccaccaacaag

SEQ ID NO: 35046 - RNA, 27 nt, Artificial Sequence
  S-phase kinase-associated protein 1 (53-61)
gccauccugaagaaggugauccagugg

SEQ ID NO: 35047 - RNA, 27 nt, Artificial Sequence
  Importin-11 (662-670)
gccauccugaccacccucauccaccug

SEQ ID NO: 35048 - RNA, 27 nt, Artificial Sequence
  Probable ATP-dependent RNA helicase DDX5 (466-474)
gccaucaaccccaagcugcuccagcug

SEQ ID NO: 35049 - RNA, 27 nt, Artificial Sequence
  Mitochondrial fission process protein 1 (94-102)
gccauccccggcuucaccaucaaccgc

SEQ ID NO: 35050 - RNA, 33 nt, Artificial Sequence
  Rab GDP dissociation inhibitor beta (163-173)
gccaucuacggcgggaccuacaugcugaacaag

SEQ ID NO: 35051 - RNA, 27 nt, Artificial Sequence
  Protein SHQ1 homolog (400-408)
gcccuggccgaggcgcucaaggaggug

SEQ ID NO: 35052 - RNA, 27 nt, Artificial Sequence
  DNA mismatch repair protein Msh2 (789-797)
gcccuggccaaccagauccccaccgug

SEQ ID NO: 35053 - RNA, 27 nt, Artificial Sequence
  EH domain-containing protein 2 (507-515)
gcccuggccagccaccucaucgaggcg

SEQ ID NO: 35054 - RNA, 27 nt, Artificial Sequence
  Carboxypeptidase Q (122-130)
gcccuggccagccucauccgcuccgug

SEQ ID NO: 35055 - RNA, 27 nt, Artificial Sequence
  (229-237)
gcccuggccagcgugaucaugggccuc

SEQ ID NO: 35056 - RNA, 27 nt, Artificial Sequence
  Fidgetin-like protein 1 (133-141)
gcccuggccagcguggucauccacaag

SEQ ID NO: 35057 - RNA, 27 nt, Artificial Sequence
  Cleavage and polyadenylation specificity factor subunit 1 (195-203)
gcccuggacgagaagcuccugaacauc

SEQ ID NO: 35058 - RNA, 30 nt, Artificial Sequence
  Serine/threonine-protein kinase 10 (901-910)
gcccuggacgagagccacaaccagaaccuc

SEQ ID NO: 35059 - RNA, 30 nt, Artificial Sequence
  Protein phosphatase 1 regulatory subunit 15B (166-175)
gcccuggaccccgccgcgcaggccuuccuc

SEQ ID NO: 35060 - RNA, 33 nt, Artificial Sequence
  Cardiolipin synthase (CMP-forming) (167-177)
gcccuggacccccucgccgacaagauccugauc

SEQ ID NO: 35061 - RNA, 27 nt, Artificial Sequence
  Splicing regulatory glutamine/lysine-rich protein 1 (152-160)
gcccuggaccccaacaucgccacccuc

SEQ ID NO: 35062 - RNA, 27 nt, Artificial Sequence
  ATP-binding cassette sub-family A member 7 (273-281)
gcccuggacagccacccccucucccgc

SEQ ID NO: 35063 - RNA, 27 nt, Artificial Sequence
  Ras-related protein Rab-11A (155-163)
gcccuggacagcaccaacguggaggcc

SEQ ID NO: 35064 - RNA, 27 nt, Artificial Sequence
  AT-rich interactive domain-containing protein 1B (1641-1649)
gcccuggacaccaucaacauccuccug

SEQ ID NO: 35065 - RNA, 30 nt, Artificial Sequence
  SWI/SNF-related matrix-associated actin-dependent regulator of chromatin subfamily A member 5 (920-929)
gcccuggacaccaagaucggccgcuacaag

SEQ ID NO: 35066 - RNA, 27 nt, Artificial Sequence
  Glutamate carboxypeptidase 2 (718-726)
gcccuguucgacaucgagagcaaggug

SEQ ID NO: 35067 - RNA, 33 nt, Artificial Sequence
  Sodium/potassium-transporting ATPase subunit beta-3 (132-142)
gcccuguucgagcagaagggccccguguacguc

SEQ ID NO: 35068 - RNA, 30 nt, Artificial Sequence
  RING finger protein 214 (467-476)
gcccuguuccccgccccgcucgcgcagauc

SEQ ID NO: 35069 - RNA, 27 nt, Artificial Sequence
  Protein disulfide-isomerase A3 (7-15)
gcccuguuccccggcguggcccuccug

SEQ ID NO: 35070 - RNA, 33 nt, Artificial Sequence
  Exportin-2 (684-694)
gcccuguucccccaccuccugcagccggugcug

SEQ ID NO: 35071 - RNA, 27 nt, Artificial Sequence
  Zinc finger BED domain-containing protein 1 (596-604)
gcccuguucccccuccugccgaaggug

SEQ ID NO: 35072 - RNA, 27 nt, Artificial Sequence
  UDP-glucuronosyltransferase 1-10 (322-330)
gcccugggcaagaucccccagaccgug

SEQ ID NO: 35073 - RNA, 30 nt, Artificial Sequence
  Developmentally-regulated GTP-binding protein 2 (66-75)
gcccugaucggcuuccccagcguggggaag

SEQ ID NO: 35074 - RNA, 27 nt, Artificial Sequence
  Transcription factor Maf (116-124)
gcccugaucagcaacucccaccagcuc

SEQ ID NO: 35075 - RNA, 24 nt, Artificial Sequence
  U3 small nucleolar ribonucleoprotein protein IMP3 (78-85)
gcccugcucgacaagcuguacgcc

SEQ ID NO: 35076 - RNA, 27 nt, Artificial Sequence
  microtubule-actin cross-linking factor 1 isoform X2  (1652-1660)
gcccugcucgacugggugaccagcguc

SEQ ID NO: 35077 - RNA, 33 nt, Artificial Sequence
  Coatomer subunit zeta-1 (90-100)
gcccugcucgagaacauggagggccuguuccug

SEQ ID NO: 35078 - RNA, 30 nt, Artificial Sequence
  Serine/threonine-protein kinase 35 (192-201)
gcccugcucgagaaccccaagauggagcug

SEQ ID NO: 35079 - RNA, 27 nt, Artificial Sequence
  GRIP and coiled-coil domain-containing protein 2 (277-285)
gcccugcucgagaccgugaaccgccug

SEQ ID NO: 35080 - RNA, 27 nt, Artificial Sequence
  Progestin and adipoQ receptor family member 4 (146-154)
gcccugcucggcgggcuggugaacguc

SEQ ID NO: 35081 - RNA, 33 nt, Artificial Sequence
  Elongation of very long chain fatty acids protein 5 (14-24)
gcccugcucggcccccgcgacacccgggugaag

SEQ ID NO: 35082 - RNA, 27 nt, Artificial Sequence
  Minor histocompatibility antigen H13 (43-51)
gcccugcuccccaucuucuucggcgcc

SEQ ID NO: 35083 - RNA, 27 nt, Artificial Sequence
  Transcription factor IIIB 90 kDa subunit (582-590)
gcccugcuccccagcuccccgacccug

SEQ ID NO: 35084 - RNA, 27 nt, Artificial Sequence
  TAF6-like RNA polymerase II p300/CBP-associated factor-associated factor 65 kDa subunit 6L (191-199)
gcccugcuccccuacuucguguacguc

SEQ ID NO: 35085 - RNA, 27 nt, Artificial Sequence
  Plectin (403-411)
gcccugcuccagagcgacgugcgccug

SEQ ID NO: 35086 - RNA, 27 nt, Artificial Sequence
  RNA-binding protein Raly (187-195)
gcccugcucagccgccuggagcagauc

SEQ ID NO: 35087 - RNA, 27 nt, Artificial Sequence
  Serine/threonine-protein phosphatase 6 regulatory ankyrin repeat subunit B (148-156)
gcccugaacggccacguggagaugguc

SEQ ID NO: 35088 - RNA, 27 nt, Artificial Sequence
  Ankyrin repeat domain-containing protein 27 (605-613)
gcccugaacagcaagauccucuccgug

SEQ ID NO: 35089 - RNA, 27 nt, Artificial Sequence
  Zinc finger protein 148 (107-115)
gcccugaacgugcccaucagcgucaag

SEQ ID NO: 35090 - RNA, 27 nt, Artificial Sequence
  Putative eukaryotic translation initiation factor 2 subunit 3-like protein (363-371)
gcccugcccgagaucuucaccgagcuc

SEQ ID NO: 35091 - RNA, 27 nt, Artificial Sequence
  La-related protein 1 (131-139)
gcccugcccccggugcucaccaccguc

SEQ ID NO: 35092 - RNA, 27 nt, Artificial Sequence
  Importin subunit alpha-5 (339-347)
gcccugcagagccuccugcaccugcuc

SEQ ID NO: 35093 - RNA, 27 nt, Artificial Sequence
  Nuclear receptor-interacting protein 1 (745-753)
gcccugagcgagcagauccucauggug

SEQ ID NO: 35094 - RNA, 27 nt, Artificial Sequence
  Glutamate-rich WD repeat-containing protein 1 (434-442)
gcccugagcggcuucaccaucuuccgc

SEQ ID NO: 35095 - RNA, 27 nt, Artificial Sequence
  Fidgetin-like protein 1 (268-276)
gcccugagcaaccccauccucaacaag

SEQ ID NO: 35096 - RNA, 27 nt, Artificial Sequence
  TBC domain-containing protein kinase-like protein (116-124)
gcccugagcccccacaacauccuccug

SEQ ID NO: 35097 - RNA, 27 nt, Artificial Sequence
  Enhancer of mRNA-decapping protein 4 (739-747)
gcccugagccaggacauccccgagauc

SEQ ID NO: 35098 - RNA, 27 nt, Artificial Sequence
  Quinone oxidoreductase-like protein 1 (41-49)
gcccugagccagaucaacaccaagcuc

SEQ ID NO: 35099 - RNA, 27 nt, Artificial Sequence
  Prelamin-A/C (147-155)
gcccugagcaccgcccucuccgagaag

SEQ ID NO: 35100 - RNA, 27 nt, Artificial Sequence
  Cyclin-dependent kinase 4 (96-104)
gcccugacccccguggucgugacccuc

SEQ ID NO: 35101 - RNA, 27 nt, Artificial Sequence
  Transcription initiation factor TFIID subunit 2 (948-956)
gcccugguggaccagcucuggaagcug

SEQ ID NO: 35102 - RNA, 27 nt, Artificial Sequence
  Beta-hexosaminidase subunit beta (22-30)
gcccuggugguccagguggccgaggcg

SEQ ID NO: 35103 - RNA, 27 nt, Artificial Sequence
  Nesprin-2 (1646-1654)
gcccugugggacaagcucuucaaccug

SEQ ID NO: 35104 - RNA, 33 nt, Artificial Sequence
  Transmembrane protein 234 (16-26)
gcccuguggggcgggacccagccccuccugaag

SEQ ID NO: 35105 - RNA, 27 nt, Artificial Sequence
  28S ribosomal protein S29, mitochondrial (267-275)
gcccuguggggccgcaccacccucaag

SEQ ID NO: 35106 - RNA, 27 nt, Artificial Sequence
  Lamin-B receptor (434-442)
gcccuguggaacgaggaggcccuccug

SEQ ID NO: 35107 - RNA, 27 nt, Artificial Sequence
  CAS1 domain-containing protein 1 (533-541)
gcccuguggccccagaucauccagaag

SEQ ID NO: 35108 - RNA, 33 nt, Artificial Sequence
  Tetratricopeptide repeat protein 14 (349-359)
gcccuguacgccaccaagggcagccucaacaag

SEQ ID NO: 35109 - RNA, 27 nt, Artificial Sequence
  Ubiquitin carboxyl-terminal hydrolase 4 (552-560)
gcccuguacggccagccccuccugcug

SEQ ID NO: 35110 - RNA, 27 nt, Artificial Sequence
  Tyrosine-protein kinase Fyn (383-391)
gcccuguacggccgcuucaccaucaag

SEQ ID NO: 35111 - RNA, 27 nt, Artificial Sequence
  Putative ATP-dependent RNA helicase DHX57 (1220-1228)
gcccuguaccccaacgugguccaggug

SEQ ID NO: 35112 - RNA, 27 nt, Artificial Sequence
  Nuclear pore complex protein Nup155 (411-419)
gcccuguacagcaagggcauccuccug

SEQ ID NO: 35113 - RNA, 27 nt, Artificial Sequence
  Heterogeneous nuclear ribonucleoprotein A0 (64-72)
gccauggccgcgagcccccacgccgug

SEQ ID NO: 35114 - RNA, 27 nt, Artificial Sequence
  Synemin (1524-1532)
gccauguucgacaagaaggugcagcug

SEQ ID NO: 35115 - RNA, 30 nt, Artificial Sequence
  DNA-dependent protein kinase catalytic subunit (1302-1311)
gccaugcacgacaucaucgccgcggagaag

SEQ ID NO: 35116 - RNA, 27 nt, Artificial Sequence
  Methionine synthase (186-194)
gccaugcacggcguguuccuguaccac

SEQ ID NO: 35117 - RNA, 27 nt, Artificial Sequence
  Transformation/transcription domain-associated protein (2516-2524)
gccaugcugcccagcaucaccaacgug

SEQ ID NO: 35118 - RNA, 27 nt, Artificial Sequence
  Heterogeneous nuclear ribonucleoprotein A1 (71-79)
gccaugaacgcccgcccccacaaggug

SEQ ID NO: 35119 - RNA, 30 nt, Artificial Sequence
  Double-strand-break repair protein rad21 homolog (467-476)
gccaugcccccgccccccccccagggcgug

SEQ ID NO: 35120 - RNA, 33 nt, Artificial Sequence
  Biogenesis of lysosome-related organelles complex 1 subunit 3 (99-109)
gcccccgccccggcgcccgcccgcagccugcuc

SEQ ID NO: 35121 - RNA, 27 nt, Artificial Sequence
  Solute carrier family 23 member 2 (174-182)
gcccccgcccgcgcgauccugagccuc

SEQ ID NO: 35122 - RNA, 27 nt, Artificial Sequence
  ATP-binding cassette sub-family F member 3 (303-311)
gcccccgcccgcgcgagcgugauccug

SEQ ID NO: 35123 - RNA, 27 nt, Artificial Sequence
  Syndecan-4 (2-10)
gcccccgcccgccuguucgcgcuccug

SEQ ID NO: 35124 - RNA, 30 nt, Artificial Sequence
  Ankyrin repeat domain-containing protein 11 (1778-1787)
gcccccgcccgcccgcugagcaccaaccuc

SEQ ID NO: 35125 - RNA, 27 nt, Artificial Sequence
  Solute carrier family 22 member 18 (145-153)
gcccccgaggagcgcccggccgcgcug

SEQ ID NO: 35126 - RNA, 27 nt, Artificial Sequence
  Zinc fingers and homeoboxes protein 2 (415-423)
gcccccgagccgaagcgcccccacauc

SEQ ID NO: 35127 - RNA, 30 nt, Artificial Sequence
  Hepatoma-derived growth factor (231-240)
gcccccggcauccgcgaccacgagagccug

SEQ ID NO: 35128 - RNA, 30 nt, Artificial Sequence
  Heterogeneous nuclear ribonucleoprotein M (460-469)
gcccccaucgaccgcgugggccagaccauc

SEQ ID NO: 35129 - RNA, 30 nt, Artificial Sequence
  Gamma-interferon-inducible protein 16 (685-694)
gcccccaagagcggcaacaccggggagcug

SEQ ID NO: 35130 - RNA, 30 nt, Artificial Sequence
  Cancer/testis antigen 2 (114-123)
gccccccugccgcgccccggcgccgugcuc

SEQ ID NO: 35131 - RNA, 24 nt, Artificial Sequence
  Talin-1 (1328-1335)
gcccccaaccugaagagccagcuc

SEQ ID NO: 35132 - RNA, 30 nt, Artificial Sequence
  REST corepressor 1 (61-70)
gcccccaacaacggccagaacaagagccug

SEQ ID NO: 35133 - RNA, 27 nt, Artificial Sequence
  Histone deacetylase 6 (706-714)
gccccccagccggccaagccccgccug

SEQ ID NO: 35134 - RNA, 27 nt, Artificial Sequence
  BAG family molecular chaperone regulator 3 (130-138)
gccccccagcgcagccaguccccgcug

SEQ ID NO: 35135 - RNA, 27 nt, Artificial Sequence
  Conserved oligomeric Golgi complex subunit 7 (287-295)
gccccccgcgccgcgcugacccggcuc

SEQ ID NO: 35136 - RNA, 33 nt, Artificial Sequence
  Protein PRRC2B (1519-1529)
gccccccgcgccggcgagcagggggaggcgaug

SEQ ID NO: 35137 - RNA, 33 nt, Artificial Sequence
  Striatin-4 (219-229)
gccccccgcgccccgcccggccccgcggggcug

SEQ ID NO: 35138 - RNA, 33 nt, Artificial Sequence
  Tricarboxylate transport protein, mitochondrial (3-13)
gccccccgcgccccgcgggcgcuggccgccgcc

SEQ ID NO: 35139 - RNA, 27 nt, Artificial Sequence
  Actin, gamma-enteric smooth muscle (27-35)
gccccccgcgccguguucccgagcauc

SEQ ID NO: 35140 - RNA, 27 nt, Artificial Sequence
  General transcription factor IIF subunit 2 (77-85)
gccccccgcgagcacccguucgugcug

SEQ ID NO: 35141 - RNA, 33 nt, Artificial Sequence
  Proteasome subunit beta type-8 (9-19)
gccccccgcggccagcggccggagagcgcccug

SEQ ID NO: 35142 - RNA, 30 nt, Artificial Sequence
  40S ribosomal protein S2 (198-207)
gccccccgcggcaccgggaucgugagcgcc

SEQ ID NO: 35143 - RNA, 30 nt, Artificial Sequence
  General transcription factor 3C polypeptide 2 (702-711)
gccccccgcaagggcaccguguggagccug

SEQ ID NO: 35144 - RNA, 27 nt, Artificial Sequence
  Coiled-coil domain-containing protein 12 (108-116)
gccccccgcaagccggacugggaccug

SEQ ID NO: 35145 - RNA, 27 nt, Artificial Sequence
  RNA demethylase ALKBH5 (289-297)
gccccccgccuggagaccaagagccuc

SEQ ID NO: 35146 - RNA, 33 nt, Artificial Sequence
  Phosphatidylinositide phosphatase SAC2 (898-908)
gccccccgccugggcagccggucccagagccuc

SEQ ID NO: 35147 - RNA, 27 nt, Artificial Sequence
  Structural maintenance of chromosomes protein 4 (79-87)
gccccccgccugaugaucacccacauc

SEQ ID NO: 35148 - RNA, 27 nt, Artificial Sequence
  IST1 homolog (107-115)
gccccccgccugcagagcgagguggcc

SEQ ID NO: 35149 - RNA, 33 nt, Artificial Sequence
  IST1 homolog (107-117)
gccccccgccugcagagcgagguggccgagcuc

SEQ ID NO: 35150 - RNA, 36 nt, Artificial Sequence
  60S ribosomal protein L13 (47-58)
gccccccgcccggccagcggccccauccggcccauc

SEQ ID NO: 35151 - RNA, 33 nt, Artificial Sequence
  Cold shock domain-containing protein E1 (762-772)
gccccccgcccggaccggcuggugaaccgccuc

SEQ ID NO: 35152 - RNA, 33 nt, Artificial Sequence
  tRNA-splicing endonuclease subunit Sen34 (71-81)
gccccccgcccggacagccggcaccacucccug

SEQ ID NO: 35153 - RNA, 27 nt, Artificial Sequence
  WAS/WASL-interacting protein family member 2 (122-130)
gccccccgcccgcccgugagcgccgcg

SEQ ID NO: 35154 - RNA, 27 nt, Artificial Sequence
  Rab GTPase-activating protein 1 (88-96)
gccccccgcagcgagguggaggcccug

SEQ ID NO: 35155 - RNA, 33 nt, Artificial Sequence
  HLA class II histocompatibility antigen, DP beta 1 chain (9-19)
gccccccgcaccguggcccugaccgcgcuccug

SEQ ID NO: 35156 - RNA, 33 nt, Artificial Sequence
  Protocadherin gamma-C3 (257-267)
gcccccagcggcacccgcgugguccaggugcug

SEQ ID NO: 35157 - RNA, 30 nt, Artificial Sequence
  Rho GTPase-activating protein 7 (785-794)
gcccccagccuguuccaccucaacacccug

SEQ ID NO: 35158 - RNA, 33 nt, Artificial Sequence
  Round spermatid basic protein 1-like protein (94-104)
gcccccagcccguccagcucccgcagcuccuuc

SEQ ID NO: 35159 - RNA, 27 nt, Artificial Sequence
  intercellular adhesion molecule-1
gcccccagcuccccgcgccccgcccug

SEQ ID NO: 35160 - RNA, 30 nt, Artificial Sequence
  intercellular adhesion molecule-1 (2-11)
gcccccagcuccccgcgccccgcccugccc

SEQ ID NO: 35161 - RNA, 24 nt, Artificial Sequence
  Unconventional myosin-Ic (176-183)
gcccccgugggcgggcacauccug

SEQ ID NO: 35162 - RNA, 27 nt, Artificial Sequence
  Alpha-mannosidase 2C1 (660-668)
gcccccgugccgccccccaccagccug

SEQ ID NO: 35163 - RNA, 27 nt, Artificial Sequence
  Transcription factor p65 (247-255)
gcccccgugcgcgucagcaugcagcug

SEQ ID NO: 35164 - RNA, 27 nt, Artificial Sequence
  Serine protease 23 (107-115)
gcccccuggaagccgaccuggcccgcc

SEQ ID NO: 35165 - RNA, 27 nt, Artificial Sequence
  Splicing factor, arginine/serine-rich 15 (410-418)
gcccagaacgagccccugacccagaag

SEQ ID NO: 35166 - RNA, 30 nt, Artificial Sequence
  GTP-binding nuclear protein Ran (215-224)
gcccaguacgagcacgaccuggagguggcc

SEQ ID NO: 35167 - RNA, 27 nt, Artificial Sequence
  Neuropathy target esterase (279-287)
gcccgcgacagcaccgugcugcggcuc

SEQ ID NO: 35168 - RNA, 27 nt, Artificial Sequence
  Tubulin epsilon chain (273-281)
gcccgcuucgagggcagccugaacaug

SEQ ID NO: 35169 - RNA, 27 nt, Artificial Sequence
  Splicing factor 3A subunit 1 (306-314)
gcccgcauccugauccaggagcgguac

SEQ ID NO: 35170 - RNA, 27 nt, Artificial Sequence
  Dedicator of cytokinesis protein 7 (251-259)
gcccgcgugaagaugcaggucaccaug

SEQ ID NO: 35171 - RNA, 27 nt, Artificial Sequence
  MICOS complex subunit MIC13 (3-11)
gcccgcguguggagccugaugcgguuc

SEQ ID NO: 35172 - RNA, 27 nt, Artificial Sequence
  Endonuclease domain-containing 1 protein (4-12)
gcccgcuggcuggcccucggcagccug

SEQ ID NO: 35173 - RNA, 27 nt, Artificial Sequence
  Sodium-dependent phosphate transport protein 4 (18-26)
gcccgcuacggcaucgcccuggugcuc

SEQ ID NO: 35174 - RNA, 33 nt, Artificial Sequence
  Deubiquitinating protein VCIP135 (28-38)
gccagcgccgcggccuccggcgggcugcucaag

SEQ ID NO: 35175 - RNA, 27 nt, Artificial Sequence
  Kinase D-interacting substrate of 220 kDa (763-771)
gccagcgacccccacaucaucaucaag

SEQ ID NO: 35176 - RNA, 30 nt, Artificial Sequence
  Multivesicular body subunit 12A (40-49)
gccagcuucggcaaguccuucgcccagaag

SEQ ID NO: 35177 - RNA, 33 nt, Artificial Sequence
  Myosin-9 (366-376)
gccagcaugcccgacaacaccgccgcgcagaag

SEQ ID NO: 35178 - RNA, 27 nt, Artificial Sequence
  Pro-interleukin-16 (1150-1158)
gccagccaggagggcaccauccagaag

SEQ ID NO: 35179 - RNA, 27 nt, Artificial Sequence
  Cullin-4B (91-99)
gccagcucccacgugcccauccagaag

SEQ ID NO: 35180 - RNA, 33 nt, Artificial Sequence
  Vimentin (54-64)
gccagcucccccggcgggguguacgccacccgc

SEQ ID NO: 35181 - RNA, 27 nt, Artificial Sequence
  Heterogeneous nuclear ribonucleoprotein D-like (81-89)
gccagcguggacaagguccuggagcuc

SEQ ID NO: 35182 - RNA, 27 nt, Artificial Sequence
  Gamma-adducin (236-244)
gccaccgccgcggugagcuccaugaag

SEQ ID NO: 35183 - RNA, 30 nt, Artificial Sequence
  Clathrin heavy chain 1 (311-320)
gccaccgccggcaucaucggggugaaccgc

SEQ ID NO: 35184 - RNA, 27 nt, Artificial Sequence
  WD repeat-containing protein 44 (93-101)
gccaccgccagccccaucguggcgcgc

SEQ ID NO: 35185 - RNA, 27 nt, Artificial Sequence
  Nucleotide exchange factor SIL1 (214-222)
gccaccgagcagccccugaccgccaag

SEQ ID NO: 35186 - RNA, 27 nt, Artificial Sequence
  Ankyrin repeat and KH domain-containing protein 1 (1541-1549)
gccaccuucaccaacguguucggcaag

SEQ ID NO: 35187 - RNA, 30 nt, Artificial Sequence
  Protein artemis (555-564)
gccaccggcgagagcaucgccgugaagaag

SEQ ID NO: 35188 - RNA, 30 nt, Artificial Sequence
  Guanine nucleotide-binding protein G(I)/G(S)/G(T) subunit beta-1 (228-237)
gccaccggcagcugggacuccuuccugaag

SEQ ID NO: 35189 - RNA, 27 nt, Artificial Sequence
  Serine/threonine-protein kinase mTOR (800-808)
gccaccaucggcgagcuggcccaggug

SEQ ID NO: 35190 - RNA, 33 nt, Artificial Sequence
  Interferon regulatory factor 2-binding protein-like (88-98)
gccaccauccuggccggcgacgugaaggucaag

SEQ ID NO: 35191 - RNA, 27 nt, Artificial Sequence
  Protein FAM76B (209-217)
gccaccauccagaacgagacccccaag

SEQ ID NO: 35192 - RNA, 33 nt, Artificial Sequence
  Paired amphipathic helix protein Sin3a (628-638)
gccaccauccgcgugcuggaggccauccagaag

SEQ ID NO: 35193 - RNA, 36 nt, Artificial Sequence
  T-complex protein 1 subunit eta (44-55)
gccaccaucagcaacgacggcgccaccauccugaag

SEQ ID NO: 35194 - RNA, 27 nt, Artificial Sequence
  Hexokinase-1 (356-364)
gccacccugggcgccauccucaaccgc

SEQ ID NO: 35195 - RNA, 27 nt, Artificial Sequence
  Nuclear mitotic apparatus protein 1 (150-158)
gccacccugcaggaggcccucgcgcac

SEQ ID NO: 35196 - RNA, 27 nt, Artificial Sequence
  Cytoplasmic dynein 1 heavy chain 1 (3080-3088)
gccaccagccccgcccuguucaaccgc

SEQ ID NO: 35197 - RNA, 30 nt, Artificial Sequence
  Isoaspartyl peptidase/L-asparaginase (183-192)
gccaccagcaccggcgggaucgugaacaag

SEQ ID NO: 35198 - RNA, 27 nt, Artificial Sequence
  Ankyrin repeat domain-containing protein 17 (653-661)
gccaccacccugcccauccgcaacaag

SEQ ID NO: 35199 - RNA, 33 nt, Artificial Sequence
  Alsin (409-419)
gccaccuacgaggccggcgcgcugagccucaag

SEQ ID NO: 35200 - RNA, 30 nt, Artificial Sequence
  Chromobox protein homolog 2 (418-427)
gccguggcccccccgacccccgcgagcaag

SEQ ID NO: 35201 - RNA, 36 nt, Artificial Sequence
  Guanine nucleotide-binding protein G(I)/G(S)/G(T) subunit beta-2 (326-337)
gccguggccaccggcagcugggacuccuuccugaag

SEQ ID NO: 35202 - RNA, 30 nt, Artificial Sequence
  Cilia- and flagella-associated protein 97 (505-514)
gccguggaccccagcuccggccacccgcgc

SEQ ID NO: 35203 - RNA, 36 nt, Artificial Sequence
  Heme-binding protein 1 (85-96)
gccguguuccccaacgaggacggcagccugcagaag

SEQ ID NO: 35204 - RNA, 27 nt, Artificial Sequence
  SCY1-like protein 2 (22-30)
gccgugaugggcaaccccgucacccgc

SEQ ID NO: 35205 - RNA, 27 nt, Artificial Sequence
  PH domain leucine-rich repeat-containing protein phosphatase 1 (285-293)
gccgugcgcaacguccccgacgcccug

SEQ ID NO: 35206 - RNA, 33 nt, Artificial Sequence
  Histone H2B type 1-A (112-122)
gccgugagcgagggcaccaaggccgucaccaag

SEQ ID NO: 35207 - RNA, 27 nt, Artificial Sequence
  E3 ubiquitin-protein ligase RNF123 (619-627)
gccgugaccggcauccugguccagcuc

SEQ ID NO: 35208 - RNA, 27 nt, Artificial Sequence
  Transcription termination factor 1 (809-817)
gccguguacguccccuucuggcagaag

SEQ ID NO: 35209 - RNA, 27 nt, Artificial Sequence
  Tyrosine-protein kinase Fyn (324-332)
gccuacaucgagcgcaugaacuacauc

SEQ ID NO: 35210 - RNA, 27 nt, Artificial Sequence
  COP9 signalosome complex subunit 4 (165-173)
gccuacaucaaccgcgccagccugcuc

SEQ ID NO: 35211 - RNA, 27 nt, Artificial Sequence
  UDP-N-acetylglucosamine-peptide N-acetylglucosaminyltransferase 110 kDa subunit (697-705)
gccuacaugccccacaccuucuucauc

SEQ ID NO: 35212 - RNA, 27 nt, Artificial Sequence
  Translocating chain-associated membrane protein 1 (155-163)
gccuacccccacaaccugaugaccuuc

SEQ ID NO: 35213 - RNA, 27 nt, Artificial Sequence
  Dihydropyrimidine dehydrogenase (NADP(+)) (185-193)
gccuacagcgccaagaucgcgcuguuc

SEQ ID NO: 35214 - RNA, 27 nt, Artificial Sequence
  Double-stranded RNA-binding protein Staufen homolog 1 (70-78)
gacgccgccgcgaaggcccugcgcauc

SEQ ID NO: 35215 - RNA, 24 nt, Artificial Sequence
  Minor histocompatibility antigen H13 (74-81)
gacgccgcccgcuuccccaucauc

SEQ ID NO: 35216 - RNA, 27 nt, Artificial Sequence
  Conserved oligomeric Golgi complex subunit 2 (338-346)
gacgccuuccacgagaaguacaccauc

SEQ ID NO: 35217 - RNA, 24 nt, Artificial Sequence
  AP-2 complex subunit mu (30-37)
gacgccuuccgcgugaacgucauc

SEQ ID NO: 35218 - RNA, 27 nt, Artificial Sequence
  UDP-N-acetylglucosamine-peptide N-acetylglucosaminyltransferase 110 kDa subunit (430-438)
gacgcccacagcaaccuggccuccauc

SEQ ID NO: 35219 - RNA, 24 nt, Artificial Sequence
  Neurobeachin-like protein 2 (378-385)
gacgccaucgccgugcacgucgug

SEQ ID NO: 35220 - RNA, 27 nt, Artificial Sequence
  Rho-associated protein kinase 2 (203-211)
gacgccauccacagcaugggccugauc

SEQ ID NO: 35221 - RNA, 27 nt, Artificial Sequence
  Ubiquitin carboxyl-terminal hydrolase 22 (496-504)
gacgccaucaucaccaaggccagcauc

SEQ ID NO: 35222 - RNA, 27 nt, Artificial Sequence
  NF-kappa-B essential modulator (63-71)
gacgccauccgccagagcaaccagauc

SEQ ID NO: 35223 - RNA, 24 nt, Artificial Sequence
  Uncharacterized protein C1orf43 (108-115)
gacgccauccgcaccagcgagauc

SEQ ID NO: 35224 - RNA, 27 nt, Artificial Sequence
  Enhancer of filamentation 1 (541-549)
gacgccaagcagcugaccaccacgauc

SEQ ID NO: 35225 - RNA, 27 nt, Artificial Sequence
  Endoplasmin (89-97)
gacgcccuggacaagauccgccucauc

SEQ ID NO: 35226 - RNA, 27 nt, Artificial Sequence
  60S ribosomal protein L23a (145-153)
gacgcccuggacguggccaacaagauc

SEQ ID NO: 35227 - RNA, 27 nt, Artificial Sequence
  Peroxisome proliferator activated receptor interacting complex protein (2369-2377)
gacgcccugggcaagcucaucagcauc

SEQ ID NO: 35228 - RNA, 24 nt, Artificial Sequence
  S-adenosylmethionine synthase isoform type-2 (220-227)
gacgcccugaaggagaaggugauc

SEQ ID NO: 35229 - RNA, 27 nt, Artificial Sequence
  Microtubule-actin cross-linking factor 1, isoforms 1/2/3/5 (533-541)
gacgcccugaaggugaucaacaagguc

SEQ ID NO: 35230 - RNA, 27 nt, Artificial Sequence
  Bax inhibitor 1 (57-65)
gacgcccugcucaaguucagccacauc

SEQ ID NO: 35231 - RNA, 27 nt, Artificial Sequence
  Spectrin beta chain, non-erythrocytic 1 (949-957)
gacgcccugcucagcgcccuguccauc

SEQ ID NO: 35232 - RNA, 24 nt, Artificial Sequence
  Protein FAM179B (198-205)
gacgcccugcagauccuccacauc

SEQ ID NO: 35233 - RNA, 24 nt, Artificial Sequence
  Isoleucine-tRNA ligase, cytoplasmic (621-628)
gacgcccugcgccucuaccugauc

SEQ ID NO: 35234 - RNA, 27 nt, Artificial Sequence
  Programmed cell death protein 4 (72-80)
gacgcccugcgcagcggccucaccgug

SEQ ID NO: 35235 - RNA, 27 nt, Artificial Sequence
  Methionine-tRNA ligase, cytoplasmic (281-289)
gacgcccugcgcagcauccucaccauc

SEQ ID NO: 35236 - RNA, 27 nt, Artificial Sequence
  ATP synthase subunit alpha, mitochondrial (164-172)
gacgccaugaaguacaccaucgugguc

SEQ ID NO: 35237 - RNA, 27 nt, Artificial Sequence
  Plectin (246-254)
gacgccaugccccgcgugccggacguc

SEQ ID NO: 35238 - RNA, 24 nt, Artificial Sequence
  Cyclic AMP-responsive element-binding protein 1 (144-151)
gacgcccccggcgugccgcgcauc

SEQ ID NO: 35239 - RNA, 27 nt, Artificial Sequence
  Putative Polycomb group protein ASXL1 (26-34)
gacgcccccaugaccccgaagcagauc

SEQ ID NO: 35240 - RNA, 27 nt, Artificial Sequence
  NEDD4 family-interacting protein 1 (37-45)
gacgcccccccgcccuacagcuccauc

SEQ ID NO: 35241 - RNA, 24 nt, Artificial Sequence
  E3 ubiquitin-protein ligase MGRN1 (127-134)
gacgcccgcguggccaucaccauc

SEQ ID NO: 35242 - RNA, 27 nt, Artificial Sequence
  HLA class I histocompatibility antigen, A-1 alpha chain (115-123)
gacgccuacgacggcaaggacuacauc

SEQ ID NO: 35243 - RNA, 24 nt, Artificial Sequence
  Probable ATP-dependent RNA helicase DDX49 (232-239)
gacgccuaccuggugcaccucauc

SEQ ID NO: 35244 - RNA, 27 nt, Artificial Sequence
  Endothelin-converting enzyme 1 (30-38)
gacgccuaccccaacggccugcaggug

SEQ ID NO: 35245 - RNA, 27 nt, Artificial Sequence
  Cohesin subunit SA-2 (683-691)
gacgccuaccaggugcugagcacccuc

SEQ ID NO: 35246 - RNA, 27 nt, Artificial Sequence
  Torsin-1A-interacting protein 1 (432-440)
gacgccuacagcuccuuccgcagcgug

SEQ ID NO: 35247 - RNA, 27 nt, Artificial Sequence
  ATP-binding cassette sub-family E member 1 (434-442)
gacgccuacacccacccccaguucgug

SEQ ID NO: 35248 - RNA, 27 nt, Artificial Sequence
  Talin-1 (1943-1951)
gacgccuacaccaagaaggagcugauc

SEQ ID NO: 35249 - RNA, 27 nt, Artificial Sequence
  Gelsolin (93-101)
gacgccuacgugauccugaagaccguc

SEQ ID NO: 35250 - RNA, 24 nt, Artificial Sequence
  40S ribosomal protein S26 (60-67)
gacgccuacgugcugcccaagcuc

SEQ ID NO: 35251 - RNA, 27 nt, Artificial Sequence
  40S ribosomal protein S26 (60-68)
gacgccuacgugcugcccaagcucuac

SEQ ID NO: 35252 - RNA, 27 nt, Artificial Sequence
  Intraflagellar transport protein 25 homolog (124-132)
gaccacuucgccagcgugcacuccguc

SEQ ID NO: 35253 - RNA, 27 nt, Artificial Sequence
  Vacuolar protein sorting-associated protein 13A (1926-1934)
gaccacuucaacgccaugaccagccug

SEQ ID NO: 35254 - RNA, 27 nt, Artificial Sequence
  Cytoplasmic FMR1-interacting protein 2 (355-363)
gaccacauccgcuucaucagcgagcug

SEQ ID NO: 35255 - RNA, 27 nt, Artificial Sequence
  Protein zer-1 homolog (237-245)
gaccacauccgcgugaucguccagcug

SEQ ID NO: 35256 - RNA, 27 nt, Artificial Sequence
  Cytoplasmic FMR1-interacting protein 1 (355-363)
gaccacaugcgcuucaucagcgagcug

SEQ ID NO: 35257 - RNA, 30 nt, Artificial Sequence
  60S ribosomal protein L9 (11-20)
gacauccccgagaacguggacaucacccug

SEQ ID NO: 35258 - RNA, 27 nt, Artificial Sequence
  5'-3' exoribonuclease 1 (835-843)
gacauccgcgccuucgacagccgguuc

SEQ ID NO: 35259 - RNA, 30 nt, Artificial Sequence
  MAX gene-associated protein (126-135)
gacaucagccccguggacaaccaccgcuac

SEQ ID NO: 35260 - RNA, 30 nt, Artificial Sequence
  Protein MAK16 homolog (177-186)
gacaucuacaacuuccccauccacgccuuc

SEQ ID NO: 35261 - RNA, 27 nt, Artificial Sequence
  DNA-directed RNA polymerases I, II, and III subunit RPABC5 (54-62)
gaccugaucgagaagcuccugaacuac

SEQ ID NO: 35262 - RNA, 27 nt, Artificial Sequence
  TAR DNA-binding protein 43 (128-136)
gaccugaucaucaagggcaucagcgug

SEQ ID NO: 35263 - RNA, 27 nt, Artificial Sequence
  Arf-GAP with Rho-GAP domain, ANK repeat and PH domain-containing protein 3 (271-279)
gaccugaucagccccuacgccuccuuc

SEQ ID NO: 35264 - RNA, 27 nt, Artificial Sequence
  V-type proton ATPase subunit C 1 (62-70)
gaccuggugaccuacaucacccgcuuc

SEQ ID NO: 35265 - RNA, 27 nt, Artificial Sequence
  Lysine-specific demethylase 5B (44-52)
gaccccuucgccuucauccacaagauc

SEQ ID NO: 35266 - RNA, 27 nt, Artificial Sequence
  116 kDa U5 small nuclear ribonucleoprotein component (910-918)
gacccccuggacaagagcaucgugauc

SEQ ID NO: 35267 - RNA, 27 nt, Artificial Sequence
  Signal recognition particle 9 kDa protein (21-29)
gaccccaugaaggcccgcgugguccug

SEQ ID NO: 35268 - RNA, 27 nt, Artificial Sequence
  Probable 28S rRNA (cytosine-C(5))-methyltransferase (223-231)
gaccccccgcccggcagccacgugauc

SEQ ID NO: 35269 - RNA, 27 nt, Artificial Sequence
  Protein BTG2 (105-113)
gaccccuacgaggugagcuaccgcauc

SEQ ID NO: 35270 - RNA, 27 nt, Artificial Sequence
  Small integral membrane protein 15 (18-26)
gaccccuacggcuuccugaccaccgug

SEQ ID NO: 35271 - RNA, 27 nt, Artificial Sequence
  Serine/threonine-protein kinase mTOR (895-903)
gaccccuacaagcacaaggugaacauc

SEQ ID NO: 35272 - RNA, 24 nt, Artificial Sequence
  Serine/threonine-protein kinase tousled-like 2 (715-722)
gaccccuaccugcucccgcacauc

SEQ ID NO: 35273 - RNA, 24 nt, Artificial Sequence
  AP-3 complex subunit delta-1 isoform 3 (706-713)
gaccccuaccgcgcccuggacauc

SEQ ID NO: 35274 - RNA, 24 nt, Artificial Sequence
  DnaJ homolog subfamily C member 16 (29-36)
gaccccuaccgcgugcugggcguc

SEQ ID NO: 35275 - RNA, 30 nt, Artificial Sequence
  CSC1-like protein 1 (174-183)
gaccccuacagcuucggccgcaccaccauc

SEQ ID NO: 35276 - RNA, 27 nt, Artificial Sequence
  Nuclear pore membraneoprotein 210 (430-438)
gaccaggacggcggggugcacauccug

SEQ ID NO: 35277 - RNA, 27 nt, Artificial Sequence
  Ubiquitin carboxyl-terminal hydrolase 7 (365-373)
gaccgcuucgaguuccccgagcagcug

SEQ ID NO: 35278 - RNA, 30 nt, Artificial Sequence
  39S ribosomal protein L38, mitochondrial (371-380)
gacagccacgagcccaccuacggcaucuac

SEQ ID NO: 35279 - RNA, 30 nt, Artificial Sequence
  Golgin subfamily A member 2 (517-526)
gacaccaucggcgaguacaucgcccuguac

SEQ ID NO: 35280 - RNA, 30 nt, Artificial Sequence
  N-alpha-acetyltransferase 25, NatB auxiliary subunit (540-549)
gacaccaucggcuaccugcucacccgcuac

SEQ ID NO: 35281 - RNA, 27 nt, Artificial Sequence
  E3 ubiquitin-protein ligase RNF213 (545-553)
gacaccaucaaccugaacagcuucuuc

SEQ ID NO: 35282 - RNA, 27 nt, Artificial Sequence
  Gamma-interferon-inducible protein 16 (447-455)
gacaccaucagcaagaugaacgacuuc

SEQ ID NO: 35283 - RNA, 27 nt, Artificial Sequence
  ADP-ribosylation factor-like protein 2 (42-50)
gacaccaucagccccacccugggcuuc

SEQ ID NO: 35284 - RNA, 27 nt, Artificial Sequence
  Protein Asterix (74-82)
gacaccaagcagaugaugagcuccuuc

SEQ ID NO: 35285 - RNA, 27 nt, Artificial Sequence
  Long-chain-fatty-acid-CoA ligase 3 (86-94)
gacacccuggacaagguguucaccuac

SEQ ID NO: 35286 - RNA, 33 nt, Artificial Sequence
  Heterogeneous nuclear ribonucleoprotein A3 (178-188)
gacaccguggacaagaucgucgugcagaaguac

SEQ ID NO: 35287 - RNA, 27 nt, Artificial Sequence
  Protein SDE2 homolog (60-68)
gacaccgugcagcacggcgccgucuac

SEQ ID NO: 35288 - RNA, 33 nt, Artificial Sequence
  Heterogeneous nuclear ribonucleoprotein A0 (108-118)
gacguggccgagggcgaccugaucgagcacuuc

SEQ ID NO: 35289 - RNA, 33 nt, Artificial Sequence
  Small ubiquitin-related modifier 2 isoform b precursor (61-71)
gacguguuccagcagcagaccggcggggucuac

SEQ ID NO: 35290 - RNA, 30 nt, Artificial Sequence
  Dapper homolog 1 (245-254)
gacgugaucgccgacgucaaccccaaguac

SEQ ID NO: 35291 - RNA, 33 nt, Artificial Sequence
  Transmembrane protein 64 (301-311)
gacgugaucgccgagcagagcgucuccggcuac

SEQ ID NO: 35292 - RNA, 30 nt, Artificial Sequence
  60S acidic ribosomal protein P2 (53-62)
gacgugaucgcccagggcaucgggaagcug

SEQ ID NO: 35293 - RNA, 27 nt, Artificial Sequence
  Transcription factor EB (253-261)
gacgugaucgacaacaucaugcgccug

SEQ ID NO: 35294 - RNA, 27 nt, Artificial Sequence
  Nipped-B-like protein (1331-1339)
gacgugaucgagcgcgucauccaguac

SEQ ID NO: 35295 - RNA, 27 nt, Artificial Sequence
  Magnesium transporter NIPA2 (278-286)
gacgugaucggcacccugagcggguuc

SEQ ID NO: 35296 - RNA, 27 nt, Artificial Sequence
  DnaJ homolog subfamily C member 8 (26-34)
gacgugauccaggccggcaaggaguac

SEQ ID NO: 35297 - RNA, 27 nt, Artificial Sequence
  Mitochondrial import receptor subunit TOM5 homolog (23-31)
gacgugaucagcuccauccgcaacuuc

SEQ ID NO: 35298 - RNA, 27 nt, Artificial Sequence
  Membrane-bound transcription factor site-2 protease (264-272)
gacgugaaggaccugaucggcuucuuc

SEQ ID NO: 35299 - RNA, 27 nt, Artificial Sequence
  E3 ubiquitin-protein ligase RNF213 (4145-4153)
gacgugaaggacuacauccaggaguac

SEQ ID NO: 35300 - RNA, 33 nt, Artificial Sequence
  Pre-mRNA-processing-splicing factor 8 (1650-1660)
gacgugauggacagcaccaccacgcagaaguac

SEQ ID NO: 35301 - RNA, 27 nt, Artificial Sequence
  Coiled-coil domain-containing protein 134 (67-75)
gacgugaugcugaagggccucuucaag

SEQ ID NO: 35302 - RNA, 30 nt, Artificial Sequence
  Dipeptidyl peptidase 9 (772-781)
gacgugcccgagaacaaccagcacggcuac

SEQ ID NO: 35303 - RNA, 27 nt, Artificial Sequence
  Vimentin (271-279)
gacgugcgccagcaguacgagagcguc

SEQ ID NO: 35304 - RNA, 27 nt, Artificial Sequence
  Src substrate cortactin (289-297)
gacgugacccaggucagcuccgccuac

SEQ ID NO: 35305 - RNA, 27 nt, Artificial Sequence
  Kynurenine 3-monooxygenase (252-260)
gacguggucgacuucuuccagaaguac

SEQ ID NO: 35306 - RNA, 33 nt, Artificial Sequence
  Vigilin (521-531)
gacguggucgacagcgaggcccugcagguguac

SEQ ID NO: 35307 - RNA, 27 nt, Artificial Sequence
  Clathrin heavy chain 1 (271-279)
gacguggucuuccugaucaccaaguac

SEQ ID NO: 35308 - RNA, 27 nt, Artificial Sequence
  Peptidyl-prolyl cis-trans isomerase F, mitochondrial (179-187)
gacguggucaagaagaucgagagcuuc

SEQ ID NO: 35309 - RNA, 27 nt, Artificial Sequence
  GH3 domain-containing protein (366-374)
gacgugguccgcguggugggcgccuac

SEQ ID NO: 35310 - RNA, 30 nt, Artificial Sequence
  MAP kinase-activated protein kinase 2 (122-131)
gacguguacgagaaccuguacgccggccgc

SEQ ID NO: 35311 - RNA, 30 nt, Artificial Sequence
  AF4/FMR2 family member 1 (32-41)
gaggccuuccccgagaagaucccgcuguuc

SEQ ID NO: 35312 - RNA, 27 nt, Artificial Sequence
  Protein SHQ1 homolog (207-215)
gaggccaucgagcagauccugaaguac

SEQ ID NO: 35313 - RNA, 27 nt, Artificial Sequence
  Condensin complex subunit 1 (636-644)
gaggccaucggcaucaucagcaagaug

SEQ ID NO: 35314 - RNA, 27 nt, Artificial Sequence
  Protein transport protein Sec16A (1405-1413)
gaggccauccagcgcaccgaggccuac

SEQ ID NO: 35315 - RNA, 27 nt, Artificial Sequence
  Trafficking protein particle complex subunit 9 (320-328)
gaggccaucagcuacuacuccaaguac

SEQ ID NO: 35316 - RNA, 24 nt, Artificial Sequence
  Heat shock cognate 71 kDa protein (88-95)
gaggccuaccugggcaagaccgug

SEQ ID NO: 35317 - RNA, 27 nt, Artificial Sequence
  Calcineurin B homologous protein 1 (15-23)
gaggagaucaagaaggagaccggcuuc

SEQ ID NO: 35318 - RNA, 27 nt, Artificial Sequence
  Protein diaphanous homolog 1 (941-949)
gaggagcugcgcaagagcgaguccuuc

SEQ ID NO: 35319 - RNA, 27 nt, Artificial Sequence
  Plectin (1635-1643)
gaggagguggcccagcagaagagccug

SEQ ID NO: 35320 - RNA, 27 nt, Artificial Sequence
  Poly(ADP-ribose)ohydrolase ARH3 (12-20)
gagggccuggcccgcccccucccgcug

SEQ ID NO: 35321 - RNA, 27 nt, Artificial Sequence
  Mitochondrial enolase superfamily member 1 (393-401)
gagcacuucaaguaccccgugaugauc

SEQ ID NO: 35322 - RNA, 27 nt, Artificial Sequence
  TERF1-interacting nuclear factor 2 (29-37)
gagcacuucccccgcgugcuggaguuc

SEQ ID NO: 35323 - RNA, 33 nt, Artificial Sequence
  Basigin (50-60)
gagcacaucaacgagggcgagaccgccaugcug

SEQ ID NO: 35324 - RNA, 27 nt, Artificial Sequence
  Prefoldin subunit 2 (53-61)
gagcacagccuggugaucgacacccuc

SEQ ID NO: 35325 - RNA, 27 nt, Artificial Sequence
  Regulator of microtubule dynamics protein 3 (350-358)
gagcacguggacaaggccaucgcccug

SEQ ID NO: 35326 - RNA, 27 nt, Artificial Sequence
  E3 ubiquitin-protein ligase MARCH6 (288-296)
gagcacguguucugggucgugagccug

SEQ ID NO: 35327 - RNA, 27 nt, Artificial Sequence
  Early endosome antigen 1 (171-179)
gagaucgccgacaucaagagcaaguac

SEQ ID NO: 35328 - RNA, 27 nt, Artificial Sequence
  Heat shock 70 kDa protein 1B (129-137)
gagaucgccgaggccuaccugggcuac

SEQ ID NO: 35329 - RNA, 27 nt, Artificial Sequence
  Pumilio homolog 1 (848-856)
gagaucgccggccacaucauggaguuc

SEQ ID NO: 35330 - RNA, 30 nt, Artificial Sequence
  GMP synthase (glutamine-hydrolyzing) (148-157)
gagaucuucccccuggagaccccggccuuc

SEQ ID NO: 35331 - RNA, 33 nt, Artificial Sequence
  ATP synthase subunit g, mitochondrial (91-101)
gagaucaucggcaagcgcgggaucaucggcuac

SEQ ID NO: 35332 - RNA, 27 nt, Artificial Sequence
  Serine/threonine-protein kinase 4 (69-77)
gagaucaucaaggagaucagcaucaug

SEQ ID NO: 35333 - RNA, 27 nt, Artificial Sequence
  Protein furry homolog-like (472-480)
gagaucaucaagaucaucggcaaguac

SEQ ID NO: 35334 - RNA, 27 nt, Artificial Sequence
  Arf-GAP with SH3 domain, ANK repeat and PH domain-containing protein 2 (422-430)
gagaucaucagcgaggugcagcgcaug

SEQ ID NO: 35335 - RNA, 27 nt, Artificial Sequence
  Structural maintenance of chromosomes flexible hinge domain-containing protein 1 (760-768)
gagaucaucagccacaucucccagcac

SEQ ID NO: 35336 - RNA, 27 nt, Artificial Sequence
  Vacuolar protein sorting-associated protein 13C (916-924)
gagaucaaggaggugauccuggaguuc

SEQ ID NO: 35337 - RNA, 27 nt, Artificial Sequence
  Pre-mRNA-processing-splicing factor 8 (2006-2014)
gagauccgcgacaucauccugggcaug

SEQ ID NO: 35338 - RNA, 30 nt, Artificial Sequence
  Filamin A (106-115)
gagaucguggagggcgagaaccacaccuac

SEQ ID NO: 35339 - RNA, 27 nt, Artificial Sequence
  Putative elongation factor 1-alpha-like 3 (169-177)
gagaucgugaaggaggucagcaccuac

SEQ ID NO: 35340 - RNA, 30 nt, Artificial Sequence
  Bifunctional 3'-phosphoadenosine 5'-phosphosulfate synthase 1 (555-564)
gagaucgugcccuuccgcgucgccgccuac

SEQ ID NO: 35341 - RNA, 30 nt, Artificial Sequence
  Splicing factor 3B subunit 1 (42-51)
gagaucuacggcgggagcgacucccgcuuc

SEQ ID NO: 35342 - RNA, 27 nt, Artificial Sequence
  Protein SET (73-81)
gagcugaucgccaagauccccaacuuc

SEQ ID NO: 35343 - RNA, 27 nt, Artificial Sequence
  Protein CMSS1 (152-160)
gagcugauccgcagcaugaccgccuuc

SEQ ID NO: 35344 - RNA, 24 nt, Artificial Sequence
  Beta-lactamase-like protein 2 (240-247)
gagcuggugaagaucaucuacaag

SEQ ID NO: 35345 - RNA, 27 nt, Artificial Sequence
  Structural maintenance of chromosomes flexible hinge domain-containing protein 1 (1904-1912)
gagcagaucgaccugcuccagcaguac

SEQ ID NO: 35346 - RNA, 33 nt, Artificial Sequence
  Glutamine-fructose-6-phosphate aminotransferase (isomerizing) 1 (443-453)
gagaccgccgacacccugaugggccuccgcuac

SEQ ID NO: 35347 - RNA, 27 nt, Artificial Sequence
  Ezrin (109-117)
gagaccgccgugcugcucggcagcuac

SEQ ID NO: 35348 - RNA, 30 nt, Artificial Sequence
  Mediator of RNA polymerase II transcription subunit 13 (1609-1618)
gagaccuucggcgaggccgggcagaaguac

SEQ ID NO: 35349 - RNA, 33 nt, Artificial Sequence
  A-kinase anchor protein 13 (546-556)
gagaccuucggcggguucgacagccaccagaug

SEQ ID NO: 35350 - RNA, 30 nt, Artificial Sequence
  DnaJ homolog subfamily C member 7 (29-38)
gagaccuucaaggagcagggcaacgccuac

SEQ ID NO: 35351 - RNA, 27 nt, Artificial Sequence
  ERO1-like protein alpha (51-59)
gagaccaucgaccgcuucaacaacuac

SEQ ID NO: 35352 - RNA, 30 nt, Artificial Sequence
  Protein SLX4IP (47-56)
gagaccaucgacagccgcgugcaggaguac

SEQ ID NO: 35353 - RNA, 27 nt, Artificial Sequence
  Pre-mRNA-processing-splicing factor 8 (1612-1620)
gagaccauccacccccgcaagagcuac

SEQ ID NO: 35354 - RNA, 27 nt, Artificial Sequence
  Far upstream element-binding protein 1 (396-404)
gagaccaucaagagcaucucccagcag

SEQ ID NO: 35355 - RNA, 27 nt, Artificial Sequence
  Vacuolar protein sorting-associated protein 8 homolog (1056-1064)
gagaccauccagaucacccagaaguac

SEQ ID NO: 35356 - RNA, 27 nt, Artificial Sequence
  RING finger protein 145 (166-174)
gagaccaucgugaucaucaacaaguuc

SEQ ID NO: 35357 - RNA, 30 nt, Artificial Sequence
  RNA polymerase-associated protein CTR9 homolog (376-385)
gagaccaugaagauccugggcagccucuac

SEQ ID NO: 35358 - RNA, 30 nt, Artificial Sequence
  Protein phosphatase 1 regulatory subunit 12A (825-834)
gagacccagaccgacagcaucucccgcuac

SEQ ID NO: 35359 - RNA, 30 nt, Artificial Sequence
  WD repeat-containing protein 11 (1019-1028)
gagaccagcgccgacaaccagcacuacuac

SEQ ID NO: 35360 - RNA, 33 nt, Artificial Sequence
  Heterogeneous nuclear ribonucleoproteins A2/B1 (19-29)
gagaccaccgaggagagccugcgcaacuacuac

SEQ ID NO: 35361 - RNA, 33 nt, Artificial Sequence
  Constitutive coactivator of PPAR-gamma-like protein 1 (893-903)
gagaccguggccaccggccccuaccgcgccuuc

SEQ ID NO: 35362 - RNA, 30 nt, Artificial Sequence
  Type II inositol 1,4,5-trisphosphate 5-phosphatase (190-199)
gagaccgugggcaccgggaucaugggccgc

SEQ ID NO: 35363 - RNA, 27 nt, Artificial Sequence
  HLA class II histocompatibility antigen, DR alpha chain (35-43)
gagaccguguggcgccuggaggaguuc

SEQ ID NO: 35364 - RNA, 27 nt, Artificial Sequence
  Spectrin alpha chain, non-erythrocytic 1 (648-656)
gagguggccgcccgcaugaacgagguc

SEQ ID NO: 35365 - RNA, 27 nt, Artificial Sequence
  Heterogeneous nuclear ribonucleoprotein M (10-18)
gagguggccgccaccgagaucaagaug

SEQ ID NO: 35366 - RNA, 30 nt, Artificial Sequence
  Transmembrane anterior posterior transformation protein 1 homolog (204-213)
gagguggccgaccgccuguucagcuccuuc

SEQ ID NO: 35367 - RNA, 27 nt, Artificial Sequence
  Tankyrase-2 (792-800)
gagguggccgaguaccugcuccagcac

SEQ ID NO: 35368 - RNA, 27 nt, Artificial Sequence
  Nuclear pore membraneoprotein 210 (776-784)
gagguggccggccaccugcgcaccuac

SEQ ID NO: 35369 - RNA, 30 nt, Artificial Sequence
  Nucleoprotein TPR (1215-1224)
gagguggcccaggucgagagccugcgcuac

SEQ ID NO: 35370 - RNA, 27 nt, Artificial Sequence
  Glutamyl-tRNA(Gln) amidotransferase subunit A, mitochondrial (334-342)
gagguggccagcaacauggcccgcuuc

SEQ ID NO: 35371 - RNA, 30 nt, Artificial Sequence
  Rho guanine nucleotide exchange factor 1 (666-675)
gagguggccaccgaccacaaggccuucuac

SEQ ID NO: 35372 - RNA, 30 nt, Artificial Sequence
  Disheveled-associated activator of morphogenesis 1 (1034-1043)
gagguguucgacaaggaccugagcaagcuc

SEQ ID NO: 35373 - RNA, 30 nt, Artificial Sequence
  Fatty acyl-CoA reductase 1 (146-155)
gagguguucaugcacgucagcaccgccuac

SEQ ID NO: 35374 - RNA, 30 nt, Artificial Sequence
  G1/S-specific cyclin-D2 (75-84)
gagguguucccccuggccaugaacuaccuc

SEQ ID NO: 35375 - RNA, 30 nt, Artificial Sequence
  Uncharacterized protein ZMYM6NB (45-54)
gagguguucccccugaaggucuucggcuac

SEQ ID NO: 35376 - RNA, 30 nt, Artificial Sequence
  Mitotic spindle assembly checkpoint protein MAD1 (619-628)
gagguguuccagaccaagauccaggaguuc

SEQ ID NO: 35377 - RNA, 27 nt, Artificial Sequence
  Zinc finger and BTB domain-containing protein 38 (82-90)
gagguguucaccgagauccugaacuac

SEQ ID NO: 35378 - RNA, 27 nt, Artificial Sequence
  Peroxisomal multifunctional enzyme type 2 (214-222)
gaggugggcgccggguggaucggcaag

SEQ ID NO: 35379 - RNA, 27 nt, Artificial Sequence
  Chromodomain-helicase-DNA-binding protein 1-like (232-240)
gaggugggcgacuucauccagcgcuac

SEQ ID NO: 35380 - RNA, 27 nt, Artificial Sequence
  PERQ amino acid-rich with GYF domain-containing protein 2 (1163-1171)
gaggugcacgacuacauccgcgccuac

SEQ ID NO: 35381 - RNA, 30 nt, Artificial Sequence
  Centrosomal protein of 55 kDa (275-284)
gaggugcacaaccugaaccagcuccuguac

SEQ ID NO: 35382 - RNA, 30 nt, Artificial Sequence
  Transcription termination factor 1, mitochondrial (99-108)
gaggugaucgccagcaucaucucccgcuac

SEQ ID NO: 35383 - RNA, 27 nt, Artificial Sequence
  Sterol 26-hydroxylase, mitochondrial (180-188)
gaggugaucgacgacuucaugacccgc

SEQ ID NO: 35384 - RNA, 27 nt, Artificial Sequence
  Alpha/beta hydrolase domain-containing protein 17C (277-285)
gaggugaucgacuucagccacggccug

SEQ ID NO: 35385 - RNA, 30 nt, Artificial Sequence
  PHD finger protein 10 (57-66)
gaggugaucgaccugaugaucaaggaguac

SEQ ID NO: 35386 - RNA, 30 nt, Artificial Sequence
  SNF-related serine/threonine-protein kinase (80-89)
gaggugaucgacacccagaccaagcuguac

SEQ ID NO: 35387 - RNA, 27 nt, Artificial Sequence
  Transcription initiation factor TFIID subunit 1-like (1043-1051)
gaggugaucgacgucgugcgcaccaug

SEQ ID NO: 35388 - RNA, 27 nt, Artificial Sequence
  Shootin-1 (164-172)
gaggugaucgaggaggucaacaaggug

SEQ ID NO: 35389 - RNA, 36 nt, Artificial Sequence
  Glucocorticoid receptor (538-549)
gaggugaucgagcccgagguccuguacgccggcuac

SEQ ID NO: 35390 - RNA, 30 nt, Artificial Sequence
  Transformation/transcription domain-associated protein (3103-3112)
gaggugaucgagagcaccaaccugaaguac

SEQ ID NO: 35391 - RNA, 30 nt, Artificial Sequence
  Serine/threonine-protein kinase MARK2 (117-126)
gaggugaucgagaccgagaagacccuguac

SEQ ID NO: 35392 - RNA, 30 nt, Artificial Sequence
  Histone H2A deubiquitinase MYSM1 (495-504)
gaggugaucggccugcucgggggccgcuac

SEQ ID NO: 35393 - RNA, 27 nt, Artificial Sequence
  CD9 antigen (116-124)
gaggugaucaaggagguccaggaguuc

SEQ ID NO: 35394 - RNA, 27 nt, Artificial Sequence
  Eukaryotic translation initiation factor 3 subunit L (50-58)
gaggugaucaagaacuucauccaguac

SEQ ID NO: 35395 - RNA, 30 nt, Artificial Sequence
  Calcium signal-modulating cyclophilin ligand (207-216)
gaggugaucaaccgcagcauggacaccuac

SEQ ID NO: 35396 - RNA, 27 nt, Artificial Sequence
  NADH dehydrogenase (ubiquinone) 1 beta subcomplex subunit 6 (115-123)
gaggugauccccccgaugaaggaguuc

SEQ ID NO: 35397 - RNA, 27 nt, Artificial Sequence
  Tyrosyl-DNA phosphodiesterase 2 (152-160)
gaggugauccccccguacuacagcuac

SEQ ID NO: 35398 - RNA, 27 nt, Artificial Sequence
  60 kDa SS-A/Ro ribonucleoprotein (72-80)
gaggugauccaggagaucaagagcuuc

SEQ ID NO: 35399 - RNA, 27 nt, Artificial Sequence
  Insulin-degrading enzyme (951-959)
gaggugauccagaacaugaccgaguuc

SEQ ID NO: 35400 - RNA, 27 nt, Artificial Sequence
  Cytosolic 5'-nucleotidase 3A (161-169)
gaggugauccgccaggccggcgucuac

SEQ ID NO: 35401 - RNA, 30 nt, Artificial Sequence
  Nucleoprotein TPR (531-540)
gaggugaucagccagcaccuggucuccuac

SEQ ID NO: 35402 - RNA, 27 nt, Artificial Sequence
  Mediator of RNA polymerase II transcription subunit 26 (33-41)
gaggugaucagcucccuggagaaguac

SEQ ID NO: 35403 - RNA, 27 nt, Artificial Sequence
  Bloom syndrome protein (1277-1285)
gaggugaucagcguccugcagaaguac

SEQ ID NO: 35404 - RNA, 33 nt, Artificial Sequence
  Ribosomal protein S6 kinase alpha-3 (14-24)
gaggugaaggaggacaucggcgucgggagcuac

SEQ ID NO: 35405 - RNA, 36 nt, Artificial Sequence
  Farnesyl pyrophosphate synthase (40-51)
gaggugcuggaguacaacgccaucggcgggaaguac

SEQ ID NO: 35406 - RNA, 33 nt, Artificial Sequence
  Tight junction protein ZO-2 (118-128)
gaggugauggacgaguucgacggccgcagcuuc

SEQ ID NO: 35407 - RNA, 27 nt, Artificial Sequence
  DNA polymerase eta (98-106)
gaggugauggagaucaugagccgcuuc

SEQ ID NO: 35408 - RNA, 27 nt, Artificial Sequence
  2',3'-cyclic-nucleotide 3'-phosphodiesterase (369-377)
gaggugcgcgccaucuucaccggcuac

SEQ ID NO: 35409 - RNA, 30 nt, Artificial Sequence
  Fragile X mental retardation syndrome-related protein 1 (7-16)
gaggugcgcggcagcaacggggccuucuac

SEQ ID NO: 35410 - RNA, 27 nt, Artificial Sequence
  Glycylpeptide N-tetradecanoyltransferase 1 (60-68)
gaggugaccgacuuccugagcuucuac

SEQ ID NO: 35411 - RNA, 27 nt, Artificial Sequence
  A-kinase anchor protein 9 (664-672)
gaggugaccgagaucaucagccaguuc

SEQ ID NO: 35412 - RNA, 27 nt, Artificial Sequence
  DNA-directed RNA polymerases I, II, and III subunit RPABC1 (155-163)
gaggugaccgagcugcucgcccgcuac

SEQ ID NO: 35413 - RNA, 27 nt, Artificial Sequence
  DNA topoisomerase 2-alpha (74-82)
gaggugaccuucguccccggccuguac

SEQ ID NO: 35414 - RNA, 27 nt, Artificial Sequence
  Volume-regulated anion channel subunit LRRC8D (74-82)
gaggugaccaccaacauccccaagaug

SEQ ID NO: 35415 - RNA, 27 nt, Artificial Sequence
  Vacuolar protein sorting-associated protein 13D (1985-1993)
gagguggucgccuucauccagcacuuc

SEQ ID NO: 35416 - RNA, 27 nt, Artificial Sequence
  Mortality factor 4-like protein 1 (216-224)
gagguggucgccggcaucaaggaguac

SEQ ID NO: 35417 - RNA, 30 nt, Artificial Sequence
  Mortality factor 4-like protein 1 (216-225)
gagguggucgccggcaucaaggaguacuuc

SEQ ID NO: 35418 - RNA, 27 nt, Artificial Sequence
  Nesprin-2 (1588-1596)
gagguggucgacaagaucaaccaggug

SEQ ID NO: 35419 - RNA, 27 nt, Artificial Sequence
  Peptide-N(4)-(N-acetyl-beta-glucosaminyl)asparagine amidase (383-391)
gagguggucgacgugaccuggcgcuac

SEQ ID NO: 35420 - RNA, 27 nt, Artificial Sequence
  GA-binding protein subunit beta-1 (118-126)
gagguggucgagcugcucaucaaguac

SEQ ID NO: 35421 - RNA, 27 nt, Artificial Sequence
  Glucocorticoid receptor (728-736)
gagguggucgagaaccugcucaacuac

SEQ ID NO: 35422 - RNA, 27 nt, Artificial Sequence
  Inverted formin-2 (336-344)
gagguggucgagcgccugcucagcgug

SEQ ID NO: 35423 - RNA, 27 nt, Artificial Sequence
  F-box only protein 22 (27-35)
gagguggucgagcgcgugcugaccuuc

SEQ ID NO: 35424 - RNA, 33 nt, Artificial Sequence
  Actin-binding protein IPP (418-428)
gagguggucggcaacauggccgugagccgcuac

SEQ ID NO: 35425 - RNA, 30 nt, Artificial Sequence
  26S proteasome non-ATPase regulatory subunit 2 (581-590)
gagguggucagcgagcccuuccgcuccuuc

SEQ ID NO: 35426 - RNA, 30 nt, Artificial Sequence
  Cold shock domain-containing protein E1 (630-639)
gagguguaccccuucggcaucgucgggaug

SEQ ID NO: 35427 - RNA, 27 nt, Artificial Sequence
  Zinc finger MIZ domain-containing protein 2 (271-279)
gagguguaccccggccagcaguaccug

SEQ ID NO: 35428 - RNA, 27 nt, Artificial Sequence
  Uncharacterized protein C18orf8 (437-445)
gaguacauccgcagccugaaccaguuc

SEQ ID NO: 35429 - RNA, 27 nt, Artificial Sequence
  Oxysterol-binding protein (17-25)
gaguacauggagcacguguaccugauc

SEQ ID NO: 35430 - RNA, 27 nt, Artificial Sequence
  Insulin receptor substrate 2 (597-605)
gaguacacccugaugcgcgccaccuuc

SEQ ID NO: 35431 - RNA, 27 nt, Artificial Sequence
  Striatin-interacting protein 2 (594-602)
gaguacgugagccagcaccuggucuuc

SEQ ID NO: 35432 - RNA, 27 nt, Artificial Sequence
  Phospholipid hydroperoxide glutathione peroxidase, mitochondrial (119-127)
uucgccgccggcuacaacgugaaguuc

SEQ ID NO: 35433 - RNA, 24 nt, Artificial Sequence
  Tuftelin-interacting protein 11 (132-139)
uucgccggcgggaccaagagcuuc

SEQ ID NO: 35434 - RNA, 33 nt, Artificial Sequence
  Sister chromatid cohesion protein PDS5 homolog A (273-283)
uucgccaucgacccccaccugcuccugagcgug

SEQ ID NO: 35435 - RNA, 27 nt, Artificial Sequence
  ATP-dependent RNA helicase DDX24 (247-255)
uucgccauccccaugauccacgccgug

SEQ ID NO: 35436 - RNA, 27 nt, Artificial Sequence
  Clathrin heavy chain 1 (1594-1602)
uucgccaugcccuacuucauccaggug

SEQ ID NO: 35437 - RNA, 27 nt, Artificial Sequence
  Splicing factor, proline- and glutamine-rich (486-494)
uucgaguacgaguacagccagcgcugg

SEQ ID NO: 35438 - RNA, 27 nt, Artificial Sequence
  Serine/threonine-protein phosphatase PP1-beta catalytic subunit (226-234)
uucggcgccgacguggucagcaaguuc

SEQ ID NO: 35439 - RNA, 27 nt, Artificial Sequence
  Chromatin assembly factor 1 subunit B (228-236)
uuccacgacgacagcaugaaguccuuc

SEQ ID NO: 35440 - RNA, 27 nt, Artificial Sequence
  Endoplasmin (422-430)
uuccacgacaugaugcccaaguaccug

SEQ ID NO: 35441 - RNA, 27 nt, Artificial Sequence
  Protein transport protein Sec23B (630-638)
uuccacggccccccggagcccgugcug

SEQ ID NO: 35442 - RNA, 27 nt, Artificial Sequence
  Coatomer subunit alpha (101-109)
uuccaccacgaguaccccuggauccug

SEQ ID NO: 35443 - RNA, 27 nt, Artificial Sequence
  Putative heat shock protein HSP 90-alpha A5 (3-11)
uuccaccacgugggccaggccgggcug

SEQ ID NO: 35444 - RNA, 27 nt, Artificial Sequence
  Phosphatidylinositol 4,5-bisphosphate 3-kinase catalytic subunit gamma isoform (961-969)
uuccacaucgacuucggccacauccug

SEQ ID NO: 35445 - RNA, 27 nt, Artificial Sequence
  Fas apoptotic inhibitory molecule 3 (252-260)
uuccacauccugauccccaccauccuc

SEQ ID NO: 35446 - RNA, 27 nt, Artificial Sequence
  Rho GTPase-activating protein 4 (276-284)
uuccaccuggcccucggccaggugcug

SEQ ID NO: 35447 - RNA, 30 nt, Artificial Sequence
  Proteasome subunit alpha type-5 (154-163)
uuccacauggaccccagcggcaccuucgug

SEQ ID NO: 35448 - RNA, 27 nt, Artificial Sequence
  Anaphase-promoting complex subunit 1 (1137-1145)
uuccacaacggcguggccgccgggcug

SEQ ID NO: 35449 - RNA, 27 nt, Artificial Sequence
  Ubiquitin-conjugating enzyme E2 J1 (237-245)
uuccaccagcccacccagccgguggcc

SEQ ID NO: 35450 - RNA, 27 nt, Artificial Sequence
  Mitotic checkpoint serine/threonine-protein kinase BUB1 (438-446)
uuccacaccacccccaacacgagccug

SEQ ID NO: 35451 - RNA, 27 nt, Artificial Sequence
  WD repeat-containing protein 47 (348-356)
uuccacuaccccggcgugcagaaccug

SEQ ID NO: 35452 - RNA, 30 nt, Artificial Sequence
  Probable ubiquitin carboxyl-terminal hydrolase FAF-X (1466-1475)
uucaucuuccccgccagcaacguguaccug

SEQ ID NO: 35453 - RNA, 27 nt, Artificial Sequence
  Endoplasmic reticulum aminopeptidase 1 (249-257)
uucaucaucagcgacuucgaguccgug

SEQ ID NO: 35454 - RNA, 27 nt, Artificial Sequence
  Protein kinase C-binding protein 1 (213-221)
uuccuggccgacgccaaguggauccuc

SEQ ID NO: 35455 - RNA, 27 nt, Artificial Sequence
  Unconventional myosin-Ic (773-781)
uuccuggaccacgugcgcaccagcuuc

SEQ ID NO: 35456 - RNA, 27 nt, Artificial Sequence
  E3 ubiquitin-protein ligase RNF216 (134-142)
uuccuggaccucggccccccggggauc

SEQ ID NO: 35457 - RNA, 27 nt, Artificial Sequence
  UDP-glucose:glycoprotein glucosyltransferase 2 (97-105)
uuccuggacaaccuccacaucaaccug

SEQ ID NO: 35458 - RNA, 27 nt, Artificial Sequence
  Proteasome-associated protein ECM29 homolog (801-809)
uuccuggacagcaccuccccccuccug

SEQ ID NO: 35459 - RNA, 27 nt, Artificial Sequence
  Eukaryotic translation initiation factor 3 subunit M (218-226)
uuccuguucgaccaccuccugacccug

SEQ ID NO: 35460 - RNA, 27 nt, Artificial Sequence
  HEAT repeat-containing protein 1 (2003-2011)
uuccuguucgacacccagcacuucauc

SEQ ID NO: 35461 - RNA, 30 nt, Artificial Sequence
  Apolipoprotein L1 (239-248)
uuccugggcgagaacaucagcaacuuccuc

SEQ ID NO: 35462 - RNA, 27 nt, Artificial Sequence
  WASH complex subunit strumpellin (1046-1054)
uuccugaucgcccagcuccccaagcug

SEQ ID NO: 35463 - RNA, 30 nt, Artificial Sequence
  Tensin-1 (1527-1536)
uuccugaucgagaccggcccccgcggggug

SEQ ID NO: 35464 - RNA, 27 nt, Artificial Sequence
  Plexin-B2 (395-403)
uuccugaucaacuucauccacacccuc

SEQ ID NO: 35465 - RNA, 27 nt, Artificial Sequence
  cAMP-specific 3',5'-cyclic phosphodiesterase 4B (382-390)
uuccugaucaacaccaacagcgagcuc

SEQ ID NO: 35466 - RNA, 30 nt, Artificial Sequence
  Serine/threonine-protein kinase 11-interacting protein (316-325)
uuccugcucgacggcaaggugcugagccug

SEQ ID NO: 35467 - RNA, 33 nt, Artificial Sequence
  Tyrosine-protein kinase BAZ1B (291-301)
uuccugcucgaccccuacaaguacaugacccug

SEQ ID NO: 35468 - RNA, 30 nt, Artificial Sequence
  Transmembrane emp24 domain-containing protein 10 (22-31)
uuccugcucggcccccgccuggugcuggcc

SEQ ID NO: 35469 - RNA, 27 nt, Artificial Sequence
  TBC1 domain family member 13 (329-337)
uuccugcuccccgacgugauccgcauc

SEQ ID NO: 35470 - RNA, 30 nt, Artificial Sequence
  Atlastin-3 (263-272)
uuccugcucccccacccgggccugcaggug

SEQ ID NO: 35471 - RNA, 27 nt, Artificial Sequence
  Glycerol-3-phosphate acyltransferase 4 (174-182)
uuccugcucccccugcgcaucgcccug

SEQ ID NO: 35472 - RNA, 30 nt, Artificial Sequence
  ATP-dependent RNA helicase DDX24 (582-591)
uuccugaugcaguaccccggccgcagccuc

SEQ ID NO: 35473 - RNA, 27 nt, Artificial Sequence
  Quinone oxidoreductase-like protein 1 (284-292)
uuccugaacgacgagguguggaaccuc

SEQ ID NO: 35474 - RNA, 27 nt, Artificial Sequence
  Spectrin beta chain, non-erythrocytic 1 (1184-1192)
uuccugaacaaccaggaguacgugcuc

SEQ ID NO: 35475 - RNA, 27 nt, Artificial Sequence
  Bifunctional coenzyme A synthase (125-133)
uuccugcccccgcuccccaccagcgug

SEQ ID NO: 35476 - RNA, 27 nt, Artificial Sequence
  RNA-binding protein EWS (550-558)
uuccugcccccgcccuucccccccccg

SEQ ID NO: 35477 - RNA, 27 nt, Artificial Sequence
  Arginyl aminopeptidase-like 1 (87-95)
uuccugcccccgagcuuccccaucgug

SEQ ID NO: 35478 - RNA, 30 nt, Artificial Sequence
  Exosome complex component RRP4 (134-143)
uuccugcaggagggcgaccucaucagcgcc

SEQ ID NO: 35479 - RNA, 30 nt, Artificial Sequence
  Cirhin (214-223)
uuccugagcgacggcaccaucaucuccgug

SEQ ID NO: 35480 - RNA, 27 nt, Artificial Sequence
  26S proteasome non-ATPase regulatory subunit 1 (260-268)
uuccugagcuccgugauccagaaccuc

SEQ ID NO: 35481 - RNA, 27 nt, Artificial Sequence
  Acidic leucine-rich nuclear phosphoprotein 32 family member A (46-54)
uuccugagcaccaucaacgugggccuc

SEQ ID NO: 35482 - RNA, 30 nt, Artificial Sequence
  Mannosyl-oligosaccharide glucosidase (448-457)
uuccugugggacgagggcuuccaccagcuc

SEQ ID NO: 35483 - RNA, 27 nt, Artificial Sequence
  rRNA methyltransferase 1, mitochondrial (246-254)
uuccugugggagcgccccacccuccug

SEQ ID NO: 35484 - RNA, 24 nt, Artificial Sequence
  Transmembrane protein 41B (141-148)
uuccuguaccccuucccgcucgcc

SEQ ID NO: 35485 - RNA, 27 nt, Artificial Sequence
  tRNA-splicing endonuclease subunit Sen15 (185-193)
uucaugcugcccgacccgcagaacauc

SEQ ID NO: 35486 - RNA, 33 nt, Artificial Sequence
  tRNA-splicing endonuclease subunit Sen15 (185-195)
uucaugcugcccgacccgcagaacaucagccuc

SEQ ID NO: 35487 - RNA, 27 nt, Artificial Sequence
  Intraflagellar transport protein 172 homolog (435-443)
uucaugaacccccaccugaucagcgug

SEQ ID NO: 35488 - RNA, 27 nt, Artificial Sequence
  Ecto-NOX disulfide-thiol exchanger 1 (187-195)
uucaugguggacaaggccaucuaccug

SEQ ID NO: 35489 - RNA, 27 nt, Artificial Sequence
  Integrin alpha-4 (949-957)
uuccccgagccgaacccccgcgugauc

SEQ ID NO: 35490 - RNA, 27 nt, Artificial Sequence
  Protein RRP5 homolog (1250-1258)
uuccccuucggcaagaucgggaccgug

SEQ ID NO: 35491 - RNA, 27 nt, Artificial Sequence
  Zinc finger protein 662 (74-82)
uuccccuucccgaagcccgcccugauc

SEQ ID NO: 35492 - RNA, 30 nt, Artificial Sequence
  U2 small nuclear ribonucleoprotein B'' (72-81)
uuccccuucuacggcaagccgaugcgcauc

SEQ ID NO: 35493 - RNA, 27 nt, Artificial Sequence
  Cyclin-dependent kinase 9 (59-67)
uuccccaucaccgcccugcgcgagauc

SEQ ID NO: 35494 - RNA, 24 nt, Artificial Sequence
  HLA class II histocompatibility antigen, DP alpha 1 chain (123-130)
uuccccaaggagccgguggagcug

SEQ ID NO: 35495 - RNA, 27 nt, Artificial Sequence
  Poly(A)-specific ribonuclease PARN (273-281)
uucccccgccugcucgacaccaagcug

SEQ ID NO: 35496 - RNA, 27 nt, Artificial Sequence
  Glutamine-fructose-6-phosphate aminotransferase (isomerizing) 2 (671-679)
uucccccgcaaccuggccaagagcgug

SEQ ID NO: 35497 - RNA, 27 nt, Artificial Sequence
  AT-rich interactive domain-containing protein 2 (669-677)
uuccccgugcagggcguccacaccgug

SEQ ID NO: 35498 - RNA, 27 nt, Artificial Sequence
  Putative heat shock protein HSP 90-beta 2 (17-25)
uuccaggccgagaucgcccagcugaug

SEQ ID NO: 35499 - RNA, 27 nt, Artificial Sequence
  Transcription intermediary factor 1-alpha (890-898)
uuccaggaccccgugccgcugaccguc

SEQ ID NO: 35500 - RNA, 27 nt, Artificial Sequence
  Integrin beta-7 (790-798)
uuccaggaggccgacagccccacccug

SEQ ID NO: 35501 - RNA, 27 nt, Artificial Sequence
  Nicotinate phosphoribosyltransferase (342-350)
uuccaggugcccuggcuggagagcguc

SEQ ID NO: 35502 - RNA, 27 nt, Artificial Sequence
  5-aminolevulinate synthase, nonspecific, mitochondrial (214-222)
uuccaguacgaccgcuucuucgagaag

SEQ ID NO: 35503 - RNA, 27 nt, Artificial Sequence
  Asparagine synthetase (glutamine-hydrolyzing) (11-19)
uuccgcuucgagaacgugaacggcuac

SEQ ID NO: 35504 - RNA, 30 nt, Artificial Sequence
  Probable ATP-dependent RNA helicase DDX5 (558-567)
uuccgcaccggcaaccccaccgggacguac

SEQ ID NO: 35505 - RNA, 30 nt, Artificial Sequence
  Protein transport protein Sec31A (398-407)
uucagcuucggcgggaagcuggugaccuuc

SEQ ID NO: 35506 - RNA, 27 nt, Artificial Sequence
  Polymeric immunoglobulin receptor (132-140)
uucagcguggucaucaaccagcugcgc

SEQ ID NO: 35507 - RNA, 27 nt, Artificial Sequence
  Neutral amino acid transporter B(0) (89-97)
uucguguuccccggcgagcugcuccug

SEQ ID NO: 35508 - RNA, 27 nt, Artificial Sequence
  Clathrin heavy chain 1 (783-791)
uucgugcacgaccugguccucuaccug

SEQ ID NO: 35509 - RNA, 27 nt, Artificial Sequence
  Actin-binding protein anillin (958-966)
uucgugcuggacaagguccccuuccuc

SEQ ID NO: 35510 - RNA, 24 nt, Artificial Sequence
  Myosin light polypeptide 6 (150-157)
uucgugcgccacauccugagcggc

SEQ ID NO: 35511 - RNA, 33 nt, Artificial Sequence
  Alkyldihydroxyacetonephosphate synthase, peroxisomal (497-507)
ggcgaggacaacgggcagcgcggcuaccugcuc

SEQ ID NO: 35512 - RNA, 27 nt, Artificial Sequence
  Putative deoxyribonuclease TATDN3 (48-56)
ggcgaguucgagaagaucaugcagcug

SEQ ID NO: 35513 - RNA, 27 nt, Artificial Sequence
  Zinc finger protein 428 (174-182)
ggcgagcugcacgggcacuucaugcuc

SEQ ID NO: 35514 - RNA, 27 nt, Artificial Sequence
  Patatin-like phospholipase domain-containing protein 2 (124-132)
ggcgagaacgugaucaucagccacuuc

SEQ ID NO: 35515 - RNA, 27 nt, Artificial Sequence
  DAZ-associated protein 1 (125-133)
ggcgagaccgagcugcgcgaguacuuc

SEQ ID NO: 35516 - RNA, 33 nt, Artificial Sequence
  Nuclear pore complex protein Nup93 (311-321)
ggcgagguggaggggcaccccgucugggcccug

SEQ ID NO: 35517 - RNA, 27 nt, Artificial Sequence
  Elongation factor 2 (120-128)
ggcgaggugagcgcccgccaggagcug

SEQ ID NO: 35518 - RNA, 27 nt, Artificial Sequence
  WD repeat-containing protein 61 (188-196)
ggccacgccaugcccauccgcagccug

SEQ ID NO: 35519 - RNA, 27 nt, Artificial Sequence
  Elongator complex protein 2 (237-245)
ggccacuucgacggggugcaggaccug

SEQ ID NO: 35520 - RNA, 27 nt, Artificial Sequence
  Neuropathy target esterase (188-196)
ggccacuucgagaagccccuguuccuc

SEQ ID NO: 35521 - RNA, 30 nt, Artificial Sequence
  Protein SCAF8 (919-928)
ggcauccuggggauccagcccccgagcgug

SEQ ID NO: 35522 - RNA, 30 nt, Artificial Sequence
  MKL/myocardin-like protein 2 (440-449)
ggccuggccgccgggggcaucguggcgguc

SEQ ID NO: 35523 - RNA, 30 nt, Artificial Sequence
  TRPM8 channel-associated factor 2 (73-82)
ggccuggcccccuuccuccugaacgccgug

SEQ ID NO: 35524 - RNA, 27 nt, Artificial Sequence
  Neurobeachin-like protein 2 (789-797)
ggccuggcccccaagccggugcagguc

SEQ ID NO: 35525 - RNA, 27 nt, Artificial Sequence
  Rapamycin-insensitive companion of mTOR (711-719)
ggccuggcccgcgugauccucagcaag

SEQ ID NO: 35526 - RNA, 33 nt, Artificial Sequence
  Nuclear pore complex protein Nup107 (915-925)
ggccuggacccccucggguacgagauccagcug

SEQ ID NO: 35527 - RNA, 27 nt, Artificial Sequence
  Elongation factor 2 (217-225)
ggccugcacgggugggccuucacccuc

SEQ ID NO: 35528 - RNA, 27 nt, Artificial Sequence
  CCR4-NOT transcription complex subunit 1 (373-381)
ggccugcacaacguggucuacgggauc

SEQ ID NO: 35529 - RNA, 27 nt, Artificial Sequence
  DNA-dependent protein kinase catalytic subunit (2509-2517)
ggccugaucgacgagaaccccgggcuc

SEQ ID NO: 35530 - RNA, 27 nt, Artificial Sequence
  Structural maintenance of chromosomes flexible hinge domain-containing protein 1 (829-837)
ggccugcucgaccugcccuuccgcgug

SEQ ID NO: 35531 - RNA, 30 nt, Artificial Sequence
  F-box only protein 22 (210-219)
ggccugcucgacaaccccgagcugcgcgug

SEQ ID NO: 35532 - RNA, 33 nt, Artificial Sequence
  Nuclear receptor subfamily 2 group C member 2 (238-248)
ggccugcucgaccccgggaugcuggugaacauc

SEQ ID NO: 35533 - RNA, 27 nt, Artificial Sequence
  Protein zer-1 homolog (593-601)
ggccugcucgggaacguggccgagguc

SEQ ID NO: 35534 - RNA, 27 nt, Artificial Sequence
  Protein zyg-11 homolog B (299-307)
ggccugcucaacaacaucgccgaggug

SEQ ID NO: 35535 - RNA, 27 nt, Artificial Sequence
  Lysophospholipid acyltransferase 7 (141-149)
ggccugcuccccgacgugccgagccug

SEQ ID NO: 35536 - RNA, 27 nt, Artificial Sequence
  E3 ubiquitin-protein ligase UBR4 (1708-1716)
ggccugcuccgcaucauccccuaccug

SEQ ID NO: 35537 - RNA, 27 nt, Artificial Sequence
  Protein ELYS (929-937)
ggccugauggaggaccuccugaagcug

SEQ ID NO: 35538 - RNA, 27 nt, Artificial Sequence
  Exocyst complex component 4 (173-181)
ggccugagcgaccuccgccuggagcug

SEQ ID NO: 35539 - RNA, 27 nt, Artificial Sequence
  Nuclear pore complex protein Nup155 (139-147)
ggccugagcgagaccauccucgccgug

SEQ ID NO: 35540 - RNA, 27 nt, Artificial Sequence
  Leucine-rich repeat and calponin homology domain-containing protein 3 (750-758)
ggccugagccagguggccgucaccgug

SEQ ID NO: 35541 - RNA, 27 nt, Artificial Sequence
  Glucocorticoid modulatory element-binding protein 1 (503-511)
ggccugaccagcgccauccaggccgug

SEQ ID NO: 35542 - RNA, 30 nt, Artificial Sequence
  Complex I assembly factor TIMMDC1, mitochondrial (187-196)
ggccugguggccgggggcaucaucggggcc

SEQ ID NO: 35543 - RNA, 27 nt, Artificial Sequence
  Serine-tRNA ligase, cytoplasmic (31-39)
ggccugguggaccagcucgucaaggcc

SEQ ID NO: 35544 - RNA, 27 nt, Artificial Sequence
  KATNB1-like protein 1 (274-282)
ggccugugggagcaggagaaccaccuc

SEQ ID NO: 35545 - RNA, 27 nt, Artificial Sequence
  Rotatin (1413-1421)
ggccugugggggaccguggucaacauc

SEQ ID NO: 35546 - RNA, 30 nt, Artificial Sequence
  Melanoma-associated antigen 10 (254-263)
ggccuguacgacgggauggagcaccucauc

SEQ ID NO: 35547 - RNA, 27 nt, Artificial Sequence
  tRNA (adenine(58)-N(1))-methyltransferase non-catalytic subunit TRM6 (83-91)
ggccuguacgaguucccccucaacaag

SEQ ID NO: 35548 - RNA, 27 nt, Artificial Sequence
  Putative ATP-dependent RNA helicase DHX30 (983-991)
ggccuguaccccaaccucauccaggug

SEQ ID NO: 35549 - RNA, 30 nt, Artificial Sequence
  Catenin alpha-1 (725-734)
ggcauggccagccugaaccuccccgccgug

SEQ ID NO: 35550 - RNA, 27 nt, Artificial Sequence
  RNA-binding protein 12 (509-517)
ggcaugcuggagaagaucgacaugauc

SEQ ID NO: 35551 - RNA, 27 nt, Artificial Sequence
  Probable ATP-dependent RNA helicase YTHDC2 (978-986)
ggcauguaccccaaccuggugcacguc

SEQ ID NO: 35552 - RNA, 27 nt, Artificial Sequence
  Heterogeneous nuclear ribonucleoprotein M (480-488)
ggccccgccaucgagcgcauggggcug

SEQ ID NO: 35553 - RNA, 27 nt, Artificial Sequence
  ETS translocation variant 5 (173-181)
ggccccgccccggccccccacagccug

SEQ ID NO: 35554 - RNA, 33 nt, Artificial Sequence
  Filamin-A (852-862)
ggccccgggcugagccgcaccggcguggagcuc

SEQ ID NO: 35555 - RNA, 30 nt, Artificial Sequence
  Splicing factor, proline- and glutamine-rich (215-224)
ggccccaagccggggggcgggcccggccug

SEQ ID NO: 35556 - RNA, 27 nt, Artificial Sequence
  Peptidyl-prolyl cis-trans isomerase-like 2 (134-142)
ggccccaacagcaaccgcucccaguuc

SEQ ID NO: 35557 - RNA, 30 nt, Artificial Sequence
  RuvB-like 1 (70-79)
ggccccccggggaccggcaagaccgcccug

SEQ ID NO: 35558 - RNA, 27 nt, Artificial Sequence
  Transmembrane protein 214 (461-469)
ggcccccgccugccguggacccggcuc

SEQ ID NO: 35559 - RNA, 27 nt, Artificial Sequence
  PHD finger protein 3 (205-213)
ggccagaucgaggugguccccgaggug

SEQ ID NO: 35560 - RNA, 27 nt, Artificial Sequence
  Nucleolar RNA helicase 2 (190-198)
ggccgcgccccccaggugcugguccuc

SEQ ID NO: 35561 - RNA, 30 nt, Artificial Sequence
  Ran-binding protein 9 (76-85)
ggccgcgacggguacaugggcaucgggcug

SEQ ID NO: 35562 - RNA, 27 nt, Artificial Sequence
  COP9 signalosome complex subunit 5 (281-289)
ggccgcgggagcuucaugcugggccuc

SEQ ID NO: 35563 - RNA, 27 nt, Artificial Sequence
  WD repeat-containing protein 81 (717-725)
ggccgcauccugcuccccgagggguuc

SEQ ID NO: 35564 - RNA, 30 nt, Artificial Sequence
  Neutral amino acid transporter A (111-120)
ggccgccuggggggcaucgccguggccuac

SEQ ID NO: 35565 - RNA, 30 nt, Artificial Sequence
  Spectrin beta chain, non-erythrocytic 1 (822-831)
ggccgccugagcgggaucgaggagcgguac

SEQ ID NO: 35566 - RNA, 33 nt, Artificial Sequence
  ATP-binding cassette sub-family F member 3 (595-605)
ggccgcuacgggaucagcggcgagcuggccaug

SEQ ID NO: 35567 - RNA, 27 nt, Artificial Sequence
  Stathmin 1/oncoprotein 18 (118-126)
ggcagccacuucaucucccaccugagc

SEQ ID NO: 35568 - RNA, 27 nt, Artificial Sequence
  AP-5 complex subunit beta-1 (317-325)
ggcaccgcccagcugacccuccugcac

SEQ ID NO: 35569 - RNA, 27 nt, Artificial Sequence
  UPF0428 protein CXorf56 (73-81)
ggcacccugaucgacaaccaguucaag

SEQ ID NO: 35570 - RNA, 27 nt, Artificial Sequence
  PX domain-containing protein kinase-like protein (149-157)
ggcacccugaaggaccucaucuacaag

SEQ ID NO: 35571 - RNA, 27 nt, Artificial Sequence
  Putative inactive carbonic anhydrase 5B-like protein (13-21)
ggcacccugagcuccuggaaccucaag

SEQ ID NO: 35572 - RNA, 27 nt, Artificial Sequence
  Small integral membrane protein 4 (34-42)
ggcaccauggaguggaucaugaucaag

SEQ ID NO: 35573 - RNA, 27 nt, Artificial Sequence
  Arf-GAP with SH3 domain, ANK repeat and PH domain-containing protein 2 (482-490)
ggcaccagcgagcugcuccuggccaag

SEQ ID NO: 35574 - RNA, 27 nt, Artificial Sequence
  DNA cross-link repair 1A protein (877-885)
ggcaccuacagcaucgggaaggagaag

SEQ ID NO: 35575 - RNA, 27 nt, Artificial Sequence
  Proteasome subunit beta type-3 (184-192)
ggcgugaucguccacaucaucgagaag

SEQ ID NO: 35576 - RNA, 27 nt, Artificial Sequence
  Tensin-1 (71-79)
cacgccaaggugcuggaguucggcugg

SEQ ID NO: 35577 - RNA, 27 nt, Artificial Sequence
  Mothers against decapentaplegic homolog 2 (291-299)
cacgccagccagcccucccugaccgug

SEQ ID NO: 35578 - RNA, 27 nt, Artificial Sequence
  TIP41-like protein (203-211)
cacgaggccgacaagaccuacaugcug

SEQ ID NO: 35579 - RNA, 27 nt, Artificial Sequence
  Zinc finger protein 655 (167-175)
cacgagcccgagaagagcuucucccug

SEQ ID NO: 35580 - RNA, 24 nt, Artificial Sequence
  Retinol dehydrogenase 10 (221-228)
cacgagagccugucccacgagcuc

SEQ ID NO: 35581 - RNA, 27 nt, Artificial Sequence
  Hippocampus abundant transcript-like protein 1 (50-58)
cacgagaccuucagccagcacaccuuc

SEQ ID NO: 35582 - RNA, 27 nt, Artificial Sequence
  N-acetyltransferase 9 (4-12)
cacgaguggaugaagagcgaggagcug

SEQ ID NO: 35583 - RNA, 27 nt, Artificial Sequence
  Tubulin beta-4B chain (28-36)
cacggcaucgaccccaccgggaccuac

SEQ ID NO: 35584 - RNA, 27 nt, Artificial Sequence
  MOB kinase activator 3A (169-177)
caccacuucgaccgcaucgcccagaug

SEQ ID NO: 35585 - RNA, 27 nt, Artificial Sequence
  Fanconi anemia group I protein (98-106)
caccacuuccccggcccgcugcucgug

SEQ ID NO: 35586 - RNA, 27 nt, Artificial Sequence
  Transcriptional repressor protein YY1 (78-86)
caccaccaccccccgaugaucgcccug

SEQ ID NO: 35587 - RNA, 27 nt, Artificial Sequence
  Myotubularin-related protein 6 (51-59)
caccacaucgccagcguggagaagcug

SEQ ID NO: 35588 - RNA, 27 nt, Artificial Sequence
  Kelch-like protein 6 (219-227)
caccacauccugaagagcgacgaccuc

SEQ ID NO: 35589 - RNA, 30 nt, Artificial Sequence
  Squalene synthase (268-277)
caccacauccccgacgugaucaccuaccug

SEQ ID NO: 35590 - RNA, 24 nt, Artificial Sequence
  N-alpha-acetyltransferase 38, NatC auxiliary subunit (107-114)
caccacaucgugagcaucgagguc

SEQ ID NO: 35591 - RNA, 30 nt, Artificial Sequence
  Fructose-bisphosphate aldolase A (220-229)
caccacaucuaccuggagggcacccuccug

SEQ ID NO: 35592 - RNA, 27 nt, Artificial Sequence
  Signal recognition particle 54 kDa protein (472-480)
caccacaugggcgggauggccggccug

SEQ ID NO: 35593 - RNA, 30 nt, Artificial Sequence
  U1 small nuclear ribonucleoprotein A (155-164)
caccacaugcccggccagccgcccuacaug

SEQ ID NO: 35594 - RNA, 24 nt, Artificial Sequence
  DNA topoisomerase 2-alpha (558-565)
caccacaacuggcccagccugcuc

SEQ ID NO: 35595 - RNA, 27 nt, Artificial Sequence
  Ubiquitin-associated protein 2-like (890-898)
caccacaccacccagcagacguuccug

SEQ ID NO: 35596 - RNA, 30 nt, Artificial Sequence
  Dedicator of cytokinesis protein 2 (573-582)
caccacguggagaacaagggcgccacccug

SEQ ID NO: 35597 - RNA, 27 nt, Artificial Sequence
  Oxidative stress-induced growth inhibitor 2 (114-122)
caccacuacaucccccacgugguccug

SEQ ID NO: 35598 - RNA, 30 nt, Artificial Sequence
  60S ribosomal protein L30 (72-81)
caccacuacagcggcaacaacaucgagcug

SEQ ID NO: 35599 - RNA, 27 nt, Artificial Sequence
  Ribosomal L1 domain-containing protein 1 (227-235)
cacaucaucgagaacaucguggccguc

SEQ ID NO: 35600 - RNA, 27 nt, Artificial Sequence
  E3 ubiquitin-protein ligase TRIM11 (224-232)
caccuggccgagcucaucgccgagcug

SEQ ID NO: 35601 - RNA, 27 nt, Artificial Sequence
  Probable E3 ubiquitin-protein ligase HERC1 (1903-1911)
caccugggcgacuuccucguguuccug

SEQ ID NO: 35602 - RNA, 27 nt, Artificial Sequence
  Talin-1 (1711-1719)
caccugaucgagccccucgccaacgcc

SEQ ID NO: 35603 - RNA, 27 nt, Artificial Sequence
  Transmembrane protein 41B (196-204)
caccugaucaacuacaucaucuuccuc

SEQ ID NO: 35604 - RNA, 27 nt, Artificial Sequence
  tRNA-specific adenosine deaminase 1 (169-177)
caccugcucgaggagcccaucuaccug

SEQ ID NO: 35605 - RNA, 27 nt, Artificial Sequence
  Nuclear pore complex protein Nup205 (808-816)
caccugcucaacgagagccccaugcug

SEQ ID NO: 35606 - RNA, 30 nt, Artificial Sequence
  Activating transcription factor 7-interacting protein 1 (1036-1045)
caccugcuccccaccgccccgaccacggug

SEQ ID NO: 35607 - RNA, 27 nt, Artificial Sequence
  Ras GTPase-activating-like protein IQGAP1 (1247-1255)
caccugagcaucaucaacgaguaccuc

SEQ ID NO: 35608 - RNA, 27 nt, Artificial Sequence
  Nucleoprotein TPR (907-915)
caccugagcaacauggaggugcagguc

SEQ ID NO: 35609 - RNA, 27 nt, Artificial Sequence
  Next to BRCA1 gene 1 protein (330-338)
caccuguggaacagcauccacggccuc

SEQ ID NO: 35610 - RNA, 33 nt, Artificial Sequence
  E3 ubiquitin-protein ligase HUWE1 (111-121)
caccuguacagcuccaucgagcaccucaccacc

SEQ ID NO: 35611 - RNA, 27 nt, Artificial Sequence
  Transmembrane protein 248 (135-143)
caccuguacagcaccauccucggccac

SEQ ID NO: 35612 - RNA, 27 nt, Artificial Sequence
  E3 ubiquitin-protein ligase RNF167 (2-10)
caccccgccgccuucccgcugcccgug

SEQ ID NO: 35613 - RNA, 27 nt, Artificial Sequence
  T-complex protein 1 subunit theta (7-15)
caccccgccgccaagaugaucgugaug

SEQ ID NO: 35614 - RNA, 27 nt, Artificial Sequence
  Ras GTPase-activating protein-binding protein 1 (336-344)
caccccgacagccaccagcuguucauc

SEQ ID NO: 35615 - RNA, 33 nt, Artificial Sequence
  Sterol regulatory element-binding protein 2 (512-522)
cacccccacagcggcuccgggcgcagcgugcug

SEQ ID NO: 35616 - RNA, 27 nt, Artificial Sequence
  AP-2 complex subunit beta (191-199)
caccccaacagcaaccugcucgaccug

SEQ ID NO: 35617 - RNA, 27 nt, Artificial Sequence
  Catenin beta-1 (499-507)
caccccccgagccacuggccccugauc

SEQ ID NO: 35618 - RNA, 30 nt, Artificial Sequence
  Uncharacterized protein C20orf196 (108-117)
cacccccagccgggcagcgccaacucccug

SEQ ID NO: 35619 - RNA, 27 nt, Artificial Sequence
  Polycomb protein EED (185-193)
cacccccgcgacccgaaccugcuccug

SEQ ID NO: 35620 - RNA, 30 nt, Artificial Sequence
  Hypoxia-inducible factor 1-alpha (708-717)
cacccccgcagcccgaacgugcuguccguc

SEQ ID NO: 35621 - RNA, 27 nt, Artificial Sequence
  Exosome complex component RRP46 (111-119)
cacccccgcaccagcaucaccgugguc

SEQ ID NO: 35622 - RNA, 27 nt, Artificial Sequence
  Kelch-like protein 11 (343-351)
caccccaccagccacgugucccugcuc

SEQ ID NO: 35623 - RNA, 27 nt, Artificial Sequence
  Cytoplasmic dynein 1 heavy chain 1 (331-339)
caccgccugcuccugauccaggccuuc

SEQ ID NO: 35624 - RNA, 27 nt, Artificial Sequence
  Chromodomain-helicase-DNA-binding protein 3 (1077-1085)
caccgcgugcugaucuucagccagaug

SEQ ID NO: 35625 - RNA, 27 nt, Artificial Sequence
  Helicase SRCAP (1801-1809)
caccgcgugcugaucuucacccagaug

SEQ ID NO: 35626 - RNA, 27 nt, Artificial Sequence
  Endothelial PAS domain-containing protein 1 (15-23)
cacagcauggacaugaaguucaccuac

SEQ ID NO: 35627 - RNA, 30 nt, Artificial Sequence
  Histone-binding protein RBBP7 (375-384)
cacaccgccaagaucagcgacuucuccugg

SEQ ID NO: 35628 - RNA, 27 nt, Artificial Sequence
  Adenylyl cyclase-associated protein 1 (23-31)
cacaccagcgacaugcaccgcggcuac

SEQ ID NO: 35629 - RNA, 27 nt, Artificial Sequence
  POTE ankyrin domain family member I (78-86)
cacaccgugcccaucuacgagggcuac

SEQ ID NO: 35630 - RNA, 30 nt, Artificial Sequence
  Thioredoxin-interacting protein (164-173)
cacaccuaccuggccaacggccagaccaag

SEQ ID NO: 35631 - RNA, 27 nt, Artificial Sequence
  Activity-dependent neuroprotector homeobox protein (162-170)
cacguggccgcccccuacaucgcgaag

SEQ ID NO: 35632 - RNA, 27 nt, Artificial Sequence
  DNA-binding protein inhibitor ID-4 (93-101)
cacgugaucgacuacauccuggaccuc

SEQ ID NO: 35633 - RNA, 30 nt, Artificial Sequence
  Secernin-2 (133-142)
cacgugaucaccggccugcucgagcacuac

SEQ ID NO: 35634 - RNA, 33 nt, Artificial Sequence
  ETS-related transcription factor Elf-1 (38-48)
cacgugcccggcgccgacauccugaacagcuac

SEQ ID NO: 35635 - RNA, 30 nt, Artificial Sequence
  Cholinesterase (154-163)
cacguguacgacggcaaguuccuggcccgc

SEQ ID NO: 35636 - RNA, 27 nt, Artificial Sequence
  TCDD-inducible poly (ADP-ribose) polymerase (387-395)
cacuacauccugcacaacagcuucuuc

SEQ ID NO: 35637 - RNA, 27 nt, Artificial Sequence
  Proliferation-associated protein 2G4 (20-28)
aucgccuuccccaccagcaucuccgug

SEQ ID NO: 35638 - RNA, 27 nt, Artificial Sequence
  Growth hormone-inducible transmembrane protein (143-151)
aucgccaucagccgcacccccgugcug

SEQ ID NO: 35639 - RNA, 30 nt, Artificial Sequence
  TRPM8 channel-associated factor 1 (376-385)
aucgcccuguggcccccggugcgcgagaag

SEQ ID NO: 35640 - RNA, 27 nt, Artificial Sequence
  Kinesin-like protein KIF18B (388-396)
aucgcccgccugcccagcuccacccuc

SEQ ID NO: 35641 - RNA, 27 nt, Artificial Sequence
  Eukaryotic initiation factor 4A-II (97-105)
aucgaguucaaggagacccaggcccug

SEQ ID NO: 35642 - RNA, 33 nt, Artificial Sequence
  Casein kinase II subunit alpha (263-273)
aucgagcuggacccccgcuucaacgacauccuc

SEQ ID NO: 35643 - RNA, 27 nt, Artificial Sequence
  Methionine adenosyltransferase 2 subunit beta (82-90)
auccacgacuuccagccccacgugauc

SEQ ID NO: 35644 - RNA, 27 nt, Artificial Sequence
  Ubiquitin-like protein 5 (62-70)
auccacgacggcaugaaccuggagcuc

SEQ ID NO: 35645 - RNA, 33 nt, Artificial Sequence
  NudC domain-containing protein 1 (119-129)
auccacuucagcuccagcaccugggugacccug

SEQ ID NO: 35646 - RNA, 27 nt, Artificial Sequence
  DNA topoisomerase 2-alpha (557-565)
auccaccacaacuggcccagccugcuc

SEQ ID NO: 35647 - RNA, 30 nt, Artificial Sequence
  Probable ATP-dependent RNA helicase DDX5 (298-307)
auccacaucaacaucggcgcccuggagcuc

SEQ ID NO: 35648 - RNA, 27 nt, Artificial Sequence
  Nucleolar protein 58 (107-115)
auccacagccccguggucaacgagcug

SEQ ID NO: 35649 - RNA, 27 nt, Artificial Sequence
  ATPase family AAA domain-containing protein 2B (521-529)
auccacagcuccaucgugagcacccug

SEQ ID NO: 35650 - RNA, 27 nt, Artificial Sequence
  RNA polymerase II-associated protein 3 (126-134)
auccacguggacagccagaaggcccug

SEQ ID NO: 35651 - RNA, 27 nt, Artificial Sequence
  Cytochrome c oxidase subunit 1 (311-319)
aucaucgccauccccaccggcgugaag

SEQ ID NO: 35652 - RNA, 27 nt, Artificial Sequence
  40S ribosomal protein S7 (59-67)
aucaucuucgugcccgucccgcagcug

SEQ ID NO: 35653 - RNA, 27 nt, Artificial Sequence
  Zinc fingers and homeoboxes protein 3 (566-574)
aucaucaucgacagcgugcccgagguc

SEQ ID NO: 35654 - RNA, 27 nt, Artificial Sequence
  Dedicator of cytokinesis protein 7 (1109-1117)
aucaucauggagaccgugccccagcug

SEQ ID NO: 35655 - RNA, 27 nt, Artificial Sequence
  Ras GTPase-activating-like protein IQGAP1 (1302-1310)
aucaucaacacccacacccugcuccug

SEQ ID NO: 35656 - RNA, 27 nt, Artificial Sequence
  Intron-binding protein aquarius (273-281)
auccuggacgacagccaccuccuggug

SEQ ID NO: 35657 - RNA, 27 nt, Artificial Sequence
  Coatomer subunit zeta-1 (5-13)
auccuggagcccagccucuacaccgug

SEQ ID NO: 35658 - RNA, 30 nt, Artificial Sequence
  Methylmalonyl-CoA mutase, mitochondrial (172-181)
auccuguucgacggcaucccccucgagaag

SEQ ID NO: 35659 - RNA, 27 nt, Artificial Sequence
  Asparagine synthetase (glutamine-hydrolyzing) (154-162)
auccuguucaacaacgccgugaagaag

SEQ ID NO: 35660 - RNA, 27 nt, Artificial Sequence
  Protein SCAF8 (920-928)
auccugggcauccagcccccgagcgug

SEQ ID NO: 35661 - RNA, 27 nt, Artificial Sequence
  CREB-binding protein (26-34)
auccugaucggcuaccucgaguacgug

SEQ ID NO: 35662 - RNA, 27 nt, Artificial Sequence
  Protein RRNAD1 (424-432)
auccugcucgaccgccugcuguaccuc

SEQ ID NO: 35663 - RNA, 24 nt, Artificial Sequence
  MAU2 chromatid cohesion factor homolog (246-253)
auccugcucgagcacaucaucaug

SEQ ID NO: 35664 - RNA, 27 nt, Artificial Sequence
  Phospholipase A-2-activating protein (517-525)
auccugcucgagaagauccugagccug

SEQ ID NO: 35665 - RNA, 27 nt, Artificial Sequence
  Serine-protein kinase ATM (144-152)
auccugcucaaggacauccugagcgug

SEQ ID NO: 35666 - RNA, 27 nt, Artificial Sequence
  Glycerol-3-phosphate acyltransferase 3 (22-30)
auccugcuccccagcguguucggcguc

SEQ ID NO: 35667 - RNA, 27 nt, Artificial Sequence
  Protein FAM122B (239-247)
auccugauggacgaccucagccccaag

SEQ ID NO: 35668 - RNA, 30 nt, Artificial Sequence
  DNA (cytosine-5)-methyltransferase 1 (382-391)
auccugauggaccccagcccggaguacgcc

SEQ ID NO: 35669 - RNA, 27 nt, Artificial Sequence
  A-kinase anchor protein 8-like (529-537)
auccugaacaacaagcucaucagcaag

SEQ ID NO: 35670 - RNA, 27 nt, Artificial Sequence
  Protein TASOR (898-906)
auccugaaccccgagguggucaccgug

SEQ ID NO: 35671 - RNA, 30 nt, Artificial Sequence
  Anaphase-promoting complex subunit 1 (57-66)
auccugagcaaggacggcgugcucuacguc

SEQ ID NO: 35672 - RNA, 27 nt, Artificial Sequence
  Uncharacterized protein KIAA1109 (858-866)
auccugagcccccucaacguguucguc

SEQ ID NO: 35673 - RNA, 27 nt, Artificial Sequence
  General vesicular transport factor p115 (329-337)
auccugaccgagaccaucaacacggug

SEQ ID NO: 35674 - RNA, 27 nt, Artificial Sequence
  ORM1-like protein 2 (28-36)
auccuggugggccuccugcacaugguc

SEQ ID NO: 35675 - RNA, 27 nt, Artificial Sequence
  Fibronectin type III domain-containing protein 3B (1072-1080)
auccugugggagaccgugcccagcaug

SEQ ID NO: 35676 - RNA, 30 nt, Artificial Sequence
  Phenylalanine-tRNA ligase, mitochondrial (215-224)
auccuguacgacauccccgacauccgccuc

SEQ ID NO: 35677 - RNA, 27 nt, Artificial Sequence
  Serine/threonine-protein phosphatase 2B catalytic subunit alpha isoform (138-146)
auccuguaccccaagacccucuuccug

SEQ ID NO: 35678 - RNA, 27 nt, Artificial Sequence
  Serine/threonine-protein phosphatase 2B catalytic subunit beta isoform (165-173)
auccuguaccccagcacccucuuccug

SEQ ID NO: 35679 - RNA, 27 nt, Artificial Sequence
  Proteasome activator complex subunit 4 (38-46)
auccuguacagcaagaccgagcaccuc

SEQ ID NO: 35680 - RNA, 27 nt, Artificial Sequence
  Vigilin (627-635)
auccccgccaagcugcacaacagccuc

SEQ ID NO: 35681 - RNA, 27 nt, Artificial Sequence
  Thioredoxin domain-containing protein 11 (92-100)
auccccgccaagccgcccgugagcuuc

SEQ ID NO: 35682 - RNA, 27 nt, Artificial Sequence
  RNA-binding protein 12B (28-36)
auccccgacggcggggugcacaucauc

SEQ ID NO: 35683 - RNA, 27 nt, Artificial Sequence
  Bifunctional glutamate/proline-tRNA ligase (709-717)
auccccgacggccacaccaaggagaug

SEQ ID NO: 35684 - RNA, 27 nt, Artificial Sequence
  Plectin (3582-3590)
auccccgaggagcagcgcgcccagcug

SEQ ID NO: 35685 - RNA, 24 nt, Artificial Sequence
  Filamin-A (1600-1607)
auccccuucagcccguaccgcgug

SEQ ID NO: 35686 - RNA, 27 nt, Artificial Sequence
  Coatomer subunit beta' (567-575)
auccccaaggacaaccgccuguaccuc

SEQ ID NO: 35687 - RNA, 27 nt, Artificial Sequence
  Bladder cancer-associated protein (13-21)
auccccaagccgcugaaccccgcccuc

SEQ ID NO: 35688 - RNA, 27 nt, Artificial Sequence
  Integrin beta-1 (92-100)
auccccaagagcgccgugggcacccug

SEQ ID NO: 35689 - RNA, 30 nt, Artificial Sequence
  Sodium/potassium-transporting ATPase subunit alpha-1 (601-610)
aucccccugccgcucggcaccgugaccauc

SEQ ID NO: 35690 - RNA, 27 nt, Artificial Sequence
  Tubulin beta chain (365-373)
auccccaacaacgugaagaccgccguc

SEQ ID NO: 35691 - RNA, 27 nt, Artificial Sequence
  Membrane cofactor protein (71-79)
auccccccgcuggccacccacaccauc

SEQ ID NO: 35692 - RNA, 24 nt, Artificial Sequence
  Chromodomain-helicase-DNA-binding protein 4 (1903-1910)
auccccccgguggccguccgccug

SEQ ID NO: 35693 - RNA, 30 nt, Artificial Sequence
  V-type proton ATPase catalytic subunit A (118-127)
aucccccgcggcgugaacgucagcgcccug

SEQ ID NO: 35694 - RNA, 27 nt, Artificial Sequence
  Ubiquitin-associated domain-containing protein 2 (32-40)
aucccccgcgugcaggucgcccagauc

SEQ ID NO: 35695 - RNA, 27 nt, Artificial Sequence
  Probable ubiquitin carboxyl-terminal hydrolase FAF-X (1578-1586)
auccccagcauccgcaacggcauccug

SEQ ID NO: 35696 - RNA, 27 nt, Artificial Sequence
  Patatin-like phospholipase domain-containing protein 2 (212-220)
auccaguucaaccugcgcaaccucuac

SEQ ID NO: 35697 - RNA, 27 nt, Artificial Sequence
  Hypoxia-inducible factor 1-alpha (370-378)
auccagcacgaccugaucuucagccuc

SEQ ID NO: 35698 - RNA, 27 nt, Artificial Sequence
  AN1-type zinc finger protein 5 (198-206)
auccgcaaggagaaccccguggucgug

SEQ ID NO: 35699 - RNA, 27 nt, Artificial Sequence
  Plectin (3944-3952)
auccgccccggcaccgccuucgagcug

SEQ ID NO: 35700 - RNA, 27 nt, Artificial Sequence
  Nuclear factor of activated T-cells, cytoplasmic 2 (431-439)
auccgcacccccgugaaggucaacuuc

SEQ ID NO: 35701 - RNA, 27 nt, Artificial Sequence
  Cytospin-A (888-896)
aucagcggccccaucuccaccagcaag

SEQ ID NO: 35702 - RNA, 33 nt, Artificial Sequence
  Endothelin-converting enzyme 1 (719-729)
aucaccgacccccacagcccgucccgcuuccgg

SEQ ID NO: 35703 - RNA, 27 nt, Artificial Sequence
  TRAF2 and NCK-interacting protein kinase (425-433)
aucaccaaggacgugguccugcagugg

SEQ ID NO: 35704 - RNA, 30 nt, Artificial Sequence
  Heat shock protein HSP 90-alpha (91-100)
aucguggacaccggcaucgggaugaccaag

SEQ ID NO: 35705 - RNA, 27 nt, Artificial Sequence
  Smith-Magenis syndrome chromosomal region candidate gene 8 protein (742-750)
aucgugcgcaagcuggucaccgcccuc

SEQ ID NO: 35706 - RNA, 30 nt, Artificial Sequence
  Actin, cytoplasmic 2 (75-84)
aucgugaccaacugggacgacauggagaag

SEQ ID NO: 35707 - RNA, 27 nt, Artificial Sequence
  Importin subunit alpha-5 (492-500)
aucuaccagaaggccuucgaccugauc

SEQ ID NO: 35708 - RNA, 30 nt, Artificial Sequence
  Krueppel-like factor 3 (37-46)
aucuacagcaccccccugccggagaaguuc

SEQ ID NO: 35709 - RNA, 27 nt, Artificial Sequence
  Butyrophilin subfamily 3 member A3 secreted isoform (315-323)
aucuacaccuucccccacgccagcuuc

SEQ ID NO: 35710 - RNA, 27 nt, Artificial Sequence
  Probable C-mannosyltransferase DPY19L1 (119-127)
aucuacaccaagaucauggaccugauc

SEQ ID NO: 35711 - RNA, 27 nt, Artificial Sequence
  Basic leucine zipper and W2 domain-containing protein 2 (358-366)
aaggccuuccagaagaucgugguccug

SEQ ID NO: 35712 - RNA, 27 nt, Artificial Sequence
  Structural maintenance of chromosomes protein 1A (1026-1034)
aaggccauggagaagcuggagagcgug

SEQ ID NO: 35713 - RNA, 27 nt, Artificial Sequence
  Histone H2B type 1-K (58-66)
aaggccaugggcaucaugaacagcuuc

SEQ ID NO: 35714 - RNA, 27 nt, Artificial Sequence
  Replication protein A 70 kDa DNA-binding subunit (157-165)
aaggccuacggcgccagcaagaccuuc

SEQ ID NO: 35715 - RNA, 27 nt, Artificial Sequence
  Protein arginine N-methyltransferase 3 (98-106)
aaggaggaguaccugaagcccgugcuc

SEQ ID NO: 35716 - RNA, 33 nt, Artificial Sequence
  Heat shock protein HSP 90-alpha (656-666)
aaggaguucgagggcaagacccuggugagcguc

SEQ ID NO: 35717 - RNA, 30 nt, Artificial Sequence
  Nuclear autoantigenic sperm protein (298-307)
aaggagaucgaggagcugaaggagcuccug

SEQ ID NO: 35718 - RNA, 30 nt, Artificial Sequence
  Nucleoporin GLE1 (442-451)
aaggagaucuucgacaagauccacagccug

SEQ ID NO: 35719 - RNA, 33 nt, Artificial Sequence
  CDK5 and ABL1 enzyme substrate 1 (180-190)
aaggagaucaucggccuggaggggguggagcuc

SEQ ID NO: 35720 - RNA, 33 nt, Artificial Sequence
  40S ribosomal protein S14 (7-17)
aaggagaagaaggaggagcaggugaucagccug

SEQ ID NO: 35721 - RNA, 33 nt, Artificial Sequence
  14-3-3 protein theta (158-168)
aaggagaugcagcccacccacccgauccgccug

SEQ ID NO: 35722 - RNA, 30 nt, Artificial Sequence
  Store-operated calcium entry-associated regulatory factor (86-95)
aagggcugggacggguacgacgugcagugg

SEQ ID NO: 35723 - RNA, 27 nt, Artificial Sequence
  Midasin (3076-3084)
aagaucgcccaguuccuggagagcgug

SEQ ID NO: 35724 - RNA, 27 nt, Artificial Sequence
  Heme oxygenase 1 (149-157)
aagaucgcccagaaggcccuggaccuc

SEQ ID NO: 35725 - RNA, 27 nt, Artificial Sequence
  WD repeat-containing protein 82 (84-92)
aagaucgacgacaccauccgcuaccug

SEQ ID NO: 35726 - RNA, 33 nt, Artificial Sequence
  Cytochrome c oxidase subunit 2 (217-227)
aagaucuucgagaugggccccguguucacccug

SEQ ID NO: 35727 - RNA, 27 nt, Artificial Sequence
  Poly (ADP-ribose) polymerase 14 (1060-1068)
aagaucggcagcaucaucuuccaggug

SEQ ID NO: 35728 - RNA, 33 nt, Artificial Sequence
  KH domain-containing, RNA-binding, signal transduction-associated protein 1 (175-185)
aagauccugggcccccaggggaacaccaucaag

SEQ ID NO: 35729 - RNA, 27 nt, Artificial Sequence
  Nucleolar pre-ribosomal-associated protein 1 (278-286)
aagauccugcccgaccucaacaccgug

SEQ ID NO: 35730 - RNA, 27 nt, Artificial Sequence
  Protein SON (1565-1573)
aagauccugcccaccagcgagaccaag

SEQ ID NO: 35731 - RNA, 27 nt, Artificial Sequence
  Phosphatidylinositol 4-phosphate 5-kinase type-1 beta (263-271)
aagaucauggacuacagccugcuccug

SEQ ID NO: 35732 - RNA, 30 nt, Artificial Sequence
  Heat shock protein HSP 90-alpha (389-398)
aagaucaugaaggacauccuggagaagaag

SEQ ID NO: 35733 - RNA, 27 nt, Artificial Sequence
  Mitotic checkpoint serine/threonine-protein kinase BUB1 beta (908-916)
aagaucguggacuucagcuacuccguc

SEQ ID NO: 35734 - RNA, 27 nt, Artificial Sequence
  Tripeptidyl-peptidase 2 (81-89)
aagaucugggaccccgugcaccgcguc

SEQ ID NO: 35735 - RNA, 33 nt, Artificial Sequence
  Cyclin-dependent kinase 16 (375-385)
aagcuggccgacuucggccucgcccgcgcgaag

SEQ ID NO: 35736 - RNA, 30 nt, Artificial Sequence
  Probable RNA-binding protein 23 (357-366)
aagcuggccgagggcgccgggauccagcuc

SEQ ID NO: 35737 - RNA, 30 nt, Artificial Sequence
  SAP domain-containing ribonucleoprotein (19-28)
aagcuggccgagcucaagcaggagugccug

SEQ ID NO: 35738 - RNA, 27 nt, Artificial Sequence
  LIM and senescent cell antigen-like-containing domain protein 1 (317-325)
aagcuggccgagacccucggccgcaag

SEQ ID NO: 35739 - RNA, 27 nt, Artificial Sequence
  Protein NDRG1 (209-217)
aagcuggaccccaccaagaccacgcuc

SEQ ID NO: 35740 - RNA, 33 nt, Artificial Sequence
  SEC14-like protein 1 (60-70)
aagcuggacguggacgccccccgccuccugaag

SEQ ID NO: 35741 - RNA, 27 nt, Artificial Sequence
  B-cell receptor-associated protein 31 (167-175)
aagcuggacgugggcaacgccgagguc

SEQ ID NO: 35742 - RNA, 27 nt, Artificial Sequence
  WAS protein family homolog 1 (210-218)
aagcuguucgacgccccccucagcauc

SEQ ID NO: 35743 - RNA, 33 nt, Artificial Sequence
  Putative WAS protein family homolog 3 (208-218)
aagcuguucgacgccccccucagcaucuccaag

SEQ ID NO: 35744 - RNA, 30 nt, Artificial Sequence
  Oxysterol-binding protein-related protein 9 (138-147)
aagcuguucgacgacaagcuccagaacugc

SEQ ID NO: 35745 - RNA, 30 nt, Artificial Sequence
  FACT complex subunit SSRP1 (413-422)
aagcuguucgacuucgugaacgccaagaag

SEQ ID NO: 35746 - RNA, 36 nt, Artificial Sequence
  Eukaryotic translation initiation factor 3 subunit I (213-224)
aagcuguucgacagcaccacccucgagcaccagaag

SEQ ID NO: 35747 - RNA, 27 nt, Artificial Sequence
  Interferon regulatory factor 4 (356-364)
aagcuguucgacacccagcaguuccuc

SEQ ID NO: 35748 - RNA, 27 nt, Artificial Sequence
  Protein transport protein Sec61 subunit alpha isoform 2 (95-103)
aagcuguucggcaugaucaucaccauc

SEQ ID NO: 35749 - RNA, 27 nt, Artificial Sequence
  Vacuolar fusion protein CCZ1 homolog (146-154)
aagcuguucaacggcaccuuccucaag

SEQ ID NO: 35750 - RNA, 27 nt, Artificial Sequence
  Iron-responsive element-binding protein 2 (746-754)
aagcuguucaacaaguucaucggcaag

SEQ ID NO: 35751 - RNA, 30 nt, Artificial Sequence
  Interleukin enhancer-binding factor 3 (591-600)
aagcuguuccccgacaccccgcucgcccug

SEQ ID NO: 35752 - RNA, 27 nt, Artificial Sequence
  DNA-directed DNA/RNA polymerase mu (238-246)
aagcuguucacccagaucuucggcgug

SEQ ID NO: 35753 - RNA, 33 nt, Artificial Sequence
  Serine/threonine-protein phosphatase 2A 65 kDa regulatory subunit A alpha isoform (188-198)
aagcugggcgaguucgccaaggugcucgagcug

SEQ ID NO: 35754 - RNA, 27 nt, Artificial Sequence
  ADP-ribosylation factor 5 (38-46)
aagcugggcgagaucgugaccaccauc

SEQ ID NO: 35755 - RNA, 24 nt, Artificial Sequence
  Ras GTPase-activating-like protein IQGAP2 (158-165)
aagcugggcaucgccccccagauc

SEQ ID NO: 35756 - RNA, 27 nt, Artificial Sequence
  Actin-like protein 6A (337-345)
aagcugaucgccaacaacaccaccgug

SEQ ID NO: 35757 - RNA, 33 nt, Artificial Sequence
  Serine/threonine-protein kinase pim-2 (179-189)
aagcugaucgacuucggcagcggggcccuccug

SEQ ID NO: 35758 - RNA, 36 nt, Artificial Sequence
  Serine/threonine-protein kinase pim-1 (274-285)
aagcugaucgacuucggcagcggggcccuccugaag

SEQ ID NO: 35759 - RNA, 27 nt, Artificial Sequence
  Dedicator of cytokinesis protein 4 (165-173)
aagcugaucgacaagcucgacagccug

SEQ ID NO: 35760 - RNA, 27 nt, Artificial Sequence
  Protein furry homolog (375-383)
aagcugaucggccaggugcacgagguc

SEQ ID NO: 35761 - RNA, 27 nt, Artificial Sequence
  Nodal modulator 3 (764-772)
aagcugaucccccuccugcugcagcuc

SEQ ID NO: 35762 - RNA, 30 nt, Artificial Sequence
  Nucleolar pre-ribosomal-associated protein 1 (172-181)
aagcugauccagcuccccguggucuacgug

SEQ ID NO: 35763 - RNA, 27 nt, Artificial Sequence
  Telomere-associated protein RIF1 (232-240)
aagcugaucagcgagcuccagaagcug

SEQ ID NO: 35764 - RNA, 30 nt, Artificial Sequence
  26S protease regulatory subunit 6A (109-118)
aagcugaagcccggcgaccucguggggguc

SEQ ID NO: 35765 - RNA, 33 nt, Artificial Sequence
  Ras association domain-containing protein 1 (139-149)
aagcugcucgacgacgagcagccccugcgccug

SEQ ID NO: 35766 - RNA, 27 nt, Artificial Sequence
  Cytochrome P450 2J2 (182-190)
aagcugcucgacgaggugaccuaccug

SEQ ID NO: 35767 - RNA, 30 nt, Artificial Sequence
  Phosphopantothenoylcysteine decarboxylase (39-48)
aagcugcucgacauccccggccuggaggug

SEQ ID NO: 35768 - RNA, 30 nt, Artificial Sequence
  Protein scribble homolog (779-788)
aagcugcucgaggugaacggcgucgcccug

SEQ ID NO: 35769 - RNA, 27 nt, Artificial Sequence
  Integrator complex subunit 4-like protein 2 isoform X2 (94-102)
aagcugcucggcagcauggagcaggug

SEQ ID NO: 35770 - RNA, 27 nt, Artificial Sequence
  Nucleolar pre-ribosomal-associated protein 1 (170-178)
aagcugcucaacaagaucuacgaggcc

SEQ ID NO: 35771 - RNA, 27 nt, Artificial Sequence
  Acidic leucine-rich nuclear phosphoprotein 32 family member A (137-145)
aagcugcucccccagcugaccuaccug

SEQ ID NO: 35772 - RNA, 27 nt, Artificial Sequence
  Proheparin-binding EGF-like growth factor (2-10)
aagcugcuccccagcgugguccugaag

SEQ ID NO: 35773 - RNA, 30 nt, Artificial Sequence
  Transmembrane protein 43 (13-22)
aagcugcucagcgaccccaacuacggcgug

SEQ ID NO: 35774 - RNA, 27 nt, Artificial Sequence
  Ubiquitin carboxyl-terminal hydrolase 48 (231-239)
aagcugcucagcaaguucuacgagcug

SEQ ID NO: 35775 - RNA, 33 nt, Artificial Sequence
  Cytosolic acyl coenzyme A thioester hydrolase (210-220)
aagcugauggacgagguggccggcaucgucgcc

SEQ ID NO: 35776 - RNA, 27 nt, Artificial Sequence
  N-alpha-acetyltransferase 20 (79-87)
aagcugauggagcuccuggaggagauc

SEQ ID NO: 35777 - RNA, 27 nt, Artificial Sequence
  Transcription intermediary factor 1-alpha (341-349)
aagcugaugcagcagcagcaggaggug

SEQ ID NO: 35778 - RNA, 27 nt, Artificial Sequence
  Cohesin subunit SA-1 (228-236)
aagcugaugaccgcccucgugaacguc

SEQ ID NO: 35779 - RNA, 27 nt, Artificial Sequence
  Proteasome subunit alpha type-5 (151-159)
aagcugaacgccaccaacaucgagcuc

SEQ ID NO: 35780 - RNA, 27 nt, Artificial Sequence
  Myomegalin (424-432)
aagcugaacgagaugagcuacgagcuc

SEQ ID NO: 35781 - RNA, 27 nt, Artificial Sequence
  Twinfilin-1 (192-200)
aagcugaacaaccgccagcucaacuac

SEQ ID NO: 35782 - RNA, 30 nt, Artificial Sequence
  Stromal interaction molecule 1 (571-580)
aagcugcccgacagcccggcccucgccaag

SEQ ID NO: 35783 - RNA, 27 nt, Artificial Sequence
  Probable U3 small nucleolar RNA-associated protein 11 (5-13)
aagcugcaggacggcgugcacaucauc

SEQ ID NO: 35784 - RNA, 27 nt, Artificial Sequence
  Hyaluronan mediated motility receptor (672-680)
aagcugcaggaggagcucaacaaggug

SEQ ID NO: 35785 - RNA, 27 nt, Artificial Sequence
  Centromere-associated protein E (1817-1825)
aagcugcaggagaagauccaggagcuc

SEQ ID NO: 35786 - RNA, 27 nt, Artificial Sequence
  Zinc finger C3H1 domain-containing protein (891-899)
aagcugcaggagcagauccaccgcgug

SEQ ID NO: 35787 - RNA, 30 nt, Artificial Sequence
  Transmembrane protein 131 (929-938)
aagcugcgcgagcccaacuucacccucaag

SEQ ID NO: 35788 - RNA, 27 nt, Artificial Sequence
  EF-hand domain-containing protein D1 (174-182)
aagcugagcgagaucgacguggcccuc

SEQ ID NO: 35789 - RNA, 27 nt, Artificial Sequence
  Keratin, type II cytoskeletal 8 (148-156)
aagcugagcgagcucgaggccgcccug

SEQ ID NO: 35790 - RNA, 27 nt, Artificial Sequence
  78 kDa glucose-regulated protein (2-10)
aagcugagccucguggccgccaugcug

SEQ ID NO: 35791 - RNA, 27 nt, Artificial Sequence
  Retrotransposon-derived protein PEG10 (112-120)
aagcugaccgaggagaacaccacgcuc

SEQ ID NO: 35792 - RNA, 27 nt, Artificial Sequence
  Zinc finger MYM-type protein 2 (166-174)
aagcugaccgagauccgccacgaggug

SEQ ID NO: 35793 - RNA, 30 nt, Artificial Sequence
  Cyclin-dependent kinase 2 (24-33)
aagcugaccggcgagguggucgcccucaag

SEQ ID NO: 35794 - RNA, 30 nt, Artificial Sequence
  Transforming acidic coiled-coil-containing protein 3 (599-608)
aagcugguggaguucgacuuccucggcgcc

SEQ ID NO: 35795 - RNA, 27 nt, Artificial Sequence
  Adenylyl cyclase-associated protein 1 (465-473)
aagcuggugaccaccgucacggagauc

SEQ ID NO: 35796 - RNA, 27 nt, Artificial Sequence
  Inactive hydroxysteroid dehydrogenase-like protein 1 (148-156)
aagcugugggacaucaucaacgugaac

SEQ ID NO: 35797 - RNA, 27 nt, Artificial Sequence
  UBX domain-containing protein 11 (82-90)
aagcugugggaccucgagcagcaggug

SEQ ID NO: 35798 - RNA, 27 nt, Artificial Sequence
  Pecanex-like protein 3 (1234-1242)
aagcugugggaccuccuguacaagcug

SEQ ID NO: 35799 - RNA, 27 nt, Artificial Sequence
  MORF4 family-associated protein 1-like 1 (56-64)
aagcugugggagauggacaacaugcuc

SEQ ID NO: 35800 - RNA, 30 nt, Artificial Sequence
  MORF4 family-associated protein 1-like 1 (56-65)
aagcugugggagauggacaacaugcucauc

SEQ ID NO: 35801 - RNA, 33 nt, Artificial Sequence
  MORF4 family-associated protein 1-like 1 (56-66)
aagcugugggagauggacaacaugcucauccag

SEQ ID NO: 35802 - RNA, 27 nt, Artificial Sequence
  Rho guanine nucleotide exchange factor 3 (108-116)
aagcuguggagcgagaccuucgacgug

SEQ ID NO: 35803 - RNA, 27 nt, Artificial Sequence
  ADP-ribosylation factor-like protein 4C (157-165)
aagcuguacgagaugauccucaagcgc

SEQ ID NO: 35804 - RNA, 27 nt, Artificial Sequence
  Splicing factor 3B subunit 4 (78-86)
aagcuguacggcaagcccauccgcgug

SEQ ID NO: 35805 - RNA, 27 nt, Artificial Sequence
  Tuberin (574-582)
aagcuguacacccuccccgccagccac

SEQ ID NO: 35806 - RNA, 33 nt, Artificial Sequence
  E3 ubiquitin-protein ligase BRE1A (694-704)
aagauggccgacgaggacgcccugcgcaagauc

SEQ ID NO: 35807 - RNA, 27 nt, Artificial Sequence
  Melanoma-associated antigen 12 (112-120)
aagauggccgagcuggugcacuuccuc

SEQ ID NO: 35808 - RNA, 33 nt, Artificial Sequence
  Ribosome biogenesis protein BOP1 (115-125)
aagauggacgaccccgacuacuggcgcaccgug

SEQ ID NO: 35809 - RNA, 27 nt, Artificial Sequence
  Talin-1 (535-543)
aagauggacgagagcaagcacgagauc

SEQ ID NO: 35810 - RNA, 27 nt, Artificial Sequence
  KDEL motif-containing protein 2 (215-223)
aagauguucagcgacgagauccugcuc

SEQ ID NO: 35811 - RNA, 30 nt, Artificial Sequence
  Structural maintenance of chromosomes protein 5 (378-387)
aagaugaucgaggaccugcagaacgagcuc

SEQ ID NO: 35812 - RNA, 36 nt, Artificial Sequence
  UPF0428 protein CXorf56 (70-81)
aagaugaagggcacccugaucgacaaccaguucaag

SEQ ID NO: 35813 - RNA, 33 nt, Artificial Sequence
  Tropomodulin-3 (307-317)
aagaugcuggaggagaacaccaacauccucaag

SEQ ID NO: 35814 - RNA, 27 nt, Artificial Sequence
  HEAT repeat-containing protein 1 (682-690)
aagaugguggaggaccugaucagcguc

SEQ ID NO: 35815 - RNA, 27 nt, Artificial Sequence
  cAMP-dependent protein kinase type I-beta regulatory subunit (244-252)
aagauguacgaggaguuccugagcaag

SEQ ID NO: 35816 - RNA, 30 nt, Artificial Sequence
  La-related protein 4B (374-383)
aagcccgccgccagcccgcugaccucccuc

SEQ ID NO: 35817 - RNA, 27 nt, Artificial Sequence
  Myosin-9 (517-525)
aagcccgccggcccgcccgggauccug

SEQ ID NO: 35818 - RNA, 27 nt, Artificial Sequence
  Serine/threonine-protein kinase Nek6 (199-207)
aagcccgccaacguguucaucaccgcc

SEQ ID NO: 35819 - RNA, 27 nt, Artificial Sequence
  Acid ceramidase (209-217)
aagcccggccuguucagccucacccug

SEQ ID NO: 35820 - RNA, 27 nt, Artificial Sequence
  BAG family molecular chaperone regulator 3 (324-332)
aagcccggcccgguggggcccgagcug

SEQ ID NO: 35821 - RNA, 27 nt, Artificial Sequence
  Proteasome assembly chaperone 1 (230-238)
aagcccauccugagcacccgcucccuc

SEQ ID NO: 35822 - RNA, 30 nt, Artificial Sequence
  Radixin (3-12)
aagcccaucaacgugcgcgucaccaccaug

SEQ ID NO: 35823 - RNA, 27 nt, Artificial Sequence
  Retinoblastoma-binding protein 5 (324-332)
aagcccaagaccaccaacaucgagcug

SEQ ID NO: 35824 - RNA, 27 nt, Artificial Sequence
  Transketolase (451-459)
aagccccuggaccgcaagcucauccug

SEQ ID NO: 35825 - RNA, 27 nt, Artificial Sequence
  Forkhead box protein N2 (170-178)
aagccccugccgcucaagaccgcccug

SEQ ID NO: 35826 - RNA, 33 nt, Artificial Sequence
  Galectin-3 (139-149)
aagcccaacgccaaccgcaucgcccuggacuuc

SEQ ID NO: 35827 - RNA, 27 nt, Artificial Sequence
  Catenin beta-1 (666-674)
aagccccaggacuacaagaagcgccug

SEQ ID NO: 35828 - RNA, 33 nt, Artificial Sequence
  Catenin beta-1 (666-676)
aagccccaggacuacaagaagcgccugagcgug

SEQ ID NO: 35829 - RNA, 27 nt, Artificial Sequence
  Serine/threonine-protein kinase tousled-like 2 (155-163)
aagccccgccuggacaccgagcagcuc

SEQ ID NO: 35830 - RNA, 27 nt, Artificial Sequence
  Retrotransposon-derived protein PEG10 (325-333)
aagccccgcagcccgccccgggcccug

SEQ ID NO: 35831 - RNA, 33 nt, Artificial Sequence
  Retrotransposon-derived protein PEG10 (325-335)
aagccccgcagcccgccccgggcccuggugcuc

SEQ ID NO: 35832 - RNA, 27 nt, Artificial Sequence
  rRNA-processing protein UTP23 homolog (149-157)
aagcccagcccgaagaccaucgccuuc

SEQ ID NO: 35833 - RNA, 27 nt, Artificial Sequence
  60S ribosomal protein L13a (130-138)
aagcccacccgcaaguucgccuaccug

SEQ ID NO: 35834 - RNA, 30 nt, Artificial Sequence
  U3 small nucleolar ribonucleoprotein protein IMP3 (14-23)
aagcagguggacuuccugaacugggagguc

SEQ ID NO: 35835 - RNA, 27 nt, Artificial Sequence
  Src kinase-associated phosphoprotein 2 (319-327)
aagcgcggcgacgugaucuacauccug

SEQ ID NO: 35836 - RNA, 30 nt, Artificial Sequence
  Guanylate-binding protein 4 (305-314)
aagcgccugggcacccucguggucaccuac

SEQ ID NO: 35837 - RNA, 33 nt, Artificial Sequence
  Eukaryotic translation initiation factor 4 gamma 1 (570-580)
aagcgcuacgaccgggaguuccugcucggcuuc

SEQ ID NO: 35838 - RNA, 30 nt, Artificial Sequence
  Hom s 1 (791-800)
aagagcaugaacgccaacaccaucaccaag

SEQ ID NO: 35839 - RNA, 33 nt, Artificial Sequence
  Prefoldin subunit 5 (107-117)
aagaccgccgaggacgccaaggacuucuucaag

SEQ ID NO: 35840 - RNA, 33 nt, Artificial Sequence
  Death-inducer obliterator 1 (585-595)
aagaccgcccccccgggcagcgccguggggaag

SEQ ID NO: 35841 - RNA, 27 nt, Artificial Sequence
  Volume-regulated anion channel subunit LRRC8C (100-108)
aagaccgaccuggaccuccagcaguac

SEQ ID NO: 35842 - RNA, 27 nt, Artificial Sequence
  Activating transcription factor 7-interacting protein 1 (394-402)
aagaccaucgacgccagcguguccaag

SEQ ID NO: 35843 - RNA, 30 nt, Artificial Sequence
  Arfaptin-1 (216-225)
aagaccaucgaggacacccugaugacggug

SEQ ID NO: 35844 - RNA, 36 nt, Artificial Sequence
  UPF0769 protein C21orf59 (114-125)
aagaccaucgaggaggccaaggccaucaucagcaag

SEQ ID NO: 35845 - RNA, 33 nt, Artificial Sequence
  Acyl-CoA dehydrogenase family member 9, mitochondrial (521-531)
aagaccaucauggaggagcagcuggugcucaag

SEQ ID NO: 35846 - RNA, 27 nt, Artificial Sequence
  Beta-synuclein (32-40)
aagaccaaggagggcgugcuguacguc

SEQ ID NO: 35847 - RNA, 27 nt, Artificial Sequence
  Transcriptional repressor protein YY1 (213-221)
aagacccuggagggcgaguucagcgug

SEQ ID NO: 35848 - RNA, 30 nt, Artificial Sequence
  SWI/SNF-related matrix-associated actin-dependent regulator of chromatin subfamily A member 5 (112-121)
aagacccccaccagcccgcugaagaugaag

SEQ ID NO: 35849 - RNA, 27 nt, Artificial Sequence
  Short coiled-coil protein (97-105)
aagacccgccugaucaaccaggugcuc

SEQ ID NO: 35850 - RNA, 27 nt, Artificial Sequence
  Collagen alpha-2(VI) chain (132-140)
aagacccgcguguucgccgucgugauc

SEQ ID NO: 35851 - RNA, 27 nt, Artificial Sequence
  Ubinuclein-2 (526-534)
aagaccagcgacaagccccugauguac

SEQ ID NO: 35852 - RNA, 27 nt, Artificial Sequence
  26S proteasome non-ATPase regulatory subunit 6 (126-134)
aagaccuacgacaagaccguggcccug

SEQ ID NO: 35853 - RNA, 30 nt, Artificial Sequence
  Coiled-coil domain-containing protein 14 (522-531)
aagaccuacgagaacgugcugagcucccgc

SEQ ID NO: 35854 - RNA, 30 nt, Artificial Sequence
  Heterogeneous nuclear ribonucleoprotein L-like (486-495)
aagguguucgacgccaagcccagcgccaag

SEQ ID NO: 35855 - RNA, 27 nt, Artificial Sequence
  Dihydroxyacetone phosphate acyltransferase (128-136)
aagguguucaagcagaucuucagcaag

SEQ ID NO: 35856 - RNA, 30 nt, Artificial Sequence
  Ubiquitin carboxyl-terminal hydrolase 11 (139-148)
aaggugaucgagcugcccaacauccagaag

SEQ ID NO: 35857 - RNA, 27 nt, Artificial Sequence
  Syntenin-1 (14-22)
aaggugauccaggcccagaccgccuuc

SEQ ID NO: 35858 - RNA, 27 nt, Artificial Sequence
  Plasmalemma vesicle-associated protein (164-172)
aaggugaagacccuggaggucgagauc

SEQ ID NO: 35859 - RNA, 27 nt, Artificial Sequence
  Mitofusin-2 (84-92)
aaggugcgcggcaucagcgagguccug

SEQ ID NO: 35860 - RNA, 27 nt, Artificial Sequence
  Heterogeneous nuclear ribonucleoprotein R isoform 7 (155-163)
aagguguggggcaacgucgugaccgug

SEQ ID NO: 35861 - RNA, 30 nt, Artificial Sequence
  Small integral membrane protein 20 (58-67)
aagguguggagcgaccccuucggccgcaag

SEQ ID NO: 35862 - RNA, 27 nt, Artificial Sequence
  Stromal interaction molecule 2 (478-486)
aagguguacaacggcauccuggagaag

SEQ ID NO: 35863 - RNA, 27 nt, Artificial Sequence
  Homeobox-containing protein 1 (325-333)
aagguguacaacugguucgccaaccgc

SEQ ID NO: 35864 - RNA, 27 nt, Artificial Sequence
  Threonylcarbamoyladenosine tRNA methylthiotransferase (405-413)
aagguguacacccccagcaucuccaag

SEQ ID NO: 35865 - RNA, 27 nt, Artificial Sequence
  WD repeat-containing protein 1 (65-73)
aaguacgcccccagcggcuucuacauc

SEQ ID NO: 35866 - RNA, 27 nt, Artificial Sequence
  Alpha-soluble NSF attachment protein (227-235)
aaguacgaggagcuguuccccgccuuc

SEQ ID NO: 35867 - RNA, 27 nt, Artificial Sequence
  Putative E3 ubiquitin-protein ligase UBR7 (125-133)
aaguacaacgacaacuucuucggccug

SEQ ID NO: 35868 - RNA, 27 nt, Artificial Sequence
  Rho guanine nucleotide exchange factor 1 (516-524)
aaguacccccugcuccugcagagcauc

SEQ ID NO: 35869 - RNA, 27 nt, Artificial Sequence
  Zinc finger MYND domain-containing protein 11 (415-423)
aaguacaccaagaucuucaacgacuuc

SEQ ID NO: 35870 - RNA, 24 nt, Artificial Sequence
  Transformation/transcription domain-associated protein (379-386)
cuggccgaccucgugcaccacguc

SEQ ID NO: 35871 - RNA, 24 nt, Artificial Sequence
  Ras GTPase-activating-like protein IQGAP1 (1072-1079)
cuggcccccguggucaaggagauc

SEQ ID NO: 35872 - RNA, 27 nt, Artificial Sequence
  Vimentin (124-132)
cuggagcagcagaacaagauccuccug

SEQ ID NO: 35873 - RNA, 27 nt, Artificial Sequence
  HLA class II histocompatibility antigen, DRB1-15 beta chain (48-56)
cugggccgccccgacgccgaguacugg

SEQ ID NO: 35874 - RNA, 27 nt, Artificial Sequence
  U5 small nuclear ribonucleoprotein 200 kDa helicase (620-628)
cugcacgacgaccgcggccccgugcuc

SEQ ID NO: 35875 - RNA, 24 nt, Artificial Sequence
  Elongation factor 2 (218-225)
cugcacggcugggccuucacccuc

SEQ ID NO: 35876 - RNA, 27 nt, Artificial Sequence
  Importin subunit alpha-1 (260-268)
cugcaccacgacgaccccgaggugcuc

SEQ ID NO: 35877 - RNA, 27 nt, Artificial Sequence
  Protein kinase C delta type (286-294)
cugcucgccgaggcccugaaccaggug

SEQ ID NO: 35878 - RNA, 27 nt, Artificial Sequence
  Protein sel-1 homolog 1 (580-588)
cugcucgccgagcagggcuacgaggug

SEQ ID NO: 35879 - RNA, 27 nt, Artificial Sequence
  BRCA1-associated ATM activator 1 (541-549)
cugcucgccagcgaggugccccagcug

SEQ ID NO: 35880 - RNA, 27 nt, Artificial Sequence
  15 kDa selenoprotein (21-29)
cugcucgccaccgugcugcaggccguc

SEQ ID NO: 35881 - RNA, 27 nt, Artificial Sequence
  Talin-1 (2250-2258)
cugcucgaccacgugcugcugacccuc

SEQ ID NO: 35882 - RNA, 24 nt, Artificial Sequence
  Annexin A11 (433-440)
cugcucgacauccgcagcgaguac

SEQ ID NO: 35883 - RNA, 24 nt, Artificial Sequence
  U3 small nucleolar ribonucleoprotein protein IMP3 (79-86)
cugcucgacaagcuguacgcccug

SEQ ID NO: 35884 - RNA, 27 nt, Artificial Sequence
  WD repeat-containing protein 36 (605-613)
cugcucgacagcgccccccugaacgug

SEQ ID NO: 35885 - RNA, 27 nt, Artificial Sequence
  Group XIIA secretory phospholipase A2 (158-166)
cugcucuucgacagcgugauccaccug

SEQ ID NO: 35886 - RNA, 27 nt, Artificial Sequence
  Ras-related GTP-binding protein A (204-212)
cugcucuucgagcgcgccaccuuccug

SEQ ID NO: 35887 - RNA, 27 nt, Artificial Sequence
  Transcription factor 20 (837-845)
cugcuccacgaggagaacuucagcgug

SEQ ID NO: 35888 - RNA, 27 nt, Artificial Sequence
  NADH dehydrogenase (ubiquinone) 1 alpha subcomplex subunit 1 (16-24)
cugcucauccccggccuggccaccgcc

SEQ ID NO: 35889 - RNA, 27 nt, Artificial Sequence
  ERO1-like protein alpha (260-268)
cugcuccuggagauccugcacgagauc

SEQ ID NO: 35890 - RNA, 27 nt, Artificial Sequence
  Staphylococcal nuclease domain-containing protein 1 (186-194)
cugcuccugcccgacuacuaccuggug

SEQ ID NO: 35891 - RNA, 33 nt, Artificial Sequence
  Staphylococcal nuclease domain-containing protein 1 (186-196)
cugcuccugcccgacuacuaccuggugaccguc

SEQ ID NO: 35892 - RNA, 27 nt, Artificial Sequence
  Histone H2B type 2-F (101-109)
cugcuccugcccggcgagcuggccaag

SEQ ID NO: 35893 - RNA, 27 nt, Artificial Sequence
  Clathrin heavy chain 1 (1422-1430)
cugcucauggugcugagcccccgccug

SEQ ID NO: 35894 - RNA, 27 nt, Artificial Sequence
  DNA-dependent protein kinase catalytic subunit (2454-2462)
cugcucaaccccguggucgaguucgug

SEQ ID NO: 35895 - RNA, 27 nt, Artificial Sequence
  Superkiller viralicidic activity 2-like 2 (273-281)
cugcuccccgacaacgugcacuacguc

SEQ ID NO: 35896 - RNA, 27 nt, Artificial Sequence
  Homocysteine-responsive endoplasmic reticulum-resident ubiquitin-like domain member 1 protein (222-230)
cugcuccccgagggcccgcccgccauc

SEQ ID NO: 35897 - RNA, 27 nt, Artificial Sequence
  Potassium channel subfamily K member 4 (365-373)
cugcuccccccgccccccugccccgcc

SEQ ID NO: 35898 - RNA, 27 nt, Artificial Sequence
  Casein kinase I isoform alpha (57-65)
cugcucuacgagagcaagcuguacaag

SEQ ID NO: 35899 - RNA, 27 nt, Artificial Sequence
  Syntenin-1 (290-298)
cugauggaccacaccauccccgaggug

SEQ ID NO: 35900 - RNA, 27 nt, Artificial Sequence
  Bombesin receptor-activated protein C6orf89 (120-128)
cugaugagccuccccaucgccaagaag

SEQ ID NO: 35901 - RNA, 27 nt, Artificial Sequence
  Constitutive coactivator of PPAR-gamma-like protein 1 (567-575)
cugauguaccccuacaucuuccacgug

SEQ ID NO: 35902 - RNA, 27 nt, Artificial Sequence
  Peripheral plasma membrane protein CASK (705-713)
cugcccgccuucaagcgcaagacccuc

SEQ ID NO: 35903 - RNA, 27 nt, Artificial Sequence
  Butyrophilin subfamily 3 member A3 secreted isoform (388-396)
cugcccgcccacccgggcgccgaggug

SEQ ID NO: 35904 - RNA, 27 nt, Artificial Sequence
  FERM domain-containing protein 4A (166-174)
cugcccgcccucccgacccaggcccug

SEQ ID NO: 35905 - RNA, 27 nt, Artificial Sequence
  Proline-rich protein PRCC (42-50)
cugcccgccccgaagggccccgcccuc

SEQ ID NO: 35906 - RNA, 27 nt, Artificial Sequence
  Serine/threonine-protein kinase SIK2 (446-454)
cugcccgccagcgugcacccgcagcuc

SEQ ID NO: 35907 - RNA, 33 nt, Artificial Sequence
  Host cell factor 1 (1377-1387)
cugcccgacgccaccagcucccaccgcaccgug

SEQ ID NO: 35908 - RNA, 27 nt, Artificial Sequence
  Actin-related protein 2 (246-254)
cugcccgacggccgcaucaucaaggug

SEQ ID NO: 35909 - RNA, 27 nt, Artificial Sequence
  Transducin-like enhancer protein 4 (517-525)
cugcccgacggccgcacccucaucgug

SEQ ID NO: 35910 - RNA, 33 nt, Artificial Sequence
  Biogenesis of lysosome-related organelles complex 1 subunit 6 (61-71)
cugcccgaccuccagcgcagcaagcaggcccug

SEQ ID NO: 35911 - RNA, 27 nt, Artificial Sequence
  Integrator complex subunit 11 (441-449)
cugcccgaggccaagaagccgcgccuc

SEQ ID NO: 35912 - RNA, 27 nt, Artificial Sequence
  Queuine tRNA-ribosyltransferase subunit QTRTD1 (120-128)
cugcccgaggacaagccgcgccucauc

SEQ ID NO: 35913 - RNA, 27 nt, Artificial Sequence
  Tyrosine-protein phosphatase non-receptor type 11 (283-291)
cugcccuucgaccacacccgcgugguc

SEQ ID NO: 35914 - RNA, 27 nt, Artificial Sequence
  Polypyrimidine tract-binding protein 2 (91-99)
cugcccuucggcaaggugaccaacauc

SEQ ID NO: 35915 - RNA, 27 nt, Artificial Sequence
  Nodal modulator 3 (615-623)
cugccccaccaccgcgugaucgagguc

SEQ ID NO: 35916 - RNA, 27 nt, Artificial Sequence
  RNA-binding protein 33 (711-719)
cugcccaucgccccgagccacgugauc

SEQ ID NO: 35917 - RNA, 27 nt, Artificial Sequence
  Leucine-rich repeat-containing protein 59 (38-46)
cugcccaaggccaccauccucgaccug

SEQ ID NO: 35918 - RNA, 27 nt, Artificial Sequence
  26S proteasome non-ATPase regulatory subunit 6 (11-19)
cugcccaagaacccggaccuccgcauc

SEQ ID NO: 35919 - RNA, 27 nt, Artificial Sequence
  Telomerase protein component 1 (671-679)
cugccccuccugccgggccgcaccgug

SEQ ID NO: 35920 - RNA, 27 nt, Artificial Sequence
  Transcription factor Sp3 (515-523)
cugcccaaccuccagaccgugaccguc

SEQ ID NO: 35921 - RNA, 27 nt, Artificial Sequence
  Eukaryotic initiation factor 4A-III (354-362)
cugcccaacaaccgcgagcucuacauc

SEQ ID NO: 35922 - RNA, 24 nt, Artificial Sequence
  eIF-2-alpha kinase activator GCN1 (1363-1370)
cugcccccgcucgugcccgccauc

SEQ ID NO: 35923 - RNA, 27 nt, Artificial Sequence
  E3 ubiquitin-protein ligase RNF181 (50-58)
cugcccccgcccgccgccaagaccgug

SEQ ID NO: 35924 - RNA, 27 nt, Artificial Sequence
  Mediator of RNA polymerase II transcription subunit 7 (10-18)
cugcccccgccccccaugcaguacauc

SEQ ID NO: 35925 - RNA, 27 nt, Artificial Sequence
  Crooked neck-like protein 1 (45-53)
cugcccccgcccccccagcagaagauc

SEQ ID NO: 35926 - RNA, 27 nt, Artificial Sequence
  Terminal uridylyltransferase 7 (284-292)
cugcccccgcccacccccagccagauc

SEQ ID NO: 35927 - RNA, 27 nt, Artificial Sequence
  Transcription elongation factor SPT4 (93-101)
cugccccagggcaucgugcgcgagcuc

SEQ ID NO: 35928 - RNA, 30 nt, Artificial Sequence
  Homeobox protein TGIF2 (105-114)
cugccccgcggcagcuccccgagcgugcuc

SEQ ID NO: 35929 - RNA, 27 nt, Artificial Sequence
  ATP-dependent RNA helicase DHX36 (300-308)
cugccccgcaagcagggcagcauccuc

SEQ ID NO: 35930 - RNA, 27 nt, Artificial Sequence
  Carnitine O-palmitoyltransferase 1, liver isoform (171-179)
cugccccgccucccggugcccgccguc

SEQ ID NO: 35931 - RNA, 30 nt, Artificial Sequence
  Beta-hexosaminidase subunit beta (8-17)
cugccccgcccgcccaugcuccuggcccug

SEQ ID NO: 35932 - RNA, 27 nt, Artificial Sequence
  cGMP-inhibited 3',5'-cyclic phosphodiesterase B (240-248)
cugcccagcgcccuccgcccgcugcug

SEQ ID NO: 35933 - RNA, 30 nt, Artificial Sequence
  Polymerase delta-interacting protein 3 (241-250)
cugcccagcuccauccgcaccaaggcccuc

SEQ ID NO: 35934 - RNA, 24 nt, Artificial Sequence
  Runt-related transcription factor 2 (116-123)
cugcccguggccuucaaggucgug

SEQ ID NO: 35935 - RNA, 27 nt, Artificial Sequence
  THUMP domain-containing protein 3 (124-132)
cugcccuggagcaacccgcucaaggug

SEQ ID NO: 35936 - RNA, 27 nt, Artificial Sequence
  Peptidyl-prolyl cis-trans isomerase FKBP4 (200-208)
cugcccuacggccucgagcgcgccauc

SEQ ID NO: 35937 - RNA, 24 nt, Artificial Sequence
  eIF-2-alpha kinase activator GCN1 (2077-2084)
cugcccuaccucgugccgaagcug

SEQ ID NO: 35938 - RNA, 24 nt, Artificial Sequence
  E3 ubiquitin-protein ligase UBR4 (260-267)
cugcccuaccagaucaagaagauc

SEQ ID NO: 35939 - RNA, 30 nt, Artificial Sequence
  Lysyl oxidase homolog 3 (408-417)
cugcccuacaccggcgccgagacccgcauc

SEQ ID NO: 35940 - RNA, 27 nt, Artificial Sequence
  Histone acetyltransferase KAT6B (711-719)
cugagcgaccucggccgccuguccuac

SEQ ID NO: 35941 - RNA, 27 nt, Artificial Sequence
  Phosphatidylinositide phosphatase SAC2 (667-675)
cugagccucgagaaccuggagaagauc

SEQ ID NO: 35942 - RNA, 33 nt, Artificial Sequence
  Serpin B6 (76-86)
cugaccgaggugaacaagaccggcacgcaguac

SEQ ID NO: 35943 - RNA, 30 nt, Artificial Sequence
  Heat shock-related 70 kDa protein 2 (213-222)
cugaccaucgaggacggcaucuucgaggug

SEQ ID NO: 35944 - RNA, 30 nt, Artificial Sequence
  Heat shock protein HSP 90-beta (36-45)
cugguggacaccggcaucgggaugaccaag

SEQ ID NO: 35945 - RNA, 27 nt, Artificial Sequence
  Interleukin-32 (97-105)
cuggugcacgccguccaggcccucugg

SEQ ID NO: 35946 - RNA, 27 nt, Artificial Sequence
  Protein diaphanous homolog 1 (1090-1098)
cuguacaaggagcucggcgaguacuuc

SEQ ID NO: 35947 - RNA, 27 nt, Artificial Sequence
  AKT-interacting protein (116-124)
cuguaccaggacggcguguucaaguuc

SEQ ID NO: 35948 - RNA, 24 nt, Artificial Sequence
  HLA class I histocompatibility antigen, Cw-3 alpha chain (4-11)
auggccccccgcacccugauccuc

SEQ ID NO: 35949 - RNA, 27 nt, Artificial Sequence
  Charged multivesicular body protein 2a (127-135)
auggaguucgagcgccaggccgagauc

SEQ ID NO: 35950 - RNA, 27 nt, Artificial Sequence
  Bifunctional glutamate/proline-tRNA ligase (487-495)
auggagugggacaagaucugggccuuc

SEQ ID NO: 35951 - RNA, 27 nt, Artificial Sequence
  Sodium-coupled neutral amino acid transporter 1 (2-10)
augcacuucaagagcggccuggagcuc

SEQ ID NO: 35952 - RNA, 27 nt, Artificial Sequence
  Nucleoside diphosphate kinase A (68-76)
augcacagcggccccguggucgccaug

SEQ ID NO: 35953 - RNA, 33 nt, Artificial Sequence
  Cytochrome b (53-63)
augcacuacagccccgacgccuccaccgccuuc

SEQ ID NO: 35954 - RNA, 27 nt, Artificial Sequence
  Lysosomal protective protein (1-9)
augauccgcgccgcccccccgccccug

SEQ ID NO: 35955 - RNA, 27 nt, Artificial Sequence
  78 kDa glucose-regulated protein (1-9)
augaagcugagccucguggccgccaug

SEQ ID NO: 35956 - RNA, 27 nt, Artificial Sequence
  Putative uncharacterized protein ZNF436-AS1 (1-9)
augcuggccgugcccguccgccucaag

SEQ ID NO: 35957 - RNA, 27 nt, Artificial Sequence
  Transformation/transcription domain-associated protein (1824-1832)
augcuggacagccuccgcaucuaccug

SEQ ID NO: 35958 - RNA, 33 nt, Artificial Sequence
  Ubiquitin carboxyl-terminal hydrolase 11 (568-578)
augcuguucggccacccccuccuggugagcguc

SEQ ID NO: 35959 - RNA, 24 nt, Artificial Sequence
  Beta-1-syntrophin (41-48)
augcccauccugaucagcaagauc

SEQ ID NO: 35960 - RNA, 27 nt, Artificial Sequence
  Neuroblast differentiation-associated protein AHNAK (882-890)
augcccaaguucagcaugccgggcuuc

SEQ ID NO: 35961 - RNA, 27 nt, Artificial Sequence
  Neuroblast differentiation-associated protein AHNAK (2766-2774)
augcccaagaucaagaugccgaagauc

SEQ ID NO: 35962 - RNA, 27 nt, Artificial Sequence
  Synergin gamma (422-430)
augccccugccgggcaccaaggcccuc

SEQ ID NO: 35963 - RNA, 27 nt, Artificial Sequence
  Cyclin-dependent kinase 6 (54-62)
augccccugagcaccauccgcgaggug

SEQ ID NO: 35964 - RNA, 27 nt, Artificial Sequence
  Type II inositol 3,4-bisphosphate 4-phosphatase (788-796)
augcccccggacuacaucagccacuuc

SEQ ID NO: 35965 - RNA, 27 nt, Artificial Sequence
  Double-strand-break repair protein rad21 homolog (468-476)
augcccccgccccccccccagggcgug

SEQ ID NO: 35966 - RNA, 27 nt, Artificial Sequence
  Eukaryotic initiation factor 4A-III (311-319)
augccccagaaggagcgcgagagcauc

SEQ ID NO: 35967 - RNA, 30 nt, Artificial Sequence
  Mitotic-spindle organizing protein 2A (99-108)
augccccgccagccgagcgccacccggcug

SEQ ID NO: 35968 - RNA, 27 nt, Artificial Sequence
  UDP-N-acetylglucosamine-peptide N-acetylglucosaminyltransferase 110 kDa subunit (774-782)
augcccgugaucccgaugaacaccauc

SEQ ID NO: 35969 - RNA, 27 nt, Artificial Sequence
  Protein diaphanous homolog 1 (845-853)
augcccuaccaggagaucaagaacgug

SEQ ID NO: 35970 - RNA, 27 nt, Artificial Sequence
  Prelamin-A/C (199-207)
augcgcgcccggaugcagcagcagcug

SEQ ID NO: 35971 - RNA, 27 nt, Artificial Sequence
  Transcobalamin-2 (1-9)
augcgccaccugggcgccuuccucuuc

SEQ ID NO: 35972 - RNA, 27 nt, Artificial Sequence
  Suppressor of SWI4 1 homolog (100-108)
augcgccugcccggcgggccgacccuc

SEQ ID NO: 35973 - RNA, 27 nt, Artificial Sequence
  Calcium/calmodulin-dependent protein kinase II inhibitor 1 (17-25)
augaccgacaaggcccccccgggcgug

SEQ ID NO: 35974 - RNA, 27 nt, Artificial Sequence
  Insulin receptor substrate 2 (543-551)
augaccauggaccgcccccugagccac

SEQ ID NO: 35975 - RNA, 27 nt, Artificial Sequence
  Necdin (58-66)
auggugaaggacgucaucggcagcuac

SEQ ID NO: 35976 - RNA, 36 nt, Artificial Sequence
  ATP-citrate synthase (529-540)
augguguaccccuucaccggcgaccacaagcagaag

SEQ ID NO: 35977 - RNA, 27 nt, Artificial Sequence
  Melanoma-associated antigen D2 (110-118)
aacgccgacccccaggccgugaccaug

SEQ ID NO: 35978 - RNA, 27 nt, Artificial Sequence
  FERM domain-containing protein 8 (198-206)
aacgccuaccgccaggugcaggagguc

SEQ ID NO: 35979 - RNA, 27 nt, Artificial Sequence
  Rapamycin-insensitive companion of mTOR (139-147)
aacgagguggagcgcacccaggcccug

SEQ ID NO: 35980 - RNA, 27 nt, Artificial Sequence
  26S protease regulatory subunit 4 (119-127)
aaccacgccaucgugagcaccuccguc

SEQ ID NO: 35981 - RNA, 24 nt, Artificial Sequence
  Serine/threonine-protein phosphatase 2A catalytic subunit beta isoform (229-236)
aaccacgccaacggccugacccuc

SEQ ID NO: 35982 - RNA, 30 nt, Artificial Sequence
  Transcription factor 4 (402-411)
aaccacgccgugggccccagcaccgccaug

SEQ ID NO: 35983 - RNA, 27 nt, Artificial Sequence
  Translationally-controlled tumor protein (75-83)
aaccaccaccugcaggagaccagcuuc

SEQ ID NO: 35984 - RNA, 27 nt, Artificial Sequence
  SHC-transforming protein 4 (284-292)
aaccaccacaugcagagcaucuccuuc

SEQ ID NO: 35985 - RNA, 27 nt, Artificial Sequence
  E3 ubiquitin-protein ligase synoviolin (308-316)
aaccacaucuuccacaccagcugccug

SEQ ID NO: 35986 - RNA, 27 nt, Artificial Sequence
  Dedicator of cytokinesis protein 8 (737-745)
aaccaccuggagaaguucuucacccuc

SEQ ID NO: 35987 - RNA, 27 nt, Artificial Sequence
  Cytochrome c oxidase subunit 6C (21-29)
aaccacauggccguggccuucguccug

SEQ ID NO: 35988 - RNA, 27 nt, Artificial Sequence
  Ankyrin repeat domain-containing protein 54 (187-195)
aaccacgugcccgucaucaccacccug

SEQ ID NO: 35989 - RNA, 30 nt, Artificial Sequence
  Transcription factor jun-B (150-159)
aaccacgugacccccccgaacgucagccug

SEQ ID NO: 35990 - RNA, 27 nt, Artificial Sequence
  Periodic tryptophan protein 2 homolog (866-874)
aaccacuacaacaugcaguacgcccug

SEQ ID NO: 35991 - RNA, 27 nt, Artificial Sequence
  Alpha-2-macroglobulin receptor-associated protein (292-300)
aaccacuaccagaagcagcuggagauc

SEQ ID NO: 35992 - RNA, 27 nt, Artificial Sequence
  Protein SCAF11 (912-920)
aacaucuuccccuacccggugggcguc

SEQ ID NO: 35993 - RNA, 27 nt, Artificial Sequence
  RUS1 family protein C16orf58 (197-205)
aaccuggccaagugcaucgugagcguc

SEQ ID NO: 35994 - RNA, 27 nt, Artificial Sequence
  Pterin-4-alpha-carbinolamine dehydratase (19-27)
aaccuggccagcuucaucgagcaggug

SEQ ID NO: 35995 - RNA, 27 nt, Artificial Sequence
  E3 ubiquitin-protein ligase RNF123 (595-603)
aaccuguucgaccgcguggucacccuc

SEQ ID NO: 35996 - RNA, 27 nt, Artificial Sequence
  Plastin-3 (327-335)
aaccuguucaacaaguaccccgcccuc

SEQ ID NO: 35997 - RNA, 30 nt, Artificial Sequence
  THO complex subunit 2 (162-171)
aaccugaucgaccucgacgaccuguacgug

SEQ ID NO: 35998 - RNA, 27 nt, Artificial Sequence
  Tyrosine-protein phosphatase non-receptor type 13 (472-480)
aaccugaucaaccaggagaucaugcuc

SEQ ID NO: 35999 - RNA, 27 nt, Artificial Sequence
  Trifunctional purine biosynthetic protein adenosine-3 (39-47)
aaccugaucagcgcccucgaggaggcc

SEQ ID NO: 36000 - RNA, 27 nt, Artificial Sequence
  Protein virilizer homolog (623-631)
aaccugcucgaggagguguuccaccug

SEQ ID NO: 36001 - RNA, 27 nt, Artificial Sequence
  Chloride intracellular channel protein 5 (187-195)
aaccugcuccccaagcugcacgugguc

SEQ ID NO: 36002 - RNA, 27 nt, Artificial Sequence
  PHD finger protein 20-like protein 1 (210-218)
aaccugcucacccacaucgagaacgug

SEQ ID NO: 36003 - RNA, 27 nt, Artificial Sequence
  AP-3 complex subunit mu-2 (268-276)
aaccugguggccauccccgucuacgug

SEQ ID NO: 36004 - RNA, 30 nt, Artificial Sequence
  55 kDa erythrocyte membrane protein (337-346)
aacauguucggcaccaaguucgagaccgug

SEQ ID NO: 36005 - RNA, 27 nt, Artificial Sequence
  Tetratricopeptide repeat protein 4 (260-268)
aacccccacggcgcccgccugagccuc

SEQ ID NO: 36006 - RNA, 27 nt, Artificial Sequence
  General transcription factor 3C polypeptide 1 (336-344)
aaccccaaggagagcuccagcucccug

SEQ ID NO: 36007 - RNA, 33 nt, Artificial Sequence
  Talin-1 (1623-1633)
aacccccgcgacccgcccagcugguccgugcug

SEQ ID NO: 36008 - RNA, 33 nt, Artificial Sequence
  Roundabout homolog 1 (1497-1507)
aacccccgcgacccgagcuccagcuccagcaug

SEQ ID NO: 36009 - RNA, 27 nt, Artificial Sequence
  Clathrin interactor 1 (379-387)
aaccaggcccccagcggcccgguggcc

SEQ ID NO: 36010 - RNA, 27 nt, Artificial Sequence
  Coiled-coil domain-containing protein 134 (154-162)
aaccagggcccccacagcccgauccug

SEQ ID NO: 36011 - RNA, 27 nt, Artificial Sequence
  Transcription factor p65 (186-194)
aaccgcgcccccaacaccgccgagcug

SEQ ID NO: 36012 - RNA, 27 nt, Artificial Sequence
  Putative methyltransferase NSUN3 (57-65)
aaccgcuucaacuaccccuucgagcug

SEQ ID NO: 36013 - RNA, 27 nt, Artificial Sequence
  Toll-like receptor 9 (425-433)
aaccgcaucagcggcgccuccgagcug

SEQ ID NO: 36014 - RNA, 27 nt, Artificial Sequence
  Dolichyl-diphosphooligosaccharide-proteinosyltransferase subunit 2 (618-626)
aaccgcaugcuggcccagcaggccgug

SEQ ID NO: 36015 - RNA, 27 nt, Artificial Sequence
  Dolichyl-diphosphooligosaccharide-proteinosyltransferase subunit 2 (358-366)
aacguggccgacgucgugaucaaguuc

SEQ ID NO: 36016 - RNA, 27 nt, Artificial Sequence
  Calcium homeostasis endoplasmic reticulum protein (14-22)
aacgugaucgacaagcuggcccaguuc

SEQ ID NO: 36017 - RNA, 30 nt, Artificial Sequence
  E3 ubiquitin-protein ligase DTX3L (376-385)
aacgugaucgaggucgacagcgcccacuac

SEQ ID NO: 36018 - RNA, 27 nt, Artificial Sequence
  U5 small nuclear ribonucleoprotein 200 kDa helicase (1517-1525)
aacgugcgccccgucccgcuggagcuc

SEQ ID NO: 36019 - RNA, 27 nt, Artificial Sequence
  Arf-GAP with SH3 domain, ANK repeat and PH domain-containing protein 1 (87-95)
aacuacgcccaggugcuggacaaguuc

SEQ ID NO: 36020 - RNA, 27 nt, Artificial Sequence
  GRB2-related adapter protein (100-108)
aacuacggcgaccaggugcagcacuuc

SEQ ID NO: 36021 - RNA, 27 nt, Artificial Sequence
  Heat shock protein HSP 90-alpha (249-257)
aacuacaagaaguucuacgagcaguuc

SEQ ID NO: 36022 - RNA, 27 nt, Artificial Sequence
  Fructosamine-3-kinase (284-292)
aacuaccugaaccacuggaaccacuuc

SEQ ID NO: 36023 - RNA, 33 nt, Artificial Sequence
  SEC14-like protein 1 (424-434)
aacuaccccgagacccugggccgccuccugauc

SEQ ID NO: 36024 - RNA, 30 nt, Artificial Sequence
  TATA element modulatory factor (751-760)
caggaggccgagaaccgcaaccaggagcug

SEQ ID NO: 36025 - RNA, 27 nt, Artificial Sequence
  Threonine-tRNA ligase, cytoplasmic (318-326)
caggagcuguacuucuuccacgagcuc

SEQ ID NO: 36026 - RNA, 30 nt, Artificial Sequence
  Nuclear autoantigen Sp-100 (132-141)
caggaguaccccgaccugauccacaucuac

SEQ ID NO: 36027 - RNA, 27 nt, Artificial Sequence
  Myosin-9 (709-717)
cagggcuuccccaaccgcguggucuuc

SEQ ID NO: 36028 - RNA, 27 nt, Artificial Sequence
  MOB kinase activator 1A (165-173)
cagcacuucgacagcgugaugcagcug

SEQ ID NO: 36029 - RNA, 27 nt, Artificial Sequence
  ATP-citrate synthase (996-1004)
cagcacuuccccgccaccccgcugcuc

SEQ ID NO: 36030 - RNA, 30 nt, Artificial Sequence
  Cullin-3 (489-498)
cagcaccugcaggccaccggcgugagccuc

SEQ ID NO: 36031 - RNA, 27 nt, Artificial Sequence
  Angio-associated migratory cell protein (356-364)
cagcaccagagcggcaucgugcagcug

SEQ ID NO: 36032 - RNA, 27 nt, Artificial Sequence
  Protein PML (767-775)
cagcacguguaccccuucagcucccug

SEQ ID NO: 36033 - RNA, 27 nt, Artificial Sequence
  Solute carrier family 41 member 3 (91-99)
cagcacuggcccguguucgucgaggug

SEQ ID NO: 36034 - RNA, 27 nt, Artificial Sequence
  Putative Polycomb group protein ASXL2 (1383-1391)
cagauccugcccaagccgcucaccaag

SEQ ID NO: 36035 - RNA, 27 nt, Artificial Sequence
  Programmed cell death 6-interacting protein (435-443)
cagcugaucaaggagcuccccgagcug

SEQ ID NO: 36036 - RNA, 27 nt, Artificial Sequence
  Dynactin subunit 1 (1167-1175)
cagcugauggagcagguggcccagcuc

SEQ ID NO: 36037 - RNA, 27 nt, Artificial Sequence
  E3 ubiquitin-protein ligase DTX3L (447-455)
cagcugaugcgcgaggugcuccugcug

SEQ ID NO: 36038 - RNA, 27 nt, Artificial Sequence
  Non-specific lipid-transfer protein (539-547)
cagcugcagcccggcaacgccaagcuc

SEQ ID NO: 36039 - RNA, 27 nt, Artificial Sequence
  Poly (ADP-ribose) polymerase 14 (218-226)
cagcugagcccccgccuccuggaggug

SEQ ID NO: 36040 - RNA, 27 nt, Artificial Sequence
  Protein ZGRF1 (2047-2055)
cagcuguggggccgcgugauccagcac

SEQ ID NO: 36041 - RNA, 27 nt, Artificial Sequence
  Myosin-10 (655-663)
cagcuguacaaggagagccucaccaag

SEQ ID NO: 36042 - RNA, 27 nt, Artificial Sequence
  Signal recognition particle subunit SRP72 (247-255)
cagcuguacaaccagaucaucaagcuc

SEQ ID NO: 36043 - RNA, 27 nt, Artificial Sequence
  Casein kinase I isoform alpha (119-127)
cagaugaucagccgcaucgaguacgug

SEQ ID NO: 36044 - RNA, 30 nt, Artificial Sequence
  rRNA 2'-O-methyltransferase fibrillarin (236-245)
cagcccgaccagacccgcaucguggcccug

SEQ ID NO: 36045 - RNA, 27 nt, Artificial Sequence
  Eukaryotic translation initiation factor 4 gamma 3 (664-672)
cagcccaagcugccgaugcgcacccuc

SEQ ID NO: 36046 - RNA, 27 nt, Artificial Sequence
  Activating transcription factor 7-interacting protein 1 (787-795)
cagccccugccggugauccuccacguc

SEQ ID NO: 36047 - RNA, 27 nt, Artificial Sequence
  Transmembrane emp24 domain-containing protein 5 (50-58)
cagcccaugccgcugaaggccagccuc

SEQ ID NO: 36048 - RNA, 27 nt, Artificial Sequence
  E3 ubiquitin-protein ligase RNF31 (125-133)
cagccccgcccgcagagcaccucccug

SEQ ID NO: 36049 - RNA, 30 nt, Artificial Sequence
  Nuclear factor of activated T-cells, cytoplasmic 2 (486-495)
cagcccuacuacccgcagcaccccauggug

SEQ ID NO: 36050 - RNA, 27 nt, Artificial Sequence
  Threonylcarbamoyladenosine tRNA methylthiotransferase (88-96)
cagcagaucgaccgcguggucgaggug

SEQ ID NO: 36051 - RNA, 27 nt, Artificial Sequence
  60S ribosomal protein L26 (65-73)
cagcagaucggcaaggugguccaggug

SEQ ID NO: 36052 - RNA, 27 nt, Artificial Sequence
  Long-chain-fatty-acid-CoA ligase 3 (405-413)
cagcgcaaccuguucauccucgccuac

SEQ ID NO: 36053 - RNA, 27 nt, Artificial Sequence
  B-cell receptor-associated protein 29 (101-109)
cagcgcaaccuguacaucagcggcuuc

SEQ ID NO: 36054 - RNA, 33 nt, Artificial Sequence
  Nucleolar RNA helicase 2 (558-568)
cagcgcagccugaucaacuccaacgugggcuuc

SEQ ID NO: 36055 - RNA, 27 nt, Artificial Sequence
  GPI transamidase component PIG-T (351-359)
cagcgcuacgugagcggcuacgggcug

SEQ ID NO: 36056 - RNA, 36 nt, Artificial Sequence
  Zinc finger protein 143 (64-75)
caggugauccagcuggaggacggcagcgccgccuac

SEQ ID NO: 36057 - RNA, 27 nt, Artificial Sequence
  mRNA cap guanine-N7 methyltransferase (448-456)
caggugcgccugccccucggcacccug

SEQ ID NO: 36058 - RNA, 27 nt, Artificial Sequence
  Elongation of very long chain fatty acids protein 1 (201-209)
caguaccccgugaucauccaccugauc

SEQ ID NO: 36059 - RNA, 27 nt, Artificial Sequence
  Arf-GAP with SH3 domain, ANK repeat and PH domain-containing protein 2 (74-82)
caguacacccaggcccuggagaaguuc

SEQ ID NO: 36060 - RNA, 27 nt, Artificial Sequence
  Telomerase protein component 1 (820-828)
cgcgccgccccccaccggaucagccug

SEQ ID NO: 36061 - RNA, 27 nt, Artificial Sequence
  MICOS complex subunit MIC60 (432-440)
cgcgccuucgacagcgccguggcgaag

SEQ ID NO: 36062 - RNA, 30 nt, Artificial Sequence
  Uromodulin (615-624)
cgcgccuucagcucccugggccuccugaag

SEQ ID NO: 36063 - RNA, 27 nt, Artificial Sequence
  Signal transducer CD24 (3-11)
cgcgccaugguggcccggcugggccuc

SEQ ID NO: 36064 - RNA, 27 nt, Artificial Sequence
  Eukaryotic translation initiation factor 4H (185-193)
cgcgcccagcggccccgccugcagcuc

SEQ ID NO: 36065 - RNA, 27 nt, Artificial Sequence
  Cytochrome b-c1 complex subunit 8 (25-33)
cgcgccuacccccacguguucaccaag

SEQ ID NO: 36066 - RNA, 30 nt, Artificial Sequence
  CLIP-associating protein 1 (519-528)
cgcgaggccgagcaccuguaccacacccuc

SEQ ID NO: 36067 - RNA, 27 nt, Artificial Sequence
  Integrin alpha-6 (29-37)
cgcgaggacaacgugauccggaaguac

SEQ ID NO: 36068 - RNA, 27 nt, Artificial Sequence
  Eukaryotic initiation factor 4A-III (260-268)
cgcgaggaguggaaguucgacacccug

SEQ ID NO: 36069 - RNA, 33 nt, Artificial Sequence
  TCF3 fusion partner (90-100)
cgcgagaucgagcaggugaacgagcggguccug

SEQ ID NO: 36070 - RNA, 33 nt, Artificial Sequence
  Ataxin-2-like protein (324-334)
cgcgagaucgagagcuccccccaguaccggcug

SEQ ID NO: 36071 - RNA, 33 nt, Artificial Sequence
  NF-kappa-B essential modulator (319-329)
cgcgagaagcuggccgagaagaaggagcuccug

SEQ ID NO: 36072 - RNA, 30 nt, Artificial Sequence
  ER membrane protein complex subunit 7 (192-201)
cgcgagauggagcagagcaugaacaugcug

SEQ ID NO: 36073 - RNA, 33 nt, Artificial Sequence
  HMG box-containing protein 1 (104-114)
cgcgagaacgagguggacuggcugaccgagcuc

SEQ ID NO: 36074 - RNA, 30 nt, Artificial Sequence
  Kinesin-like protein KIFC1 (639-648)
cgcgagacccaggccaucaacagcucccug

SEQ ID NO: 36075 - RNA, 27 nt, Artificial Sequence
  Translation machinery-associated protein 16 (109-117)
cgcgagaccgugaucaagcagaccaug

SEQ ID NO: 36076 - RNA, 30 nt, Artificial Sequence
  Protein timeless homolog (623-632)
cgcgagguguggcccgagggcgacgucuuc

SEQ ID NO: 36077 - RNA, 27 nt, Artificial Sequence
  E3 SUMO-protein ligase PIAS3 (145-153)
cgcuucgaggaggcccacuucaccuuc

SEQ ID NO: 36078 - RNA, 27 nt, Artificial Sequence
  Tubulin alpha-1C chain (334-342)
cgcauccacuucccccuggccaccuac

SEQ ID NO: 36079 - RNA, 27 nt, Artificial Sequence
  Poly (ADP-ribose) polymerase 4 (631-639)
cgcaucaucgacaccguggcccagguc

SEQ ID NO: 36080 - RNA, 27 nt, Artificial Sequence
  Moesin (275-283)
cgcaucaacaagcggauccuggcccuc

SEQ ID NO: 36081 - RNA, 27 nt, Artificial Sequence
  Valine-tRNA ligase (530-538)
cgcauccccgccuacuucgugaccguc

SEQ ID NO: 36082 - RNA, 36 nt, Artificial Sequence
  COMM domain-containing protein 9 (145-156)
cgcauccgggaccagcugagcgccguggccuccaag

SEQ ID NO: 36083 - RNA, 27 nt, Artificial Sequence
  SUN domain-containing protein 2 (117-125)
cgcauccggcccaccgccgugacccug

SEQ ID NO: 36084 - RNA, 30 nt, Artificial Sequence
  28S ribosomal protein S21, mitochondrial (50-59)
cgcaucuacaacauggagauggcccggaag

SEQ ID NO: 36085 - RNA, 30 nt, Artificial Sequence
  Heterogeneous nuclear ribonucleoprotein A1 (14-23)
cgcaagcuguucaucggcgggcucagcuuc

SEQ ID NO: 36086 - RNA, 30 nt, Artificial Sequence
  Catenin beta-1 (124-133)
cgccuggccgagcccagccagaugcucaag

SEQ ID NO: 36087 - RNA, 27 nt, Artificial Sequence
  Kalirin (2002-2010)
cgccuggcccagcucuucaucaagcac

SEQ ID NO: 36088 - RNA, 27 nt, Artificial Sequence
  Thyroid adenoma-associated protein (345-353)
cgccuggccagcaaggugaucucccac

SEQ ID NO: 36089 - RNA, 27 nt, Artificial Sequence
  Prostaglandin F2 receptor negative regulator (3-11)
cgccuggccagccggccccuccugcug

SEQ ID NO: 36090 - RNA, 27 nt, Artificial Sequence
  Transcription factor 4 (368-376)
cgccuggacgacgccauccacgugcuc

SEQ ID NO: 36091 - RNA, 27 nt, Artificial Sequence
  Fanconi anemia group D2 protein (253-261)
cgccuggaccccaacuuccuccugaag

SEQ ID NO: 36092 - RNA, 33 nt, Artificial Sequence
  Ubiquitin carboxyl-terminal hydrolase 19 (1354-1364)
cgccuguucgacgacagcaccgugaccacgguc

SEQ ID NO: 36093 - RNA, 33 nt, Artificial Sequence
  BTB/POZ domain-containing protein 2 (2-12)
cgccuguucgacgagccccagcucgccagccug

SEQ ID NO: 36094 - RNA, 27 nt, Artificial Sequence
  Heat shock protein beta-1 (27-35)
cgccuguucgaccaggccuucggccuc

SEQ ID NO: 36095 - RNA, 27 nt, Artificial Sequence
  V-type proton ATPase subunit S1 (315-323)
cgccuguucggcaccaccgugacguuc

SEQ ID NO: 36096 - RNA, 30 nt, Artificial Sequence
  V-type proton ATPase subunit S1 (225-234)
cgccuguucggcaccaccgugacguucaag

SEQ ID NO: 36097 - RNA, 30 nt, Artificial Sequence
  Dol-P-Man:Man(5)GlcNAc(2)-PP-Dol alpha-1,3-mannosyltransferase (123-132)
cgccuguucaacgaccccguggccaugguc

SEQ ID NO: 36098 - RNA, 27 nt, Artificial Sequence
  tRNA-dihydrouridine(20) synthase (NAD(P)+)-like (362-370)
cgccuguucagcuccaucgugaccguc

SEQ ID NO: 36099 - RNA, 27 nt, Artificial Sequence
  Surfeit locus protein 6 (121-129)
cgccugcacgagaagauccaggaggcc

SEQ ID NO: 36100 - RNA, 27 nt, Artificial Sequence
  Proteasome subunit alpha type-4 (20-28)
cgccugaucgcccagcgguaccuccug

SEQ ID NO: 36101 - RNA, 27 nt, Artificial Sequence
  Lysine-specific demethylase 5B (975-983)
cgccugaucgaccucggcguggggcug

SEQ ID NO: 36102 - RNA, 30 nt, Artificial Sequence
  Rho GTPase-activating protein 19 (65-74)
cgccugaucgaccuccccggcaccgagcug

SEQ ID NO: 36103 - RNA, 27 nt, Artificial Sequence
  General transcription factor 3C polypeptide 1 (377-385)
cgccugaucgagagccucuucaccauc

SEQ ID NO: 36104 - RNA, 33 nt, Artificial Sequence
  Heat shock 70 kDa protein 1-like (51-61)
cgccugaucggcgacgccgccaagaaccaggug

SEQ ID NO: 36105 - RNA, 27 nt, Artificial Sequence
  Short coiled-coil protein (55-63)
cgccugaucaaccaggugcucgagcug

SEQ ID NO: 36106 - RNA, 27 nt, Artificial Sequence
  Importin-9 (241-249)
cgccugauccccacccucgugagcauc

SEQ ID NO: 36107 - RNA, 27 nt, Artificial Sequence
  Eukaryotic translation initiation factor 4E (61-69)
cgccugaucagcaaguucgacaccgug

SEQ ID NO: 36108 - RNA, 27 nt, Artificial Sequence
  C-X-C motif chemokine 14 (14-22)
cgccugcucgccgccgcgcugcugcuc

SEQ ID NO: 36109 - RNA, 30 nt, Artificial Sequence
  Engulfment and cell motility protein 1 (697-706)
cgccugcucgaccuggagaacauccagauc

SEQ ID NO: 36110 - RNA, 27 nt, Artificial Sequence
  PX domain-containing protein kinase-like protein (219-227)
cgccugcucgaccuggagaacagccug

SEQ ID NO: 36111 - RNA, 27 nt, Artificial Sequence
  Collagen alpha-1(XVIII) chain (14-22)
cgccugcucgacgugcuggccccccug

SEQ ID NO: 36112 - RNA, 27 nt, Artificial Sequence
  Baculoviral IAP repeat-containing protein 6 (2177-2185)
cgccugcucgacuacguggccaccguc

SEQ ID NO: 36113 - RNA, 27 nt, Artificial Sequence
  Lysine-specific histone demethylase 1A (180-188)
cgccugcucgaggccaccagcuaccug

SEQ ID NO: 36114 - RNA, 27 nt, Artificial Sequence
  Isochorismatase domain-containing protein 2 (49-57)
cgccugcucgaggugcccgucaugcug

SEQ ID NO: 36115 - RNA, 36 nt, Artificial Sequence
  Histone H2B type 1-K (100-111)
cgccugcuccugcccggcgagcuggccaagcacgcc

SEQ ID NO: 36116 - RNA, 30 nt, Artificial Sequence
  Attractin (51-60)
cgccugcucagccccccgcugcggccccgc

SEQ ID NO: 36117 - RNA, 27 nt, Artificial Sequence
  Heat shock protein 105 kDa (183-191)
cgccugaugaacgacaugaccgccgug

SEQ ID NO: 36118 - RNA, 27 nt, Artificial Sequence
  Heat shock 70 kDa protein 4L (128-136)
cgccugaugaacgagaccaccgccgug

SEQ ID NO: 36119 - RNA, 33 nt, Artificial Sequence
  Heat shock 70 kDa protein 4L (128-138)
cgccugaugaacgagaccaccgccguggcccuc

SEQ ID NO: 36120 - RNA, 27 nt, Artificial Sequence
  Cyclin-D1-binding protein 1 (55-63)
cgccugaacgaggccgccgugaccguc

SEQ ID NO: 36121 - RNA, 30 nt, Artificial Sequence
  Coatomer subunit gamma-2 (708-717)
cgccugcccgacgacgacccgaccgccgug

SEQ ID NO: 36122 - RNA, 27 nt, Artificial Sequence
  Glyoxylate reductase/hydroxypyruvate reductase (125-133)
cgccugcccgaggccaucgaggaggug

SEQ ID NO: 36123 - RNA, 27 nt, Artificial Sequence
  EH domain-containing protein 4 (337-345)
cgccugcccgagaucuacauccagcuc

SEQ ID NO: 36124 - RNA, 27 nt, Artificial Sequence
  Sorting nexin-1 (13-21)
cgccugcccccgcccuuccccggccuc

SEQ ID NO: 36125 - RNA, 27 nt, Artificial Sequence
  DNA-directed RNA polymerase III subunit RPC1 (218-226)
cgccugcccccgcccaccauccucaag

SEQ ID NO: 36126 - RNA, 27 nt, Artificial Sequence
  Kazrin (78-86)
cgccugcaggaggaggugcaccuccug

SEQ ID NO: 36127 - RNA, 33 nt, Artificial Sequence
  Synaptojanin-2-binding protein (58-68)
cgccugcaggagggcgacaagauccucagcgug

SEQ ID NO: 36128 - RNA, 27 nt, Artificial Sequence
  Centrosomal protein of 85 kDa (243-251)
cgccugcagauggagcagaugcagcuc

SEQ ID NO: 36129 - RNA, 36 nt, Artificial Sequence
  KIF1-binding protein (494-505)
cgccugcgggaccccgacagccacaucgugaagaag

SEQ ID NO: 36130 - RNA, 27 nt, Artificial Sequence
  Transmembrane protein 69 (146-154)
cgccugagcgaggccaucgugaccguc

SEQ ID NO: 36131 - RNA, 30 nt, Artificial Sequence
  WASH complex subunit strumpellin (31-40)
cgccugagcgaguucauccccgccguguuc

SEQ ID NO: 36132 - RNA, 27 nt, Artificial Sequence
  COP9 signalosome complex subunit 8 (199-207)
cgccugaccgacuacguggccuuccuc

SEQ ID NO: 36133 - RNA, 27 nt, Artificial Sequence
  Proliferating cell nuclear antigen (5-13)
cgccuggugcagggcagcauccucaag

SEQ ID NO: 36134 - RNA, 33 nt, Artificial Sequence
  Serine-threonine kinase receptor-associated protein (167-177)
cgccugugggaccacgccaccaugaccgaggug

SEQ ID NO: 36135 - RNA, 27 nt, Artificial Sequence
  Probable ubiquitin carboxyl-terminal hydrolase FAF-Y (1674-1682)
cgccuguggggcgagcccgugaaccuc

SEQ ID NO: 36136 - RNA, 33 nt, Artificial Sequence
  Lariat debranching enzyme (301-311)
cgccuguggaacaugcccgagaacaacggccuc

SEQ ID NO: 36137 - RNA, 27 nt, Artificial Sequence
  DNA damage-inducible transcript 4 protein (184-192)
cgccuguggcccaagauccagggccuc

SEQ ID NO: 36138 - RNA, 30 nt, Artificial Sequence
  Serine/threonine-protein kinase mTOR (2035-2044)
cgccuguacuucggcgagcggaacgugaag

SEQ ID NO: 36139 - RNA, 30 nt, Artificial Sequence
  Filamin-A (142-151)
cgccuguacagcguguccuaccuccugaag

SEQ ID NO: 36140 - RNA, 27 nt, Artificial Sequence
  C-1-tetrahydrofolate synthase, cytoplasmic (746-754)
cgcauguucggcauccccguggucgug

SEQ ID NO: 36141 - RNA, 30 nt, Artificial Sequence
  Hemoglobin subunit alpha (3-12)
cgcauguuccugagcuuccccaccaccaag

SEQ ID NO: 36142 - RNA, 27 nt, Artificial Sequence
  Transaldolase (28-36)
cgcauguucaacgccgagaacggcaag

SEQ ID NO: 36143 - RNA, 27 nt, Artificial Sequence
  Receptor activity-modifying protein 2 (21-29)
cgccccgccgcccugcggcuccugcug

SEQ ID NO: 36144 - RNA, 33 nt, Artificial Sequence
  Nucleolar protein 11 (53-63)
cgccccgccgacccggagaagaaccagagccug

SEQ ID NO: 36145 - RNA, 27 nt, Artificial Sequence
  F-box only protein 32 (160-168)
cgccccgccuucaagggccugaccuuc

SEQ ID NO: 36146 - RNA, 27 nt, Artificial Sequence
  Transcription cofactor vestigial-like protein 4 (144-152)
cgccccgccggccugagcccgacccuc

SEQ ID NO: 36147 - RNA, 30 nt, Artificial Sequence
  26S proteasome non-ATPase regulatory subunit 13 (284-293)
cgccccgccaaccaccggcagcugaccuuc

SEQ ID NO: 36148 - RNA, 27 nt, Artificial Sequence
  SH3 domain-binding protein 1 (567-575)
cgccccgccccggcccggcccaccaug

SEQ ID NO: 36149 - RNA, 27 nt, Artificial Sequence
  Epsin-2 (471-479)
cgccccgccccgcccgcccagagccug

SEQ ID NO: 36150 - RNA, 27 nt, Artificial Sequence
  Sterol regulatory element-binding protein 2 (1026-1034)
cgccccgccuaccggaagguguuccug

SEQ ID NO: 36151 - RNA, 30 nt, Artificial Sequence
  Protein O-GlcNAcase (828-837)
cgccccgacgacaagcggauccuggaguuc

SEQ ID NO: 36152 - RNA, 27 nt, Artificial Sequence
  Transcription factor 25 (211-219)
cgccccgagaaccggagcuucuaccug

SEQ ID NO: 36153 - RNA, 27 nt, Artificial Sequence
  NFX1-type zinc finger-containing protein 1 (350-358)
cgccccuuccugcggccgaacaucauc

SEQ ID NO: 36154 - RNA, 27 nt, Artificial Sequence
  Procollagen-lysine,2-oxoglutarate 5-dioxygenase 2 (137-145)
cgcccccaccacgacgccagcaccuuc

SEQ ID NO: 36155 - RNA, 27 nt, Artificial Sequence
  Transducin beta-like protein 3 (564-572)
cgcccccacaccgugcugaccgucauc

SEQ ID NO: 36156 - RNA, 30 nt, Artificial Sequence
  Mitogen-activated protein kinase 3 (229-238)
cgccccaucuucccgggcaagcacuaccug

SEQ ID NO: 36157 - RNA, 27 nt, Artificial Sequence
  Ragulator complex protein LAMTOR2 (3-11)
cgccccaaggcccugacccaggugcuc

SEQ ID NO: 36158 - RNA, 30 nt, Artificial Sequence
  Pre-mRNA-processing factor 19 (62-71)
cgccccaagccgcccagcgccaccuccauc

SEQ ID NO: 36159 - RNA, 30 nt, Artificial Sequence
  Poly(rC)-binding protein 2 (183-192)
cgccccaagccgagcuccagccccgugauc

SEQ ID NO: 36160 - RNA, 27 nt, Artificial Sequence
  Mitogen-activated protein kinase 9 (263-271)
cgccccaaguacccgggcaucaaguuc

SEQ ID NO: 36161 - RNA, 27 nt, Artificial Sequence
  Probable ATP-dependent RNA helicase DDX27 (196-204)
cgcccccugcucaaggccaucaccgcc

SEQ ID NO: 36162 - RNA, 30 nt, Artificial Sequence
  Protein transport protein Sec23B (243-252)
cgcccccugcggagcaccggcguggcccuc

SEQ ID NO: 36163 - RNA, 27 nt, Artificial Sequence
  RNA-binding protein 39 (297-305)
cgccccaugaaggugggccacgucacc

SEQ ID NO: 36164 - RNA, 27 nt, Artificial Sequence
  UAP56-interacting factor (71-79)
cgccccaacggcgugaucaccgggcug

SEQ ID NO: 36165 - RNA, 27 nt, Artificial Sequence
  Adipocyte plasma membrane-associated protein (337-345)
cgccccaacccgggcuucagcaugcug

SEQ ID NO: 36166 - RNA, 27 nt, Artificial Sequence
  Induced myeloid leukemia cell differentiation protein Mcl-1 (78-86)
cgccccccgcccaucggcgccgaggug

SEQ ID NO: 36167 - RNA, 27 nt, Artificial Sequence
  Sterol regulatory element-binding protein 1 (1003-1011)
cgcccccaggccagcgcccuggagcuc

SEQ ID NO: 36168 - RNA, 27 nt, Artificial Sequence
  (Pyruvate dehydrogenase (acetyl-transferring))-phosphatase 1, mitochondrial (443-451)
cgcccccaggacaaguuccuggugcuc

SEQ ID NO: 36169 - RNA, 27 nt, Artificial Sequence
  RuvB-like 1 (249-257)
cgcccccagggcgggcaggacauccug

SEQ ID NO: 36170 - RNA, 27 nt, Artificial Sequence
  28S ribosomal protein S12, mitochondrial (55-63)
cgcccccagcugaagggcgugguccuc

SEQ ID NO: 36171 - RNA, 30 nt, Artificial Sequence
  WD repeat and FYVE domain-containing protein 1 (8-17)
cgcccccagagcucccggccggugcugcuc

SEQ ID NO: 36172 - RNA, 27 nt, Artificial Sequence
  Renin receptor (59-67)
cgcccccgggccaccgugauggucaug

SEQ ID NO: 36173 - RNA, 30 nt, Artificial Sequence
  Protein OS-9 (186-195)
cgcccccgggaggccgaggugcgcuuccug

SEQ ID NO: 36174 - RNA, 24 nt, Artificial Sequence
  Protein disulfide-isomerase A4 (2-9)
cgcccccggaaggccuuccugcuc

SEQ ID NO: 36175 - RNA, 30 nt, Artificial Sequence
  Protein disulfide-isomerase A4 (2-11)
cgcccccggaaggccuuccugcuccugcug

SEQ ID NO: 36176 - RNA, 33 nt, Artificial Sequence
  Glycogen synthase kinase-3 beta (306-316)
cgcccccggaccccgcccgaggccaucgcccug

SEQ ID NO: 36177 - RNA, 30 nt, Artificial Sequence
  Apolipoprotein L1 (285-294)
cgcccccgggugaccgagccgaucagcgcc

SEQ ID NO: 36178 - RNA, 27 nt, Artificial Sequence
  ATP-dependent RNA helicase A (272-280)
cgccccagcgccgccggcaucaaccug

SEQ ID NO: 36179 - RNA, 27 nt, Artificial Sequence
  Protein DEPP (195-203)
cgccccagcuccgugcugcggacccuc

SEQ ID NO: 36180 - RNA, 27 nt, Artificial Sequence
  Filamin-B (69-77)
cgccccaccuuccggcagaugcagcug

SEQ ID NO: 36181 - RNA, 27 nt, Artificial Sequence
  Antigen peptide transporter 2 (168-176)
cgccccgugcugaagggccucaccuuc

SEQ ID NO: 36182 - RNA, 27 nt, Artificial Sequence
  FAS-associated factor 1 (77-85)
cgccccgugaugccgagccggcagauc

SEQ ID NO: 36183 - RNA, 27 nt, Artificial Sequence
  CDC42 small effector protein 1 (69-77)
cgccccuggagcaacucccggggccug

SEQ ID NO: 36184 - RNA, 30 nt, Artificial Sequence
  Cyclin-dependent kinase 13 (254-263)
cgccccuacaccaacaaggugaucacccug

SEQ ID NO: 36185 - RNA, 36 nt, Artificial Sequence
  Rac GTPase-activating protein 1 (547-558)
cgccagggcaacuucuucgccagccccaugcugaag

SEQ ID NO: 36186 - RNA, 33 nt, Artificial Sequence
  SEC14-like protein 1 (168-178)
cgccagcuggaggaggagggcaucaccuucgug

SEQ ID NO: 36187 - RNA, 30 nt, Artificial Sequence
  Ubiquitin carboxyl-terminal hydrolase 22 (419-428)
cgccggaagaucaccaccuacgugagcuuc

SEQ ID NO: 36188 - RNA, 27 nt, Artificial Sequence
  MICOS complex subunit MIC10 (38-46)
cgccggauguggccccuggccuucggc

SEQ ID NO: 36189 - RNA, 27 nt, Artificial Sequence
  Protein transport protein Sec23B (569-577)
cgccggagccccuuccugcagguguuc

SEQ ID NO: 36190 - RNA, 27 nt, Artificial Sequence
  Protein transport protein Sec23A (585-593)
cgccggagcuccuuccugcagguguuc

SEQ ID NO: 36191 - RNA, 27 nt, Artificial Sequence
  Nicastrin (225-233)
cgccggagcuccauccagagcaccuuc

SEQ ID NO: 36192 - RNA, 27 nt, Artificial Sequence
  Protein FAM73A (222-230)
cgccggugggagcaggcccugaccuuc

SEQ ID NO: 36193 - RNA, 27 nt, Artificial Sequence
  Complement C1q subcomponent subunit C (184-192)
cgcagcggcgugaaggucgugaccuuc

SEQ ID NO: 36194 - RNA, 33 nt, Artificial Sequence
  RNA polymerase II subunit A C-terminal domain phosphatase SSU72 (18-28)
cgcagcauggaggcccacaacauccuguccaag

SEQ ID NO: 36195 - RNA, 30 nt, Artificial Sequence
  Heterogeneous nuclear ribonucleoproteins A2/B1 (60-69)
cgcagccggggcuucggguucgugaccuuc

SEQ ID NO: 36196 - RNA, 27 nt, Artificial Sequence
  Dynamin-2 (199-207)
cgcaccaucggcgugaucaccaagcug

SEQ ID NO: 36197 - RNA, 33 nt, Artificial Sequence
  Profilin-1 (87-97)
cgcaccaagagcaccggcggggcccccacguuc

SEQ ID NO: 36198 - RNA, 33 nt, Artificial Sequence
  28S ribosomal protein S7, mitochondrial (198-208)
cgcacccugaugcccgagaagcucagccacaag

SEQ ID NO: 36199 - RNA, 30 nt, Artificial Sequence
  Protein SDA1 homolog (403-412)
cgcacccugaacccccagaugcuccagaag

SEQ ID NO: 36200 - RNA, 27 nt, Artificial Sequence
  Serine/threonine-protein kinase TAO1 (49-57)
cgcaccaacgagguggucgccaucaag

SEQ ID NO: 36201 - RNA, 30 nt, Artificial Sequence
  Serine/threonine-protein kinase TAO1 (49-58)
cgcaccaacgagguggucgccaucaagaag

SEQ ID NO: 36202 - RNA, 30 nt, Artificial Sequence
  Ras GTPase-activating protein 3 (360-369)
cgcacccaggaccccaacaccaucuuccgg

SEQ ID NO: 36203 - RNA, 33 nt, Artificial Sequence
  Zinc finger protein 706 (45-55)
cgcacccagaugcccgacccgaagaccuucaag

SEQ ID NO: 36204 - RNA, 36 nt, Artificial Sequence
  Fructose-bisphosphate aldolase A (259-270)
cgcaccgugcccccggccgucaccggcaucacguuc

SEQ ID NO: 36205 - RNA, 27 nt, Artificial Sequence
  Protein LDOC1L (175-183)
cgcaccuacaagagcccccugcggcac

SEQ ID NO: 36206 - RNA, 33 nt, Artificial Sequence
  Sorting nexin-4 (243-253)
cgcguggccgaccggcuguacggcgucuacaag

SEQ ID NO: 36207 - RNA, 27 nt, Artificial Sequence
  Cell division cycle and apoptosis regulator protein 1 (148-156)
cgcguguucaccggcgucgugaccaag

SEQ ID NO: 36208 - RNA, 30 nt, Artificial Sequence
  Centrosomal protein of 57 kDa (325-334)
cgcgugaucaacagcaucccccuggccaag

SEQ ID NO: 36209 - RNA, 27 nt, Artificial Sequence
  Hom s 1 (22-30)
cgcgugaaggcccccaacaagagccug

SEQ ID NO: 36210 - RNA, 27 nt, Artificial Sequence
  Cytosolic 10-formyltetrahydrofolate dehydrogenase (894-902)
cgcgugaagaccgucaccuucgaguac

SEQ ID NO: 36211 - RNA, 30 nt, Artificial Sequence
  E3 ubiquitin-protein ligase HUWE1 (812-821)
cgcgugcuggacuucgacgucaagcggaag

SEQ ID NO: 36212 - RNA, 30 nt, Artificial Sequence
  Eukaryotic translation initiation factor 4 gamma 3 (1045-1054)
cgcgugcuggaccccagcaaguuccucaag

SEQ ID NO: 36213 - RNA, 27 nt, Artificial Sequence
  Paired amphipathic helix protein Sin3a (631-639)
cgcgugcuggaggccauccagaagaag

SEQ ID NO: 36214 - RNA, 30 nt, Artificial Sequence
  Smoothelin (476-485)
cgcgugcugcuccccaccggcaaccagcgg

SEQ ID NO: 36215 - RNA, 36 nt, Artificial Sequence
  40S ribosomal protein S18 (14-25)
cgcgugcugaacaccaacaucgacggccggcgcaag

SEQ ID NO: 36216 - RNA, 27 nt, Artificial Sequence
  WASH complex subunit strumpellin (573-581)
cgcgugaaccccagcauggucaccaag

SEQ ID NO: 36217 - RNA, 27 nt, Artificial Sequence
  Transcription factor 4 (552-560)
cgcgugcgggacaucaacgaggccuuc

SEQ ID NO: 36218 - RNA, 27 nt, Artificial Sequence
  WW domain-binding protein 5 (82-90)
cgcgugcggaacaagcugaucgucaug

SEQ ID NO: 36219 - RNA, 33 nt, Artificial Sequence
  Phosphatidylinositide phosphatase SAC1 (35-45)
cgcgugagcaccgaggucacccuggccgugaag

SEQ ID NO: 36220 - RNA, 33 nt, Artificial Sequence
  Periodic tryptophan protein 1 homolog (244-254)
cgcgugugggacaucagcaccgucuccagcgug

SEQ ID NO: 36221 - RNA, 33 nt, Artificial Sequence
  39S ribosomal protein L3, mitochondrial (250-260)
cgcguguggcccggcaccaagaugccggggaag

SEQ ID NO: 36222 - RNA, 27 nt, Artificial Sequence
  Inositol-trisphosphate 3-kinase B (33-41)
cgcguguggcagggcaccauggagaag

SEQ ID NO: 36223 - RNA, 30 nt, Artificial Sequence
  Guanine nucleotide-binding protein subunit beta-2-like 1 (308-317)
cgcguguggcaggucaccaucggcacccgg

SEQ ID NO: 36224 - RNA, 27 nt, Artificial Sequence
  Cip1-interacting zinc finger protein (591-599)
cgcuacuucaagaccccccggaaguuc

SEQ ID NO: 36225 - RNA, 27 nt, Artificial Sequence
  Signal transducer and activator of transcription 3 (93-101)
cgcuaccuggagaagcccauggagauc

SEQ ID NO: 36226 - RNA, 27 nt, Artificial Sequence
  Erythrocyte band 7 integral membrane protein (251-259)
cgcuaccugcagacccucaccacgauc

SEQ ID NO: 36227 - RNA, 27 nt, Artificial Sequence
  Telomerase protein component 1 (464-472)
cgcuaccccagcaaccugcagcucuuc

SEQ ID NO: 36228 - RNA, 27 nt, Artificial Sequence
  Histone H3.1 (41-49)
cgcuaccggcccggcaccguggcccug

SEQ ID NO: 36229 - RNA, 27 nt, Artificial Sequence
  26S proteasome non-ATPase regulatory subunit 6 (267-275)
cgcuacagcguguucuuccagucccug

SEQ ID NO: 36230 - RNA, 27 nt, Artificial Sequence
  G1/S-specific cyclin-D3 (37-45)
cgcuacgugccccgggccagcuacuuc

SEQ ID NO: 36231 - RNA, 24 nt, Artificial Sequence
  Heterogeneous nuclear ribonucleoprotein H (23-30)
agcgccgacgaggugcagcgcuuc

SEQ ID NO: 36232 - RNA, 27 nt, Artificial Sequence
  Solute carrier family 35 member E1 (53-61)
agcgccuuccccuucccggugaccguc

SEQ ID NO: 36233 - RNA, 33 nt, Artificial Sequence
  Probable 28S rRNA (cytosine(4447)-C(5))-methyltransferase (511-521)
agcgccaucgacuccgugaacgccaccagcaag

SEQ ID NO: 36234 - RNA, 27 nt, Artificial Sequence
  Catenin alpha-2 (667-675)
agcgcccgcgccaucauggcgcagcug

SEQ ID NO: 36235 - RNA, 27 nt, Artificial Sequence
  Large proline-rich protein BAG6 (145-153)
agcgccguggacguccacaucaacaug

SEQ ID NO: 36236 - RNA, 27 nt, Artificial Sequence
  Gamma-interferon-inducible protein 16 (280-288)
agcgaggccggccccaaccagaccuuc

SEQ ID NO: 36237 - RNA, 27 nt, Artificial Sequence
  Y-box-binding protein 3 (149-157)
agcgaggacgccgagaagaaggugcug

SEQ ID NO: 36238 - RNA, 27 nt, Artificial Sequence
  Proline-, glutamic acid- and leucine-rich protein 1 (231-239)
agcgaggacggcgacgcccacgugcug

SEQ ID NO: 36239 - RNA, 33 nt, Artificial Sequence
  Vacuolar protein sorting-associated protein 35 (500-510)
agcgaggaccccgaccagcaguaccugauccuc

SEQ ID NO: 36240 - RNA, 36 nt, Artificial Sequence
  Actin-binding protein anillin (796-807)
agcgaguucaugcccuccaagggcagcgugacccug

SEQ ID NO: 36241 - RNA, 27 nt, Artificial Sequence
  Actin-related protein 2 (295-303)
agcgaguucuacaagcacaucgugcug

SEQ ID NO: 36242 - RNA, 30 nt, Artificial Sequence
  Neutral amino acid transporter A (22-31)
agcgagggcgaggaccugauccgcuucuuc

SEQ ID NO: 36243 - RNA, 30 nt, Artificial Sequence
  HCLS1-binding protein 3 (72-81)
agcgagaucgaggaguucuaccagaagcug

SEQ ID NO: 36244 - RNA, 27 nt, Artificial Sequence
  Poly (ADP-ribose) polymerase 1 (25-33)
agcgaguccauccccaaggacagccug

SEQ ID NO: 36245 - RNA, 33 nt, Artificial Sequence
  ATP-citrate synthase (769-779)
agcgagaccgccguggccaagaaccaggcgcug

SEQ ID NO: 36246 - RNA, 33 nt, Artificial Sequence
  Antigen KI-67 (2326-2336)
agcgagaccuccggccacacccaggagagccug

SEQ ID NO: 36247 - RNA, 24 nt, Artificial Sequence
  40S ribosomal protein S23 (45-52)
agccacgccaagggcaucgugcug

SEQ ID NO: 36248 - RNA, 27 nt, Artificial Sequence
  Mitogen-activated protein kinase kinase kinase 1 (497-505)
agccacgacuucuacucccacgagcug

SEQ ID NO: 36249 - RNA, 33 nt, Artificial Sequence
  Bax inhibitor 1 (17-27)
agccacaucacccccuccacccagcagcaccug

SEQ ID NO: 36250 - RNA, 27 nt, Artificial Sequence
  Hypoxia-inducible factor 1-alpha (52-60)
agccaccuggacaaggccuccgugaug

SEQ ID NO: 36251 - RNA, 27 nt, Artificial Sequence
  Ubiquitin carboxyl-terminal hydrolase 37 (54-62)
agccacaacaucaagaacgugguccug

SEQ ID NO: 36252 - RNA, 27 nt, Artificial Sequence
  Protein-L-isoaspartate(D-aspartate) O-methyltransferase (9-17)
agccacuccgagcugauccacaaccuc

SEQ ID NO: 36253 - RNA, 27 nt, Artificial Sequence
  Cyclin-T1 (431-439)
agccacuccagcgugauccugaagaug

SEQ ID NO: 36254 - RNA, 27 nt, Artificial Sequence
  Transcriptional activator Myb (257-265)
agccacgugcccuacccggucgcccug

SEQ ID NO: 36255 - RNA, 27 nt, Artificial Sequence
  Ubiquitin carboxyl-terminal hydrolase 22 (354-362)
agccacguguccggcaccaccacgcug

SEQ ID NO: 36256 - RNA, 27 nt, Artificial Sequence
  MAP kinase-activating death domain protein (181-189)
agccacuaccccuucuucuccaccuuc

SEQ ID NO: 36257 - RNA, 27 nt, Artificial Sequence
  Abnormal spindle-like microcephaly-associated protein (532-540)
agcaucuuccgcacccccaucuccaag

SEQ ID NO: 36258 - RNA, 27 nt, Artificial Sequence
  ATPase family AAA domain-containing protein 5 (1793-1801)
agcaucaucgaguaccugcccacccuc

SEQ ID NO: 36259 - RNA, 27 nt, Artificial Sequence
  Exportin-4 (345-353)
agcaucaucuccaaccugaucaccgug

SEQ ID NO: 36260 - RNA, 27 nt, Artificial Sequence
  LIM domain and actin-binding protein 1 (168-176)
agcaucaaggaccgcauggccaaguac

SEQ ID NO: 36261 - RNA, 27 nt, Artificial Sequence
  GMP reductase 1 (115-123)
agcauccuggaggccgugccccagguc

SEQ ID NO: 36262 - RNA, 27 nt, Artificial Sequence
  DNA replication licensing factor MCM4 (252-260)
agcauccuggagcaccagauccaggug

SEQ ID NO: 36263 - RNA, 27 nt, Artificial Sequence
  Sperm-associated antigen 7 (79-87)
agcauccugcacgacguggucgaggug

SEQ ID NO: 36264 - RNA, 27 nt, Artificial Sequence
  Regulation of nuclear pre-mRNA domain-containing protein 2 (432-440)
agcauccuguccagccucaccuccgug

SEQ ID NO: 36265 - RNA, 27 nt, Artificial Sequence
  E3 ubiquitin-protein ligase TRIP12 (580-588)
agcaucaacgcccagcgcaacgcccug

SEQ ID NO: 36266 - RNA, 27 nt, Artificial Sequence
  Pre-mRNA-processing-splicing factor 8 (1693-1701)
agcaucuaccccuccccgaccggcgug

SEQ ID NO: 36267 - RNA, 30 nt, Artificial Sequence
  40S ribosomal protein S3a (70-79)
agccuggccgaccuccagaacgacgaggug

SEQ ID NO: 36268 - RNA, 27 nt, Artificial Sequence
  All-trans-retinol 13,14-reductase (241-249)
agccuggccgaggugcuccagcagcug

SEQ ID NO: 36269 - RNA, 33 nt, Artificial Sequence
  Condensin complex subunit 1 (928-938)
agccuggccggcgacguggcccuccagcagcug

SEQ ID NO: 36270 - RNA, 27 nt, Artificial Sequence
  AP-3 complex subunit delta-1 (220-228)
agccuggccccccucuucuucaagcug

SEQ ID NO: 36271 - RNA, 27 nt, Artificial Sequence
  Poly(rC)-binding protein 1 (337-345)
agccuggcccaguaccucaucaacgcc

SEQ ID NO: 36272 - RNA, 33 nt, Artificial Sequence
  Tyrosine-protein kinase Fer (665-675)
agccuggacgccgccgcgggcaugcucuaccug

SEQ ID NO: 36273 - RNA, 27 nt, Artificial Sequence
  Hemoglobin subunit alpha (29-37)
agccuggacaaguuccucgccuccgug

SEQ ID NO: 36274 - RNA, 27 nt, Artificial Sequence
  General transcription factor 3C polypeptide 1 (202-210)
agccuggacaagaccucccacagcgug

SEQ ID NO: 36275 - RNA, 27 nt, Artificial Sequence
  Regulator of nonsense transcripts 1 (683-691)
agccuguucgagcgccucgugguccug

SEQ ID NO: 36276 - RNA, 27 nt, Artificial Sequence
  MKL/myocardin-like protein 2 (820-828)
agccuguucggcucccccguggccaag

SEQ ID NO: 36277 - RNA, 30 nt, Artificial Sequence
  Protein flightless-1 homolog (1009-1018)
agccuguuccccggcaagcucgaggugguc

SEQ ID NO: 36278 - RNA, 30 nt, Artificial Sequence
  Cip1-interacting zinc finger protein (720-729)
agccugggccacuucgagaaccuccagaag

SEQ ID NO: 36279 - RNA, 27 nt, Artificial Sequence
  T-complex protein 1 subunit eta (301-309)
agccugcacgacgccaucaugaucgug

SEQ ID NO: 36280 - RNA, 30 nt, Artificial Sequence
  Coronin-1B (173-182)
agccugcaccccgaccucaucuacaacgug

SEQ ID NO: 36281 - RNA, 27 nt, Artificial Sequence
  T-complex protein 1 subunit zeta-2 (75-83)
agccugaucgccaagguggccaccgcg

SEQ ID NO: 36282 - RNA, 27 nt, Artificial Sequence
  Tyrosine-protein kinase JAK2 (367-375)
agccugaucgacggcuacuaccgccuc

SEQ ID NO: 36283 - RNA, 30 nt, Artificial Sequence
  Acidic leucine-rich nuclear phosphoprotein 32 family member B (48-57)
agccugaucaacgugggccucaucuccguc

SEQ ID NO: 36284 - RNA, 27 nt, Artificial Sequence
  Protein Smaug homolog 2 (238-246)
agccugauccccaccuccccgcaggug

SEQ ID NO: 36285 - RNA, 27 nt, Artificial Sequence
  Syntaxin-binding protein 2 (433-441)
agccugauccgcaaccucgagcagcug

SEQ ID NO: 36286 - RNA, 27 nt, Artificial Sequence
  Phospholipase A-2-activating protein (670-678)
agccugaucuccaccauccucgaggug

SEQ ID NO: 36287 - RNA, 27 nt, Artificial Sequence
  Serine/threonine-protein phosphatase PP1-beta catalytic subunit (10-18)
agccugaucacccgccuccuggaggug

SEQ ID NO: 36288 - RNA, 27 nt, Artificial Sequence
  Schlafen family member 5 (473-481)
agccugaagcagaagcucgugaacaag

SEQ ID NO: 36289 - RNA, 27 nt, Artificial Sequence
  Caprin-1 (184-192)
agccugcucgacgaguucuacaagcug

SEQ ID NO: 36290 - RNA, 30 nt, Artificial Sequence
  Macrophage erythroblast attacher (64-73)
agccugcucgacggcguggucgagaagcug

SEQ ID NO: 36291 - RNA, 24 nt, Artificial Sequence
  Cyclin-I (71-78)
agccugcucgaccgcuuccuggcc

SEQ ID NO: 36292 - RNA, 30 nt, Artificial Sequence
  Cyclin-I (71-80)
agccugcucgaccgcuuccuggccaccgug

SEQ ID NO: 36293 - RNA, 33 nt, Artificial Sequence
  Splicing factor 3B subunit 3 (509-519)
agccugcucggcgacgacgcccuggugcagguc

SEQ ID NO: 36294 - RNA, 27 nt, Artificial Sequence
  Histidine triad nucleotide-binding protein 1 (72-80)
agccugcucggccaccugaugaucgug

SEQ ID NO: 36295 - RNA, 33 nt, Artificial Sequence
  Acyl-CoA desaturase (80-90)
agccugcuccaccugggcgcccuguacgggauc

SEQ ID NO: 36296 - RNA, 27 nt, Artificial Sequence
  Splicing factor 3B subunit 1 (643-651)
agccugcuccccuuccugaaggccgug

SEQ ID NO: 36297 - RNA, 27 nt, Artificial Sequence
  Transformation/transcription domain-associated protein (819-827)
agccugcuccccuaccugccgaugcug

SEQ ID NO: 36298 - RNA, 27 nt, Artificial Sequence
  Histone acetyltransferase KAT2A (320-328)
agccugcuccgcuccaucuucaccgug

SEQ ID NO: 36299 - RNA, 27 nt, Artificial Sequence
  Mitotic spindle assembly checkpoint protein MAD2B (114-122)
agccugcucucccacguggagcagcug

SEQ ID NO: 36300 - RNA, 27 nt, Artificial Sequence
  Gamma-secretase C-terminal fragment 59 (436-444)
agccugcucuacaacgugcccgccguc

SEQ ID NO: 36301 - RNA, 30 nt, Artificial Sequence
  Syntenin-1 (289-298)
agccugauggaccacaccauccccgaggug

SEQ ID NO: 36302 - RNA, 27 nt, Artificial Sequence
  DNA topoisomerase 2-alpha (763-771)
agccugaugaugaccaucaucaaccuc

SEQ ID NO: 36303 - RNA, 27 nt, Artificial Sequence
  Phospholipase A-2-activating protein (625-633)
agccugaugucccacgccaucgagcuc

SEQ ID NO: 36304 - RNA, 27 nt, Artificial Sequence
  RecQ-mediated genome instability protein 1 (437-445)
agccugaacaacaagauccucaaccgc

SEQ ID NO: 36305 - RNA, 30 nt, Artificial Sequence
  A-kinase anchor protein 13 (131-140)
agccugcccaccgugaucaugcgcaacaag

SEQ ID NO: 36306 - RNA, 27 nt, Artificial Sequence
  Lon protease homolog 2, peroxisomal (51-59)
agccugcaguccaccauccucggcgug

SEQ ID NO: 36307 - RNA, 27 nt, Artificial Sequence
  Up-regulator of cell proliferation (550-558)
agccuguccgagaagcaguacuuccuc

SEQ ID NO: 36308 - RNA, 27 nt, Artificial Sequence
  Pleiotropic regulator 1 (232-240)
agccugaccggccacaucuccaccgug

SEQ ID NO: 36309 - RNA, 27 nt, Artificial Sequence
  Tyrosine-protein kinase JAK1 (405-413)
agccugguggacggcuacuuccgccuc

SEQ ID NO: 36310 - RNA, 27 nt, Artificial Sequence
  Long-chain-fatty-acid-CoA ligase 1 (410-418)
agccugugggaccgccucaucuuccac

SEQ ID NO: 36311 - RNA, 27 nt, Artificial Sequence
  Nucleoside diphosphate kinase (246-254)
agccugugguucaagcccgaggagcuc

SEQ ID NO: 36312 - RNA, 27 nt, Artificial Sequence
  Eukaryotic translation initiation factor 3 subunit C-like protein (382-390)
agccuguacgacuacaaccccaaccuc

SEQ ID NO: 36313 - RNA, 27 nt, Artificial Sequence
  DNA repair and recombination protein RAD54B (618-626)
agccuguacaagggccuccuguccgug

SEQ ID NO: 36314 - RNA, 27 nt, Artificial Sequence
  C-myc promoter-binding protein (1841-1849)
agccuguaccgcgagauccucuuccug

SEQ ID NO: 36315 - RNA, 27 nt, Artificial Sequence
  Molybdate-anion transporter (297-305)
agccuguaccgcaucgccaccuccaag

SEQ ID NO: 36316 - RNA, 33 nt, Artificial Sequence
  60S ribosome subunit biogenesis protein NIP7 homolog (135-145)
agcauggccgacaucccccugggcuucggggug

SEQ ID NO: 36317 - RNA, 27 nt, Artificial Sequence
  Eukaryotic translation initiation factor 3 subunit L (348-356)
agcauguuccagcgcaccaccuacaag

SEQ ID NO: 36318 - RNA, 27 nt, Artificial Sequence
  Probable ATP-dependent RNA helicase DDX6 (451-459)
agcaacaucgacaagucccuguacgug

SEQ ID NO: 36319 - RNA, 27 nt, Artificial Sequence
  Integrator complex subunit 5 (495-503)
agccccgccggccugaaggccgugcuc

SEQ ID NO: 36320 - RNA, 27 nt, Artificial Sequence
  Centrosomal protein of 170 kDa (1260-1268)
agccccgcccugaagaccacccgccuc

SEQ ID NO: 36321 - RNA, 24 nt, Artificial Sequence
  Cellular tumor antigen p53 (2-9)
agccccgcccugaacaagauguuc

SEQ ID NO: 36322 - RNA, 27 nt, Artificial Sequence
  E3 ubiquitin-protein ligase HUWE1 (376-384)
agccccgccccgaccaucaccucccug

SEQ ID NO: 36323 - RNA, 27 nt, Artificial Sequence
  Type II inositol 3,4-bisphosphate 4-phosphatase (439-447)
agccccgacucccugaagaacagccuc

SEQ ID NO: 36324 - RNA, 27 nt, Artificial Sequence
  N6-adenosine-methyltransferase 70 kDa subunit (525-533)
agccccggcacccgcaagaucgagcug

SEQ ID NO: 36325 - RNA, 27 nt, Artificial Sequence
  Integrator complex subunit 1 (254-262)
agcccccacggcggggcccuggugaug

SEQ ID NO: 36326 - RNA, 27 nt, Artificial Sequence
  Protein CASC5 (837-845)
agccccaucgagaaguccggcgugcug

SEQ ID NO: 36327 - RNA, 27 nt, Artificial Sequence
  Ephrin-A4 (18-26)
agcccccugcgcggcggguccagccuc

SEQ ID NO: 36328 - RNA, 27 nt, Artificial Sequence
  Cullin-7 (801-809)
agccccaacaccgaccgcgaggugcug

SEQ ID NO: 36329 - RNA, 27 nt, Artificial Sequence
  Tumor suppressor p53-binding protein 1 (1028-1036)
agcccccagaagaccauguccgugcug

SEQ ID NO: 36330 - RNA, 27 nt, Artificial Sequence
  Stromal interaction molecule 2 (531-539)
agcccccagccgcagcgcgcccagcug

SEQ ID NO: 36331 - RNA, 30 nt, Artificial Sequence
  Polyadenylate-binding protein-interacting protein 1 (120-129)
agcccccaguccggcaacuuccgccagcug

SEQ ID NO: 36332 - RNA, 27 nt, Artificial Sequence
  Proteasomal ATPase-associated factor 1 (195-203)
agcccccgcgccccggugcaggucauc

SEQ ID NO: 36333 - RNA, 30 nt, Artificial Sequence
  Gephyrin (270-279)
agcccccgcgcccaggccaccucccggcug

SEQ ID NO: 36334 - RNA, 27 nt, Artificial Sequence
  Tumor suppressor p53-binding protein 1 (1656-1664)
agcccccgcgccuccaugggcgugcug

SEQ ID NO: 36335 - RNA, 30 nt, Artificial Sequence
  Ras-related protein Rab-7a (111-120)
agcccccgcgacccggagaacuuccccuuc

SEQ ID NO: 36336 - RNA, 27 nt, Artificial Sequence
  Ankyrin repeat and LEM domain-containing protein 2 (512-520)
agcccccgcgacccggugcugacccuc

SEQ ID NO: 36337 - RNA, 27 nt, Artificial Sequence
  Helicase SKI2W (1016-1024)
agcccccgcuucccggcccaguaccug

SEQ ID NO: 36338 - RNA, 33 nt, Artificial Sequence
  Pleckstrin homology domain-containing family G member 2 (45-55)
agcccccgcggcuccgggagcuccaccagccug

SEQ ID NO: 36339 - RNA, 27 nt, Artificial Sequence
  Serine/threonine-protein kinase receptor R3 (5-13)
agcccccgcaagggccugcucaugcug

SEQ ID NO: 36340 - RNA, 27 nt, Artificial Sequence
  Procollagen-lysine,2-oxoglutarate 5-dioxygenase 2 (174-182)
agcccccgcaagggcugguccuucaug

SEQ ID NO: 36341 - RNA, 27 nt, Artificial Sequence
  Tyrosine-protein kinase BAZ1B (197-205)
agcccccgcaagcugccgaccucccuc

SEQ ID NO: 36342 - RNA, 27 nt, Artificial Sequence
  Mitochondrial carrier homolog 1 (89-97)
agcccccgccugauguccaacgcccuc

SEQ ID NO: 36343 - RNA, 30 nt, Artificial Sequence
  Intercellular adhesion molecule 1 (5-14)
agcccccgcccggcccugcccgcccuccug

SEQ ID NO: 36344 - RNA, 27 nt, Artificial Sequence
  AP-5 complex subunit mu-1 (117-125)
agcccccgcccgccccugaucuccgug

SEQ ID NO: 36345 - RNA, 27 nt, Artificial Sequence
  Integrator complex subunit 1 (211-219)
agcccccgcccgguggcccuggcccuc

SEQ ID NO: 36346 - RNA, 33 nt, Artificial Sequence
  Nuclear receptor subfamily 1 group D member 1 (405-415)
agcccccgccagggcaacuccaagaacgugcug

SEQ ID NO: 36347 - RNA, 27 nt, Artificial Sequence
  Sorbin and SH3 domain-containing protein 2 (230-238)
agcccccgcuccuacagcuccacccug

SEQ ID NO: 36348 - RNA, 27 nt, Artificial Sequence
  Baculoviral IAP repeat-containing protein 6 (4258-4266)
agcccccgcgugccgaacuccagcguc

SEQ ID NO: 36349 - RNA, 33 nt, Artificial Sequence
  Thymidine kinase, cytosolic (13-23)
agccccuccaagacccgcggccagauccaggug

SEQ ID NO: 36350 - RNA, 27 nt, Artificial Sequence
  Histone deacetylase 9 (322-330)
agccccucccugccgaacaucacccuc

SEQ ID NO: 36351 - RNA, 24 nt, Artificial Sequence
  Nucleolin (67-74)
agccccaccaagaagguggccguc

SEQ ID NO: 36352 - RNA, 27 nt, Artificial Sequence
  Nucleolar protein 11 (166-174)
agccaggaccccggcacccacgugguc

SEQ ID NO: 36353 - RNA, 27 nt, Artificial Sequence
  Unconventional myosin-If (124-132)
agccgcuucggcaaguacuucgagauc

SEQ ID NO: 36354 - RNA, 30 nt, Artificial Sequence
  DnaJ homolog subfamily B member 2 (131-140)
agccgccacuccggccccuucuucaccuuc

SEQ ID NO: 36355 - RNA, 27 nt, Artificial Sequence
  Hyccin (228-236)
agccgcauccccguguccagcggcuuc

SEQ ID NO: 36356 - RNA, 27 nt, Artificial Sequence
  Merlin (587-595)
agccgcguggccuucuucgaggagcug

SEQ ID NO: 36357 - RNA, 27 nt, Artificial Sequence
  Catenin beta-1 (341-349)
agccgcgugcugaagguccucuccgug

SEQ ID NO: 36358 - RNA, 33 nt, Artificial Sequence
  Stomatin-like protein 2, mitochondrial (29-39)
agcuccggccugccccgcaacaccgugguccuc

SEQ ID NO: 36359 - RNA, 27 nt, Artificial Sequence
  General transcription factor 3C polypeptide 2 (775-783)
agcuccggcgugcccaacccgcccaag

SEQ ID NO: 36360 - RNA, 30 nt, Artificial Sequence
  60S ribosomal protein L10a (2-11)
agcuccaaggugagccgcgacacccuguac

SEQ ID NO: 36361 - RNA, 27 nt, Artificial Sequence
  Ashwin (155-163)
agcuccaaccugcccgugaacaacaag

SEQ ID NO: 36362 - RNA, 27 nt, Artificial Sequence
  Transmembrane protein 176A (50-58)
agcucccgccugcucguggccagcugg

SEQ ID NO: 36363 - RNA, 27 nt, Artificial Sequence
  Vimentin (72-80)
agcuccgugcccggcguccgccugcuc

SEQ ID NO: 36364 - RNA, 27 nt, Artificial Sequence
  Synaptotagmin-like protein 2 (282-290)
agcaccgacuccgagacccugcgcuac

SEQ ID NO: 36365 - RNA, 27 nt, Artificial Sequence
  Ribosomal protein S6 kinase alpha-3 (327-335)
agcaccaucgacuggaacaagcuguac

SEQ ID NO: 36366 - RNA, 33 nt, Artificial Sequence
  Serine/threonine-protein kinase RIO2 (494-504)
agcaccauccccccggagcuggugaagcagaag

SEQ ID NO: 36367 - RNA, 36 nt, Artificial Sequence
  AP-3 complex subunit beta-1 (26-37)
agcaccaucucccccagcggcgccuucgggcuguuc

SEQ ID NO: 36368 - RNA, 33 nt, Artificial Sequence
  Forkhead box protein O1 (544-554)
agcaccaugccccacaccuccggcaugaaccgc

SEQ ID NO: 36369 - RNA, 27 nt, Artificial Sequence
  ATP-dependent RNA helicase DDX3X (410-418)
agcaccuccgagaacaucacccagaag

SEQ ID NO: 36370 - RNA, 30 nt, Artificial Sequence
  Elongation factor 1-alpha 1 (21-30)
agcaccaccacgggccaccugaucuacaag

SEQ ID NO: 36371 - RNA, 27 nt, Artificial Sequence
  Protein STON1-GTF2A1L (339-347)
agcguggccggcaagauccacaccguc

SEQ ID NO: 36372 - RNA, 30 nt, Artificial Sequence
  Lysine-specific demethylase 7A (208-217)
agcguguuccccaagccguucguccagaag

SEQ ID NO: 36373 - RNA, 30 nt, Artificial Sequence
  Round spermatid basic protein 1-like protein (733-742)
agcguguucuccgacaagcugcacagcaag

SEQ ID NO: 36374 - RNA, 30 nt, Artificial Sequence
  Disintegrin and metalloproteinase domain-containing protein 10 (118-127)
agcgugaucgacggccgcuucgagggguuc

SEQ ID NO: 36375 - RNA, 27 nt, Artificial Sequence
  Inactive phospholipase C-like protein 2 (372-380)
agcgugaucgacaucaucaacaaguac

SEQ ID NO: 36376 - RNA, 27 nt, Artificial Sequence
  E3 ubiquitin-protein ligase UBR2 (812-820)
agcgugaucgaggccgucgcccacuuc

SEQ ID NO: 36377 - RNA, 27 nt, Artificial Sequence
  Transcription factor MafG (149-157)
agcgugaucaccaucgucaaguccaag

SEQ ID NO: 36378 - RNA, 30 nt, Artificial Sequence
  Probable E3 ubiquitin-protein ligase HERC4 (549-558)
agcgugcuggagcccccgcucuuccugaag

SEQ ID NO: 36379 - RNA, 30 nt, Artificial Sequence
  40S ribosomal protein S6 (105-114)
agcgugcugaaccucgucaucgugaagaag

SEQ ID NO: 36380 - RNA, 30 nt, Artificial Sequence
  Pumilio homolog 1 (183-192)
agcgugucccagcccaucaugguccagcgc

SEQ ID NO: 36381 - RNA, 27 nt, Artificial Sequence
  Phosphatidylinositol 3-kinase regulatory subunit gamma (51-59)
agcguggucgagcugaucaaccacuac

SEQ ID NO: 36382 - RNA, 27 nt, Artificial Sequence
  Dolichyl-diphosphooligosaccharide-proteinosyltransferase subunit DAD1 (4-12)
agcguggucuccgugaucagccgcuuc

SEQ ID NO: 36383 - RNA, 27 nt, Artificial Sequence
  Protein TBRG4 (151-159)
agcguguggcacggcacccuguccaag

SEQ ID NO: 36384 - RNA, 27 nt, Artificial Sequence
  Nesprin-1 (4541-4549)
agcguguacgacuccguccugcagaag

SEQ ID NO: 36385 - RNA, 33 nt, Artificial Sequence
  Protein ELYS (1415-1425)
agcguguacgagggcaagaucuucacccagaag

SEQ ID NO: 36386 - RNA, 30 nt, Artificial Sequence
  ATPase family AAA domain-containing protein 2 (757-766)
agcguguacgagaacggccugucccagaag

SEQ ID NO: 36387 - RNA, 27 nt, Artificial Sequence
  Type I inositol 1,4,5-trisphosphate 5-phosphatase (94-102)
agcguguacuccggcauccgccacaag

SEQ ID NO: 36388 - RNA, 27 nt, Artificial Sequence
  Disks large homolog 3 (45-53)
agcuacggcgacauccugcacgugauc

SEQ ID NO: 36389 - RNA, 27 nt, Artificial Sequence
  Long-chain-fatty-acid-CoA ligase 5 (359-367)
agcuaccugccccucgcccacauguuc

SEQ ID NO: 36390 - RNA, 27 nt, Artificial Sequence
  Trafficking protein particle complex subunit 1 (132-140)
agcuacgugcgcucccugcccuucuuc

SEQ ID NO: 36391 - RNA, 27 nt, Artificial Sequence
  HLA class I histocompatibility antigen, B-15 alpha chain (158-166)
accgccgccgacaccgcggcccagauc

SEQ ID NO: 36392 - RNA, 27 nt, Artificial Sequence
  Bromodomain testis-specific protein (144-152)
accgccgcccccccggcgcagccccug

SEQ ID NO: 36393 - RNA, 24 nt, Artificial Sequence
  Heterochromatin protein 1-binding protein 3 (363-370)
accgcccugaagaaguacgugcuc

SEQ ID NO: 36394 - RNA, 24 nt, Artificial Sequence
  Probable E3 ubiquitin-protein ligase HERC4 (592-599)
accgcccugaaggugcucgagauc

SEQ ID NO: 36395 - RNA, 24 nt, Artificial Sequence
  Histone H1.3 (4-11)
accgccccccuggccccgaccauc

SEQ ID NO: 36396 - RNA, 27 nt, Artificial Sequence
  Malectin (10-18)
accgccguggcccugcuccgccugcug

SEQ ID NO: 36397 - RNA, 27 nt, Artificial Sequence
  Glyoxalase domain-containing protein 4 (117-125)
accgaggcccccggcggguacaaguuc

SEQ ID NO: 36398 - RNA, 27 nt, Artificial Sequence
  SRSF protein kinase 2 (529-537)
accgaggacauccagacccgccaguac

SEQ ID NO: 36399 - RNA, 36 nt, Artificial Sequence
  Twinfilin-2 (164-175)
accgagaucagcguggaguccaagcaccagacccug

SEQ ID NO: 36400 - RNA, 27 nt, Artificial Sequence
  Nucleolar protein 14 (741-749)
accgagauggagagccagaagcagcug

SEQ ID NO: 36401 - RNA, 27 nt, Artificial Sequence
  ATPase WRNIP1 (477-485)
accgagaacgacgugaaggagggccug

SEQ ID NO: 36402 - RNA, 30 nt, Artificial Sequence
  4F2 cell-surface antigen heavy chain (5-14)
accgagguggacaugaaggaggucgagcug

SEQ ID NO: 36403 - RNA, 27 nt, Artificial Sequence
  Transgelin (191-199)
accggcuacgggcgcccccggcagauc

SEQ ID NO: 36404 - RNA, 27 nt, Artificial Sequence
  Splicing factor 3A subunit 3 (238-246)
acccacgccggcgcccaccuggaccuc

SEQ ID NO: 36405 - RNA, 27 nt, Artificial Sequence
  Histone-binding protein RBBP4 (37-45)
acccacgcccuggaguggcccagccuc

SEQ ID NO: 36406 - RNA, 27 nt, Artificial Sequence
  Bifunctional glutamate/proline-tRNA ligase (614-622)
acccacgcccugcccaucccggugauc

SEQ ID NO: 36407 - RNA, 27 nt, Artificial Sequence
  Activator of 90 kDa heat shock protein ATPase homolog 1 (236-244)
acccacgcccccgccacccuggaggcg

SEQ ID NO: 36408 - RNA, 27 nt, Artificial Sequence
  Integrin beta-7 (446-454)
acccacugccugcccgagccgcaccuc

SEQ ID NO: 36409 - RNA, 30 nt, Artificial Sequence
  Echinoderm microtubule-associated protein-like 3 (848-857)
acccacgacgacagccaccuggugucccuc

SEQ ID NO: 36410 - RNA, 27 nt, Artificial Sequence
  Double-stranded RNA-specific adenosine deaminase (1054-1062)
acccacuuccugcagcccaucuaccuc

SEQ ID NO: 36411 - RNA, 27 nt, Artificial Sequence
  Histone deacetylase complex subunit SAP18 (85-93)
acccacuucaacuucgccaucguguuc

SEQ ID NO: 36412 - RNA, 27 nt, Artificial Sequence
  Ubiquitin carboxyl-terminal hydrolase 34 (2105-2113)
acccacuucagcuucccccugcgccuc

SEQ ID NO: 36413 - RNA, 27 nt, Artificial Sequence
  Syntaxin-binding protein 1 (570-578)
acccacauccugaccccccagaagcuc

SEQ ID NO: 36414 - RNA, 30 nt, Artificial Sequence
  Telomere-associated protein RIF1 (62-71)
acccacaucagcucccagaacagcgagcug

SEQ ID NO: 36415 - RNA, 30 nt, Artificial Sequence
  RE1-silencing transcription factor (917-926)
acccacaucagcuccagcggccagaaccug

SEQ ID NO: 36416 - RNA, 27 nt, Artificial Sequence
  Microtubule-actin cross-linking factor 1, isoforms 1/2/3/5 (6374-6382)
acccacauggagcuguacagccagcuc

SEQ ID NO: 36417 - RNA, 27 nt, Artificial Sequence
  ATP-citrate synthase (409-417)
acccacaugaccgccaucgugggcaug

SEQ ID NO: 36418 - RNA, 27 nt, Artificial Sequence
  Protein tyrosine phosphatase type IVA 1 (22-30)
acccacaaccccaccaacgccacgcug

SEQ ID NO: 36419 - RNA, 27 nt, Artificial Sequence
  Phospholipase D3 (389-397)
acccacagcgacauccaggugaagcug

SEQ ID NO: 36420 - RNA, 27 nt, Artificial Sequence
  General transcription factor IIH subunit 5 (41-49)
acccacguguucgucaucgccgagcug

SEQ ID NO: 36421 - RNA, 30 nt, Artificial Sequence
  DNA replication licensing factor MCM6 (781-790)
acccacuacgaccacgugcugaucgagcuc

SEQ ID NO: 36422 - RNA, 27 nt, Artificial Sequence
  Microfibrillar-associated protein 1 (372-380)
accauccugcccaaggugaugcagguc

SEQ ID NO: 36423 - RNA, 27 nt, Artificial Sequence
  Putative protein arginine N-methyltransferase 9 (164-172)
accaucuacaacgccgccauccagaag

SEQ ID NO: 36424 - RNA, 27 nt, Artificial Sequence
  Protein NYNRIN (1487-1495)
acccuggccgacaucaucgcccgccuc

SEQ ID NO: 36425 - RNA, 27 nt, Artificial Sequence
  Ankyrin repeat and KH domain-containing protein 1 (1028-1036)
acccuggacgaccucaucgccgccgug

SEQ ID NO: 36426 - RNA, 27 nt, Artificial Sequence
  TGF-beta-activated kinase 1 and MAP3K7-binding protein 1 (426-434)
acccuggacgaggccacccccacgcuc

SEQ ID NO: 36427 - RNA, 27 nt, Artificial Sequence
  Exocyst complex component 1 (91-99)
acccugggcaacgugcucgucaccgug

SEQ ID NO: 36428 - RNA, 30 nt, Artificial Sequence
  Spliceosome RNA helicase DDX39B (114-123)
acccugcacggccuccagcaguacuacgug

SEQ ID NO: 36429 - RNA, 27 nt, Artificial Sequence
  Hexokinase-1 (35-43)
acccugaucgacaucaugacccgcuuc

SEQ ID NO: 36430 - RNA, 27 nt, Artificial Sequence
  Short transient receptor potential channel 4-associated protein (209-217)
acccugaucgaggacauccucggcgug

SEQ ID NO: 36431 - RNA, 27 nt, Artificial Sequence
  Cullin-7 (386-394)
acccugaucagcgagcucgugcaggcc

SEQ ID NO: 36432 - RNA, 33 nt, Artificial Sequence
  T-complex protein 1 subunit eta (11-21)
acccugcucgccgccgaguuccugaagcaggug

SEQ ID NO: 36433 - RNA, 33 nt, Artificial Sequence
  NADH-cytochrome b5 reductase 1 (39-49)
acccugcucgaccccaacgagaaguaccugcug

SEQ ID NO: 36434 - RNA, 27 nt, Artificial Sequence
  Centrosomal protein POC5 (254-262)
acccugcucaagaagguguggaagguc

SEQ ID NO: 36435 - RNA, 27 nt, Artificial Sequence
  Protrudin (88-96)
acccugcucaacagcacccuguuccug

SEQ ID NO: 36436 - RNA, 27 nt, Artificial Sequence
  Eukaryotic translation initiation factor 3 subunit M (163-171)
acccugcuccgccugcuguacgaggcc

SEQ ID NO: 36437 - RNA, 27 nt, Artificial Sequence
  DNA mismatch repair protein Msh6 (739-747)
acccugaacaaccucgagaucuuccug

SEQ ID NO: 36438 - RNA, 27 nt, Artificial Sequence
  Protein SDA1 homolog (404-412)
acccugaacccccagaugcuccagaag

SEQ ID NO: 36439 - RNA, 27 nt, Artificial Sequence
  Testis-expressed sequence 10 protein (436-444)
acccugagcgacaucauggugucccuc

SEQ ID NO: 36440 - RNA, 27 nt, Artificial Sequence
  Transcription initiation factor TFIID subunit 8 (89-97)
acccugagcgacaucguggucacccuc

SEQ ID NO: 36441 - RNA, 27 nt, Artificial Sequence
  Serine/threonine-protein kinase SIK2 (269-277)
acccugagcgaggugaccaaccagcuc

SEQ ID NO: 36442 - RNA, 27 nt, Artificial Sequence
  MAP kinase-activating death domain protein (291-299)
acccugguggacuucccccuccaccug

SEQ ID NO: 36443 - RNA, 33 nt, Artificial Sequence
  Motile sperm domain-containing protein 1 (39-49)
acccuguacaaccccuacgaguucgcccucaag

SEQ ID NO: 36444 - RNA, 27 nt, Artificial Sequence
  Chondroitin sulfate proteoglycan 4 (21-29)
accaugcuggcccgccucgccagcgcg

SEQ ID NO: 36445 - RNA, 27 nt, Artificial Sequence
  Poly (ADP-ribose) polymerase 14 (1511-1519)
accaugaacgagaagcagcuguuccac

SEQ ID NO: 36446 - RNA, 27 nt, Artificial Sequence
  ATP-binding cassette sub-family F member 2 (218-226)
acccccgccaugcagcgcaagaagcug

SEQ ID NO: 36447 - RNA, 27 nt, Artificial Sequence
  Splicing factor, arginine/serine-rich 19 (1147-1155)
acccccgccccggugcccaccagccug

SEQ ID NO: 36448 - RNA, 27 nt, Artificial Sequence
  SCAN domain-containing protein 1 (132-140)
acccccggcccggccgggagccgccug

SEQ ID NO: 36449 - RNA, 27 nt, Artificial Sequence
  Dolichyl-diphosphooligosaccharide-proteinosyltransferase subunit 2 (291-299)
accccccaccagaccuucgugcgccug

SEQ ID NO: 36450 - RNA, 27 nt, Artificial Sequence
  Protein ELYS (1773-1781)
acccccaagaugccgggccagagcgug

SEQ ID NO: 36451 - RNA, 27 nt, Artificial Sequence
  Microtubule-associated protein 4 (892-900)
acccccaugccgagccgccccuccacc

SEQ ID NO: 36452 - RNA, 24 nt, Artificial Sequence
  Nucleophosmin (95-102)
acccccccggugguccugcgccuc

SEQ ID NO: 36453 - RNA, 33 nt, Artificial Sequence
  Filamin-A (812-822)
accccccgcggcgccgggagcuacaccaucaug

SEQ ID NO: 36454 - RNA, 33 nt, Artificial Sequence
  40S ribosomal protein S9 (15-25)
accccccgccggccguucgagaagagccgccug

SEQ ID NO: 36455 - RNA, 27 nt, Artificial Sequence
  BTB/POZ domain-containing adapter for CUL3-mediated RhoA degradation protein 2 (290-298)
accccccgcgugccggacaacagccug

SEQ ID NO: 36456 - RNA, 27 nt, Artificial Sequence
  Sentrin-specific protease 3 (353-361)
acccccagccgcaagggccuggugcuc

SEQ ID NO: 36457 - RNA, 24 nt, Artificial Sequence
  Interferon regulatory factor 1 (54-61)
acccccgugcgccugccgagcauc

SEQ ID NO: 36458 - RNA, 27 nt, Artificial Sequence
  Replication protein A 70 kDa DNA-binding subunit (191-199)
acccccuaccagagcaaguggaccauc

SEQ ID NO: 36459 - RNA, 27 nt, Artificial Sequence
  Splicing factor U2AF 65 kDa subunit (179-187)
acccaggcccccggcaacccggugcug

SEQ ID NO: 36460 - RNA, 27 nt, Artificial Sequence
  GPN-loop GTPase 1 (88-96)
acccgcuucgaccaggugaugaaguuc

SEQ ID NO: 36461 - RNA, 27 nt, Artificial Sequence
  RuvB-like 2 (391-399)
acccgcaucggccuggagaccagccuc

SEQ ID NO: 36462 - RNA, 27 nt, Artificial Sequence
  40S ribosomal protein S4, Y isoform 2 (220-228)
acccgcaucagcaacaucuucgugauc

SEQ ID NO: 36463 - RNA, 27 nt, Artificial Sequence
  40S ribosomal protein S4, X isoform (201-209)
acccgccugagcaacaucuucgugauc

SEQ ID NO: 36464 - RNA, 27 nt, Artificial Sequence
  Transmembrane protein 147 (157-165)
acccgcuacgaccuguaccacaccuuc

SEQ ID NO: 36465 - RNA, 30 nt, Artificial Sequence
  Transcriptional regulator Kaiso (365-374)
accagcuucgacggcucccugauccagaag

SEQ ID NO: 36466 - RNA, 24 nt, Artificial Sequence
  HCG2043421, isoform CRA_c (58-65)
accagcaagcagcccgugggcuuc

SEQ ID NO: 36467 - RNA, 27 nt, Artificial Sequence
  WD repeat-containing protein 78 (675-683)
accagcguggucuacgacguggccugg

SEQ ID NO: 36468 - RNA, 27 nt, Artificial Sequence
  Non-POU domain-containing octamer-binding protein (127-135)
accaccuucccccgcccggugacgguc

SEQ ID NO: 36469 - RNA, 33 nt, Artificial Sequence
  Nicotinamide phosphoribosyltransferase (220-230)
accguggccggccuggcccucaucaagaaguac

SEQ ID NO: 36470 - RNA, 27 nt, Artificial Sequence
  1,2-dihydroxy-3-keto-5-methylthiopentene dioxygenase (150-158)
accguggacgagaagaacuacaccaag

SEQ ID NO: 36471 - RNA, 30 nt, Artificial Sequence
  Aldehyde dehydrogenase family 16 member A1 (661-670)
accguguuccccgccggccuggccaacguc

SEQ ID NO: 36472 - RNA, 27 nt, Artificial Sequence
  Protein phosphatase 1D (261-269)
accgugaucgaccagauccccuuccug

SEQ ID NO: 36473 - RNA, 27 nt, Artificial Sequence
  Integrin beta-7 (200-208)
accgugcugcccuucgucagcaccgug

SEQ ID NO: 36474 - RNA, 27 nt, Artificial Sequence
  Caspase-1 (49-57)
accgugauggacaagacccgcgcccug

SEQ ID NO: 36475 - RNA, 27 nt, Artificial Sequence
  Kelch-like protein 8 (200-208)
accgugaugggcaagaucuucgccguc

SEQ ID NO: 36476 - RNA, 27 nt, Artificial Sequence
  CMP-N-acetylneuraminate-beta-galactosamide-alpha-2,3-sialyltransf erase 1 (229-237)
accuacauccccgugccggccaagauc

SEQ ID NO: 36477 - RNA, 27 nt, Artificial Sequence
  Vacuolar protein sorting-associated protein 13C (2564-2572)
accuacaucagcuggaaggaggagcug

SEQ ID NO: 36478 - RNA, 27 nt, Artificial Sequence
  Rho GTPase-activating protein 18 (597-605)
accuacaugaaggaccuguaccagcuc

SEQ ID NO: 36479 - RNA, 27 nt, Artificial Sequence
  Plexin-B2 (1279-1287)
accuacaccgaccgcguguucuuccug

SEQ ID NO: 36480 - RNA, 27 nt, Artificial Sequence
  Poly (ADP-ribose) polymerase 14 (1544-1552)
guggccuacggcaaggggaccuacuuc

SEQ ID NO: 36481 - RNA, 27 nt, Artificial Sequence
  Zinc finger SWIM domain-containing protein 1 (322-330)
guggagagccacauccagcacucccug

SEQ ID NO: 36482 - RNA, 27 nt, Artificial Sequence
  Putative 40S ribosomal protein S10-like (27-35)
gugcacaugcccaagcacccggagcug

SEQ ID NO: 36483 - RNA, 30 nt, Artificial Sequence
  Inosine-5'-monophosphate dehydrogenase 2 (361-370)
gugaucgccgacggcgggauccagaacguc

SEQ ID NO: 36484 - RNA, 27 nt, Artificial Sequence
  Protein DENND6A (261-269)
gugauccugcccaccguccacgaggug

SEQ ID NO: 36485 - RNA, 27 nt, Artificial Sequence
  N-glycosylase/DNA lyase (58-66)
gugcuggccgaccaggucuggacccuc

SEQ ID NO: 36486 - RNA, 27 nt, Artificial Sequence
  CREB-binding protein (238-246)
gugcuggccgagacccucacccagguc

SEQ ID NO: 36487 - RNA, 27 nt, Artificial Sequence
  Transmembrane protein 209 (29-37)
gugcuggccuggggccuccugaacguc

SEQ ID NO: 36488 - RNA, 27 nt, Artificial Sequence
  Kelch-like protein 5 (324-332)
gugcuggacgacaagcucuacgucgug

SEQ ID NO: 36489 - RNA, 27 nt, Artificial Sequence
  RNA-binding protein 40 (490-498)
gugcuguucggcaagcccauggucgug

SEQ ID NO: 36490 - RNA, 27 nt, Artificial Sequence
  Pre-mRNA-splicing factor ATP-dependent RNA helicase PRP16 (663-671)
gugcuguucggccuccugcgcgagguc

SEQ ID NO: 36491 - RNA, 36 nt, Artificial Sequence
  Translocon-associated protein subunit alpha (19-30)
gugcuguuccgcggcgggccccggggccuccuggcc

SEQ ID NO: 36492 - RNA, 36 nt, Artificial Sequence
  Translocon-associated protein subunit alpha (19-30)
gugcuguuccgcggcgggccccggggcagccucgcc

SEQ ID NO: 36493 - RNA, 33 nt, Artificial Sequence
  Major prion protein (226-236)
gugcuguucagcucccccccggucauccuccug

SEQ ID NO: 36494 - RNA, 27 nt, Artificial Sequence
  Fibroblast growth factor receptor substrate 2 (252-260)
gugcugggccccaccccgguccagaag

SEQ ID NO: 36495 - RNA, 30 nt, Artificial Sequence
  Actin-related protein 2/3 complex subunit 4 (61-70)
gugcugaucgagggcagcaucaacuccguc

SEQ ID NO: 36496 - RNA, 30 nt, Artificial Sequence
  mRNA cap guanine-N7 methyltransferase (182-191)
gugcugaucggcgaguuccucgagaagguc

SEQ ID NO: 36497 - RNA, 30 nt, Artificial Sequence
  Trabeculin-alpha (4505-4514)
gugcugaucaagaaccuccuggucagcgug

SEQ ID NO: 36498 - RNA, 27 nt, Artificial Sequence
  ATP-binding cassette sub-family F member 3 (85-93)
gugcugcucgacgcccccauccagcug

SEQ ID NO: 36499 - RNA, 27 nt, Artificial Sequence
  Vacuolar protein sorting-associated protein 8 homolog (414-422)
gugcugcucgacagcgucgagaagcug

SEQ ID NO: 36500 - RNA, 30 nt, Artificial Sequence
  Fragile X mental retardation protein 1 (19-28)
gugcugcucgacuaccaccugaacuaccug

SEQ ID NO: 36501 - RNA, 27 nt, Artificial Sequence
  Signal recognition particle 14 kDa protein (2-10)
gugcugcucgagagcgagcaguuccug

SEQ ID NO: 36502 - RNA, 36 nt, Artificial Sequence
  Signal recognition particle 14 kDa protein (2-13)
gugcugcucgagagcgagcaguuccugaccgagcug

SEQ ID NO: 36503 - RNA, 27 nt, Artificial Sequence
  Leucine-tRNA ligase, cytoplasmic (328-336)
gugcugauggagaacaucgucuaccuc

SEQ ID NO: 36504 - RNA, 30 nt, Artificial Sequence
  E3 ubiquitin-protein ligase MARCH6 (457-466)
gugcugcccaacuuccucccguacaacguc

SEQ ID NO: 36505 - RNA, 27 nt, Artificial Sequence
  DNA replication licensing factor MCM5 (120-128)
gugcugcaggacauccaggucaugcuc

SEQ ID NO: 36506 - RNA, 27 nt, Artificial Sequence
  Sarcolemmal membrane-associated protein (140-148)
gugcugcaggagaagaucgaggucgug

SEQ ID NO: 36507 - RNA, 27 nt, Artificial Sequence
  Trabeculin-alpha (2088-2096)
gugcugcagggcaagcucgccgagguc

SEQ ID NO: 36508 - RNA, 27 nt, Artificial Sequence
  Cytoplasmic dynein 1 heavy chain 1 (1781-1789)
gugcugagcaacgucgaggugacccuc

SEQ ID NO: 36509 - RNA, 27 nt, Artificial Sequence
  5-formyltetrahydrofolate cyclo-ligase (35-43)
gugcugagccagaaggucaucgcccac

SEQ ID NO: 36510 - RNA, 24 nt, Artificial Sequence
  Signal transducer and activator of transcription 1-alpha/beta (300-307)
gugcugugggaccgcaccuucagc

SEQ ID NO: 36511 - RNA, 30 nt, Artificial Sequence
  Signal transducer and activator of transcription 1-alpha/beta (300-309)
gugcugugggaccgcaccuucagccucuuc

SEQ ID NO: 36512 - RNA, 27 nt, Artificial Sequence
  Pre-rRNA-processing protein TSR1 homolog (678-686)
gugcugugguucaagcccgucgagcuc

SEQ ID NO: 36513 - RNA, 27 nt, Artificial Sequence
  Dolichol-phosphate mannosyltransferase subunit 3 (58-66)
gugcuguggccccucccggccuaccug

SEQ ID NO: 36514 - RNA, 33 nt, Artificial Sequence
  Msx2-interacting protein (557-567)
gugcuguacaacgagaucgaguacgcccaggcc

SEQ ID NO: 36515 - RNA, 27 nt, Artificial Sequence
  2',5'-phosphodiesterase 12 (419-427)
gugcuguaccccagcgcccaggagaag

SEQ ID NO: 36516 - RNA, 27 nt, Artificial Sequence
  Serine/threonine-protein kinase ATR (2265-2273)
gugaugauccccacccugccgagcauc

SEQ ID NO: 36517 - RNA, 27 nt, Artificial Sequence
  Receptor-type tyrosine-protein phosphatase U (975-983)
gugaugaucaccaagcuggucgaggug

SEQ ID NO: 36518 - RNA, 27 nt, Artificial Sequence
  Translocon-associated protein subunit gamma (64-72)
gugaugacccuggucagcaccuaccuc

SEQ ID NO: 36519 - RNA, 24 nt, Artificial Sequence
  60S ribosomal protein L13a (120-127)
gugcccgccgcccugaaggucgug

SEQ ID NO: 36520 - RNA, 27 nt, Artificial Sequence
  Ankyrin repeat and KH domain-containing protein 1 (1721-1729)
gugcccgccagcgucgugucccgcauc

SEQ ID NO: 36521 - RNA, 27 nt, Artificial Sequence
  Protein UXT (95-103)
gugcccgacaccagccgcaucuacguc

SEQ ID NO: 36522 - RNA, 27 nt, Artificial Sequence
  Guanine nucleotide-binding protein-like 3 (295-303)
gugccccuggacaagcagaucaccauc

SEQ ID NO: 36523 - RNA, 27 nt, Artificial Sequence
  Pumilio homolog 1 (345-353)
gugccccuggacccgauggagcacguc

SEQ ID NO: 36524 - RNA, 27 nt, Artificial Sequence
  Myotubularin (85-93)
gugccccugggcgucaucagccgcauc

SEQ ID NO: 36525 - RNA, 24 nt, Artificial Sequence
  Ran-binding protein 6 (956-963)
gugccccugcucgucaaggugauc

SEQ ID NO: 36526 - RNA, 27 nt, Artificial Sequence
  Cytoplasmic dynein 1 heavy chain 1 (2524-2532)
gugccccugccgaccgcccccaacauc

SEQ ID NO: 36527 - RNA, 27 nt, Artificial Sequence
  Transcriptional regulator Kaiso (118-126)
gugccccugagccaggucaaguccauc

SEQ ID NO: 36528 - RNA, 27 nt, Artificial Sequence
  Transcription factor Sp4 (217-225)
gugcccaaccugcagaccgucagcgug

SEQ ID NO: 36529 - RNA, 27 nt, Artificial Sequence
  L-lactate dehydrogenase B chain (19-27)
gugcccaacaacaagaucaccgucgug

SEQ ID NO: 36530 - RNA, 27 nt, Artificial Sequence
  Histone deacetylase complex subunit SAP130 (800-808)
gugcccccgcuggccaccaacaccguc

SEQ ID NO: 36531 - RNA, 30 nt, Artificial Sequence
  Endoplasmic reticulum resident protein 29 (5-14)
gugccccgcgccgccuuccugagcccgcuc

SEQ ID NO: 36532 - RNA, 27 nt, Artificial Sequence
  Myotubularin (35-43)
gugccccgccugccgggcgagacccuc

SEQ ID NO: 36533 - RNA, 27 nt, Artificial Sequence
  Adapter protein CIKS (387-395)
gugccccgcccgcccagcaaccccccc

SEQ ID NO: 36534 - RNA, 27 nt, Artificial Sequence
  Histone H2A deubiquitinase MYSM1 (446-454)
gugccccgcccgaccaagagcuccuuc

SEQ ID NO: 36535 - RNA, 30 nt, Artificial Sequence
  PDZ and LIM domain protein 5 (203-212)
gugccccgccagccgaccgucaccagcgug

SEQ ID NO: 36536 - RNA, 33 nt, Artificial Sequence
  Filamin-A (1503-1513)
gugccccgcagcccguucaaggucaaggugcug

SEQ ID NO: 36537 - RNA, 27 nt, Artificial Sequence
  Ankyrin repeat domain-containing protein 40 (223-231)
gugcccagcaagccgcccaugucccug

SEQ ID NO: 36538 - RNA, 27 nt, Artificial Sequence
  Uroporphyrinogen decarboxylase (106-114)
gugcccuaccuggucggccagguggug

SEQ ID NO: 36539 - RNA, 24 nt, Artificial Sequence
  Puromycin-sensitive aminopeptidase-like protein (298-305)
gugcccuacccgcugcccaagauc

SEQ ID NO: 36540 - RNA, 36 nt, Artificial Sequence
  Elongation factor 1-beta (214-225)
gugcagagcauggacgucgccgccuucaacaagauc

SEQ ID NO: 36541 - RNA, 30 nt, Artificial Sequence
  DNA repair protein RAD51 homolog 3 (23-32)
gugcgcgucaagcuggugagcgccggcuuc

SEQ ID NO: 36542 - RNA, 27 nt, Artificial Sequence
  CGG triplet repeat-binding protein 1 (6-14)
gugaccgcccccccggcccgcaaccgg

SEQ ID NO: 36543 - RNA, 27 nt, Artificial Sequence
  UDP-N-acetylhexosamine pyrophosphorylase-like protein 1 (35-43)
gugaccuaccccaagggcauguaccgc

SEQ ID NO: 36544 - RNA, 27 nt, Artificial Sequence
  Transformation/transcription domain-associated protein (246-254)
guggucgccgaguucgugccccugauc

SEQ ID NO: 36545 - RNA, 27 nt, Artificial Sequence
  Ubiquitin carboxyl-terminal hydrolase BAP1 (172-180)
guggucaagcccccgggcagcucccug

SEQ ID NO: 36546 - RNA, 27 nt, Artificial Sequence
  Ran-binding protein 9 (33-41)
gugguccugcccgccccgcccgccgug

SEQ ID NO: 36547 - RNA, 30 nt, Artificial Sequence
  ATP-dependent DNA helicase Q1 (430-439)
guggucauggagaacgugggccagcagaag

SEQ ID NO: 36548 - RNA, 27 nt, Artificial Sequence
  Heterogeneous nuclear ribonucleoprotein A1 (44-52)
guggucaugcgcgaccccaacaccaag

SEQ ID NO: 36549 - RNA, 30 nt, Artificial Sequence
  G2/mitotic-specific cyclin-B1 (387-396)
guggucauggugaaccagggccugaccaag

SEQ ID NO: 36550 - RNA, 27 nt, Artificial Sequence
  Ral GTPase-activating protein subunit beta (37-45)
gugguccgcccccugggccaggugcuc

SEQ ID NO: 36551 - RNA, 27 nt, Artificial Sequence
  CTD small phosphatase-like protein 2 (354-362)
guguacgccgacaagcugcucaacauc

SEQ ID NO: 36552 - RNA, 27 nt, Artificial Sequence
  Sorting nexin-8 (400-408)
guguaccugccccucaccagccacauc

SEQ ID NO: 36553 - RNA, 27 nt, Artificial Sequence
  Tuftelin-interacting protein 11 (428-436)
guguacccccugaugaaggaguacuuc

SEQ ID NO: 36554 - RNA, 27 nt, Artificial Sequence
  Syntaxin-binding protein 6 (92-100)
uggaugcuggagcagcuccgccaggug

SEQ ID NO: 36555 - RNA, 27 nt, Artificial Sequence
  Protein syndesmos (33-41)
uacgccgccaaccccggccagcuguuc

SEQ ID NO: 36556 - RNA, 27 nt, Artificial Sequence
  Heat shock cognate 71 kDa protein (545-553)
uacgccuucaacaugaaggccaccgug

SEQ ID NO: 36557 - RNA, 27 nt, Artificial Sequence
  HLA class I histocompatibility antigen, alpha chain G (115-123)
uacgccuacgacggcaaggacuaccug

SEQ ID NO: 36558 - RNA, 30 nt, Artificial Sequence
  RHO/RAC effector protein (1011-1020)
uacgagaucgacaugaagcaguacacccug

SEQ ID NO: 36559 - RNA, 27 nt, Artificial Sequence
  Actin, alpha skeletal muscle (36-44)
uacgagcugcccgacggccaggugauc

SEQ ID NO: 36560 - RNA, 36 nt, Artificial Sequence
  Mitogen-activated protein kinase kinase kinase 6 (112-123)
uacgaguacaccgagaccggcgagcgccuggugcuc

SEQ ID NO: 36561 - RNA, 27 nt, Artificial Sequence
  Gametogenetin-binding protein 2 (25-33)
uacaucgacgacacccugaccauggug

SEQ ID NO: 36562 - RNA, 27 nt, Artificial Sequence
  ATP-dependent 6-phosphofructokinase, muscle type (292-300)
uacaucuucgaggagcccuucaccauc

SEQ ID NO: 36563 - RNA, 27 nt, Artificial Sequence
  Sphingomyelin phosphodiesterase 4 (105-113)
uacaaguucgacuuccccgugagcuac

SEQ ID NO: 36564 - RNA, 27 nt, Artificial Sequence
  Microsomal glutathione S-transferase 3 (36-44)
uacaagguggaguaccccaucauguac

SEQ ID NO: 36565 - RNA, 27 nt, Artificial Sequence
  Zinc finger BED domain-containing protein 5 (476-484)
uaccuggccgacaucuucaccaagcuc

SEQ ID NO: 36566 - RNA, 27 nt, Artificial Sequence
  SH3 domain-binding protein 1 (145-153)
uaccuggccgaccucuaccacuucgug

SEQ ID NO: 36567 - RNA, 27 nt, Artificial Sequence
  E3 ubiquitin-protein ligase UBR4 (824-832)
uaccuggccgacgugaccaacgcccuc

SEQ ID NO: 36568 - RNA, 27 nt, Artificial Sequence
  Exportin-4 (318-326)
uaccuggcccacuucaucgagggccuc

SEQ ID NO: 36569 - RNA, 27 nt, Artificial Sequence
  ATP-dependent RNA helicase DHX8 (756-764)
uaccuggacgccagccucaucaccgug

SEQ ID NO: 36570 - RNA, 30 nt, Artificial Sequence
  ADP-ribosylation factor-like protein 6-interacting protein 1 (32-41)
uaccuggaccccagcgugcucuccggcguc

SEQ ID NO: 36571 - RNA, 33 nt, Artificial Sequence
  Protein dpy-30 homolog (56-66)
uaccuggaccagaccgugguccccauccuccug

SEQ ID NO: 36572 - RNA, 30 nt, Artificial Sequence
  Trafficking protein particle complex subunit 1 (7-16)
uaccuguucgaccgcaacggcgugugccuc

SEQ ID NO: 36573 - RNA, 24 nt, Artificial Sequence
  Sphingomyelin phosphodiesterase 2 (372-379)
uaccuguuccacgugcaggagguc

SEQ ID NO: 36574 - RNA, 27 nt, Artificial Sequence
  Protein yippee-like 1 (49-57)
uaccuguucaacagcguggucaacgug

SEQ ID NO: 36575 - RNA, 27 nt, Artificial Sequence
  Coatomer subunit alpha (738-746)
uaccugggcgacgugagcgagcgcguc

SEQ ID NO: 36576 - RNA, 27 nt, Artificial Sequence
  26S protease regulatory subunit 6B (239-247)
uaccugggcgaggggccccgcauggug

SEQ ID NO: 36577 - RNA, 27 nt, Artificial Sequence
  U2 snRNP-associated SURP motif-containing protein (276-284)
uaccugggcaacaucaacccccagaug

SEQ ID NO: 36578 - RNA, 27 nt, Artificial Sequence
  Mortality factor 4-like protein 1 (290-298)
uaccugcacgacuuccucaaguaccug

SEQ ID NO: 36579 - RNA, 33 nt, Artificial Sequence
  Coatomer subunit epsilon (127-137)
uaccugcacgaccagaaccccgacgccgcccuc

SEQ ID NO: 36580 - RNA, 27 nt, Artificial Sequence
  Antigen peptide transporter 2 (25-33)
uaccugcacagccagguggucuccgug

SEQ ID NO: 36581 - RNA, 27 nt, Artificial Sequence
  Signal recognition particle subunit SRP68 (347-355)
uaccugcacagcuaccucaccuacauc

SEQ ID NO: 36582 - RNA, 30 nt, Artificial Sequence
  ATP-binding cassette sub-family E member 1 (483-492)
uaccugaucgacgagcccagcgccuaccuc

SEQ ID NO: 36583 - RNA, 27 nt, Artificial Sequence
  Probable ATP-dependent RNA helicase DDX6 (139-147)
uaccugaucccccuccuggagcgccug

SEQ ID NO: 36584 - RNA, 27 nt, Artificial Sequence
  Mitotic checkpoint serine/threonine-protein kinase BUB1 (44-52)
uaccugaucacccuccuggagcaccug

SEQ ID NO: 36585 - RNA, 27 nt, Artificial Sequence
  60S ribosomal protein L19 (105-113)
uaccugaaggugaagggcaacgucuuc

SEQ ID NO: 36586 - RNA, 27 nt, Artificial Sequence
  E3 ubiquitin-protein ligase MARCH6 (514-522)
uaccugcucgaccugcacagcuaccug

SEQ ID NO: 36587 - RNA, 27 nt, Artificial Sequence
  Ras-like protein family member 11A (22-30)
uaccugcuccccaaggacaucaagcug

SEQ ID NO: 36588 - RNA, 27 nt, Artificial Sequence
  Nuclear pore complex protein Nup160 (542-550)
uaccugcuccccuacgagaaccugcug

SEQ ID NO: 36589 - RNA, 27 nt, Artificial Sequence
  E3 ubiquitin-protein ligase MGRN1 (248-256)
uaccugcuccaggagaucuacggcauc

SEQ ID NO: 36590 - RNA, 27 nt, Artificial Sequence
  Eukaryotic initiation factor 4A-III (207-215)
uaccugcccccggccacccaggugguc

SEQ ID NO: 36591 - RNA, 27 nt, Artificial Sequence
  COP9 signalosome complex subunit 1 (211-219)
uaccugcagaacuggagccacgugcuc

SEQ ID NO: 36592 - RNA, 33 nt, Artificial Sequence
  Leucyl-cystinyl aminopeptidase (548-558)
uaccugagcgaggacguguuccagcacgccguc

SEQ ID NO: 36593 - RNA, 27 nt, Artificial Sequence
  Core histone macro-H2A.1 (55-63)
uaccugaccgccgagauccucgagcug

SEQ ID NO: 36594 - RNA, 27 nt, Artificial Sequence
  U1 small nuclear ribonucleoprotein C (12-20)
uaccugacccacgacagccccuccgug

SEQ ID NO: 36595 - RNA, 27 nt, Artificial Sequence
  Cohesin subunit SA-2 (775-783)
uaccugaccaacgugaacaccacgguc

SEQ ID NO: 36596 - RNA, 27 nt, Artificial Sequence
  Vacuolar protein sorting-associated protein 16 homolog (308-316)
uaccuggugcccgagcucgacggcguc

SEQ ID NO: 36597 - RNA, 27 nt, Artificial Sequence
  Lamin-B receptor (474-482)
uaccuggugagccaccccaacgagguc

SEQ ID NO: 36598 - RNA, 30 nt, Artificial Sequence
  DNA topoisomerase 2-alpha (684-693)
uaccuguacggccagaccaccacguaccuc

SEQ ID NO: 36599 - RNA, 27 nt, Artificial Sequence
  ER lumen protein-retaining receptor 2 (196-204)
uaccuguacaucaccaaggugcucaag

SEQ ID NO: 36600 - RNA, 27 nt, Artificial Sequence
  V-type proton ATPase subunit d 1 (27-35)
uacaugaucgacaacgugauccugcuc

SEQ ID NO: 36601 - RNA, 27 nt, Artificial Sequence
  Ras GTPase-activating protein-binding protein 2 (294-302)
uaccccgacagccaccagcuguucgug

SEQ ID NO: 36602 - RNA, 27 nt, Artificial Sequence
  Transcription factor p65 (479-487)
uaccccgaggccaucacccgccuggug

SEQ ID NO: 36603 - RNA, 27 nt, Artificial Sequence
  Neuropathy target esterase (299-307)
uaccccgagagccuggugcgcgucgug

SEQ ID NO: 36604 - RNA, 27 nt, Artificial Sequence
  Ral GTPase-activating protein subunit beta (25-33)
uaccccgagagcgugggccgcgagguc

SEQ ID NO: 36605 - RNA, 24 nt, Artificial Sequence
  Ubiquitin-conjugating enzyme E2 L3 (61-68)
uaccccuucaagccgcccaagauc

SEQ ID NO: 36606 - RNA, 24 nt, Artificial Sequence
  Phosphatidate cytidylyltransferase 1 (350-357)
uaccccuuccagauccacagcauc

SEQ ID NO: 36607 - RNA, 27 nt, Artificial Sequence
  LIM and SH3 domain protein 1 (57-65)
uaccccaagcagagcuucaccauggug

SEQ ID NO: 36608 - RNA, 27 nt, Artificial Sequence
  Pumilio homolog 1 (841-849)
uaccccaaccugcagcuccgcgagauc

SEQ ID NO: 36609 - RNA, 27 nt, Artificial Sequence
  Ubiquitin-associated protein 2-like (268-276)
uaccccccggcccccuucaugcacauc

SEQ ID NO: 36610 - RNA, 27 nt, Artificial Sequence
  Splicing factor 3A subunit 1 (44-52)
uaccccccgcccgaggugcgcaacauc

SEQ ID NO: 36611 - RNA, 27 nt, Artificial Sequence
  Putative oxidoreductase GLYR1 (19-27)
uaccccccguggcccggcaagaucgug

SEQ ID NO: 36612 - RNA, 27 nt, Artificial Sequence
  ETS-related transcription factor Elf-1 (354-362)
uaccccacccagcuguuccgcaccgug

SEQ ID NO: 36613 - RNA, 27 nt, Artificial Sequence
  39S ribosomal protein L37, mitochondrial (283-291)
uaccccuacccguacccccacacccug

SEQ ID NO: 36614 - RNA, 27 nt, Artificial Sequence
  LEM domain-containing protein 2 (134-142)
uaccccuacgugggcauccugcacguc

SEQ ID NO: 36615 - RNA, 27 nt, Artificial Sequence
  HLA class II histocompatibility antigen, DQ beta 1 chain (78-86)
uaccagcuggagcuccgcaccacccug

SEQ ID NO: 36616 - RNA, 27 nt, Artificial Sequence
  Farnesyl pyrophosphate synthase (158-166)
uaccagaccgagaucggccagacccug

SEQ ID NO: 36617 - RNA, 24 nt, Artificial Sequence
  Mitogen-activated protein kinase 14 (188-195)
uaccgcgcccccgagaucaugcug

SEQ ID NO: 36618 - RNA, 24 nt, Artificial Sequence
  Mitogen-activated protein kinase 7 (227-234)
uaccgcgcccccgagcugaugcuc

SEQ ID NO: 36619 - RNA, 27 nt, Artificial Sequence
  Endoplasmic reticulum lectin 1 (115-123)
uaccgcaucgagagcuacuggaccuac

SEQ ID NO: 36620 - RNA, 27 nt, Artificial Sequence
  Transmembrane protein 258 (9-17)
uacaccagccccgugaacccggccguc

SEQ ID NO: 36621 - RNA, 27 nt, Artificial Sequence
  Protein SZT2 (2368-2376)
uacguggccgaccacgccagcuccuac

SEQ ID NO: 36622 - RNA, 30 nt, Artificial Sequence
  DDB1- and CUL4-associated factor 8 (338-347)
uacgugaaccccgccaacacccaccaguuc

SEQ ID NO: 36623 - RNA, 24 nt, Artificial Sequence
  Tubulin beta chain (79-86)
uacgugccccgcgccauccugguc

SEQ ID NO: 36624 - RNA, 27 nt, Artificial Sequence
  E3 ubiquitin-protein ligase MARCH7 (172-180)
uacgugcaggaccgcguccccagcuac

SEQ ID NO: 36625 - RNA, 27 nt, Artificial Sequence
  Single-stranded DNA-binding protein 2 (25-33)
uacguguacgaguaccugcuccacguc

SEQ ID NO: 36626 - RNA, 27 nt, Artificial Sequence
  Tyrosine-protein kinase Fyn (213-221)
uacuacaucaccacccgcgcccaguuc

SEQ ID NO: 36627 - RNA, 27 nt, Artificial Sequence
  Heat shock cognate 71 kDa protein (16-24)
gccaugaaccccaccaacaccguguuc

SEQ ID NO: 36628 - RNA, 27 nt, Artificial Sequence
  HLA class II histocompatibility antigen, DP alpha 1 chain (32-40)
aucaaggccgaccacgugagcaccuac

SEQ ID NO: 36629 - RNA, 27 nt, Artificial Sequence
  Protein SSX2 (41-49)
aaggccagcgagaagaucuucuacgug

SEQ ID NO: 36630 - RNA, 27 nt, Artificial Sequence
  Paired amphipathic helix protein Sin3a (790-798)
gccgccgcgcugaucauccaccacgug

SEQ ID NO: 36631 - RNA, 27 nt, Artificial Sequence
  Rho GTPase-activating protein 17 (420-428)
gccgccgcgaccagcgugcacgucgug

SEQ ID NO: 36632 - RNA, 33 nt, Artificial Sequence
  Abhydrolase domain-containing protein 2 (342-352)
gccgccgacgacccccuggugcacgagagccuc

SEQ ID NO: 36633 - RNA, 27 nt, Artificial Sequence
  Pre-mRNA-processing factor 19 (410-418)
gccgccgacgacagcuccgugaagcug

SEQ ID NO: 36634 - RNA, 27 nt, Artificial Sequence
  Ubiquitin carboxyl-terminal hydrolase 4 (677-685)
gccgccgacggcaagcugcucaagcug

SEQ ID NO: 36635 - RNA, 33 nt, Artificial Sequence
  EP300-interacting inhibitor of differentiation 1 (69-79)
gccgcccuggaggaggcggacaagauguuccuc

SEQ ID NO: 36636 - RNA, 27 nt, Artificial Sequence
  Vacuolar protein sorting-associated protein 51 homolog (131-139)
gccgccaccgagaucguggagcgcguc

SEQ ID NO: 36637 - RNA, 30 nt, Artificial Sequence
  Codanin-1 (412-421)
gccgccuacgagggcagcguggcgaagguc

SEQ ID NO: 36638 - RNA, 27 nt, Artificial Sequence
  Tetratricopeptide repeat protein 19, mitochondrial (92-100)
gccgaggccgagaucauccagcugcuc

SEQ ID NO: 36639 - RNA, 33 nt, Artificial Sequence
  40S ribosomal protein S10 (140-150)
gccgaggccggcgcggggagcgccaccgaguuc

SEQ ID NO: 36640 - RNA, 27 nt, Artificial Sequence
  A-kinase anchor protein 11 (1199-1207)
gccgaggcccuggcgacccacauccuc

SEQ ID NO: 36641 - RNA, 27 nt, Artificial Sequence
  Staphylococcal nuclease domain-containing protein 1 (426-434)
gccgaggcccuggugagcaagggccuc

SEQ ID NO: 36642 - RNA, 27 nt, Artificial Sequence
  DnaJ homolog subfamily C member 3 (124-132)
gccgaggacgacuucaagaaggugcug

SEQ ID NO: 36643 - RNA, 27 nt, Artificial Sequence
  Cyclin-dependent kinase 11B (701-709)
gccgaggacggccugaagcacgaguac

SEQ ID NO: 36644 - RNA, 30 nt, Artificial Sequence
  High affinity cationic amino acid transporter 1 (354-363)
gccgaggacggccugcucuucaaguuccug

SEQ ID NO: 36645 - RNA, 30 nt, Artificial Sequence
  Protein strawberry notch homolog 2 (92-101)
gccgaggagcugggccacaccgagaccuac

SEQ ID NO: 36646 - RNA, 30 nt, Artificial Sequence
  Casein kinase II subunit alpha (179-188)
gccgaguucuaccaccccggccaggaguac

SEQ ID NO: 36647 - RNA, 30 nt, Artificial Sequence
  Probable E3 ubiquitin-protein ligase HERC4 (886-895)
gccgagcaccccaccaucaagaucuucugg

SEQ ID NO: 36648 - RNA, 24 nt, Artificial Sequence
  Rabankyrin-5 (229-236)
gccgagaucaucgccagccacugg

SEQ ID NO: 36649 - RNA, 30 nt, Artificial Sequence
  26S proteasome non-ATPase regulatory subunit 6 (244-253)
gccgagauccuggaggugcuccacagccug

SEQ ID NO: 36650 - RNA, 30 nt, Artificial Sequence
  Son of sevenless homolog 2 (963-972)
gccgagaucaccggcgagauccagcaguac

SEQ ID NO: 36651 - RNA, 27 nt, Artificial Sequence
  Leucine-rich repeat and calponin homology domain-containing protein 3 (340-348)
gccgagaucaccaaggagcagcgccug

SEQ ID NO: 36652 - RNA, 30 nt, Artificial Sequence
  HEAT repeat-containing protein 6 (209-218)
gccgagaaggacggcgugagcuccagcuuc

SEQ ID NO: 36653 - RNA, 27 nt, Artificial Sequence
  Transformation/transcription domain-associated protein (2625-2633)
gccgagaagaccugggugcagcuguuc

SEQ ID NO: 36654 - RNA, 33 nt, Artificial Sequence
  Glycerol-3-phosphate acyltransferase 3 (4-14)
gccgagcuggccggcaagauccucagcaccugg

SEQ ID NO: 36655 - RNA, 27 nt, Artificial Sequence
  Hom s 1 (495-503)
gccgagcuggagcuccagaagcagcug

SEQ ID NO: 36656 - RNA, 27 nt, Artificial Sequence
  HEAT repeat-containing protein 1 (617-625)
gccgagaugaagaucgccaucuaccug

SEQ ID NO: 36657 - RNA, 27 nt, Artificial Sequence
  Mitochondrial antiviral-signaling protein (471-479)
gccgagaaccccagcauccagcugcuc

SEQ ID NO: 36658 - RNA, 30 nt, Artificial Sequence
  Exocyst complex component 1 (513-522)
gccgagcaggacuucaucagcaaguucuuc

SEQ ID NO: 36659 - RNA, 27 nt, Artificial Sequence
  Liprin-alpha-1 (374-382)
gccgagcagaagcugcagcagacccuc

SEQ ID NO: 36660 - RNA, 27 nt, Artificial Sequence
  Chromodomain-helicase-DNA-binding protein 9 (618-626)
gccgagcagaugccccagcacacccug

SEQ ID NO: 36661 - RNA, 30 nt, Artificial Sequence
  F-box DNA helicase 1 (868-877)
gccgagcagcgcaucggcccccuggccuuc

SEQ ID NO: 36662 - RNA, 33 nt, Artificial Sequence
  Nuclear cap-binding protein subunit 1 (577-587)
gccgagagcgacgagggcaagcugcacgugcuc

SEQ ID NO: 36663 - RNA, 33 nt, Artificial Sequence
  Ras-specific guanine nucleotide-releasing factor RalGPS2 (418-428)
gccgagagcgaggaccuggccgugcaccucuac

SEQ ID NO: 36664 - RNA, 27 nt, Artificial Sequence
  Transmembrane 9 superfamily member 1 (89-97)
gccgagagccuguacgagauccgcuuc

SEQ ID NO: 36665 - RNA, 30 nt, Artificial Sequence
  Glycerol-3-phosphate dehydrogenase, mitochondrial (535-544)
gccgaggugaaguacggcaucaaggaguac

SEQ ID NO: 36666 - RNA, 30 nt, Artificial Sequence
  Protein PRRC2C (2815-2824)
gccgaggugcugcagagcacccagcgcuuc

SEQ ID NO: 36667 - RNA, 24 nt, Artificial Sequence
  Eukaryotic translation initiation factor 3 subunit D (442-449)
gccggcagcgaguaccugaagcuc

SEQ ID NO: 36668 - RNA, 27 nt, Artificial Sequence
  Coatomer subunit gamma-2 (147-155)
gccaucguggacaaggucagcuccgug

SEQ ID NO: 36669 - RNA, 33 nt, Artificial Sequence
  Dipeptidyl peptidase 2 (134-144)
gcccuggccgacuucgcggagcuccugcgcgcc

SEQ ID NO: 36670 - RNA, 27 nt, Artificial Sequence
  Mediator of RNA polymerase II transcription subunit 23 (388-396)
gcccuggccgacuuccuccccgugaug

SEQ ID NO: 36671 - RNA, 30 nt, Artificial Sequence
  Coatomer subunit gamma-2 (844-853)
gcccuggccgacggcgugaccaugcagguc

SEQ ID NO: 36672 - RNA, 27 nt, Artificial Sequence
  Nicastrin (466-474)
gcccuggccgacguggcgaccguccuc

SEQ ID NO: 36673 - RNA, 27 nt, Artificial Sequence
  Lysophosphatidylcholine acyltransferase 1 (178-186)
gcccuggccgagggccagcuccgccug

SEQ ID NO: 36674 - RNA, 27 nt, Artificial Sequence
  Filamin-A (1713-1721)
gcccuggccggcgaccagcccagcgug

SEQ ID NO: 36675 - RNA, 27 nt, Artificial Sequence
  CAD protein (1492-1500)
gcccuggccggcgggaucaccauggug

SEQ ID NO: 36676 - RNA, 27 nt, Artificial Sequence
  Microtubule-associated protein 4 (259-267)
gcccuggccaaggacauggcgcucgcc

SEQ ID NO: 36677 - RNA, 30 nt, Artificial Sequence
  E1A-binding protein p400 (910-919)
gcccuggccaagcccccgguggucagcgug

SEQ ID NO: 36678 - RNA, 27 nt, Artificial Sequence
  Transcription factor p65 (361-369)
gcccuggcccccgcgccgccccaggug

SEQ ID NO: 36679 - RNA, 27 nt, Artificial Sequence
  HEAT repeat-containing protein 2 (159-167)
gcccuggccccccaccucgacgacgcg

SEQ ID NO: 36680 - RNA, 27 nt, Artificial Sequence
  DNA fragmentation factor subunit alpha (236-244)
gcccuggccagccacauccucaccgcg

SEQ ID NO: 36681 - RNA, 27 nt, Artificial Sequence
  DNA mismatch repair protein Mlh1 (103-111)
gcccuggccagcaucucccacguggcg

SEQ ID NO: 36682 - RNA, 27 nt, Artificial Sequence
  Intraflagellar transport protein 81 homolog (503-511)
gcccuggccagcgugaucaaggagcuc

SEQ ID NO: 36683 - RNA, 27 nt, Artificial Sequence
  T-complex protein 1 subunit zeta (19-27)
gcccuggccgugaacaucagcgcggcc

SEQ ID NO: 36684 - RNA, 30 nt, Artificial Sequence
  Elongation factor 2 (191-200)
gcccugugcgaggagaacaugcgcggcgug

SEQ ID NO: 36685 - RNA, 27 nt, Artificial Sequence
  DNA repair protein RAD50 (1090-1098)
gcccuggacgagcccaccaccaaccuc

SEQ ID NO: 36686 - RNA, 27 nt, Artificial Sequence
  Perilipin-3 (400-408)
gcccuggaccacaugguggaguacguc

SEQ ID NO: 36687 - RNA, 33 nt, Artificial Sequence
  Receptor-interacting serine/threonine-protein kinase 4 (482-492)
gcccuggacagcggcgccucccuccugcaccug

SEQ ID NO: 36688 - RNA, 27 nt, Artificial Sequence
  Centrosomal protein of 104 kDa (617-625)
gcccuggagcaccgcguguacgagguc

SEQ ID NO: 36689 - RNA, 27 nt, Artificial Sequence
  Alpha-tubulin N-acetyltransferase 1 (9-17)
gcccuguuccccgagcgcaucaccgug

SEQ ID NO: 36690 - RNA, 33 nt, Artificial Sequence
  SEC14-like protein 1 (357-367)
gcccugggcgaggaggcccuccugcgcuacgug

SEQ ID NO: 36691 - RNA, 33 nt, Artificial Sequence
  HLA class I histocompatibility antigen, B-40 alpha chain (204-214)
gcccugggcuucuaccccgccgagaucacccuc

SEQ ID NO: 36692 - RNA, 30 nt, Artificial Sequence
  Dystonin (3724-3733)
gcccugaucgagcagaagcucaacgaggcc

SEQ ID NO: 36693 - RNA, 27 nt, Artificial Sequence
  RILP-like protein 1 (221-229)
gcccugaucgagcagaagguggagcuc

SEQ ID NO: 36694 - RNA, 33 nt, Artificial Sequence
  Aminopeptidase B (193-203)
gcccugaucgaggugcccgacggcuucaccgcc

SEQ ID NO: 36695 - RNA, 33 nt, Artificial Sequence
  Coatomer subunit zeta-1 (3-13)
gcccugauccucgagcccagccuguacaccgug

SEQ ID NO: 36696 - RNA, 33 nt, Artificial Sequence
  Protein fem-1 homolog A (362-372)
gcccugaucaccgaccccgacgagaugcgcaug

SEQ ID NO: 36697 - RNA, 27 nt, Artificial Sequence
  Rapamycin-insensitive companion of mTOR (226-234)
gcccugaucaccaccauccuccaccug

SEQ ID NO: 36698 - RNA, 27 nt, Artificial Sequence
  DNA polymerase alpha catalytic subunit (520-528)
gcccugaagcccgaccucgugaacguc

SEQ ID NO: 36699 - RNA, 27 nt, Artificial Sequence
  Agrin (1405-1413)
gcccugcucgacggccgcgugcagcug

SEQ ID NO: 36700 - RNA, 30 nt, Artificial Sequence
  Protein DGCR6L (54-63)
gcccugcucgacggcaccguguucgagauc

SEQ ID NO: 36701 - RNA, 30 nt, Artificial Sequence
  Trabeculin-alpha (3432-3441)
gcccugcucgaccaggcccugagcaacgcg

SEQ ID NO: 36702 - RNA, 27 nt, Artificial Sequence
  Talin-1 (1760-1768)
gcccugcucgaccagaccaagacccug

SEQ ID NO: 36703 - RNA, 33 nt, Artificial Sequence
  Histone deacetylase 10 (587-597)
gcccugcucgaggagaacagcaccccccagcug

SEQ ID NO: 36704 - RNA, 27 nt, Artificial Sequence
  LEM domain-containing protein 2 (268-276)
gcccugcucgagcugcugcacgagcuc

SEQ ID NO: 36705 - RNA, 30 nt, Artificial Sequence
  Dystonin (5785-5794)
gcccugcucgagcuggugcccuggcgcgcc

SEQ ID NO: 36706 - RNA, 33 nt, Artificial Sequence
  Telomerase protein component 1 (281-291)
gcccugcucgagcccgaguucauccugaaggcc

SEQ ID NO: 36707 - RNA, 33 nt, Artificial Sequence
  Midasin (2257-2267)
gcccugcucgagcccggcggggugcugaccauc

SEQ ID NO: 36708 - RNA, 30 nt, Artificial Sequence
  DENN domain-containing protein 4B (1391-1400)
gcccugcucgagagcgugcugcgccacguc

SEQ ID NO: 36709 - RNA, 27 nt, Artificial Sequence
  Transmembrane protein 102 (468-476)
gcccugcucggcgagcuggcccgccug

SEQ ID NO: 36710 - RNA, 27 nt, Artificial Sequence
  Inhibitor of growth protein 4 (58-66)
gcccugcucaagcagauccaggaggcc

SEQ ID NO: 36711 - RNA, 27 nt, Artificial Sequence
  Sorting and assembly machinery component 50 homolog (277-285)
gcccugcucaaggugaaccaggagcug

SEQ ID NO: 36712 - RNA, 27 nt, Artificial Sequence
  ATP-dependent RNA helicase A (638-646)
gcccugcucaaguacaucgagacccug

SEQ ID NO: 36713 - RNA, 30 nt, Artificial Sequence
  Nucleolar protein 11 (404-413)
gcccugcucaacgccauccugcacagcgcg

SEQ ID NO: 36714 - RNA, 27 nt, Artificial Sequence
  Rapamycin-insensitive companion of mTOR (91-99)
gcccugcucaacgaggccaaggaggug

SEQ ID NO: 36715 - RNA, 27 nt, Artificial Sequence
  Lysosomal alpha-glucosidase (501-509)
gcccugcucccccaccuguacacccug

SEQ ID NO: 36716 - RNA, 27 nt, Artificial Sequence
  Coiled-coil domain-containing protein 189 isoform 2 (146-154)
gcccugcuccaggaccugcacaaggcc

SEQ ID NO: 36717 - RNA, 27 nt, Artificial Sequence
  Cell differentiation protein RCD1 homolog (65-73)
gcccugcuccaggagaucgugaacauc

SEQ ID NO: 36718 - RNA, 27 nt, Artificial Sequence
  GSK3-beta interaction protein (125-133)
gcccugcuccagcgccuggaggcccug

SEQ ID NO: 36719 - RNA, 27 nt, Artificial Sequence
  Mitochondrial import receptor subunit TOM5 homolog (36-44)
gcccugcuccgcgugacccccuucauc

SEQ ID NO: 36720 - RNA, 27 nt, Artificial Sequence
  Catenin alpha-1 (130-138)
gcccugcucagcgccgugacccgccug

SEQ ID NO: 36721 - RNA, 30 nt, Artificial Sequence
  DNA-dependent protein kinase catalytic subunit (2867-2876)
gcccugcucagccuggaccccgccgcggug

SEQ ID NO: 36722 - RNA, 27 nt, Artificial Sequence
  Multiple inositol polyphosphate phosphatase 1 (26-34)
gcccugcucagcucccuggcccgcugc

SEQ ID NO: 36723 - RNA, 27 nt, Artificial Sequence
  DNA-directed RNA polymerase I subunit RPA1 (343-351)
gcccugauggcccaggagcagaagcuc

SEQ ID NO: 36724 - RNA, 27 nt, Artificial Sequence
  Brefeldin A-inhibited guanine nucleotide-exchange protein 1 (924-932)
gcccugauggaggccgugagccacguc

SEQ ID NO: 36725 - RNA, 30 nt, Artificial Sequence
  THAP domain-containing protein 11 (268-277)
gcccugauggaggugaagaugaaggagaug

SEQ ID NO: 36726 - RNA, 27 nt, Artificial Sequence
  Junction plakoglobin (178-186)
gcccugaugggcagcccccagcucgug

SEQ ID NO: 36727 - RNA, 27 nt, Artificial Sequence
  Probable E3 ubiquitin-protein ligase HECTD4 (327-335)
gcccugaugccccagcucgugcagcug

SEQ ID NO: 36728 - RNA, 33 nt, Artificial Sequence
  Synaptosomal-associated protein 29 (65-75)
gcccugauguacgagagcgagaaggugggcguc

SEQ ID NO: 36729 - RNA, 27 nt, Artificial Sequence
  F-box only protein 21 (284-292)
gcccugaaccucuacaugcaccaggug

SEQ ID NO: 36730 - RNA, 30 nt, Artificial Sequence
  Immunoglobulin-binding protein 1 (279-288)
gcccugcccgaccagggcaucgccaaggcg

SEQ ID NO: 36731 - RNA, 30 nt, Artificial Sequence
  Coatomer subunit gamma-1 (711-720)
gcccugcccaaggaggacccgaccgccgug

SEQ ID NO: 36732 - RNA, 27 nt, Artificial Sequence
  EVI5-like protein (617-625)
gcccugcaggagaagcuccaguaccug

SEQ ID NO: 36733 - RNA, 27 nt, Artificial Sequence
  Signal recognition particle receptor subunit alpha (360-368)
gcccugcaggagagccucgugcagauc

SEQ ID NO: 36734 - RNA, 27 nt, Artificial Sequence
  Dolichyl-diphosphooligosaccharide-proteinosyltransferase subunit 2 (5-13)
gcccugagcgcccucaccgcgcgccug

SEQ ID NO: 36735 - RNA, 27 nt, Artificial Sequence
  Fas apoptotic inhibitory molecule 1 (45-53)
gcccugagcgacggcgugcacaagauc

SEQ ID NO: 36736 - RNA, 30 nt, Artificial Sequence
  T-complex protein 1 subunit delta (308-317)
gcccugagcgaccucgcccugcacuuccug

SEQ ID NO: 36737 - RNA, 27 nt, Artificial Sequence
  Coiled-coil domain-containing protein 93 (85-93)
gcccugagcgagaagaucguguccguc

SEQ ID NO: 36738 - RNA, 27 nt, Artificial Sequence
  Uncharacterized protein C1orf43 (148-156)
gcccugagcgagcucgccaccgcggug

SEQ ID NO: 36739 - RNA, 27 nt, Artificial Sequence
  Lanosterol 14-alpha demethylase (197-205)
gcccugagcgagcucaucauccugacc

SEQ ID NO: 36740 - RNA, 27 nt, Artificial Sequence
  26S proteasome non-ATPase regulatory subunit 14 (135-143)
gcccugagcgagcgcgccguggcgguc

SEQ ID NO: 36741 - RNA, 27 nt, Artificial Sequence
  Inversin (365-373)
gcccugagcggccacguguccaccguc

SEQ ID NO: 36742 - RNA, 27 nt, Artificial Sequence
  Small integral membrane protein 10 (21-29)
gcccugagcggccucgccgugcgccug

SEQ ID NO: 36743 - RNA, 27 nt, Artificial Sequence
  Kinesin light chain 1 (87-95)
gcccugagcaaccaccucaacgccgug

SEQ ID NO: 36744 - RNA, 27 nt, Artificial Sequence
  tRNA-splicing endonuclease subunit Sen2 (347-355)
gcccugagccgcguguccgucaacgug

SEQ ID NO: 36745 - RNA, 27 nt, Artificial Sequence
  FAST kinase domain-containing protein 2 (485-493)
gcccugaccggcuaccuccacaccauc

SEQ ID NO: 36746 - RNA, 27 nt, Artificial Sequence
  Putative phospholipase B-like 2 (16-24)
gcccugacccgcgcccucgcgcuggcc

SEQ ID NO: 36747 - RNA, 27 nt, Artificial Sequence
  AP-1 complex subunit gamma-1 (331-339)
gcccugaccagccuccugaagaccgug

SEQ ID NO: 36748 - RNA, 30 nt, Artificial Sequence
  E3 ubiquitin-protein ligase RFWD2 (46-55)
gcccuggugagcggcggggucgcccaggcg

SEQ ID NO: 36749 - RNA, 27 nt, Artificial Sequence
  Nesprin-2 (3479-3487)
gcccugugggagaaguggcucagccug

SEQ ID NO: 36750 - RNA, 27 nt, Artificial Sequence
  Integrin alpha-X (412-420)
gcccuguggaagggcgugcagagccuc

SEQ ID NO: 36751 - RNA, 27 nt, Artificial Sequence
  Helicase with zinc finger domain 2 (1826-1834)
gcccuguggaagcagcuccuggagcug

SEQ ID NO: 36752 - RNA, 27 nt, Artificial Sequence
  Rabankyrin-5 (638-646)
gcccuguggaccggcaugcacaccauc

SEQ ID NO: 36753 - RNA, 30 nt, Artificial Sequence
  CDK5 regulatory subunit-associated protein 3 (102-111)
gcccuguacgagaaggacaacaccuaccuc

SEQ ID NO: 36754 - RNA, 27 nt, Artificial Sequence
  Small subunit processome component 20 homolog (799-807)
gcccuguaccacgagcagcucgcccug

SEQ ID NO: 36755 - RNA, 33 nt, Artificial Sequence
  Prohibitin (26-36)
gcccuguacaacguggacgccggccaccgcgcg

SEQ ID NO: 36756 - RNA, 27 nt, Artificial Sequence
  Receptor expression-enhancing protein 3 (46-54)
gcccuguacaccgugaucgagaccguc

SEQ ID NO: 36757 - RNA, 27 nt, Artificial Sequence
  Heterogeneous nuclear ribonucleoproteins A2/B1 (66-74)
gccauggccgcgcgcccccacagcauc

SEQ ID NO: 36758 - RNA, 30 nt, Artificial Sequence
  Leucine-tRNA ligase, cytoplasmic (67-76)
gccauggccgacgcgggcauccugcgccuc

SEQ ID NO: 36759 - RNA, 33 nt, Artificial Sequence
  Translocon-associated protein subunit delta (3-13)
gccauggccagccugggcgcgcucgcccugcug

SEQ ID NO: 36760 - RNA, 33 nt, Artificial Sequence
  Phosphatidylinositol 4-kinase alpha (1043-1053)
gccauggccaccgagagcauccugcacuucgcg

SEQ ID NO: 36761 - RNA, 27 nt, Artificial Sequence
  Nuclear cap-binding protein subunit 1 (147-155)
gccauguucgagaacuucgugagcguc

SEQ ID NO: 36762 - RNA, 30 nt, Artificial Sequence
  Eukaryotic translation initiation factor 3 subunit K (2-11)
gccauguucgagcagaugcgcgccaacgug

SEQ ID NO: 36763 - RNA, 27 nt, Artificial Sequence
  U4/U6 small nuclear ribonucleoprotein Prp3 (237-245)
gccaugggcaucgcccccccgaaggug

SEQ ID NO: 36764 - RNA, 27 nt, Artificial Sequence
  Chitobiosyldiphosphodolichol beta-mannosyltransferase (57-65)
gccaugcacggcuucagcgugacccug

SEQ ID NO: 36765 - RNA, 27 nt, Artificial Sequence
  Tripartite motif-containing protein 44 (233-241)
gccaugaucgagcugguggagcgccuc

SEQ ID NO: 36766 - RNA, 27 nt, Artificial Sequence
  Importin subunit beta-1 (122-130)
gccaugaagagcgacaucgacgaggug

SEQ ID NO: 36767 - RNA, 27 nt, Artificial Sequence
  Intraflagellar transport protein 172 homolog (30-38)
gccaugcuggagaagaacuacaagcuc

SEQ ID NO: 36768 - RNA, 27 nt, Artificial Sequence
  E3 ubiquitin-protein ligase RNF31 (159-167)
gccaugcugaacgagcccugggccgug

SEQ ID NO: 36769 - RNA, 30 nt, Artificial Sequence
  HLA class II histocompatibility antigen, DQ beta 1 chain (23-32)
gccaugcugagcacccccguggccgagggc

SEQ ID NO: 36770 - RNA, 27 nt, Artificial Sequence
  AP-1 complex subunit gamma-1 (266-274)
gccaugaacgacauccuggcccaggug

SEQ ID NO: 36771 - RNA, 27 nt, Artificial Sequence
  Splicing factor 3A subunit 3 (45-53)
gccaugcaggaccgcuacauggaggug

SEQ ID NO: 36772 - RNA, 33 nt, Artificial Sequence
  Guanine nucleotide-binding protein G(s) subunit alpha isoforms short (95-105)
gccaugagcaaccuggugcccccggucgagcuc

SEQ ID NO: 36773 - RNA, 27 nt, Artificial Sequence
  Heat shock 70 kDa protein 1-like (450-458)
gccaugaccaaggacaacaaccugcuc

SEQ ID NO: 36774 - RNA, 27 nt, Artificial Sequence
  F-box only protein 21 (416-424)
gccauguaccccgaccaggugcagcug

SEQ ID NO: 36775 - RNA, 30 nt, Artificial Sequence
  Vascular endothelial growth factor A (130-139)
gcccccgccgcgcgcgccccgcaggcccug

SEQ ID NO: 36776 - RNA, 27 nt, Artificial Sequence
  Sister chromatid cohesion protein PDS5 homolog A (368-376)
gcccccgccgagcgccagaucgaccug

SEQ ID NO: 36777 - RNA, 27 nt, Artificial Sequence
  Host cell factor 1 (810-818)
gcccccgccaagaucaucaccgcggug

SEQ ID NO: 36778 - RNA, 30 nt, Artificial Sequence
  Histone H1.4 (11-20)
gcccccgccccggcggagaagacccccgug

SEQ ID NO: 36779 - RNA, 27 nt, Artificial Sequence
  Zinc finger protein 428 (123-131)
gcccccgccccggagggccgcgcgcug

SEQ ID NO: 36780 - RNA, 30 nt, Artificial Sequence
  Pleckstrin homology domain-containing family B member 2 (137-146)
gcccccgccccggaggugggccgcacccug

SEQ ID NO: 36781 - RNA, 33 nt, Artificial Sequence
  Cathepsin D (16-26)
gcccccgccagcgcgcuggugcgcaucccgcuc

SEQ ID NO: 36782 - RNA, 27 nt, Artificial Sequence
  Liprin-beta-1 (819-827)
gcccccaaccugcgcggcagcggggug

SEQ ID NO: 36783 - RNA, 33 nt, Artificial Sequence
  Double-stranded RNA-binding protein Staufen homolog 1 (362-372)
gcccccaacccggccaaggcgaccgugaccgcc

SEQ ID NO: 36784 - RNA, 30 nt, Artificial Sequence
  Zinc finger HIT domain-containing protein 2 (59-68)
gcccccccgagccgccuggccuccgcgcuc

SEQ ID NO: 36785 - RNA, 33 nt, Artificial Sequence
  Putative sodium-coupled neutral amino acid transporter 10 (841-851)
gccccccgcgccgcgggcaccgugaaggagcug

SEQ ID NO: 36786 - RNA, 33 nt, Artificial Sequence
  RELT-like protein 1 (2-12)
gccccccgcgcccugccgggcagcgcggugcuc

SEQ ID NO: 36787 - RNA, 27 nt, Artificial Sequence
  Rhotekin (385-393)
gccccccgcaagccgccccaggcccug

SEQ ID NO: 36788 - RNA, 27 nt, Artificial Sequence
  Long-chain fatty acid transport protein 1 (264-272)
gcccccuacgcccgcccgaucuuccug

SEQ ID NO: 36789 - RNA, 27 nt, Artificial Sequence
  Coiled-coil domain-containing protein 50 (69-77)
gcccaggcccagcugcagaagcgcuac

SEQ ID NO: 36790 - RNA, 27 nt, Artificial Sequence
  Pumilio homolog 2 (180-188)
gcccagcagccccacaucgccggcgug

SEQ ID NO: 36791 - RNA, 27 nt, Artificial Sequence
  E3 ubiquitin-protein ligase HUWE1 (1181-1189)
gcccagguggcccuggucaacgaggug

SEQ ID NO: 36792 - RNA, 27 nt, Artificial Sequence
  Unconventional myosin-If (36-44)
gcccaguacgagaaccccccgcacauc

SEQ ID NO: 36793 - RNA, 33 nt, Artificial Sequence
  Alpha-actinin-1 (231-241)
gcccgccccgacgagaaggccaucaugaccuac

SEQ ID NO: 36794 - RNA, 27 nt, Artificial Sequence
  Vacuolar protein sorting-associated protein 54 (467-475)
gccacccugaacaucauccacagcgug

SEQ ID NO: 36795 - RNA, 30 nt, Artificial Sequence
  Cullin-2 (577-586)
gccguggacgaggaccgcaagauguaccug

SEQ ID NO: 36796 - RNA, 33 nt, Artificial Sequence
  Erlin-1 (214-224)
gccgugaucgaggccgagaagaucgcgcagguc

SEQ ID NO: 36797 - RNA, 27 nt, Artificial Sequence
  Ubiquitin carboxyl-terminal hydrolase 28 (743-751)
gccgugauggagagcauccagggcguc

SEQ ID NO: 36798 - RNA, 27 nt, Artificial Sequence
  40S ribosomal protein S5 (172-180)
ugccuggccgacgagcucaucaacgcc

SEQ ID NO: 36799 - RNA, 30 nt, Artificial Sequence
  Protein transport protein Sec23B (288-297)
gacgagcugaagauccccauccgcagcugg

SEQ ID NO: 36800 - RNA, 30 nt, Artificial Sequence
  Serine/threonine-protein kinase 11-interacting protein (963-972)
gacgaggugagccgccuggaguccuucugg

SEQ ID NO: 36801 - RNA, 27 nt, Artificial Sequence
  Guanine nucleotide-binding protein G(I)/G(S)/G(T) subunit beta-2 (170-178)
gacaucgagaccggccagcagaccgug

SEQ ID NO: 36802 - RNA, 24 nt, Artificial Sequence
  Tuberin (529-536)
gacaucaucgagaaggugauggcc

SEQ ID NO: 36803 - RNA, 24 nt, Artificial Sequence
  E3 ubiquitin-protein ligase RNF213 (2081-2088)
gacaucaacggcaagauguggcug

SEQ ID NO: 36804 - RNA, 27 nt, Artificial Sequence
  Echinoderm microtubule-associated protein-like 5 (1134-1142)
gacauccgcggcaagcugcuccaggug

SEQ ID NO: 36805 - RNA, 24 nt, Artificial Sequence
  Negative elongation factor A (258-265)
gacaucagcgagcuggacauggug

SEQ ID NO: 36806 - RNA, 27 nt, Artificial Sequence
  Golgin subfamily A member 4 (852-860)
gaccuggagaccgagcgcauccuccug

SEQ ID NO: 36807 - RNA, 30 nt, Artificial Sequence
  GRB2-associated-binding protein 1 (123-132)
gaccccgugaagccgcccggcagcucccug

SEQ ID NO: 36808 - RNA, 27 nt, Artificial Sequence
  Signal recognition particle 54 kDa protein (388-396)
gacagcaccgacggcgccaagguguuc

SEQ ID NO: 36809 - RNA, 27 nt, Artificial Sequence
  Protein BANP (72-80)
gaggccaagcugcaggcccucgaggcg

SEQ ID NO: 36810 - RNA, 27 nt, Artificial Sequence
  Endothelial differentiation-related factor 1 (36-44)
gaggacguggagaccagcaagaagugg

SEQ ID NO: 36811 - RNA, 30 nt, Artificial Sequence
  Clathrin heavy chain 1 (1066-1075)
gaggaggccuucgccaucuuccgcaaguuc

SEQ ID NO: 36812 - RNA, 30 nt, Artificial Sequence
  DNA excision repair protein ERCC-1 (203-212)
gaggaggccggccgcuaccuggagaccuac

SEQ ID NO: 36813 - RNA, 27 nt, Artificial Sequence
  cAMP-dependent protein kinase type I-alpha regulatory subunit (60-68)
gaggaggccaagcagauccagaaccug

SEQ ID NO: 36814 - RNA, 27 nt, Artificial Sequence
  Zinc finger protein 548 (56-64)
gaggaggcccccagccagcagggcuuc

SEQ ID NO: 36815 - RNA, 30 nt, Artificial Sequence
  Zinc finger and BTB domain-containing protein 17 (715-724)
gaggaggaccccaacacccacauccuguac

SEQ ID NO: 36816 - RNA, 30 nt, Artificial Sequence
  Cullin-4A (268-277)
gaggaggagggcgaccgcgugaucaccuac

SEQ ID NO: 36817 - RNA, 27 nt, Artificial Sequence
  S-phase kinase-associated protein 1 (120-128)
gaggagauccgcaagaccuucaacauc

SEQ ID NO: 36818 - RNA, 24 nt, Artificial Sequence
  Nuclear transcription factor Y subunit gamma (28-35)
gaggagauccgcaaccugaccgug

SEQ ID NO: 36819 - RNA, 30 nt, Artificial Sequence
  Flotillin-1 (118-127)
gaggagaucuacaaggaccgccagaaguuc

SEQ ID NO: 36820 - RNA, 27 nt, Artificial Sequence
  Microtubule-associated protein 4 (105-113)
gaggagaagauggccuaccaggaguac

SEQ ID NO: 36821 - RNA, 27 nt, Artificial Sequence
  Eukaryotic translation initiation factor 3 subunit D (172-180)
gaggagauggacuucccccagcugaug

SEQ ID NO: 36822 - RNA, 30 nt, Artificial Sequence
  HEAT repeat-containing protein 1 (411-420)
gaggagauggacagcaacaaggugucccug

SEQ ID NO: 36823 - RNA, 27 nt, Artificial Sequence
  BRISC and BRCA1-A complex member 1 (257-265)
gaggagaugagcuggaaggacauguuc

SEQ ID NO: 36824 - RNA, 30 nt, Artificial Sequence
  Mitotic checkpoint serine/threonine-protein kinase BUB1 (35-44)
gaggagaacuuccccgagaacaaggaguac

SEQ ID NO: 36825 - RNA, 30 nt, Artificial Sequence
  Autophagy-related protein 16-1 (158-167)
gaggagaaccaggagcuggugacccgcugg

SEQ ID NO: 36826 - RNA, 27 nt, Artificial Sequence
  Eukaryotic translation initiation factor 3 subunit C-like protein (786-794)
gaggagagccugcgcaccuaccucuuc

SEQ ID NO: 36827 - RNA, 27 nt, Artificial Sequence
  Segment polarity protein dishevelled homolog DVL-2 (23-31)
gaggagacccccuaccuggugaagauc

SEQ ID NO: 36828 - RNA, 30 nt, Artificial Sequence
  GRIP1-associated protein 1 (706-715)
gaggagguggccgagcuguuccagcgccuc

SEQ ID NO: 36829 - RNA, 27 nt, Artificial Sequence
  Glutaredoxin-3 (9-17)
gagcuggccaaggagcucccccaggug

SEQ ID NO: 36830 - RNA, 27 nt, Artificial Sequence
  Nuclear factor of activated T-cells 5 (953-961)
gagcuguucagcucccccccggccgug

SEQ ID NO: 36831 - RNA, 24 nt, Artificial Sequence
  Cyclin-J-like protein (62-69)
gagcagcugcgccuccaggagcug

SEQ ID NO: 36832 - RNA, 27 nt, Artificial Sequence
  Nucleolar RNA helicase 2 (172-180)
uucgccaucccccugaucgagaagcuc

SEQ ID NO: 36833 - RNA, 27 nt, Artificial Sequence
  Tristetraprolin (304-312)
uucgcccccccgcagcccguggccgcg

SEQ ID NO: 36834 - RNA, 30 nt, Artificial Sequence
  Laminin subunit gamma-1 (1227-1236)
uucgagaucgaggagcugaaccgcaaguac

SEQ ID NO: 36835 - RNA, 27 nt, Artificial Sequence
  Nucleolar pre-ribosomal-associated protein 1 (1554-1562)
uucgagcagaagaccgagcagaagugg

SEQ ID NO: 36836 - RNA, 27 nt, Artificial Sequence
  Non-POU domain-containing octamer-binding protein (174-182)
uucgaguacgaguacgccaugcgcugg

SEQ ID NO: 36837 - RNA, 27 nt, Artificial Sequence
  Antizyme inhibitor 1 (4-12)
uucaucgacgacgccaacuacagcgug

SEQ ID NO: 36838 - RNA, 30 nt, Artificial Sequence
  Activator of 90 kDa heat shock protein ATPase homolog 1 (215-224)
uucaucgacaagaacggcgagaccgagcug

SEQ ID NO: 36839 - RNA, 27 nt, Artificial Sequence
  Ral GTPase-activating protein subunit alpha-1 (86-94)
uucaucuucgagaagauccugcagcuc

SEQ ID NO: 36840 - RNA, 27 nt, Artificial Sequence
  DENN domain-containing protein 5B (1150-1158)
uucaucugggacuucaucgagaaggug

SEQ ID NO: 36841 - RNA, 30 nt, Artificial Sequence
  Dipeptidyl peptidase 8 (19-28)
uucaucuacggcgggccccaggugcagcug

SEQ ID NO: 36842 - RNA, 27 nt, Artificial Sequence
  Caspase recruitment domain-containing protein 19 (155-163)
uuccuggccgacgaccucggcgggcug

SEQ ID NO: 36843 - RNA, 33 nt, Artificial Sequence
  Protein YIF1B (55-65)
uuccuggccgaccccgugagcaacauggccaug

SEQ ID NO: 36844 - RNA, 27 nt, Artificial Sequence
  Interferon-induced GTP-binding protein Mx2 (30-38)
uuccuggccaaggacuucaacuuccuc

SEQ ID NO: 36845 - RNA, 27 nt, Artificial Sequence
  Eukaryotic translation initiation factor 4 gamma 2 (315-323)
uuccuggacaacggccccaagaccauc

SEQ ID NO: 36846 - RNA, 27 nt, Artificial Sequence
  Phospholipase DDHD1 (681-689)
uuccuggacagcgccuacuuccgccuc

SEQ ID NO: 36847 - RNA, 27 nt, Artificial Sequence
  Condensin complex subunit 3 (699-707)
uuccuggacagcgagguguccgagcuc

SEQ ID NO: 36848 - RNA, 27 nt, Artificial Sequence
  Microtubule-associated protein 1B (32-40)
uuccuggacagcaaguucuaccuccug

SEQ ID NO: 36849 - RNA, 27 nt, Artificial Sequence
  Catenin alpha-2 (392-400)
uuccuggagaccaacgugccccuccug

SEQ ID NO: 36850 - RNA, 30 nt, Artificial Sequence
  Calnexin (139-148)
uuccuguucgacaccaagccccucaucgug

SEQ ID NO: 36851 - RNA, 27 nt, Artificial Sequence
  Vacuolar protein sorting-associated protein 51 homolog (106-114)
uuccuguucgagcuccccagccgccug

SEQ ID NO: 36852 - RNA, 30 nt, Artificial Sequence
  Ankyrin repeat and LEM domain-containing protein 2 (825-834)
uuccuguucggcgaggagcccagcaagcuc

SEQ ID NO: 36853 - RNA, 27 nt, Artificial Sequence
  Cullin-4B (289-297)
uuccuguuccucgaccgcaccuacgug

SEQ ID NO: 36854 - RNA, 27 nt, Artificial Sequence
  Elongation of very long chain fatty acids protein 1 (87-95)
uuccuguucagcaaguucaucgagcuc

SEQ ID NO: 36855 - RNA, 24 nt, Artificial Sequence
  Sacsin (645-652)
uuccugggcaagaucuaccagauc

SEQ ID NO: 36856 - RNA, 27 nt, Artificial Sequence
  UDP-N-acetylglucosamine-dolichyl-phosphate N-acetylglucosaminephosphotransferase (221-229)
uuccugggcaccuucauccucaaggug

SEQ ID NO: 36857 - RNA, 27 nt, Artificial Sequence
  DNA ligase 3 (616-624)
uuccugcacgacaacaugguggagauc

SEQ ID NO: 36858 - RNA, 27 nt, Artificial Sequence
  Major facilitator superfamily domain-containing protein 1 (150-158)
uuccugaucgaccgcguguucggcauc

SEQ ID NO: 36859 - RNA, 27 nt, Artificial Sequence
  ATP-dependent RNA helicase DHX36 (519-527)
uuccugaucaucccccuccacagccug

SEQ ID NO: 36860 - RNA, 30 nt, Artificial Sequence
  Beta-glucuronidase (117-126)
uuccugaucaacggcaagcccuucuacuuc

SEQ ID NO: 36861 - RNA, 27 nt, Artificial Sequence
  Isoleucine-tRNA ligase, cytoplasmic (662-670)
uuccugauccagaacgugcuccgccug

SEQ ID NO: 36862 - RNA, 27 nt, Artificial Sequence
  Puromycin-sensitive aminopeptidase (846-854)
uuccugaucagccgccucaucaagcug

SEQ ID NO: 36863 - RNA, 27 nt, Artificial Sequence
  Myotubularin-related protein 2 (121-129)
uuccugaucaccauccucgaccaccug

SEQ ID NO: 36864 - RNA, 27 nt, Artificial Sequence
  Putative protein PLEKHA9 (298-306)
uuccugaagggcuuccucaccgaggug

SEQ ID NO: 36865 - RNA, 30 nt, Artificial Sequence
  Regulator of nonsense transcripts 1 (192-201)
uuccugcucggcuucauccccgccaaggcc

SEQ ID NO: 36866 - RNA, 30 nt, Artificial Sequence
  Alpha-N-acetylglucosaminidase (616-625)
uuccugcucggcagcuggcuggagcaggcc

SEQ ID NO: 36867 - RNA, 27 nt, Artificial Sequence
  Probable ATP-dependent RNA helicase DDX59 (257-265)
uuccugcuccccgugaucaugcgcgcc

SEQ ID NO: 36868 - RNA, 30 nt, Artificial Sequence
  HLA class II histocompatibility antigen, DP alpha 1 chain (22-31)
uuccugcucagccugcgcggcgccggggcc

SEQ ID NO: 36869 - RNA, 27 nt, Artificial Sequence
  Putative histone H2B type 2-D (86-94)
uuccugaacgacaucuucgagcgcauc

SEQ ID NO: 36870 - RNA, 27 nt, Artificial Sequence
  A-kinase anchor protein 9 (956-964)
uuccugaacgaggaggugaagagccuc

SEQ ID NO: 36871 - RNA, 27 nt, Artificial Sequence
  Osteopetrosis-associated transmembrane protein 1 (171-179)
uuccugaaccucuucaaccacacccug

SEQ ID NO: 36872 - RNA, 30 nt, Artificial Sequence
  Structure-specific endonuclease subunit SLX1 (220-229)
uuccugcaggaggagcccggccagcuccug

SEQ ID NO: 36873 - RNA, 27 nt, Artificial Sequence
  Golgin subfamily A member 4 (1152-1160)
uuccugcaggagcagcucguggagcug

SEQ ID NO: 36874 - RNA, 27 nt, Artificial Sequence
  Endoplasmic reticulum-Golgi intermediate compartment protein 3 (5-13)
uuccugagcgagcuccaguacuaccug

SEQ ID NO: 36875 - RNA, 27 nt, Artificial Sequence
  Nicalin (262-270)
uuccugagcacccucgagcaccaccug

SEQ ID NO: 36876 - RNA, 27 nt, Artificial Sequence
  Uncharacterized protein KIAA1109 (19-27)
uuccugaccgagcacaacagcaacgug

SEQ ID NO: 36877 - RNA, 27 nt, Artificial Sequence
  Zinc finger BED domain-containing protein 5 (533-541)
uuccugaccgagaucaacagcaccgug

SEQ ID NO: 36878 - RNA, 30 nt, Artificial Sequence
  Signal transducer and activator of transcription 6 (163-172)
uuccugguggagaagcagcccccgcagguc

SEQ ID NO: 36879 - RNA, 30 nt, Artificial Sequence
  Phospholipase D3 (58-67)
uuccugugggaguacggcgaccuccaccug

SEQ ID NO: 36880 - RNA, 27 nt, Artificial Sequence
  Transcription factor 25 (382-390)
uuccuguggaaggagcccgccaccaug

SEQ ID NO: 36881 - RNA, 27 nt, Artificial Sequence
  Cytochrome b (107-115)
uuccuguacagcgagaccuggaacauc

SEQ ID NO: 36882 - RNA, 30 nt, Artificial Sequence
  E3 ubiquitin-protein ligase XIAP (52-61)
uuccuguacaccggcgagggggacaccgug

SEQ ID NO: 36883 - RNA, 27 nt, Artificial Sequence
  Putative oxidoreductase GLYR1 (382-390)
uucauggccaccaucgccgagggccug

SEQ ID NO: 36884 - RNA, 27 nt, Artificial Sequence
  Probable helicase senataxin (266-274)
uucaugcagagcauccugcacaccaug

SEQ ID NO: 36885 - RNA, 27 nt, Artificial Sequence
  Alpha-adducin (97-105)
uucaugaccaccaacgugcccaacguc

SEQ ID NO: 36886 - RNA, 27 nt, Artificial Sequence
  Ubiquitin carboxyl-terminal hydrolase 11 (94-102)
uuccaggacgagaucaacuggcgccug

SEQ ID NO: 36887 - RNA, 33 nt, Artificial Sequence
  E3 ubiquitin-protein ligase TRIP12 (633-643)
uuccagcacgaggagaaccugcuccagcaggug

SEQ ID NO: 36888 - RNA, 27 nt, Artificial Sequence
  Threonine-tRNA ligase, cytoplasmic (598-606)
uuccagcugcccauccgcuucaaccuc

SEQ ID NO: 36889 - RNA, 27 nt, Artificial Sequence
  RNA-binding protein EWS (267-275)
uuccgccaggaccaccccagcuccaug

SEQ ID NO: 36890 - RNA, 24 nt, Artificial Sequence
  Spliceosome RNA helicase DDX39B (106-113)
uucguggacgacgagaccaagcug

SEQ ID NO: 36891 - RNA, 27 nt, Artificial Sequence
  Cytoplasmic dynein 1 heavy chain 1 (4145-4153)
uucguguucgagcccccgcccggcguc

SEQ ID NO: 36892 - RNA, 27 nt, Artificial Sequence
  General transcription factor IIH subunit 5 (44-52)
uucgugaucgccgagcuggucaacgug

SEQ ID NO: 36893 - RNA, 27 nt, Artificial Sequence
  Transmembrane protein 147 (181-189)
uucgugauggagaccuucguccaccug

SEQ ID NO: 36894 - RNA, 27 nt, Artificial Sequence
  Rhomboid domain-containing protein 2 (68-76)
uucguguacgagaaccccaucagccug

SEQ ID NO: 36895 - RNA, 27 nt, Artificial Sequence
  ER degradation-enhancing alpha-mannosidase-like protein 1 (33-41)
uucuaccagcgcuucccccugagcuuc

SEQ ID NO: 36896 - RNA, 27 nt, Artificial Sequence
  Filamin-A (998-1006)
ggcgccgacaacagcgugguccgcuuc

SEQ ID NO: 36897 - RNA, 27 nt, Artificial Sequence
  FACT complex subunit SPT16 (233-241)
ggcgccgaccccagcaccguggagaug

SEQ ID NO: 36898 - RNA, 30 nt, Artificial Sequence
  Telomere length regulation protein TEL2 homolog (189-198)
ggcgaggaggugguccgcgugcugcaggcc

SEQ ID NO: 36899 - RNA, 30 nt, Artificial Sequence
  Leucine-rich repeat serine/threonine-protein kinase 2 (1802-1811)
ggcgagggggagacccugcucaagaagugg

SEQ ID NO: 36900 - RNA, 30 nt, Artificial Sequence
  Nuclear factor erythroid 2-related factor 2 (521-530)
ggcgagaacgacaagagccugcaccuccug

SEQ ID NO: 36901 - RNA, 27 nt, Artificial Sequence
  AT-rich interactive domain-containing protein 2 (80-88)
ggcgagagcucccugaucaagcagcuc

SEQ ID NO: 36902 - RNA, 30 nt, Artificial Sequence
  Acetyl-CoA carboxylase 1 (1979-1988)
ggcgggauccccgugggcgucguggccgug

SEQ ID NO: 36903 - RNA, 24 nt, Artificial Sequence
  DNA damage-binding protein 1 (59-66)
ggcaagaucgccgugauggagcug

SEQ ID NO: 36904 - RNA, 27 nt, Artificial Sequence
  Cyclin-dependent kinase 12 (1103-1111)
ggccuggccgacaucacccagcagcuc

SEQ ID NO: 36905 - RNA, 33 nt, Artificial Sequence
  ATPase WRNIP1 (548-558)
ggccuggccgaccccagcgcccucacccaggcg

SEQ ID NO: 36906 - RNA, 30 nt, Artificial Sequence
  Negative regulator of reactive oxygen species (203-212)
ggccuggccgagcuccgccaccugaaccug

SEQ ID NO: 36907 - RNA, 27 nt, Artificial Sequence
  Flap endonuclease 1 (5-13)
ggccuggccaagcucaucgccgacgug

SEQ ID NO: 36908 - RNA, 27 nt, Artificial Sequence
  GPN-loop GTPase 1 (234-242)
ggccuggacgagcucuucgugcagguc

SEQ ID NO: 36909 - RNA, 30 nt, Artificial Sequence
  Probable ATP-dependent RNA helicase DDX27 (497-506)
ggccuggacaucgagggggugaagaccguc

SEQ ID NO: 36910 - RNA, 33 nt, Artificial Sequence
  U3 small nucleolar RNA-associated protein 18 homolog (107-117)
ggccuggacaacgccgugagccucuuccagguc

SEQ ID NO: 36911 - RNA, 27 nt, Artificial Sequence
  26S protease regulatory subunit 4 (189-197)
ggccuggacaaccagauccaggagauc

SEQ ID NO: 36912 - RNA, 30 nt, Artificial Sequence
  DNA mismatch repair protein Msh2 (438-447)
ggccuggaccccgggaagcagaucaagcuc

SEQ ID NO: 36913 - RNA, 27 nt, Artificial Sequence
  CAP-Gly domain-containing linker protein 1 (270-278)
ggccuguucgcccccgugcacaagguc

SEQ ID NO: 36914 - RNA, 33 nt, Artificial Sequence
  Ras suppressor protein 1 (35-45)
ggccuguucacccucagccacaucacccagcug

SEQ ID NO: 36915 - RNA, 33 nt, Artificial Sequence
  Autophagy-related protein 13 (84-94)
ggccugggggagggcuuccagaccgugcgcguc

SEQ ID NO: 36916 - RNA, 33 nt, Artificial Sequence
  WD repeat and FYVE domain-containing protein 3 (1077-1087)
ggccugaucgacggggccguggucagcggcauc

SEQ ID NO: 36917 - RNA, 33 nt, Artificial Sequence
  Structural maintenance of chromosomes flexible hinge domain-containing protein 1 (829-839)
ggccugcucgaccugcccuuccgcguggggguc

SEQ ID NO: 36918 - RNA, 30 nt, Artificial Sequence
  Nucleolar complex protein 4 homolog (332-341)
ggccugcucgaccccagcguguuccacguc

SEQ ID NO: 36919 - RNA, 27 nt, Artificial Sequence
  Transcription initiation factor TFIID subunit 4B (694-702)
ggccugcucgagaagcugaccgccauc

SEQ ID NO: 36920 - RNA, 27 nt, Artificial Sequence
  Vigilin (1000-1008)
ggccugcucgagcgcgugaaggagcug

SEQ ID NO: 36921 - RNA, 33 nt, Artificial Sequence
  Vigilin (354-364)
ggccugcucgagcgcgugaaggagcugcaggcc

SEQ ID NO: 36922 - RNA, 27 nt, Artificial Sequence
  Phosphatidylinositol N-acetylglucosaminyltransferase subunit H (75-83)
ggccugcucggguaccugcacuucgug

SEQ ID NO: 36923 - RNA, 27 nt, Artificial Sequence
  Thyroid adenoma-associated protein (229-237)
ggccugcucagcaucuucaccaaggug

SEQ ID NO: 36924 - RNA, 33 nt, Artificial Sequence
  Trafficking protein particle complex subunit 2-like protein (29-39)
ggccugcucuaccccaccgaggacuacaaggug

SEQ ID NO: 36925 - RNA, 27 nt, Artificial Sequence
  Nuclear receptor corepressor 1 (313-321)
ggccugauggaggaccccaugaaggug

SEQ ID NO: 36926 - RNA, 33 nt, Artificial Sequence
  Importin-4 (301-311)
ggccugaugggggagggccucgccccccaccug

SEQ ID NO: 36927 - RNA, 27 nt, Artificial Sequence
  Adiponectin receptor protein 2 (286-294)
ggccugagcgggaucauccccacccuc

SEQ ID NO: 36928 - RNA, 27 nt, Artificial Sequence
  Protein GPR107 (398-406)
ggccuguggaaggacagccucuuccug

SEQ ID NO: 36929 - RNA, 27 nt, Artificial Sequence
  Chromodomain-helicase-DNA-binding protein 8 (115-123)
ggcauggacgagaaggaguucaccgug

SEQ ID NO: 36930 - RNA, 27 nt, Artificial Sequence
  DnaJ homolog subfamily A member 1 (168-176)
ggcauggugcagcagauccagagcguc

SEQ ID NO: 36931 - RNA, 30 nt, Artificial Sequence
  Cysteine and histidine-rich protein 1 (139-148)
ggcaugugggggggcgccaugcugggggug

SEQ ID NO: 36932 - RNA, 33 nt, Artificial Sequence
  Rab GTPase-activating protein 1-like (35-45)
ggcauguggaaccccaacgccccgguguuccug

SEQ ID NO: 36933 - RNA, 27 nt, Artificial Sequence
  Tumor protein p53-inducible protein 13 (212-220)
ggcccccagccgacccgcagcgcccug

SEQ ID NO: 36934 - RNA, 27 nt, Artificial Sequence
  Ubiquitin carboxyl-terminal hydrolase 48 (545-553)
ggcccccgccugaccgugaaggcccuc

SEQ ID NO: 36935 - RNA, 30 nt, Artificial Sequence
  Filamin-A (2186-2195)
ggcccccgccuggugagcaaccacucccuc

SEQ ID NO: 36936 - RNA, 27 nt, Artificial Sequence
  Apoptosis-stimulating of p53 protein 2 (99-107)
ggcccccgcagccaggacccgucccug

SEQ ID NO: 36937 - RNA, 27 nt, Artificial Sequence
  Interleukin-6 receptor subunit beta (849-857)
ggccagguggagcgcuucgagaccguc

SEQ ID NO: 36938 - RNA, 30 nt, Artificial Sequence
  HLA class I histocompatibility antigen, B-15 alpha chain (25-34)
ggcagccacuccaugcgcuacuucuacacc

SEQ ID NO: 36939 - RNA, 30 nt, Artificial Sequence
  Nucleolar protein 56 (116-125)
ggcgugaucgccgagauccugcgcgggguc

SEQ ID NO: 36940 - RNA, 30 nt, Artificial Sequence
  Perilipin-2 (347-356)
ggcgugauggccggggacaucuacagcguc

SEQ ID NO: 36941 - RNA, 33 nt, Artificial Sequence
  Golgi resident protein GCP60 (488-498)
cacgaggagguguacgccggcagccaccaguac

SEQ ID NO: 36942 - RNA, 27 nt, Artificial Sequence
  Small subunit processome component 20 homolog (748-756)
cacgagauggagaacaagcaguucugg

SEQ ID NO: 36943 - RNA, 27 nt, Artificial Sequence
  Kelch domain-containing protein 3 (196-204)
cacauccuggacuucagccccucccuc

SEQ ID NO: 36944 - RNA, 33 nt, Artificial Sequence
  Leucine-rich repeat and calponin homology domain-containing protein 3 (744-754)
cacauccuggaggagaagggccucagccaggug

SEQ ID NO: 36945 - RNA, 33 nt, Artificial Sequence
  Leucine-rich repeat and calponin homology domain-containing protein 1 (668-678)
cacauccuggaggagaagggccucgugaagguc

SEQ ID NO: 36946 - RNA, 30 nt, Artificial Sequence
  Vascular endothelial growth factor receptor 1 (327-336)
cacaucuacgacaaggccuucaucaccgug

SEQ ID NO: 36947 - RNA, 33 nt, Artificial Sequence
  Phenylalanine-tRNA ligase alpha subunit (365-375)
caccuggccgaguuccaccagaucgagggcgug

SEQ ID NO: 36948 - RNA, 27 nt, Artificial Sequence
  ZW10 interactor (166-174)
caccuggccgaggugagcgccgagguc

SEQ ID NO: 36949 - RNA, 27 nt, Artificial Sequence
  Gamma-adducin (155-163)
caccuggccaacaccuacaucagcgug

SEQ ID NO: 36950 - RNA, 27 nt, Artificial Sequence
  Transcription factor E2-alpha (182-190)
caccuggacgaggccauccacgugcuc

SEQ ID NO: 36951 - RNA, 27 nt, Artificial Sequence
  Pre-mRNA-processing factor 17 (71-79)
caccuggaccccgccgugaaggagguc

SEQ ID NO: 36952 - RNA, 27 nt, Artificial Sequence
  Membrane-associated tyrosine- and threonine-specific cdc2-inhibitory kinase (162-170)
caccuggacgugaagcccgccaacauc

SEQ ID NO: 36953 - RNA, 27 nt, Artificial Sequence
  DEP domain-containing protein 1B (290-298)
caccuguucgacgccuucgugagcguc

SEQ ID NO: 36954 - RNA, 27 nt, Artificial Sequence
  Clathrin heavy chain 1 (1233-1241)
caccugggcgaguaccaggccgccgug

SEQ ID NO: 36955 - RNA, 27 nt, Artificial Sequence
  Neutral alpha-glucosidase AB (77-85)
caccugauccacgaggugaccaagguc

SEQ ID NO: 36956 - RNA, 30 nt, Artificial Sequence
  Heat shock protein HSP 90-beta (110-119)
caccugaaggaggaccagaccgaguaccuc

SEQ ID NO: 36957 - RNA, 27 nt, Artificial Sequence
  Centromere protein F (2031-2039)
caccugcaggagaagcuccagagccug

SEQ ID NO: 36958 - RNA, 27 nt, Artificial Sequence
  Late secretory pathway protein AVL9 homolog (517-525)
caccugagcgacgccaucguggagguc

SEQ ID NO: 36959 - RNA, 27 nt, Artificial Sequence
  Leupaxin (99-107)
caccugaccgagaugcaggccaaggug

SEQ ID NO: 36960 - RNA, 33 nt, Artificial Sequence
  Transmembrane protein 2 (1314-1324)
caccuguacgacaagggcagcaccaucuuccuc

SEQ ID NO: 36961 - RNA, 27 nt, Artificial Sequence
  Huntingtin-interacting protein 1 (192-200)
caccuguacgacuacaccgugaagcuc

SEQ ID NO: 36962 - RNA, 27 nt, Artificial Sequence
  Beta-lactamase-like protein 2 (145-153)
cacaccgacgaccacauggcccugcuc

SEQ ID NO: 36963 - RNA, 24 nt, Artificial Sequence
  DNA topoisomerase 2-beta (834-841)
cacaccgacaccacggugaaguuc

SEQ ID NO: 36964 - RNA, 27 nt, Artificial Sequence
  NIPA-like protein 3 (122-130)
aucgccaucaccgccggcgcgaucuuc

SEQ ID NO: 36965 - RNA, 27 nt, Artificial Sequence
  Cyclin-dependent kinase 1 (136-144)
aucgacgacaagggcaccaucaagcug

SEQ ID NO: 36966 - RNA, 27 nt, Artificial Sequence
  Glucosamine-6-phosphate isomerase 2 (146-154)
aucgaggagggcgugaaccacaugugg

SEQ ID NO: 36967 - RNA, 30 nt, Artificial Sequence
  Zinc finger protein ZPR1 (195-204)
aucaucgacgaccccagcggcaacuccuuc

SEQ ID NO: 36968 - RNA, 27 nt, Artificial Sequence
  U5 small nuclear ribonucleoprotein 200 kDa helicase (612-620)
aucauccuggacgagauccaccuccug

SEQ ID NO: 36969 - RNA, 27 nt, Artificial Sequence
  ATP-dependent RNA helicase DDX1 (707-715)
auccuggcccccaccgugcaggagcuc

SEQ ID NO: 36970 - RNA, 30 nt, Artificial Sequence
  Prohibitin (164-173)
auccuggacgacgugagccucacccaccug

SEQ ID NO: 36971 - RNA, 27 nt, Artificial Sequence
  Dihydroxyacetone phosphate acyltransferase (106-114)
auccuggacgagaugagccacaagcuc

SEQ ID NO: 36972 - RNA, 27 nt, Artificial Sequence
  ATP-binding cassette sub-family F member 3 (633-641)
auccuggacgagcccaccaaccaccuc

SEQ ID NO: 36973 - RNA, 27 nt, Artificial Sequence
  ATP-binding cassette sub-family F member 1 (765-773)
auccuggacgagcccaccaacaaccuc

SEQ ID NO: 36974 - RNA, 27 nt, Artificial Sequence
  U6 snRNA-associated Sm-like protein LSm8 (16-24)
auccuggacgagagccacgagcgcgug

SEQ ID NO: 36975 - RNA, 27 nt, Artificial Sequence
  Coiled-coil domain-containing protein 66 (307-315)
auccuggaccagagccgcgagaccgug

SEQ ID NO: 36976 - RNA, 27 nt, Artificial Sequence
  Heterogeneous nuclear ribonucleoprotein U (458-466)
auccuggaccagaccaacgugagcgcc

SEQ ID NO: 36977 - RNA, 30 nt, Artificial Sequence
  Actin-like protein 6A (127-136)
auccuggacagcggcgccacccacaccacg

SEQ ID NO: 36978 - RNA, 27 nt, Artificial Sequence
  Putative pre-mRNA-splicing factor ATP-dependent RNA helicase DHX16 (531-539)
auccuguucggccucaucaaggacgug

SEQ ID NO: 36979 - RNA, 27 nt, Artificial Sequence
  Pecanex-like protein 1 (1442-1450)
auccuguucaacaagcucugggagcug

SEQ ID NO: 36980 - RNA, 33 nt, Artificial Sequence
  Copper chaperone for superoxide dismutase (92-102)
auccugggcgggcccggcaccgugcaggggguc

SEQ ID NO: 36981 - RNA, 27 nt, Artificial Sequence
  Major facilitator superfamily domain-containing protein 8 (444-452)
auccugggccccaagccgcagggggug

SEQ ID NO: 36982 - RNA, 33 nt, Artificial Sequence
  Matrin-3 (67-77)
auccugggccccccgccccccagcuuccaccuc

SEQ ID NO: 36983 - RNA, 27 nt, Artificial Sequence
  Integrator complex subunit 7 (849-857)
auccugggcacccacaacaucaccgug

SEQ ID NO: 36984 - RNA, 27 nt, Artificial Sequence
  Cytoplasmic dynein 1 light intermediate chain 2 (245-253)
auccugcacgagaacuucaccaccgug

SEQ ID NO: 36985 - RNA, 33 nt, Artificial Sequence
  Adenosylhomocysteinase (339-349)
auccugcucgccgagggccgccuggugaaccug

SEQ ID NO: 36986 - RNA, 27 nt, Artificial Sequence
  Protein angel homolog 1 (409-417)
auccugcucgccgagguggacaagguc

SEQ ID NO: 36987 - RNA, 33 nt, Artificial Sequence
  Arginine-tRNA ligase, cytoplasmic (564-574)
auccugcucgaccacgagaaggaguggaagcug

SEQ ID NO: 36988 - RNA, 27 nt, Artificial Sequence
  MAP kinase-activating death domain protein (316-324)
auccugcucgagcacaaggugguccug

SEQ ID NO: 36989 - RNA, 27 nt, Artificial Sequence
  Eukaryotic translation initiation factor 3 subunit K (69-77)
auccugcucaaggcccugaccaaccug

SEQ ID NO: 36990 - RNA, 33 nt, Artificial Sequence
  Serine/threonine-protein kinase TAO1 (157-167)
auccugcucaccgagcccggccaggugaagcug

SEQ ID NO: 36991 - RNA, 27 nt, Artificial Sequence
  Ubiquitin carboxyl-terminal hydrolase 34 (46-54)
auccugauggacgagcgcaccuuccuc

SEQ ID NO: 36992 - RNA, 30 nt, Artificial Sequence
  Protein BIVM-ERCC5 (1331-1340)
auccugaacgaguuccccggccacgggcuc

SEQ ID NO: 36993 - RNA, 30 nt, Artificial Sequence
  Unconventional myosin-Ic (579-588)
auccugcagagcaaggagcccgccuacgug

SEQ ID NO: 36994 - RNA, 27 nt, Artificial Sequence
  Cohesin subunit SA-2 (1002-1010)
auccugagcgaguucuccagcaagcuc

SEQ ID NO: 36995 - RNA, 27 nt, Artificial Sequence
  TELO2-interacting protein 1 homolog (373-381)
auccugagcgagucccuccacagccug

SEQ ID NO: 36996 - RNA, 27 nt, Artificial Sequence
  Nuclear pore complex protein Nup153 (39-47)
auccugagccgcgugaccgaguccguc

SEQ ID NO: 36997 - RNA, 27 nt, Artificial Sequence
  XAGE1D protein (105-113)
auccugaccagcauccagucccuccug

SEQ ID NO: 36998 - RNA, 27 nt, Artificial Sequence
  Importin-11 (663-671)
auccugaccacccucauccaccuggug

SEQ ID NO: 36999 - RNA, 27 nt, Artificial Sequence
  A-kinase anchor protein 10, mitochondrial (437-445)
auccuguacgacaaguacuucagccuc

SEQ ID NO: 37000 - RNA, 27 nt, Artificial Sequence
  Signal transducer and activator of transcription 3 (96-104)
aucauggacgccaccaacauccuggug

SEQ ID NO: 37001 - RNA, 27 nt, Artificial Sequence
  Long-chain-fatty-acid-CoA ligase 3 (386-394)
aucauggaccgcaucuacaagaacgug

SEQ ID NO: 37002 - RNA, 33 nt, Artificial Sequence
  Syntaxin-binding protein 6 (160-170)
aucaugggcgggaacagcauccugcacuccgcc

SEQ ID NO: 37003 - RNA, 30 nt, Artificial Sequence
  Small nuclear ribonucleoprotein E (64-73)
aucaugcugaagggcgacaacaucacccuc

SEQ ID NO: 37004 - RNA, 27 nt, Artificial Sequence
  Talin-1 (100-108)
aucaugguggacgacagcaagaccguc

SEQ ID NO: 37005 - RNA, 27 nt, Artificial Sequence
  Zinc finger MIZ domain-containing protein 1 (736-744)
auccagcacagcgaguucgaggaggug

SEQ ID NO: 37006 - RNA, 27 nt, Artificial Sequence
  L-lactate dehydrogenase A chain (329-337)
aucagcgaccuggugaaggucacccuc

SEQ ID NO: 37007 - RNA, 27 nt, Artificial Sequence
  Protein cramped-like (737-745)
aucagcaccgaggugaaccccaagcug

SEQ ID NO: 37008 - RNA, 27 nt, Artificial Sequence
  Transmembrane protein 261 (13-21)
aucaccgcccccccgggcaccgccgcg

SEQ ID NO: 37009 - RNA, 30 nt, Artificial Sequence
  Apoptosis-resistant E3 ubiquitin protein ligase 1 (140-149)
aucaccgugaagcugggcgggcucaacguc

SEQ ID NO: 37010 - RNA, 27 nt, Artificial Sequence
  Alpha-adducin (206-214)
aucguggaccgcggcagcaccaaccug

SEQ ID NO: 37011 - RNA, 24 nt, Artificial Sequence
  NADH dehydrogenase (ubiquinone) 1 beta subcomplex subunit 10 (34-41)
aucguggaccgccccgucacccug

SEQ ID NO: 37012 - RNA, 27 nt, Artificial Sequence
  1-phosphatidylinositol 3-phosphate 5-kinase (742-750)
aucguggacguccgccccacccuggug

SEQ ID NO: 37013 - RNA, 27 nt, Artificial Sequence
  Cytoplasmic dynein 1 heavy chain 1 (132-140)
aucgugaugcaggaggucgagaccgug

SEQ ID NO: 37014 - RNA, 27 nt, Artificial Sequence
  Eukaryotic translation initiation factor 3 subunit B (187-195)
aucguggucgacaacgugccccaggug

SEQ ID NO: 37015 - RNA, 27 nt, Artificial Sequence
  Trifunctional purine biosynthetic protein adenosine-3 (125-133)
aaggccuucaccaagcccgaggaggcc

SEQ ID NO: 37016 - RNA, 27 nt, Artificial Sequence
  T-complex protein 1 subunit zeta (84-92)
aaggcccugcaguuccucgaggaggug

SEQ ID NO: 37017 - RNA, 27 nt, Artificial Sequence
  Endonuclease G, mitochondrial (153-161)
aaggccauggacgacaccuucuaccug

SEQ ID NO: 37018 - RNA, 27 nt, Artificial Sequence
  Histone-lysine N-methyltransferase NSD2 (573-581)
aaggccauggaggccgcgagcucccug

SEQ ID NO: 37019 - RNA, 27 nt, Artificial Sequence
  Tubulin alpha-1C chain (350-358)
aaggccuaccacgagcagcugaccgug

SEQ ID NO: 37020 - RNA, 30 nt, Artificial Sequence
  Melanoma-associated antigen 1 (160-169)
aaggaggccgaccccaccggccacagcuac

SEQ ID NO: 37021 - RNA, 30 nt, Artificial Sequence
  Melanoma-associated antigen D2 (337-346)
aaggagaucgacaagaacgaccaccuguac

SEQ ID NO: 37022 - RNA, 27 nt, Artificial Sequence
  Lysine-specific demethylase 5A (1136-1144)
aaggagaucgaggccaugcacagccug

SEQ ID NO: 37023 - RNA, 27 nt, Artificial Sequence
  Something about silencing protein 10 (380-388)
aaggagaucgaggaccgccagaagcug

SEQ ID NO: 37024 - RNA, 30 nt, Artificial Sequence
  Plectin (705-714)
aaggagaacgccgccuacuuccaguucuuc

SEQ ID NO: 37025 - RNA, 27 nt, Artificial Sequence
  ATP-binding cassette sub-family F member 3 (472-480)
aaggagagcgagguggucaugaaguuc

SEQ ID NO: 37026 - RNA, 27 nt, Artificial Sequence
  Kinetochore protein Nuf2 (447-455)
aagaucgacgagaagaccgccgagcug

SEQ ID NO: 37027 - RNA, 33 nt, Artificial Sequence
  Interferon-induced, double-stranded RNA-activated protein kinase (388-398)
aagaucggcgacuucgggcuggugaccagccuc

SEQ ID NO: 37028 - RNA, 27 nt, Artificial Sequence
  Cyclin-dependent kinase 1 (9-17)
aagaucggcgaggggaccuacggcgug

SEQ ID NO: 37029 - RNA, 27 nt, Artificial Sequence
  DNA mismatch repair protein Msh6 (740-748)
aagaucaucggcaucauggaggaggug

SEQ ID NO: 37030 - RNA, 33 nt, Artificial Sequence
  Arginine-tRNA ligase, cytoplasmic (587-597)
aagauccuggacgaccucuuccugcacacccug

SEQ ID NO: 37031 - RNA, 30 nt, Artificial Sequence
  Vacuolar protein sorting-associated protein 41 homolog (318-327)
aagauccuggacaucggccucgccuacauc

SEQ ID NO: 37032 - RNA, 30 nt, Artificial Sequence
  Signal transducer and activator of transcription 3 (658-667)
aagaucauggacgccaccaacauccuggug

SEQ ID NO: 37033 - RNA, 27 nt, Artificial Sequence
  UPF0568 protein C14orf166 (218-226)
aagaucaacgaggccaucguggccguc

SEQ ID NO: 37034 - RNA, 27 nt, Artificial Sequence
  Cell division cycle protein 27 homolog (380-388)
aagaucagcaccaucaccccccagauc

SEQ ID NO: 37035 - RNA, 27 nt, Artificial Sequence
  Calpain-7 (56-64)
aagaucaccgaguaccuggagcgcgug

SEQ ID NO: 37036 - RNA, 33 nt, Artificial Sequence
  Pre-mRNA-processing factor 19 (375-385)
aagaucugggaccugaaggagcgcaccaacgug

SEQ ID NO: 37037 - RNA, 33 nt, Artificial Sequence
  Probable ATP-dependent RNA helicase DDX60 (16-26)
aagcuggccgacaugaaccaggaguaccagcuc

SEQ ID NO: 37038 - RNA, 27 nt, Artificial Sequence
  WD repeat-containing protein 11 (1062-1070)
aagcuggccgagggcgugcagcuccug

SEQ ID NO: 37039 - RNA, 27 nt, Artificial Sequence
  KAT8 regulatory NSL complex subunit 1 (21-29)
aagcuggcccccccgagcuccacccuc

SEQ ID NO: 37040 - RNA, 27 nt, Artificial Sequence
  Dolichol-phosphate mannosyltransferase subunit 3 (24-32)
aagcuggcccaguggcucuggggccug

SEQ ID NO: 37041 - RNA, 27 nt, Artificial Sequence
  DnaJ homolog subfamily C member 7 (322-330)
aagcuggacgacaccuacaucaaggcc

SEQ ID NO: 37042 - RNA, 27 nt, Artificial Sequence
  Nuclear transcription factor Y subunit gamma (53-61)
aagcuggacgaggacgugaagaugauc

SEQ ID NO: 37043 - RNA, 27 nt, Artificial Sequence
  Coronin-1C (493-501)
aagcuggacgagauccucaaggagauc

SEQ ID NO: 37044 - RNA, 27 nt, Artificial Sequence
  Protein LAP2 (759-767)
aagcuggaccacaucaacaugaaccuc

SEQ ID NO: 37045 - RNA, 27 nt, Artificial Sequence
  Protein NPAT (88-96)
aagcuggaccacacccucagccagauc

SEQ ID NO: 37046 - RNA, 27 nt, Artificial Sequence
  Rab3 GTPase-activating protein catalytic subunit (784-792)
aagcuggaggagaucauccaccagauc

SEQ ID NO: 37047 - RNA, 30 nt, Artificial Sequence
  Vacuolar protein sorting-associated protein 35 (323-332)
aagcuguucgacaucuucagccagcaggug

SEQ ID NO: 37048 - RNA, 27 nt, Artificial Sequence
  Transmembrane protein 223 (189-197)
aagcuguucgacaacaccgugggcgcc

SEQ ID NO: 37049 - RNA, 27 nt, Artificial Sequence
  tRNA wybutosine-synthesizing protein 2 homolog (32-40)
aagcuguucgacacccagcaccgcgug

SEQ ID NO: 37050 - RNA, 33 nt, Artificial Sequence
  Testin (65-75)
aagcuguucgaggacaccaaguacaccacgcuc

SEQ ID NO: 37051 - RNA, 27 nt, Artificial Sequence
  T-complex protein 11-like protein 2 (131-139)
aagcuguucgaggagauccgcgagauc

SEQ ID NO: 37052 - RNA, 27 nt, Artificial Sequence
  Exportin-1 (568-576)
aagcuguucgaguucaugcacgagacc

SEQ ID NO: 37053 - RNA, 27 nt, Artificial Sequence
  TATA box-binding protein-associated factor RNA polymerase I subunit B (312-320)
aagcuguucgagaagaaguacagcgug

SEQ ID NO: 37054 - RNA, 33 nt, Artificial Sequence
  Retinoic acid-induced protein 1 (1841-1851)
aagcuguucggccuccaggaggccaugaaggug

SEQ ID NO: 37055 - RNA, 27 nt, Artificial Sequence
  Rab-like protein 2A (105-113)
aagcuguucaacgacgccauccgccuc

SEQ ID NO: 37056 - RNA, 27 nt, Artificial Sequence
  WD repeat-containing protein 3 (837-845)
aagcuguucaacgaguucauccagcuc

SEQ ID NO: 37057 - RNA, 33 nt, Artificial Sequence
  Asparagine synthetase (glutamine-hydrolyzing) (138-148)
aagcuguuccccggcuucgagaucgagaccgug

SEQ ID NO: 37058 - RNA, 27 nt, Artificial Sequence
  Splicing factor 3B subunit 3 (769-777)
aagcugggcgccguguucaaccagguc

SEQ ID NO: 37059 - RNA, 27 nt, Artificial Sequence
  Membrane-associated tyrosine- and threonine-specific cdc2-inhibitory kinase (179-187)
aagcugggcgacuucgggcuccuggug

SEQ ID NO: 37060 - RNA, 24 nt, Artificial Sequence
  Pre-mRNA-splicing factor ATP-dependent RNA helicase PRP16 (474-481)
aagcugggcgacaucaugggggug

SEQ ID NO: 37061 - RNA, 27 nt, Artificial Sequence
  Inactive ubiquitin carboxyl-terminal hydrolase 54 (272-280)
aagcugggcgaccucuucuuccgcgug

SEQ ID NO: 37062 - RNA, 27 nt, Artificial Sequence
  Probable ATP-dependent RNA helicase DHX37 (678-686)
aagcugggcgaccucauggugcugcug

SEQ ID NO: 37063 - RNA, 24 nt, Artificial Sequence
  Ras GTPase-activating-like protein IQGAP1 (161-168)
aagcugggccucgccccccagauc

SEQ ID NO: 37064 - RNA, 27 nt, Artificial Sequence
  Neutral amino acid transporter B(0) (45-53)
aagcugggccccgagggggagcuccug

SEQ ID NO: 37065 - RNA, 30 nt, Artificial Sequence
  Nicotinamide phosphoribosyltransferase (189-198)
aagcugcacgacuucggcuaccgcggggug

SEQ ID NO: 37066 - RNA, 27 nt, Artificial Sequence
  AP-2 complex subunit beta (147-155)
aagcugcacgacaucaacgcccagaug

SEQ ID NO: 37067 - RNA, 27 nt, Artificial Sequence
  Inner nuclear membrane protein Man1 (532-540)
aagcugcacgaccgccucgcccagcug

SEQ ID NO: 37068 - RNA, 27 nt, Artificial Sequence
  Ribosomal protein S6 kinase alpha-4 (94-102)
aagcugcaccucauccuggacuacgug

SEQ ID NO: 37069 - RNA, 27 nt, Artificial Sequence
  E3 ubiquitin-protein ligase HECTD1 (525-533)
aagcugaucgccgugcucgagagcauc

SEQ ID NO: 37070 - RNA, 27 nt, Artificial Sequence
  Serine/threonine-protein phosphatase 6 regulatory subunit 3 (43-51)
aagcugaucgaguuccuccugaaggcc

SEQ ID NO: 37071 - RNA, 27 nt, Artificial Sequence
  ATP-dependent RNA helicase DDX18 (507-515)
aagcugaucgagaagaacuacuuccuc

SEQ ID NO: 37072 - RNA, 27 nt, Artificial Sequence
  Early endosome antigen 1 (1075-1083)
aagcugauccaggagcucaagaccgcc

SEQ ID NO: 37073 - RNA, 27 nt, Artificial Sequence
  Centrosomal protein of 57 kDa (383-391)
aagcugauccaggagagccccaccgug

SEQ ID NO: 37074 - RNA, 27 nt, Artificial Sequence
  Transmembrane protein 209 (50-58)
aagcugaucagcuccuacuacaacgug

SEQ ID NO: 37075 - RNA, 27 nt, Artificial Sequence
  Kelch-like protein 7 (25-33)
aagcugcucgccggcuucaugggggug

SEQ ID NO: 37076 - RNA, 30 nt, Artificial Sequence
  Vacuolar protein sorting-associated protein 35 (14-23)
aagcugcucgacgaggccauccaggccgug

SEQ ID NO: 37077 - RNA, 33 nt, Artificial Sequence
  40S ribosomal protein S17 (107-117)
aagcugcucgacuucggcagccuguccaaccug

SEQ ID NO: 37078 - RNA, 27 nt, Artificial Sequence
  Ligand of Numb protein X 2 (105-113)
aagcugcucgacaagcugcuggugcuc

SEQ ID NO: 37079 - RNA, 33 nt, Artificial Sequence
  DDB1- and CUL4-associated factor 16 (79-89)
aagcugcucgaccccagcaccccggugcacauc

SEQ ID NO: 37080 - RNA, 33 nt, Artificial Sequence
  HCG2044777 (36-46)
aagcugcucgacaccaugguggacaccuuccug

SEQ ID NO: 37081 - RNA, 33 nt, Artificial Sequence
  E3 ubiquitin-protein ligase DTX3L (386-396)
aagcugcucgagaccgagcugcugcaggagauc

SEQ ID NO: 37082 - RNA, 27 nt, Artificial Sequence
  GRIP and coiled-coil domain-containing protein 2 (1083-1091)
aagcugcucgaggugcagauccuggag

SEQ ID NO: 37083 - RNA, 30 nt, Artificial Sequence
  GRIP and coiled-coil domain-containing protein 2 (1083-1092)
aagcugcucgaggugcagauccuggagguc

SEQ ID NO: 37084 - RNA, 33 nt, Artificial Sequence
  V-type proton ATPase subunit H (396-406)
aagcugcucgaggugagcgacgacccccagguc

SEQ ID NO: 37085 - RNA, 27 nt, Artificial Sequence
  TELO2-interacting protein 2 (122-130)
aagcugcucggcaagguggagaccgcc

SEQ ID NO: 37086 - RNA, 30 nt, Artificial Sequence
  TELO2-interacting protein 1 homolog (409-418)
aagcugcucggccccaagaucaacuucgug

SEQ ID NO: 37087 - RNA, 27 nt, Artificial Sequence
  Bromodomain-containing protein 9 (476-484)
aagcugcuccaggaccugcacgaggcc

SEQ ID NO: 37088 - RNA, 27 nt, Artificial Sequence
  Zinc finger protein 644 (475-483)
aagcugauggaggagauccgcgagcuc

SEQ ID NO: 37089 - RNA, 27 nt, Artificial Sequence
  ATP-binding cassette sub-family F member 2 (188-196)
aagcugauggagcucuacgagcgccug

SEQ ID NO: 37090 - RNA, 27 nt, Artificial Sequence
  Dual specificity protein phosphatase 10 (474-482)
aagcugaugggcguggagaccgucgug

SEQ ID NO: 37091 - RNA, 27 nt, Artificial Sequence
  Tax1-binding protein 1 (296-304)
aagcugaugagcgaggugcagacccuc

SEQ ID NO: 37092 - RNA, 27 nt, Artificial Sequence
  S-adenosylmethionine synthase isoform type-2 (159-167)
aagcugaacgccaagcucgccgagcug

SEQ ID NO: 37093 - RNA, 27 nt, Artificial Sequence
  Coatomer subunit alpha (1002-1010)
aagcugaacgaccucauccagcgccug

SEQ ID NO: 37094 - RNA, 27 nt, Artificial Sequence
  THAP domain-containing protein 4 (389-397)
aagcugcaggagaagcucgacgagcug

SEQ ID NO: 37095 - RNA, 27 nt, Artificial Sequence
  E3 ubiquitin-protein ligase BRE1A (194-202)
aagcugcaggagaagguggagcuccug

SEQ ID NO: 37096 - RNA, 27 nt, Artificial Sequence
  DNA topoisomerase I, mitochondrial (529-537)
aagcugcaggagcagcucgcccagcug

SEQ ID NO: 37097 - RNA, 33 nt, Artificial Sequence
  Ectopic P granules protein 5 homolog (535-545)
aagcugcagcccaccccgggcauccagaaggug

SEQ ID NO: 37098 - RNA, 27 nt, Artificial Sequence
  Unconventional myosin-Id (406-414)
aagcugcagcagcucuucauccagcug

SEQ ID NO: 37099 - RNA, 27 nt, Artificial Sequence
  NFATC2-interacting protein (17-25)
aagcugagcgaggugaacaagcgccuc

SEQ ID NO: 37100 - RNA, 27 nt, Artificial Sequence
  ATPase family AAA domain-containing protein 1 (68-76)
aagcugagcgaguacgagauguccauc

SEQ ID NO: 37101 - RNA, 27 nt, Artificial Sequence
  Serpin H1 (262-270)
aagcugagcucccucaucauccugaug

SEQ ID NO: 37102 - RNA, 27 nt, Artificial Sequence
  Coiled-coil domain-containing protein 93 (26-34)
aagcugaccgagauccucgagcugcug

SEQ ID NO: 37103 - RNA, 27 nt, Artificial Sequence
  Protein Hook homolog 1 (556-564)
aagcugaccgaggugcacgaggagcuc

SEQ ID NO: 37104 - RNA, 27 nt, Artificial Sequence
  Polypeptide N-acetylgalactosaminyltransferase 18 (204-212)
aagcugaccgaguacguggacaagguc

SEQ ID NO: 37105 - RNA, 27 nt, Artificial Sequence
  Kinesin-like protein KIF1C (839-847)
aagcugaccggcauccuccaggaggug

SEQ ID NO: 37106 - RNA, 27 nt, Artificial Sequence
  Actin-related protein 2/3 complex subunit 4 (130-138)
aagcugguggacuucgucauccacuuc

SEQ ID NO: 37107 - RNA, 33 nt, Artificial Sequence
  Caprin-1 (191-201)
aagcugguggaccccgagcgcgacaugagccuc

SEQ ID NO: 37108 - RNA, 27 nt, Artificial Sequence
  Lysine-tRNA ligase (474-482)
aagcuggugggcgaguuccucgagguc

SEQ ID NO: 37109 - RNA, 27 nt, Artificial Sequence
  Baculoviral IAP repeat-containing protein 6 (860-868)
aagcuggugaacauccucguccagcug

SEQ ID NO: 37110 - RNA, 27 nt, Artificial Sequence
  Eukaryotic peptide chain release factor GTP-binding subunit ERF3A (239-247)
aagcuggugcccuuccucaagaagguc

SEQ ID NO: 37111 - RNA, 27 nt, Artificial Sequence
  Trafficking protein particle complex subunit 11 (245-253)
aagcugugggccgaccgcaucagccuc

SEQ ID NO: 37112 - RNA, 27 nt, Artificial Sequence
  Pecanex-like protein 1 (1446-1454)
aagcugugggagcuccuguacaagcug

SEQ ID NO: 37113 - RNA, 27 nt, Artificial Sequence
  Intraflagellar transport protein 27 homolog (77-85)
aagcugugggagagccccaacgugcuc

SEQ ID NO: 37114 - RNA, 33 nt, Artificial Sequence
  Transducin-like enhancer protein 4 (308-318)
aagcuguggaccggcgggcucgacaacaccgug

SEQ ID NO: 37115 - RNA, 30 nt, Artificial Sequence
  Cytochrome P450 4V2 (91-100)
aagcugugggugggccccgucccgauggug

SEQ ID NO: 37116 - RNA, 27 nt, Artificial Sequence
  Intraflagellar transport protein 172 homolog (352-360)
aagcuguacgacgacaugauccgccuc

SEQ ID NO: 37117 - RNA, 27 nt, Artificial Sequence
  General transcription factor II-I repeat domain-containing protein 2B (841-849)
aagcuguacgagagcgagcucacccug

SEQ ID NO: 37118 - RNA, 27 nt, Artificial Sequence
  DNA-directed RNA polymerase I subunit RPA1 (386-394)
aagcuguacaacaucuggauccgccuc

SEQ ID NO: 37119 - RNA, 33 nt, Artificial Sequence
  Regulator of nonsense transcripts 1 (816-826)
aagcuguaccaggagguggagaucgccagcguc

SEQ ID NO: 37120 - RNA, 27 nt, Artificial Sequence
  Glutamine-tRNA ligase (401-409)
aagauggaccccguggccuaccgcguc

SEQ ID NO: 37121 - RNA, 27 nt, Artificial Sequence
  Adiponectin receptor protein 1 (79-87)
aagauggaggaguucguguacaagguc

SEQ ID NO: 37122 - RNA, 27 nt, Artificial Sequence
  NADH dehydrogenase (ubiquinone) iron-sulfur protein 2, mitochondrial (1-9)
aagauguucgaguucuacgagcgcgug

SEQ ID NO: 37123 - RNA, 30 nt, Artificial Sequence
  cAMP-dependent protein kinase type II-alpha regulatory subunit (222-231)
aagauguucgagagcuucaucgaguccgug

SEQ ID NO: 37124 - RNA, 30 nt, Artificial Sequence
  3-hydroxy-3-methylglutaryl-coenzyme A reductase (314-323)
aagaugaucagcauggacaucgagcaggug

SEQ ID NO: 37125 - RNA, 33 nt, Artificial Sequence
  Serine/threonine-protein kinase SIK2 (72-82)
aagaugcuggaccacccccacaucaucaagcuc

SEQ ID NO: 37126 - RNA, 27 nt, Artificial Sequence
  Transmembrane protein 245 (455-463)
aagaugcuggacaagaucaucagcauc

SEQ ID NO: 37127 - RNA, 30 nt, Artificial Sequence
  Acetyl-CoA acetyltransferase, mitochondrial (365-374)
aagaugcuggagaucgacccccagaaggug

SEQ ID NO: 37128 - RNA, 33 nt, Artificial Sequence
  HLA class II histocompatibility antigen, DQ beta 1 chain (229-239)
aagaugcugagcggcaucgggggcuucgugcuc

SEQ ID NO: 37129 - RNA, 33 nt, Artificial Sequence
  HLA class II histocompatibility antigen, DRB1-11 beta chain (227-237)
aagaugcugagcggcguggggggcuucguccuc

SEQ ID NO: 37130 - RNA, 27 nt, Artificial Sequence
  DNA replication licensing factor MCM4 (578-586)
aagaugaacgagagcacccgcuccgug

SEQ ID NO: 37131 - RNA, 27 nt, Artificial Sequence
  MAP kinase-activating death domain protein (389-397)
aagaugcccgacgacguguggcugguc

SEQ ID NO: 37132 - RNA, 27 nt, Artificial Sequence
  Mitotic spindle assembly checkpoint protein MAD1 (294-302)
aagaugcaggagacccuggugggccuc

SEQ ID NO: 37133 - RNA, 27 nt, Artificial Sequence
  Rho GTPase-activating protein 5 (514-522)
aagaugagcgagauccacaccgugcug

SEQ ID NO: 37134 - RNA, 27 nt, Artificial Sequence
  Centromere protein F (1431-1439)
aagaugagcgagcugcagaccuacgug

SEQ ID NO: 37135 - RNA, 27 nt, Artificial Sequence
  Nucleolar protein 56 (288-296)
aagaugagccagguggcccccucccug

SEQ ID NO: 37136 - RNA, 27 nt, Artificial Sequence
  AP-1 complex subunit sigma-1A (29-37)
aagauggugcgcgagcugaugcagguc

SEQ ID NO: 37137 - RNA, 33 nt, Artificial Sequence
  mRNA export factor (111-121)
aagaugugggaccugagcuccaaccaggccauc

SEQ ID NO: 37138 - RNA, 27 nt, Artificial Sequence
  Ski oncogene (28-36)
aagcccagcuccuggcugcgcacccuc

SEQ ID NO: 37139 - RNA, 27 nt, Artificial Sequence
  Breast cancer type 2 susceptibility protein (1180-1188)
aagcaguucgagggcaccguggagauc

SEQ ID NO: 37140 - RNA, 27 nt, Artificial Sequence
  E3 UFM1-protein ligase 1 (402-410)
aagcagaucagcacccuggaguccgug

SEQ ID NO: 37141 - RNA, 27 nt, Artificial Sequence
  General transcription factor II-I (532-540)
aagcagguggaggagaucuucaaccug

SEQ ID NO: 37142 - RNA, 27 nt, Artificial Sequence
  Ribonuclease H2 subunit B (295-303)
aagagcaucgacaccuucuucggcgug

SEQ ID NO: 37143 - RNA, 27 nt, Artificial Sequence
  Zinc finger MYM-type protein 3 (414-422)
aagaccggcgaggugcugcacgagguc

SEQ ID NO: 37144 - RNA, 33 nt, Artificial Sequence
  PRELI domain-containing protein 1, mitochondrial (157-167)
aagaccaugaagggcuucgaguacauccuggcc

SEQ ID NO: 37145 - RNA, 27 nt, Artificial Sequence
  Sister chromatid cohesion protein PDS5 homolog A (1070-1078)
aagaccaacgagaagcuguacaccgug

SEQ ID NO: 37146 - RNA, 27 nt, Artificial Sequence
  Pre-rRNA-processing protein TSR1 homolog (106-114)
aagguggccgacaccauccuguuccuc

SEQ ID NO: 37147 - RNA, 27 nt, Artificial Sequence
  TNFAIP3-interacting protein 2 (330-338)
aagguggccagccugcuccaccagguc

SEQ ID NO: 37148 - RNA, 27 nt, Artificial Sequence
  Polyadenylate-binding protein 4 (602-610)
aagguggacgaggccgucgccgugcug

SEQ ID NO: 37149 - RNA, 30 nt, Artificial Sequence
  Beta-secretase 2 (314-323)
aagguguucgacgccgucguggaggccgug

SEQ ID NO: 37150 - RNA, 27 nt, Artificial Sequence
  Melanoma inhibitory activity protein 3 (259-267)
aaggugcuggacaaggucuuccgcgcc

SEQ ID NO: 37151 - RNA, 27 nt, Artificial Sequence
  Lipopolysaccharide-responsive and beige-like anchor protein (136-144)
aaggugcugggcaagaucgagaagguc

SEQ ID NO: 37152 - RNA, 27 nt, Artificial Sequence
  Protein SET (137-145)
aaggugcugagcaaggaguuccaccuc

SEQ ID NO: 37153 - RNA, 33 nt, Artificial Sequence
  E3 ubiquitin-protein ligase RNF213 (3249-3259)
aaggugagcgaggaggccaaguccauccugcuc

SEQ ID NO: 37154 - RNA, 30 nt, Artificial Sequence
  T-complex protein 1 subunit delta (232-241)
aaggugagcaacuccggcaucacccgcguc

SEQ ID NO: 37155 - RNA, 30 nt, Artificial Sequence
  Inhibitor of nuclear factor kappa-B kinase subunit alpha (394-403)
aaggugugggccgaggccguccacuacgug

SEQ ID NO: 37156 - RNA, 27 nt, Artificial Sequence
  TRIO and F-actin-binding protein (548-556)
aaguaccaggacguguacgucgagcug

SEQ ID NO: 37157 - RNA, 27 nt, Artificial Sequence
  Growth arrest-specific protein 7 (317-325)
cuggccgacgaggccgaggugcaccuc

SEQ ID NO: 37158 - RNA, 24 nt, Artificial Sequence
  Heat shock protein HSP 90-beta (497-504)
cuggacaagaagguggagaagguc

SEQ ID NO: 37159 - RNA, 27 nt, Artificial Sequence
  Glutamine-tRNA ligase (170-178)
cuggaggccgaccucgagaagaaguuc

SEQ ID NO: 37160 - RNA, 27 nt, Artificial Sequence
  GRIP and coiled-coil domain-containing protein 2 (490-498)
cuggagaacgagcaggugcagaagcuc

SEQ ID NO: 37161 - RNA, 27 nt, Artificial Sequence
  ERO1-like protein alpha (69-77)
cuggagagcgacuacuuccgcuacuac

SEQ ID NO: 37162 - RNA, 33 nt, Artificial Sequence
  Lethal(2) giant larvae protein homolog 2 (69-79)
cugcaccaggagaacaacgccgugacccagauc

SEQ ID NO: 37163 - RNA, 27 nt, Artificial Sequence
  Beta-hexosaminidase subunit beta (194-202)
cugaucgacaccagccgccacuaccuc

SEQ ID NO: 37164 - RNA, 27 nt, Artificial Sequence
  mRNA cap guanine-N7 methyltransferase (183-191)
cugaucggcgaguuccucgagaaggug

SEQ ID NO: 37165 - RNA, 27 nt, Artificial Sequence
  Activating signal cointegrator 1 complex subunit 3 (1174-1182)
cugaucaucgacgagauccaccuccug

SEQ ID NO: 37166 - RNA, 27 nt, Artificial Sequence
  Elongation factor 2 (292-300)
cugauccucgaccccaucuucaaggug

SEQ ID NO: 37167 - RNA, 27 nt, Artificial Sequence
  Zinc finger protein 532 (468-476)
cugaagcucgccaacaacaccaccgug

SEQ ID NO: 37168 - RNA, 27 nt, Artificial Sequence
  Protein TBRG4 (214-222)
cugcucgccgagcugcugacccaccuc

SEQ ID NO: 37169 - RNA, 27 nt, Artificial Sequence
  Cytoplasmic dynein 1 heavy chain 1 (1716-1724)
cugcucgccgagagcgugaccgagguc

SEQ ID NO: 37170 - RNA, 27 nt, Artificial Sequence
  m7GpppX diphosphatase (297-305)
cugcucgccgaggugaucgagaaccug

SEQ ID NO: 37171 - RNA, 27 nt, Artificial Sequence
  E3 ubiquitin-protein ligase UBR2 (617-625)
cugcucgccggccugcacgugcugcuc

SEQ ID NO: 37172 - RNA, 33 nt, Artificial Sequence
  MAP kinase-activating death domain protein (367-377)
cugcucgcccccaccccguacaucaucggcgug

SEQ ID NO: 37173 - RNA, 27 nt, Artificial Sequence
  Peroxiredoxin-5, mitochondrial (164-172)
cugcucgacgacagccugguguccauc

SEQ ID NO: 37174 - RNA, 30 nt, Artificial Sequence
  Beta-adrenergic receptor kinase 1 (324-333)
cugcucgacgagcacggccacgugcgcauc

SEQ ID NO: 37175 - RNA, 27 nt, Artificial Sequence
  Lon protease homolog 2, peroxisomal (678-686)
cugcucgacaacaccgacauccaccug

SEQ ID NO: 37176 - RNA, 27 nt, Artificial Sequence
  Coatomer subunit gamma-1 (848-856)
cugcucgacaccgugaccaugcagguc

SEQ ID NO: 37177 - RNA, 27 nt, Artificial Sequence
  Serine-protein kinase ATM (1590-1598)
cugcucgaggagaucaaccacuuccug

SEQ ID NO: 37178 - RNA, 33 nt, Artificial Sequence
  DNA-directed RNA polymerase II subunit RPB11-a (11-21)
cugcucuucgagggcgagaagaagaucaccauc

SEQ ID NO: 37179 - RNA, 27 nt, Artificial Sequence
  GCN1 general control of amino-acid synthesis 1-like 1 (1599-1607)
cugcucggcgaccugcuguuccacauc

SEQ ID NO: 37180 - RNA, 27 nt, Artificial Sequence
  Transport and Golgi organization protein 6 homolog (991-999)
cugcucggcagcgugguccacgaggug

SEQ ID NO: 37181 - RNA, 27 nt, Artificial Sequence
  Nucleoprotein TPR (1158-1166)
cugcuccacgaccagaucgagaagcug

SEQ ID NO: 37182 - RNA, 27 nt, Artificial Sequence
  Sentrin-specific protease 5 (328-336)
cugcucauccccauccaccuggaggug

SEQ ID NO: 37183 - RNA, 27 nt, Artificial Sequence
  cAMP-dependent protein kinase type I-alpha regulatory subunit (30-38)
cugcucaaggacagcaucgugcagcug

SEQ ID NO: 37184 - RNA, 30 nt, Artificial Sequence
  Coatomer subunit gamma-1 (847-856)
cugcuccuggacaccgugaccaugcagguc

SEQ ID NO: 37185 - RNA, 27 nt, Artificial Sequence
  ATP-binding cassette sub-family B member 8, mitochondrial (150-158)
cugcuccugggccagcugguggagguc

SEQ ID NO: 37186 - RNA, 33 nt, Artificial Sequence
  Ubiquitin/ISG15-conjugating enzyme E2 L6 (38-48)
cugcuccugcccgaccagccgcccuaccaccug

SEQ ID NO: 37187 - RNA, 33 nt, Artificial Sequence
  E3 ubiquitin-protein ligase listerin (646-656)
cugcucaugcccagcuccgaggaccugcugcuc

SEQ ID NO: 37188 - RNA, 27 nt, Artificial Sequence
  Kelch-like protein 12 (470-478)
cugcucaacgaccacaucuacgugguc

SEQ ID NO: 37189 - RNA, 27 nt, Artificial Sequence
  Polyadenylate-binding protein 4 (162-170)
cugcucaacgaccgcaagguguucguc

SEQ ID NO: 37190 - RNA, 30 nt, Artificial Sequence
  Staphylococcal nuclease domain-containing protein 1 (187-196)
cugcuccccgacuacuaccuggugaccguc

SEQ ID NO: 37191 - RNA, 30 nt, Artificial Sequence
  tRNA-dihydrouridine(47) synthase (NAD(P)(+))-like (208-217)
cugcuccccgagcugcgcgacuggggcgug

SEQ ID NO: 37192 - RNA, 27 nt, Artificial Sequence
  Activating molecule in BECN1-regulated autophagy protein 1 (810-818)
cugcuccccgaguaccugccguacgcc

SEQ ID NO: 37193 - RNA, 27 nt, Artificial Sequence
  Transportin-1 (394-402)
cugcucccccacauccugccgcugcuc

SEQ ID NO: 37194 - RNA, 27 nt, Artificial Sequence
  Angiomotin-like protein 1 (845-853)
cugcuccccccgccccccaccagcgcc

SEQ ID NO: 37195 - RNA, 27 nt, Artificial Sequence
  ATP-citrate synthase (43-51)
cugcuccaggaccaccccuggcugcug

SEQ ID NO: 37196 - RNA, 27 nt, Artificial Sequence
  Pleckstrin homology domain-containing family A member 4 (400-408)
cugcuccaggaccgccuggugagcguc

SEQ ID NO: 37197 - RNA, 27 nt, Artificial Sequence
  T-complex protein 1 subunit epsilon (314-322)
cugcuccagaacaaccugcccgccgug

SEQ ID NO: 37198 - RNA, 27 nt, Artificial Sequence
  Nuclear factor erythroid 2-related factor 1 (371-379)
cugcuccgcgagaagguggaguuccug

SEQ ID NO: 37199 - RNA, 27 nt, Artificial Sequence
  Eukaryotic translation initiation factor 4 gamma 3 (1361-1369)
cugcucagcgagauccugcaccugcuc

SEQ ID NO: 37200 - RNA, 27 nt, Artificial Sequence
  Liprin-alpha-3 (437-445)
cugcucagcgaguccaacgagcgccug

SEQ ID NO: 37201 - RNA, 30 nt, Artificial Sequence
  Cyclin-dependent kinase 11B (556-565)
cugcucagccacgccggcauccugaaggug

SEQ ID NO: 37202 - RNA, 27 nt, Artificial Sequence
  TATA-binding protein-associated factor 172 (43-51)
cugcucagcaaggugcugaucuaccug

SEQ ID NO: 37203 - RNA, 27 nt, Artificial Sequence
  Ras GTPase-activating protein-binding protein 1 (97-105)
cugcucagcaacaacaaccaggcccug

SEQ ID NO: 37204 - RNA, 27 nt, Artificial Sequence
  Fasciculation and elongation protein zeta-2 (365-373)
cugcucaccgacuacauccugaaggug

SEQ ID NO: 37205 - RNA, 27 nt, Artificial Sequence
  5'-nucleotidase domain-containing protein 3 (276-284)
cugcucugggacaagauccacaagcug

SEQ ID NO: 37206 - RNA, 30 nt, Artificial Sequence
  Cyclic AMP-dependent transcription factor ATF-6 beta (206-215)
cugcucugggacgugcccgccccgagccug

SEQ ID NO: 37207 - RNA, 33 nt, Artificial Sequence
  Protein KIAA0100 (525-535)
cugcucuggagccccccggaccacauguaccug

SEQ ID NO: 37208 - RNA, 27 nt, Artificial Sequence
  Growth arrest-specific protein 8 (22-30)
cugcucuacgagcaccagaacaaccug

SEQ ID NO: 37209 - RNA, 30 nt, Artificial Sequence
  ATP-dependent RNA helicase DHX29 (149-158)
cugcucuacggcggggaccugcacagcgcc

SEQ ID NO: 37210 - RNA, 27 nt, Artificial Sequence
  Catenin alpha-1 (702-710)
cugaugaacgccgugguccagaccgug

SEQ ID NO: 37211 - RNA, 27 nt, Artificial Sequence
  Transient receptor potential cation channel subfamily V member 2 (644-652)
cugaugagcgagaccgugaacuccguc

SEQ ID NO: 37212 - RNA, 27 nt, Artificial Sequence
  5'-3' exoribonuclease 2 (347-355)
cugccccaccucccgagccuggagauc

SEQ ID NO: 37213 - RNA, 27 nt, Artificial Sequence
  Exosome component 10 (544-552)
cugcccaaggagccgcagggcaucauc

SEQ ID NO: 37214 - RNA, 24 nt, Artificial Sequence
  Girdin (733-740)
cugccccgcgccagcuccgugauc

SEQ ID NO: 37215 - RNA, 27 nt, Artificial Sequence
  Cytoskeleton-associated protein 5 (598-606)
cugcccuggaccgccgagcaggugguc

SEQ ID NO: 37216 - RNA, 27 nt, Artificial Sequence
  SLIT-ROBO Rho GTPase-activating protein 2 (519-527)
cugcagcacgagggcaucuuccgcgug

SEQ ID NO: 37217 - RNA, 33 nt, Artificial Sequence
  DNA dC-dU-editing enzyme APOBEC-3A (64-74)
cugcagcucgaccccgcccagaucuaccgcgug

SEQ ID NO: 37218 - RNA, 27 nt, Artificial Sequence
  N-acetylgalactosamine kinase (236-244)
cugcagugggacaaggugcuccgccug

SEQ ID NO: 37219 - RNA, 27 nt, Artificial Sequence
  ATP-binding cassette sub-family A member 7 (407-415)
cugagccucgacaagcuggaggccgcc

SEQ ID NO: 37220 - RNA, 27 nt, Artificial Sequence
  U6 snRNA-associated Sm-like protein LSm4 (4-12)
cugagccuccugaagaccgcccagaac

SEQ ID NO: 37221 - RNA, 27 nt, Artificial Sequence
  Pre-mRNA-processing-splicing factor 8 (249-257)
cugguggacgacaacuacuucuaccuc

SEQ ID NO: 37222 - RNA, 30 nt, Artificial Sequence
  Protein PRRC2B (148-157)
cugguguacgagggccagcucagccaggcc

SEQ ID NO: 37223 - RNA, 27 nt, Artificial Sequence
  E3 ubiquitin-protein ligase Hakai (268-276)
auggcccccccgcccccccgcagcgug

SEQ ID NO: 37224 - RNA, 27 nt, Artificial Sequence
  Eukaryotic translation initiation factor 4 gamma 1 (1290-1298)
auggagaucgacaucccccacgugugg

SEQ ID NO: 37225 - RNA, 30 nt, Artificial Sequence
  Keratinocyte-associated transmembrane protein 2 (176-185)
auggagaucgagcagagcgugaaguccuuc

SEQ ID NO: 37226 - RNA, 27 nt, Artificial Sequence
  E3 ubiquitin-protein ligase UBR1 (380-388)
auggagauggaguacaagaagcuguuc

SEQ ID NO: 37227 - RNA, 27 nt, Artificial Sequence
  Intron-binding protein aquarius (94-102)
auggagcagagccuguucacccgcuuc

SEQ ID NO: 37228 - RNA, 27 nt, Artificial Sequence
  Riboflavin kinase (85-93)
auggagacccacaucaugcacaccuuc

SEQ ID NO: 37229 - RNA, 27 nt, Artificial Sequence
  Adenosylhomocysteinase (210-218)
augaucgccggcaagguggccgucgug

SEQ ID NO: 37230 - RNA, 27 nt, Artificial Sequence
  TFIIH basal transcription factor complex helicase XPB subunit (438-446)
augauccuggacgaggugcacaccauc

SEQ ID NO: 37231 - RNA, 27 nt, Artificial Sequence
  GPN-loop GTPase 3 (162-170)
augaucagccuggagaucccccaggug

SEQ ID NO: 37232 - RNA, 27 nt, Artificial Sequence
  DNA replication licensing factor MCM5 (531-539)
augcuggccaagcacgugaucacccuc

SEQ ID NO: 37233 - RNA, 27 nt, Artificial Sequence
  Microtubule-associated protein RP/EB family member 1 (20-28)
augcuggccuggaucaacgagagccuc

SEQ ID NO: 37234 - RNA, 27 nt, Artificial Sequence
  Protein SSXT (28-36)
augcuggacgacaacaaccaccucauc

SEQ ID NO: 37235 - RNA, 27 nt, Artificial Sequence
  Nucleoporin NUP188 homolog (296-304)
augcuggacgaccgcgccuaccucgug

SEQ ID NO: 37236 - RNA, 27 nt, Artificial Sequence
  Nitrogen permease regulator 3-like protein (542-550)
augcuguucgacaaguuccgcagcgug

SEQ ID NO: 37237 - RNA, 33 nt, Artificial Sequence
  Protein zyg-11 homolog B (424-434)
augcugaucgaggagggcgggcuccagcaccug

SEQ ID NO: 37238 - RNA, 27 nt, Artificial Sequence
  AP-3 complex subunit beta-1 (138-146)
augcugaucgaggugaucgagaagcuc

SEQ ID NO: 37239 - RNA, 27 nt, Artificial Sequence
  1-phosphatidylinositol 3-phosphate 5-kinase (763-771)
augcugcucgagcacggcaucacccug

SEQ ID NO: 37240 - RNA, 30 nt, Artificial Sequence
  Eukaryotic translation initiation factor 3 subunit C-like protein (692-701)
augcugcucgagauccccuacauggccgcc

SEQ ID NO: 37241 - RNA, 27 nt, Artificial Sequence
  Mitochondrial import receptor subunit TOM20 homolog (121-129)
augcugcucaccaagcugcccaccauc

SEQ ID NO: 37242 - RNA, 27 nt, Artificial Sequence
  Beta-2-syntrophin (451-459)
augcugaacggccaggaggugcgccuc

SEQ ID NO: 37243 - RNA, 30 nt, Artificial Sequence
  SH3KBP1-binding protein 1 (437-446)
augcugagcgagaagcaccucaucuccgug

SEQ ID NO: 37244 - RNA, 27 nt, Artificial Sequence
  BRCA1-A complex subunit BRE (13-21)
augcugagccccuucaucuccagcgug

SEQ ID NO: 37245 - RNA, 27 nt, Artificial Sequence
  Nesprin-2 (4298-4306)
augcugaccgagaucgagcacaaggug

SEQ ID NO: 37246 - RNA, 27 nt, Artificial Sequence
  T-complex protein 1 subunit eta (97-105)
augaugcuggacgaccuccugcagcug

SEQ ID NO: 37247 - RNA, 27 nt, Artificial Sequence
  ATP-dependent RNA helicase DDX18 (187-195)
augccccgcaacggcaccggggugcug

SEQ ID NO: 37248 - RNA, 33 nt, Artificial Sequence
  Abhydrolase domain-containing protein 2 (301-311)
augcagaucgacgacaacgugaugcgcaaguuc

SEQ ID NO: 37249 - RNA, 27 nt, Artificial Sequence
  Bifunctional glutamate/proline-tRNA ligase (589-597)
aacgccgacggcaagaucaucagccug

SEQ ID NO: 37250 - RNA, 27 nt, Artificial Sequence
  HEAT repeat-containing protein 1 (1568-1576)
aacgccgacaagcugaccgugaaguuc

SEQ ID NO: 37251 - RNA, 24 nt, Artificial Sequence
  Eukaryotic translation initiation factor 3 subunit C-like protein (434-441)
aacgccgaccagccccugcgcgug

SEQ ID NO: 37252 - RNA, 27 nt, Artificial Sequence
  Inner centromere protein (178-186)
aacgccgagcagcacgugacccagcug

SEQ ID NO: 37253 - RNA, 27 nt, Artificial Sequence
  Serine/threonine-protein phosphatase 4 regulatory subunit 3B (168-176)
aacgagggcuacaucaagaagcugcuc

SEQ ID NO: 37254 - RNA, 24 nt, Artificial Sequence
  tRNA (cytosine(34)-C(5))-methyltransferase (262-269)
aacgagcugcccggccucaagugg

SEQ ID NO: 37255 - RNA, 27 nt, Artificial Sequence
  Nuclear factor erythroid 2-related factor 2 (459-467)
aacgagaugaugagcaaggagcaguuc

SEQ ID NO: 37256 - RNA, 30 nt, Artificial Sequence
  DDB1- and CUL4-associated factor 8 (367-376)
aacgagaacaacggcgugcugaagaaguuc

SEQ ID NO: 37257 - RNA, 27 nt, Artificial Sequence
  Syntaxin-binding protein 3 (434-442)
aacgagagcgacaugauccgcaacugg

SEQ ID NO: 37258 - RNA, 27 nt, Artificial Sequence
  Unconventional myosin-XVIIIa (417-425)
aacgagagcuccgugcugcacacccuc

SEQ ID NO: 37259 - RNA, 33 nt, Artificial Sequence
  FACT complex subunit SPT16 (585-595)
aacaucuuccccaacccggaggccaccuucgug

SEQ ID NO: 37260 - RNA, 27 nt, Artificial Sequence
  Ras GTPase-activating-like protein IQGAP3 (896-904)
aacaucauggacaucaagaucggccug

SEQ ID NO: 37261 - RNA, 27 nt, Artificial Sequence
  Protein TRIM6-TRIM34 (430-438)
aacaucguggagcgccugaaggagguc

SEQ ID NO: 37262 - RNA, 24 nt, Artificial Sequence
  Calponin-2 (7-14)
aacaagggccccagcuacgggcug

SEQ ID NO: 37263 - RNA, 27 nt, Artificial Sequence
  Developmentally-regulated GTP-binding protein 1 (83-91)
aaccuggccggcguguacagcgagguc

SEQ ID NO: 37264 - RNA, 27 nt, Artificial Sequence
  Nodal modulator 3 (667-675)
aaccuggacaaccccauccagaccgug

SEQ ID NO: 37265 - RNA, 27 nt, Artificial Sequence
  Ubiquitin-conjugating enzyme E2 J1 (44-52)
aaccuguucgaguggcacuucaccgug

SEQ ID NO: 37266 - RNA, 27 nt, Artificial Sequence
  Transcription initiation factor TFIID subunit 1 (767-775)
aaccuguuccgcgcccccaucuaccuc

SEQ ID NO: 37267 - RNA, 27 nt, Artificial Sequence
  Vacuolar fusion protein CCZ1 homolog (460-468)
aaccugaucgaggugaacgaggagguc

SEQ ID NO: 37268 - RNA, 27 nt, Artificial Sequence
  GCN1 general control of amino-acid synthesis 1-like 1 (846-854)
aaccugcuccgccggcugugggugguc

SEQ ID NO: 37269 - RNA, 27 nt, Artificial Sequence
  Ras GTPase-activating-like protein IQGAP2 (826-834)
aaccugauggacaucaagaucggccuc

SEQ ID NO: 37270 - RNA, 27 nt, Artificial Sequence
  Iron-responsive element-binding protein 2 (380-388)
aaccugaacagcaucgugcccuccguc

SEQ ID NO: 37271 - RNA, 27 nt, Artificial Sequence
  Phosphoserine aminotransferase (58-66)
aaccuggugcgcgagcuccuggccguc

SEQ ID NO: 37272 - RNA, 27 nt, Artificial Sequence
  Zinc finger BED domain-containing protein 4 (1063-1071)
aaccuguggagccucguggccaagguc

SEQ ID NO: 37273 - RNA, 27 nt, Artificial Sequence
  Ubiquitin-like modifier-activating enzyme 7 (733-741)
aaccuguacgcccagaugcacggccuc

SEQ ID NO: 37274 - RNA, 27 nt, Artificial Sequence
  Rho guanine nucleotide exchange factor 2 (717-725)
aaccuguacggccuccugcacgggcug

SEQ ID NO: 37275 - RNA, 27 nt, Artificial Sequence
  RRP12-like protein (634-642)
aaccuguacggccagcccguggccgcc

SEQ ID NO: 37276 - RNA, 33 nt, Artificial Sequence
  Splicing factor 3A subunit 1 (774-784)
aacauggccaacggcgccgugauccaccuggcg

SEQ ID NO: 37277 - RNA, 27 nt, Artificial Sequence
  Protein C12orf4 (534-542)
aacaugcugccccagaucuuccgcgug

SEQ ID NO: 37278 - RNA, 27 nt, Artificial Sequence
  Casein kinase II subunit alpha (350-358)
aacaugaugagcggcaucuccagcgug

SEQ ID NO: 37279 - RNA, 33 nt, Artificial Sequence
  Prefoldin subunit 1 (59-69)
aacauguacgagggcguggggcgcauguucauc

SEQ ID NO: 37280 - RNA, 27 nt, Artificial Sequence
  Putative pre-mRNA-splicing factor ATP-dependent RNA helicase DHX16 (701-709)
aacccccgcaccggcauggagagccug

SEQ ID NO: 37281 - RNA, 27 nt, Artificial Sequence
  Histone acetyltransferase p300 (478-486)
aaccagaugcccacccagccgcaggug

SEQ ID NO: 37282 - RNA, 27 nt, Artificial Sequence
  Phosphatidate phosphatase LPIN1 (800-808)
aaccgccccgccgacguguacagcuac

SEQ ID NO: 37283 - RNA, 33 nt, Artificial Sequence
  Nuclear valosin-containing protein-like isoform 4 (634-644)
aaccgccccgacaucaucgacccggccauccug

SEQ ID NO: 37284 - RNA, 27 nt, Artificial Sequence
  Glyceraldehyde-3-phosphate dehydrogenase (287-295)
aacagcgacacccacuccagcaccuuc

SEQ ID NO: 37285 - RNA, 27 nt, Artificial Sequence
  Myosin regulatory light chain 12B (155-163)
aacuacaucgaguucacccgcauccug

SEQ ID NO: 37286 - RNA, 27 nt, Artificial Sequence
  N-acetyllactosaminide beta-1,3-N-acetylglucosaminyltransferase 2 (208-216)
aacuaccgcgacaccuucuucaaccug

SEQ ID NO: 37287 - RNA, 24 nt, Artificial Sequence
  Vigilin (628-635)
cccgccaagcugcacaacagccuc

SEQ ID NO: 37288 - RNA, 27 nt, Artificial Sequence
  Leucine-rich repeat-containing protein 47 (93-101)
cccgagcugggcccgcuccccgcccug

SEQ ID NO: 37289 - RNA, 27 nt, Artificial Sequence
  Mitochondrial fission regulator 1 (152-160)
ccccacccgcccccccccccgcccccc

SEQ ID NO: 37290 - RNA, 27 nt, Artificial Sequence
  SCAN domain-containing protein 1 (113-121)
ccccugggcccggcccccgugagcguc

SEQ ID NO: 37291 - RNA, 24 nt, Artificial Sequence
  Long-chain-fatty-acid-CoA ligase 4 (577-584)
cccaaccagaagcgccugacccuc

SEQ ID NO: 37292 - RNA, 27 nt, Artificial Sequence
  Long-chain-fatty-acid-CoA ligase 4 (577-585)
cccaaccagaagcgccugacccuccug

SEQ ID NO: 37293 - RNA, 30 nt, Artificial Sequence
  Proline-rich nuclear receptor coactivator 2 (6-15)
ccccgccugaacagcgccgaccggccgaug

SEQ ID NO: 37294 - RNA, 24 nt, Artificial Sequence
  Protein flightless-1 homolog (882-889)
ccccgccagccgcccaugagccug

SEQ ID NO: 37295 - RNA, 24 nt, Artificial Sequence
  RHO/RAC effector protein (1130-1137)
ccccgcuaccugggcccggccauc

SEQ ID NO: 37296 - RNA, 27 nt, Artificial Sequence
  Palladin (86-94)
cccagcccgcccccccccccgcccccc

SEQ ID NO: 37297 - RNA, 27 nt, Artificial Sequence
  Forkhead box protein J3 (438-446)
caggcccccccgcccccccagcaggug

SEQ ID NO: 37298 - RNA, 30 nt, Artificial Sequence
  AT-rich interactive domain-containing protein 1A (1477-1486)
caggaguucgacagcggccugcuccacugg

SEQ ID NO: 37299 - RNA, 30 nt, Artificial Sequence
  Rho GTPase-activating protein 35 (914-923)
caggagaucgacggccgcuucaccagcauc

SEQ ID NO: 37300 - RNA, 33 nt, Artificial Sequence
  Translin-associated protein X (106-116)
caggagcugagcggcgaggacaugcaccaguuc

SEQ ID NO: 37301 - RNA, 27 nt, Artificial Sequence
  Acetyl-CoA carboxylase 1 (270-278)
caggagaacgacuucagcaagcgcauc

SEQ ID NO: 37302 - RNA, 30 nt, Artificial Sequence
  Lamin-B receptor (157-166)
caggagagcuccuacaucgccacccaguac

SEQ ID NO: 37303 - RNA, 27 nt, Artificial Sequence
  Death-associated protein kinase 3 (122-130)
cagauccuggacggcgugcacuaccuc

SEQ ID NO: 37304 - RNA, 27 nt, Artificial Sequence
  Dynamin-like 120 kDa protein, mitochondrial (953-961)
cagcuggccgaggaccucaagaaggug

SEQ ID NO: 37305 - RNA, 27 nt, Artificial Sequence
  Epidermal growth factor receptor kinase substrate 8 (455-463)
cagcuggccgagagcguggccaacguc

SEQ ID NO: 37306 - RNA, 30 nt, Artificial Sequence
  Transforming acidic coiled-coil-containing protein 3 (776-785)
cagcuggccaacgaggagaucgcccaggug

SEQ ID NO: 37307 - RNA, 30 nt, Artificial Sequence
  E3 ubiquitin-protein ligase BRE1B (68-77)
cagcuggacgaggcccgcggccuccugcug

SEQ ID NO: 37308 - RNA, 27 nt, Artificial Sequence
  Tyrosine-protein phosphatase non-receptor type 12 (162-170)
cagcuguucgagaagcagcuccagcug

SEQ ID NO: 37309 - RNA, 30 nt, Artificial Sequence
  Phospholipase A1 member A (177-186)
cagcuguucggcgggcagcucggccagauc

SEQ ID NO: 37310 - RNA, 27 nt, Artificial Sequence
  CDK5 regulatory subunit-associated protein 2 (1222-1230)
cagcuguucagcgagauccacaaccuc

SEQ ID NO: 37311 - RNA, 27 nt, Artificial Sequence
  Trinucleotide repeat-containing gene 18 protein (900-908)
cagcuguucagccagcagcacuuccuc

SEQ ID NO: 37312 - RNA, 27 nt, Artificial Sequence
  Dual specificity protein phosphatase 14 (157-165)
cagcugaucgacuacgagcgccagcuc

SEQ ID NO: 37313 - RNA, 27 nt, Artificial Sequence
  Eyes absent homolog 2 (420-428)
cagcugauccccgcccucgccaaggug

SEQ ID NO: 37314 - RNA, 27 nt, Artificial Sequence
  Dual specificity protein phosphatase 6 (193-201)
cagcugcucgacuucgagcgcacccug

SEQ ID NO: 37315 - RNA, 30 nt, Artificial Sequence
  Circadian clock protein PASD1 (39-48)
cagcugcucgacggcuucaugaucacccug

SEQ ID NO: 37316 - RNA, 27 nt, Artificial Sequence
  Transport and Golgi organization protein 6 homolog (720-728)
cagcugcucccccugcuggagaaggug

SEQ ID NO: 37317 - RNA, 27 nt, Artificial Sequence
  AP-1 complex subunit beta-1 (483-491)
cagcugcucaccgccaucgugaagcug

SEQ ID NO: 37318 - RNA, 27 nt, Artificial Sequence
  tRNA (guanine(26)-N(2))-dimethyltransferase (198-206)
cagcugaacgacguggcccaccucguc

SEQ ID NO: 37319 - RNA, 27 nt, Artificial Sequence
  WD repeat-containing protein 36 (690-698)
cagcugaacgagcagcucgugacccug

SEQ ID NO: 37320 - RNA, 27 nt, Artificial Sequence
  COMM domain-containing protein 8 (116-124)
cagcugcaggacuucgacuggcaggug

SEQ ID NO: 37321 - RNA, 27 nt, Artificial Sequence
  Thyroid receptor-interacting protein 11 (1241-1249)
cagcugcaggaggagcuccaccagcug

SEQ ID NO: 37322 - RNA, 27 nt, Artificial Sequence
  Golgin subfamily A member 4 (1397-1405)
cagcugaccgaccucaacgugcagcug

SEQ ID NO: 37323 - RNA, 27 nt, Artificial Sequence
  Eyes absent homolog 3 (439-447)
cagcuggugcccgcccucgccaagguc

SEQ ID NO: 37324 - RNA, 27 nt, Artificial Sequence
  Nuclear factor NF-kappa-B p105 subunit (558-566)
cagcuggugcgcgaccuccuggagguc

SEQ ID NO: 37325 - RNA, 27 nt, Artificial Sequence
  Ketosamine-3-kinase (140-148)
cagcuguaccagcucuuccacuaccug

SEQ ID NO: 37326 - RNA, 27 nt, Artificial Sequence
  T-complex protein 1 subunit epsilon (184-192)
cagauggccgagaucgccgugaacgcg

SEQ ID NO: 37327 - RNA, 27 nt, Artificial Sequence
  Spectrin beta chain, non-erythrocytic 1 (1423-1431)
cagaugcuggagaaccagauggaggug

SEQ ID NO: 37328 - RNA, 33 nt, Artificial Sequence
  Signal transducer and activator of transcription 1-alpha/beta (8-18)
cagcagcuggacagcaaguuccucgagcaggug

SEQ ID NO: 37329 - RNA, 33 nt, Artificial Sequence
  E1A-binding protein p400 (1051-1061)
cagcagacccccguggccagcauccagcagguc

SEQ ID NO: 37330 - RNA, 24 nt, Artificial Sequence
  E3 ubiquitin-protein ligase RLIM (173-180)
cagcgccccccgaccaucgugcug

SEQ ID NO: 37331 - RNA, 27 nt, Artificial Sequence
  Cell division cycle protein 27 homolog (580-588)
cgcgagcacgacaucgccaucaaguuc

SEQ ID NO: 37332 - RNA, 27 nt, Artificial Sequence
  Small nuclear ribonucleoprotein Sm D2 (102-110)
cgcggcgacagcgugaucgucgugcug

SEQ ID NO: 37333 - RNA, 33 nt, Artificial Sequence
  DNA topoisomerase 1 (376-386)
cgcaucaugcccgaggacaucaucaucaacugc

SEQ ID NO: 37334 - RNA, 27 nt, Artificial Sequence
  Cyclin-L2 (140-148)
cgcauccgggacgugaucaacgucuuc

SEQ ID NO: 37335 - RNA, 27 nt, Artificial Sequence
  Prelamin-A/C (91-99)
cgccuggccgacgcccuccaggagcug

SEQ ID NO: 37336 - RNA, 27 nt, Artificial Sequence
  Clathrin heavy chain 1 (1182-1190)
cgccuggccgagcucgaggaguucauc

SEQ ID NO: 37337 - RNA, 30 nt, Artificial Sequence
  tRNA (cytosine(34)-C(5))-methyltransferase (514-523)
cgccuggcccaggagggcaucuacacccuc

SEQ ID NO: 37338 - RNA, 30 nt, Artificial Sequence
  RUS1 family protein C16orf58 (165-174)
cgccuguucgccgacauccucaacgacgug

SEQ ID NO: 37339 - RNA, 27 nt, Artificial Sequence
  HEAT repeat-containing protein 2 (253-261)
cgccuguucgacgacgugccccagguc

SEQ ID NO: 37340 - RNA, 27 nt, Artificial Sequence
  BTB/POZ domain-containing protein 2 (2-10)
cgccuguucgacgagccccagcucgcc

SEQ ID NO: 37341 - RNA, 33 nt, Artificial Sequence
  WD repeat domain phosphoinositide-interacting protein 4 (219-229)
cgccuguucgacacccagagcaaggagaagcuc

SEQ ID NO: 37342 - RNA, 33 nt, Artificial Sequence
  DDB1- and CUL4-associated factor 4-like protein 1 (246-256)
cgccuguuccacgacagcgccgugaccuccguc

SEQ ID NO: 37343 - RNA, 33 nt, Artificial Sequence
  Histone-lysine N-methyltransferase setd3 (468-478)
cgccugggcgagaaggagauccucgagaaggcc

SEQ ID NO: 37344 - RNA, 27 nt, Artificial Sequence
  Plectin (462-470)
cgccugcacgagcggcucguggccauc

SEQ ID NO: 37345 - RNA, 27 nt, Artificial Sequence
  Probable ATP-dependent RNA helicase DDX47 (147-155)
cgccugaucgaccaccucgagaacacc

SEQ ID NO: 37346 - RNA, 27 nt, Artificial Sequence
  Nuclear pore complex protein Nup160 (575-583)
cgccugaucgaggagagcgugaccguc

SEQ ID NO: 37347 - RNA, 30 nt, Artificial Sequence
  Partitioning defective 3 homolog (510-519)
cgccugaucgaggugaacggcgucgaccuc

SEQ ID NO: 37348 - RNA, 27 nt, Artificial Sequence
  3-ketodihydrosphingosine reductase (236-244)
cgccugaucagcgagaccaccuccgug

SEQ ID NO: 37349 - RNA, 27 nt, Artificial Sequence
  Eukaryotic translation initiation factor 4 gamma 1 (840-848)
cgccugaaggaggagcucgaggaggcc

SEQ ID NO: 37350 - RNA, 33 nt, Artificial Sequence
  Upstream-binding protein 1 (145-155)
cgccugcucgaccuggacauccccaugagcgug

SEQ ID NO: 37351 - RNA, 33 nt, Artificial Sequence
  Cytochrome c oxidase subunit 2 (134-144)
cgccugcucgacguggacaaccgggucgugcug

SEQ ID NO: 37352 - RNA, 27 nt, Artificial Sequence
  Pyridoxal-dependent decarboxylase domain-containing protein 1 (603-611)
cgccugcucgagaacaugaccgaggug

SEQ ID NO: 37353 - RNA, 33 nt, Artificial Sequence
  Xyloside xylosyltransferase 1 (295-305)
cgccugcucgagcccgcccaggugcagcagcug

SEQ ID NO: 37354 - RNA, 30 nt, Artificial Sequence
  Telomere length regulation protein TEL2 homolog (186-195)
cgccugcucggcgaggaggugguccgggug

SEQ ID NO: 37355 - RNA, 27 nt, Artificial Sequence
  Suppressor APC domain-containing protein 2 (290-298)
cgccugcuccccaaggugcaggagguc

SEQ ID NO: 37356 - RNA, 27 nt, Artificial Sequence
  Translocon-associated protein subunit beta (2-10)
cgccugcucagcuucgugguccuggcc

SEQ ID NO: 37357 - RNA, 27 nt, Artificial Sequence
  Vacuolar protein sorting-associated protein 33B (607-615)
cgccugauggaggccaugagcgaggug

SEQ ID NO: 37358 - RNA, 33 nt, Artificial Sequence
  Probable inactiveosyltransferase 25 family member 3 (351-361)
cgccugauggaggacguggaggccgagaagcuc

SEQ ID NO: 37359 - RNA, 33 nt, Artificial Sequence
  Vacuolar protein sorting-associated protein 13D (1845-1855)
cgccugcccccggagggcauccuccacaacgug

SEQ ID NO: 37360 - RNA, 27 nt, Artificial Sequence
  Ribosome-binding protein 1 (569-577)
cgccugcaggaggagcucgagaagcug

SEQ ID NO: 37361 - RNA, 33 nt, Artificial Sequence
  HMG domain-containing protein 4 (432-442)
cgccugcaggagaccgagggcaugguggccguc

SEQ ID NO: 37362 - RNA, 27 nt, Artificial Sequence
  Protein orai-3 (287-295)
cgccugcagggcgagcuccaggccgug

SEQ ID NO: 37363 - RNA, 27 nt, Artificial Sequence
  C-1-tetrahydrofolate synthase, cytoplasmic (478-486)
cgccuggugcccagcgucaacggcgug

SEQ ID NO: 37364 - RNA, 33 nt, Artificial Sequence
  Guanine nucleotide-binding protein subunit beta-2-like 1 (88-98)
cgccugugggaccucaccaccggcacgaccacc

SEQ ID NO: 37365 - RNA, 24 nt, Artificial Sequence
  Circadian clock protein PASD1 (691-698)
cgccuguggcaggagcucagcgac

SEQ ID NO: 37366 - RNA, 27 nt, Artificial Sequence
  Ubiquitin carboxyl-terminal hydrolase 11 (210-218)
cgccuguacgacacccacaucaccgug

SEQ ID NO: 37367 - RNA, 33 nt, Artificial Sequence
  TIP41-like protein (200-210)
cgccuguaccacgaggccgacaagaccuacaug

SEQ ID NO: 37368 - RNA, 27 nt, Artificial Sequence
  N-acetyllactosaminide beta-1,3-N-acetylglucosaminyltransferase 2 (314-322)
cgccuguaccacaucaccgaccaggug

SEQ ID NO: 37369 - RNA, 33 nt, Artificial Sequence
  Heterogeneous nuclear ribonucleoprotein M (511-521)
cgcauggccaccggccuggagcggaugggggcc

SEQ ID NO: 37370 - RNA, 33 nt, Artificial Sequence
  Eukaryotic translation initiation factor 3 subunit A (752-762)
cgcaugcuggaggaccgggaccucuucgugaug

SEQ ID NO: 37371 - RNA, 33 nt, Artificial Sequence
  N-alpha-acetyltransferase 38, NatC auxiliary subunit (104-114)
cgcaugaccgacggccggacccugguggggugc

SEQ ID NO: 37372 - RNA, 33 nt, Artificial Sequence
  Nucleophosmin (277-287)
cgcaugaccgaccaggaggccauccaggaccug

SEQ ID NO: 37373 - RNA, 30 nt, Artificial Sequence
  Copine-3 (121-130)
cgccccgccggcaaggggagcaucaccauc

SEQ ID NO: 37374 - RNA, 27 nt, Artificial Sequence
  Myeloid-derived growth factor (146-154)
cgccccggcgccuucaaggccgagcug

SEQ ID NO: 37375 - RNA, 27 nt, Artificial Sequence
  BTB/POZ domain-containing adapter for CUL3-mediated RhoA degradation protein 1 (319-327)
cgcccccacggccagcagaucguguuc

SEQ ID NO: 37376 - RNA, 27 nt, Artificial Sequence
  Histone-lysine N-methyltransferase 2C (1906-1914)
cgccccccgcccgugggccacagcuuc

SEQ ID NO: 37377 - RNA, 27 nt, Artificial Sequence
  Calcium-independent phospholipase A2-gamma (321-329)
cgccccaccgagggcgugcaggcccug

SEQ ID NO: 37378 - RNA, 27 nt, Artificial Sequence
  Sperm-specific antigen 2 (241-249)
cgccagaucgaggugcugaccaccguc

SEQ ID NO: 37379 - RNA, 30 nt, Artificial Sequence
  Dolichyl-diphosphooligosaccharide-proteinosyltransferase subunit 1 (268-277)
cgccagcccgacagcggcaucuccagcauc

SEQ ID NO: 37380 - RNA, 27 nt, Artificial Sequence
  DNA ligase 1 (294-302)
cgcaccuucgagaagaucgaggaggug

SEQ ID NO: 37381 - RNA, 27 nt, Artificial Sequence
  Trifunctional enzyme subunit alpha, mitochondrial (235-243)
cgcaccaucgaguaccuggaggaggug

SEQ ID NO: 37382 - RNA, 27 nt, Artificial Sequence
  Sorting nexin-4 (243-251)
cgcguggccgaccggcuguacggcguc

SEQ ID NO: 37383 - RNA, 30 nt, Artificial Sequence
  THO complex subunit 2 (904-913)
cgcguguucagcgacaucaucuacaccguc

SEQ ID NO: 37384 - RNA, 27 nt, Artificial Sequence
  Glycerol-3-phosphate acyltransferase 1, mitochondrial (138-146)
cgcgugcaggaggccaucgccgagguc

SEQ ID NO: 37385 - RNA, 27 nt, Artificial Sequence
  Putative eukaryotic translation initiation factor 2 subunit 3-like protein (416-424)
cgcgugagcgccgucaaggccgaccug

SEQ ID NO: 37386 - RNA, 27 nt, Artificial Sequence
  Regulation of nuclear pre-mRNA domain-containing protein 1A (271-279)
cgcgugagccugguccggaaggagcuc

SEQ ID NO: 37387 - RNA, 30 nt, Artificial Sequence
  Nuclear receptor corepressor 2 (2392-2401)
cgcgugugggaggaccggcccagcuccgcc

SEQ ID NO: 37388 - RNA, 27 nt, Artificial Sequence
  Replication initiator 1 (328-336)
agcgccgccgagcccaccccggcggug

SEQ ID NO: 37389 - RNA, 27 nt, Artificial Sequence
  DAZ-associated protein 2 (62-70)
agcgccgccuuccccggcgcgucccug

SEQ ID NO: 37390 - RNA, 27 nt, Artificial Sequence
  Serine-threonine kinase receptor-associated protein (160-168)
agcgccgacgacaagaccgugcgccug

SEQ ID NO: 37391 - RNA, 27 nt, Artificial Sequence
  Poly (ADP-ribose) polymerase 1 (385-393)
agcgccgacaagccccuguccaacaug

SEQ ID NO: 37392 - RNA, 27 nt, Artificial Sequence
  Uncharacterized protein C15orf39 (994-1002)
agcgccucccccccgggccccacccug

SEQ ID NO: 37393 - RNA, 33 nt, Artificial Sequence
  Replication protein A 32 kDa subunit (93-103)
agcgaggccggcaacuucgggggcaacuccuuc

SEQ ID NO: 37394 - RNA, 27 nt, Artificial Sequence
  Kelch repeat and BTB domain-containing protein 6 (137-145)
agcgaggccaacguggagcgccuguac

SEQ ID NO: 37395 - RNA, 27 nt, Artificial Sequence
  Protein PRRC2C (867-875)
agcgaggcccaggugcagaaguuccug

SEQ ID NO: 37396 - RNA, 30 nt, Artificial Sequence
  Non-POU domain-containing octamer-binding protein (120-129)
agcgagggcuccuuccugcucaccaccuuc

SEQ ID NO: 37397 - RNA, 30 nt, Artificial Sequence
  Cyclin-dependent kinase 11B (629-638)
agcgagaucgaccagaucaacaagguguuc

SEQ ID NO: 37398 - RNA, 27 nt, Artificial Sequence
  Uncharacterized protein C5orf34 (564-572)
agcgagcuggagaagauccagaaguuc

SEQ ID NO: 37399 - RNA, 30 nt, Artificial Sequence
  V-type proton ATPase subunit H (357-366)
agcgagcugaaguccggccgccucgagugg

SEQ ID NO: 37400 - RNA, 27 nt, Artificial Sequence
  Myomegalin (838-846)
agcgagcugcaggcccuccgccaguac

SEQ ID NO: 37401 - RNA, 30 nt, Artificial Sequence
  Small subunit processome component 20 homolog (777-786)
agcgagcaggacccccugcucaagaaccug

SEQ ID NO: 37402 - RNA, 30 nt, Artificial Sequence
  ATP-citrate synthase (7-16)
agcgagcagaccggcaaggagcugcucuac

SEQ ID NO: 37403 - RNA, 27 nt, Artificial Sequence
  PERQ amino acid-rich with GYF domain-containing protein 2 (199-207)
agcgaguccgagaacuggcgcaucuuc

SEQ ID NO: 37404 - RNA, 27 nt, Artificial Sequence
  FACT complex subunit SSRP1 (657-665)
agcgaguccuucaagagcaaggaguuc

SEQ ID NO: 37405 - RNA, 27 nt, Artificial Sequence
  FAD synthase (193-201)
agcaucgcccccauccuggccgaggcg

SEQ ID NO: 37406 - RNA, 33 nt, Artificial Sequence
  Coatomer subunit beta (249-259)
agcaucuucggcgaggacgcccuggccaacgug

SEQ ID NO: 37407 - RNA, 27 nt, Artificial Sequence
  Inhibitor of Bruton tyrosine kinase (562-570)
agcauccacgacgugaccuuccagguc

SEQ ID NO: 37408 - RNA, 27 nt, Artificial Sequence
  Cell growth-regulating nucleolar protein (128-136)
agcauccuggaccagguguggaacauc

SEQ ID NO: 37409 - RNA, 27 nt, Artificial Sequence
  Poly (ADP-ribose) polymerase 1 (711-719)
agcauccuguccgaggugcagcaggcc

SEQ ID NO: 37410 - RNA, 24 nt, Artificial Sequence
  EF-hand domain-containing protein 1 (48-55)
agcaaggcccccgugcugaccuac

SEQ ID NO: 37411 - RNA, 27 nt, Artificial Sequence
  CCR4-NOT transcription complex subunit 1 (254-262)
agccuggccgacuucaugcaggaggug

SEQ ID NO: 37412 - RNA, 27 nt, Artificial Sequence
  DNA replication licensing factor MCM7 (208-216)
agccuggccgacuacaucaccgccgcg

SEQ ID NO: 37413 - RNA, 27 nt, Artificial Sequence
  Ubiquitin carboxyl-terminal hydrolase 7 (543-551)
agccuggccgaguucgugcagucccuc

SEQ ID NO: 37414 - RNA, 30 nt, Artificial Sequence
  X-ray repair cross-complementing protein 5 (580-589)
agccuggccgagggcuccgugaccagcguc

SEQ ID NO: 37415 - RNA, 27 nt, Artificial Sequence
  Exosome complex exonuclease RRP44 (720-728)
agccuggccgagucccucgaccaggcc

SEQ ID NO: 37416 - RNA, 30 nt, Artificial Sequence
  Phosphatidylinositol 3,4,5-trisphosphate-dependent Rac exchanger 1 protein (655-664)
agccuggccgagguggccggccuccagguc

SEQ ID NO: 37417 - RNA, 27 nt, Artificial Sequence
  Centrosome-associated protein CEP250 (112-120)
agccuggccgaggugaacacccagcuc

SEQ ID NO: 37418 - RNA, 27 nt, Artificial Sequence
  Apolipoprotein L1 (249-257)
agccuggccggcaacaccuaccagcuc

SEQ ID NO: 37419 - RNA, 27 nt, Artificial Sequence
  SH3 domain and tetratricopeptide repeat-containing protein 1 (740-748)
agccuggccggcucccuccgcagcgug

SEQ ID NO: 37420 - RNA, 33 nt, Artificial Sequence
  Kelch-like protein 21 (506-516)
agccuggccgugcucggcgggaagcuguacguc

SEQ ID NO: 37421 - RNA, 30 nt, Artificial Sequence
  Insulin-degrading enzyme (224-233)
agccuggacgaccucaccaaccuggugguc

SEQ ID NO: 37422 - RNA, 27 nt, Artificial Sequence
  Bone morphogenetic protein receptor type-2 (221-229)
agccuggacgagcgccccguggccguc

SEQ ID NO: 37423 - RNA, 30 nt, Artificial Sequence
  Glycogen debranching enzyme (835-844)
agccuggacccccacgcccagguggccguc

SEQ ID NO: 37424 - RNA, 27 nt, Artificial Sequence
  Cullin-9 (676-684)
agccuggaccagcacguggccgccguc

SEQ ID NO: 37425 - RNA, 27 nt, Artificial Sequence
  Protein RMD5 homolog B (28-36)
agccuggaggagcuccugcacuacgug

SEQ ID NO: 37426 - RNA, 27 nt, Artificial Sequence
  NAD(P)H dehydrogenase (quinone) 1 (155-163)
agccuguucgaccucaacuuccaggcc

SEQ ID NO: 37427 - RNA, 27 nt, Artificial Sequence
  Signal recognition particle 54 kDa protein (200-208)
agccuguucgaggagaugcuccaggug

SEQ ID NO: 37428 - RNA, 30 nt, Artificial Sequence
  Zinc finger protein 451 (454-463)
agccuguucggccaggacgugaaggccguc

SEQ ID NO: 37429 - RNA, 27 nt, Artificial Sequence
  Importin-8 (243-251)
agccuguucaaggaccagauggagcuc

SEQ ID NO: 37430 - RNA, 27 nt, Artificial Sequence
  Optineurin (302-310)
agccuguucaaggagcuccaggaggcc

SEQ ID NO: 37431 - RNA, 24 nt, Artificial Sequence
  Kelch domain-containing protein 10 (353-360)
agccuguucaagaucuggcucgug

SEQ ID NO: 37432 - RNA, 27 nt, Artificial Sequence
  Telomere-associated protein RIF1 (802-810)
agccuguucaagcucaucgugaagguc

SEQ ID NO: 37433 - RNA, 27 nt, Artificial Sequence
  DNA polymerase alpha subunit B (295-303)
agccuguuccccggccagguggucauc

SEQ ID NO: 37434 - RNA, 33 nt, Artificial Sequence
  Lamin-B receptor (312-322)
agccuguuccagggcguggaguuccacuacguc

SEQ ID NO: 37435 - RNA, 33 nt, Artificial Sequence
  Renin receptor (103-113)
agccuguucuccgaggagacccccgugguccuc

SEQ ID NO: 37436 - RNA, 30 nt, Artificial Sequence
  Ubiquitin-protein ligase E3C (505-514)
agccuguucucccacagccucaucuccauc

SEQ ID NO: 37437 - RNA, 27 nt, Artificial Sequence
  Cytoplasmic dynein 1 heavy chain 1 (2457-2465)
agccuguucuccaugcuccaccaggcc

SEQ ID NO: 37438 - RNA, 27 nt, Artificial Sequence
  Kelch-like protein 12 (364-372)
agccugcacgaccgcaucuacgugauc

SEQ ID NO: 37439 - RNA, 27 nt, Artificial Sequence
  Cytochrome P450 20A1 (53-61)
agccugcacgaguuccucgugaaccug

SEQ ID NO: 37440 - RNA, 27 nt, Artificial Sequence
  Ectopic P granules protein 5 homolog (837-845)
agccugcacuccgugaucauccagcuc

SEQ ID NO: 37441 - RNA, 27 nt, Artificial Sequence
  DNA-directed RNA polymerase I subunit RPA1 (382-390)
agccugaucgacaagcucuacaacauc

SEQ ID NO: 37442 - RNA, 33 nt, Artificial Sequence
  Structural maintenance of chromosomes protein 6 (601-611)
agccugaucgacaugcgcggcaucgagaccgug

SEQ ID NO: 37443 - RNA, 27 nt, Artificial Sequence
  Transmembrane protein 209 (11-19)
agccugaucgaccgcaccaucaagaug

SEQ ID NO: 37444 - RNA, 27 nt, Artificial Sequence
  Cation channel sperm-associated protein 2 (33-41)
agccugaucgagcaccuccagggccug

SEQ ID NO: 37445 - RNA, 27 nt, Artificial Sequence
  Mediator of RNA polymerase II transcription subunit 19 (129-137)
agccugaucgagaagcccccgauccuc

SEQ ID NO: 37446 - RNA, 27 nt, Artificial Sequence
  Nucleolar pre-ribosomal-associated protein 1 (1761-1769)
agccugaucgagcgcgaccucaagcug

SEQ ID NO: 37447 - RNA, 27 nt, Artificial Sequence
  Solute carrier family 35 member C2 (14-22)
agccugaucuucaagcucgaggagcug

SEQ ID NO: 37448 - RNA, 27 nt, Artificial Sequence
  Solute carrier family 35 member E1 (24-32)
agccugauccccaucaucuccggcgug

SEQ ID NO: 37449 - RNA, 27 nt, Artificial Sequence
  Putative Polycomb group protein ASXL2 (835-843)
agccugauccgcaucgugcccgucgug

SEQ ID NO: 37450 - RNA, 27 nt, Artificial Sequence
  Carboxypeptidase D (372-380)
agccugaucacccucaucgagaaggug

SEQ ID NO: 37451 - RNA, 27 nt, Artificial Sequence
  Peroxisomal biogenesis factor 3 (201-209)
agccugcucgaccuggagcagaagcug

SEQ ID NO: 37452 - RNA, 27 nt, Artificial Sequence
  Zinc finger BED domain-containing protein 1 (280-288)
agccugcucgacguggccguccacaug

SEQ ID NO: 37453 - RNA, 27 nt, Artificial Sequence
  Kinesin-like protein KIF3A (470-478)
agccugcucgagaagcuguccgcccug

SEQ ID NO: 37454 - RNA, 27 nt, Artificial Sequence
  Kinesin-like protein (557-565)
agccugcucaaggaccuggccgagauc

SEQ ID NO: 37455 - RNA, 27 nt, Artificial Sequence
  Phosphatidylinositol 4-phosphate 5-kinase type-1 alpha (312-320)
agccugcucauguccauccacaacauc

SEQ ID NO: 37456 - RNA, 27 nt, Artificial Sequence
  Claspin (1254-1262)
agccugcucaaccagcccaaggccgug

SEQ ID NO: 37457 - RNA, 33 nt, Artificial Sequence
  Sister chromatid cohesion protein PDS5 homolog A (36-46)
agccugcuccccgaguacguggucccguacaug

SEQ ID NO: 37458 - RNA, 33 nt, Artificial Sequence
  Inositol 1,4,5-trisphosphate receptor type 1 (1393-1403)
agccugcucccccuggacgacaucgugcgcguc

SEQ ID NO: 37459 - RNA, 27 nt, Artificial Sequence
  Lysosomal-trafficking regulator (78-86)
agccugcucccccugguguggaagauc

SEQ ID NO: 37460 - RNA, 33 nt, Artificial Sequence
  Signal transducer and activator of transcription 2 (25-35)
agccugcuccccguggacauccgccaguaccug

SEQ ID NO: 37461 - RNA, 27 nt, Artificial Sequence
  Cytoplasmic dynein 1 heavy chain 1 (3748-3756)
agccugcuccaggcccugaacgaggug

SEQ ID NO: 37462 - RNA, 27 nt, Artificial Sequence
  Melanoma antigen preferentially expressed in tumors (425-433)
agccugcuccagcaccugaucggccug

SEQ ID NO: 37463 - RNA, 30 nt, Artificial Sequence
  SH3KBP1-binding protein 1 (47-56)
agccugcucuccggccgcaucagcacccug

SEQ ID NO: 37464 - RNA, 27 nt, Artificial Sequence
  Uncharacterized aarF domain-containing protein kinase 2 (132-140)
agccugcucuccagcguguucaagcug

SEQ ID NO: 37465 - RNA, 27 nt, Artificial Sequence
  Transportin-3 (89-97)
agccugcucacccacauccagaaccug

SEQ ID NO: 37466 - RNA, 27 nt, Artificial Sequence
  E3 ubiquitin-protein ligase TRIP12 (971-979)
agccugcucaccucccccccgaaggcc

SEQ ID NO: 37467 - RNA, 30 nt, Artificial Sequence
  Mediator of RNA polymerase II transcription subunit 24 (800-809)
agccugauggaccccccgggcaccgcccuc

SEQ ID NO: 37468 - RNA, 27 nt, Artificial Sequence
  CAP-Gly domain-containing linker protein 2 (873-881)
agccugaacgagcuccgcgugcugcug

SEQ ID NO: 37469 - RNA, 27 nt, Artificial Sequence
  Solute carrier family 35 member E4 (65-73)
agccugaacaaguggaucuucaccgug

SEQ ID NO: 37470 - RNA, 27 nt, Artificial Sequence
  Sestrin-3 (47-55)
agccugcccgagcucgugcacgccguc

SEQ ID NO: 37471 - RNA, 27 nt, Artificial Sequence
  Transmembrane protein 214 (435-443)
agccugcaggagaccauccagucccuc

SEQ ID NO: 37472 - RNA, 27 nt, Artificial Sequence
  Centrosome-associated protein CEP250 (2189-2197)
agccugcaggagguggccauguuccuc

SEQ ID NO: 37473 - RNA, 27 nt, Artificial Sequence
  Heat shock protein HSP 90-beta (394-402)
agccuguccgaguacgugagccgcaug

SEQ ID NO: 37474 - RNA, 27 nt, Artificial Sequence
  Cell division cycle and apoptosis regulator protein 1 (1078-1086)
agccuguccggcgagcuccgcgaggug

SEQ ID NO: 37475 - RNA, 27 nt, Artificial Sequence
  RNA-binding protein 12B (105-113)
agccuguccaacuucaucgagagcgug

SEQ ID NO: 37476 - RNA, 27 nt, Artificial Sequence
  Bromodomain adjacent to zinc finger domain protein 1A (1093-1101)
agccugucccagguguuccuccaccug

SEQ ID NO: 37477 - RNA, 27 nt, Artificial Sequence
  Dehydrogenase/reductase SDR family member 1 (277-285)
agccuguccagcgugcucucccacguc

SEQ ID NO: 37478 - RNA, 27 nt, Artificial Sequence
  Spectrin beta chain, erythrocytic (333-341)
agccugaccggcgugcagcagcagcuc

SEQ ID NO: 37479 - RNA, 30 nt, Artificial Sequence
  Conserved oligomeric Golgi complex subunit 4 (458-467)
agccugguggccgucgagcucgagaaggug

SEQ ID NO: 37480 - RNA, 30 nt, Artificial Sequence
  Phospholipase A1 member A (341-350)
agccugguggaguuccaccucaaggagcug

SEQ ID NO: 37481 - RNA, 27 nt, Artificial Sequence
  26S proteasome non-ATPase regulatory subunit 13 (75-83)
agccugguggagaucauccuccacguc

SEQ ID NO: 37482 - RNA, 27 nt, Artificial Sequence
  Cyclin-dependent-like kinase 5 (247-255)
agccuggugaacgucgugcccaagcuc

SEQ ID NO: 37483 - RNA, 27 nt, Artificial Sequence
  Heat shock factor protein 2 (156-164)
agccuguggaaggagguguccgagcuc

SEQ ID NO: 37484 - RNA, 27 nt, Artificial Sequence
  GRIP and coiled-coil domain-containing protein 2 (689-697)
agccuguacgaggagaacaacaagcuc

SEQ ID NO: 37485 - RNA, 27 nt, Artificial Sequence
  Centrosome-associated protein CEP250 (1184-1192)
agccuguacuccgcccuccagcaggcc

SEQ ID NO: 37486 - RNA, 27 nt, Artificial Sequence
  Serine/threonine-protein kinase TBK1 (413-421)
agcauggccaaggccaucaccggcgug

SEQ ID NO: 37487 - RNA, 33 nt, Artificial Sequence
  Erlin-2 (158-168)
agcauggcccccggccuggugauccaggccguc

SEQ ID NO: 37488 - RNA, 27 nt, Artificial Sequence
  SEC14-like protein 1 (203-211)
agcauggccguggucauccccgaggcc

SEQ ID NO: 37489 - RNA, 27 nt, Artificial Sequence
  Cullin-1 (79-87)
agcaugaucuccaagcugaagcaggcc

SEQ ID NO: 37490 - RNA, 27 nt, Artificial Sequence
  Ubiquitin conjugation factor E4 B (1278-1286)
agcaugcuggagcccgugccggagcuc

SEQ ID NO: 37491 - RNA, 27 nt, Artificial Sequence
  Antizyme inhibitor 1 (152-160)
agcaugaugaagaacuucuucuucgug

SEQ ID NO: 37492 - RNA, 27 nt, Artificial Sequence
  Large proline-rich protein BAG6 (763-771)
agcaugguggacgucgugaugcugcuc

SEQ ID NO: 37493 - RNA, 30 nt, Artificial Sequence
  Band 4.1-like protein 3 (185-194)
agcauguacggcguggaccugcaccacgcc

SEQ ID NO: 37494 - RNA, 30 nt, Artificial Sequence
  Protein 4.1 (185-194)
agcauguacggcguggaccugcacaaggcc

SEQ ID NO: 37495 - RNA, 27 nt, Artificial Sequence
  A-kinase anchor protein 10, mitochondrial (278-286)
agccccgccuccccgcugaaggagcuc

SEQ ID NO: 37496 - RNA, 30 nt, Artificial Sequence
  Beta-1-syntrophin (175-184)
agccccgacgccaagcacaccgugauccug

SEQ ID NO: 37497 - RNA, 30 nt, Artificial Sequence
  Cytoplasmic dynein 1 heavy chain 1 (577-586)
agccccgacaagaucccgugguccgcccug

SEQ ID NO: 37498 - RNA, 27 nt, Artificial Sequence
  Ubiquitin carboxyl-terminal hydrolase 22 (237-245)
agcccccacaucccguacaagcugcuc

SEQ ID NO: 37499 - RNA, 30 nt, Artificial Sequence
  ADNP homeobox protein 2 (336-345)
agcccccugccggugggccagaacucccuc

SEQ ID NO: 37500 - RNA, 33 nt, Artificial Sequence
  COUP transcription factor 2 (278-288)
agccccauguccgccgaccgcguggucgccuuc

SEQ ID NO: 37501 - RNA, 27 nt, Artificial Sequence
  Ubiquitin carboxyl-terminal hydrolase 6 (1192-1200)
agccccaacuccagcccgcgcacccug

SEQ ID NO: 37502 - RNA, 27 nt, Artificial Sequence
  Ubiquitin-associated protein 2-like (477-485)
agcccccagccggcccagcagaagcug

SEQ ID NO: 37503 - RNA, 30 nt, Artificial Sequence
  Acyl-CoA desaturase (281-290)
agcccccgcgagaacauccuggugucccuc

SEQ ID NO: 37504 - RNA, 27 nt, Artificial Sequence
  U3 small nucleolar RNA-associated protein 18 homolog (367-375)
agcccccgcuccggcuacuucgcccug

SEQ ID NO: 37505 - RNA, 30 nt, Artificial Sequence
  Integrator complex subunit 7 (289-298)
agcccccgcuccagcgaccuggugaagcuc

SEQ ID NO: 37506 - RNA, 27 nt, Artificial Sequence
  Protein Wiz (5-13)
agccccucccugccgaagaagagccuc

SEQ ID NO: 37507 - RNA, 27 nt, Artificial Sequence
  Mediator of DNA damage checkpoint protein 1 (1786-1794)
agccagauccagaagguggagcccgcc

SEQ ID NO: 37508 - RNA, 30 nt, Artificial Sequence
  DNA-directed RNA polymerases I, II, and III subunit RPABC3 (47-56)
agccgcgccgaccaguucgaguacgugaug

SEQ ID NO: 37509 - RNA, 27 nt, Artificial Sequence
  Mitochondrial fission factor (5-13)
agccgcauccaguacgagauggaguac

SEQ ID NO: 37510 - RNA, 27 nt, Artificial Sequence
  Histone H2B type 2-F (33-41)
agccgcaaggaguccuacagcguguac

SEQ ID NO: 37511 - RNA, 33 nt, Artificial Sequence
  Solute carrier family 35 member E1 (251-261)
agccgccaguccuaccccaacagcuacucccug

SEQ ID NO: 37512 - RNA, 27 nt, Artificial Sequence
  Mucin-1 (950-958)
agcaccgcccccccggugcacaacguc

SEQ ID NO: 37513 - RNA, 33 nt, Artificial Sequence
  T-complex protein 1 subunit beta (333-343)
agcaccuucgaccaccccgagcuggugaagcuc

SEQ ID NO: 37514 - RNA, 27 nt, Artificial Sequence
  Exosome complex component RRP4 (55-63)
agcguggccggcuccgucgagcgcgug

SEQ ID NO: 37515 - RNA, 27 nt, Artificial Sequence
  Rho guanine nucleotide exchange factor 18 (538-546)
agcguggacuccaagcccccggucauc

SEQ ID NO: 37516 - RNA, 27 nt, Artificial Sequence
  PDZ domain-containing protein GIPC1 (87-95)
agcgugaucgaccacauccaccugauc

SEQ ID NO: 37517 - RNA, 33 nt, Artificial Sequence
  Programmed cell death 6-interacting protein (423-433)
agcgugaucgagcagggcgggauccagaccguc

SEQ ID NO: 37518 - RNA, 27 nt, Artificial Sequence
  Nucleolar pre-ribosomal-associated protein 1 (1313-1321)
agcgugcuggaccagaagauccuccug

SEQ ID NO: 37519 - RNA, 27 nt, Artificial Sequence
  Serine incorporator 1 (244-252)
agcgugauguccauccugcccaagauc

SEQ ID NO: 37520 - RNA, 27 nt, Artificial Sequence
  Heterogeneous nuclear ribonucleoprotein K (372-380)
agcuacgccggcgggcgcggcuccuac

SEQ ID NO: 37521 - RNA, 27 nt, Artificial Sequence
  Nectin-2 (494-502)
agcuaccagggcaagggguucgugaug

SEQ ID NO: 37522 - RNA, 27 nt, Artificial Sequence
  Transcription intermediary factor 1-beta (33-41)
accgccgacagccagcccccgguguuc

SEQ ID NO: 37523 - RNA, 27 nt, Artificial Sequence
  Phosphatidylinositol 4-kinase alpha (299-307)
accgagaucgagcgccugaucaccugg

SEQ ID NO: 37524 - RNA, 30 nt, Artificial Sequence
  Phosphatidylinositol 4-kinase alpha (299-308)
accgagaucgagcgccugaucaccugguac

SEQ ID NO: 37525 - RNA, 33 nt, Artificial Sequence
  Putative oxidoreductase GLYR1 (385-395)
accaucgccgagggccugacccucgcccaggug

SEQ ID NO: 37526 - RNA, 27 nt, Artificial Sequence
  Phosphopantothenate-cysteine ligase (151-159)
acccuggccgacuaccuccaccugcug

SEQ ID NO: 37527 - RNA, 30 nt, Artificial Sequence
  Paraspeckle component 1 (128-137)
acccuggccgagaucgccaaggcggagcuc

SEQ ID NO: 37528 - RNA, 27 nt, Artificial Sequence
  Tumor necrosis factor receptor superfamily member 6 (305-313)
acccuggccgagaagauccagaccauc

SEQ ID NO: 37529 - RNA, 27 nt, Artificial Sequence
  Vacuolar protein sorting-associated protein 29 (57-65)
acccuggccggcgacgugcacaucguc

SEQ ID NO: 37530 - RNA, 27 nt, Artificial Sequence
  Nuclear transcription factor Y subunit gamma (147-155)
acccuggcccagcagcccaccgccgug

SEQ ID NO: 37531 - RNA, 30 nt, Artificial Sequence
  Pre-mRNA-splicing factor ATP-dependent RNA helicase DHX15 (266-275)
acccuggccaccgacauccucaugggcgug

SEQ ID NO: 37532 - RNA, 27 nt, Artificial Sequence
  Heat shock cognate 71 kDa protein (313-321)
acccuggaccccguggagaaggcccuc

SEQ ID NO: 37533 - RNA, 27 nt, Artificial Sequence
  EMILIN-2 (411-419)
acccuggaccagaagaucgagcgcgug

SEQ ID NO: 37534 - RNA, 27 nt, Artificial Sequence
  Ubiquitin carboxyl-terminal hydrolase 33 (252-260)
acccuguuccagggcaucaagaccgug

SEQ ID NO: 37535 - RNA, 27 nt, Artificial Sequence
  Cyclic AMP-responsive element-binding protein 1 (213-221)
acccugaucgaggagcucaaggcccug

SEQ ID NO: 37536 - RNA, 30 nt, Artificial Sequence
  Mediator of RNA polymerase II transcription subunit 14 (53-62)
acccugaucgaguuccuccugcaccgcgcc

SEQ ID NO: 37537 - RNA, 27 nt, Artificial Sequence
  Histone-lysine N-methyltransferase 2B (517-525)
acccugaucgagaaggugcaggaggcc

SEQ ID NO: 37538 - RNA, 30 nt, Artificial Sequence
  Protein arginine N-methyltransferase 3 (288-297)
acccugaucaagggcaagaucgaggaggug

SEQ ID NO: 37539 - RNA, 27 nt, Artificial Sequence
  UDP-N-acetylglucosamine-dolichyl-phosphate N-acetylglucosaminephosphotransferase (255-263)
acccugaucaaccuccugcugaaggug

SEQ ID NO: 37540 - RNA, 33 nt, Artificial Sequence
  Peroxisomal acyl-coenzyme A oxidase 1 (597-607)
acccugauccgcagcgacgccguggcccucguc

SEQ ID NO: 37541 - RNA, 27 nt, Artificial Sequence
  Ubiquitin-like modifier-activating enzyme 6 (967-975)
acccugcucgacuucaucaacgccgug

SEQ ID NO: 37542 - RNA, 27 nt, Artificial Sequence
  Coronin (508-516)
acccugcucgaggagaucaaggcccug

SEQ ID NO: 37543 - RNA, 27 nt, Artificial Sequence
  Signal-induced proliferation-associated protein 1 (365-373)
acccugcucggcgacgugguccgccug

SEQ ID NO: 37544 - RNA, 27 nt, Artificial Sequence
  2-hydroxyacyl-CoA lyase 1 (238-246)
acccugcucggcaacauccacgccgug

SEQ ID NO: 37545 - RNA, 30 nt, Artificial Sequence
  Pecanex-like protein 1 (955-964)
acccugcucaucggcagcccccugucccug

SEQ ID NO: 37546 - RNA, 27 nt, Artificial Sequence
  Kelch-like protein 22 (490-498)
acccugcucaacaagcuguacgugauc

SEQ ID NO: 37547 - RNA, 27 nt, Artificial Sequence
  AP-2 complex subunit beta (483-491)
acccugcucaccgccaucgugaagcug

SEQ ID NO: 37548 - RNA, 27 nt, Artificial Sequence
  Vacuolar protein sorting-associated protein 11 homolog (911-919)
acccugcucaccgaccccccgacggcc

SEQ ID NO: 37549 - RNA, 27 nt, Artificial Sequence
  Fanconi anemia group I protein (1140-1148)
acccugcucaccuucuuccacgagcug

SEQ ID NO: 37550 - RNA, 27 nt, Artificial Sequence
  1-phosphatidylinositol 4,5-bisphosphate phosphodiesterase gamma-1 (436-444)
acccugcucaccaagcccguggagauc

SEQ ID NO: 37551 - RNA, 30 nt, Artificial Sequence
  Pre-mRNA-processing factor 6 (249-258)
acccugauggacaugcgccucagccaggug

SEQ ID NO: 37552 - RNA, 30 nt, Artificial Sequence
  Transgelin-2 (128-137)
acccugaugaaccucggcgggcuggccgug

SEQ ID NO: 37553 - RNA, 27 nt, Artificial Sequence
  Cleft lip and palate transmembrane protein 1 (101-109)
acccugaugaaccuccacguguacauc

SEQ ID NO: 37554 - RNA, 27 nt, Artificial Sequence
  Nuclear receptor-binding protein (524-532)
acccugaacagcgccgccgugaccguc

SEQ ID NO: 37555 - RNA, 27 nt, Artificial Sequence
  Acylglycerol kinase, mitochondrial (127-135)
acccugcaggagguggucaccggcgug

SEQ ID NO: 37556 - RNA, 27 nt, Artificial Sequence
  Baculoviral IAP repeat-containing protein 6 (1801-1809)
acccugagcgacgugcucgaccgcguc

SEQ ID NO: 37557 - RNA, 27 nt, Artificial Sequence
  Lysine-specific demethylase 5C (849-857)
acccugaccgagcuccgcgccuuccug

SEQ ID NO: 37558 - RNA, 27 nt, Artificial Sequence
  Cytochrome b-c1 complex subunit 9 (5-13)
acccugaccagcaagcucuacucccug

SEQ ID NO: 37559 - RNA, 27 nt, Artificial Sequence
  Putative helicase MOV-10 (131-139)
acccugguggaggccaucaagcagguc

SEQ ID NO: 37560 - RNA, 27 nt, Artificial Sequence
  Transmembrane protein 9B (3-11)
acccuguggggcgggcuccugcgccug

SEQ ID NO: 37561 - RNA, 27 nt, Artificial Sequence
  Trafficking protein particle complex subunit 9 (207-215)
acccuguacgacagccgccucuucgug

SEQ ID NO: 37562 - RNA, 30 nt, Artificial Sequence
  Transmembrane protein 214 (42-51)
acccuguacgagcgcggcuucgagaacauc

SEQ ID NO: 37563 - RNA, 27 nt, Artificial Sequence
  Exportin-6 (594-602)
acccuguacggcagccagaucaagcuc

SEQ ID NO: 37564 - RNA, 33 nt, Artificial Sequence
  Insulin-like growth factor 2 mRNA-binding protein 1 (319-329)
acccuguacaaccccgagcgcaccaucacggug

SEQ ID NO: 37565 - RNA, 30 nt, Artificial Sequence
  AP-1 complex subunit beta-1 (827-836)
acccuguacccccuccacauccuguucgug

SEQ ID NO: 37566 - RNA, 27 nt, Artificial Sequence
  Syntaxin-binding protein 3 (176-184)
accauggccgaccagaucgugaccguc

SEQ ID NO: 37567 - RNA, 27 nt, Artificial Sequence
  Actin-like protein 6A (279-287)
accaugcugggcgugagccacgucgug

SEQ ID NO: 37568 - RNA, 27 nt, Artificial Sequence
  Tartrate-resistant acid phosphatase type 5 (23-31)
acccccgcccugcgcuucguggccguc

SEQ ID NO: 37569 - RNA, 30 nt, Artificial Sequence
  Eukaryotic translation initiation factor 2A (542-551)
accccccgcaacaccgugagccaguccauc

SEQ ID NO: 37570 - RNA, 27 nt, Artificial Sequence
  Intron-binding protein aquarius (396-404)
accaccuucgacaaggaguuccugcuc

SEQ ID NO: 37571 - RNA, 33 nt, Artificial Sequence
  Elongation factor 2 (486-496)
accaccuucgagcacgcccacaacaugcgcgug

SEQ ID NO: 37572 - RNA, 27 nt, Artificial Sequence
  Nuclear factor of activated T-cells, cytoplasmic 1 (325-333)
accacccuggagcagcccccgagcgug

SEQ ID NO: 37573 - RNA, 27 nt, Artificial Sequence
  Chromatin complexes subunit BAP18 (72-80)
accguggcccagaucaaggccaccguc

SEQ ID NO: 37574 - RNA, 27 nt, Artificial Sequence
  Kelch-like protein 18 (361-369)
accguguucgagggccgcaucuacguc

SEQ ID NO: 37575 - RNA, 27 nt, Artificial Sequence
  Ubiquitin carboxyl-terminal hydrolase 10 (731-739)
accuaccgccuguucgccguggucuac

SEQ ID NO: 37576 - RNA, 27 nt, Artificial Sequence
  Dolichyl-diphosphooligosaccharide-proteinosyltransferase 48 kDa subunit (203-211)
guggccgaccccgacaacccgcugguc

SEQ ID NO: 37577 - RNA, 30 nt, Artificial Sequence
  Chromodomain-helicase-DNA-binding protein 4 (243-252)
guggcccccccgcccccccccgucgaggug

SEQ ID NO: 37578 - RNA, 30 nt, Artificial Sequence
  Glycogen phosphorylase, liver form (207-216)
guggagcacaccaacaccggcacgaagugg

SEQ ID NO: 37579 - RNA, 33 nt, Artificial Sequence
  Prelamin-A/C (78-88)
guggagaucgacaacggcaagcagcgcgaguuc

SEQ ID NO: 37580 - RNA, 27 nt, Artificial Sequence
  GPI transamidase component PIG-T (292-300)
gugcaccccccgcccaccaccacguac

SEQ ID NO: 37581 - RNA, 27 nt, Artificial Sequence
  Probable ATP-dependent RNA helicase DDX60-like (866-874)
gugaucuucgacgagguccacuaccug

SEQ ID NO: 37582 - RNA, 27 nt, Artificial Sequence
  Platelet-activating factor acetylhydrolase IB subunit alpha (114-122)
gugaucuuccaccccgucuucagcgug

SEQ ID NO: 37583 - RNA, 27 nt, Artificial Sequence
  ORM1-like protein 2 (54-62)
gugauccacaaccuggccaccuacguc

SEQ ID NO: 37584 - RNA, 27 nt, Artificial Sequence
  Mediator of RNA polymerase II transcription subunit 23 (140-148)
gugauccuggagaagauccucaccauc

SEQ ID NO: 37585 - RNA, 27 nt, Artificial Sequence
  Protein Mis18-beta (88-96)
gugcuggccgacagcguccaccucgcc

SEQ ID NO: 37586 - RNA, 33 nt, Artificial Sequence
  Guanine nucleotide-binding protein G(i) subunit alpha-1 (233-243)
gugcuggccgaggacgaggagaugaaccgcaug

SEQ ID NO: 37587 - RNA, 27 nt, Artificial Sequence
  Bromodomain adjacent to zinc finger domain protein 2A (972-980)
gugcuggccuuccucguccacgagcug

SEQ ID NO: 37588 - RNA, 33 nt, Artificial Sequence
  Disheveled-associated activator of morphogenesis 2 (194-204)
gugcuggcccagcccgaggccaucagcaccauc

SEQ ID NO: 37589 - RNA, 27 nt, Artificial Sequence
  DNA repair protein RAD50 (1068-1076)
gugcuggccagccucaucauccgccug

SEQ ID NO: 37590 - RNA, 30 nt, Artificial Sequence
  Cytoplasmic dynein 1 heavy chain 1 (2318-2327)
gugcuggacgacaacaagcuccugacccug

SEQ ID NO: 37591 - RNA, 30 nt, Artificial Sequence
  Cytoplasmic FMR1-interacting protein 2 (170-179)
gugcuggacgagcucaagaacaugaagugc

SEQ ID NO: 37592 - RNA, 27 nt, Artificial Sequence
  Serrate RNA effector molecule homolog (161-169)
gugcuggacaagcuccugcuguaccuc

SEQ ID NO: 37593 - RNA, 27 nt, Artificial Sequence
  Protein transport protein Sec61 subunit alpha isoform 1 (354-362)
gugcuggaggaccccguccacgccgug

SEQ ID NO: 37594 - RNA, 30 nt, Artificial Sequence
  HLA class I histocompatibility antigen, A-2 alpha chain (291-300)
gugcuguucggcgccgucaucaccggggcc

SEQ ID NO: 37595 - RNA, 30 nt, Artificial Sequence
  Fatty acid synthase (743-752)
gugcuguuccaggaggcccucuggcacguc

SEQ ID NO: 37596 - RNA, 27 nt, Artificial Sequence
  Protein VAC14 homolog (32-40)
gugcugggcgaguuccucaaggagauc

SEQ ID NO: 37597 - RNA, 27 nt, Artificial Sequence
  Mediator of RNA polymerase II transcription subunit 23 (1163-1171)
gugcugcacgaccgcaucgucagcgug

SEQ ID NO: 37598 - RNA, 33 nt, Artificial Sequence
  GPN-loop GTPase 1 (103-113)
gugcugaucgacacccccggccagaucgagguc

SEQ ID NO: 37599 - RNA, 27 nt, Artificial Sequence
  Adenosylhomocysteinase (62-70)
gugcugaucgagacccucgucacccug

SEQ ID NO: 37600 - RNA, 33 nt, Artificial Sequence
  Splicing factor 3B subunit 3 (959-969)
gugcugaucggcgucgggaagcuccugcgcgug

SEQ ID NO: 37601 - RNA, 30 nt, Artificial Sequence
  Membrane-bound transcription factor site-2 protease (164-173)
gugcugaucagcggcgucgugcacgagauc

SEQ ID NO: 37602 - RNA, 27 nt, Artificial Sequence
  Cytoplasmic FMR1-interacting protein 2 (505-513)
gugcugaucagcguccuccaggccauc

SEQ ID NO: 37603 - RNA, 27 nt, Artificial Sequence
  Putative helicase MOV-10 (216-224)
gugcugaucaccacccucaucacggcc

SEQ ID NO: 37604 - RNA, 33 nt, Artificial Sequence
  Ubiquitin-like protein 4A (77-87)
gugcugcucgaggagggcgaggcccagcgccug

SEQ ID NO: 37605 - RNA, 33 nt, Artificial Sequence
  Cleavage stimulation factor subunit 1 (368-378)
gugcugcuccccgacgagcgcaccaucagccug

SEQ ID NO: 37606 - RNA, 27 nt, Artificial Sequence
  Glycerol-3-phosphate acyltransferase 3 (155-163)
gugcugcucccccugcgcgucacccug

SEQ ID NO: 37607 - RNA, 27 nt, Artificial Sequence
  Eukaryotic translation initiation factor 4 gamma 3 (1360-1368)
gugcugcucagcgagauccugcaccug

SEQ ID NO: 37608 - RNA, 27 nt, Artificial Sequence
  Vesicle-trafficking protein SEC22b (2-10)
gugcugcucaccaugaucgcccgcguc

SEQ ID NO: 37609 - RNA, 27 nt, Artificial Sequence
  Probable ATP-dependent RNA helicase DDX41 (543-551)
gugcugauggaccucaaggcccugcug

SEQ ID NO: 37610 - RNA, 30 nt, Artificial Sequence
  Probable ATP-dependent RNA helicase DDX41 (543-552)
gugcugauggaccucaaggcccugcugcuc

SEQ ID NO: 37611 - RNA, 30 nt, Artificial Sequence
  Sterol regulatory element-binding protein 1 (412-421)
gugcugauggagggcgucaagaccgaggug

SEQ ID NO: 37612 - RNA, 27 nt, Artificial Sequence
  Cytoskeleton-associated protein 5 (1259-1267)
gugcugaugaaggcccucgaguaccug

SEQ ID NO: 37613 - RNA, 27 nt, Artificial Sequence
  Eukaryotic translation initiation factor 4 gamma 1 (187-195)
gugcugaugaaccagcccccgcagauc

SEQ ID NO: 37614 - RNA, 30 nt, Artificial Sequence
  Ubiquitin-like protein 7 (159-168)
gugcugcaggacaaggaccucuucagcguc

SEQ ID NO: 37615 - RNA, 27 nt, Artificial Sequence
  Zinc finger CCCH-type antiviral protein 1 (112-120)
gugcugagcgaggagaacuucaagguc

SEQ ID NO: 37616 - RNA, 27 nt, Artificial Sequence
  Probable ubiquitin carboxyl-terminal hydrolase FAF-X (2317-2325)
gugcugagcgagcuccuguggcagguc

SEQ ID NO: 37617 - RNA, 27 nt, Artificial Sequence
  Phosphatidylinositol N-acetylglucosaminyltransferase subunit A (165-173)
gugcugaccaacaagcuccugaccguc

SEQ ID NO: 37618 - RNA, 27 nt, Artificial Sequence
  UPF0505 protein C16orf62 (670-678)
gugcugguccagcucauccacagcgug

SEQ ID NO: 37619 - RNA, 30 nt, Artificial Sequence
  Coiled-coil domain-containing protein 84 (84-93)
gugcuguacggcgggcuccuggagcaccug

SEQ ID NO: 37620 - RNA, 30 nt, Artificial Sequence
  Signal recognition particle subunit SRP68 (231-240)
gugcuguacaaccagcgcgucgaggagauc

SEQ ID NO: 37621 - RNA, 27 nt, Artificial Sequence
  BTB/POZ domain-containing protein 2 (212-220)
gugauguucaaggagcccgucgaggug

SEQ ID NO: 37622 - RNA, 30 nt, Artificial Sequence
  Ligand-dependent nuclear receptor-interacting factor 1 (358-367)
gugauguucaacggcaaggucuaccugcuc

SEQ ID NO: 37623 - RNA, 30 nt, Artificial Sequence
  Poly(rC)-binding protein 2 (165-174)
gugaugcuggagagccccccgaagggcguc

SEQ ID NO: 37624 - RNA, 27 nt, Artificial Sequence
  Vesicle-associated membrane protein 4 (66-74)
gugaugcaggagaacaucaccaagguc

SEQ ID NO: 37625 - RNA, 30 nt, Artificial Sequence
  Transient receptor potential cation channel subfamily V member 2 (730-739)
gugccccgcacccuggagaacccgguccuc

SEQ ID NO: 37626 - RNA, 27 nt, Artificial Sequence
  UPF0606 protein KIAA1549L (15-23)
gugcccagccugcacaucaccacccuc

SEQ ID NO: 37627 - RNA, 27 nt, Artificial Sequence
  Cholinesterase (308-316)
gugcccuacggcaccccgcugagcguc

SEQ ID NO: 37628 - RNA, 27 nt, Artificial Sequence
  Phosphatidylglycerophosphatase and protein-tyrosine phosphatase 1 (6-14)
gugcaggacgagaacguccgcggcgug

SEQ ID NO: 37629 - RNA, 30 nt, Artificial Sequence
  Pre-mRNA-processing-splicing factor 8 (1168-1177)
gugcagugggagaacagcuucgucuccgug

SEQ ID NO: 37630 - RNA, 24 nt, Artificial Sequence
  Nucleoprotein TPR (1846-1853)
gugagcgacgacaccgucgagaug

SEQ ID NO: 37631 - RNA, 24 nt, Artificial Sequence
  Proliferating cell nuclear antigen (111-118)
gugagcgacuacgagaugaagcug

SEQ ID NO: 37632 - RNA, 27 nt, Artificial Sequence
  SHC-transforming protein 1 (77-85)
gugacccgcgaggccaucagccugguc

SEQ ID NO: 37633 - RNA, 27 nt, Artificial Sequence
  Uncharacterized protein C11orf24 (396-404)
guggucgacaagacccugcuccuggug

SEQ ID NO: 37634 - RNA, 27 nt, Artificial Sequence
  Protein SZT2 (1295-1303)
guggucuggggcaccgugauccgcgug

SEQ ID NO: 37635 - RNA, 27 nt, Artificial Sequence
  N-alpha-acetyltransferase 20 (118-126)
guguaccgcaccgucaucgaguacuac

SEQ ID NO: 37636 - RNA, 27 nt, Artificial Sequence
  E3 ubiquitin-protein ligase UBR5 (446-454)
uggguggacgagacccugagcuccguc

SEQ ID NO: 37637 - RNA, 27 nt, Artificial Sequence
  60S ribosomal protein L32 (95-103)
uacugcgccgagaucgcccacaacgug

SEQ ID NO: 37638 - RNA, 27 nt, Artificial Sequence
  EF-hand calcium-binding domain-containing protein 7 (548-556)
uacgagaacaucaucgugcacaccuac

SEQ ID NO: 37639 - RNA, 27 nt, Artificial Sequence
  Catenin beta-1 (489-497)
uacggccugcccguggucgugaagcuc

SEQ ID NO: 37640 - RNA, 30 nt, Artificial Sequence
  Signal recognition particle subunit SRP68 (333-342)
uacauccuggagggcgagcccgggaaggug

SEQ ID NO: 37641 - RNA, 27 nt, Artificial Sequence
  Protein timeless homolog (772-780)
uacauccugggcaaguucuucgcccuc

SEQ ID NO: 37642 - RNA, 27 nt, Artificial Sequence
  Glucose-fructose oxidoreductase domain-containing protein 2 (181-189)
uacaucguggaccugcucacccaccug

SEQ ID NO: 37643 - RNA, 27 nt, Artificial Sequence
  Kelch repeat and BTB domain-containing protein 4 (141-149)
uacaucuaccacggcaccgugaagcug

SEQ ID NO: 37644 - RNA, 27 nt, Artificial Sequence
  FACT complex subunit SSRP1 (232-240)
uacaagauccccuacaccaccgugcug

SEQ ID NO: 37645 - RNA, 27 nt, Artificial Sequence
  Nucleolar protein 6 (206-214)
uaccuggcccaccucgcccaccaccug

SEQ ID NO: 37646 - RNA, 30 nt, Artificial Sequence
  NAD kinase (302-311)
uaccuggacggccaccucaucaccaccgug

SEQ ID NO: 37647 - RNA, 30 nt, Artificial Sequence
  S-phase kinase-associated protein 1 (33-42)
uaccuggacaucaagggccuccuggacgug

SEQ ID NO: 37648 - RNA, 27 nt, Artificial Sequence
  Transcription cofactor vestigial-like protein 4 (13-21)
uaccuggacaagaugaacaacaacauc

SEQ ID NO: 37649 - RNA, 27 nt, Artificial Sequence
  Zinc finger protein 655 (93-101)
uaccuggaccccgugcagcgcgaccuc

SEQ ID NO: 37650 - RNA, 30 nt, Artificial Sequence
  Methyltransferase-like protein 9 (41-50)
uaccuggaccagggcacccagaucuuccuc

SEQ ID NO: 37651 - RNA, 27 nt, Artificial Sequence
  Ubiquitin-conjugating enzyme E2 variant 3 (132-140)
uaccuggacgugguccagagcaacgug

SEQ ID NO: 37652 - RNA, 27 nt, Artificial Sequence
  Nuclear factor erythroid 2-related factor 3 (299-307)
uaccuggaggacaccgaccgcaaccuc

SEQ ID NO: 37653 - RNA, 27 nt, Artificial Sequence
  MKI67 FHA domain-interacting nucleolar phosphoprotein (43-51)
uaccuguucggcgagcgccuccuggag

SEQ ID NO: 37654 - RNA, 33 nt, Artificial Sequence
  Pyridoxal-dependent decarboxylase domain-containing protein 1 (347-357)
uaccugggccucgacggguucguggagcgcauc

SEQ ID NO: 37655 - RNA, 30 nt, Artificial Sequence
  Unconventional myosin-Id (612-621)
uaccugggccuccuggagaacgugcgcguc

SEQ ID NO: 37656 - RNA, 27 nt, Artificial Sequence
  60S ribosomal protein L13a (137-145)
uaccugggccgccucgcccacgaggug

SEQ ID NO: 37657 - RNA, 27 nt, Artificial Sequence
  Ubiquitin-like domain-containing CTD phosphatase 1 (165-173)
uaccugcacgaguuccucaccagcgcc

SEQ ID NO: 37658 - RNA, 27 nt, Artificial Sequence
  Vam6/Vps39-like protein (368-376)
uaccugcacaccaacguggcccucguc

SEQ ID NO: 37659 - RNA, 27 nt, Artificial Sequence
  GTP-binding protein 2 (227-235)
uaccugcacaccaccaucuucggccuc

SEQ ID NO: 37660 - RNA, 30 nt, Artificial Sequence
  Isoleucine-tRNA ligase, cytoplasmic (626-635)
uaccugaucaacagccccgugguccgcgcc

SEQ ID NO: 37661 - RNA, 30 nt, Artificial Sequence
  Pre-mRNA-processing-splicing factor 8 (794-803)
uaccugaaggacggccccuacaucaccgcc

SEQ ID NO: 37662 - RNA, 30 nt, Artificial Sequence
  E3 ubiquitin-protein ligase MARCH6 (514-523)
uaccugcucgaccugcacagcuaccugcuc

SEQ ID NO: 37663 - RNA, 30 nt, Artificial Sequence
  Ninein (544-553)
uaccugcucgaggagaagaucgccagccug

SEQ ID NO: 37664 - RNA, 27 nt, Artificial Sequence
  Unconventional myosin-Va (242-250)
uaccugcucgagaagagccgcgugguc

SEQ ID NO: 37665 - RNA, 30 nt, Artificial Sequence
  EH domain-containing protein 4 (80-89)
uaccugcucgagcaggacuuccccggcaug

SEQ ID NO: 37666 - RNA, 27 nt, Artificial Sequence
  Protein fem-1 homolog A (168-176)
uaccugcucgagcagggcgcccaggug

SEQ ID NO: 37667 - RNA, 27 nt, Artificial Sequence
  PCI domain-containing protein 2 (252-260)
uaccugcuccccgugaagaugcugcug

SEQ ID NO: 37668 - RNA, 27 nt, Artificial Sequence
  Pecanex-like protein 3 (1380-1388)
uaccugaacgcccucgugcaccugauc

SEQ ID NO: 37669 - RNA, 27 nt, Artificial Sequence
  Malignant T-cell-amplified sequence 1 (170-178)
uaccugaacgacggccucuggcacaug

SEQ ID NO: 37670 - RNA, 27 nt, Artificial Sequence
  Elongation factor 2 (171-179)
uaccugaacgagaucaaggacagcgug

SEQ ID NO: 37671 - RNA, 33 nt, Artificial Sequence
  H/ACA ribonucleoprotein complex subunit 3 (6-16)
uaccugaacgagcagggcgaccgcguguacacc

SEQ ID NO: 37672 - RNA, 27 nt, Artificial Sequence
  Ferritin heavy chain (11-19)
uaccugaacgagcaggugaaggccauc

SEQ ID NO: 37673 - RNA, 30 nt, Artificial Sequence
  T-complex protein 1 subunit theta (278-287)
uaccugagcgaggugggcgacacccagguc

SEQ ID NO: 37674 - RNA, 27 nt, Artificial Sequence
  Probable C-mannosyltransferase DPY19L1 (356-364)
uaccugaccagcaagaucuucggcauc

SEQ ID NO: 37675 - RNA, 27 nt, Artificial Sequence
  Circadian clock protein PASD1 (168-176)
uaccuggugggcaacgucugcauccuc

SEQ ID NO: 37676 - RNA, 27 nt, Artificial Sequence
  Protocadherin beta-6 (446-454)
uaccuggugaccaaggucguggccgug

SEQ ID NO: 37677 - RNA, 27 nt, Artificial Sequence
  Myotubularin-related protein 4 (250-258)
uaccuggugaccagcaucgccaaggcc

SEQ ID NO: 37678 - RNA, 30 nt, Artificial Sequence
  F-actin-capping protein subunit beta (120-129)
uaccugugggaccucgaccacggcuucgcc

SEQ ID NO: 37679 - RNA, 27 nt, Artificial Sequence
  Growth arrest and DNA damage-inducible protein GADD45 alpha (118-126)
uacauggaccagugggugcccgucauc

SEQ ID NO: 37680 - RNA, 27 nt, Artificial Sequence
  Signal transducing adapter molecule 2 (404-412)
uacaugggccagagcauccaccaggug

SEQ ID NO: 37681 - RNA, 33 nt, Artificial Sequence
  SWI/SNF-related matrix-associated actin-dependent regulator of chromatin subfamily B member 1 (26-36)
uacaugaucggcagcgagguggggaacuaccug

SEQ ID NO: 37682 - RNA, 30 nt, Artificial Sequence
  Serine palmitoyltransferase small subunit A (24-33)
uacaugcuggagcccugggagcgcaccgug

SEQ ID NO: 37683 - RNA, 27 nt, Artificial Sequence
  Kinetochore protein Nuf2 (65-73)
uacaugaugcccgugaacagcgagguc

SEQ ID NO: 37684 - RNA, 27 nt, Artificial Sequence
  G patch domain-containing protein 11 (33-41)
uacaugagcgacuccuucaucaacgug

SEQ ID NO: 37685 - RNA, 27 nt, Artificial Sequence
  Transcription factor SOX-8 (6-14)
uacccccaccugcacaacgccgagcuc

SEQ ID NO: 37686 - RNA, 27 nt, Artificial Sequence
  Immunoglobulin-binding protein 1 (259-267)
uaccccagccugccgaccaugaccgug

SEQ ID NO: 37687 - RNA, 33 nt, Artificial Sequence
  RNA-binding motif protein 22 (253-263)
uaccaguucggcgagauccgcaccaucaccgug

SEQ ID NO: 37688 - RNA, 27 nt, Artificial Sequence
  NADH dehydrogenase (ubiquinone) iron-sulfur protein 2, mitochondrial (245-253)
uaccaguucagcaagaacuucucccug

SEQ ID NO: 37689 - RNA, 27 nt, Artificial Sequence
  GRB2-associated-binding protein 2 (324-332)
uaccagaucccccgcaccuucacccug

SEQ ID NO: 37690 - RNA, 27 nt, Artificial Sequence
  Copper-transporting ATPase 1 (1410-1418)
uaccgcaagcccaccuacgagagcuac

SEQ ID NO: 37691 - RNA, 33 nt, Artificial Sequence
  Tuberin (602-612)
uacacccugcccaucgccagcuccauccgccuc

SEQ ID NO: 37692 - RNA, 27 nt, Artificial Sequence
  Heterogeneous nuclear ribonucleoprotein U-like protein 1 (797-805)
uacacccccccgcccccccccaccgcc

SEQ ID NO: 37693 - RNA, 27 nt, Artificial Sequence
  PAS domain-containing serine/threonine-protein kinase (890-898)
uacaccugggaggagguguuccgcguc

SEQ ID NO: 37694 - RNA, 48 nt, Artificial Sequence
  Selenoprotein H (51-66)
gccgccgcgcugagccaggcccuccgccuggaggcccccgagcugccg

SEQ ID NO: 37695 - RNA, 45 nt, Artificial Sequence
  40S ribosomal protein S26 (47-61)
gccgccgcggugcgcgacaucagcgaggccuccgucuucgacgcc

SEQ ID NO: 37696 - RNA, 51 nt, Artificial Sequence
  Profilin-1 (33-49)
gccgccgugcccggcaagaccuucgucaacaucaccccggcggaggugggg

SEQ ID NO: 37697 - RNA, 39 nt, Artificial Sequence
  Calmodulin (58-70)
gccgacggcaacgggaccaucgacuuccccgaguuccug

SEQ ID NO: 37698 - RNA, 39 nt, Artificial Sequence
  Coiled-coil and C2 domain-containing protein 2A (1275-1287)
gccgagugcgcccugaaguuccccaaccgccagugccuc

SEQ ID NO: 37699 - RNA, 30 nt, Artificial Sequence
  Helicase ARIP4 (881-890)
gccgagaagaaggccgcgaagaagagcuac

SEQ ID NO: 37700 - RNA, 36 nt, Artificial Sequence
  NHP2-like protein 1 (60-71)
gccgagccccuggagaucauccuccaccugccgcug

SEQ ID NO: 37701 - RNA, 42 nt, Artificial Sequence
  Uncharacterized protein C20orf144 (70-83)
gccggccuggggagccccgccgcgccgcgccuccggggcgcc

SEQ ID NO: 37702 - RNA, 39 nt, Artificial Sequence
  ATP synthase mitochondrial F1 complex assembly factor 1 (20-32)
gccggccuguaccgcgggcucugcgccgugcggagccgc

SEQ ID NO: 37703 - RNA, 60 nt, Artificial Sequence
  Gamma-soluble NSF attachment protein (267-286)
gccaagcugggccucagccuggugguccccgggggcgggaucaagaagaaguccccggcc

SEQ ID NO: 37704 - RNA, 54 nt, Artificial Sequence
  Deoxyuridine 5'-triphosphate nucleotidohydrolase, mitochondrial (124-141)
gcccuggacgacaccgagcgcggcagcgggggcuucggguccaccggcaagaac

SEQ ID NO: 37705 - RNA, 30 nt, Artificial Sequence
  Lysine-specific demethylase 6A (1264-1273)
gcccugaucgccgcgggcaaggagaucauc

SEQ ID NO: 37706 - RNA, 30 nt, Artificial Sequence
  Protein S100-A6 (81-90)
gcccugaucuacaacgaggcccucaagggc

SEQ ID NO: 37707 - RNA, 42 nt, Artificial Sequence
  Collagen alpha-2(VIII) chain (568-581)
gcccuguacaagaacaacgugcccgccaccuacaccuacgac

SEQ ID NO: 37708 - RNA, 39 nt, Artificial Sequence
  Peroxiredoxin-5, mitochondrial (54-66)
gcccccaucaaggugggcgacgccaucccggcggucgag

SEQ ID NO: 37709 - RNA, 33 nt, Artificial Sequence
  Neuroblast differentiation-associated protein AHNAK (105-115)
gcccccaagaucagcaugccggacaucgaccug

SEQ ID NO: 37710 - RNA, 33 nt, Artificial Sequence
  Ephrin type-B receptor 1 (422-432)
gcccccagcaccgugccgaucaugcaccagguc

SEQ ID NO: 37711 - RNA, 51 nt, Artificial Sequence
  Fer-1-like protein 5 (176-192)
gcccgccagcugaugggcaacaacaucaagcccguggucaaggugagcauc

SEQ ID NO: 37712 - RNA, 39 nt, Artificial Sequence
  Molybdenum cofactor sulfurase (561-573)
gcccgcacccagcccaccccgagcgagaaggccgcgggc

SEQ ID NO: 37713 - RNA, 48 nt, Artificial Sequence
  Protein LAP2 (1003-1018)
gccagcuuccccccgcagcugcucccccgcuccgagagcaccgagaac

SEQ ID NO: 37714 - RNA, 45 nt, Artificial Sequence
  Cysteine-rich protein 2 (59-73)
gccacccuguucggccccaagggggugaacaucggcggggccggc

SEQ ID NO: 37715 - RNA, 48 nt, Artificial Sequence
  Sodium channel and clathrin linker 1 (424-439)
gccguggaggaggagcuggagaagaucuaccgcgagggccgggggaac

SEQ ID NO: 37716 - RNA, 36 nt, Artificial Sequence
  Interferon-induced protein with tetratricopeptide repeats 2 (285-296)
ugccagaucggcugcugcuaccgcgccaagguguuc

SEQ ID NO: 37717 - RNA, 75 nt, Artificial Sequence
  Fas-binding factor 1 (99-123)
gacgccgacauccugggccucaagaagagcaacuccgcccccagcaagaaggcggccaaggacccggggaagggc

SEQ ID NO: 37718 - RNA, 51 nt, Artificial Sequence
  IQ motif and SEC7 domain-containing protein 2 (977-993)
gacuucaucaagaaccugcgcggcguggacaacggggaggacaucccccgg

SEQ ID NO: 37719 - RNA, 39 nt, Artificial Sequence
  Peptidyl-prolyl cis-trans isomerase A (9-21)
gacaucgccguggacggcgagccccuggggcgcgucagc

SEQ ID NO: 37720 - RNA, 48 nt, Artificial Sequence
  Peptidyl-prolyl cis-trans isomerase A (9-24)
gacaucgccguggacggcgagccccuggggcgcgucagcuucgagcuc

SEQ ID NO: 37721 - RNA, 45 nt, Artificial Sequence
  Beta-secretase 1 (93-107)
gacaccggcagcuccaacuucgccgugggggccgcgccccacccg

SEQ ID NO: 37722 - RNA, 42 nt, Artificial Sequence
  Elongation factor 1-alpha 1 (252-265)
gacguguacaagaucggcgggaucggcaccguccccgugggg

SEQ ID NO: 37723 - RNA, 42 nt, Artificial Sequence
  GDNF family receptor alpha-1 (117-130)
gaggacagccccuacgagccggugaacucccgccugagcgac

SEQ ID NO: 37724 - RNA, 30 nt, Artificial Sequence
  H/ACA ribonucleoprotein complex subunit 2 (144-153)
gaggaggugcagagccugccccucccgcug

SEQ ID NO: 37725 - RNA, 42 nt, Artificial Sequence
  Rho guanine nucleotide exchange factor 17 (425-438)
gagggccugcuccgcagccaggcccggacccgcgccaagggg

SEQ ID NO: 37726 - RNA, 42 nt, Artificial Sequence
  Uncharacterized protein C2orf15 (95-108)
gagggcaccgggaccggcagccuguccgggaaggcccucggc

SEQ ID NO: 37727 - RNA, 36 nt, Artificial Sequence
  Nesprin-3 (221-232)
gagcacgaggaguaccaggccggcguggacgaguuc

SEQ ID NO: 37728 - RNA, 45 nt, Artificial Sequence
  Ankyrin repeat domain-containing protein 35 (351-365)
gagccccgcgccagcggcaagcagggguccagccugcggccgggc

SEQ ID NO: 37729 - RNA, 36 nt, Artificial Sequence
  Probable ATP-dependent RNA helicase DDX53 (502-513)
gagcagagcgaccaggagcgcgccguggaggacuuc

SEQ ID NO: 37730 - RNA, 54 nt, Artificial Sequence
  DNA-binding protein RFX6 (414-431)
gagcgcguggaccugaacagcaucggcucccaggcccuccugaccaucagcggg

SEQ ID NO: 37731 - RNA, 39 nt, Artificial Sequence
  Annexin A2 (242-254)
gagagcauccgcaaggaggugaagggcgaccuggagaac

SEQ ID NO: 37732 - RNA, 42 nt, Artificial Sequence
  Annexin A2 (242-255)
gagagcauccgcaaggaggugaagggcgaccuggagaacgcc

SEQ ID NO: 37733 - RNA, 33 nt, Artificial Sequence
  Elongation factor 1-alpha 1 (280-290)
uucgcccccgugaacgucaccaccgaggugaag

SEQ ID NO: 37734 - RNA, 33 nt, Artificial Sequence
  Plasminogen activator inhibitor 1 RNA-binding protein (21-31)
uucgacgacgagagcgaccccuucgaggugcug

SEQ ID NO: 37735 - RNA, 42 nt, Artificial Sequence
  Peptidyl-prolyl cis-trans isomerase A (8-21)
uucgacaucgccguggacggcgagccccuggggcgcgucagc

SEQ ID NO: 37736 - RNA, 48 nt, Artificial Sequence
  Peptidyl-prolyl cis-trans isomerase A (8-23)
uucgacaucgccguggacggcgagccccuggggcgcgucagcuucgag

SEQ ID NO: 37737 - RNA, 27 nt, Artificial Sequence
  Alpha-2-macroglobulin receptor-associated protein (252-260)
uucgaggagccccgcgugaucgaccug

SEQ ID NO: 37738 - RNA, 45 nt, Artificial Sequence
  BTB/POZ domain-containing protein KCTD7 (96-110)
uucaucgaccgcgacggcacccacuucggggacgugcugaacuuc

SEQ ID NO: 37739 - RNA, 33 nt, Artificial Sequence
  Small nuclear ribonucleoprotein Sm D1 (74-84)
uucauccugcccgacagccucccgcuggacacc

SEQ ID NO: 37740 - RNA, 27 nt, Artificial Sequence
  Proteasome activator complex subunit 2 (35-43)
uuccugccccagaagaucaucuaccuc

SEQ ID NO: 37741 - RNA, 36 nt, Artificial Sequence
  Triosephosphate isomerase (230-241)
uuccuggugggcggggccagccucaagcccgaguuc

SEQ ID NO: 37742 - RNA, 36 nt, Artificial Sequence
  Protein FAM208B (156-167)
uuccgcagcccccuguccaccggcgugaaggaccuc

SEQ ID NO: 37743 - RNA, 72 nt, Artificial Sequence
  Elongation factor 1-alpha 1 (190-213)
uucgugcccaucagcggcuggaacggggacaacaugcuggagccguccgccaacaugcccugguucaagggc

SEQ ID NO: 37744 - RNA, 42 nt, Artificial Sequence
  Fanconi anemia group M protein (201-214)
ggcgccugccccgccgcggagaucaagugccuggugaucgac

SEQ ID NO: 37745 - RNA, 24 nt, Artificial Sequence
  Collagen alpha-4(IV) chain (170-177)
ggcgagaaggggaacagcguguuc

SEQ ID NO: 37746 - RNA, 63 nt, Artificial Sequence
  Heterogeneous nuclear ribonucleoproteins A2/B1 (333-353)
ggcgggaacuacggccccgggggcagcgggggcuccggcggguacggcgggcgcagccgguac

SEQ ID NO: 37747 - RNA, 39 nt, Artificial Sequence
  Structural maintenance of chromosomes protein 4 (528-540)
ggcaucuacgggcgccugggcgaccucggggccaucgac

SEQ ID NO: 37748 - RNA, 54 nt, Artificial Sequence
  60S ribosomal protein L5 (207-224)
ggcaaggagaccagcccccugcagaccccggugguccccgagaaccgcuucccc

SEQ ID NO: 37749 - RNA, 45 nt, Artificial Sequence
  Charged multivesicular body protein 7 (48-62)
ggccuggccaccgugcuccaggaccugcugcgccggggggagcuc

SEQ ID NO: 37750 - RNA, 39 nt, Artificial Sequence
  Complement C4-A (1353-1365)
ggccuggaggaggagcuccaguucagccugggguccaag

SEQ ID NO: 37751 - RNA, 51 nt, Artificial Sequence
  Complement C4-A (1353-1369)
ggccuggaggaggagcuccaguucagccugggguccaagaucaacgugaag

SEQ ID NO: 37752 - RNA, 69 nt, Artificial Sequence
  Collagen alpha-1(XIX) chain (351-373)
ggccugaagggggacaagggcgagaccgggcuccccggcuucccggggagcgugggccccaagggccag

SEQ ID NO: 37753 - RNA, 60 nt, Artificial Sequence
  Neuronal tyrosine-phosphorylated phosphoinositide-3-kinase adapter 2 (33-52)
ggccuggugauccagaacgccagcgacaucgcccgcgagaacgaccggcuccgcaacgag

SEQ ID NO: 37754 - RNA, 60 nt, Artificial Sequence
  Kinesin-like protein KIF27 (84-103)
ggccagaccgggagcggcaagaccuacacgaucgggggcgggcacaucgccuccgugguc

SEQ ID NO: 37755 - RNA, 39 nt, Artificial Sequence
  Helicase SKI2W (705-717)
ggccgccgggggcuggaccccaccggcaccgugauccuc

SEQ ID NO: 37756 - RNA, 30 nt, Artificial Sequence
  E3 ubiquitin-protein ligase HUWE1 (757-766)
ggcaccgaggagcgcauccccaucccgcug

SEQ ID NO: 37757 - RNA, 39 nt, Artificial Sequence
  Ankyrin repeat domain-containing protein 11 (421-433)
ggcaccggggagaagcugcgccucagcgcccacaccauc

SEQ ID NO: 37758 - RNA, 39 nt, Artificial Sequence
  US7745391-778469 (29-41)
ggcguggcccuggccccccgcccgcucgggaccagcuuc

SEQ ID NO: 37759 - RNA, 51 nt, Artificial Sequence
  Meprin A subunit beta (617-633)
ggcgugugcaccguccgcgacgggaaggccgagugccggugccagagcggc

SEQ ID NO: 37760 - RNA, 87 nt, Artificial Sequence
  F-box/LRR-repeat protein 4 (227-255)
ggcgugaaggacaagcccguccugagccucaagaccucccugaucgacaugaacgacaucgaggacgacgccuacgccgagaaggac

SEQ ID NO: 37761 - RNA, 42 nt, Artificial Sequence
  PHD finger protein 14 (609-622)
cacuucggcugccuggaccccccgcucaagaagagccccaag

SEQ ID NO: 37762 - RNA, 45 nt, Artificial Sequence
  Arylsulfatase E (503-517)
caccagcgcacccugagccccgugccgcuccagcuggaccggcug

SEQ ID NO: 37763 - RNA, 51 nt, Artificial Sequence
  NACHT, LRR and PYD domains-containing protein 9 (146-162)
cacaccgugguccuggagggccccgacgggaucggcaagaccacgcuccug

SEQ ID NO: 37764 - RNA, 33 nt, Artificial Sequence
  60S ribosomal protein L8 (31-41)
aucgccgccgagggcauccacaccgggcaguuc

SEQ ID NO: 37765 - RNA, 48 nt, Artificial Sequence
  Kelch-like protein 2 (479-494)
aucgccgagaugagcacccgccgguccggcgccggggugggcguccug

SEQ ID NO: 37766 - RNA, 36 nt, Artificial Sequence
  Protein RER1 (80-91)
aucgccuuccugagccccaagguggacccgucccuc

SEQ ID NO: 37767 - RNA, 39 nt, Artificial Sequence
  Peptidyl-prolyl cis-trans isomerase A (10-22)
aucgccguggacggcgagccccuggggcgcgucagcuuc

SEQ ID NO: 37768 - RNA, 42 nt, Artificial Sequence
  Dedicator of cytokinesis protein 4 (1742-1755)
aucggcgacggggcccugccccgcagcgacccgaaccucucc

SEQ ID NO: 37769 - RNA, 30 nt, Artificial Sequence
  L-lactate dehydrogenase A-like 6B (183-192)
aucaucgugagcaaccccgucgacauccug

SEQ ID NO: 37770 - RNA, 60 nt, Artificial Sequence
  Carboxy-terminal domain RNA polymerase II polypeptide A small phosphatase 2 (215-234)
auccuggacaacagccccgccuccuacguguuccacaccgagaacgccgucccggugcag

SEQ ID NO: 37771 - RNA, 39 nt, Artificial Sequence
  Heat shock cognate 71 kDa protein (379-391)
auccugagcggcgacaaguccgagaacgugcaggaccuc

SEQ ID NO: 37772 - RNA, 63 nt, Artificial Sequence
  Poly(rC)-binding protein 2 (38-58)
aucaacaucagcgagggcaacugccccgagcgcaucaucacccuggccgggccgaccaacgcc

SEQ ID NO: 37773 - RNA, 36 nt, Artificial Sequence
  Diacylglycerol O-acyltransferase 2 (253-264)
auccccaagcuggagcacccgacccagcaggacauc

SEQ ID NO: 37774 - RNA, 45 nt, Artificial Sequence
  Elongation factor 1-alpha 1 (115-129)
aucguggccgccggcgucggggaguucgaggcgggcaucagcaag

SEQ ID NO: 37775 - RNA, 51 nt, Artificial Sequence
  Macrophage migration inhibitory factor (3-19)
aucgugaacaccaacgucccccgcgccagcgugccggacggcuuccugucc

SEQ ID NO: 37776 - RNA, 30 nt, Artificial Sequence
  L-lactate dehydrogenase A chain (135-144)
aucgugagcaaccccgucgacauccugacc

SEQ ID NO: 37777 - RNA, 48 nt, Artificial Sequence
  Fructose-bisphosphate aldolase A (153-168)
aagaucggcgagcacacccccagcgcccuggccaucauggagaacgcg

SEQ ID NO: 37778 - RNA, 33 nt, Artificial Sequence
  PWWP domain-containing protein 2B (191-201)
aagauccccagccgcgugcacggcucccuggag

SEQ ID NO: 37779 - RNA, 51 nt, Artificial Sequence
  DNA mismatch repair protein Mlh3 (135-151)
aagcugcucagcuccacccugauccccccgcuggagaucaccgugacggag

SEQ ID NO: 37780 - RNA, 36 nt, Artificial Sequence
  Cathepsin K (314-325)
aagaacaacgccugcggcaucgccaaccuggcgagc

SEQ ID NO: 37781 - RNA, 51 nt, Artificial Sequence
  Integrator complex subunit 12 (329-345)
aagcccgugggccugaccgggcucgccaccagcuccaagggcgggaucggc

SEQ ID NO: 37782 - RNA, 39 nt, Artificial Sequence
  Synaptojanin-1 (1453-1465)
aagagccgcgccuccagcucccuggacggcuucaaggac

SEQ ID NO: 37783 - RNA, 39 nt, Artificial Sequence
  Thymidylate synthase (284-296)
aagguggagaagaucgacgacuucaaggccgaggacuuc

SEQ ID NO: 37784 - RNA, 30 nt, Artificial Sequence
  Zinc finger MYND domain-containing protein 15 (138-147)
aagguggagcccgaggaggaccgcgagcug

SEQ ID NO: 37785 - RNA, 36 nt, Artificial Sequence
  Glyceraldehyde-3-phosphate dehydrogenase (219-230)
aaggugauccccgagcugaacggcaagcucaccggg

SEQ ID NO: 37786 - RNA, 39 nt, Artificial Sequence
  Alpha-enolase (343-355)
aaggugaaccagaucggcagcgucaccgagucccugcag

SEQ ID NO: 37787 - RNA, 45 nt, Artificial Sequence
  Histone H2A type 2-A (100-114)
aaggugaccaucgcccagggcgggguccugcccaacauccaggcc

SEQ ID NO: 37788 - RNA, 27 nt, Artificial Sequence
  D-dopachrome decarboxylase (89-97)
cuggcccucggccaggaccgcauccug

SEQ ID NO: 37789 - RNA, 33 nt, Artificial Sequence
  Acidic fibroblast growth factor intracellular-binding protein (169-179)
cuggcccgcgacuacgccgcgaucguguucuuc

SEQ ID NO: 37790 - RNA, 54 nt, Artificial Sequence
  FAST kinase domain-containing protein 1 (497-514)
cuggaccuccugcgcaaggagcugaagagccucaagggcaacaccuuccccgag

SEQ ID NO: 37791 - RNA, 42 nt, Artificial Sequence
  F-box only protein 41 (284-297)
cuggagagccuccugaaggccgccggcgggaaccugcucauc

SEQ ID NO: 37792 - RNA, 30 nt, Artificial Sequence
  Eukaryotic initiation factor 4A-III (110-119)
cugauccucgcccccacccgcgagcuggcc

SEQ ID NO: 37793 - RNA, 39 nt, Artificial Sequence
  Alpha-enolase (342-354)
cugaaggugaaccagaucggcagcgucaccgagucccuc

SEQ ID NO: 37794 - RNA, 33 nt, Artificial Sequence
  Threonine synthase-like 1 (295-305)
cugcucgagcgcugcauccaccccgccgacauc

SEQ ID NO: 37795 - RNA, 30 nt, Artificial Sequence
  Beta-1,4-galactosyltransferase 7 (20-29)
cugcucagcggcgggcugccccgcaagugc

SEQ ID NO: 37796 - RNA, 30 nt, Artificial Sequence
  Protein S100-A11 (40-49)
cugagcuucaugaacaccgagcucgccgcc

SEQ ID NO: 37797 - RNA, 45 nt, Artificial Sequence
  4F2 cell-surface antigen heavy chain (496-510)
cugagcacccagcccggccgcgaggagggguccccgcucgagcug

SEQ ID NO: 37798 - RNA, 36 nt, Artificial Sequence
  L-lactate dehydrogenase A chain (254-265)
cugagcguggccgaccucgccgaguccaucaugaag

SEQ ID NO: 37799 - RNA, 27 nt, Artificial Sequence
  Complement C4-A (1202-1210)
cugaccaaggcccccguggaccuccug

SEQ ID NO: 37800 - RNA, 36 nt, Artificial Sequence
  Usherin (3700-3711)
cuguacuggagccuccccgagaagccgaacggccug

SEQ ID NO: 37801 - RNA, 33 nt, Artificial Sequence
  Phosphopantothenoylcysteine decarboxylase (1-11)
auggagcccaaggccagcugcccggccgcggcc

SEQ ID NO: 37802 - RNA, 42 nt, Artificial Sequence
  DEAD/H box polypeptide 11 like 12 (1-14)
augggccugaucugccgcgaccccgccaccaaggugaagccg

SEQ ID NO: 37803 - RNA, 39 nt, Artificial Sequence
  Elongation factor 1-alpha 1 (201-213)
augcuggagcccagcgccaacaugccgugguucaagggc

SEQ ID NO: 37804 - RNA, 42 nt, Artificial Sequence
  Transgelin-2 (130-143)
augaaccugggcgggcucgccguggcccgcgacgacggccug

SEQ ID NO: 37805 - RNA, 30 nt, Artificial Sequence
  Nucleoside diphosphate kinase B (76-85)
auggugugggagggccugaacgucgugaag

SEQ ID NO: 37806 - RNA, 33 nt, Artificial Sequence
  Endoplasmic reticulum aminopeptidase 2 (861-869)
aacgccaucagccgcauccccaagggccaggug

SEQ ID NO: 37807 - RNA, 60 nt, Artificial Sequence
  Wiskott-Aldrich syndrome protein (262-281)
aaccuggaccccgaccuccgcagccuguucucccgggccggcaucagcgaggcccagcug

SEQ ID NO: 37808 - RNA, 27 nt, Artificial Sequence
  Cartilage intermediate layer protein 1 (779-787)
aaccuggagccccgcaccggcuuccuc

SEQ ID NO: 37809 - RNA, 27 nt, Artificial Sequence
  Probable phosphoglycerate mutase 4 (209-217)
aaccugcccaccggcaucccgaucgug

SEQ ID NO: 37810 - RNA, 42 nt, Artificial Sequence
  Nuclear receptor subfamily 1 group D member 1 (343-356)
aacaacacccuggccgcccagcgccacaacgaggcgcucaac

SEQ ID NO: 37811 - RNA, 54 nt, Artificial Sequence
  Tumor protein D52 (212-229)
aacagcgccgccaacgcguccgccaccaccacggagccccugccggagaagacc

SEQ ID NO: 37812 - RNA, 60 nt, Artificial Sequence
  Tumor protein D52 (212-231)
aacagcgccgccaacgcguccgccaccaccacggagccccugccggagaagacccaggag

SEQ ID NO: 37813 - RNA, 69 nt, Artificial Sequence
  Replication initiator 1 (10-32)
cccgccgccgaggugcgcccgggccaggggcggggcgcgaccgccgggccccgcggcgccgcccccccc

SEQ ID NO: 37814 - RNA, 45 nt, Artificial Sequence
  Histidine protein methyltransferase 1 homolog (142-156)
cccggcgagaacaucgugagcaaguccuucagcucccacagcgac

SEQ ID NO: 37815 - RNA, 57 nt, Artificial Sequence
  Glutaredoxin-2, mitochondrial (32-50)
cccggccgcacccggagcgccgcccgccggauggaguccaacaccagcuccagccug

SEQ ID NO: 37816 - RNA, 57 nt, Artificial Sequence
  Insulin receptor substrate 2 (989-1007)
cccaagccgggcgcccccagcgggcaccccgugggcucccuggacgggcuccugagc

SEQ ID NO: 37817 - RNA, 33 nt, Artificial Sequence
  Polycystin-1 (4192-4202)
cagcuggacggccucagcgugucccuggggcgc

SEQ ID NO: 37818 - RNA, 33 nt, Artificial Sequence
  Keratin, type II cytoskeletal 8 (226-236)
cagcuguacgaggaggagauccgcgagcuccag

SEQ ID NO: 37819 - RNA, 93 nt, Artificial Sequence
  Cilia- and flagella-associated protein 52 (145-175)
cgcgacgccaucugcggcagccccgccgcggggcugaacgugggcaacgccaccaacgucaucuucucccggugccgcgacgagauguucaug

SEQ ID NO: 37820 - RNA, 45 nt, Artificial Sequence
  Histone H3.3 (84-98)
cgcuuccagagcgccgccaucggcgcgcugcaggaggccuccgag

SEQ ID NO: 37821 - RNA, 78 nt, Artificial Sequence
  keratin 8, isoform CRA (125-150)
cgcggcgggcugggcgggggcuacgggggcgccagcggcauggggggcaucaccgccgugauggucaaccagaaccuc

SEQ ID NO: 37822 - RNA, 33 nt, Artificial Sequence
  Oxysterol-binding protein 2 (60-70)
cgcggcaccaucaaccugagcaccgcccacauc

SEQ ID NO: 37823 - RNA, 39 nt, Artificial Sequence
  F-actin-capping protein subunit alpha-2 (100-112)
cgcaaggaggccaccgacccccggccgugcgagguggag

SEQ ID NO: 37824 - RNA, 57 nt, Artificial Sequence
  kelch repeat and BTB domain-containing protein 6 (1-18)
cgcaaggugcugcgggaggacgaccccagcuccguccgccucgccagcccguccagc

SEQ ID NO: 37825 - RNA, 42 nt, Artificial Sequence
  UV excision repair protein RAD23 homolog B (268-281)
cgccagaucauccagcagaaccccagccugcucccggcccug

SEQ ID NO: 37826 - RNA, 72 nt, Artificial Sequence
  Protein boule-like (35-58)
agcgccccccgcuacggcaccgugaucccgaaccggaucuucgucgggggcaucgacuucaagaccaacgag

SEQ ID NO: 37827 - RNA, 54 nt, Artificial Sequence
  Beta-1,3-galactosyltransferase 6 (23-40)
agcgcccagccccugcgcgacgcccggugcgcgcucgccccgggcgacccccgc

SEQ ID NO: 37828 - RNA, 39 nt, Artificial Sequence
  Structure-specific endonuclease subunit SLX4 (603-615)
agcgccucccagcgcgagcaccaggcccugcaggaccuc

SEQ ID NO: 37829 - RNA, 45 nt, Artificial Sequence
  Elongation factor 1-alpha 1 (396-410)
agcggcgacgccgccaucguggacaugguccccgggaagccgaug

SEQ ID NO: 37830 - RNA, 39 nt, Artificial Sequence
  Fructose-bisphosphate aldolase A (272-284)
agcggcgggcaguccgaggaggaggccagcaucaaccug

SEQ ID NO: 37831 - RNA, 42 nt, Artificial Sequence
  Sodium-coupled monocarboxylate transporter 2 (343-356)
agcggcacccuguccaccguggccagcuccaucaacgcccuc

SEQ ID NO: 37832 - RNA, 39 nt, Artificial Sequence
  Poly(rC)-binding protein 1 (223-235)
agcauccagggccagcacaccaucuccccccuggaccuc

SEQ ID NO: 37833 - RNA, 51 nt, Artificial Sequence
  DNA ligase 3 (790-806)
agcaaguccgaggcccacaccgccgacggcaucagcauccgcuucccccgg

SEQ ID NO: 37834 - RNA, 36 nt, Artificial Sequence
  Keratin, type II cytoskeletal 8 (253-264)
agccuggacauggacuccaucaucgccgaggugaag

SEQ ID NO: 37835 - RNA, 36 nt, Artificial Sequence
  Rabenosyn-5 (541-552)
agccugcacacccgcacccggucccucgacuuccgc

SEQ ID NO: 37836 - RNA, 36 nt, Artificial Sequence
  Leucine-rich repeat-containing protein 28 (186-197)
agcauggccggcaaccgccuggccuuccucccccug

SEQ ID NO: 37837 - RNA, 30 nt, Artificial Sequence
  NUAK family SNF1-like kinase 2 (446-455)
agcaaccugaagcuccccaagggcauccug

SEQ ID NO: 37838 - RNA, 36 nt, Artificial Sequence
  Keratin, type I cytoskeletal 18 (272-283)
agccagcagaucgaggaguccaccaccguggucacg

SEQ ID NO: 37839 - RNA, 66 nt, Artificial Sequence
  Striated muscle preferentially expressed protein kinase isoform X10 (928-946)
agccaggugcugcgcgagggcuccaaggccgggggcgggacccuccugugccugccccucgccgag

SEQ ID NO: 37840 - RNA, 30 nt, Artificial Sequence
  Vimentin (72-81)
agcuccgugcccggcguccgccugcuccag

SEQ ID NO: 37841 - RNA, 42 nt, Artificial Sequence
  4F2 cell-surface antigen heavy chain (497-510)
agcacccagcccggccgcgaggagggguccccgcuggagcuc

SEQ ID NO: 37842 - RNA, 51 nt, Artificial Sequence
  Laminin subunit alpha-4 (1023-1039)
agcaccuccgugcccugcgcccgcgacaagcuggccuucacccagagccgg

SEQ ID NO: 37843 - RNA, 39 nt, Artificial Sequence
  Otoferlin (965-977)
accgagcugcgcgugaucaucggcaagccccuccugagc

SEQ ID NO: 37844 - RNA, 42 nt, Artificial Sequence
  Procollagen-lysine,2-oxoglutarate 5-dioxygenase 1 (388-401)
accgagcccaacagccugcgccuccugauccagcagaacaag

SEQ ID NO: 37845 - RNA, 51 nt, Artificial Sequence
  Galectin-1 (71-87)
accgagcagcgcgaggccguguuccccuuccagccgggcagcgucgccgag

SEQ ID NO: 37846 - RNA, 57 nt, Artificial Sequence
  Ovochymase-1 (314-332)
accaaggcccugagcuccgugcaggaggucaacggcagccagcgcgggaagggcauc

SEQ ID NO: 37847 - RNA, 72 nt, Artificial Sequence
  Envoplakin (1400-1423)
acccagaaggaccccaagcugcgcgaggagcacagccggcucuccggcagccuggacgaggagguggggcgc

SEQ ID NO: 37848 - RNA, 36 nt, Artificial Sequence
  Neuron navigator 2 (450-461)
accaccgugggccccgccagcuccagcccgaagauc

SEQ ID NO: 37849 - RNA, 57 nt, Artificial Sequence
  Bifunctional heparan sulfate N-deacetylase/N-sulfotransferase 3 isoform X3 (310-335)
guggccauccuggucagcaaggagggcgcccgcauggggcucgacacccacaccccc

SEQ ID NO: 37850 - RNA, 36 nt, Artificial Sequence
  VIP peptides (52-63)
guguucaccgacaacuacacccgccugcggaagcag

SEQ ID NO: 37851 - RNA, 27 nt, Artificial Sequence
  60S acidic ribosomal protein P2 (54-62)
gugaucgcccagggcaucgggaagcug

SEQ ID NO: 37852 - RNA, 54 nt, Artificial Sequence
  Elongation factor 1-alpha 1 (344-361)
gugaucauccugaaccaccccggccagaucagcgccggguacgccccgguccuc

SEQ ID NO: 37853 - RNA, 51 nt, Artificial Sequence
  Activin receptor type-2A (262-278)
gugcuggagggcgccaucaacuuccagcgcgacgccuuccuccggaucgac

SEQ ID NO: 37854 - RNA, 57 nt, Artificial Sequence
  Serine/threonine-protein phosphatase with EF-hands 1 (308-326)
gugcugauccccccgaccgagaccaaccgcgaccacgacacggacagcaagcacaac

SEQ ID NO: 37855 - RNA, 33 nt, Artificial Sequence
  Galectin-1 (31-41)
gugcugaaccucggcaaggacagcaacaaccug

SEQ ID NO: 37856 - RNA, 39 nt, Artificial Sequence
  Profilin-1 (41-53)
gugaacaucacccccgccgaggucggcgugcuggugggg

SEQ ID NO: 37857 - RNA, 54 nt, Artificial Sequence
  Kin of IRRE-like protein 3 (402-419)
gugccccgcgucggcgccggggagcgggaggugacccugaccgugaacggcccg

SEQ ID NO: 37858 - RNA, 39 nt, Artificial Sequence
  Keratin, type II cytoskeletal 8 (66-78)
gugaccgucaaccagagccugcucuccccccuggugcug

SEQ ID NO: 37859 - RNA, 45 nt, Artificial Sequence
  Enhancer of rudimentary homolog (71-85)
guguaccgcgccgacacccagaccuaccagcccuacaacaaggac

SEQ ID NO: 37860 - RNA, 48 nt, Artificial Sequence
  Ankyrin repeat domain-containing protein 26 (168-183)
uacgacgccaacaucgaggccaagaacaaggacgaccugaccccccuc

SEQ ID NO: 37861 - RNA, 51 nt, Artificial Sequence
  78 kDa glucose-regulated protein (635-651)
uacggcagcgccgggcccccgcccaccggcgaggaggacaccgccgagaag

SEQ ID NO: 37862 - RNA, 57 nt, Artificial Sequence
  78 kDa glucose-regulated protein (635-653)
uacggcagcgccgggcccccgcccaccggcgaggaggacaccgccgagaaggacgag

SEQ ID NO: 37863 - RNA, 36 nt, Artificial Sequence
  Alpha-enolase (270-281)
uacaucagccccgaccagcuggccgaccucuacaag

SEQ ID NO: 37864 - RNA, 36 nt, Artificial Sequence
  Microsomal glutathione S-transferase 1 (121-132)
uaccugaccccccucccgcagcccaaccgcgcccug

SEQ ID NO: 37865 - RNA, 42 nt, Artificial Sequence
  Beta-actin-like protein 2 (8-21)
uacaacgagcugcgcguggcccccgacgagcacccgauccuc

SEQ ID NO: 37866 - RNA, 63 nt, Artificial Sequence
  Gamma-enolase (25-45)
uacaccgccaagggccuguuccgcgccgcggugcccagcggggccuccaccggcaucuacgag

SEQ ID NO: 37867 - RNA, 42 nt, Artificial Sequence
  Polypyrimidine tract-binding protein 1 (114-127)
uacaccagcgugacccccguccugcgcggccagccgaucuac

SEQ ID NO: 37868 - RNA, 27 nt, Artificial Sequence
  HLA class I histocompatibility antigen, B-13 alpha chain (26-34)
uacguggacgacacccaguucguccgc

SEQ ID NO: 37869 - RNA, 39 nt, Artificial Sequence
  Matrix-remodeling-associated protein 5 (34-46)
uacgugcccagcgagguccacugcaccuuccgcucccug

SEQ ID NO: 37870 - RNA, 27 nt, Artificial Sequence
  Flotillin-2 (156-164)
gacguguacgacaaggucgacuaccug

SEQ ID NO: 37871 - RNA, 27 nt, Artificial Sequence
  Gamma-adducin (305-313)
gaggccuuccacuacaucuucaacgug

SEQ ID NO: 37872 - RNA, 27 nt, Artificial Sequence
  Nucleoporin GLE1 (443-451)
gagaucuucgacaagauccacagccug

SEQ ID NO: 37873 - RNA, 27 nt, Artificial Sequence
  GRIP1-associated protein 1 (707-715)
gagguggccgagcuguuccagcgccuc

SEQ ID NO: 37874 - RNA, 27 nt, Artificial Sequence
  HMG domain-containing protein 3 (954-962)
gagguguucgcccugauccacgagcuc

SEQ ID NO: 37875 - RNA, 30 nt, Artificial Sequence
  Beta-hexosaminidase subunit beta (330-339)
gagguguuccccgaccaguucauccaccug

SEQ ID NO: 37876 - RNA, 27 nt, Artificial Sequence
  Selenide, water dikinase 2 (336-344)
gaggugagcuucgucauccacaaccug

SEQ ID NO: 37877 - RNA, 27 nt, Artificial Sequence
  ATPase family AAA domain-containing protein 1 (15-23)
gagguggucggccugaucuuccgccuc

SEQ ID NO: 37878 - RNA, 27 nt, Artificial Sequence
  MOB kinase activator 3A (64-72)
cacguggucgacuucuucaaccgcgug

SEQ ID NO: 37879 - RNA, 27 nt, Artificial Sequence
  Transmembraneoprotein NMB (539-547)
aagggccugagcguguuccucaaccgc

SEQ ID NO: 37880 - RNA, 33 nt, Artificial Sequence
  Cytochrome b-245 light chain (78-88)
aagcuguucggccccuucacccgcaacuacuac

SEQ ID NO: 37881 - RNA, 27 nt, Artificial Sequence
  Syntenin-1 (270-278)
augcccgccuucaucuucgagcacauc

SEQ ID NO: 37882 - RNA, 30 nt, Artificial Sequence
  Transcription factor 7-like 2 (366-375)
cgcgaggagcaggccaaguacuacgagcug

SEQ ID NO: 37883 - RNA, 27 nt, Artificial Sequence
  Tumor protein p63-regulated gene 1-like protein (59-67)
cgcgugaaggaguacuucgucuuccgg

SEQ ID NO: 37884 - RNA, 27 nt, Artificial Sequence
  Clathrin heavy chain 1 (1342-1350)
cgcgugaacauccccaagguccugcgg

SEQ ID NO: 37885 - RNA, 30 nt, Artificial Sequence
  COP9 signalosome complex subunit 6 (311-320)
gugcuguacgaccgccagggcaucgggcgg

SEQ ID NO: 37886 - RNA, 54 nt, Artificial Sequence
  GTP-binding nuclear protein Ran (203-220)
gcccccccggagguggucauggaccccgcccuggcggcccaguacgagcacgac

SEQ ID NO: 37887 - RNA, 27 nt, Artificial Sequence
  Ubiquitin carboxyl-terminal hydrolase 48 (534-542)
gccgccgacaucuucuacagccgcuac

SEQ ID NO: 37888 - RNA, 27 nt, Artificial Sequence
  Transmembrane protein 141 (30-38)
gccuucaugaagggcguguucaccuuc

SEQ ID NO: 37889 - RNA, 30 nt, Artificial Sequence
  DNA replication licensing factor MCM4 (846-855)
gcccuggccgacgacgacuuccucaccgug

SEQ ID NO: 37890 - RNA, 27 nt, Artificial Sequence
  Protein FAM188B (498-506)
gcccuggccgacaucguguggcgcgcg

SEQ ID NO: 37891 - RNA, 27 nt, Artificial Sequence
  Protein TANC1 (1389-1397)
gcccuggccgaccuccaggaggcggug

SEQ ID NO: 37892 - RNA, 33 nt, Artificial Sequence
  Protein TANC1 (1389-1399)
gcccuggccgaccuccaggaggcggugaagcug

SEQ ID NO: 37893 - RNA, 27 nt, Artificial Sequence
  5-oxoprolinase (523-531)
gcccuggccgacgugguccacgaggcg

SEQ ID NO: 37894 - RNA, 27 nt, Artificial Sequence
  Nodal modulator 3 (459-467)
gcccuggccggcgugagcuucgagauc

SEQ ID NO: 37895 - RNA, 30 nt, Artificial Sequence
  Midasin (1405-1414)
gcccuggccaaccagaagcucuacagcgug

SEQ ID NO: 37896 - RNA, 27 nt, Artificial Sequence
  WD repeat-containing protein 36 (542-550)
gcccuggacgacuucagcaucuccgug

SEQ ID NO: 37897 - RNA, 30 nt, Artificial Sequence
  EP300-interacting inhibitor of differentiation 1 (85-94)
gcccuggacggcggguuccagaugcacuac

SEQ ID NO: 37898 - RNA, 27 nt, Artificial Sequence
  Elongation factor 2 (350-358)
gcccuggacaacuuccucgacaagcug

SEQ ID NO: 37899 - RNA, 27 nt, Artificial Sequence
  Inverted formin-2 (131-139)
gcccuggacaccagcaacgugaugguc

SEQ ID NO: 37900 - RNA, 33 nt, Artificial Sequence
  Keratinocyte-associated protein 2 (108-118)
gcccuguucgccagcggccucauccaccgcgug

SEQ ID NO: 37901 - RNA, 36 nt, Artificial Sequence
  Exportin-2 (684-695)
gcccuguucccccaccuccugcagccggugcugugg

SEQ ID NO: 37902 - RNA, 24 nt, Artificial Sequence
  Activating signal cointegrator 1 complex subunit 3 (627-634)
gcccugggcaccgugaccaacguc

SEQ ID NO: 37903 - RNA, 27 nt, Artificial Sequence
  Replication factor C subunit 5 (276-284)
gcccugcacgacauccucaccgagauc

SEQ ID NO: 37904 - RNA, 30 nt, Artificial Sequence
  Tryptophan-tRNA ligase, cytoplasmic (433-442)
gcccugaucgaggugcuccagccccugauc

SEQ ID NO: 37905 - RNA, 30 nt, Artificial Sequence
  Tight junction protein ZO-1 (692-701)
gcccugcucgacgugacccccaacgccguc

SEQ ID NO: 37906 - RNA, 27 nt, Artificial Sequence
  Polypeptide N-acetylgalactosaminyltransferase 2 (185-193)
gcccugcucggcaagaucgagaaggug

SEQ ID NO: 37907 - RNA, 27 nt, Artificial Sequence
  Bifunctional glutamate/proline-tRNA ligase (218-226)
gcccugcucaaccagcacuaccaggug

SEQ ID NO: 37908 - RNA, 27 nt, Artificial Sequence
  LEM domain-containing protein 2 (70-78)
gcccugcucaccgccgugaccaacguc

SEQ ID NO: 37909 - RNA, 30 nt, Artificial Sequence
  Nuclear pore complex protein Nup205 (494-503)
gcccugcucaccggcaucaucagcaaggcc

SEQ ID NO: 37910 - RNA, 30 nt, Artificial Sequence
  LYST-interacting protein LIP6 (84-93)
gcccugauggacggcaagguguacgacauc

SEQ ID NO: 37911 - RNA, 33 nt, Artificial Sequence
  Leishmanolysin-like peptidase (353-363)
gcccugauggaggacaccggccgccagaugcuc

SEQ ID NO: 37912 - RNA, 27 nt, Artificial Sequence
  Kinesin-like protein KIF7 (91-99)
gcccugaacgaggacaucgugcgcguc

SEQ ID NO: 37913 - RNA, 27 nt, Artificial Sequence
  40S ribosomal protein S12 (17-25)
gcccugcaggaggugcucaagaccgcc

SEQ ID NO: 37914 - RNA, 27 nt, Artificial Sequence
  Anthrax toxin receptor 1 (207-215)
gcccugcagggcaucauccacagcauc

SEQ ID NO: 37915 - RNA, 30 nt, Artificial Sequence
  Probable ATP-dependent RNA helicase DDX5 (128-137)
gcccugagcggccucgacaugguggggguc

SEQ ID NO: 37916 - RNA, 27 nt, Artificial Sequence
  Actin-related protein 2/3 complex subunit 1A (24-32)
gcccugagccccaacaaccacgaggug

SEQ ID NO: 37917 - RNA, 27 nt, Artificial Sequence
  DNA-dependent protein kinase catalytic subunit (3134-3142)
gcccugaccgagauccaggaguucauc

SEQ ID NO: 37918 - RNA, 27 nt, Artificial Sequence
  Annexin A1 (99-107)
gcccugaccggccaccucgaggaggug

SEQ ID NO: 37919 - RNA, 30 nt, Artificial Sequence
  Cyclin-dependent kinase 2 (95-104)
gcccugaccggcaucccccucccgcugauc

SEQ ID NO: 37920 - RNA, 30 nt, Artificial Sequence
  Staphylococcal nuclease domain-containing protein 1 (428-437)
gcccuggugagcaagggccucgccaccguc

SEQ ID NO: 37921 - RNA, 27 nt, Artificial Sequence
  Nicotinate-nucleotide pyrophosphorylase (carboxylating) (45-53)
gcccugugggccaagagccccggcgug

SEQ ID NO: 37922 - RNA, 33 nt, Artificial Sequence
  Guanine nucleotide-binding protein G(I)/G(S)/G(T) subunit beta-1 (74-84)
gcccugugggacaucgagaccggccagcagacc

SEQ ID NO: 37923 - RNA, 27 nt, Artificial Sequence
  Centrosome-associated protein CEP250 (656-664)
gcccugugggagaagaacacccaccuc

SEQ ID NO: 37924 - RNA, 36 nt, Artificial Sequence
  Nuclear pore complex protein Nup160 (372-383)
gcccuguggcacgacgccgagaaccagaccgugguc

SEQ ID NO: 37925 - RNA, 36 nt, Artificial Sequence
  Tyrosine-protein kinase JAK1 (79-90)
gcccuguacgacgagaacaccaagcucugguacgcc

SEQ ID NO: 37926 - RNA, 33 nt, Artificial Sequence
  Caskin-2 (147-157)
gcccuguacggcaagaccgaggugguccgccuc

SEQ ID NO: 37927 - RNA, 27 nt, Artificial Sequence
  Probable dolichyl pyrophosphate Glc1Man9GlcNAc2 alpha-1,3-glucosyltransferase (287-295)
gcccuguacaacgcccucgacaaggug

SEQ ID NO: 37928 - RNA, 27 nt, Artificial Sequence
  Nuclear pore complex protein Nup155 (1038-1046)
gcccuguacaacuggcucauccaggug

SEQ ID NO: 37929 - RNA, 39 nt, Artificial Sequence
  Lysine-tRNA ligase (583-595)
gccauguuccugaccgacagcaacaacaucaaggaggug

SEQ ID NO: 37930 - RNA, 27 nt, Artificial Sequence
  Protein GPR107 (189-197)
gccaugggcgagaagagcuucuccgug

SEQ ID NO: 37931 - RNA, 27 nt, Artificial Sequence
  Probable cation-transporting ATPase 13A3 (829-837)
gccaugaacggcaagagcuucuccgug

SEQ ID NO: 37932 - RNA, 27 nt, Artificial Sequence
  Protein Wnt-5a (20-28)
gccaugagcuccaaguucuuccuggug

SEQ ID NO: 37933 - RNA, 24 nt, Artificial Sequence
  Syndecan-4 (2-9)
gcccccgcccgccuguucgcgcuc

SEQ ID NO: 37934 - RNA, 27 nt, Artificial Sequence
  Dehydrogenase/reductase SDR family member 4 (110-118)
gcccccggccugaucaagaccagcuuc

SEQ ID NO: 37935 - RNA, 27 nt, Artificial Sequence
  Filamin-A (1687-1695)
gccccccagccgggcaaguacgugauc

SEQ ID NO: 37936 - RNA, 27 nt, Artificial Sequence
  U1 small nuclear ribonucleoprotein 70 kDa (14-22)
gccccccgcgacccgauccccuaccug

SEQ ID NO: 37937 - RNA, 27 nt, Artificial Sequence
  Vacuolar protein sorting-associated protein 16 homolog (41-49)
gcccccuacggcgggccgaucgcccug

SEQ ID NO: 37938 - RNA, 27 nt, Artificial Sequence
  Fatty acid desaturase 1 (12-20)
gcccagggccccaccccgcgcuacuuc

SEQ ID NO: 37939 - RNA, 30 nt, Artificial Sequence
  Elongation factor 1-gamma (19-28)
gcccaguacagcggcgcccaggugcgcguc

SEQ ID NO: 37940 - RNA, 30 nt, Artificial Sequence
  Serine/threonine-protein kinase SMG1 (35-44)
gccagcgccgaccccgacaaccugaaguac

SEQ ID NO: 37941 - RNA, 30 nt, Artificial Sequence
  RalBP1-associated Eps domain-containing protein 1 (609-618)
gccagcgaccccgccuccagccugcgcgug

SEQ ID NO: 37942 - RNA, 30 nt, Artificial Sequence
  Tryptophan-tRNA ligase, cytoplasmic (352-361)
gccagcgaccccaacuccagcaucuuccug

SEQ ID NO: 37943 - RNA, 39 nt, Artificial Sequence
  Extended synaptotagmin-2 (868-880)
gccagcgaggagcuggccaagggcuggacccagugguac

SEQ ID NO: 37944 - RNA, 30 nt, Artificial Sequence
  Alpha-enolase (78-87)
gccagcgaguucuuccgcuccggcaaguac

SEQ ID NO: 37945 - RNA, 36 nt, Artificial Sequence
  Unconventional myosin-Ib (243-254)
gccagcgagcuguucaaggacaagaaggcccucuac

SEQ ID NO: 37946 - RNA, 36 nt, Artificial Sequence
  Protein-glutamate O-methyltransferase (421-432)
gccagcgagcccuccugguggaccaccggcaaguac

SEQ ID NO: 37947 - RNA, 24 nt, Artificial Sequence
  Keratinocyte-associated protein 2 (111-118)
gccagcggccugauccaccgcgug

SEQ ID NO: 37948 - RNA, 30 nt, Artificial Sequence
  Cadherin-5 (339-348)
gccaccgaccccaccaucgaccugcgcuac

SEQ ID NO: 37949 - RNA, 30 nt, Artificial Sequence
  Mitogen-activated protein kinase kinase kinase MLT (111-120)
gccaccgacguggccaagggcaugcacuac

SEQ ID NO: 37950 - RNA, 33 nt, Artificial Sequence
  Mitogen-activated protein kinase kinase kinase MLT (111-121)
gccaccgacguggccaagggcaugcacuaccug

SEQ ID NO: 37951 - RNA, 30 nt, Artificial Sequence
  Coatomer subunit beta' (480-489)
gccaccgaggagagcuucuucauccugaag

SEQ ID NO: 37952 - RNA, 36 nt, Artificial Sequence
  Rho GTPase-activating protein 5 (908-919)
gccaccgagaucaccgccaaguucacggcgcuguac

SEQ ID NO: 37953 - RNA, 27 nt, Artificial Sequence
  Transcription initiation protein SPT3 homolog (109-117)
gccaccgagcugcagagcaugauguac

SEQ ID NO: 37954 - RNA, 27 nt, Artificial Sequence
  Clathrin heavy chain 1 (1626-1634)
gccaccgagacccagcccaucguguac

SEQ ID NO: 37955 - RNA, 27 nt, Artificial Sequence
  HEAT repeat-containing protein 5A (1311-1319)
gccgugaagcugcccggcgggcagcuc

SEQ ID NO: 37956 - RNA, 33 nt, Artificial Sequence
  L-lactate dehydrogenase B chain (200-210)
gccguguggagcggcgucaacguggccggggug

SEQ ID NO: 37957 - RNA, 30 nt, Artificial Sequence
  Myotrophin (75-84)
gccguguacgagggccacgucagcugcgug

SEQ ID NO: 37958 - RNA, 30 nt, Artificial Sequence
  Ubiquitin carboxyl-terminal hydrolase 11 (318-327)
gccuacgccgaccuggugaagcaggcgugg

SEQ ID NO: 37959 - RNA, 27 nt, Artificial Sequence
  Phosphoinositide 3-kinase regulatory subunit 4 (481-489)
gccuacgccgagaacaucgcgcugcuc

SEQ ID NO: 37960 - RNA, 27 nt, Artificial Sequence
  Solute carrier family 26 member 6 (67-75)
gccuacgcccugcuccugcagcaccug

SEQ ID NO: 37961 - RNA, 27 nt, Artificial Sequence
  CD109 antigen (1146-1154)
gccuacgcccugcucagccacuuccug

SEQ ID NO: 37962 - RNA, 30 nt, Artificial Sequence
  Stress-induced-phosphoprotein 1 (349-358)
gccuacgcccgcaucggcaacagcuacuuc

SEQ ID NO: 37963 - RNA, 27 nt, Artificial Sequence
  Nuclear receptor coactivator 7 (730-738)
gccuacgccacccaccccuucaaguuc

SEQ ID NO: 37964 - RNA, 27 nt, Artificial Sequence
  WD repeat-containing protein 36 (426-434)
gccuacuuccugaagcccaaggagcuc

SEQ ID NO: 37965 - RNA, 27 nt, Artificial Sequence
  Probable ATP-dependent RNA helicase DDX60 (93-101)
gccuacuucaacuuccccgagcugcuc

SEQ ID NO: 37966 - RNA, 27 nt, Artificial Sequence
  Liprin-alpha-4 (952-960)
gccuacggcgacaugaaccacgagugg

SEQ ID NO: 37967 - RNA, 30 nt, Artificial Sequence
  S-adenosylmethionine synthase isoform type-2 (376-385)
gccuacggccacuucgggcgcgacagcuuc

SEQ ID NO: 37968 - RNA, 27 nt, Artificial Sequence
  Mesoderm induction early response protein 1 (319-327)
gccuacggcaaggacuuccaccugauc

SEQ ID NO: 37969 - RNA, 27 nt, Artificial Sequence
  WD repeat-containing protein 36 (84-92)
gccuacggcaacguguucagcgccuuc

SEQ ID NO: 37970 - RNA, 27 nt, Artificial Sequence
  Kynurenine-oxoglutarate transaminase 3 (134-142)
gccuacggcagccuguucaacaccauc

SEQ ID NO: 37971 - RNA, 27 nt, Artificial Sequence
  Cleavage stimulation factor subunit 3 (440-448)
gccuacaucgacuaccugagccaccuc

SEQ ID NO: 37972 - RNA, 27 nt, Artificial Sequence
  Leucine-zipper-like transcriptional regulator 1 (75-83)
gccuacaaggacgccaucuacguguuc

SEQ ID NO: 37973 - RNA, 27 nt, Artificial Sequence
  Small subunit processome component 20 homolog (1114-1122)
gccuaccugcccaagauccuccagauc

SEQ ID NO: 37974 - RNA, 27 nt, Artificial Sequence
  Ubiquitin-like-conjugating enzyme ATG3 (65-73)
gccuaccugcccaccggcaagcaguuc

SEQ ID NO: 37975 - RNA, 33 nt, Artificial Sequence
  Elongation factor 2 (286-296)
gccuaccugcccgugaacgagagcuucggcuuc

SEQ ID NO: 37976 - RNA, 30 nt, Artificial Sequence
  Protein shisa-5 (128-137)
gccuacauggacgcccccaaggcggcccug

SEQ ID NO: 37977 - RNA, 30 nt, Artificial Sequence
  La-related protein 4B (250-259)
gccuacaacgacaacugguucaucaccuuc

SEQ ID NO: 37978 - RNA, 30 nt, Artificial Sequence
  Phosphatidylinositol-binding clathrin assembly protein (210-219)
gccuacaacgagggcaucaucaaccugcuc

SEQ ID NO: 37979 - RNA, 30 nt, Artificial Sequence
  Beta-hexosaminidase subunit alpha (194-203)
gccuacaacaagcugaacguguuccacugg

SEQ ID NO: 37980 - RNA, 27 nt, Artificial Sequence
  Cirhin (34-42)
gccuacaacaaccagagcaaccgccug

SEQ ID NO: 37981 - RNA, 27 nt, Artificial Sequence
  Cell adhesion molecule-related/down-regulated by oncogenes (193-201)
gccuacaaccccgugacccaccagcug

SEQ ID NO: 37982 - RNA, 30 nt, Artificial Sequence
  Ubiquitin-associated protein 2-like (267-276)
gccuaccccccggcccccuucaugcacauc

SEQ ID NO: 37983 - RNA, 33 nt, Artificial Sequence
  Cathepsin D (202-212)
gccuacccccgcaucagcgugaacaacguccug

SEQ ID NO: 37984 - RNA, 27 nt, Artificial Sequence
  Ras GTPase-activating-like protein IQGAP1 (794-802)
gccuaccaggaccgccuggccuaccuc

SEQ ID NO: 37985 - RNA, 27 nt, Artificial Sequence
  Ras GTPase-activating-like protein IQGAP3 (955-963)
gccuaccagcaccuguucuaccuccug

SEQ ID NO: 37986 - RNA, 27 nt, Artificial Sequence
  40S ribosomal protein S11 (9-17)
gccuaccagaagcagcccaccaucuuc

SEQ ID NO: 37987 - RNA, 27 nt, Artificial Sequence
  UDP-glucose:glycoprotein glucosyltransferase 2 (114-122)
gccuacagccccgccauccagauguuc

SEQ ID NO: 37988 - RNA, 27 nt, Artificial Sequence
  Breast cancer anti-estrogen resistance protein 3 (211-219)
gccuacagccgcgugcaguaccaguuc

SEQ ID NO: 37989 - RNA, 33 nt, Artificial Sequence
  Eukaryotic translation initiation factor 4 gamma 1 (168-178)
gccuacuaccccgcccagggcgugcagcaguuc

SEQ ID NO: 37990 - RNA, 27 nt, Artificial Sequence
  Heterogeneous nuclear ribonucleoprotein L (387-395)
ugccuguacggcaacguggagaagguc

SEQ ID NO: 37991 - RNA, 27 nt, Artificial Sequence
  Structural maintenance of chromosomes protein 4 (1136-1144)
gacgccgcccuggacuucaagaacgug

SEQ ID NO: 37992 - RNA, 27 nt, Artificial Sequence
  Phosphoacetylglucosamine mutase (288-296)
gacgccgacggccacuuccaccugauc

SEQ ID NO: 37993 - RNA, 27 nt, Artificial Sequence
  Nuclear cap-binding protein subunit 2 (93-101)
gacgccgagaacgccaugcgcuacauc

SEQ ID NO: 37994 - RNA, 30 nt, Artificial Sequence
  Ras-related protein Rab-14 (163-172)
gacgccuuccuggaggccgcgaagaagauc

SEQ ID NO: 37995 - RNA, 27 nt, Artificial Sequence
  Rho-associated protein kinase 1 (187-195)
gacgccauccacagcaugggcuucauc

SEQ ID NO: 37996 - RNA, 27 nt, Artificial Sequence
  Elongation factor 2 (348-356)
gacgcccugcuccagaugaucaccauc

SEQ ID NO: 37997 - RNA, 27 nt, Artificial Sequence
  SRR1-like protein (237-245)
gacgcccugagcaagauggugaucauc

SEQ ID NO: 37998 - RNA, 27 nt, Artificial Sequence
  Carnitine O-palmitoyltransferase 1, liver isoform (477-485)
gacgcccccaucguggcccaccugugg

SEQ ID NO: 37999 - RNA, 24 nt, Artificial Sequence
  ATP-binding cassette sub-family E member 1 (326-333)
gacgccagccugguguucaagguc

SEQ ID NO: 38000 - RNA, 30 nt, Artificial Sequence
  Glutamate receptor ionotropic, kainate 2 (325-334)
gacgccgugcacgucgugagcguggccguc

SEQ ID NO: 38001 - RNA, 27 nt, Artificial Sequence
  General transcription factor II-I repeat domain-containing protein 2B (818-826)
gacggccugaacuacauccccaagauc

SEQ ID NO: 38002 - RNA, 30 nt, Artificial Sequence
  HLA class I histocompatibility antigen, A-1 alpha chain (89-98)
gacggcagccacaccauccagaucauguac

SEQ ID NO: 38003 - RNA, 27 nt, Artificial Sequence
  Serine/threonine-protein kinase tousled-like 2 (313-321)
gacggcuacgccuuccagaaccugauc

SEQ ID NO: 38004 - RNA, 27 nt, Artificial Sequence
  Heterogeneous nuclear ribonucleoprotein L (411-419)
gacggcuacgccguggaccgcgccauc

SEQ ID NO: 38005 - RNA, 27 nt, Artificial Sequence
  T-complex protein 1 subunit epsilon (135-143)
gacggcuacgagcaggccgcccgcgug

SEQ ID NO: 38006 - RNA, 27 nt, Artificial Sequence
  Ribosomal protein S6 kinase alpha-1 (416-424)
gacggcuacguggucaaggagaccauc

SEQ ID NO: 38007 - RNA, 24 nt, Artificial Sequence
  DNA-directed RNA polymerase III subunit RPC3 (186-193)
gacauguaccuggugcccaagcuc

SEQ ID NO: 38008 - RNA, 27 nt, Artificial Sequence
  Cyclic AMP-responsive element-binding protein 3-like protein 2 (54-62)
gaccccuuccugagcgagaaguccgug

SEQ ID NO: 38009 - RNA, 33 nt, Artificial Sequence
  Tubulin beta chain (39-49)
gacagcgaccugcagcucgaccgcaucuccgug

SEQ ID NO: 38010 - RNA, 33 nt, Artificial Sequence
  Zinc finger MYND domain-containing protein 11 (140-150)
gacagcgagcaggccgacaucgcccgcaugcug

SEQ ID NO: 38011 - RNA, 24 nt, Artificial Sequence
  Negative elongation factor C/D (323-330)
gacaccgacaucagccugauccgc

SEQ ID NO: 38012 - RNA, 27 nt, Artificial Sequence
  Kinectin (454-462)
gacuacgcccgccuggugaacgagcuc

SEQ ID NO: 38013 - RNA, 27 nt, Artificial Sequence
  Enhancer of polycomb homolog 1 (423-431)
gacuacgacagcguguuccaccaccug

SEQ ID NO: 38014 - RNA, 27 nt, Artificial Sequence
  Histone deacetylase 1 (71-79)
gacuacaucaaguuccugcgcagcauc

SEQ ID NO: 38015 - RNA, 27 nt, Artificial Sequence
  Protein KIAA0100 (885-893)
gacuacccccgcuaccuguucgagauc

SEQ ID NO: 38016 - RNA, 27 nt, Artificial Sequence
  T-complex protein 1 subunit beta (509-517)
gaggccgccgaggugauccugcgcguc

SEQ ID NO: 38017 - RNA, 27 nt, Artificial Sequence
  DNA-dependent protein kinase catalytic subunit (1728-1736)
gaguuccccccgggcaccccccgcuuc

SEQ ID NO: 38018 - RNA, 33 nt, Artificial Sequence
  Nuclear protein 1 (26-36)
gagagcgaccuguacucccucgcccacagcuac

SEQ ID NO: 38019 - RNA, 30 nt, Artificial Sequence
  General transcription factor II-I (242-251)
gagagcgaggaccccgacuacuaccaguac

SEQ ID NO: 38020 - RNA, 39 nt, Artificial Sequence
  E3 ubiquitin-protein ligase HUWE1 (969-981)
gagagcgaggacuaccacuucuaccagggccugguguac

SEQ ID NO: 38021 - RNA, 27 nt, Artificial Sequence
  ATP-dependent RNA helicase DDX24 (571-579)
gagaccgacgagaaggacuucuaccug

SEQ ID NO: 38022 - RNA, 33 nt, Artificial Sequence
  Serrate RNA effector molecule homolog (86-96)
gagaccgaggccgugaagcgcuacaacgacuac

SEQ ID NO: 38023 - RNA, 30 nt, Artificial Sequence
  Probable ATP-dependent RNA helicase DDX56 (239-248)
gagaccgaggaggacaaguuccugcuccug

SEQ ID NO: 38024 - RNA, 30 nt, Artificial Sequence
  Complement C4-A (1516-1525)
gagaccgagggcccccacgugcugcucuac

SEQ ID NO: 38025 - RNA, 27 nt, Artificial Sequence
  Copine-1 (269-277)
gagaccgaguacagcuuccuggacuac

SEQ ID NO: 38026 - RNA, 27 nt, Artificial Sequence
  Melanoma-associated antigen 11 (252-260)
gagguggaccccaccagccacuccuac

SEQ ID NO: 38027 - RNA, 27 nt, Artificial Sequence
  General transcription factor 3C polypeptide 2 (329-337)
gaguggaucccccuggccuggaagugg

SEQ ID NO: 38028 - RNA, 33 nt, Artificial Sequence
  Influenza virus NS1A-binding protein (632-642)
gaguggagccccuacaccaagaucuuccaguuc

SEQ ID NO: 38029 - RNA, 27 nt, Artificial Sequence
  Zinc finger protein 318 (408-416)
gaguacgccaagauccacgaccugcuc

SEQ ID NO: 38030 - RNA, 27 nt, Artificial Sequence
  CLIP-associating protein 1 (358-366)
gaguacgacaacuucuuccagcaccug

SEQ ID NO: 38031 - RNA, 27 nt, Artificial Sequence
  Pericentrin (3305-3313)
gaguacauccaccaccuggaggugauc

SEQ ID NO: 38032 - RNA, 27 nt, Artificial Sequence
  Transcriptional regulator homolog RPD3 (72-80)
gaguacaucaaguuccugcgcagcauc

SEQ ID NO: 38033 - RNA, 30 nt, Artificial Sequence
  Rab GTPase-activating protein 1 (632-641)
gaguacauccccgaccuguacaaccacuuc

SEQ ID NO: 38034 - RNA, 27 nt, Artificial Sequence
  Gem-associated protein 4 (892-900)
gaguacauccaguucgugccccugcuc

SEQ ID NO: 38035 - RNA, 27 nt, Artificial Sequence
  Inhibitor of growth protein 5 (48-56)
gaguacaucagcaccgugaagacccug

SEQ ID NO: 38036 - RNA, 27 nt, Artificial Sequence
  Inositol polyphosphate multikinase (290-298)
gaguacaacaacaacuuccacgugcug

SEQ ID NO: 38037 - RNA, 27 nt, Artificial Sequence
  Sorting nexin-18 (463-471)
gaguaccagaaggugggccagagcuuc

SEQ ID NO: 38038 - RNA, 27 nt, Artificial Sequence
  Poly (ADP-ribose) polymerase 12 (509-517)
gaguaccagaagguguggaaccuguuc

SEQ ID NO: 38039 - RNA, 27 nt, Artificial Sequence
  Poly (ADP-ribose) polymerase 4 (584-592)
gaguaccgccccgaguucagcaacuuc

SEQ ID NO: 38040 - RNA, 27 nt, Artificial Sequence
  Ubiquitin-conjugating enzyme E2 K (161-169)
gaguacaccaagaagaucgagaaccug

SEQ ID NO: 38041 - RNA, 27 nt, Artificial Sequence
  Leucine-rich repeats and immunoglobulin-like domains protein 2 (560-568)
gaguacaccagcauccugcaccucuuc

SEQ ID NO: 38042 - RNA, 30 nt, Artificial Sequence
  HLA class I histocompatibility antigen, Cw-7 alpha chain (140-149)
uucgccuacgacggcaaggacuacaucgcc

SEQ ID NO: 38043 - RNA, 24 nt, Artificial Sequence
  60S ribosomal protein L3 (362-369)
uucaucgacaccaccagcaaguuc

SEQ ID NO: 38044 - RNA, 24 nt, Artificial Sequence
  Cysteine-rich protein 2-binding protein (155-162)
uucaucgagaagcacuggaccuuc

SEQ ID NO: 38045 - RNA, 27 nt, Artificial Sequence
  DNA replication licensing factor MCM5 (427-435)
uucaucauggagggcggggccauggug

SEQ ID NO: 38046 - RNA, 27 nt, Artificial Sequence
  60S acidic ribosomal protein P0 (108-116)
uuccuggccgaccccagcgccuucgug

SEQ ID NO: 38047 - RNA, 27 nt, Artificial Sequence
  Trifunctional enzyme subunit beta, mitochondrial (184-192)
uuccuggcccccgagcucccggccgug

SEQ ID NO: 38048 - RNA, 27 nt, Artificial Sequence
  Membrane-bound transcription factor site-2 protease (251-259)
uuccuggacgccacccucaccagcgug

SEQ ID NO: 38049 - RNA, 30 nt, Artificial Sequence
  Glucosylceramidase (172-181)
uuccuggacgccuacgccgagcacaagcuc

SEQ ID NO: 38050 - RNA, 27 nt, Artificial Sequence
  Neutral alpha-glucosidase AB (604-612)
uuccuggacgacggccacaccuucaac

SEQ ID NO: 38051 - RNA, 30 nt, Artificial Sequence
  Cytoplasmic dynein 2 heavy chain 1 (42-51)
uuccuggacgacggcaaccagaugcuccug

SEQ ID NO: 38052 - RNA, 27 nt, Artificial Sequence
  Thimet oligopeptidase (294-302)
uuccuggacgagcucgcccagaagcug

SEQ ID NO: 38053 - RNA, 27 nt, Artificial Sequence
  Regulatory-associated protein of mTOR (240-248)
uuccuggaccucggccccugggccgug

SEQ ID NO: 38054 - RNA, 27 nt, Artificial Sequence
  Protein FAM83H (343-351)
uuccuggaccccgaccgccacuuccuc

SEQ ID NO: 38055 - RNA, 30 nt, Artificial Sequence
  CAD protein (150-159)
uuccuggaccccaacgcccgcccgcucgug

SEQ ID NO: 38056 - RNA, 27 nt, Artificial Sequence
  DDB1- and CUL4-associated factor 12 (303-311)
uuccuggacccccgccagccgagcuac

SEQ ID NO: 38057 - RNA, 27 nt, Artificial Sequence
  Desmoplakin (1057-1065)
uuccuggaccagaaccuccagaaguac

SEQ ID NO: 38058 - RNA, 30 nt, Artificial Sequence
  Basic leucine zipper and W2 domain-containing protein 2 (51-60)
uuccuggacagcaccggcucccgccucgac

SEQ ID NO: 38059 - RNA, 27 nt, Artificial Sequence
  Exportin-1 (1034-1042)
uuccuggaggagcgcgagaucgcccuc

SEQ ID NO: 38060 - RNA, 30 nt, Artificial Sequence
  Creatine kinase M-type (192-201)
uuccuguucgacaagcccgugagcccgcuc

SEQ ID NO: 38061 - RNA, 27 nt, Artificial Sequence
  Ras-related GTP-binding protein C (226-234)
uuccuguucgacguggucagcaagauc

SEQ ID NO: 38062 - RNA, 33 nt, Artificial Sequence
  Nestin (43-53)
uuccuguuccccggcaccgagaaccaggagcuc

SEQ ID NO: 38063 - RNA, 33 nt, Artificial Sequence
  Unconventional myosin-Ib (362-372)
uuccuguucagcuccgaccaccucaucgagaug

SEQ ID NO: 38064 - RNA, 33 nt, Artificial Sequence
  Glycogen phosphorylase, liver form (525-535)
uuccugggcgacgacguguuccuccgcgagcug

SEQ ID NO: 38065 - RNA, 27 nt, Artificial Sequence
  Lysosomal alpha-glucosidase (139-147)
uuccugggccccgagccgaagagcgug

SEQ ID NO: 38066 - RNA, 27 nt, Artificial Sequence
  Sterol regulatory element-binding protein 1 (1036-1044)
uuccugcacgaggccaccgcccgccuc

SEQ ID NO: 38067 - RNA, 27 nt, Artificial Sequence
  DNA-dependent protein kinase catalytic subunit (319-327)
uuccugaagcaggugagcaacaugguc

SEQ ID NO: 38068 - RNA, 27 nt, Artificial Sequence
  ADP-ribosylation factor-binding protein GGA1 (90-98)
uuccugaacgagcucaucaaggugguc

SEQ ID NO: 38069 - RNA, 27 nt, Artificial Sequence
  CDK5 regulatory subunit-associated protein 2 (1316-1324)
uuccugaacggcaagagcguggggguc

SEQ ID NO: 38070 - RNA, 27 nt, Artificial Sequence
  Nestin (377-385)
uuccugcaggcccgcacccccacccuc

SEQ ID NO: 38071 - RNA, 27 nt, Artificial Sequence
  Plectin (2481-2489)
uuccugagcgagaaggacucccuccug

SEQ ID NO: 38072 - RNA, 27 nt, Artificial Sequence
  Hemoglobin subunit alpha (5-13)
uuccugagcuuccccaccaccaagacg

SEQ ID NO: 38073 - RNA, 27 nt, Artificial Sequence
  DDRGK domain-containing protein 1 (215-223)
uuccugaccgaguucaucaacuacauc

SEQ ID NO: 38074 - RNA, 27 nt, Artificial Sequence
  Elongation factor 1-gamma (69-77)
uuccuggugggcgagcgcgucacccuc

SEQ ID NO: 38075 - RNA, 36 nt, Artificial Sequence
  Laminin subunit alpha-1 (2178-2189)
uuccugugggaccucggcagcggguccacccgccug

SEQ ID NO: 38076 - RNA, 27 nt, Artificial Sequence
  Upstream stimulatory factor 1 (42-50)
uuccccgacccgaacgugaaguacguc

SEQ ID NO: 38077 - RNA, 27 nt, Artificial Sequence
  Deubiquitinating protein VCIP135 (505-513)
uucccccaccugccgggcaagaccuuc

SEQ ID NO: 38078 - RNA, 27 nt, Artificial Sequence
  Putative helicase MOV-10 (232-240)
uuccccaucgaccacuucacccacauc

SEQ ID NO: 38079 - RNA, 27 nt, Artificial Sequence
  NEDD4 family-interacting protein 1 (61-69)
uuccccaagccgcccagcuacaacgug

SEQ ID NO: 38080 - RNA, 27 nt, Artificial Sequence
  Vacuolar fusion protein CCZ1 homolog (254-262)
uucccccgccacaucgagccggagcug

SEQ ID NO: 38081 - RNA, 24 nt, Artificial Sequence
  Retinoblastoma-binding protein 5 (81-88)
uuccccagcccgauccugaaggug

SEQ ID NO: 38082 - RNA, 27 nt, Artificial Sequence
  DNA polymerase alpha catalytic subunit (594-602)
uuccccuacgccuucaaggaggugauc

SEQ ID NO: 38083 - RNA, 24 nt, Artificial Sequence
  HEAT repeat-containing protein 1 (243-250)
uuccccuacauccagaagggccug

SEQ ID NO: 38084 - RNA, 27 nt, Artificial Sequence
  Reticulocalbin-3 (52-60)
uuccaguacgaccacgaggccuuccug

SEQ ID NO: 38085 - RNA, 30 nt, Artificial Sequence
  Short transient receptor potential channel 4-associated protein (457-466)
uucagcgaccaccacgagaacaaguaccug

SEQ ID NO: 38086 - RNA, 27 nt, Artificial Sequence
  Phosphoinositide 3-kinase regulatory subunit 4 (20-28)
uucagcgacauccacgacuucgaguac

SEQ ID NO: 38087 - RNA, 27 nt, Artificial Sequence
  Serine/threonine-protein kinase N2 (754-762)
uucagcgagccccgcgccguguucuac

SEQ ID NO: 38088 - RNA, 33 nt, Artificial Sequence
  Low-density lipoprotein receptor-related protein 4 (36-46)
uucaccgaccccggcauggggaaccugaccuac

SEQ ID NO: 38089 - RNA, 27 nt, Artificial Sequence
  PR domain zinc finger protein 10 (81-89)
uucaccgaccccggccagguggccuac

SEQ ID NO: 38090 - RNA, 27 nt, Artificial Sequence
  Unconventional myosin-Ib (229-237)
uucaccgaccagcagaagcugaucuac

SEQ ID NO: 38091 - RNA, 33 nt, Artificial Sequence
  Glutathione S-transferase Mu 3 (27-37)
uucaccgacaccagcuacgaggagaagcgcuac

SEQ ID NO: 38092 - RNA, 27 nt, Artificial Sequence
  Ribosomal protein S6 kinase alpha-5 (149-157)
uucaccgagcacgaggugcagaucuac

SEQ ID NO: 38093 - RNA, 30 nt, Artificial Sequence
  Unconventional myosin-Ib (526-535)
uucguggacaagaacaacgaccugcucuac

SEQ ID NO: 38094 - RNA, 27 nt, Artificial Sequence
  Heat shock 70 kDa protein 4 (200-208)
uucguggacaugggccacagcgccuac

SEQ ID NO: 38095 - RNA, 27 nt, Artificial Sequence
  Talin-1 (1850-1858)
uucguggacuaccagaccaccaugguc

SEQ ID NO: 38096 - RNA, 33 nt, Artificial Sequence
  Trafficking protein particle complex subunit 3 (115-125)
uucguggagcugcccgacaaccacagcucccuc

SEQ ID NO: 38097 - RNA, 27 nt, Artificial Sequence
  Serine/threonine-protein kinase Nek6 (272-280)
uucuacggcgacaagaugaaccuguuc

SEQ ID NO: 38098 - RNA, 27 nt, Artificial Sequence
  Myotubularin-related protein 5 (454-462)
uucuacggcgacgugcagacccacauc

SEQ ID NO: 38099 - RNA, 27 nt, Artificial Sequence
  Protein CLEC16A (161-169)
uucuacaacgagcacaccaacgacuuc

SEQ ID NO: 38100 - RNA, 27 nt, Artificial Sequence
  Fanconi anemia group I protein (922-930)
uucuaccagcccaagauccagcaguuc

SEQ ID NO: 38101 - RNA, 30 nt, Artificial Sequence
  Heat shock 70 kDa protein 1-like (295-304)
uucuacaccagcaucacccgcgcccgguuc

SEQ ID NO: 38102 - RNA, 27 nt, Artificial Sequence
  Little elongation complex subunit 2 (213-221)
uucuacgugggccacaucgacgccuuc

SEQ ID NO: 38103 - RNA, 27 nt, Artificial Sequence
  E3 ubiquitin-protein ligase MARCH6 (231-239)
ggccuggacgggagccucguguuccug

SEQ ID NO: 38104 - RNA, 27 nt, Artificial Sequence
  Malate dehydrogenase, mitochondrial (144-152)
ggccuggaccccgcccgcgugaacguc

SEQ ID NO: 38105 - RNA, 27 nt, Artificial Sequence
  Asparagine synthetase (glutamine-hydrolyzing) (177-185)
ggccuggacagcucccucguggccgcc

SEQ ID NO: 38106 - RNA, 33 nt, Artificial Sequence
  DNA damage-binding protein 1 (996-1006)
ggccuguuccaccucggggaguucgugaacguc

SEQ ID NO: 38107 - RNA, 30 nt, Artificial Sequence
  Importin-9 (119-128)
ggccugcacgagacccagcccccgagcgug

SEQ ID NO: 38108 - RNA, 27 nt, Artificial Sequence
  HEAT repeat-containing protein 5A (449-457)
ggccugcucgacagcauccuguccgug

SEQ ID NO: 38109 - RNA, 27 nt, Artificial Sequence
  HEAT repeat-containing protein 5B (445-453)
ggccugcucgagaucgugaccagcguc

SEQ ID NO: 38110 - RNA, 30 nt, Artificial Sequence
  Zinc transporter SLC39A7 (454-463)
ggccugcucgggggcgugaucaugaugguc

SEQ ID NO: 38111 - RNA, 33 nt, Artificial Sequence
  Protein SON (535-545)
ggccugcucgggcagcccgaggccaccauggug

SEQ ID NO: 38112 - RNA, 27 nt, Artificial Sequence
  Nestin (273-281)
ggccugcagagccagaucgcccaggug

SEQ ID NO: 38113 - RNA, 27 nt, Artificial Sequence
  Armadillo repeat containing 8, isoform CRA_g (325-333)
ggccugagcgaguccagcgugaagguc

SEQ ID NO: 38114 - RNA, 27 nt, Artificial Sequence
  Eukaryotic translation initiation factor 3 subunit F (252-260)
ggccugagcuccgaccuccagcaggug

SEQ ID NO: 38115 - RNA, 27 nt, Artificial Sequence
  Bifunctional glutamate/proline-tRNA ligase (1274-1282)
ggccugaccacccgcacgaucggggug

SEQ ID NO: 38116 - RNA, 27 nt, Artificial Sequence
  Glyceraldehyde-3-phosphate dehydrogenase (230-238)
ggcauggccuuccgcgugcccaccgcc

SEQ ID NO: 38117 - RNA, 27 nt, Artificial Sequence
  WD repeat-containing protein 19 (311-319)
ggccccgacgagcugcgcccgaugcuc

SEQ ID NO: 38118 - RNA, 27 nt, Artificial Sequence
  Uncharacterized protein KIAA0355 (842-850)
ggcagcgaccccgaguucgcccgcuac

SEQ ID NO: 38119 - RNA, 27 nt, Artificial Sequence
  Extended synaptotagmin-2 (388-396)
ggcagcgaccccuacgugcgcauguac

SEQ ID NO: 38120 - RNA, 36 nt, Artificial Sequence
  YY1-associated protein 1 (203-214)
ggcaccgaguuccugaacccccucaucagcaaguac

SEQ ID NO: 38121 - RNA, 33 nt, Artificial Sequence
  Clustered mitochondria protein homolog (777-787)
ggcaccgagcaccccaacaccauccaggaguac

SEQ ID NO: 38122 - RNA, 33 nt, Artificial Sequence
  Nucleolin (451-461)
ggcaccgagaucgacgggcgcagcaucucccug

SEQ ID NO: 38123 - RNA, 27 nt, Artificial Sequence
  DNA-dependent protein kinase catalytic subunit (1480-1488)
ggcaccgagcugcucagccugguguac

SEQ ID NO: 38124 - RNA, 27 nt, Artificial Sequence
  Pecanex-like protein 3 (789-797)
ggcgugcuggagaacaucuucgggguc

SEQ ID NO: 38125 - RNA, 33 nt, Artificial Sequence
  Ubiquitin-like protein 7 (158-168)
ggcgugcugcaggacaaggaccucuucagcguc

SEQ ID NO: 38126 - RNA, 27 nt, Artificial Sequence
  Polypyrimidine tract-binding protein 2 (308-316)
ggcguguacggggacguccagcgcgug

SEQ ID NO: 38127 - RNA, 33 nt, Artificial Sequence
  Caseinolytic peptidase B protein homolog (337-347)
ggcugguacgacgaggagcacccccugguguuc

SEQ ID NO: 38128 - RNA, 27 nt, Artificial Sequence
  Signal recognition particle subunit SRP68 (586-594)
ggcuacaucaaggggaucuucggcuuc

SEQ ID NO: 38129 - RNA, 27 nt, Artificial Sequence
  Hypoxanthine-guanine phosphoribosyltransferase (173-181)
ggcuacaagcccgacuucgugggguuc

SEQ ID NO: 38130 - RNA, 27 nt, Artificial Sequence
  GMP reductase 2 (151-159)
ggcuacagcgagcacuucguggaguuc

SEQ ID NO: 38131 - RNA, 27 nt, Artificial Sequence
  Lysine-specific histone demethylase 1B (77-85)
ggcuacaccagccgcugguaccaccug

SEQ ID NO: 38132 - RNA, 30 nt, Artificial Sequence
  ATP-binding cassette sub-family E member 1 (315-324)
ggcuacgugcccaccgagaaccugcgcuuc

SEQ ID NO: 38133 - RNA, 27 nt, Artificial Sequence
  Ankyrin repeat domain-containing protein 17 (2149-2157)
cacgccuucuggggcgggagcgugguc

SEQ ID NO: 38134 - RNA, 27 nt, Artificial Sequence
  CCR4-NOT transcription complex subunit 1 (1619-1627)
cacgccauccccccgacccuggccaug

SEQ ID NO: 38135 - RNA, 27 nt, Artificial Sequence
  Syntaxin-binding protein 1 (295-303)
cacaucgccgaggugagccaggagguc

SEQ ID NO: 38136 - RNA, 27 nt, Artificial Sequence
  Dolichyl-diphosphooligosaccharide-proteinosyltransferase subunit 1 (45-53)
caccuggccaaggugaccgccgagguc

SEQ ID NO: 38137 - RNA, 27 nt, Artificial Sequence
  ATP-binding cassette sub-family F member 1 (520-528)
caccuggacgcccagcgccuccacuac

SEQ ID NO: 38138 - RNA, 27 nt, Artificial Sequence
  T-complex protein 1 subunit epsilon (147-155)
caccuggacaagaucagcgacuccgug

SEQ ID NO: 38139 - RNA, 30 nt, Artificial Sequence
  Pre-mRNA-processing-splicing factor 8 (1875-1884)
caccugcucgacuuccccaacaucgugauc

SEQ ID NO: 38140 - RNA, 27 nt, Artificial Sequence
  Polypyrimidine tract-binding protein 3 (383-391)
caccugagcaacauccccccguccgug

SEQ ID NO: 38141 - RNA, 27 nt, Artificial Sequence
  Integrator complex subunit 4 (10-18)
caccugaccgacaccagccacggcgug

SEQ ID NO: 38142 - RNA, 27 nt, Artificial Sequence
  Clathrin heavy chain 1 (1356-1364)
caccugugggccgagcucguguuccug

SEQ ID NO: 38143 - RNA, 36 nt, Artificial Sequence
  LanC-like protein 1 (74-85)
caccuguacgacguguucggcgaccccgccuaccuc

SEQ ID NO: 38144 - RNA, 27 nt, Artificial Sequence
  U3 small nucleolar RNA-associated protein 6 homolog (267-275)
cacaccgacgacccccugaccugggac

SEQ ID NO: 38145 - RNA, 27 nt, Artificial Sequence
  Ras GTPase-activating-like protein IQGAP3 (1072-1080)
cacaccgaccccgugcaccuguacaag

SEQ ID NO: 38146 - RNA, 30 nt, Artificial Sequence
  Receptor-type tyrosine-protein phosphatase F (1334-1343)
cacaccgaggugcccgcccgcaaccuguac

SEQ ID NO: 38147 - RNA, 27 nt, Artificial Sequence
  Non-specific lipid-transfer protein (143-151)
cacguggaccugcucaucaacaaguac

SEQ ID NO: 38148 - RNA, 27 nt, Artificial Sequence
  Rhophilin-2 (351-359)
cacuacgccgcccuggcgcacuacuuc

SEQ ID NO: 38149 - RNA, 27 nt, Artificial Sequence
  Heat shock protein 105 kDa (739-747)
cacuacgccaagaucgccgcggacuuc

SEQ ID NO: 38150 - RNA, 30 nt, Artificial Sequence
  Eukaryotic translation initiation factor 3 subunit I (312-321)
cacuacuucgacccccaguacuucgaguuc

SEQ ID NO: 38151 - RNA, 30 nt, Artificial Sequence
  General transcription factor 3C polypeptide 2 (687-696)
cacuacaucgacgccggcuaccugggguuc

SEQ ID NO: 38152 - RNA, 27 nt, Artificial Sequence
  Centrosomal protein of 192 kDa (2495-2503)
cacuacaucaacaugcccgugcaguuc

SEQ ID NO: 38153 - RNA, 27 nt, Artificial Sequence
  Tubulin gamma-1 chain (59-67)
cacuacaucccccgcgccgugcugcuc

SEQ ID NO: 38154 - RNA, 27 nt, Artificial Sequence
  Structural maintenance of chromosomes protein 4 (1123-1131)
cacuacaagcccaccccgcuguacuuc

SEQ ID NO: 38155 - RNA, 27 nt, Artificial Sequence
  Rho GTPase-activating protein 5 (207-215)
cacuaccugcgcgaggugcaggccuuc

SEQ ID NO: 38156 - RNA, 30 nt, Artificial Sequence
  E3 ubiquitin-protein ligase Arkadia (644-653)
cacuacaugcccccgcccuacgccagccug

SEQ ID NO: 38157 - RNA, 33 nt, Artificial Sequence
  Rho-related BTB domain-containing protein 3 (239-249)
cacuacaacagcgaccugaacaaccuccuguuc

SEQ ID NO: 38158 - RNA, 27 nt, Artificial Sequence
  DNA mismatch repair protein Msh6 (458-466)
cacuaccccccggugcagguccuguuc

SEQ ID NO: 38159 - RNA, 27 nt, Artificial Sequence
  Dedicator of cytokinesis protein 5 (968-976)
cacuacagccacuacaucuccaccuuc

SEQ ID NO: 38160 - RNA, 27 nt, Artificial Sequence
  Dynein heavy chain 14, axonemal (48-56)
aucgccgagaaggagacccuggaguac

SEQ ID NO: 38161 - RNA, 27 nt, Artificial Sequence
  Inositol 1,4,5-trisphosphate receptor type 1 (2578-2586)
aucuucggcgugaucaucgacaccuuc

SEQ ID NO: 38162 - RNA, 27 nt, Artificial Sequence
  U5 small nuclear ribonucleoprotein 40 kDa protein (217-225)
aucuuccagggcaacgugcacaacuuc

SEQ ID NO: 38163 - RNA, 27 nt, Artificial Sequence
  Progesterone-induced-blocking factor 1 (734-742)
aucuucacccccaagccgacccuguuc

SEQ ID NO: 38164 - RNA, 27 nt, Artificial Sequence
  Phosphoserine aminotransferase (281-289)
aucaucgacaacagccagggcuucuac

SEQ ID NO: 38165 - RNA, 30 nt, Artificial Sequence
  Vesicle-associated membrane protein-associated protein A (60-69)
aucaucgaccccggcagcaccgugaccguc

SEQ ID NO: 38166 - RNA, 27 nt, Artificial Sequence
  T-complex protein 1 subunit gamma (100-108)
auccuggccggcgagaugcucagcgug

SEQ ID NO: 38167 - RNA, 36 nt, Artificial Sequence
  Adenosylhomocysteinase 2 (196-207)
auccuggacgacggcggggaccucacccacugggug

SEQ ID NO: 38168 - RNA, 27 nt, Artificial Sequence
  Disabled homolog 2 (198-206)
auccuggacgaccagaccaacaagcuc

SEQ ID NO: 38169 - RNA, 27 nt, Artificial Sequence
  Switch-associated protein 70 (208-216)
auccuggacgugcucaagcagggcuac

SEQ ID NO: 38170 - RNA, 27 nt, Artificial Sequence
  Protein SCAF8 (864-872)
auccugggcgggcagcccccgaacgug

SEQ ID NO: 38171 - RNA, 27 nt, Artificial Sequence
  Prolow-density lipoprotein receptor-related protein 1 (596-604)
auccugaaggacggcauccacaacgug

SEQ ID NO: 38172 - RNA, 27 nt, Artificial Sequence
  Nucleoprotein TPR (616-624)
auccugcucagccagaccaccggcgug

SEQ ID NO: 38173 - RNA, 30 nt, Artificial Sequence
  Noelin (14-23)
auccugaugggcaccgagcucacccaggug

SEQ ID NO: 38174 - RNA, 30 nt, Artificial Sequence
  ATP-citrate synthase (1022-1031)
auccugaacguggacggccucaucgggguc

SEQ ID NO: 38175 - RNA, 30 nt, Artificial Sequence
  D-3-phosphoglycerate dehydrogenase (22-31)
auccugcaggacggcgggcuccaggugguc

SEQ ID NO: 38176 - RNA, 27 nt, Artificial Sequence
  Poly (ADP-ribose) polymerase 1 (477-485)
auccugagccccuggggcgccgaggug

SEQ ID NO: 38177 - RNA, 33 nt, Artificial Sequence
  Heat shock-related 70 kDa protein 2 (212-222)
auccugaccaucgaggacggcaucuucgaggug

SEQ ID NO: 38178 - RNA, 33 nt, Artificial Sequence
  Proteasome subunit alpha type-2 (46-56)
auccuguacgacgagcgcagcgugcacaagguc

SEQ ID NO: 38179 - RNA, 30 nt, Artificial Sequence
  Elongation factor 2 (203-212)
aucaugaucgaccccgugcugggcaccguc

SEQ ID NO: 38180 - RNA, 27 nt, Artificial Sequence
  Gem-associated protein 4 (471-479)
auccccgagagccagauccgccaggug

SEQ ID NO: 38181 - RNA, 27 nt, Artificial Sequence
  Serine/threonine-protein kinase 24 (212-220)
auccccaagaacaacccgcccacccug

SEQ ID NO: 38182 - RNA, 27 nt, Artificial Sequence
  Cathepsin D (24-32)
aucccccugcacaaguucaccagcauc

SEQ ID NO: 38183 - RNA, 24 nt, Artificial Sequence
  ATP-binding cassette sub-family F member 2 (391-398)
auccccccgcccgugaucaugguc

SEQ ID NO: 38184 - RNA, 27 nt, Artificial Sequence
  Serine protease HTRA1 (3-11)
aucccccgcgccgcccugcucccgcug

SEQ ID NO: 38185 - RNA, 30 nt, Artificial Sequence
  Serine protease HTRA1 (3-12)
aucccccgcgccgcccugcucccgcugcug

SEQ ID NO: 38186 - RNA, 24 nt, Artificial Sequence
  Lysine-specific demethylase 5D (1030-1037)
auccccgugcaccugccgaacauc

SEQ ID NO: 38187 - RNA, 24 nt, Artificial Sequence
  Pre-mRNA-processing-splicing factor 8 (724-731)
auccccuggaaggugccgggccug

SEQ ID NO: 38188 - RNA, 24 nt, Artificial Sequence
  Serine-tRNA ligase, cytoplasmic (357-364)
auccccuaccacaucgugaacauc

SEQ ID NO: 38189 - RNA, 24 nt, Artificial Sequence
  T-complex protein 1 subunit gamma (296-303)
aucagcgaccuggcccagcacuac

SEQ ID NO: 38190 - RNA, 27 nt, Artificial Sequence
  39S ribosomal protein L12, mitochondrial (79-87)
aucagcgaccugaacgagcuccugaag

SEQ ID NO: 38191 - RNA, 27 nt, Artificial Sequence
  Junction plakoglobin (651-659)
aucagcgaggacaagaaccccgacuac

SEQ ID NO: 38192 - RNA, 30 nt, Artificial Sequence
  ATP-citrate synthase (6-15)
aucagcgagcagaccggcaaggagcugcuc

SEQ ID NO: 38193 - RNA, 30 nt, Artificial Sequence
  Peptidyl-prolyl cis-trans isomerase FKBP9 (274-283)
aucagccaguccggcgacuuccugcgcuac

SEQ ID NO: 38194 - RNA, 24 nt, Artificial Sequence
  Staphylococcal nuclease domain-containing protein 1 (665-672)
aucaccgacgaccugcacuucuac

SEQ ID NO: 38195 - RNA, 27 nt, Artificial Sequence
  E3 ubiquitin-protein ligase TRIM21 (423-431)
aucaccgaccacggcagccugaucuac

SEQ ID NO: 38196 - RNA, 33 nt, Artificial Sequence
  5-oxoprolinase (1145-1155)
aucaccgaccccgagauccuggagagccgcuac

SEQ ID NO: 38197 - RNA, 30 nt, Artificial Sequence
  Wee1-like protein kinase (72-81)
aucaccgagagcaacaugaagucccgcuac

SEQ ID NO: 38198 - RNA, 27 nt, Artificial Sequence
  Interleukin enhancer-binding factor 2 (89-97)
aucguggcccccggcaccuucgagguc

SEQ ID NO: 38199 - RNA, 27 nt, Artificial Sequence
  Pre-mRNA-processing-splicing factor 8 (1000-1008)
aucguggaccacaacaucgccgacuac

SEQ ID NO: 38200 - RNA, 27 nt, Artificial Sequence
  EKC/KEOPS complex subunit TPRKB (48-56)
aucguggaccccuuccagauccugguc

SEQ ID NO: 38201 - RNA, 30 nt, Artificial Sequence
  Hydroxyacylglutathione hydrolase, mitochondrial (27-36)
aucguggaccccguccagccgcagaaggug

SEQ ID NO: 38202 - RNA, 39 nt, Artificial Sequence
  POTE ankyrin domain family member F (851-863)
aucgugauggacagcggcgacggggucacccacaccgug

SEQ ID NO: 38203 - RNA, 30 nt, Artificial Sequence
  Beta-secretase 2 (263-272)
aucugguacacccccaucaaggaggagugg

SEQ ID NO: 38204 - RNA, 27 nt, Artificial Sequence
  Solute carrier family 12 member 4 (260-268)
aucuacgccggcgggaucaagagcauc

SEQ ID NO: 38205 - RNA, 33 nt, Artificial Sequence
  1-phosphatidylinositol 4,5-bisphosphate phosphodiesterase gamma-2 (1124-1134)
aucuacgaccccaaccuggccuuccuccgcuuc

SEQ ID NO: 38206 - RNA, 30 nt, Artificial Sequence
  Cullin-4B (579-588)
aucuacggcaaggacguguucgaggccuuc

SEQ ID NO: 38207 - RNA, 27 nt, Artificial Sequence
  ATP-dependent zinc metalloprotease YME1L1 (305-313)
aucuacggccugcucaagaaccccuuc

SEQ ID NO: 38208 - RNA, 27 nt, Artificial Sequence
  Protein transport protein Sec31A (147-155)
aucuacaucugggaccugaacaacuuc

SEQ ID NO: 38209 - RNA, 27 nt, Artificial Sequence
  USP6 N-terminal-like protein (97-105)
aucuacaagggcaucccccugcagcuc

SEQ ID NO: 38210 - RNA, 27 nt, Artificial Sequence
  Plectin (1069-1077)
aucuaccuggagaagcucaagaccauc

SEQ ID NO: 38211 - RNA, 27 nt, Artificial Sequence
  Tumor susceptibility gene 101 protein (109-117)
aucuaccugcccuaccuccacgagugg

SEQ ID NO: 38212 - RNA, 27 nt, Artificial Sequence
  Ubiquitin-conjugating enzyme E2 variant 3 (109-117)
aucuaccugcccuaccuccagaacugg

SEQ ID NO: 38213 - RNA, 27 nt, Artificial Sequence
  Collagen alpha-1(XV) chain (1157-1165)
aucuaccugcgcgacagcaccgaguuc

SEQ ID NO: 38214 - RNA, 27 nt, Artificial Sequence
  Disks large homolog 1 (868-876)
aucuacaaccaggugaagcagaucauc

SEQ ID NO: 38215 - RNA, 33 nt, Artificial Sequence
  Nuclear fragile X mental retardation-interacting protein 2 (473-483)
aucuaccccagcaacaugcagaccaugcugcuc

SEQ ID NO: 38216 - RNA, 30 nt, Artificial Sequence
  Pre-mRNA-processing-splicing factor 8 (1694-1703)
aucuaccccagcccgaccggcgugcugauc

SEQ ID NO: 38217 - RNA, 30 nt, Artificial Sequence
  5'-3' exoribonuclease 1 (610-619)
aucuaccccagcccguggcccgagaaguuc

SEQ ID NO: 38218 - RNA, 27 nt, Artificial Sequence
  Protein unc-119 homolog B (91-99)
aucuacagcaucgacuucacccgcuuc

SEQ ID NO: 38219 - RNA, 24 nt, Artificial Sequence
  Serine-protein kinase ATM (121-128)
aucuacacccugauccacuacauc

SEQ ID NO: 38220 - RNA, 27 nt, Artificial Sequence
  Exocyst complex component 6B (648-656)
aucuacaccaaccugaaccagaagauc

SEQ ID NO: 38221 - RNA, 27 nt, Artificial Sequence
  Aminoacylase-1 (390-398)
aucuacacccgccugcuccccgcccug

SEQ ID NO: 38222 - RNA, 27 nt, Artificial Sequence
  Kelch domain-containing protein 7B (353-361)
aucuacgugaccggcgggcaccuguuc

SEQ ID NO: 38223 - RNA, 30 nt, Artificial Sequence
  RNA polymerase I-specific transcription initiation factor RRN3 (572-581)
aaguucaucgaccccaucuaccaggugugg

SEQ ID NO: 38224 - RNA, 30 nt, Artificial Sequence
  Ubiquitin carboxyl-terminal hydrolase 8 (551-560)
aaguuccuggaccccaucaccggcaccuuc

SEQ ID NO: 38225 - RNA, 27 nt, Artificial Sequence
  pre-rRNA processing protein FTSJ3 (64-72)
aaguucaugcccgugagcucccugauc

SEQ ID NO: 38226 - RNA, 27 nt, Artificial Sequence
  M-phase inducer phosphatase 2 (349-357)
aaguucagcaacaucguggacaaguuc

SEQ ID NO: 38227 - RNA, 27 nt, Artificial Sequence
  Mitotic checkpoint protein BUB3 (21-29)
aaguucagccccaacaccucccaguuc

SEQ ID NO: 38228 - RNA, 27 nt, Artificial Sequence
  Protein SCAF11 (1039-1047)
aagcuggccgagagcaagguguccguc

SEQ ID NO: 38229 - RNA, 27 nt, Artificial Sequence
  Neuroblast differentiation-associated protein AHNAK (2352-2360)
aagcuggacgccgacaugcccgaggug

SEQ ID NO: 38230 - RNA, 27 nt, Artificial Sequence
  Ryanodine receptor 1 (3709-3717)
aagcuggacgaggacuaccucuacaug

SEQ ID NO: 38231 - RNA, 30 nt, Artificial Sequence
  Nucleobindin-1 (98-107)
aagcuggacgagcucaagcgccaggaggug

SEQ ID NO: 38232 - RNA, 27 nt, Artificial Sequence
  Spectrin alpha chain, non-erythrocytic 1 (201-209)
aagcuggacgagaacagcgccuuccuc

SEQ ID NO: 38233 - RNA, 27 nt, Artificial Sequence
  Striatin-3 (767-775)
aagcuggacgagagcaucuacgacgug

SEQ ID NO: 38234 - RNA, 27 nt, Artificial Sequence
  DNA topoisomerase 2-alpha (278-286)
aagcuggacgagaccggcaacagccuc

SEQ ID NO: 38235 - RNA, 27 nt, Artificial Sequence
  Eukaryotic initiation factor 4A-III (152-160)
aagcuggacuacggccagcacgugguc

SEQ ID NO: 38236 - RNA, 27 nt, Artificial Sequence
  HEAT repeat-containing protein 2 (624-632)
aagcuguucagcauccucuccaccgug

SEQ ID NO: 38237 - RNA, 27 nt, Artificial Sequence
  Helicase-like transcription factor (170-178)
aagcugggccccgccccgaagacccuc

SEQ ID NO: 38238 - RNA, 27 nt, Artificial Sequence
  Serine/threonine-protein kinase ULK4 (46-54)
aagcugaucccccucaucuucgaggug

SEQ ID NO: 38239 - RNA, 33 nt, Artificial Sequence
  GTP-binding protein Rheb (102-112)
aagcugcucgacauggugggcaagguccagauc

SEQ ID NO: 38240 - RNA, 27 nt, Artificial Sequence
  Probable E3 ubiquitin-protein ligase HERC3 (474-482)
aagcugcucgagaagcuguacaaggug

SEQ ID NO: 38241 - RNA, 30 nt, Artificial Sequence
  Dedicator of cytokinesis protein 1 (386-395)
aagcugcuccccggcgacauccaccagauc

SEQ ID NO: 38242 - RNA, 27 nt, Artificial Sequence
  Adenosylhomocysteinase 2 (47-55)
aagcugaacgaggugauccgccagguc

SEQ ID NO: 38243 - RNA, 27 nt, Artificial Sequence
  V-type proton ATPase catalytic subunit A (220-228)
aagcugcccgccaaccacccgcuccug

SEQ ID NO: 38244 - RNA, 27 nt, Artificial Sequence
  Proline-rich protein 11 (128-136)
aagcugcaggaggcccucaagaccauc

SEQ ID NO: 38245 - RNA, 27 nt, Artificial Sequence
  Serine/threonine-protein kinase MRCK alpha (461-469)
aagcugcaggagagcacccagaccgug

SEQ ID NO: 38246 - RNA, 30 nt, Artificial Sequence
  Integrin alpha-V (338-347)
aagcugcaggaggugggccaggucagcgug

SEQ ID NO: 38247 - RNA, 33 nt, Artificial Sequence
  78 kDa glucose-regulated protein (2-12)
aagcugagccucguggccgccaugcugcugcuc

SEQ ID NO: 38248 - RNA, 27 nt, Artificial Sequence
  Serum albumin (257-265)
aagcuggugaccgaccucaccaagguc

SEQ ID NO: 38249 - RNA, 27 nt, Artificial Sequence
  Zinc finger and BTB domain-containing protein 38 (661-669)
aagauggaccuggacaacaacuucuac

SEQ ID NO: 38250 - RNA, 27 nt, Artificial Sequence
  Sister chromatid cohesion protein PDS5 homolog B (1060-1068)
aagaugaacgagaagcuguacaccgug

SEQ ID NO: 38251 - RNA, 27 nt, Artificial Sequence
  Nucleophosmin (250-258)
aagaugcaggccagcaucgagaaggcc

SEQ ID NO: 38252 - RNA, 36 nt, Artificial Sequence
  Breast cancer anti-estrogen resistance protein 1 (335-346)
aagcccuucgacccggcccgcaccccccuggugcuc

SEQ ID NO: 38253 - RNA, 27 nt, Artificial Sequence
  Poly (ADP-ribose) polymerase 1 (388-396)
aagccccugagcaacaugaagauccuc

SEQ ID NO: 38254 - RNA, 27 nt, Artificial Sequence
  Vitamin K-dependent protein S (29-37)
aagcagcaggccagccaggugcugguc

SEQ ID NO: 38255 - RNA, 27 nt, Artificial Sequence
  POZ-, AT hook-, and zinc finger-containing protein 1 (157-165)
aagcagagcaacgugcagauccugguc

SEQ ID NO: 38256 - RNA, 27 nt, Artificial Sequence
  Probable global transcription activator SNF2L1 (37-45)
aagcagaccgagcuguucgcccacuuc

SEQ ID NO: 38257 - RNA, 27 nt, Artificial Sequence
  Probable ATP-dependent RNA helicase DDX5 (451-459)
aagcaggugagcgaccugaucuccguc

SEQ ID NO: 38258 - RNA, 36 nt, Artificial Sequence
  Myosin-10 (296-307)
aagagcgaccugcuccuggagggcuucaacaacuac

SEQ ID NO: 38259 - RNA, 27 nt, Artificial Sequence
  Importin-11 (549-557)
aagagcgaccugcgccccaugcucuac

SEQ ID NO: 38260 - RNA, 30 nt, Artificial Sequence
  Hepatocyte growth factor receptor (32-41)
aagagcgagaugaacgugaacaugaaguac

SEQ ID NO: 38261 - RNA, 27 nt, Artificial Sequence
  Leucine-rich repeat-containing protein 42 (68-76)
aagaccgaccacuucaucuucaccuac

SEQ ID NO: 38262 - RNA, 33 nt, Artificial Sequence
  AMP deaminase 2 (106-116)
aagaccgacagcgacuccgaccugcagcucuac

SEQ ID NO: 38263 - RNA, 27 nt, Artificial Sequence
  pre-rRNA processing protein FTSJ3 (466-474)
aagaccgagaucaugagcccccuguac

SEQ ID NO: 38264 - RNA, 27 nt, Artificial Sequence
  Fanconi anemia group I protein (402-410)
aagaccaucgagaccagccccucccug

SEQ ID NO: 38265 - RNA, 39 nt, Artificial Sequence
  Tubulin alpha-1C chain (5-17)
aagaccaucggcgggggcgacgacagcuucaacaccuuc

SEQ ID NO: 38266 - RNA, 36 nt, Artificial Sequence
  Calnexin (227-238)
aagaccuacuucaccgacaagaagacgcaccuguac

SEQ ID NO: 38267 - RNA, 27 nt, Artificial Sequence
  General transcription factor 3C polypeptide 1 (135-143)
aagguggacgccggcaagcugcacuac

SEQ ID NO: 38268 - RNA, 33 nt, Artificial Sequence
  Protein phosphatase Slingshot homolog 3 (281-291)
aaggugcuggacgucagcgaccucgaguccgug

SEQ ID NO: 38269 - RNA, 27 nt, Artificial Sequence
  HEAT repeat-containing protein 5A (1475-1483)
aaggugcuggagacccucgucaccgug

SEQ ID NO: 38270 - RNA, 30 nt, Artificial Sequence
  DNA-directed RNA polymerase II subunit RPB3 (175-184)
aaguggaaccccaccgccggcguggccuuc

SEQ ID NO: 38271 - RNA, 27 nt, Artificial Sequence
  UDP-glucose:glycoprotein glucosyltransferase 2 (42-50)
aaguggcccgagaccccgcugcuccug

SEQ ID NO: 38272 - RNA, 27 nt, Artificial Sequence
  Serine/threonine-protein kinase PLK3 (427-435)
aaguggguggacuacagcaacaaguuc

SEQ ID NO: 38273 - RNA, 27 nt, Artificial Sequence
  Integrin alpha-V (188-196)
aaguacgaccccaacguguacagcauc

SEQ ID NO: 38274 - RNA, 27 nt, Artificial Sequence
  Kinesin-like protein KIF7 (588-596)
aaguacuucgacaagguggucacccug

SEQ ID NO: 38275 - RNA, 27 nt, Artificial Sequence
  Putative deoxyribonuclease TATDN1 (130-138)
aaguacuucgagaagcaguucgagcug

SEQ ID NO: 38276 - RNA, 33 nt, Artificial Sequence
  BTB/POZ domain-containing protein 3 (484-494)
aaguacuucagcgacggcuccagcaacaccuuc

SEQ ID NO: 38277 - RNA, 27 nt, Artificial Sequence
  Ras GTPase-activating-like protein IQGAP1 (191-199)
aaguacggcauccagaugcccgccuuc

SEQ ID NO: 38278 - RNA, 27 nt, Artificial Sequence
  General transcription factor IIF subunit 1 (83-91)
aaguacggcaucgugcugaaggaguuc

SEQ ID NO: 38279 - RNA, 24 nt, Artificial Sequence
  Protein SOGA1 (415-422)
aaguacggcaucgugcaggaguuc

SEQ ID NO: 38280 - RNA, 27 nt, Artificial Sequence
  Tyrosine-protein phosphatase non-receptor type 13 (1101-1109)
aaguacggccugggguuccagaucauc

SEQ ID NO: 38281 - RNA, 27 nt, Artificial Sequence
  Serine/threonine-protein kinase Kist (248-256)
aaguacggccccguggucagccugcuc

SEQ ID NO: 38282 - RNA, 24 nt, Artificial Sequence
  Serine/threonine-protein phosphatase 4 catalytic subunit (133-140)
aaguacggcagcgugaccgucugg

SEQ ID NO: 38283 - RNA, 27 nt, Artificial Sequence
  Magnesium transporter protein 1 (356-364)
aaguaccacggcuaccccuacagcuuc

SEQ ID NO: 38284 - RNA, 27 nt, Artificial Sequence
  Protein cramped-like (21-29)
aaguacaucgacuucgaccacguguuc

SEQ ID NO: 38285 - RNA, 27 nt, Artificial Sequence
  Ataxin-2-like protein (371-379)
aaguacaucccccugccgcagcgcgug

SEQ ID NO: 38286 - RNA, 30 nt, Artificial Sequence
  Programmed cell death protein 6 (90-99)
aaguacaucaccgacuggcagaacguguuc

SEQ ID NO: 38287 - RNA, 27 nt, Artificial Sequence
  Elongation of very long chain fatty acids protein 5 (200-208)
aaguacaucacccagggccagcugcuc

SEQ ID NO: 38288 - RNA, 27 nt, Artificial Sequence
  Muscleblind-like protein 3 (18-26)
aaguaccugcaccccccgccccaccuc

SEQ ID NO: 38289 - RNA, 27 nt, Artificial Sequence
  Muscleblind-like protein 2 (67-75)
aaguaccugcaccccccgacccaccuc

SEQ ID NO: 38290 - RNA, 27 nt, Artificial Sequence
  Nesprin-2 (895-903)
aaguaccugaaggccguggaggagcuc

SEQ ID NO: 38291 - RNA, 27 nt, Artificial Sequence
  Presenilin-1 (239-247)
aaguaccugcccgaguggaccgccugg

SEQ ID NO: 38292 - RNA, 30 nt, Artificial Sequence
  ATP-dependent RNA helicase DDX24 (720-729)
aaguacauggacguggucaaggagcgcauc

SEQ ID NO: 38293 - RNA, 30 nt, Artificial Sequence
  Protein polybromo-1 (653-662)
aaguacaugacccccaugcagcagaagcug

SEQ ID NO: 38294 - RNA, 27 nt, Artificial Sequence
  Zinc finger protein 3 (173-181)
aaguacaacgacuucggcaacagcuuc

SEQ ID NO: 38295 - RNA, 30 nt, Artificial Sequence
  Putative endoplasmin-like protein (136-145)
aaguacaacgacaccuucuggaaggaguuc

SEQ ID NO: 38296 - RNA, 27 nt, Artificial Sequence
  Sphingolipid delta(4)-desaturase DES1 (5-13)
aaguaccccgagaucaagagccugaug

SEQ ID NO: 38297 - RNA, 27 nt, Artificial Sequence
  Neurolysin, mitochondrial (244-252)
aaguacccccacuacuucccggugaug

SEQ ID NO: 38298 - RNA, 27 nt, Artificial Sequence
  Protein farnesyltransferase/geranylgeranyltransferase type-1 subunit alpha (288-296)
aaguaccccaaccugcucaaccagcug

SEQ ID NO: 38299 - RNA, 27 nt, Artificial Sequence
  Protein ERGIC-53 (288-296)
aaguaccaggaggaguucgagcacuuc

SEQ ID NO: 38300 - RNA, 27 nt, Artificial Sequence
  T-box transcription factor TBX3 (227-235)
aaguaccagccccgcuuccacaucgug

SEQ ID NO: 38301 - RNA, 27 nt, Artificial Sequence
  Isoleucine-tRNA ligase, cytoplasmic (288-296)
aaguaccgcccccuguucgacuacuuc

SEQ ID NO: 38302 - RNA, 27 nt, Artificial Sequence
  Bardet-Biedl syndrome 10 protein (585-593)
aaguacagcuucccccacaccuacauc

SEQ ID NO: 38303 - RNA, 27 nt, Artificial Sequence
  Ubiquitin-conjugating enzyme E2 variant 3 (36-44)
aaguacagcauggacaccuacguguuc

SEQ ID NO: 38304 - RNA, 27 nt, Artificial Sequence
  Inositol-trisphosphate 3-kinase C (318-326)
aaguacagccccuucguggucuccuuc

SEQ ID NO: 38305 - RNA, 27 nt, Artificial Sequence
  Serine/threonine-protein phosphatase 5 (314-322)
aaguacaccgcccagauguacgagcug

SEQ ID NO: 38306 - RNA, 27 nt, Artificial Sequence
  FACT complex subunit SPT16 (92-100)
aaguacaccgagggcgugcagagccug

SEQ ID NO: 38307 - RNA, 30 nt, Artificial Sequence
  Glycogen debranching enzyme (495-504)
aaguacaccgagaucaccgccacguacuuc

SEQ ID NO: 38308 - RNA, 27 nt, Artificial Sequence
  Phospholipase DDHD2 (124-132)
aaguacgugcccuacagcgaguccuuc

SEQ ID NO: 38309 - RNA, 27 nt, Artificial Sequence
  Serine/threonine-protein kinase RIO1 (222-230)
aaguacgugagcggcgaguuccgcuuc

SEQ ID NO: 38310 - RNA, 30 nt, Artificial Sequence
  Splicing factor U2AF 65 kDa subunit (90-99)
aaguacugggacgugcccccgcccggcuuc

SEQ ID NO: 38311 - RNA, 27 nt, Artificial Sequence
  Catenin alpha-1 (777-785)
cuggccuaccuccagcgcaucgcccug

SEQ ID NO: 38312 - RNA, 24 nt, Artificial Sequence
  Heterogeneous nuclear ribonucleoprotein F (259-266)
cuguucggccgcgaccucagcuac

SEQ ID NO: 38313 - RNA, 27 nt, Artificial Sequence
  Tubulin beta-6 chain (312-320)
cuguucaagcgcaucagcgagcaguuc

SEQ ID NO: 38314 - RNA, 24 nt, Artificial Sequence
  Plectin (4148-4155)
cugaucgaccaccagaccuaccuc

SEQ ID NO: 38315 - RNA, 36 nt, Artificial Sequence
  Heat shock 70 kDa protein 1-like (198-209)
cugaucuucgaccucggcgggggcaccuucgacgug

SEQ ID NO: 38316 - RNA, 27 nt, Artificial Sequence
  ATP synthase subunit beta, mitochondrial (215-223)
cugaucauggagcucaucaacaacgug

SEQ ID NO: 38317 - RNA, 27 nt, Artificial Sequence
  DNA damage-binding protein 1 (880-888)
cugcucgccagcaucaacuccaccgug

SEQ ID NO: 38318 - RNA, 30 nt, Artificial Sequence
  Zinc finger protein 530 (30-39)
cugcucgacgagaugcagcgccugcuguac

SEQ ID NO: 38319 - RNA, 27 nt, Artificial Sequence
  Phospholysine phosphohistidine inorganic pyrophosphate phosphatase (15-23)
cugcucgacaucagcggcgugcuguac

SEQ ID NO: 38320 - RNA, 27 nt, Artificial Sequence
  Vacuolar fusion protein CCZ1 homolog (130-138)
cugcucgacaagguguacagcuccguc

SEQ ID NO: 38321 - RNA, 27 nt, Artificial Sequence
  SPRY domain-containing SOCS box protein 1 (138-146)
cugcucgacaugcccccggugagcuac

SEQ ID NO: 38322 - RNA, 27 nt, Artificial Sequence
  Beta-hexosaminidase subunit alpha (173-181)
cugcucgacaccagccgccacuaccug

SEQ ID NO: 38323 - RNA, 27 nt, Artificial Sequence
  Fragile X mental retardation protein 1 (20-28)
cugcucgacuaccaccugaacuaccug

SEQ ID NO: 38324 - RNA, 27 nt, Artificial Sequence
  Supervillin (34-42)
cugcucgaggaggacaccccccgcuac

SEQ ID NO: 38325 - RNA, 27 nt, Artificial Sequence
  LEM domain-containing protein 2 (269-277)
cugcucgagcugcugcacgagcucuac

SEQ ID NO: 38326 - RNA, 33 nt, Artificial Sequence
  UDP-N-acetylglucosamine/UDP-glucose/GDP-mannose transporter (133-143)
cugcucgagaccaucauccugggcaagcaguac

SEQ ID NO: 38327 - RNA, 33 nt, Artificial Sequence
  Complement decay-accelerating factor (9-19)
cugcucggcgagcugccccgccugcuccugcug

SEQ ID NO: 38328 - RNA, 24 nt, Artificial Sequence
  Kelch-like protein 24 (405-412)
cugcucggcaagguguacgucgug

SEQ ID NO: 38329 - RNA, 27 nt, Artificial Sequence
  Myosin-9 (292-300)
cugcuccuggagcccuacaacaaguac

SEQ ID NO: 38330 - RNA, 33 nt, Artificial Sequence
  Plectin (3700-3710)
cugcucagcgccgagguggcccgccugcugcuc

SEQ ID NO: 38331 - RNA, 27 nt, Artificial Sequence
  Integrin alpha-3 (830-838)
cugcucuaccccaccgagaucaccgug

SEQ ID NO: 38332 - RNA, 27 nt, Artificial Sequence
  Putative heat shock protein HSP 90-beta 2 (24-32)
cugaugagccucaucaucaacaccuuc

SEQ ID NO: 38333 - RNA, 27 nt, Artificial Sequence
  LIM and calponin homology domains-containing protein 1 (480-488)
cugaacgaccccaacccgaugaaguac

SEQ ID NO: 38334 - RNA, 27 nt, Artificial Sequence
  Leucine-rich repeat-containing protein 59 (77-85)
cugcccgccgacuucggccgccucgug

SEQ ID NO: 38335 - RNA, 27 nt, Artificial Sequence
  DNA-directed RNA polymerase II subunit RPB2 (74-82)
cugcccgccggcaucaacagcaucgug

SEQ ID NO: 38336 - RNA, 27 nt, Artificial Sequence
  Lysosomal Pro-X carboxypeptidase (301-309)
cugcccgccuggccgaucaaggugguc

SEQ ID NO: 38337 - RNA, 27 nt, Artificial Sequence
  Leucine-tRNA ligase, cytoplasmic (424-432)
cugcccuucgagccggugcccgucauc

SEQ ID NO: 38338 - RNA, 30 nt, Artificial Sequence
  RNA-binding protein 26 (329-338)
cugcccuucccggcccagccccccgugguc

SEQ ID NO: 38339 - RNA, 30 nt, Artificial Sequence
  Putative RNA polymerase II subunit B1 CTD phosphatase RPAP2 (434-443)
cugcccuuccgcggcagcgggaccgccauc

SEQ ID NO: 38340 - RNA, 27 nt, Artificial Sequence
  Major facilitator superfamily domain-containing protein 12 (308-316)
cugcccaagaaguucaucgccaccauc

SEQ ID NO: 38341 - RNA, 27 nt, Artificial Sequence
  Targeting protein for Xklp2 (528-536)
cugccccucccgcacuucgacaccauc

SEQ ID NO: 38342 - RNA, 27 nt, Artificial Sequence
  Heat shock 70 kDa protein 13 (26-34)
cugccccucccgacccccaaggugauc

SEQ ID NO: 38343 - RNA, 27 nt, Artificial Sequence
  Alpha/beta hydrolase domain-containing protein 14B (203-211)
cugcccaaccaccgcgugcucaucaug

SEQ ID NO: 38344 - RNA, 27 nt, Artificial Sequence
  Ubiquitin carboxyl-terminal hydrolase 11 (143-151)
cugcccaacauccagaagguggagguc

SEQ ID NO: 38345 - RNA, 24 nt, Artificial Sequence
  Protein transport protein Sec61 subunit alpha isoform 2 (217-224)
cugcccaaccucaugaaccugauc

SEQ ID NO: 38346 - RNA, 24 nt, Artificial Sequence
  Unconventional myosin-X (129-136)
cugcccccgcacaucuucgccauc

SEQ ID NO: 38347 - RNA, 27 nt, Artificial Sequence
  Mimitin, mitochondrial (121-129)
cugcccccgcccgugcagacccagauc

SEQ ID NO: 38348 - RNA, 27 nt, Artificial Sequence
  Phosphoglycerate kinase 1 (181-189)
cugccccagaaggccggcggguuccuc

SEQ ID NO: 38349 - RNA, 27 nt, Artificial Sequence
  Coatomer subunit beta' (762-770)
cugcccagccaggugucccgcgucgug

SEQ ID NO: 38350 - RNA, 27 nt, Artificial Sequence
  Neutral amino acid transporter B(0) (246-254)
cugcccguggaccacaucagccucauc

SEQ ID NO: 38351 - RNA, 27 nt, Artificial Sequence
  Protein TALPID3 (38-46)
cugcccgugggcaccgggaccagccuc

SEQ ID NO: 38352 - RNA, 27 nt, Artificial Sequence
  Centrosomal protein of 63 kDa (446-454)
cugcccgugagcccgcucggcuccauc

SEQ ID NO: 38353 - RNA, 24 nt, Artificial Sequence
  Clathrin heavy chain 1 (859-866)
cugcccuggcucgaggcccgcauc

SEQ ID NO: 38354 - RNA, 24 nt, Artificial Sequence
  Protein transport protein Sec16A (155-162)
cugcccuaccucccgcacuacauc

SEQ ID NO: 38355 - RNA, 27 nt, Artificial Sequence
  Very-long-chain (3R)-3-hydroxyacyl-CoA dehydratase 3 (314-322)
cugcccuacccggugaagaucaagguc

SEQ ID NO: 38356 - RNA, 27 nt, Artificial Sequence
  HAUS augmin-like complex subunit 6 (131-139)
cugagcgaccucaagcacaugcgcuac

SEQ ID NO: 38357 - RNA, 27 nt, Artificial Sequence
  General transcription factor 3C polypeptide 1 (333-341)
cugagcgacucccagaugaagagcuac

SEQ ID NO: 38358 - RNA, 30 nt, Artificial Sequence
  Importin-7 (681-690)
cugagcgacaccaaguaccucgagaugauc

SEQ ID NO: 38359 - RNA, 27 nt, Artificial Sequence
  Cytoplasmic dynein 1 heavy chain 1 (2161-2169)
cugagcgacguguuccccggcguccag

SEQ ID NO: 38360 - RNA, 30 nt, Artificial Sequence
  Cytoplasmic dynein 1 heavy chain 1 (2161-2170)
cugagcgacguguuccccggcguccaguac

SEQ ID NO: 38361 - RNA, 39 nt, Artificial Sequence
  Creatine kinase B-type (162-174)
cugagcucccucgacggcgaccuggccgggcgcuacuac

SEQ ID NO: 38362 - RNA, 27 nt, Artificial Sequence
  Pumilio homolog 2 (167-175)
cugaccgccgcccagcagcagcaguac

SEQ ID NO: 38363 - RNA, 27 nt, Artificial Sequence
  26S proteasome non-ATPase regulatory subunit 2 (391-399)
cugaccgacgacggcaacaaguggcuc

SEQ ID NO: 38364 - RNA, 30 nt, Artificial Sequence
  Neural cell adhesion molecule L1 (975-984)
cugaccgaccucagcccccaccugcgcuac

SEQ ID NO: 38365 - RNA, 30 nt, Artificial Sequence
  Pre-mRNA-processing-splicing factor 8 (246-255)
cugaccgaccucguggacgacaacuacuuc

SEQ ID NO: 38366 - RNA, 27 nt, Artificial Sequence
  Exosome component 10 (356-364)
cugaccgaccccgccaucgugaagguc

SEQ ID NO: 38367 - RNA, 24 nt, Artificial Sequence
  Tubulin polyglutamylase complex subunit 2 (125-132)
cugaccgacaccuucacggccuac

SEQ ID NO: 38368 - RNA, 27 nt, Artificial Sequence
  Alpha-N-acetylglucosaminidase (121-129)
cugaccgaggccacccccaaccgcuac

SEQ ID NO: 38369 - RNA, 27 nt, Artificial Sequence
  AF4/FMR2 family member 4 (1028-1036)
cugaccgagcaccucaagaacagcuac

SEQ ID NO: 38370 - RNA, 33 nt, Artificial Sequence
  Unconventional myosin-X (71-81)
cugaccgagcuccacggcgggagcaucauguac

SEQ ID NO: 38371 - RNA, 27 nt, Artificial Sequence
  Actin-like protein 6A (94-102)
cugaccgagcucauguucgagcacuac

SEQ ID NO: 38372 - RNA, 33 nt, Artificial Sequence
  Adenosylhomocysteinase 2 (192-202)
cugaccgagcucaccgacgaccaggccaaguac

SEQ ID NO: 38373 - RNA, 27 nt, Artificial Sequence
  Semaphorin-4C (58-66)
cugaccgagcccaccggccuccuguac

SEQ ID NO: 38374 - RNA, 27 nt, Artificial Sequence
  Oxysterol-binding protein-related protein 1 (580-588)
cugaccgaguacauggagcacaccuac

SEQ ID NO: 38375 - RNA, 39 nt, Artificial Sequence
  Melanoma-associated antigen 1 (239-251)
cugacccaggaccucgugcaggagaaguaccuggaguac

SEQ ID NO: 38376 - RNA, 33 nt, Artificial Sequence
  Caspase recruitment domain-containing protein 8 (43-53)
cugguggacaacagcauccgcgagcuccaguac

SEQ ID NO: 38377 - RNA, 27 nt, Artificial Sequence
  Non-canonical poly(A) RNA polymerase PAPD5 (82-90)
cuguacggccgccacuucaacuaccuc

SEQ ID NO: 38378 - RNA, 27 nt, Artificial Sequence
  Ras-related protein Rap-2c (70-78)
cuguacaucaagaacggccagggguuc

SEQ ID NO: 38379 - RNA, 30 nt, Artificial Sequence
  Dedicator of cytokinesis protein 7 (456-465)
cuguacaucuacccccagagccucaacuuc

SEQ ID NO: 38380 - RNA, 27 nt, Artificial Sequence
  Mitochondrial carrier homolog 1 (63-71)
cuguaccuccccagcuucuucaccuac

SEQ ID NO: 38381 - RNA, 27 nt, Artificial Sequence
  Eukaryotic translation initiation factor 3 subunit C-like protein (609-617)
cuguacaaccgcaccauggugcagcuc

SEQ ID NO: 38382 - RNA, 27 nt, Artificial Sequence
  Serine/threonine-protein phosphatase 5 (284-292)
cuguaccccgaccacuuccaccuccug

SEQ ID NO: 38383 - RNA, 27 nt, Artificial Sequence
  ATPase family AAA domain-containing protein 2B (421-429)
cuguaccccgagaucuucgagaaguuc

SEQ ID NO: 38384 - RNA, 27 nt, Artificial Sequence
  Syntenin-1 (45-53)
cuguacccccgccucuacccggagcug

SEQ ID NO: 38385 - RNA, 27 nt, Artificial Sequence
  Nuclear factor erythroid 2-related factor 1 (392-400)
cuguaccaggagguguucggccgccuc

SEQ ID NO: 38386 - RNA, 27 nt, Artificial Sequence
  Rapamycin-insensitive companion of mTOR (1676-1684)
cuguacagcgaggugucccaccuccug

SEQ ID NO: 38387 - RNA, 24 nt, Artificial Sequence
  Nuclear protein 1 (29-36)
cuguacagccucgcccacuccuac

SEQ ID NO: 38388 - RNA, 27 nt, Artificial Sequence
  Protein CLEC16A (171-179)
cuguacaccgaggccaucaaguucuuc

SEQ ID NO: 38389 - RNA, 27 nt, Artificial Sequence
  UDP-glucose:glycoprotein glucosyltransferase 1 (1417-1425)
cuguacguggucgaccucaagaaguuc

SEQ ID NO: 38390 - RNA, 27 nt, Artificial Sequence
  Sorting nexin-30 (408-416)
auggccgacaagaacauccaguacuac

SEQ ID NO: 38391 - RNA, 24 nt, Artificial Sequence
  HLA class I histocompatibility antigen, Cw-2 alpha chain (4-11)
auggccccccgcacccugcuccug

SEQ ID NO: 38392 - RNA, 24 nt, Artificial Sequence
  HLA class I histocompatibility antigen, A-23 alpha chain (4-11)
auggccccccgcacccuggugcuc

SEQ ID NO: 38393 - RNA, 30 nt, Artificial Sequence
  Uroporphyrinogen decarboxylase (66-75)
augcuggacgacuucggcccccaccgcuac

SEQ ID NO: 38394 - RNA, 27 nt, Artificial Sequence
  ATP-binding cassette sub-family F member 1 (474-482)
augcuggacgagcccaccaaccaccuc

SEQ ID NO: 38395 - RNA, 27 nt, Artificial Sequence
  V-type proton ATPase subunit S1 (306-314)
augcugcaggacuuccagauccaggcc

SEQ ID NO: 38396 - RNA, 27 nt, Artificial Sequence
  Lysine-specific demethylase 5A (1454-1462)
augauggugggcgaccugcucgagguc

SEQ ID NO: 38397 - RNA, 27 nt, Artificial Sequence
  Inosine-5'-monophosphate dehydrogenase (348-356)
augauguacagcggcgagcugaaguuc

SEQ ID NO: 38398 - RNA, 27 nt, Artificial Sequence
  Nucleolar pre-ribosomal-associated protein 1 (691-699)
augccccaccugagcaugcagcaggug

SEQ ID NO: 38399 - RNA, 24 nt, Artificial Sequence
  Myoferlin (1357-1364)
augcccccgcuggugaucaagguc

SEQ ID NO: 38400 - RNA, 27 nt, Artificial Sequence
  Serine/threonine-protein kinase D3 (532-540)
augcccgugaccccgcaggccagcguc

SEQ ID NO: 38401 - RNA, 27 nt, Artificial Sequence
  Progressive ankylosis protein homolog (288-296)
augcccuacggcuggcugaccgagauc

SEQ ID NO: 38402 - RNA, 30 nt, Artificial Sequence
  YTH domain-containing family protein 2 (206-215)
augagcgacuccuaccugcccagcuacuac

SEQ ID NO: 38403 - RNA, 27 nt, Artificial Sequence
  Bleomycin hydrolase (410-418)
augaccgacgagugguucagcgaguac

SEQ ID NO: 38404 - RNA, 27 nt, Artificial Sequence
  Eukaryotic initiation factor 4A-III (233-241)
augaccgaccccauccgcauccuggug

SEQ ID NO: 38405 - RNA, 36 nt, Artificial Sequence
  Cytochrome c oxidase subunit 1 (484-495)
augguggaggagcccagcaugaaccuggaguggcuc

SEQ ID NO: 38406 - RNA, 33 nt, Artificial Sequence
  Son of sevenless homolog 2 (615-625)
auguacgccgaccccaacuucgugcgcaccuuc

SEQ ID NO: 38407 - RNA, 27 nt, Artificial Sequence
  Trafficking protein particle complex subunit 2 (93-101)
auguaccugaagaccguggacaaguuc

SEQ ID NO: 38408 - RNA, 27 nt, Artificial Sequence
  Pyruvate carboxylase, mitochondrial (1012-1020)
auguaccccgacguguucgcccacuuc

SEQ ID NO: 38409 - RNA, 27 nt, Artificial Sequence
  Constitutive coactivator of PPAR-gamma-like protein 1 (568-576)
auguaccccuacaucuuccacgugcug

SEQ ID NO: 38410 - RNA, 27 nt, Artificial Sequence
  Msx2-interacting protein (2894-2902)
aacgccagccccgugaucuccagcguc

SEQ ID NO: 38411 - RNA, 27 nt, Artificial Sequence
  Cytoplasmic dynein 1 heavy chain 1 (3346-3354)
aacuucauccccaccaucgugaacuuc

SEQ ID NO: 38412 - RNA, 30 nt, Artificial Sequence
  Ras GTPase-activating-like protein IQGAP3 (896-905)
aacaucauggacaucaagaucggccugcuc

SEQ ID NO: 38413 - RNA, 27 nt, Artificial Sequence
  Tuberin (178-186)
aaccuggccgccuacgugccccuccug

SEQ ID NO: 38414 - RNA, 27 nt, Artificial Sequence
  Nestin (83-91)
aaccuggccgaggagcucgagggcgug

SEQ ID NO: 38415 - RNA, 36 nt, Artificial Sequence
  Spliceosome RNA helicase DDX39B (201-212)
aaccuguucggccgcgggauggacaucgagcgggug

SEQ ID NO: 38416 - RNA, 27 nt, Artificial Sequence
  Protein unc-45 homolog A (297-305)
aaccugcucgaccugcugaccgaggug

SEQ ID NO: 38417 - RNA, 30 nt, Artificial Sequence
  Ras GTPase-activating-like protein IQGAP2 (826-835)
aaccugauggacaucaagaucggccuccug

SEQ ID NO: 38418 - RNA, 42 nt, Artificial Sequence
  Peroxisome proliferator-activated receptor gamma coactivator 1-alpha (767-780)
aacagcgacgacuucgaccccgccuccaccaagagcaaguac

SEQ ID NO: 38419 - RNA, 33 nt, Artificial Sequence
  NADH-ubiquinone oxidoreductase chain 5 (109-119)
aacagcgaccccaacaucaaccaguucuucaag

SEQ ID NO: 38420 - RNA, 27 nt, Artificial Sequence
  Cadherin EGF LAG seven-pass G-type receptor 2 (2584-2592)
aacagcgacacccugcucuuccacuac

SEQ ID NO: 38421 - RNA, 27 nt, Artificial Sequence
  Unconventional myosin-X (1519-1527)
aacagcgacguggucgagcagaucuac

SEQ ID NO: 38422 - RNA, 27 nt, Artificial Sequence
  Dedicator of cytokinesis protein 9 (118-126)
aacagcgacuggcaccuggugaacuac

SEQ ID NO: 38423 - RNA, 27 nt, Artificial Sequence
  Serine/threonine-protein kinase RIO3 (378-386)
aacagcgaggagaugaaggaggccuac

SEQ ID NO: 38424 - RNA, 27 nt, Artificial Sequence
  Nuclear factor erythroid 2-related factor 2 (178-186)
aacaccgacuucggcgacgaguucuac

SEQ ID NO: 38425 - RNA, 27 nt, Artificial Sequence
  26S proteasome non-ATPase regulatory subunit 12 (218-226)
aacaccgagaagcugaagcucaaguac

SEQ ID NO: 38426 - RNA, 27 nt, Artificial Sequence
  Transgelin-2 (106-114)
aacaccaccgacaucuuccagacggug

SEQ ID NO: 38427 - RNA, 33 nt, Artificial Sequence
  Anaphase-promoting complex subunit 7 (236-246)
aacguggaccugcucggcagccuggccgaccug

SEQ ID NO: 38428 - RNA, 27 nt, Artificial Sequence
  C-Jun-amino-terminal kinase-interacting protein 4 (137-145)
aacuacgccgaccagaucagccgccug

SEQ ID NO: 38429 - RNA, 30 nt, Artificial Sequence
  Heterogeneous nuclear ribonucleoprotein U-like protein 1 (472-481)
aacuacgccggccgcugggacgugcugauc

SEQ ID NO: 38430 - RNA, 27 nt, Artificial Sequence
  Basic leucine zipper and W2 domain-containing protein 2 (110-118)
aacuacgcccagguguucaacaagcug

SEQ ID NO: 38431 - RNA, 27 nt, Artificial Sequence
  Baculoviral IAP repeat-containing protein 6 (803-811)
aacuacgccacccgcaucgugacccug

SEQ ID NO: 38432 - RNA, 27 nt, Artificial Sequence
  Cleavage stimulation factor subunit 3 (71-79)
aacuacgacaagguggagaagcuguuc

SEQ ID NO: 38433 - RNA, 27 nt, Artificial Sequence
  E3 ubiquitin-protein ligase SHPRH (409-417)
aacuacuucauccccagccacuacuuc

SEQ ID NO: 38434 - RNA, 30 nt, Artificial Sequence
  Translocon-associated protein subunit alpha (108-117)
aacuacaaggaccugaacggcaacguguuc

SEQ ID NO: 38435 - RNA, 27 nt, Artificial Sequence
  Ubiquitin fusion degradation protein 1 homolog (197-205)
aacuacaacgagaagaucuacgagcug

SEQ ID NO: 38436 - RNA, 27 nt, Artificial Sequence
  Neurofibromin (31-39)
aacuaccccgacgaguucaccaagcug

SEQ ID NO: 38437 - RNA, 27 nt, Artificial Sequence
  Zinc finger MYM-type protein 4 (344-352)
aacuaccagaacgugguccacaagcug

SEQ ID NO: 38438 - RNA, 27 nt, Artificial Sequence
  Alpha-mannosidase 2x (441-449)
aacuaccagcgccuguucgacuucuuc

SEQ ID NO: 38439 - RNA, 27 nt, Artificial Sequence
  Neuron navigator 2 (1368-1376)
aacuacagcaucauccccuaccugcuc

SEQ ID NO: 38440 - RNA, 27 nt, Artificial Sequence
  E1A-binding protein p400 (343-351)
cccuucgccaagccgcugcccaccuuc

SEQ ID NO: 38441 - RNA, 30 nt, Artificial Sequence
  Cyclic AMP-responsive element-binding protein 3-like protein 2 (17-26)
cccagcuacggcgggcagcagcaguccuac

SEQ ID NO: 38442 - RNA, 27 nt, Artificial Sequence
  Coatomer subunit alpha (1152-1160)
cccaccgacgccuaccagcugaacuac

SEQ ID NO: 38443 - RNA, 30 nt, Artificial Sequence
  Endoplasmin (497-506)
cccaccgacaucaccagccuggaccaguac

SEQ ID NO: 38444 - RNA, 27 nt, Artificial Sequence
  Neurofibromin (147-155)
cccaccgaccuggagacccgcagcuac

SEQ ID NO: 38445 - RNA, 27 nt, Artificial Sequence
  H/ACA ribonucleoprotein complex subunit 1 (96-104)
cccuacuucaacgccccgguguaccug

SEQ ID NO: 38446 - RNA, 27 nt, Artificial Sequence
  E3 ubiquitin-protein ligase UBR4 (190-198)
cccuacaucauccacaccgugcuguac

SEQ ID NO: 38447 - RNA, 27 nt, Artificial Sequence
  Procollagen-lysine,2-oxoglutarate 5-dioxygenase 1 (449-457)
cccuacaucagcaacaucuaccugauc

SEQ ID NO: 38448 - RNA, 27 nt, Artificial Sequence
  Zinc finger protein 503 (342-350)
cccuacaagccgggccagaccguguuc

SEQ ID NO: 38449 - RNA, 27 nt, Artificial Sequence
  Synergin gamma (94-102)
cccuaccugggccaggccccguuccuc

SEQ ID NO: 38450 - RNA, 27 nt, Artificial Sequence
  Tubulin polyglutamylase TTLL4 (755-763)
cccuaccugaucagcggcuccaaguuc

SEQ ID NO: 38451 - RNA, 33 nt, Artificial Sequence
  Protein-L-isoaspartate(D-aspartate) O-methyltransferase (45-55)
cccuacauggacagcccgcaguccaucggcuuc

SEQ ID NO: 38452 - RNA, 30 nt, Artificial Sequence
  Oxysterol-binding protein-related protein 10 (414-423)
cccuacaacccgaucaucggcgagaccuuc

SEQ ID NO: 38453 - RNA, 30 nt, Artificial Sequence
  Oxysterol-binding protein-related protein 8 (441-450)
cccuacaacccgauccugggcgagaccuuc

SEQ ID NO: 38454 - RNA, 27 nt, Artificial Sequence
  DNA-dependent protein kinase catalytic subunit (2252-2260)
cccuaccgccugaucuucgagaaguuc

SEQ ID NO: 38455 - RNA, 27 nt, Artificial Sequence
  Ubiquitin-associated protein 2-like (857-865)
cccuacagcggcgaccugaccaaguuc

SEQ ID NO: 38456 - RNA, 27 nt, Artificial Sequence
  Origin recognition complex subunit 5 (303-311)
cccuacuacagcaaguucauccugauc

SEQ ID NO: 38457 - RNA, 27 nt, Artificial Sequence
  Spectrin alpha chain, non-erythrocytic 1 (417-425)
cagcugcucggcagcgcccacgaggug

SEQ ID NO: 38458 - RNA, 27 nt, Artificial Sequence
  LIM and calponin homology domains-containing protein 1 (431-439)
cagauguucgagggcguggcccgcguc

SEQ ID NO: 38459 - RNA, 27 nt, Artificial Sequence
  Protein transport protein Sec61 subunit alpha isoform 2 (272-280)
cagagcgcccugguguccaaccucuac

SEQ ID NO: 38460 - RNA, 36 nt, Artificial Sequence
  HLA class I histocompatibility antigen, A-1 alpha chain (86-97)
cagagcgaggacggcucccacaccauccagaucaug

SEQ ID NO: 38461 - RNA, 27 nt, Artificial Sequence
  Peroxisome proliferator-activated receptor gamma coactivator 1-alpha (61-69)
cagagcgagaucaucuccaaccaguac

SEQ ID NO: 38462 - RNA, 36 nt, Artificial Sequence
  Probable ubiquitin carboxyl-terminal hydrolase FAF-X (1852-1863)
cagagcgaguccgagaccgccggcagcaccaaguac

SEQ ID NO: 38463 - RNA, 27 nt, Artificial Sequence
  Obscurin-like protein 1 (662-670)
cagguggagcccggcgcccugcgcuac

SEQ ID NO: 38464 - RNA, 33 nt, Artificial Sequence
  Regulator of nonsense transcripts 1 (738-748)
caguggccccagccggacaagcccauguucuuc

SEQ ID NO: 38465 - RNA, 27 nt, Artificial Sequence
  Bardet-Biedl syndrome 4 protein (147-155)
caguacgccagcgccuuccacuuccug

SEQ ID NO: 38466 - RNA, 27 nt, Artificial Sequence
  Dynein light chain roadblock-type 1 (48-56)
caguacgccagccugaugcacuccuuc

SEQ ID NO: 38467 - RNA, 27 nt, Artificial Sequence
  Serine/threonine-protein kinase PLK4 (655-663)
caguacgccagccgcuucgugcagcug

SEQ ID NO: 38468 - RNA, 30 nt, Artificial Sequence
  Neuron navigator 2 (639-648)
caguacgaccccuacaccgacagccgcuuc

SEQ ID NO: 38469 - RNA, 27 nt, Artificial Sequence
  Disks large homolog 5 (1316-1324)
caguacaacccccacgugcaccagcug

SEQ ID NO: 38470 - RNA, 27 nt, Artificial Sequence
  YY1-associated protein 1 (219-227)
caguacaaccccaaguuccagacccug

SEQ ID NO: 38471 - RNA, 27 nt, Artificial Sequence
  H/ACA ribonucleoprotein complex non-core subunit NAF1 (421-429)
caguaccccuucccgcugcccguguuc

SEQ ID NO: 38472 - RNA, 27 nt, Artificial Sequence
  ATP-dependent RNA helicase DDX24 (585-593)
caguaccccggccgcagccugguguuc

SEQ ID NO: 38473 - RNA, 33 nt, Artificial Sequence
  Signal transducer and activator of transcription 1-alpha/beta (67-77)
caguacagccgcuucucccuggagaacaacuuc

SEQ ID NO: 38474 - RNA, 27 nt, Artificial Sequence
  Regulatory-associated protein of mTOR (699-707)
caguacaccccccacagccaccaguuc

SEQ ID NO: 38475 - RNA, 27 nt, Artificial Sequence
  60S ribosomal protein L7 (200-208)
cgcuucaaggaggccaacaacuuccug

SEQ ID NO: 38476 - RNA, 27 nt, Artificial Sequence
  Cullin-3 (709-717)
cgcuuccugcccagcccgguggucauc

SEQ ID NO: 38477 - RNA, 27 nt, Artificial Sequence
  40S ribosomal protein S30 (115-123)
cgcuucgugaacgucgugcccaccuuc

SEQ ID NO: 38478 - RNA, 27 nt, Artificial Sequence
  Putative PIP5K1A and PSMD4-like protein (555-563)
cgcauccugagcaagcuccacaccgug

SEQ ID NO: 38479 - RNA, 27 nt, Artificial Sequence
  Schlafen family member 5 (693-701)
cgcaucauggagaagauccggaacgug

SEQ ID NO: 38480 - RNA, 27 nt, Artificial Sequence
  Condensin complex subunit 1 (412-420)
cgccuggccgacaagagcgugcucguc

SEQ ID NO: 38481 - RNA, 27 nt, Artificial Sequence
  DNA replication licensing factor MCM4 (739-747)
cgccuggccgaggcccacgcgaaggug

SEQ ID NO: 38482 - RNA, 30 nt, Artificial Sequence
  Histone-lysine N-methyltransferase ASH1L (2786-2795)
cgccuggacaagagcgcccaccucuucuac

SEQ ID NO: 38483 - RNA, 30 nt, Artificial Sequence
  Prolyl 3-hydroxylase 1 (554-563)
cgccuggacaccccccucuacuucagcuac

SEQ ID NO: 38484 - RNA, 27 nt, Artificial Sequence
  Elongation factor 2 (239-247)
cgccugauggagcccaucuaccucgug

SEQ ID NO: 38485 - RNA, 30 nt, Artificial Sequence
  Solute carrier family 22 member 18 (149-158)
cgccccgccgcccugggccggcucgggcug

SEQ ID NO: 38486 - RNA, 30 nt, Artificial Sequence
  BCL-6 corepressor (1395-1404)
cgccccaugccgcccgaggcccggcgccug

SEQ ID NO: 38487 - RNA, 33 nt, Artificial Sequence
  Protein FAM46B (291-301)
cgcccccggccgagcaccgacgugcgcgcccug

SEQ ID NO: 38488 - RNA, 27 nt, Artificial Sequence
  Nuclear factor 1 X-type (113-121)
cgccaggccgacaagguguggcggcug

SEQ ID NO: 38489 - RNA, 27 nt, Artificial Sequence
  Multiple PDZ domain protein (911-919)
cgccaggacgagaacacccccagcgug

SEQ ID NO: 38490 - RNA, 30 nt, Artificial Sequence
  REST corepressor 1 (336-345)
cgccagcuggacauggagcucgugagcguc

SEQ ID NO: 38491 - RNA, 27 nt, Artificial Sequence
  Bifunctional coenzyme A synthase (204-212)
cgccagguggagaaggccugggcccug

SEQ ID NO: 38492 - RNA, 36 nt, Artificial Sequence
  Serine/threonine-protein kinase SIK3 (368-379)
cgcagcgacgccuacgaccacuacuccgccaucuac

SEQ ID NO: 38493 - RNA, 27 nt, Artificial Sequence
  Truncated EKLF (17-25)
cgcagcgacgagcugacccggcacuac

SEQ ID NO: 38494 - RNA, 30 nt, Artificial Sequence
  Unconventional myosin-X (35-44)
cgcaccgacuacggccagguguucaccuac

SEQ ID NO: 38495 - RNA, 27 nt, Artificial Sequence
  Ribonuclease P protein subunit p21 (66-74)
cgcaccaucgccaagcggcuggugcuc

SEQ ID NO: 38496 - RNA, 27 nt, Artificial Sequence
  Serine/threonine-protein kinase MRCK beta (1490-1498)
cgcaccauggagugggugcagaccauc

SEQ ID NO: 38497 - RNA, 27 nt, Artificial Sequence
  Liprin-beta-1 (738-746)
cgcguggacggccggaugcugcacuac

SEQ ID NO: 38498 - RNA, 33 nt, Artificial Sequence
  DNA damage-binding protein 1 (263-273)
cgcguggaccccaacggcagccgguaccugcuc

SEQ ID NO: 38499 - RNA, 33 nt, Artificial Sequence
  Src substrate cortactin (131-141)
cgcguggaccagagcgccgucggcuucgaguac

SEQ ID NO: 38500 - RNA, 30 nt, Artificial Sequence
  HLA class I histocompatibility antigen, alpha chain E (284-293)
cgcuggaagcccgccagccagccgaccauc

SEQ ID NO: 38501 - RNA, 33 nt, Artificial Sequence
  Serine/threonine-protein phosphatase 2A 55 kDa regulatory subunit B alpha isoform (100-110)
cgcuggcugccccagaagaacgccgcccaguuc

SEQ ID NO: 38502 - RNA, 27 nt, Artificial Sequence
  snRNA-activating protein complex subunit 1 (64-72)
cgcuacuuccugcccccguacaccuuc

SEQ ID NO: 38503 - RNA, 27 nt, Artificial Sequence
  Heterogeneous nuclear ribonucleoprotein H (275-283)
cgcuacggcgacgggggcagcaccuuc

SEQ ID NO: 38504 - RNA, 27 nt, Artificial Sequence
  Rab proteins geranylgeranyltransferase component A 1 (79-87)
cgcuacggcaacacccccuuccuguuc

SEQ ID NO: 38505 - RNA, 30 nt, Artificial Sequence
  Pre-mRNA-processing-splicing factor 8 (1090-1099)
cgcuacaucgaccggauccacaucuucuuc

SEQ ID NO: 38506 - RNA, 27 nt, Artificial Sequence
  Cystine/glutamate transporter (148-156)
cgcuacauccuggagcccuucuucauc

SEQ ID NO: 38507 - RNA, 27 nt, Artificial Sequence
  ER degradation-enhancing alpha-mannosidase-like protein 3 (281-289)
cgcuacaucagccagcccccgcugcuc

SEQ ID NO: 38508 - RNA, 27 nt, Artificial Sequence
  Homeodomain-interacting protein kinase 2 (411-419)
cgcuacaucagccagacccagggccug

SEQ ID NO: 38509 - RNA, 27 nt, Artificial Sequence
  DNA-directed RNA polymerase III subunit RPC3 (90-98)
cgcuacaucuacaccaccaagacgcug

SEQ ID NO: 38510 - RNA, 27 nt, Artificial Sequence
  Probable global transcription activator SNF2L1 (867-875)
cgcuacaaggcccccuuccaccagcug

SEQ ID NO: 38511 - RNA, 27 nt, Artificial Sequence
  Ras GTPase-activating-like protein IQGAP1 (102-110)
cgcuacaaggccaccggccugcacuuc

SEQ ID NO: 38512 - RNA, 30 nt, Artificial Sequence
  RNA pseudouridylate synthase domain-containing protein 2 (461-470)
cgcuacaagggccccggguucgaguacuuc

SEQ ID NO: 38513 - RNA, 27 nt, Artificial Sequence
  Cytoplasmic dynein 1 heavy chain 1 (979-987)
cgcuacaagcuguaccaggagauguuc

SEQ ID NO: 38514 - RNA, 30 nt, Artificial Sequence
  DENN domain-containing protein 1B (346-355)
cgcuacaagcccggcgagccgaucaccuuc

SEQ ID NO: 38515 - RNA, 27 nt, Artificial Sequence
  Trimethylguanosine synthase (469-477)
cgcuaccuggagaagaacgugaagcuc

SEQ ID NO: 38516 - RNA, 27 nt, Artificial Sequence
  Catechol O-methyltransferase (196-204)
cgcuaccugcccgacacccuccugcug

SEQ ID NO: 38517 - RNA, 36 nt, Artificial Sequence
  Zinc finger protein 281 (390-401)
cgcuaccugcccaccgccagcuccaacagcgccuuc

SEQ ID NO: 38518 - RNA, 30 nt, Artificial Sequence
  Histone-binding protein RBBP7 (130-139)
cgcuacaugccccagaacccgcacaucauc

SEQ ID NO: 38519 - RNA, 27 nt, Artificial Sequence
  E3 ubiquitin-protein ligase DZIP3 (194-202)
cgcuacaacggcgggcugcucgaguuc

SEQ ID NO: 38520 - RNA, 27 nt, Artificial Sequence
  Influenza virus NS1A-binding protein (531-539)
cgcuacaaccccgagaacaacaccugg

SEQ ID NO: 38521 - RNA, 27 nt, Artificial Sequence
  Kelch-like protein 11 (425-433)
cgcuacaaccccaaccugaacaccugg

SEQ ID NO: 38522 - RNA, 27 nt, Artificial Sequence
  Solute carrier family 35 member B1 (235-243)
cgcuaccccgccaucaucuacaacauc

SEQ ID NO: 38523 - RNA, 30 nt, Artificial Sequence
  Myotubularin-related protein 5 (78-87)
cgcuaccccccggacauccgggccaccuuc

SEQ ID NO: 38524 - RNA, 30 nt, Artificial Sequence
  Myotubularin-related protein 13 (1004-1013)
cgcuacccccagagcaucuucuccaccuuc

SEQ ID NO: 38525 - RNA, 27 nt, Artificial Sequence
  Golgin subfamily B member 1 (2035-2043)
cgcuaccaggagaagaucagcgcccug

SEQ ID NO: 38526 - RNA, 27 nt, Artificial Sequence
  Zinc phosphodiesterase ELAC protein 2 (313-321)
cgcuaccagcaguggauggagcgguuc

SEQ ID NO: 38527 - RNA, 27 nt, Artificial Sequence
  Supervillin (423-431)
cgcuaccagacccagcccgugacccug

SEQ ID NO: 38528 - RNA, 36 nt, Artificial Sequence
  Magnesium transporter protein 1 (137-148)
cgcuacagcuccgccuucaccaaccggaucuucuuc

SEQ ID NO: 38529 - RNA, 33 nt, Artificial Sequence
  Retinoic acid receptor alpha (412-422)
cgcuacacccccgagcaggacaccaugacguuc

SEQ ID NO: 38530 - RNA, 27 nt, Artificial Sequence
  Beta-hexosaminidase subunit alpha (36-44)
cgcuacgugcuguaccccaacaacuuc

SEQ ID NO: 38531 - RNA, 33 nt, Artificial Sequence
  Beta-hexosaminidase subunit alpha (36-46)
cgcuacgugcuguaccccaacaacuuccaguuc

SEQ ID NO: 38532 - RNA, 27 nt, Artificial Sequence
  39S ribosomal protein L43, mitochondrial (21-29)
cgcuacgugcagcagcugcagcggcuc

SEQ ID NO: 38533 - RNA, 27 nt, Artificial Sequence
  Syntaxin-binding protein 1 (149-157)
agcgccgacuccuuccagagcuucuac

SEQ ID NO: 38534 - RNA, 27 nt, Artificial Sequence
  Histone-binding protein RBBP4 (220-228)
agcuucaaccccuacuccgaguucauc

SEQ ID NO: 38535 - RNA, 27 nt, Artificial Sequence
  Hemoglobin subunit alpha (7-15)
agcuuccccaccaccaagacguacuuc

SEQ ID NO: 38536 - RNA, 27 nt, Artificial Sequence
  Dolichyl-diphosphooligosaccharide-proteinosyltransferase subunit 2 (185-193)
agcuucacccccgugggcgacgucuuc

SEQ ID NO: 38537 - RNA, 36 nt, Artificial Sequence
  Heat shock-related 70 kDa protein 2 (211-222)
agcauccugaccaucgaggacggcaucuucgaggug

SEQ ID NO: 38538 - RNA, 27 nt, Artificial Sequence
  Transcription factor BTF3 (88-96)
agccuggccgccaacaccuucaccauc

SEQ ID NO: 38539 - RNA, 27 nt, Artificial Sequence
  Superkiller viralicidic activity 2-like 2 (92-100)
agccuggccgaccucaugccccgcgug

SEQ ID NO: 38540 - RNA, 30 nt, Artificial Sequence
  Aminopeptidase B (318-327)
agccuggccgacgugaucauccacgagauc

SEQ ID NO: 38541 - RNA, 27 nt, Artificial Sequence
  Epoxide hydrolase 1 (350-358)
agccuggacgaccuccugaccaacgug

SEQ ID NO: 38542 - RNA, 27 nt, Artificial Sequence
  Band 4.1-like protein 2 (550-558)
agccuggacggcgcccccaucggggug

SEQ ID NO: 38543 - RNA, 27 nt, Artificial Sequence
  RNA-binding motif protein, X-linked-like-2 (67-75)
agccuggacggcaaggccaucaaggug

SEQ ID NO: 38544 - RNA, 27 nt, Artificial Sequence
  Telomere-associated protein RIF1 (1157-1165)
agccuggacaagaccucccccgagaug

SEQ ID NO: 38545 - RNA, 27 nt, Artificial Sequence
  Cytoskeleton-associated protein 4 (535-543)
agccuggacaaccucaaggccuccgug

SEQ ID NO: 38546 - RNA, 24 nt, Artificial Sequence
  Signal recognition particle 54 kDa protein (200-207)
agccuguucgaggagaugcuccag

SEQ ID NO: 38547 - RNA, 27 nt, Artificial Sequence
  WD repeat and FYVE domain-containing protein 3 (1518-1526)
agccuguucgagcacuucaucgagcuc

SEQ ID NO: 38548 - RNA, 30 nt, Artificial Sequence
  Programmed cell death 6-interacting protein (103-112)
agccuguucggcggguccgugaagcucgcc

SEQ ID NO: 38549 - RNA, 36 nt, Artificial Sequence
  Junction plakoglobin (670-681)
agccuguucaagcacgaccccgccgccugggaggcg

SEQ ID NO: 38550 - RNA, 39 nt, Artificial Sequence
  Unconventional myosin-Ib (552-564)
agccuguuccccgagggcaacccggccaagaucaaccuc

SEQ ID NO: 38551 - RNA, 27 nt, Artificial Sequence
  Disintegrin and metalloproteinase domain-containing protein 10 (80-88)
agccuguucuccgacgaguucaaggug

SEQ ID NO: 38552 - RNA, 30 nt, Artificial Sequence
  Renin receptor (103-112)
agccuguucuccgaggagacccccgugguc

SEQ ID NO: 38553 - RNA, 27 nt, Artificial Sequence
  Tyrosine-protein phosphatase non-receptor type 9 (479-487)
agccugaucgacuuccuccgcgugguc

SEQ ID NO: 38554 - RNA, 27 nt, Artificial Sequence
  Probable E3 ubiquitin-protein ligase HECTD4 (234-242)
agccugaagaccuucgugcacaccguc

SEQ ID NO: 38555 - RNA, 30 nt, Artificial Sequence
  Acyl-coenzyme A thioesterase 1 isoform X1 (59-68)
agccugcucgccggcaagggguucgccgug

SEQ ID NO: 38556 - RNA, 27 nt, Artificial Sequence
  Cell cycle checkpoint control protein RAD9A (254-262)
agccugcucgacggccacuucgugcug

SEQ ID NO: 38557 - RNA, 27 nt, Artificial Sequence
  Unconventional myosin-Ib (9-17)
agccugcucgacaacaugaucggcgug

SEQ ID NO: 38558 - RNA, 27 nt, Artificial Sequence
  Protein virilizer homolog (1470-1478)
agccugcucgacuccguggucggccug

SEQ ID NO: 38559 - RNA, 27 nt, Artificial Sequence
  Programmed cell death 6-interacting protein (554-562)
agccugcucuccaaccuggacgaggug

SEQ ID NO: 38560 - RNA, 33 nt, Artificial Sequence
  E3 ubiquitin-protein ligase UBR1 (683-693)
agccugauggaccccaacaaguuccuccugcug

SEQ ID NO: 38561 - RNA, 33 nt, Artificial Sequence
  Insulin receptor substrate 2 (1109-1119)
agccugauggagcagguguccggcgucgaggcc

SEQ ID NO: 38562 - RNA, 27 nt, Artificial Sequence
  UHRF1-binding protein 1-like (1293-1301)
agccugaugaacauccagcacuuccuc

SEQ ID NO: 38563 - RNA, 30 nt, Artificial Sequence
  DNA-dependent protein kinase catalytic subunit (3481-3490)
agccugaugaccaaggagaucuccagcgug

SEQ ID NO: 38564 - RNA, 27 nt, Artificial Sequence
  Serpin H1 (304-312)
agccugcccaagggcguggucgaggug

SEQ ID NO: 38565 - RNA, 24 nt, Artificial Sequence
  Vimentin (226-233)
agccugcaggaggagaucgccuuc

SEQ ID NO: 38566 - RNA, 30 nt, Artificial Sequence
  Enhancer of mRNA-decapping protein 4 (777-786)
agccugcaggaguccauccucgcccaggug

SEQ ID NO: 38567 - RNA, 27 nt, Artificial Sequence
  Plasma membrane calcium-transporting ATPase 4 (1197-1205)
agccugcagucccucgagaccagcgug

SEQ ID NO: 38568 - RNA, 27 nt, Artificial Sequence
  Ubiquitin-associated protein 2-like (493-501)
agccugaccuccaagauccccgcccuc

SEQ ID NO: 38569 - RNA, 33 nt, Artificial Sequence
  Ras-related C3 botulinum toxin substrate 1 (39-49)
agccuggugucccccgccagcuucgagaacguc

SEQ ID NO: 38570 - RNA, 27 nt, Artificial Sequence
  Renin receptor (241-249)
agccuguacggcgggaacgccgugguc

SEQ ID NO: 38571 - RNA, 33 nt, Artificial Sequence
  Renin receptor (241-251)
agccuguacggcgggaacgccguggucgagcuc

SEQ ID NO: 38572 - RNA, 39 nt, Artificial Sequence
  Renin receptor (241-253)
agccuguacggcgggaacgccguggucgagcucgugacc

SEQ ID NO: 38573 - RNA, 27 nt, Artificial Sequence
  Nucleolar pre-ribosomal-associated protein 1 (1994-2002)
agccuguacaucaaggacaucuggcuc

SEQ ID NO: 38574 - RNA, 30 nt, Artificial Sequence
  Endoplasmin (71-80)
agccuguacaagaacaaggagaucuuccuc

SEQ ID NO: 38575 - RNA, 27 nt, Artificial Sequence
  Probable ATP-dependent RNA helicase DDX59 (525-533)
agcauggacgaguacgugcaccagauc

SEQ ID NO: 38576 - RNA, 36 nt, Artificial Sequence
  Zinc finger protein 841 (58-69)
agcaugcuggagcagggcaaggagcccuggaccgug

SEQ ID NO: 38577 - RNA, 27 nt, Artificial Sequence
  E3 ubiquitin-protein ligase UBR2 (703-711)
agcaugauggaccccaaccacuuccug

SEQ ID NO: 38578 - RNA, 27 nt, Artificial Sequence
  Neuroblast differentiation-associated protein AHNAK (323-331)
agcauguccgagguggaccugaacguc

SEQ ID NO: 38579 - RNA, 27 nt, Artificial Sequence
  Unhealthy ribosome biogenesis protein 2 homolog (629-637)
agcauguccggcccccugaucggggug

SEQ ID NO: 38580 - RNA, 33 nt, Artificial Sequence
  Desmoplakin (1673-1683)
agcaugguggaggacaucaccggccugcgccuc

SEQ ID NO: 38581 - RNA, 39 nt, Artificial Sequence
  Aminoacyl tRNA synthase complex-interacting multifunctional protein 1 (90-102)
agcaugguguccgagaacgucauccagagcaccgccgug

SEQ ID NO: 38582 - RNA, 27 nt, Artificial Sequence
  Poly (ADP-ribose) polymerase 4 (1186-1194)
agccccuucccggacauccccaaggug

SEQ ID NO: 38583 - RNA, 27 nt, Artificial Sequence
  Neuroblast differentiation-associated protein AHNAK (1150-1158)
agccccaagggcaaguucucccuguuc

SEQ ID NO: 38584 - RNA, 30 nt, Artificial Sequence
  Cohesin subunit SA-1 (459-468)
agccccaacggcaaccugauccgcaugcuc

SEQ ID NO: 38585 - RNA, 27 nt, Artificial Sequence
  Neural Wiskott-Aldrich syndrome protein (82-90)
agcccccgcggcuacuuccacaccuuc

SEQ ID NO: 38586 - RNA, 27 nt, Artificial Sequence
  Collagen alpha-1(VII) chain (586-594)
agcccccgcgugccguccaucgagcug

SEQ ID NO: 38587 - RNA, 27 nt, Artificial Sequence
  Microtubule-associated protein 4 (280-288)
agccccaccaagcuggacgugacccuc

SEQ ID NO: 38588 - RNA, 27 nt, Artificial Sequence
  Kelch repeat and BTB domain-containing protein 2 (594-602)
agccccuggaagccgcccaccuaccug

SEQ ID NO: 38589 - RNA, 27 nt, Artificial Sequence
  Molybdenum cofactor sulfurase (515-523)
agccaggccgacgugauccccgccguc

SEQ ID NO: 38590 - RNA, 27 nt, Artificial Sequence
  Protein FAM63A (74-82)
agcuccgcccccccgggccccacccug

SEQ ID NO: 38591 - RNA, 27 nt, Artificial Sequence
  Coatomer subunit gamma-2 (186-194)
agcuccgacaacaucauggugcaguac

SEQ ID NO: 38592 - RNA, 30 nt, Artificial Sequence
  Oxysterol-binding protein-related protein 8 (244-253)
agcuccgacagcacccacgugaccuucuac

SEQ ID NO: 38593 - RNA, 33 nt, Artificial Sequence
  RNA-binding protein with multiple splicing 2 (84-94)
agcuccgacaccacccagcagggcuggaaguac

SEQ ID NO: 38594 - RNA, 27 nt, Artificial Sequence
  Discoidin domain-containing receptor 2 (676-684)
agcuccgacgugcgcaccgucagcuac

SEQ ID NO: 38595 - RNA, 42 nt, Artificial Sequence
  RNA-binding protein EWS (265-278)
agcuccuuccgccaggaccaccccagcuccaugggcguguac

SEQ ID NO: 38596 - RNA, 27 nt, Artificial Sequence
  Bromodomain and WD repeat-containing protein 1 (343-351)
agcaccgaccacgugauccgcauguac

SEQ ID NO: 38597 - RNA, 30 nt, Artificial Sequence
  Integrin alpha-5 (179-188)
agcaccgacaacuucacccgcauccuggag

SEQ ID NO: 38598 - RNA, 27 nt, Artificial Sequence
  Actin filament-associated protein 1 (443-451)
agcaccgaccccgaggcccugcacuac

SEQ ID NO: 38599 - RNA, 33 nt, Artificial Sequence
  Eukaryotic translation initiation factor 2A (26-36)
agcaccgacguggacaagaccggcgccuccuac

SEQ ID NO: 38600 - RNA, 30 nt, Artificial Sequence
  NADH dehydrogenase (ubiquinone) iron-sulfur protein 8, mitochondrial (174-183)
agcaccgagacccacgaggagcugcucuac

SEQ ID NO: 38601 - RNA, 39 nt, Artificial Sequence
  Src substrate cortactin (285-297)
agcaccuucgaggacgugacccaggucuccagcgccuac

SEQ ID NO: 38602 - RNA, 30 nt, Artificial Sequence
  Protein Smaug homolog 1 (46-55)
agcguggacuacggccagacccacuacuac

SEQ ID NO: 38603 - RNA, 27 nt, Artificial Sequence
  Eukaryotic peptide chain release factor subunit 1 (70-78)
agcgugcugggcgccaucaccuccguc

SEQ ID NO: 38604 - RNA, 30 nt, Artificial Sequence
  Elongation factor 2 (500-509)
agcgugucccccgucgugcgcguggccguc

SEQ ID NO: 38605 - RNA, 27 nt, Artificial Sequence
  Serum paraoxonase/arylesterase 2 (334-342)
agcguguacgacggcaagcugcucauc

SEQ ID NO: 38606 - RNA, 33 nt, Artificial Sequence
  Renin receptor (47-57)
agcuggcccggccuggccguggggaaccucuuc

SEQ ID NO: 38607 - RNA, 27 nt, Artificial Sequence
  Short transient receptor potential channel 4-associated protein (540-548)
agcuacgccgaccagauguuccugcuc

SEQ ID NO: 38608 - RNA, 27 nt, Artificial Sequence
  Ankyrin repeat and BTB/POZ domain-containing protein 2 (419-427)
agcuacgccgagaccccccugcagcuc

SEQ ID NO: 38609 - RNA, 27 nt, Artificial Sequence
  Zinc-binding alcohol dehydrogenase domain-containing protein 2 (16-24)
agcuacgcccgccacuuccuggacuuc

SEQ ID NO: 38610 - RNA, 30 nt, Artificial Sequence
  Spatacsin (908-917)
agcuacgccucccugcagcagaacaagugg

SEQ ID NO: 38611 - RNA, 30 nt, Artificial Sequence
  Tubulin polyglutamylase TTLL4 (773-782)
agcuacgacccccugcgcaucuaccucuuc

SEQ ID NO: 38612 - RNA, 27 nt, Artificial Sequence
  Kinectin (1090-1098)
agcuacggcgaguggcugcacggguuc

SEQ ID NO: 38613 - RNA, 27 nt, Artificial Sequence
  Serine/threonine-protein kinase 3 (65-73)
agcuacggcuccguguucaaggccauc

SEQ ID NO: 38614 - RNA, 27 nt, Artificial Sequence
  Ubiquitin-like modifier-activating enzyme 1 (921-929)
agcuacaagaacggcuuccugaaccuc

SEQ ID NO: 38615 - RNA, 27 nt, Artificial Sequence
  Unconventional myosin-Va (78-86)
agcuaccugcacgagcccgccgugcuc

SEQ ID NO: 38616 - RNA, 27 nt, Artificial Sequence
  Actin-related protein 10 (66-74)
agcuaccugaaggaguucauccacauc

SEQ ID NO: 38617 - RNA, 27 nt, Artificial Sequence
  Kelch-like protein 15 (402-410)
agcuacaacggcaagcuguacguguuc

SEQ ID NO: 38618 - RNA, 33 nt, Artificial Sequence
  Coatomer subunit alpha (369-379)
agcuacaaccccgccgagaacgccgugcugcuc

SEQ ID NO: 38619 - RNA, 27 nt, Artificial Sequence
  Protein artemis (321-329)
agcuacuccgagaucaaggacuuccug

SEQ ID NO: 38620 - RNA, 27 nt, Artificial Sequence
  Zinc finger protein 24 (343-351)
agcuacucccagagcuccaaccuguuc

SEQ ID NO: 38621 - RNA, 27 nt, Artificial Sequence
  Melanoma-associated antigen 3 (282-290)
agcuacgugaagguccugcaccacaug

SEQ ID NO: 38622 - RNA, 27 nt, Artificial Sequence
  Basement membrane-specific heparan sulfate proteoglycan core protein (176-184)
agcuacgugaccuccccccagggcuuc

SEQ ID NO: 38623 - RNA, 27 nt, Artificial Sequence
  Cell differentiation protein RCD1 homolog (6-14)
accgccgcccccgugccgaccacgcug

SEQ ID NO: 38624 - RNA, 27 nt, Artificial Sequence
  Protein PRRC2C (2488-2496)
accgccauccacaacuuccccaccgug

SEQ ID NO: 38625 - RNA, 27 nt, Artificial Sequence
  Lipoma-preferred partner (284-292)
accgccauggaccagguguuccacguc

SEQ ID NO: 38626 - RNA, 27 nt, Artificial Sequence
  Integrator complex subunit 1 (301-309)
accgccaccaugcacauccuggugguc

SEQ ID NO: 38627 - RNA, 27 nt, Artificial Sequence
  Histone-lysine N-methyltransferase 2C (316-324)
accuuccaggacuucagccacaucuuc

SEQ ID NO: 38628 - RNA, 27 nt, Artificial Sequence
  Probable ATP-dependent RNA helicase DDX27 (430-438)
accuucaccgaccacgugaugcuguuc

SEQ ID NO: 38629 - RNA, 27 nt, Artificial Sequence
  Zinc finger protein RFP (458-466)
accuucaccuucagccacgccacguuc

SEQ ID NO: 38630 - RNA, 27 nt, Artificial Sequence
  WD repeat-containing protein 61 (32-40)
acccacgugggcaaggucaacaucuuc

SEQ ID NO: 38631 - RNA, 27 nt, Artificial Sequence
  Very-long-chain enoyl-CoA reductase (28-36)
accaucgccgagaucaagaaccuguuc

SEQ ID NO: 38632 - RNA, 27 nt, Artificial Sequence
  Heat shock-related 70 kDa protein 2 (214-222)
accaucgaggacggcaucuucgaggug

SEQ ID NO: 38633 - RNA, 27 nt, Artificial Sequence
  40S ribosomal protein S4, X isoform (127-135)
accauccgcuaccccgacccgcugauc

SEQ ID NO: 38634 - RNA, 27 nt, Artificial Sequence
  Protein FAM73A (584-592)
acccuggccgaggaccucaugcagcug

SEQ ID NO: 38635 - RNA, 33 nt, Artificial Sequence
  Calmodulin-regulated spectrin-associated protein 1 (102-112)
acccuggccgagcuccagcccccggugcagcug

SEQ ID NO: 38636 - RNA, 27 nt, Artificial Sequence
  Importin-4 (587-595)
acccuggccgagaccauccagggccuc

SEQ ID NO: 38637 - RNA, 27 nt, Artificial Sequence
  E3 ubiquitin-protein ligase UBR4 (345-353)
acccuggacgccgccaucagcaaggug

SEQ ID NO: 38638 - RNA, 27 nt, Artificial Sequence
  Molybdenum cofactor sulfurase (474-482)
acccuggacgacgugcaggccuuccuc

SEQ ID NO: 38639 - RNA, 27 nt, Artificial Sequence
  Solute carrier family 23 member 2 (493-501)
acccuguucggcaugaucaccgccgug

SEQ ID NO: 38640 - RNA, 33 nt, Artificial Sequence
  Putative elongation factor 1-alpha-like 3 (142-152)
acccugggcgugaagcagcucaucgucggggug

SEQ ID NO: 38641 - RNA, 27 nt, Artificial Sequence
  Dynactin subunit 1 (646-654)
acccugcaccgcuacgagcacgcccuc

SEQ ID NO: 38642 - RNA, 30 nt, Artificial Sequence
  60S acidic ribosomal protein P0 (50-59)
acccugcacagccgcuuccucgagggcgug

SEQ ID NO: 38643 - RNA, 27 nt, Artificial Sequence
  Peptidyl-prolyl cis-trans isomerase FKBP9 (457-465)
acccugcucgacagcaccuggaaccug

SEQ ID NO: 38644 - RNA, 30 nt, Artificial Sequence
  Midasin (3030-3039)
acccugcucgaggugggccagaucgccguc

SEQ ID NO: 38645 - RNA, 30 nt, Artificial Sequence
  Puromycin-sensitive aminopeptidase (786-795)
acccugcuccccgaccugauccagaaggug

SEQ ID NO: 38646 - RNA, 33 nt, Artificial Sequence
  116 kDa U5 small nuclear ribonucleoprotein component (103-113)
acccugauggagcagacccuccccgugacgguc

SEQ ID NO: 38647 - RNA, 27 nt, Artificial Sequence
  SH3 domain-binding glutamic acid-rich-like protein 3 (218-226)
acccugcaggaguuccucaagcuggcc

SEQ ID NO: 38648 - RNA, 27 nt, Artificial Sequence
  Zinc finger BED domain-containing protein 5 (529-537)
acccugagcgacuuccucaccgagauc

SEQ ID NO: 38649 - RNA, 27 nt, Artificial Sequence
  Elongation protein 4 homolog (S. cerevisiae), isoform CRA_b (319-327)
acccugagcgacguggucgugggccuc

SEQ ID NO: 38650 - RNA, 27 nt, Artificial Sequence
  Protein MON2 homolog (629-637)
acccugagcaacaaguccuacagcgug

SEQ ID NO: 38651 - RNA, 39 nt, Artificial Sequence
  Malate dehydrogenase, mitochondrial (54-66)
acccuguacgacaucgcccacacccccggcguggccgcg

SEQ ID NO: 38652 - RNA, 27 nt, Artificial Sequence
  Cyclic AMP-dependent transcription factor ATF-6 beta (30-38)
acccuguacagcggccucgacgaggug

SEQ ID NO: 38653 - RNA, 30 nt, Artificial Sequence
  NAD(P)H dehydrogenase (quinone) 1 (124-133)
acccccgccgacgcccgcauccagauccug

SEQ ID NO: 38654 - RNA, 27 nt, Artificial Sequence
  Dual specificity protein phosphatase 4 (356-364)
acccccgccaccccgacgagccaguuc

SEQ ID NO: 38655 - RNA, 27 nt, Artificial Sequence
  Cytoplasmic dynein 1 heavy chain 1 (264-272)
accccccgcauccagggccugaccgug

SEQ ID NO: 38656 - RNA, 27 nt, Artificial Sequence
  Exostosin-2 (555-563)
accagcgacgagcugcaguucggcuac

SEQ ID NO: 38657 - RNA, 30 nt, Artificial Sequence
  Anoctamin-1 (662-671)
accagcgacuucaucccccgccugguguac

SEQ ID NO: 38658 - RNA, 33 nt, Artificial Sequence
  Actin-binding LIM protein 3 (350-360)
accagcgaggacaucucccagaccagcaaguac

SEQ ID NO: 38659 - RNA, 33 nt, Artificial Sequence
  Serine/threonine-protein kinase MRCK alpha (699-709)
accagcgagcuggacaagcucaccacgcuguac

SEQ ID NO: 38660 - RNA, 30 nt, Artificial Sequence
  Catenin beta-1 (297-306)
accaccgacugccugcagauccucgccuac

SEQ ID NO: 38661 - RNA, 30 nt, Artificial Sequence
  Junction plakoglobin (287-296)
accaccgacugccugcagcuccuggccuac

SEQ ID NO: 38662 - RNA, 27 nt, Artificial Sequence
  ATP-dependent 6-phosphofructokinase, muscle type (251-259)
accaccgacuucaucuucaaccuguac

SEQ ID NO: 38663 - RNA, 27 nt, Artificial Sequence
  Serine/threonine-protein kinase N2 (73-81)
accaccgacaagaagagccuggccuac

SEQ ID NO: 38664 - RNA, 27 nt, Artificial Sequence
  Heterogeneous nuclear ribonucleoprotein F (256-264)
accaccgaccuguucggccgcgaccuc

SEQ ID NO: 38665 - RNA, 30 nt, Artificial Sequence
  Heterogeneous nuclear ribonucleoprotein F (256-265)
accaccgaccuguucggccgcgaccucagc

SEQ ID NO: 38666 - RNA, 30 nt, Artificial Sequence
  Cofilin-1 (63-72)
accguggacgaccccuacgccaccuucguc

SEQ ID NO: 38667 - RNA, 27 nt, Artificial Sequence
  Heat shock cognate 71 kDa protein (138-146)
accgugaccaacgccgucgugacggug

SEQ ID NO: 38668 - RNA, 27 nt, Artificial Sequence
  Kelch-like protein 9 (442-450)
accguguacggcgggcugauguacauc

SEQ ID NO: 38669 - RNA, 27 nt, Artificial Sequence
  Kelch-like protein 13 (468-476)
accguguacggcggggucauguacauc

SEQ ID NO: 38670 - RNA, 30 nt, Artificial Sequence
  60S ribosomal protein L13 (24-33)
accugguucaaccagcccgcccgcaagauc

SEQ ID NO: 38671 - RNA, 33 nt, Artificial Sequence
  WD repeat-containing protein 35 (163-173)
accuggagcgccgacuccaaggugcugcucuuc

SEQ ID NO: 38672 - RNA, 36 nt, Artificial Sequence
  26S protease regulatory subunit 4 (183-194)
accuacgccgacaucggcgggcuggacaaccagauc

SEQ ID NO: 38673 - RNA, 27 nt, Artificial Sequence
  DNA replication licensing factor MCM3 (90-98)
accuacgccaagcaguacgaggaguuc

SEQ ID NO: 38674 - RNA, 27 nt, Artificial Sequence
  AT-rich interactive domain-containing protein 2 (938-946)
accuacgcccccgccauccaccagauc

SEQ ID NO: 38675 - RNA, 27 nt, Artificial Sequence
  Ataxin-2-like protein (167-175)
accuacgagggcaucuucaagacccug

SEQ ID NO: 38676 - RNA, 27 nt, Artificial Sequence
  Dedicator of cytokinesis protein 7 (588-596)
accuacuucgacaagaacuacaaccug

SEQ ID NO: 38677 - RNA, 27 nt, Artificial Sequence
  Tubulin beta-6 chain (156-164)
accuacggcgaccugaaccaccucgug

SEQ ID NO: 38678 - RNA, 27 nt, Artificial Sequence
  Cytoplasmic aconitate hydratase (542-550)
accuacaucaagagccccccguucuuc

SEQ ID NO: 38679 - RNA, 27 nt, Artificial Sequence
  Fanconi anemia group M protein (303-311)
accuacauccagauccuggagagcuuc

SEQ ID NO: 38680 - RNA, 27 nt, Artificial Sequence
  Protein FAM178B (655-663)
accuacauccgcuggcaggagcugcuc

SEQ ID NO: 38681 - RNA, 27 nt, Artificial Sequence
  DNA-dependent protein kinase catalytic subunit (523-531)
accuacaaggacuacguggaccuguuc

SEQ ID NO: 38682 - RNA, 27 nt, Artificial Sequence
  ETS translocation variant 3 (134-142)
accuacaaguucaacuucaacaagcug

SEQ ID NO: 38683 - RNA, 33 nt, Artificial Sequence
  Leucine-rich repeat-containing protein 58 (257-267)
accuaccugccccgcgagauccucaaccugauc

SEQ ID NO: 38684 - RNA, 30 nt, Artificial Sequence
  Eukaryotic translation initiation factor 3 subunit I (47-56)
accuacaugggccacaccggggccgugugg

SEQ ID NO: 38685 - RNA, 27 nt, Artificial Sequence
  F-box only protein 38 (157-165)
accuacaugccccacgugcacauccug

SEQ ID NO: 38686 - RNA, 30 nt, Artificial Sequence
  Protein polybromo-1 (261-270)
accuacaacgagcccggcagccagguguuc

SEQ ID NO: 38687 - RNA, 30 nt, Artificial Sequence
  Cell division cycle and apoptosis regulator protein 1 (191-200)
accuacaaccccaacaugccguucaagugg

SEQ ID NO: 38688 - RNA, 27 nt, Artificial Sequence
  Cell cycle control protein 50A (296-304)
accuacaacuaccccgugcacuacuuc

SEQ ID NO: 38689 - RNA, 27 nt, Artificial Sequence
  Aryl hydrocarbon receptor (47-55)
accuaccccgccgagcugaacaacauc

SEQ ID NO: 38690 - RNA, 27 nt, Artificial Sequence
  Elongation factor 1-gamma (5-13)
accuaccccgagaacuggcgcgccuuc

SEQ ID NO: 38691 - RNA, 27 nt, Artificial Sequence
  Pre-mRNA-processing-splicing factor 8 (224-232)
accuaccagcgcuggcaguucacccug

SEQ ID NO: 38692 - RNA, 27 nt, Artificial Sequence
  Helicase SKI2W (746-754)
accuacaccaugauccugaaccuccug

SEQ ID NO: 38693 - RNA, 27 nt, Artificial Sequence
  U5 small nuclear ribonucleoprotein 200 kDa helicase (604-612)
accuacacccagcuggugcgccucauc

SEQ ID NO: 38694 - RNA, 27 nt, Artificial Sequence
  Catenin beta-1 (330-338)
accuacaccuacgagaagcugcucugg

SEQ ID NO: 38695 - RNA, 27 nt, Artificial Sequence
  Alanine-tRNA ligase, cytoplasmic (24-32)
accuacgugcacagcuccgccaccauc

SEQ ID NO: 38696 - RNA, 27 nt, Artificial Sequence
  E3 ubiquitin-protein ligase RNF213 (931-939)
accuacgugaaggagaucgaggucugg

SEQ ID NO: 38697 - RNA, 27 nt, Artificial Sequence
  tRNA wybutosine-synthesizing protein 4 (507-515)
accuacgugcccuggccgcugaugcuc

SEQ ID NO: 38698 - RNA, 27 nt, Artificial Sequence
  Cholinephosphotransferase 1 (178-186)
accuacgugagcggcaugcugcgcuuc

SEQ ID NO: 38699 - RNA, 27 nt, Artificial Sequence
  Kinectin (1222-1230)
accuacgugaccgagguccgcgagcug

SEQ ID NO: 38700 - RNA, 27 nt, Artificial Sequence
  Renin receptor (97-105)
guggccaacagcauccacucccuguuc

SEQ ID NO: 38701 - RNA, 27 nt, Artificial Sequence
  Elongation factor 1-alpha 1 (433-441)
guggccgucggcgugaucaaggccgug

SEQ ID NO: 38702 - RNA, 27 nt, Artificial Sequence
  Glycogen synthase kinase-3 alpha (117-125)
guggccuacaccgacaucaaggucauc

SEQ ID NO: 38703 - RNA, 27 nt, Artificial Sequence
  Influenza virus NS1A-binding protein (484-492)
guguucgaccccgucaccaagcugugg

SEQ ID NO: 38704 - RNA, 39 nt, Artificial Sequence
  Cathepsin D (178-190)
guguucggcgaggccaccaagcagcccgggaucaccuuc

SEQ ID NO: 38705 - RNA, 30 nt, Artificial Sequence
  Pre-mRNA-processing factor 19 (271-280)
guguuccaccccagccaggaccuggucuuc

SEQ ID NO: 38706 - RNA, 27 nt, Artificial Sequence
  Heterogeneous nuclear ribonucleoprotein C-like 1 (18-26)
guguucaucggcaaccugaacacccuc

SEQ ID NO: 38707 - RNA, 33 nt, Artificial Sequence
  Tectonic-3 (150-160)
guguucauggacagcaacggcauccgccaguuc

SEQ ID NO: 38708 - RNA, 30 nt, Artificial Sequence
  Serine/threonine-protein kinase N2 (753-762)
guguucagcgagccccgcgccgucuucuac

SEQ ID NO: 38709 - RNA, 27 nt, Artificial Sequence
  Paired amphipathic helix protein Sin3b (212-220)
guguucaccgaggucgccaaccuguuc

SEQ ID NO: 38710 - RNA, 33 nt, Artificial Sequence
  Cytospin-A (478-488)
gugaucgacgaggacgucaagagcggccgcuac

SEQ ID NO: 38711 - RNA, 27 nt, Artificial Sequence
  Bifunctional glutamate/proline-tRNA ligase (506-514)
gugaucgaccccgucgccccgcgcuac

SEQ ID NO: 38712 - RNA, 30 nt, Artificial Sequence
  Zinc finger protein 638 (208-217)
gugaucgacuacggccacgccagcaaguac

SEQ ID NO: 38713 - RNA, 27 nt, Artificial Sequence
  DNA replication licensing factor MCM4 (151-159)
gugaucuggggcaccgacgucaacgug

SEQ ID NO: 38714 - RNA, 27 nt, Artificial Sequence
  Eukaryotic initiation factor 4A-II (181-189)
gugcuggacgaggccgacgagaugcuc

SEQ ID NO: 38715 - RNA, 27 nt, Artificial Sequence
  Protein VPRBP (540-548)
gugcuggacgaggccggcagcaccguc

SEQ ID NO: 38716 - RNA, 27 nt, Artificial Sequence
  Protein ELYS (1430-1438)
gugcuggacgagggccucaccagcguc

SEQ ID NO: 38717 - RNA, 33 nt, Artificial Sequence
  WD repeat-containing protein 48 (472-482)
gugcuggaccccaacauggaccuccgcaccguc

SEQ ID NO: 38718 - RNA, 33 nt, Artificial Sequence
  Acylamino-acid-releasing enzyme (226-236)
gugcuggacgucgagagcggcaacaucuccgug

SEQ ID NO: 38719 - RNA, 30 nt, Artificial Sequence
  Serine/threonine-protein kinase Sgk1 (270-279)
gugcuggacuacaucaacggcggggagcuc

SEQ ID NO: 38720 - RNA, 33 nt, Artificial Sequence
  Serine/threonine-protein kinase Sgk1 (270-280)
gugcuggacuacaucaacggcggggagcucuuc

SEQ ID NO: 38721 - RNA, 36 nt, Artificial Sequence
  Serine/threonine-protein kinase Sgk1 (270-281)
gugcuggacuacaucaacggcggggagcucuucuac

SEQ ID NO: 38722 - RNA, 27 nt, Artificial Sequence
  RNA-binding protein 34 (333-341)
gugcuguucgagaacaccgacagcguc

SEQ ID NO: 38723 - RNA, 30 nt, Artificial Sequence
  Major prion protein (233-242)
gugcuguucagcucccccccggucauccuc

SEQ ID NO: 38724 - RNA, 27 nt, Artificial Sequence
  Protein transport protein Sec16A (1388-1396)
gugcugaucggcagcaaccacucccuc

SEQ ID NO: 38725 - RNA, 27 nt, Artificial Sequence
  ATP-binding cassette sub-family D member 3 (541-549)
gugcugaaggaguaccucgacaacguc

SEQ ID NO: 38726 - RNA, 30 nt, Artificial Sequence
  Phosphotriesterase-related protein (148-157)
gugcugaugaacgagauccuccacggcgcc

SEQ ID NO: 38727 - RNA, 33 nt, Artificial Sequence
  Eukaryotic translation initiation factor 4 gamma 1 (187-197)
gugcugaugaaccagcccccgcagaucgccccc

SEQ ID NO: 38728 - RNA, 27 nt, Artificial Sequence
  GDP-L-fucose synthase (187-195)
gugcugcccggccucauccacaagguc

SEQ ID NO: 38729 - RNA, 27 nt, Artificial Sequence
  CCR4-NOT transcription complex subunit 4 (471-479)
gugcugccccagcgcuucccgcaguuc

SEQ ID NO: 38730 - RNA, 27 nt, Artificial Sequence
  Mini-chromosome maintenance complex-binding protein (204-212)
gugcugcccagcguccucaacaaguuc

SEQ ID NO: 38731 - RNA, 30 nt, Artificial Sequence
  Fatty acid synthase (1496-1505)
gugcugcagggcgaccucgucaugaacgug

SEQ ID NO: 38732 - RNA, 27 nt, Artificial Sequence
  Coatomer subunit alpha (130-138)
gugcugaccggccacaaccacuacguc

SEQ ID NO: 38733 - RNA, 27 nt, Artificial Sequence
  Protein O-GlcNAcase (247-255)
gugcuguggaccggccccaaggucgug

SEQ ID NO: 38734 - RNA, 33 nt, Artificial Sequence
  Integral membrane protein 2C (51-61)
gugcuguacgaggacagccucuccagccagguc

SEQ ID NO: 38735 - RNA, 27 nt, Artificial Sequence
  Deoxynucleotidyltransferase terminal-interacting protein 2 (359-367)
gugaugaagagccugacccagaccuuc

SEQ ID NO: 38736 - RNA, 30 nt, Artificial Sequence
  Protein C-ets-2 (78-87)
gugaugagccaggcccugaaggccaccuuc

SEQ ID NO: 38737 - RNA, 24 nt, Artificial Sequence
  ER membrane protein complex subunit 1 (192-199)
gugcccuucagccacgucaacauc

SEQ ID NO: 38738 - RNA, 27 nt, Artificial Sequence
  ER membrane protein complex subunit 1 (192-200)
gugcccuucagccacgucaacaucgug

SEQ ID NO: 38739 - RNA, 24 nt, Artificial Sequence
  Interferon-induced 35 kDa protein (52-59)
gugcccuucagcgucccgaagauc

SEQ ID NO: 38740 - RNA, 27 nt, Artificial Sequence
  Protein transport protein Sec16A (69-77)
gugccccacuucccgacccccagcauc

SEQ ID NO: 38741 - RNA, 30 nt, Artificial Sequence
  Filamin-A (436-445)
gugcccaucccgcgcagccccuacaccguc

SEQ ID NO: 38742 - RNA, 27 nt, Artificial Sequence
  Tubulin alpha-1C chain (394-402)
gugcccaaggacgucaacgccgccauc

SEQ ID NO: 38743 - RNA, 27 nt, Artificial Sequence
  Helicase with zinc finger domain 2 (656-664)
gugcccgucggcuucuucagccacauc

SEQ ID NO: 38744 - RNA, 27 nt, Artificial Sequence
  RNA-binding protein NOB1 (300-308)
gugagcgacgacggcacccugcacaug

SEQ ID NO: 38745 - RNA, 33 nt, Artificial Sequence
  rRNA 2'-O-methyltransferase fibrillarin (174-184)
gugagcgacaucgucggccccgacgggcuggug

SEQ ID NO: 38746 - RNA, 30 nt, Artificial Sequence
  Glyoxalase domain-containing protein 4 (145-154)
gugagcgaccugcagaagucccucaacuac

SEQ ID NO: 38747 - RNA, 27 nt, Artificial Sequence
  Tripeptidyl-peptidase 1 (68-76)
gugagcgaccccuccagcccgcaguac

SEQ ID NO: 38748 - RNA, 27 nt, Artificial Sequence
  DENN domain-containing protein 1B (677-685)
gugagcgaccccaccuccggccuggac

SEQ ID NO: 38749 - RNA, 30 nt, Artificial Sequence
  DENN domain-containing protein 1B (677-686)
gugagcgaccccaccuccggccuggacuuc

SEQ ID NO: 38750 - RNA, 33 nt, Artificial Sequence
  Liprin-beta-1 (207-217)
gugagcgagauggacuccgagcgccugcaguac

SEQ ID NO: 38751 - RNA, 27 nt, Artificial Sequence
  DnaJ homolog subfamily B member 12 (287-295)
gugaccgaccaccugggcgucguguac

SEQ ID NO: 38752 - RNA, 27 nt, Artificial Sequence
  Selenocysteine insertion sequence-binding protein 2 (645-653)
gugaccgaccugcucaaggagcugguc

SEQ ID NO: 38753 - RNA, 27 nt, Artificial Sequence
  Disabled homolog 2 (128-136)
gugaccgacaaccgcgccuucggcuac

SEQ ID NO: 38754 - RNA, 27 nt, Artificial Sequence
  Integrin beta-1 (77-85)
gugaccgaggaguuccagcccgucuac

SEQ ID NO: 38755 - RNA, 33 nt, Artificial Sequence
  Neutral alpha-glucosidase AB (29-39)
gugaccgagggcggggagcccuaccgccuguac

SEQ ID NO: 38756 - RNA, 27 nt, Artificial Sequence
  Cohesin subunit SA-1 (101-109)
guggucgacgacuggaucgagagcuac

SEQ ID NO: 38757 - RNA, 30 nt, Artificial Sequence
  Tubulin-tyrosine ligase (13-22)
guguacgccgaggucagccgccugcuccug

SEQ ID NO: 38758 - RNA, 27 nt, Artificial Sequence
  E3 ubiquitin-protein ligase MARCH6 (744-752)
guguacgccaacggcauccgcaacauc

SEQ ID NO: 38759 - RNA, 27 nt, Artificial Sequence
  Enoyl-CoA delta isomerase 2, mitochondrial (230-238)
guguacgccagcgaccgcgccaccuuc

SEQ ID NO: 38760 - RNA, 27 nt, Artificial Sequence
  Receptor tyrosine-protein kinase erbB-3 (110-118)
guguacgacggcaaguucgccaucuuc

SEQ ID NO: 38761 - RNA, 27 nt, Artificial Sequence
  SRR1-like protein (178-186)
guguacgacccccuguucagccagcuc

SEQ ID NO: 38762 - RNA, 33 nt, Artificial Sequence
  Prolow-density lipoprotein receptor-related protein 1 (736-746)
guguacgagggccccgagcugaaccacgccuuc

SEQ ID NO: 38763 - RNA, 30 nt, Artificial Sequence
  Partitioning defective 3 homolog B (682-691)
guguacuuccccgaccagcacaucaacuuc

SEQ ID NO: 38764 - RNA, 27 nt, Artificial Sequence
  Exocyst complex component 6B (452-460)
guguacggcuuccccgucaaccagcug

SEQ ID NO: 38765 - RNA, 33 nt, Artificial Sequence
  Phosphatidylinositol-binding clathrin assembly protein (87-97)
guguacggcaacgagcgcuucauccaguaccug

SEQ ID NO: 38766 - RNA, 27 nt, Artificial Sequence
  Alanine-tRNA ligase, cytoplasmic (92-100)
guguaccaccacaccuucuucgagaug

SEQ ID NO: 38767 - RNA, 27 nt, Artificial Sequence
  Elongator complex protein 1 (1236-1244)
guguaccacauccugaagguccucuuc

SEQ ID NO: 38768 - RNA, 27 nt, Artificial Sequence
  Sterol regulatory element-binding protein cleavage-activating protein (751-759)
guguacaucgaccagaccaugguccug

SEQ ID NO: 38769 - RNA, 27 nt, Artificial Sequence
  Prelamin-A/C (44-52)
guguacaucgaccgcguccggagccug

SEQ ID NO: 38770 - RNA, 27 nt, Artificial Sequence
  F-box only protein 42 (181-189)
guguacaaggaccugcucguccuguuc

SEQ ID NO: 38771 - RNA, 27 nt, Artificial Sequence
  mRNA cap guanine-N7 methyltransferase (390-398)
guguacaagaagaccuuccuggaguuc

SEQ ID NO: 38772 - RNA, 27 nt, Artificial Sequence
  Kelch repeat and BTB domain-containing protein 6 (407-415)
guguacaagcccgcccagaacagcugg

SEQ ID NO: 38773 - RNA, 27 nt, Artificial Sequence
  Brain-specific angiogenesis inhibitor 1-associated protein 2 (16-24)
guguacaagaccaucauggagcaguuc

SEQ ID NO: 38774 - RNA, 27 nt, Artificial Sequence
  Polymerase I and transcript release factor (225-233)
guguacaagguccccccguucaccuuc

SEQ ID NO: 38775 - RNA, 27 nt, Artificial Sequence
  Sarcolemmal membrane-associated protein (22-30)
guguaccuggacgagcccaucaagauc

SEQ ID NO: 38776 - RNA, 33 nt, Artificial Sequence
  Molybdenum cofactor sulfurase (50-60)
guguaccuggaccacgccggcgccacccucuuc

SEQ ID NO: 38777 - RNA, 30 nt, Artificial Sequence
  Plectin (3681-3690)
guguaccugcccggcagccgccagacccuc

SEQ ID NO: 38778 - RNA, 27 nt, Artificial Sequence
  Nuclear nucleic acid-binding protein C1D (92-100)
guguacaugaaccgcgucaaggagauc

SEQ ID NO: 38779 - RNA, 27 nt, Artificial Sequence
  Pre-mRNA-splicing factor SPF27 (137-145)
guguacaacgagaaccugguccacaug

SEQ ID NO: 38780 - RNA, 27 nt, Artificial Sequence
  Kelch-like protein 11 (473-481)
guguacaaccccgagcuggacaagugg

SEQ ID NO: 38781 - RNA, 27 nt, Artificial Sequence
  Kelch repeat and BTB domain-containing protein 6 (536-544)
guguacaaccccguccgcgccgagugg

SEQ ID NO: 38782 - RNA, 33 nt, Artificial Sequence
  Zinc transporter ZIP6 (191-201)
guguacaacaccgucagcgagggcacccacuuc

SEQ ID NO: 38783 - RNA, 30 nt, Artificial Sequence
  BAG family molecular chaperone regulator 3 (113-122)
guguacccccagccgggcaugcagcgcuuc

SEQ ID NO: 38784 - RNA, 33 nt, Artificial Sequence
  3-ketodihydrosphingosine reductase (150-160)
guguaccccagccgcgccgucaucaccaccaug

SEQ ID NO: 38785 - RNA, 27 nt, Artificial Sequence
  Hemoglobin subunit gamma-2 (35-43)
guguaccccuggacccagcgcuucuuc

SEQ ID NO: 38786 - RNA, 27 nt, Artificial Sequence
  Nuclear factor of activated T-cells 5 (855-863)
guguaccagcagaccagccacaugaug

SEQ ID NO: 38787 - RNA, 27 nt, Artificial Sequence
  Anaphase-promoting complex subunit 2 (564-572)
guguacagcgccggcgucuaccgccug

SEQ ID NO: 38788 - RNA, 33 nt, Artificial Sequence
  N-acetylgalactosamine kinase (311-321)
guguacagcgaggccgcccgcguccugcaguuc

SEQ ID NO: 38789 - RNA, 27 nt, Artificial Sequence
  Zinc transporter 6 (62-70)
guguacagcuucggcuucgagcgccug

SEQ ID NO: 38790 - RNA, 27 nt, Artificial Sequence
  La-related protein 4 (319-327)
guguacagcaucgucccccaguccugg

SEQ ID NO: 38791 - RNA, 33 nt, Artificial Sequence
  Pre-mRNA-processing-splicing factor 8 (1177-1187)
guguacagcaaggacaaccccaaccugcucuuc

SEQ ID NO: 38792 - RNA, 27 nt, Artificial Sequence
  Condensin-2 complex subunit H2 (66-74)
guguacagcaagaaggucgaguaccug

SEQ ID NO: 38793 - RNA, 27 nt, Artificial Sequence
  Zinc transporter 7 (318-326)
guguacagccugcaggagcagcacuuc

SEQ ID NO: 38794 - RNA, 33 nt, Artificial Sequence
  Ribonuclease P protein subunit p30 (155-165)
guguacagccccgccaucaaggacuccaccaug

SEQ ID NO: 38795 - RNA, 27 nt, Artificial Sequence
  E3 ubiquitin-protein ligase MGRN1 (148-156)
guguacagccccaaguccccgagccug

SEQ ID NO: 38796 - RNA, 27 nt, Artificial Sequence
  DDB1- and CUL4-associated factor 13 (310-318)
guguacaccggcaucgaccaccacugg

SEQ ID NO: 38797 - RNA, 30 nt, Artificial Sequence
  Nuclear pore complex protein Nup153 (667-676)
guguacacccgccccgccaucagcuccuuc

SEQ ID NO: 38798 - RNA, 27 nt, Artificial Sequence
  Tensin-2 (334-342)
guguacaccagcggcgucuaccacauc

SEQ ID NO: 38799 - RNA, 27 nt, Artificial Sequence
  Pre-mRNA-processing-splicing factor 8 (809-817)
guguacaccaccacgguccacuggcug

SEQ ID NO: 38800 - RNA, 27 nt, Artificial Sequence
  Volume-regulated anion channel subunit LRRC8E (11-19)
guguacgucgagaagaucagcuuccug

SEQ ID NO: 38801 - RNA, 27 nt, Artificial Sequence
  Cleavage and polyadenylation specificity factor subunit 7 (127-135)
guguacgucggcagcuucuccuggugg

SEQ ID NO: 38802 - RNA, 27 nt, Artificial Sequence
  Kinesin-like protein KIF3B (174-182)
guguacgucaaggaccugagcuccuuc

SEQ ID NO: 38803 - RNA, 27 nt, Artificial Sequence
  Cytochrome c oxidase assembly protein COX11, mitochondrial (223-231)
guguacguccuggagagcuggcaccuc

SEQ ID NO: 38804 - RNA, 27 nt, Artificial Sequence
  Splicing factor 3B subunit 1 (254-262)
guguacuggaagaucuacaacagcauc

SEQ ID NO: 38805 - RNA, 27 nt, Artificial Sequence
  Dolichyl-diphosphooligosaccharide-proteinosyltransferase subunit 2 (453-461)
guguacuggacccagcugaacauguuc

SEQ ID NO: 38806 - RNA, 27 nt, Artificial Sequence
  Tripartite motif-containing protein 47 (182-190)
uacgccgaccgcgcccuggcguucuac

SEQ ID NO: 38807 - RNA, 27 nt, Artificial Sequence
  Monocarboxylate transporter 1 (34-42)
uacgccuuccccaagagcaucaccgug

SEQ ID NO: 38808 - RNA, 24 nt, Artificial Sequence
  DDB1- and CUL4-associated factor 4 (355-362)
uacgccuaccugccccuccacgug

SEQ ID NO: 38809 - RNA, 30 nt, Artificial Sequence
  Septin-9 (180-189)
uacuucauccccgccaccggccacagccug

SEQ ID NO: 38810 - RNA, 27 nt, Artificial Sequence
  Serine/threonine-protein kinase ATR (1253-1261)
uacuuccugcccgaccacccggagcuc

SEQ ID NO: 38811 - RNA, 27 nt, Artificial Sequence
  Cytochrome c oxidase subunit 2 (113-121)
uacggcgggcugaucuucaacagcuac

SEQ ID NO: 38812 - RNA, 27 nt, Artificial Sequence
  Sterol O-acyltransferase 1 (161-169)
uacaucgacgagggccgccuggugcuc

SEQ ID NO: 38813 - RNA, 27 nt, Artificial Sequence
  Unconventional myosin-Ic (44-52)
uacaucggccccgugcuggucagcgug

SEQ ID NO: 38814 - RNA, 27 nt, Artificial Sequence
  DENN domain-containing protein 5B (228-236)
uacauccacaacauccuguacgaggug

SEQ ID NO: 38815 - RNA, 27 nt, Artificial Sequence
  Kinesin-like protein KIF1A (510-518)
uacaucaaggacggcaucacccgcgug

SEQ ID NO: 38816 - RNA, 36 nt, Artificial Sequence
  Signal recognition particle 9 kDa protein (18-29)
uaccuggccgaccccaugaaggcccgcgugguccuc

SEQ ID NO: 38817 - RNA, 27 nt, Artificial Sequence
  Ras GTPase-activating-like protein IQGAP2 (898-906)
uaccuggccaagcucaucuuccagaug

SEQ ID NO: 38818 - RNA, 27 nt, Artificial Sequence
  Kinesin-like protein KIF13A (1108-1116)
uaccuggacgagcagaucaagaaggug

SEQ ID NO: 38819 - RNA, 27 nt, Artificial Sequence
  Metastasis-associated protein MTA3 (123-131)
uaccuggacaaggaggacaccuucuuc

SEQ ID NO: 38820 - RNA, 24 nt, Artificial Sequence
  Guanine nucleotide-binding protein-like 3-like protein (294-301)
uaccuggacaaguucauccgccuc

SEQ ID NO: 38821 - RNA, 27 nt, Artificial Sequence
  DNA topoisomerase 1 (723-731)
uaccuggacccccgcaucaccguggcc

SEQ ID NO: 38822 - RNA, 30 nt, Artificial Sequence
  Proteasome activator complex subunit 3 (188-197)
uaccuggaccagaucagccgcuacuacauc

SEQ ID NO: 38823 - RNA, 36 nt, Artificial Sequence
  Lysosomal protective protein (125-136)
uaccuggagagccccgccggcgugggguucuccuac

SEQ ID NO: 38824 - RNA, 33 nt, Artificial Sequence
  ATP synthase F(0) complex subunit B1, mitochondrial (165-175)
uaccuguucgacgugcagcgcaacaacaucgcc

SEQ ID NO: 38825 - RNA, 36 nt, Artificial Sequence
  ATP synthase F(0) complex subunit B1, mitochondrial (165-176)
uaccuguucgacgugcagcgcaacaacaucgccaug

SEQ ID NO: 38826 - RNA, 27 nt, Artificial Sequence
  WD repeat-containing protein 81 (72-80)
uaccuguucgagcccguggccaaggcc

SEQ ID NO: 38827 - RNA, 27 nt, Artificial Sequence
  WD repeat and FYVE domain-containing protein 3 (158-166)
uaccuguucuucgaccucccccacgug

SEQ ID NO: 38828 - RNA, 27 nt, Artificial Sequence
  LIM domain-containing protein ajuba (391-399)
uaccuguucagcggcuuccaggaggcc

SEQ ID NO: 38829 - RNA, 27 nt, Artificial Sequence
  Heat shock cognate 71 kDa protein (134-142)
uaccugggcaagaccgugaccaacgcc

SEQ ID NO: 38830 - RNA, 30 nt, Artificial Sequence
  Intraflagellar transport protein 172 homolog (461-470)
uaccugaucgacaucaagaccaucgccauc

SEQ ID NO: 38831 - RNA, 27 nt, Artificial Sequence
  Ankyrin repeat domain-containing protein 17 (599-607)
uaccugcucgacuaccccaacaaccug

SEQ ID NO: 38832 - RNA, 30 nt, Artificial Sequence
  Ankyrin repeat domain-containing protein 17 (599-608)
uaccugcucgacuaccccaacaaccugcug

SEQ ID NO: 38833 - RNA, 33 nt, Artificial Sequence
  Filamin-A (148-158)
uaccugcucaaggacaagggcgaguacacccug

SEQ ID NO: 38834 - RNA, 27 nt, Artificial Sequence
  Condensin complex subunit 3 (370-378)
uaccugcucagcuacauccaguccauc

SEQ ID NO: 38835 - RNA, 27 nt, Artificial Sequence
  UDP-glucose 6-dehydrogenase (143-151)
uaccugauggacgagggcgcccaccuc

SEQ ID NO: 38836 - RNA, 27 nt, Artificial Sequence
  L-lactate dehydrogenase A chain (172-180)
uaccugaugggcgagcgccucggggug

SEQ ID NO: 38837 - RNA, 36 nt, Artificial Sequence
  H/ACA ribonucleoprotein complex subunit 3 (6-17)
uaccugaacgagcagggcgaccgcguguacacccuc

SEQ ID NO: 38838 - RNA, 27 nt, Artificial Sequence
  POZ-, AT hook-, and zinc finger-containing protein 1 (645-653)
uaccugaacaagcacauccagaaggug

SEQ ID NO: 38839 - RNA, 27 nt, Artificial Sequence
  Structural maintenance of chromosomes protein 4 (748-756)
uaccugaacgugcaggucaaggagcuc

SEQ ID NO: 38840 - RNA, 27 nt, Artificial Sequence
  Mitochondrial-processing peptidase subunit alpha (107-115)
uaccugagcggcaucgcccacuuccuc

SEQ ID NO: 38841 - RNA, 27 nt, Artificial Sequence
  Gelsolin (409-417)
uaccugagcucccacaucgccaacgug

SEQ ID NO: 38842 - RNA, 27 nt, Artificial Sequence
  Protein S100-A10 (25-33)
uaccugaccaaggaggaccuccgcgug

SEQ ID NO: 38843 - RNA, 30 nt, Artificial Sequence
  Plectin (73-82)
uaccugaccaacgagggcaucgcccaccuc

SEQ ID NO: 38844 - RNA, 33 nt, Artificial Sequence
  Mitochondrial carrier homolog 1 (278-288)
uaccugguggacgacagcuucucccaggcccuc

SEQ ID NO: 38845 - RNA, 27 nt, Artificial Sequence
  Thimet oligopeptidase (612-620)
uaccuguggagcgagguguacuccaug

SEQ ID NO: 38846 - RNA, 36 nt, Artificial Sequence
  SWI/SNF-related matrix-associated actin-dependent regulator of chromatin subfamily A containing DEAD/H box 1 (108-119)
uaccuguaccaggagggcaacaacgggccccaccuc

SEQ ID NO: 38847 - RNA, 27 nt, Artificial Sequence
  Transcriptional enhancer factor TEF-3 (369-377)
uacaugaucaacuucauccacaagcug

SEQ ID NO: 38848 - RNA, 24 nt, Artificial Sequence
  Pterin-4-alpha-carbinolamine dehydratase (70-77)
uacaacaaggugcacaucacccug

SEQ ID NO: 38849 - RNA, 24 nt, Artificial Sequence
  Mid1-interacting protein 1 (7-14)
uacaaccagaagcacagccuguuc

SEQ ID NO: 38850 - RNA, 27 nt, Artificial Sequence
  Phosducin-like protein 3 (158-166)
uaccccgaccgcaaccugccgaccauc

SEQ ID NO: 38851 - RNA, 33 nt, Artificial Sequence
  Lipase maturation factor 2 (522-532)
uaccccuuccacaagcagccgcccaccuacgug

SEQ ID NO: 38852 - RNA, 24 nt, Artificial Sequence
  Ubiquitin-conjugating enzyme E2 K (66-73)
uaccccuucaacccgcccaaggug

SEQ ID NO: 38853 - RNA, 36 nt, Artificial Sequence
  Dolichyl-diphosphooligosaccharide-proteinosyltransferase 48 kDa subunit (233-244)
uacccccacgccgugggcaagaacacccugcucauc

SEQ ID NO: 38854 - RNA, 27 nt, Artificial Sequence
  Ganglioside-induced differentiation-associated protein 2 (176-184)
uacccccuggaggacgccacccacauc

SEQ ID NO: 38855 - RNA, 27 nt, Artificial Sequence
  TFIIH basal transcription factor complex helicase XPD subunit (39-47)
uacccccuggaggugaccaagcucauc

SEQ ID NO: 38856 - RNA, 27 nt, Artificial Sequence
  AP-2 complex subunit beta (421-429)
uaccccaacaaguacgagagcaucauc

SEQ ID NO: 38857 - RNA, 30 nt, Artificial Sequence
  BAG family molecular chaperone regulator 4 (184-193)
uaccccuacggcgacgggaaccgcagcgug

SEQ ID NO: 38858 - RNA, 33 nt, Artificial Sequence
  InaD-like protein (703-713)
uaccaggacccccuggacccgacccgcagcgug

SEQ ID NO: 38859 - RNA, 33 nt, Artificial Sequence
  DNA mismatch repair protein Msh6 (977-987)
uaccagcuggagauccccgagaacuucaccacc

SEQ ID NO: 38860 - RNA, 27 nt, Artificial Sequence
  Ubiquitin-like-conjugating enzyme ATG3 (210-218)
uaccagaccccccgccuguggcucuuc

SEQ ID NO: 38861 - RNA, 27 nt, Artificial Sequence
  RNA binding protein fox-1 homolog 2 (317-325)
uacagcgacggcuacgggcgcguguac

SEQ ID NO: 38862 - RNA, 27 nt, Artificial Sequence
  Signal transducer and activator of transcription 3 (22-30)
uacagcgacuccuuccccauggagcug

SEQ ID NO: 38863 - RNA, 30 nt, Artificial Sequence
  Protein TANC2 (62-71)
uacagcgagaacguggagcgcaccaaguac

SEQ ID NO: 38864 - RNA, 24 nt, Artificial Sequence
  Putative heat shock protein HSP 90-beta 2 (33-40)
uacagcaacaaggagaucuuccug

SEQ ID NO: 38865 - RNA, 33 nt, Artificial Sequence
  Probable E3 ubiquitin-protein ligase HECTD2 (624-634)
uacaccgacuuccugcucaacaagagcaucuac

SEQ ID NO: 38866 - RNA, 27 nt, Artificial Sequence
  Tight junction protein ZO-1 (1054-1062)
uacaccgaccaguucagccgcaacuac

SEQ ID NO: 38867 - RNA, 27 nt, Artificial Sequence
  RNA-binding protein FUS (324-332)
uacaccgaccgcgagaccggcaagcug

SEQ ID NO: 38868 - RNA, 30 nt, Artificial Sequence
  Cytochrome c oxidase subunit 2 (110-119)
uacaccgacuacggcgggcugaucuucaac

SEQ ID NO: 38869 - RNA, 33 nt, Artificial Sequence
  Cytochrome c oxidase subunit 2 (110-120)
uacaccgacuacggcgggcugaucuucaacagc

SEQ ID NO: 38870 - RNA, 24 nt, Artificial Sequence
  Peroxisomal multifunctional enzyme type 2 (339-346)
uacaccgagcuggaggccaucaug

SEQ ID NO: 38871 - RNA, 27 nt, Artificial Sequence
  Peroxisomal multifunctional enzyme type 2 (339-347)
uacaccgagcuggaggccaucauguac

SEQ ID NO: 38872 - RNA, 27 nt, Artificial Sequence
  RNA-binding protein FUS (6-14)
uacacccagcaggccacccagagcuac

SEQ ID NO: 38873 - RNA, 30 nt, Artificial Sequence
  F-box only protein 11 (224-233)
uacaccagcuaccccaugcacgacuucuac

SEQ ID NO: 38874 - RNA, 27 nt, Artificial Sequence
  Zinc finger and BTB domain-containing protein 38 (794-802)
uacguggccgaccccggcgggagccug

SEQ ID NO: 38875 - RNA, 24 nt, Artificial Sequence
  Bax inhibitor 1 (92-99)
uacgugcacauggucacccacuuc

SEQ ID NO: 38876 - RNA, 36 nt, Artificial Sequence
  Negative elongation factor E (265-276)
uacguguacggcgaggacaugacccccacccugcuc

SEQ ID NO: 38877 - RNA, 27 nt, Artificial Sequence
  Medium-chain specific acyl-CoA dehydrogenase, mitochondrial (316-324)
uacuacgccagcaucgccaaggcguuc

SEQ ID NO: 38878 - RNA, 30 nt, Artificial Sequence
  Eukaryotic translation initiation factor 3 subunit A (275-284)
uacuacaacaaggugagcaccgucuucugg

SEQ ID NO: 38879 - RNA, 33 nt, Artificial Sequence
  Importin-7 (763-773)
uacuacaacccccaccugcuccugaacacccug

SEQ ID NO: 38880 - RNA, 27 nt, Artificial Sequence
  Prenylcysteine oxidase 1 (220-228)
uacuaccagcacaucgugaccacccug

SEQ ID NO: 38881 - RNA, 27 nt, Artificial Sequence
  Protein PAT1 homolog 1 (367-375)
uacuaccagaacuacuucgagaagcug

SEQ ID NO: 38882 - RNA, 27 nt, Artificial Sequence
  ATP-binding cassette sub-family F member 1 (528-536)
uacuaccgcggcaacuacaugaccuuc

SEQ ID NO: 38883 - RNA, 27 nt, Artificial Sequence
  Polypyrimidine tract-binding protein 2 (124-132)
uacuacagcgccgugaccccccaccug

SEQ ID NO: 38884 - RNA, 27 nt, Artificial Sequence
  Eukaryotic translation initiation factor 2A (345-353)
uacuacagcccccacggccacauccug

SEQ ID NO: 38885 - RNA, 27 nt, Artificial Sequence
  26S protease regulatory subunit 6B (111-119)
uacuacgugcgcauccugagcaccauc

SEQ ID NO: 38886 - RNA, 33 nt, Artificial Sequence
  Glutathione peroxidase 1 (7-17)
gccgccgcggccgccgccgcccagagcguguac

SEQ ID NO: 38887 - RNA, 27 nt, Artificial Sequence
  Interferon alpha-inducible protein 27-like protein 2 (6-14)
gccgccgcggccgugggcggggcccug

SEQ ID NO: 38888 - RNA, 27 nt, Artificial Sequence
  Pumilio homolog 2 (304-312)
gccgccgcgaaccccacccuggccuuc

SEQ ID NO: 38889 - RNA, 27 nt, Artificial Sequence
  Angiomotin (918-926)
gccgccgcgcccgccgccgccgccgcg

SEQ ID NO: 38890 - RNA, 27 nt, Artificial Sequence
  RNA-binding protein 38 (217-225)
gccgccgcgcccgccggcaccaccuuc

SEQ ID NO: 38891 - RNA, 30 nt, Artificial Sequence
  Protein SON (246-255)
gccgccgcgcccgugccgaccaccacgcug

SEQ ID NO: 38892 - RNA, 27 nt, Artificial Sequence
  Kelch-like protein 7 (15-23)
gccgccgcgagccacuucuucaaccug

SEQ ID NO: 38893 - RNA, 27 nt, Artificial Sequence
  Ephrin-A1 (167-175)
gccgccgacgaccccgaggugcgcguc

SEQ ID NO: 38894 - RNA, 27 nt, Artificial Sequence
  RNA-binding protein 4 (47-55)
gccgccgaggacgcgauccgcaaccug

SEQ ID NO: 38895 - RNA, 27 nt, Artificial Sequence
  Death-associated protein kinase 3 (334-342)
gccgccgaggagggccugcgcgagcuc

SEQ ID NO: 38896 - RNA, 27 nt, Artificial Sequence
  Perilipin-3 (62-70)
gccgccgagaagggcgugcgcacccug

SEQ ID NO: 38897 - RNA, 24 nt, Artificial Sequence
  Ribosome-binding protein 1 (105-112)
gccgccuucgagaagcaggugcug

SEQ ID NO: 38898 - RNA, 27 nt, Artificial Sequence
  Glycine dehydrogenase (decarboxylating), mitochondrial (969-977)
gccgccuucccccugccguucgugaag

SEQ ID NO: 38899 - RNA, 27 nt, Artificial Sequence
  DNA-directed RNA polymerase II subunit RPB1 (1495-1503)
gccgccggccccaccgggauguucuuc

SEQ ID NO: 38900 - RNA, 27 nt, Artificial Sequence
  Programmed cell death protein 4 (282-290)
gccgcccuggacaaggcgaccgugcuc

SEQ ID NO: 38901 - RNA, 27 nt, Artificial Sequence
  Leucine-rich repeat-containing protein 59 (36-44)
gccgcccugcccaaggcgaccauccuc

SEQ ID NO: 38902 - RNA, 27 nt, Artificial Sequence
  E3 ubiquitin-protein ligase BRE1B (225-233)
gccgcccaggcgcacacccgcgagcug

SEQ ID NO: 38903 - RNA, 33 nt, Artificial Sequence
  NEDD8-activating enzyme E1 regulatory subunit (495-505)
gccgcccaggaggugaucaagaucaucaccaag

SEQ ID NO: 38904 - RNA, 27 nt, Artificial Sequence
  Protein FAM50A (7-15)
gccgccagcgaggcgggccgcgccaug

SEQ ID NO: 38905 - RNA, 27 nt, Artificial Sequence
  4F2 cell-surface antigen heavy chain (127-135)
gccgccagcggcgcggccaugucccug

SEQ ID NO: 38906 - RNA, 27 nt, Artificial Sequence
  Nuclear pore membraneoprotein 210 (1023-1031)
gccgccagccccaucaucacccuggug

SEQ ID NO: 38907 - RNA, 27 nt, Artificial Sequence
  Cirhin (108-116)
gccgccagccccuccggcagccagcug

SEQ ID NO: 38908 - RNA, 27 nt, Artificial Sequence
  40S ribosomal protein SA (92-100)
gccgccaccggcgcgacccccaucgcc

SEQ ID NO: 38909 - RNA, 27 nt, Artificial Sequence
  ELM2 and SANT domain-containing protein 1 (966-974)
gccgccgugaaggcgacccagacccug

SEQ ID NO: 38910 - RNA, 27 nt, Artificial Sequence
  UPF0668 protein C10orf76 (556-564)
gccgccgugaaccacaucagccagcug

SEQ ID NO: 38911 - RNA, 27 nt, Artificial Sequence
  Leucine-rich repeat and calponin homology domain-containing protein 3 (56-64)
gccgccgugaccggcguccugagccuc

SEQ ID NO: 38912 - RNA, 27 nt, Artificial Sequence
  Synaptonemal complex protein SC65 (428-436)
gccgaggccgagcccgagccggagcug

SEQ ID NO: 38913 - RNA, 27 nt, Artificial Sequence
  Rhotekin (187-195)
gccgaggccggccccgacuucgagcug

SEQ ID NO: 38914 - RNA, 30 nt, Artificial Sequence
  Catenin alpha-1 (750-759)
gccgaggccggcagccgcauggacaagcug

SEQ ID NO: 38915 - RNA, 27 nt, Artificial Sequence
  Leucine-tRNA ligase, cytoplasmic (461-469)
gccgaggccaaggagaagaucuaccug

SEQ ID NO: 38916 - RNA, 36 nt, Artificial Sequence
  5'-AMP-activated protein kinase catalytic subunit alpha-1 (501-512)
gccgaggcccagggcaagagcuccgaggugagccug

SEQ ID NO: 38917 - RNA, 27 nt, Artificial Sequence
  Something about silencing protein 10 (119-127)
gccgaggccagcguggaccccucccug

SEQ ID NO: 38918 - RNA, 33 nt, Artificial Sequence
  Mediator of DNA damage checkpoint protein 1 (431-441)
gccgaggaggacaugccccagcgcgugguccug

SEQ ID NO: 38919 - RNA, 27 nt, Artificial Sequence
  NudC domain-containing protein 1 (175-183)
gccgaggagcacagcaucgccacccug

SEQ ID NO: 38920 - RNA, 27 nt, Artificial Sequence
  Peroxisome assembly protein 26 (71-79)
gccgaggagcccgccggcaccagccug

SEQ ID NO: 38921 - RNA, 27 nt, Artificial Sequence
  Alpha-actinin-4 (804-812)
gccgaguucaaccgcaucaugagccug

SEQ ID NO: 38922 - RNA, 27 nt, Artificial Sequence
  Coatomer subunit beta' (333-341)
gccgagaucaaggacggcgagcgccug

SEQ ID NO: 38923 - RNA, 33 nt, Artificial Sequence
  Stathmin (73-83)
gccgagaagcgcgagcacgagaaggaggugcug

SEQ ID NO: 38924 - RNA, 27 nt, Artificial Sequence
  Heat shock protein 105 kDa (311-319)
gccgagcugcuccagaagaucgaggug

SEQ ID NO: 38925 - RNA, 27 nt, Artificial Sequence
  LisH domain-containing protein ARMC9 (557-565)
gccgagaugauccgccagaucgaguuc

SEQ ID NO: 38926 - RNA, 36 nt, Artificial Sequence
  V-type proton ATPase subunit C 1 (170-181)
gccgagaugguggucccccgcagcuccaacgugcug

SEQ ID NO: 38927 - RNA, 33 nt, Artificial Sequence
  Centromere protein F (2273-2283)
gccgagaacagcaaggccgagguggagacccug

SEQ ID NO: 38928 - RNA, 33 nt, Artificial Sequence
  Thioredoxin domain-containing protein 5 (207-217)
gccgagcccgaggccgacaagggcaccgugcug

SEQ ID NO: 38929 - RNA, 33 nt, Artificial Sequence
  Cell cycle and apoptosis regulator protein 2 (303-313)
gccgagcagcaggacagcggccgccuguaccuc

SEQ ID NO: 38930 - RNA, 30 nt, Artificial Sequence
  AP-1 complex subunit beta-1 (188-197)
gccgagagccaccccuccagcaaccugcuc

SEQ ID NO: 38931 - RNA, 33 nt, Artificial Sequence
  Clathrin heavy chain 1 (493-503)
gccgagaccggccaggugcagaagaucguccug

SEQ ID NO: 38932 - RNA, 39 nt, Artificial Sequence
  T-complex protein 1 subunit eta (76-88)
gccgaggugggcgacgggaccaccagcgucacgcugcuc

SEQ ID NO: 38933 - RNA, 27 nt, Artificial Sequence
  Heterogeneous nuclear ribonucleoprotein M (129-137)
gccgaggugcugaacaagcacagccuc

SEQ ID NO: 38934 - RNA, 27 nt, Artificial Sequence
  X-box-binding protein 1 (28-36)
gccggcgcccccgcggggcaggcccug

SEQ ID NO: 38935 - RNA, 27 nt, Artificial Sequence
  Protein YIF1A (153-161)
gccggcauggcccuggggauccagaag

SEQ ID NO: 38936 - RNA, 27 nt, Artificial Sequence
  PAB-dependent poly(A)-specific ribonuclease subunit PAN2 (870-878)
gcccacaucaaggugggcgagaccuac

SEQ ID NO: 38937 - RNA, 27 nt, Artificial Sequence
  Coatomer subunit gamma-1 (45-53)
gcccacauccugaccaagauccucuac

SEQ ID NO: 38938 - RNA, 27 nt, Artificial Sequence
  Clathrin heavy chain 1 (1312-1320)
gcccacaugggcauguucaccgagcug

SEQ ID NO: 38939 - RNA, 27 nt, Artificial Sequence
  Elongation factor 2 (491-499)
gcccacaacaugcgcgugaugaaguuc

SEQ ID NO: 38940 - RNA, 27 nt, Artificial Sequence
  Methionine-R-sulfoxide reductase B1 (38-46)
gcccacagcucccccuggccggccuuc

SEQ ID NO: 38941 - RNA, 27 nt, Artificial Sequence
  Calcineurin-binding protein cabin-1 (1962-1970)
gcccacaccaagccccgcccggcccug

SEQ ID NO: 38942 - RNA, 27 nt, Artificial Sequence
  Protein RTF2 homolog (296-304)
gcccacugggugacccacaccagcuac

SEQ ID NO: 38943 - RNA, 30 nt, Artificial Sequence
  Endoplasmic reticulum-Golgi intermediate compartment protein 2 (241-250)
gccaucgaccacaaccagauguuccaguac

SEQ ID NO: 38944 - RNA, 27 nt, Artificial Sequence
  E3 ubiquitin-protein ligase RNF135 (258-266)
gccauccaccccaccuucaaccugaag

SEQ ID NO: 38945 - RNA, 27 nt, Artificial Sequence
  Proteasome subunit alpha type-2 (187-195)
gccauccacaccgccauccugacccuc

SEQ ID NO: 38946 - RNA, 27 nt, Artificial Sequence
  All-trans-retinol 13,14-reductase (189-197)
gccaucaucgacaaguacaucaagcug

SEQ ID NO: 38947 - RNA, 27 nt, Artificial Sequence
  General transcription factor 3C polypeptide 3 (294-302)
gccauccuggacaagaacuuccgcaag

SEQ ID NO: 38948 - RNA, 27 nt, Artificial Sequence
  AP-1 complex subunit beta-1 (487-495)
gccaucgugaagcuguuccucaagaag

SEQ ID NO: 38949 - RNA, 27 nt, Artificial Sequence
  Ribosomal RNA processing protein 36 homolog (221-229)
gcccuggccgagaaguucaaggagcuc

SEQ ID NO: 38950 - RNA, 27 nt, Artificial Sequence
  Gem-associated protein 4 (288-296)
gcccuggccgagaaggugaaggaggcg

SEQ ID NO: 38951 - RNA, 27 nt, Artificial Sequence
  Glycosylphosphatidylinositol anchor attachment 1 protein (584-592)
gcccuggcccagggcgugcucgagcac

SEQ ID NO: 38952 - RNA, 39 nt, Artificial Sequence
  Ankyrin repeat and KH domain-containing protein 1 (182-194)
gcccuggacgaggccgcggccgcccucacccgcaugaag

SEQ ID NO: 38953 - RNA, 27 nt, Artificial Sequence
  Hexokinase-1 (530-538)
gcccuggaccucggcgggaccaacuuc

SEQ ID NO: 38954 - RNA, 30 nt, Artificial Sequence
  N-acylneuraminate cytidylyltransferase (79-88)
gcccuggacagcggcgccuuccaguccgug

SEQ ID NO: 38955 - RNA, 30 nt, Artificial Sequence
  EP300-interacting inhibitor of differentiation 1 (70-79)
gcccuggaggaggccgacaagauguuccuc

SEQ ID NO: 38956 - RNA, 30 nt, Artificial Sequence
  Zinc finger protein ZXDC (46-55)
gcccuguucagcgacacccccgccaacgcg

SEQ ID NO: 38957 - RNA, 27 nt, Artificial Sequence
  Dystonin (1368-1376)
gcccuguucagcaaggugcucgagcgc

SEQ ID NO: 38958 - RNA, 27 nt, Artificial Sequence
  Protein transport protein Sec23A (40-48)
gcccuguucaccccccucaaggagcgc

SEQ ID NO: 38959 - RNA, 27 nt, Artificial Sequence
  PRKCA-binding protein (279-287)
gcccugggcgagccccucuaccgcgug

SEQ ID NO: 38960 - RNA, 27 nt, Artificial Sequence
  Talin-2 (171-179)
gcccugcacgaccuccugcagcacgug

SEQ ID NO: 38961 - RNA, 27 nt, Artificial Sequence
  Golgin subfamily A member 3 (270-278)
gcccugcacgagcgcauccaggcccuc

SEQ ID NO: 38962 - RNA, 27 nt, Artificial Sequence
  SURP and G-patch domain-containing protein 2 (429-437)
gcccugcucggccagaccuucagccug

SEQ ID NO: 38963 - RNA, 27 nt, Artificial Sequence
  E3 ubiquitin-protein ligase AMFR (24-32)
gcccugcucggcaccaucaucagcgcc

SEQ ID NO: 38964 - RNA, 30 nt, Artificial Sequence
  Tropomodulin-3 (44-53)
gcccugcuccccgccggcuuccgccagaag

SEQ ID NO: 38965 - RNA, 36 nt, Artificial Sequence
  RNA-binding protein NOB1 (19-30)
gcccugcaggacaucggcaagaacaucuacaccauc

SEQ ID NO: 38966 - RNA, 27 nt, Artificial Sequence
  Kinesin-1 heavy chain (666-674)
gcccugagcgaggagcucgugcagcug

SEQ ID NO: 38967 - RNA, 30 nt, Artificial Sequence
  Syntaxin-8 (157-166)
gcccugagcuccaucaucagccgccagaag

SEQ ID NO: 38968 - RNA, 27 nt, Artificial Sequence
  Protein RCC2 (151-159)
gcccugaccgagaccggcagcguguuc

SEQ ID NO: 38969 - RNA, 27 nt, Artificial Sequence
  Zinc finger BED domain-containing protein 4 (250-258)
gcccuggugggcagcuccccccaccuc

SEQ ID NO: 38970 - RNA, 33 nt, Artificial Sequence
  Protein unc-93 homolog B1 (440-450)
gcccuguggggcguggggagcgcccucaacaag

SEQ ID NO: 38971 - RNA, 30 nt, Artificial Sequence
  Galectin-3-binding protein (184-193)
gcccuguggaaggagcccggcagcaacgug

SEQ ID NO: 38972 - RNA, 27 nt, Artificial Sequence
  Fructose-bisphosphate aldolase A (132-140)
gccauggccaccgugaccgcgcugcgc

SEQ ID NO: 38973 - RNA, 30 nt, Artificial Sequence
  Myosin-9 (1912-1921)
gccaugaaccgcgaggugagcucccugaag

SEQ ID NO: 38974 - RNA, 27 nt, Artificial Sequence
  NAD(P)H dehydrogenase (quinone) 1 (128-136)
gccauguacgacaagggccccuuccgc

SEQ ID NO: 38975 - RNA, 27 nt, Artificial Sequence
  Type II inositol 3,4-bisphosphate 4-phosphatase (368-376)
gcccccgccgcgcacuuccagggcuuc

SEQ ID NO: 38976 - RNA, 33 nt, Artificial Sequence
  Ankyrin repeat and zinc finger domain-containing protein 1 (4-14)
gcccccgacgccgcgccggcccccgccagcauc

SEQ ID NO: 38977 - RNA, 30 nt, Artificial Sequence
  E3 ubiquitin-protein ligase NEURL1B (119-128)
gccccccgcccggacggcgggcggacccug

SEQ ID NO: 38978 - RNA, 27 nt, Artificial Sequence
  40S ribosomal protein S4, Y isoform 1 (27-35)
gccccccgcccgagcaccggcccccac

SEQ ID NO: 38979 - RNA, 30 nt, Artificial Sequence
  60S ribosomal protein L36 (51-60)
gcccccuacgagcgccgggccauggagcug

SEQ ID NO: 38980 - RNA, 30 nt, Artificial Sequence
  PHD and RING finger domain-containing protein 1 (159-168)
gcccaguucggcgggaagauccugcgcaag

SEQ ID NO: 38981 - RNA, 33 nt, Artificial Sequence
  Cleavage stimulation factor subunit 3 (59-69)
gcccaguuccccagcuccggccgcuucuggaag

SEQ ID NO: 38982 - RNA, 30 nt, Artificial Sequence
  Transcription and mRNA export factor ENY2 (10-19)
gcccagaugcgcgccgcgaucaaccagaag

SEQ ID NO: 38983 - RNA, 27 nt, Artificial Sequence
  V-type proton ATPase 21 kDa proteolipid subunit (10-18)
gcccagaaccccagccuguucgugaag

SEQ ID NO: 38984 - RNA, 24 nt, Artificial Sequence
  Myosin-9 (2-9)
gcccagcaggccgcggacaaguac

SEQ ID NO: 38985 - RNA, 27 nt, Artificial Sequence
  MICOS complex subunit MIC60 (196-204)
gcccagcaggagaagcaggagcaggug

SEQ ID NO: 38986 - RNA, 27 nt, Artificial Sequence
  Ubiquitin-like protein 5 (33-41)
gcccagaccggcacccgcuggaacaag

SEQ ID NO: 38987 - RNA, 27 nt, Artificial Sequence
  Cytochrome c oxidase assembly factor 3 homolog, mitochondrial (44-52)
gcccaguggcagaaggugcugccccgc

SEQ ID NO: 38988 - RNA, 27 nt, Artificial Sequence
  SUMO-activating enzyme subunit 1 (17-25)
gcccaguacgaccgccagauccggcug

SEQ ID NO: 38989 - RNA, 27 nt, Artificial Sequence
  Poly(U)-binding-splicing factor PUF60 (204-212)
gcccgcgccuucaaccggaucuacgug

SEQ ID NO: 38990 - RNA, 27 nt, Artificial Sequence
  Protein transport protein Sec61 subunit alpha isoform 1 (310-318)
gcccgcuucagcggcaaccugcucgug

SEQ ID NO: 38991 - RNA, 27 nt, Artificial Sequence
  Ran GTPase-activating protein 1 (576-584)
gcccgccacagccugcuccagacccug

SEQ ID NO: 38992 - RNA, 33 nt, Artificial Sequence
  Probable RNA-binding protein 19 (488-498)
gccagcgcccugggcuccagcuccuacaagaag

SEQ ID NO: 38993 - RNA, 27 nt, Artificial Sequence
  Polyadenylate-binding protein 1 (551-559)
gccagcgcccccccgcaggagcagaag

SEQ ID NO: 38994 - RNA, 27 nt, Artificial Sequence
  3'(2'),5'-bisphosphate nucleotidase 1 (13-21)
gccagcgccuacuccaucgcgcagaag

SEQ ID NO: 38995 - RNA, 27 nt, Artificial Sequence
  WD repeat-containing protein 26 (616-624)
gccagcgacgacggcaccgugcgcauc

SEQ ID NO: 38996 - RNA, 27 nt, Artificial Sequence
  WD repeat-containing protein 61 (115-123)
gccagcgacgacggcuacaucaagauc

SEQ ID NO: 38997 - RNA, 30 nt, Artificial Sequence
  Selenoprotein O (215-224)
gccagcgacaacaccggccgcuacgccuac

SEQ ID NO: 38998 - RNA, 27 nt, Artificial Sequence
  Protein flightless-1 homolog (1107-1115)
gccagcgaccccgacgaggccaagcug

SEQ ID NO: 38999 - RNA, 30 nt, Artificial Sequence
  Transcription factor 20 (70-79)
gccagcgagaccuccggccaccagggguac

SEQ ID NO: 39000 - RNA, 33 nt, Artificial Sequence
  Zinc finger protein 622 (77-87)
gccagcuucaacgccuacgagaaccaccugaag

SEQ ID NO: 39001 - RNA, 27 nt, Artificial Sequence
  LIM domain and actin-binding protein 1 (496-504)
gccagcuuccaguccaccagcgugaag

SEQ ID NO: 39002 - RNA, 33 nt, Artificial Sequence
  Origin recognition complex subunit 3 (514-524)
gccagcggcucccagcccaaggggcugcagaag

SEQ ID NO: 39003 - RNA, 33 nt, Artificial Sequence
  Serine/threonine-protein phosphatase 6 regulatory ankyrin repeat subunit B (624-634)
gccagcaucuucgugaaggacaacgucaccaag

SEQ ID NO: 39004 - RNA, 33 nt, Artificial Sequence
  Serine/threonine-protein phosphatase 6 regulatory ankyrin repeat subunit A (637-647)
gccagcauccuggugaaggacuacauccucaag

SEQ ID NO: 39005 - RNA, 33 nt, Artificial Sequence
  39S ribosomal protein L22, mitochondrial (37-47)
gccagccuggacaucucccgcaagugggagaag

SEQ ID NO: 39006 - RNA, 27 nt, Artificial Sequence
  Centrosome-associated protein 350 (95-103)
gccagccugaucaagcagcucgaggug

SEQ ID NO: 39007 - RNA, 33 nt, Artificial Sequence
  Deoxynucleotidyltransferase terminal-interacting protein 2 (668-678)
gccagcauggaccccaagcgcuucuacaagaag

SEQ ID NO: 39008 - RNA, 33 nt, Artificial Sequence
  Myosin-10 (370-380)
gccagcaugcccgagaacaccguggcccagaag

SEQ ID NO: 39009 - RNA, 36 nt, Artificial Sequence
  Discoidin, CUB and LCCL domain-containing protein 2 (153-164)
gccagcaacuuccuggagcccgaguucuccaaguac

SEQ ID NO: 39010 - RNA, 27 nt, Artificial Sequence
  Chromosome transmission fidelity protein 8 homolog isoform 2 (379-387)
gccagcaaccccgccaccuuccagcgc

SEQ ID NO: 39011 - RNA, 36 nt, Artificial Sequence
  Heterogeneous nuclear ribonucleoprotein H (160-171)
gccagccaggagaucgccgagaaggcgcugaagaag

SEQ ID NO: 39012 - RNA, 27 nt, Artificial Sequence
  Zinc finger protein 574 (226-234)
gccagccaggagcuguggcucaaccac

SEQ ID NO: 39013 - RNA, 27 nt, Artificial Sequence
  E3 ubiquitin-protein ligase MARCH7 (344-352)
gccagccagggcuuccgcuuccugcgg

SEQ ID NO: 39014 - RNA, 27 nt, Artificial Sequence
  Ubiquitin-conjugating enzyme E2 T (183-191)
gccagccagcuggugggcaucgagaag

SEQ ID NO: 39015 - RNA, 39 nt, Artificial Sequence
  Anthrax toxin receptor 2 (131-143)
gccagcuacuacggcgggcgcggcguggggggcaucaag

SEQ ID NO: 39016 - RNA, 27 nt, Artificial Sequence
  Transmembrane protein 147 (107-115)
gccaccgccgagcugaucaugagccgc

SEQ ID NO: 39017 - RNA, 30 nt, Artificial Sequence
  Multifunctional protein ADE2 (2-11)
gccaccgccgaggugcugaacaucggcaag

SEQ ID NO: 39018 - RNA, 33 nt, Artificial Sequence
  Clathrin heavy chain 1 (311-321)
gccaccgccggcaucaucggggugaaccgcaag

SEQ ID NO: 39019 - RNA, 27 nt, Artificial Sequence
  Cilia- and flagella-associated protein 58 (79-87)
gccaccgcccugaagcucagccaggac

SEQ ID NO: 39020 - RNA, 33 nt, Artificial Sequence
  Mitogen-activated protein kinase-binding protein 1 (686-696)
gccaccgccagccccuucuccggccugcagaag

SEQ ID NO: 39021 - RNA, 27 nt, Artificial Sequence
  Glucosamine 6-phosphate N-acetyltransferase (99-107)
gccaccgccacccugaucaucgagcac

SEQ ID NO: 39022 - RNA, 27 nt, Artificial Sequence
  UPF0472 protein C16orf72 (67-75)
gccaccgccguggcgcagcuguacaag

SEQ ID NO: 39023 - RNA, 30 nt, Artificial Sequence
  NAD(P) transhydrogenase, mitochondrial (730-739)
gccaccgacgccgcggccaaccugaccaag

SEQ ID NO: 39024 - RNA, 33 nt, Artificial Sequence
  E3 ubiquitin-protein ligase RNF220 (291-301)
gccaccgacgaccugcaccacagcgaccgcuac

SEQ ID NO: 39025 - RNA, 30 nt, Artificial Sequence
  Collagen alpha-1(XII) chain (183-192)
gccaccgaccccgacgacacccacgccuac

SEQ ID NO: 39026 - RNA, 27 nt, Artificial Sequence
  V-type proton ATPase 21 kDa proteolipid subunit (120-128)
gccaccgaccccaaggccaucggccac

SEQ ID NO: 39027 - RNA, 27 nt, Artificial Sequence
  ATP-dependent RNA helicase DDX1 (614-622)
gccaccgagaaggagaaggugugguac

SEQ ID NO: 39028 - RNA, 36 nt, Artificial Sequence
  Apoptosis inhibitor 5 (17-28)
gccaccgagcaggugggccagcacaaggacgccuac

SEQ ID NO: 39029 - RNA, 33 nt, Artificial Sequence
  Calcium-binding protein 39 (186-196)
gccaccuucaaggaccugcucacccgccacaag

SEQ ID NO: 39030 - RNA, 30 nt, Artificial Sequence
  Serine/threonine-protein kinase OSR1 (172-181)
gccaccggcggggacaucacccgcaacaag

SEQ ID NO: 39031 - RNA, 30 nt, Artificial Sequence
  Inositol-pentakisphosphate 2-kinase (170-179)
gccaccggcaaguggaagcagaucagcaag

SEQ ID NO: 39032 - RNA, 30 nt, Artificial Sequence
  DNA-directed RNA polymerase II subunit RPB2 (442-451)
gccaccggcaacuggggggaccagaagaag

SEQ ID NO: 39033 - RNA, 27 nt, Artificial Sequence
  Plexin-B2 (68-76)
gccaccggccccgcccuggacaacaag

SEQ ID NO: 39034 - RNA, 27 nt, Artificial Sequence
  General transcription factor IIH subunit 2 (32-40)
gccaccaucgaggacauccuguucaag

SEQ ID NO: 39035 - RNA, 33 nt, Artificial Sequence
  Polycomb group RING finger protein 6 (210-220)
gccaccaucggccacguggagaaguuccugcgc

SEQ ID NO: 39036 - RNA, 33 nt, Artificial Sequence
  Isocitrate dehydrogenase (NAD) subunit alpha, mitochondrial (333-343)
gccaccaucaaggacggcaagagccugaccaag

SEQ ID NO: 39037 - RNA, 27 nt, Artificial Sequence
  Protein MMS22-like (831-839)
gccaccauccccccgaucagcucccug

SEQ ID NO: 39038 - RNA, 30 nt, Artificial Sequence
  Ankyrin repeat and KH domain-containing protein 1 (1428-1437)
gccaccaucaccgacaaggagcugcucaag

SEQ ID NO: 39039 - RNA, 33 nt, Artificial Sequence
  Ankyrin repeat and KH domain-containing protein 1 (1428-1438)
gccaccaucaccgacaaggagcugcucaagaag

SEQ ID NO: 39040 - RNA, 33 nt, Artificial Sequence
  Ankyrin repeat domain-containing protein 17 (1306-1316)
gccaccaucaccgacaaggagaugcugaagaag

SEQ ID NO: 39041 - RNA, 30 nt, Artificial Sequence
  HAUS augmin-like complex subunit 7 (418-427)
gccaccaagaugaacgagcugauggagaag

SEQ ID NO: 39042 - RNA, 27 nt, Artificial Sequence
  E3 SUMO-protein ligase NSE2 (69-77)
gccacccuggaccgccagcucaaccac

SEQ ID NO: 39043 - RNA, 33 nt, Artificial Sequence
  PIN2/TERF1-interacting telomerase inhibitor 1 (312-322)
gccacccuggaggagacccucgugaagaagaag

SEQ ID NO: 39044 - RNA, 33 nt, Artificial Sequence
  Coatomer subunit beta (111-121)
gccacccugggcgaccucaagcugguggagaag

SEQ ID NO: 39045 - RNA, 36 nt, Artificial Sequence
  DNA-directed RNA polymerase II subunit RPB1 (907-918)
gccacccugaagcccagcaacaaggccuucgagaag

SEQ ID NO: 39046 - RNA, 33 nt, Artificial Sequence
  Telomerase protein component 1 (83-93)
gccacccugagcgaccucaagaccauggagaag

SEQ ID NO: 39047 - RNA, 30 nt, Artificial Sequence
  KIF1-binding protein (254-263)
gccacccugagccaguucuacaucaacaag

SEQ ID NO: 39048 - RNA, 36 nt, Artificial Sequence
  Eukaryotic initiation factor 4A-I (214-225)
gccaccaugcccagcgacgugcuggaggucaccaag

SEQ ID NO: 39049 - RNA, 33 nt, Artificial Sequence
  Activity-dependent neuroprotector homeobox protein (988-998)
gccaccaugcagggcgaccgcgagcagcugaag

SEQ ID NO: 39050 - RNA, 30 nt, Artificial Sequence
  Arf-GAP with coiled-coil, ANK repeat and PH domain-containing protein 2 (155-164)
gccaccaacauccugaccgccacgcgcaag

SEQ ID NO: 39051 - RNA, 30 nt, Artificial Sequence
  Homeobox protein Hox-A13 (342-351)
gccaccaacaaguucaucaccaaggacaag

SEQ ID NO: 39052 - RNA, 30 nt, Artificial Sequence
  Rho-related BTB domain-containing protein 3 (557-566)
gccaccaacuaccugaucuucagccagaag

SEQ ID NO: 39053 - RNA, 27 nt, Artificial Sequence
  Glutathione S-transferase kappa 1 (148-156)
gccacccccaaggugaagaaccagcug

SEQ ID NO: 39054 - RNA, 30 nt, Artificial Sequence
  Splicing factor 1 (7-16)
gccaccccccuggacuucccgagcaagaag

SEQ ID NO: 39055 - RNA, 27 nt, Artificial Sequence
  Geranylgeranyl transferase type-2 subunit alpha (31-39)
gccacccaggccguguuccagaagcgc

SEQ ID NO: 39056 - RNA, 36 nt, Artificial Sequence
  Forkhead box protein J3 (44-55)
gccacccagaacgcccacggcaccgggaucagcaag

SEQ ID NO: 39057 - RNA, 27 nt, Artificial Sequence
  Tubby-related protein 4 (741-749)
gccacccaguaccccgugagcaaccgc

SEQ ID NO: 39058 - RNA, 33 nt, Artificial Sequence
  Importin subunit alpha-5 (407-417)
gccaccagcggcggguccgccgagcagaucaag

SEQ ID NO: 39059 - RNA, 27 nt, Artificial Sequence
  CLIP-associating protein 1 (426-434)
gccaccagcggcguggucgccgugcgc

SEQ ID NO: 39060 - RNA, 27 nt, Artificial Sequence
  Origin recognition complex subunit 3 (253-261)
gccaccagccccaucaucauccaccgc

SEQ ID NO: 39061 - RNA, 30 nt, Artificial Sequence
  Origin recognition complex subunit 3 (253-262)
gccaccagccccaucaucauccaccgccug

SEQ ID NO: 39062 - RNA, 27 nt, Artificial Sequence
  Importin subunit alpha-1 (60-68)
gccaccagcccccugcaggagaaccgc

SEQ ID NO: 39063 - RNA, 27 nt, Artificial Sequence
  tRNA pseudouridine synthase-like 1 (125-133)
gccaccagccgcaccuaccuguaccgg

SEQ ID NO: 39064 - RNA, 33 nt, Artificial Sequence
  Golgi apparatus membrane protein TVP23 homolog B (186-196)
gccaccagcuacuucggcaagcaguuccugcgc

SEQ ID NO: 39065 - RNA, 33 nt, Artificial Sequence
  ATP-citrate synthase (93-103)
gccaccgugggcaaggccaccggguuccugaag

SEQ ID NO: 39066 - RNA, 27 nt, Artificial Sequence
  Phosphoribosyl pyrophosphate synthase-associated protein 1 (222-230)
gccaccgugcaccccggccuggagcuc

SEQ ID NO: 39067 - RNA, 30 nt, Artificial Sequence
  Integrator complex subunit 7 (445-454)
gccaccgugaucuucgucgccagccagaag

SEQ ID NO: 39068 - RNA, 27 nt, Artificial Sequence
  Pre-mRNA-processing factor 19 (180-188)
gccaccgugcugaccacggagcgcaag

SEQ ID NO: 39069 - RNA, 33 nt, Artificial Sequence
  Mitochondrial folate transporter/carrier (241-251)
gccaccuaccccuaccaggugguccgcgcccgg

SEQ ID NO: 39070 - RNA, 33 nt, Artificial Sequence
  Eukaryotic translation initiation factor 3 subunit D (48-58)
gccaccuaccaggacaagcgcuacaccaacaag

SEQ ID NO: 39071 - RNA, 27 nt, Artificial Sequence
  Cleavage and polyadenylation specificity factor subunit 2 (52-60)
gccaccuacgugcagccccgccggaag

SEQ ID NO: 39072 - RNA, 27 nt, Artificial Sequence
  Protein phosphatase methylesterase 1 (362-370)
gccguggccaccuuccugauccgccac

SEQ ID NO: 39073 - RNA, 27 nt, Artificial Sequence
  Serine/threonine-protein kinase SIK2 (699-707)
gccguggacccccagcacaacggcuac

SEQ ID NO: 39074 - RNA, 27 nt, Artificial Sequence
  Fanconi anemia group D2 protein (69-77)
gccguggaccagaucgccuuccagaag

SEQ ID NO: 39075 - RNA, 27 nt, Artificial Sequence
  Breast cancer type 1 susceptibility protein (1104-1112)
gccguguucagcaaguccguccagaag

SEQ ID NO: 39076 - RNA, 33 nt, Artificial Sequence
  Uncharacterized aarF domain-containing protein kinase 5 (335-345)
gccgugcacgacaucgccgagaagcugaucaag

SEQ ID NO: 39077 - RNA, 27 nt, Artificial Sequence
  Telomere-associated protein RIF1 (481-489)
gccgugcacgacagcuucgucgccgug

SEQ ID NO: 39078 - RNA, 33 nt, Artificial Sequence
  Protein canopy homolog 4 (15-25)
gccgugcacgaggccugggcgggcaugcugaag

SEQ ID NO: 39079 - RNA, 27 nt, Artificial Sequence
  Zinc transporter ZIP3 (302-310)
gccgugcacgagacccuggucgccgug

SEQ ID NO: 39080 - RNA, 27 nt, Artificial Sequence
  Bifunctional methylenetetrahydrofolate dehydrogenase/cyclohydrolase, mitochondrial (270-278)
gccgugaucgacgucggcaucaaccgc

SEQ ID NO: 39081 - RNA, 39 nt, Artificial Sequence
  Cytoplasmic dynein 1 heavy chain 1 (3288-3300)
gccgugaucgaggcccagaacgcggucaagagcaucaag

SEQ ID NO: 39082 - RNA, 27 nt, Artificial Sequence
  Nucleosome-remodeling factor subunit BPTF (2407-2415)
gccgugaucgagcaccugaagcagaag

SEQ ID NO: 39083 - RNA, 33 nt, Artificial Sequence
  L-xylulose reductase (110-120)
gccgugauccaggucagccagaucguggcccgc

SEQ ID NO: 39084 - RNA, 33 nt, Artificial Sequence
  Protein S100-A16 (11-21)
gccgugaucguccugguggagaacuucuacaag

SEQ ID NO: 39085 - RNA, 30 nt, Artificial Sequence
  Periodic tryptophan protein 1 homolog (46-55)
gccgugcuggaccucagcuggaacaagcug

SEQ ID NO: 39086 - RNA, 33 nt, Artificial Sequence
  Zinc finger SWIM domain-containing protein 8 (430-440)
gccgugcuggaccccgcccucagcccgcagcgc

SEQ ID NO: 39087 - RNA, 27 nt, Artificial Sequence
  Vacuolar protein sorting-associated protein 11 homolog (740-748)
gccgugcugaagcacaucgagaacaag

SEQ ID NO: 39088 - RNA, 33 nt, Artificial Sequence
  Charged multivesicular body protein 3 (30-40)
gccgugcugcgcgucgccggcagccuccagaag

SEQ ID NO: 39089 - RNA, 33 nt, Artificial Sequence
  Long-chain-fatty-acid-CoA ligase 4 (332-342)
gccgugcccgagaucauggaccgcaucuacaag

SEQ ID NO: 39090 - RNA, 33 nt, Artificial Sequence
  Aspartyl aminopeptidase (23-33)
gccgugcagaccgccgcgaaggagcugcucaag

SEQ ID NO: 39091 - RNA, 30 nt, Artificial Sequence
  TSC22 domain family protein 4 (336-345)
gccgugcgcgaggaggucgaggugcugaag

SEQ ID NO: 39092 - RNA, 30 nt, Artificial Sequence
  Peroxisomal acyl-coenzyme A oxidase 1 (63-72)
gccgugcgcaagagcgccaucauggucaag

SEQ ID NO: 39093 - RNA, 33 nt, Artificial Sequence
  Pre-mRNA-processing factor 6 (914-924)
gccgugagcaaggacaucgccaacuggcagaag

SEQ ID NO: 39094 - RNA, 27 nt, Artificial Sequence
  5'-AMP-activated protein kinase subunit gamma-1 (141-149)
gccgugagcucccugauccgcaacaag

SEQ ID NO: 39095 - RNA, 33 nt, Artificial Sequence
  CD99 antigen-like protein 2 (58-68)
gccgugagcuccuacaucagcuaccagcagaag

SEQ ID NO: 39096 - RNA, 27 nt, Artificial Sequence
  Inactive hydroxysteroid dehydrogenase-like protein 1 (258-266)
gccgugagcacccugggcaucuccaag

SEQ ID NO: 39097 - RNA, 33 nt, Artificial Sequence
  CD81 antigen (63-73)
gccguggucgacgacgacgccaacaacgcgaag

SEQ ID NO: 39098 - RNA, 27 nt, Artificial Sequence
  GTP-binding protein 2 (496-504)
gccguggucgagaagauccacgccaag

SEQ ID NO: 39099 - RNA, 33 nt, Artificial Sequence
  Mitochondrial folate transporter/carrier (154-164)
gccguggucaacagcccccaccgccaguacaag

SEQ ID NO: 39100 - RNA, 27 nt, Artificial Sequence
  Inositol 1,4,5-trisphosphate receptor-interacting protein (385-393)
gccguguacgagcgccacuuccugcgg

SEQ ID NO: 39101 - RNA, 33 nt, Artificial Sequence
  Nuclear factor interleukin-3-regulated protein (146-156)
gccguguacuuccaggacuaccagaccagcaag

SEQ ID NO: 39102 - RNA, 27 nt, Artificial Sequence
  Aladin (158-166)
gccuggcacccccacaccaacaaguuc

SEQ ID NO: 39103 - RNA, 27 nt, Artificial Sequence
  Ankyrin-2 (1480-1488)
gccuacaucgccgaccaccugggcuuc

SEQ ID NO: 39104 - RNA, 27 nt, Artificial Sequence
  Leucine-rich repeat protein SHOC-2 (468-476)
gccuaccugaaggaccuccagaagcug

SEQ ID NO: 39105 - RNA, 27 nt, Artificial Sequence
  Fragile X mental retardation syndrome-related protein 1 (356-364)
gccuaccugaaggagguggagcagcuc

SEQ ID NO: 39106 - RNA, 27 nt, Artificial Sequence
  Serine/threonine-protein kinase RIO1 (156-164)
gccuaccugagcaaggccauggagauc

SEQ ID NO: 39107 - RNA, 27 nt, Artificial Sequence
  ER degradation-enhancing alpha-mannosidase-like protein 1 (395-403)
gccuaccagagcauccagaacuaccug

SEQ ID NO: 39108 - RNA, 27 nt, Artificial Sequence
  Angiomotin-like protein 1 (604-612)
gccuacguggagaaggucgagaagcug

SEQ ID NO: 39109 - RNA, 27 nt, Artificial Sequence
  Angiomotin-like protein 2 (481-489)
gccuacguggagaaggucgagcgccug

SEQ ID NO: 39110 - RNA, 27 nt, Artificial Sequence
  Zinc finger protein 580 (248-256)
gacgccgccgagcuggcgcagcacgug

SEQ ID NO: 39111 - RNA, 27 nt, Artificial Sequence
  Embryonic stem cell-specific 5-hydroxymethylcytosine-binding protein (62-70)
gacgccgacagcuccgagcgcaucauc

SEQ ID NO: 39112 - RNA, 27 nt, Artificial Sequence
  Proteasome subunit beta type-10 (90-98)
gacgccgagaugaccacccgcauggug

SEQ ID NO: 39113 - RNA, 27 nt, Artificial Sequence
  Torsin-1A-interacting protein 2 (129-137)
gacgcccaccugggcagcuccagcgug

SEQ ID NO: 39114 - RNA, 27 nt, Artificial Sequence
  Centrosomal protein of 95 kDa (61-69)
gacgcccacaacgugcaggccgucauc

SEQ ID NO: 39115 - RNA, 27 nt, Artificial Sequence
  Cohesin subunit SA-1 (302-310)
gacgccaucgccgagauccgcgcgauc

SEQ ID NO: 39116 - RNA, 27 nt, Artificial Sequence
  Heat shock cognate 71 kDa protein (323-331)
gacgccaagcuggacaagagccagauc

SEQ ID NO: 39117 - RNA, 24 nt, Artificial Sequence
  Phosphatidylinositol 4-kinase alpha (403-410)
gacgcccccgagcugagccacgug

SEQ ID NO: 39118 - RNA, 24 nt, Artificial Sequence
  Carnitine O-palmitoyltransferase 1, liver isoform (477-484)
gacgcccccaucguggcccaccug

SEQ ID NO: 39119 - RNA, 30 nt, Artificial Sequence
  Transcription activator BRG1 (696-705)
gacgcccccaaggccggccagcuggaggcg

SEQ ID NO: 39120 - RNA, 27 nt, Artificial Sequence
  Protein RMD5 homolog B (51-59)
gacgcccgcgagcagcagcagcagauc

SEQ ID NO: 39121 - RNA, 27 nt, Artificial Sequence
  Myotubularin (278-286)
gacgcccgccccagcgugaacgccguc

SEQ ID NO: 39122 - RNA, 27 nt, Artificial Sequence
  Filamin-A (1614-1622)
gacgccagcaagugcaccgugaccguc

SEQ ID NO: 39123 - RNA, 27 nt, Artificial Sequence
  E3 ubiquitin-protein ligase RNF114 (127-135)
gacgccagccugcagccccgcaacgug

SEQ ID NO: 39124 - RNA, 27 nt, Artificial Sequence
  Translocon-associated protein subunit delta (40-48)
gacgccgugaucagcaccgagaccguc

SEQ ID NO: 39125 - RNA, 24 nt, Artificial Sequence
  DNA-directed RNA polymerase II subunit RPB2 (306-313)
gacgccgugaacguccagaagauc

SEQ ID NO: 39126 - RNA, 27 nt, Artificial Sequence
  Adipocyte plasma membrane-associated protein (180-188)
gacgccuacaagggccuguucgaggug

SEQ ID NO: 39127 - RNA, 27 nt, Artificial Sequence
  Securin (108-116)
gacgccuaccccgagaucgagaaguuc

SEQ ID NO: 39128 - RNA, 33 nt, Artificial Sequence
  Proteasome subunit beta type-4 (118-128)
gacgaggagcugcucggcgacgggcacagcuac

SEQ ID NO: 39129 - RNA, 27 nt, Artificial Sequence
  DNA polymerase alpha catalytic subunit (336-344)
gacgaggagcagguguuccacuucuac

SEQ ID NO: 39130 - RNA, 33 nt, Artificial Sequence
  26S protease regulatory subunit 8 (123-133)
gacgagaucgacagcaucggcuccagccgccug

SEQ ID NO: 39131 - RNA, 27 nt, Artificial Sequence
  N-alpha-acetyltransferase 10 (47-55)
gacgagaacggcaagaucgugggguac

SEQ ID NO: 39132 - RNA, 27 nt, Artificial Sequence
  40S ribosomal protein S18 (62-70)
gacgagguggagcgcgucaucaccauc

SEQ ID NO: 39133 - RNA, 27 nt, Artificial Sequence
  Rab GDP dissociation inhibitor beta (21-29)
gacuucaaggugaccgagggcagcuuc

SEQ ID NO: 39134 - RNA, 27 nt, Artificial Sequence
  Fatty acid synthase (2469-2477)
gacggcaaggugagcguccacgugauc

SEQ ID NO: 39135 - RNA, 27 nt, Artificial Sequence
  Nucleoporin NUP53 (211-219)
gacggccgcaucuucggggagagcauc

SEQ ID NO: 39136 - RNA, 27 nt, Artificial Sequence
  Nicotinamide/nicotinic acid mononucleotide adenylyltransferase 1 (112-120)
gaccaccagcagaacagccccacccug

SEQ ID NO: 39137 - RNA, 42 nt, Artificial Sequence
  Glia-derived nexin (118-131)
gacaucgugaccgucgccaacgccguguucgugaagaacgcg

SEQ ID NO: 39138 - RNA, 27 nt, Artificial Sequence
  Non-POU domain-containing octamer-binding protein (226-234)
gaccugaugcgccggcaggaggagcuc

SEQ ID NO: 39139 - RNA, 27 nt, Artificial Sequence
  Homeodomain-interacting protein kinase 1 (252-260)
gaccccuuccagcagaccuucaucgug

SEQ ID NO: 39140 - RNA, 27 nt, Artificial Sequence
  Mediator of RNA polymerase II transcription subunit 13-like (1410-1418)
gaccccuacggcgggcaccgcgacgug

SEQ ID NO: 39141 - RNA, 24 nt, Artificial Sequence
  Plectin (3424-3431)
gaccccuacagcggcuccaccauc

SEQ ID NO: 39142 - RNA, 27 nt, Artificial Sequence
  Elongator complex protein 2 (46-54)
gaccaguuccagaaggugcugagccuc

SEQ ID NO: 39143 - RNA, 30 nt, Artificial Sequence
  Ras GTPase-activating protein-binding protein 2 (285-294)
gacagcgacaaccgccggaucauccgcuac

SEQ ID NO: 39144 - RNA, 24 nt, Artificial Sequence
  AP-3 complex subunit delta-1 (314-321)
gacagcgaccagaaccugaaguac

SEQ ID NO: 39145 - RNA, 27 nt, Artificial Sequence
  Ubiquitin carboxyl-terminal hydrolase 28 (507-515)
gacagcuacggcgggcugcgcaacgug

SEQ ID NO: 39146 - RNA, 27 nt, Artificial Sequence
  Zinc transporter ZIP6 (485-493)
gacaccgacgaccgcaccgagggcuac

SEQ ID NO: 39147 - RNA, 24 nt, Artificial Sequence
  Poly (ADP-ribose) polymerase 14 (118-125)
gacaccaucauggccaccaagcug

SEQ ID NO: 39148 - RNA, 24 nt, Artificial Sequence
  Protein S100-A9 (67-74)
gacaccaacgccgacaagcagcug

SEQ ID NO: 39149 - RNA, 27 nt, Artificial Sequence
  Protein FAM172A (263-271)
gacgugaagaacaaggucaccgccgug

SEQ ID NO: 39150 - RNA, 27 nt, Artificial Sequence
  Cytochrome c oxidase subunit 6C (57-65)
gacgugaugaaggacuucgaggagaug

SEQ ID NO: 39151 - RNA, 27 nt, Artificial Sequence
  N-acetyl-D-glucosamine kinase (175-183)
gaggccgccccccacgacaucggcuac

SEQ ID NO: 39152 - RNA, 30 nt, Artificial Sequence
  Myosin light polypeptide 6 (148-157)
gaggccuucgugcgccacauccugagcggc

SEQ ID NO: 39153 - RNA, 27 nt, Artificial Sequence
  Hsp70-binding protein 1 (201-209)
gaggccggcgccgcggggcugcgcugg

SEQ ID NO: 39154 - RNA, 24 nt, Artificial Sequence
  Probable U3 small nucleolar RNA-associated protein 11 (43-50)
gaggccaagaagaucgagcgccug

SEQ ID NO: 39155 - RNA, 27 nt, Artificial Sequence
  Ribosomal RNA-processing protein 7 homolog A (260-268)
gaggaggacaagcagcgcaucgagcug

SEQ ID NO: 39156 - RNA, 27 nt, Artificial Sequence
  WD40 repeat-containing protein SMU1 (197-205)
gaggaggagaaguuccccacccagcug

SEQ ID NO: 39157 - RNA, 30 nt, Artificial Sequence
  Guanine nucleotide-binding protein-like 3-like protein (97-106)
gaggaguucgagcacaaggaggaggugcug

SEQ ID NO: 39158 - RNA, 27 nt, Artificial Sequence
  Protocadherin Fat 1 (2948-2956)
gaggagaucaaccgccaggugaccuac

SEQ ID NO: 39159 - RNA, 27 nt, Artificial Sequence
  Midasin (582-590)
gaggagaucagccaccugaucuccuuc

SEQ ID NO: 39160 - RNA, 27 nt, Artificial Sequence
  Protein strawberry notch homolog 2 (93-101)
gaggagcugggccacaccgagaccuac

SEQ ID NO: 39161 - RNA, 27 nt, Artificial Sequence
  X-ray repair cross-complementing protein 5 (651-659)
gaggagcagcgcuucaacaacuuccug

SEQ ID NO: 39162 - RNA, 24 nt, Artificial Sequence
  Angiomotin-like protein 2 (573-580)
gaggagcgcgccaugcggcaguuc

SEQ ID NO: 39163 - RNA, 30 nt, Artificial Sequence
  Methylmalonic aciduria and homocystinuria type D protein, mitochondrial (191-200)
gaggagguggagaucgagcgcgagguccug

SEQ ID NO: 39164 - RNA, 27 nt, Artificial Sequence
  Mitotic checkpoint serine/threonine-protein kinase BUB1 beta (160-168)
gaggaguacgaggcccgcgagaacuuc

SEQ ID NO: 39165 - RNA, 27 nt, Artificial Sequence
  Mediator of RNA polymerase II transcription subunit 18 (128-136)
gaguucguggccaagggccaccuguuc

SEQ ID NO: 39166 - RNA, 27 nt, Artificial Sequence
  Glycerol-3-phosphate dehydrogenase 1-like protein (49-57)
gagggccccgaggggcugaagcucauc

SEQ ID NO: 39167 - RNA, 27 nt, Artificial Sequence
  3-ketoacyl-CoA thiolase, mitochondrial (221-229)
gagcacgcccgcccccagaccacccug

SEQ ID NO: 39168 - RNA, 27 nt, Artificial Sequence
  COMM domain-containing protein 6 (77-85)
gagaucgccgccgugaucgagaccguc

SEQ ID NO: 39169 - RNA, 30 nt, Artificial Sequence
  Actin-related protein 6 (47-56)
gagaucaaggaccccagcggccuguucuac

SEQ ID NO: 39170 - RNA, 27 nt, Artificial Sequence
  Spectrin beta chain, non-erythrocytic 1 (1987-1995)
gagaucaaggagaagcugcuccagcug

SEQ ID NO: 39171 - RNA, 27 nt, Artificial Sequence
  DnaJ homolog subfamily C member 8 (83-91)
gagaucaagaagcgcuuccggcagcug

SEQ ID NO: 39172 - RNA, 27 nt, Artificial Sequence
  Heat shock protein 105 kDa (740-748)
gagaucaagaccaagaucaaggagcug

SEQ ID NO: 39173 - RNA, 27 nt, Artificial Sequence
  Replication protein A 14 kDa subunit (62-70)
gagaucagcggcaucguggaggucgug

SEQ ID NO: 39174 - RNA, 27 nt, Artificial Sequence
  Centrosomal protein of 170 kDa (1472-1480)
gagaucagcuccauccugcaggagcuc

SEQ ID NO: 39175 - RNA, 33 nt, Artificial Sequence
  Peptidyl-prolyl cis-trans isomerase CWC27 homolog (445-455)
gagaucuacgacccccgcaacccggugaacaag

SEQ ID NO: 39176 - RNA, 27 nt, Artificial Sequence
  Serine-protein kinase ATM (1146-1154)
gagaucuacaaccgcaagagcgugcug

SEQ ID NO: 39177 - RNA, 27 nt, Artificial Sequence
  Translin-associated protein X (45-53)
gagcuggacgcccgccacgacaaguac

SEQ ID NO: 39178 - RNA, 27 nt, Artificial Sequence
  Ankyrin repeat domain-containing protein 40 (281-289)
gagcuggaccgccaggagcucaccuac

SEQ ID NO: 39179 - RNA, 27 nt, Artificial Sequence
  Uncharacterized protein C16orf45 (98-106)
gagcugauccagaagauccacaagcuc

SEQ ID NO: 39180 - RNA, 27 nt, Artificial Sequence
  ATP-dependent DNA helicase Q1 (34-42)
gagcugauccagaagaagaaggugcuc

SEQ ID NO: 39181 - RNA, 27 nt, Artificial Sequence
  Dedicator of cytokinesis protein 7 (661-669)
gagcugaagagcuccaucagcgcccuc

SEQ ID NO: 39182 - RNA, 27 nt, Artificial Sequence
  Protein Spindly (108-116)
gagcugaagaccaagaucgagaagcuc

SEQ ID NO: 39183 - RNA, 27 nt, Artificial Sequence
  Hypoxia-inducible factor 1-alpha (705-713)
gagcugaaccccaagauccucgcccug

SEQ ID NO: 39184 - RNA, 27 nt, Artificial Sequence
  NF-kappa-B inhibitor-interacting Ras-like protein 1 (70-78)
gagcugcccaagcacuacuucagcuuc

SEQ ID NO: 39185 - RNA, 27 nt, Artificial Sequence
  Transmembrane emp24 domain-containing protein 9 (163-171)
gagcugcagcuccgcgugcggcagcug

SEQ ID NO: 39186 - RNA, 27 nt, Artificial Sequence
  FRAS1-related extracellular matrix protein 2 (2560-2568)
gagcugagcaacuucgagcucacccug

SEQ ID NO: 39187 - RNA, 27 nt, Artificial Sequence
  Immediate early response gene 5 protein (99-107)
gagccccagccggagcgcagcuccgug

SEQ ID NO: 39188 - RNA, 27 nt, Artificial Sequence
  Tubulin beta-6 chain (116-124)
gagcccuacaacgccacccugagcgug

SEQ ID NO: 39189 - RNA, 30 nt, Artificial Sequence
  Proline-rich protein PRCC (289-298)
gagcccuacccguaccccauccccaccgug

SEQ ID NO: 39190 - RNA, 24 nt, Artificial Sequence
  Eukaryotic translation initiation factor 3 subunit A (641-648)
gagcagaucaagaagaccgagcug

SEQ ID NO: 39191 - RNA, 27 nt, Artificial Sequence
  Integrator complex subunit 1 (747-755)
gagcagcccgagaccuacuacaagugg

SEQ ID NO: 39192 - RNA, 27 nt, Artificial Sequence
  Oxysterol-binding protein-related protein 9 (151-159)
gagcagcgcaagaagaucgagacccug

SEQ ID NO: 39193 - RNA, 39 nt, Artificial Sequence
  (1108-1120)
gagagcgacaaguacgccgagcgcaagggcgccgcguac

SEQ ID NO: 39194 - RNA, 30 nt, Artificial Sequence
  39S ribosomal protein L2, mitochondrial (197-206)
gagagcgagcccggccgcggggcccaguac

SEQ ID NO: 39195 - RNA, 27 nt, Artificial Sequence
  Trafficking protein particle complex subunit 3 (73-81)
gagaccgccgacgugaucgccaagguc

SEQ ID NO: 39196 - RNA, 33 nt, Artificial Sequence
  60S ribosomal protein L17 (31-41)
gagaccgcccaggccaucaagggcaugcacauc

SEQ ID NO: 39197 - RNA, 33 nt, Artificial Sequence
  Semaphorin-3C (312-322)
gagaccgacaacccccgcaccacgcugguguac

SEQ ID NO: 39198 - RNA, 27 nt, Artificial Sequence
  Maturin (26-34)
gagaccgagcgccggauggacuucuac

SEQ ID NO: 39199 - RNA, 27 nt, Artificial Sequence
  Type II inositol 3,4-bisphosphate 4-phosphatase (389-397)
gagaccgagcgccggaacaccggcuac

SEQ ID NO: 39200 - RNA, 27 nt, Artificial Sequence
  Crooked neck-like protein 1 (679-687)
gagaccgagcgcacccggaaccuguac

SEQ ID NO: 39201 - RNA, 27 nt, Artificial Sequence
  Mortality factor 4-like protein 1 (187-195)
gagaccuucaugaaccgcguggagguc

SEQ ID NO: 39202 - RNA, 27 nt, Artificial Sequence
  Proteasome-associated protein ECM29 homolog (349-357)
gagaccuuccccgccaacauccaggug

SEQ ID NO: 39203 - RNA, 27 nt, Artificial Sequence
  Nucleoporin NUP188 homolog (337-345)
gagaccagcuccgugguccgcaagauc

SEQ ID NO: 39204 - RNA, 27 nt, Artificial Sequence
  NF-kappa-B-repressing factor (487-495)
gaggugaucgccgaggccgucggcgug

SEQ ID NO: 39205 - RNA, 27 nt, Artificial Sequence
  Sphingolipid delta(4)-desaturase DES1 (150-158)
gaggugaucaacaccgucgcccaggug

SEQ ID NO: 39206 - RNA, 27 nt, Artificial Sequence
  U11/U12 small nuclear ribonucleoprotein 48 kDa protein (239-247)
gaggugauccgcgacgucaucaacgug

SEQ ID NO: 39207 - RNA, 27 nt, Artificial Sequence
  T-complex protein 1 subunit theta (462-470)
gaggugaucagcaagcuguacgccguc

SEQ ID NO: 39208 - RNA, 27 nt, Artificial Sequence
  Protein O-GlcNAcase (266-274)
gaggugagcaagaucaucaagcgcgcc

SEQ ID NO: 39209 - RNA, 30 nt, Artificial Sequence
  Prolyl 3-hydroxylase OGFOD1 (211-220)
gaggugagccccgucuccuuccaccaggug

SEQ ID NO: 39210 - RNA, 30 nt, Artificial Sequence
  Melanoma-associated antigen 1 (222-231)
gagguguacgacggccgcgagcacagcgcc

SEQ ID NO: 39211 - RNA, 27 nt, Artificial Sequence
  Exocyst complex component 4 (587-595)
gaguacauccacgcccugacccuccug

SEQ ID NO: 39212 - RNA, 33 nt, Artificial Sequence
  Inactive tyrosine-protein kinase transmembrane receptor ROR1 (4-14)
gaguacaucaaccagggcgaccugcacgaguuc

SEQ ID NO: 39213 - RNA, 27 nt, Artificial Sequence
  Vacuolar protein sorting-associated protein 4B (64-72)
gaguaccuggaccgcgccgagaagcuc

SEQ ID NO: 39214 - RNA, 27 nt, Artificial Sequence
  5'-3' exoribonuclease 1 (989-997)
gaguaccuggagcgcgcccccgagcuc

SEQ ID NO: 39215 - RNA, 24 nt, Artificial Sequence
  Tubulin beta chain (178-185)
gaguaccccgaccgcaucaugaac

SEQ ID NO: 39216 - RNA, 30 nt, Artificial Sequence
  Zinc finger protein 281 (515-524)
gaguacagcaaguaccugcagcaggccuuc

SEQ ID NO: 39217 - RNA, 27 nt, Artificial Sequence
  UPF0469 protein KIAA0907 (327-335)
gaguacagccgcuucgugaaccagauc

SEQ ID NO: 39218 - RNA, 27 nt, Artificial Sequence
  Melanoma-associated antigen D1 (504-512)
gaguacaccgacguguaccccgagauc

SEQ ID NO: 39219 - RNA, 27 nt, Artificial Sequence
  Probable global transcription activator SNF2L2 (535-543)
gaguacguggccaaccugaccaaccuc

SEQ ID NO: 39220 - RNA, 33 nt, Artificial Sequence
  HLA class I histocompatibility antigen, alpha chain F (43-53)
gaguacguggacgacacccaguuccugcgcuuc

SEQ ID NO: 39221 - RNA, 27 nt, Artificial Sequence
  Zinc finger protein 506 (117-125)
gaguacgugaaguuccugcacaaguuc

SEQ ID NO: 39222 - RNA, 27 nt, Artificial Sequence
  Kinesin-like protein KIF22 (218-226)
uucgccgacuucgagcgccacuuccug

SEQ ID NO: 39223 - RNA, 27 nt, Artificial Sequence
  Phosphatidylinositol 4-phosphate 3-kinase C2 domain-containing subunit alpha (950-958)
uucgccgaccaggaggugcgcagccug

SEQ ID NO: 39224 - RNA, 27 nt, Artificial Sequence
  E3 ubiquitin-protein ligase TRIM22 (386-394)
uucgccuucgaccccagcgugaacuac

SEQ ID NO: 39225 - RNA, 27 nt, Artificial Sequence
  Protein disulfide-isomerase A3 (184-192)
uucgcccacaccaacguggagagccug

SEQ ID NO: 39226 - RNA, 27 nt, Artificial Sequence
  Sarcosine dehydrogenase, mitochondrial (859-867)
uucgccaucgacaagaccaucgccuac

SEQ ID NO: 39227 - RNA, 27 nt, Artificial Sequence
  Eukaryotic translation initiation factor 3 subunit E (53-61)
uucgccauggacguguacaagaaccug

SEQ ID NO: 39228 - RNA, 27 nt, Artificial Sequence
  Protein-tyrosine kinase 2-beta (257-265)
uucgccaacaucgaccaggagaccuac

SEQ ID NO: 39229 - RNA, 33 nt, Artificial Sequence
  Glutamine and serine-rich protein 1 (1659-1669)
uucgccguggaccccgagaagauccagcuguac

SEQ ID NO: 39230 - RNA, 27 nt, Artificial Sequence
  Ubiquilin-1 (50-58)
uucgccgugcccgagaacagcuccguc

SEQ ID NO: 39231 - RNA, 30 nt, Artificial Sequence
  Eukaryotic translation initiation factor 3 subunit B (568-577)
uucgccugggagcccaacggcagcaaguuc

SEQ ID NO: 39232 - RNA, 33 nt, Artificial Sequence
  Probable ATP-dependent RNA helicase DDX56 (464-474)
uucgaggacaacccccgcgaccugcagcuccug

SEQ ID NO: 39233 - RNA, 27 nt, Artificial Sequence
  Coatomer subunit gamma-1 (783-791)
uucgagaaggaggagaccuucacccug

SEQ ID NO: 39234 - RNA, 27 nt, Artificial Sequence
  Alpha-parvin (133-141)
uucgagaagcuggagagcgagaagcuc

SEQ ID NO: 39235 - RNA, 30 nt, Artificial Sequence
  Glycogen phosphorylase, brain form (327-336)
uucgagaccuuccccgacaagguggccauc

SEQ ID NO: 39236 - RNA, 33 nt, Artificial Sequence
  Destrin (89-99)
uucgagaccaaggagagccgcaaggaggagcug

SEQ ID NO: 39237 - RNA, 27 nt, Artificial Sequence
  Zinc finger protein 462 (268-276)
uucggcgacagcgggcgccuguacuac

SEQ ID NO: 39238 - RNA, 27 nt, Artificial Sequence
  Endoplasmic reticulum-Golgi intermediate compartment protein 3 (214-222)
uuccacuucgcccccggcaagagcuuc

SEQ ID NO: 39239 - RNA, 30 nt, Artificial Sequence
  HLA class II histocompatibility antigen, DQ alpha 1 chain (134-143)
uucaucgacaaguucacccccccggugguc

SEQ ID NO: 39240 - RNA, 27 nt, Artificial Sequence
  Guanine nucleotide-binding protein G(I)/G(S)/G(T) subunit beta-1 (58-66)
uuccuggacgacaaccagaucgugacc

SEQ ID NO: 39241 - RNA, 27 nt, Artificial Sequence
  Basigin (25-33)
uuccugcccgagccgaugggcaccgcc

SEQ ID NO: 39242 - RNA, 30 nt, Artificial Sequence
  Volume-regulated anion channel subunit LRRC8D (80-89)
uuccugagcgagguguccgagaacaagcuc

SEQ ID NO: 39243 - RNA, 27 nt, Artificial Sequence
  Transmembrane protein 97 (18-26)
uuccugagccacauccccaucacccuc

SEQ ID NO: 39244 - RNA, 30 nt, Artificial Sequence
  Vitamin K-dependent protein S (26-35)
uuccugagcaagcagcaggccucccaggug

SEQ ID NO: 39245 - RNA, 27 nt, Artificial Sequence
  Helicase with zinc finger domain 2 (630-638)
uuccgccccccgacccgggccgagcug

SEQ ID NO: 39246 - RNA, 27 nt, Artificial Sequence
  Myeloid leukemia factor 2 (203-211)
uuccgccagcagcggccccuggaguuc

SEQ ID NO: 39247 - RNA, 27 nt, Artificial Sequence
  Importin subunit alpha-7 (90-98)
uucagcgacgacuccgaccugcagcuc

SEQ ID NO: 39248 - RNA, 27 nt, Artificial Sequence
  Protein phosphatase 1D (12-20)
uucagcgaccagggcgggcgcaaguac

SEQ ID NO: 39249 - RNA, 27 nt, Artificial Sequence
  60S ribosomal protein L11 (98-106)
uucagcgacaccggcaacuucggguuc

SEQ ID NO: 39250 - RNA, 27 nt, Artificial Sequence
  Renin receptor (105-113)
uucagcgaggagacccccgugguccug

SEQ ID NO: 39251 - RNA, 27 nt, Artificial Sequence
  Transforming protein RhoA (80-88)
uucagcaucgacucccccgacagccug

SEQ ID NO: 39252 - RNA, 27 nt, Artificial Sequence
  Condensin complex subunit 3 (305-313)
uucagcaucaccccccuguccgagcuc

SEQ ID NO: 39253 - RNA, 27 nt, Artificial Sequence
  Unconventional myosin-Ib (364-372)
uucagcuccgaccaccugaucgagaug

SEQ ID NO: 39254 - RNA, 27 nt, Artificial Sequence
  TBC1 domain family member 22B (80-88)
uucagcucccccagcuuccagacccug

SEQ ID NO: 39255 - RNA, 27 nt, Artificial Sequence
  Basic leucine zipper and W2 domain-containing protein 2 (234-242)
uucaccgacgccggccugaaggagcuc

SEQ ID NO: 39256 - RNA, 27 nt, Artificial Sequence
  Multidrug resistance protein 1 (175-183)
uucaccgacaaggagcugcucgccuac

SEQ ID NO: 39257 - RNA, 27 nt, Artificial Sequence
  Protein VPRBP (1070-1078)
uucaccgaggaccacuacguggaguuc

SEQ ID NO: 39258 - RNA, 30 nt, Artificial Sequence
  Neuronal calcium sensor 1 (22-31)
uucaccgagaaggaggugcagcagugguac

SEQ ID NO: 39259 - RNA, 27 nt, Artificial Sequence
  RNMT-activating mini protein (19-27)
uucaccgagaacgacaaggaguaccag

SEQ ID NO: 39260 - RNA, 39 nt, Artificial Sequence
  DNA-directed RNA polymerase II subunit RPB7 (31-43)
uucaccgagguggagggcaccugcacggggaaguacggc

SEQ ID NO: 39261 - RNA, 27 nt, Artificial Sequence
  SURP and G-patch domain-containing protein 1 (198-206)
uucguggccgagggcgggcccgagcug

SEQ ID NO: 39262 - RNA, 30 nt, Artificial Sequence
  Glutamyl-tRNA(Gln) amidotransferase subunit C, mitochondrial (112-121)
uucguggcccccccgggcaacaucagccug

SEQ ID NO: 39263 - RNA, 27 nt, Artificial Sequence
  E3 ubiquitin-protein ligase RNF187 (182-190)
uucguggaggaggaggagcacuuccug

SEQ ID NO: 39264 - RNA, 27 nt, Artificial Sequence
  Ubiquitin carboxyl-terminal hydrolase 22 (45-53)
uucguguggagcggcaccgccgaggcc

SEQ ID NO: 39265 - RNA, 33 nt, Artificial Sequence
  Membrane cofactor protein (69-79)
uucuacauccccccgcuggccacccacaccauc

SEQ ID NO: 39266 - RNA, 27 nt, Artificial Sequence
  GPI transamidase component PIG-T (539-547)
uucuacaaccugcucacccgcaccuuc

SEQ ID NO: 39267 - RNA, 27 nt, Artificial Sequence
  RNA polymerase II-associated factor 1 homolog (423-431)
ggcgccaccgccgcggcccccgugccg

SEQ ID NO: 39268 - RNA, 33 nt, Artificial Sequence
  Nuclear mitotic apparatus protein 1 (775-785)
ggcgaggcccaccaggccgagaccgaggugcug

SEQ ID NO: 39269 - RNA, 30 nt, Artificial Sequence
  Cytoplasmic dynein 1 light intermediate chain 2 (61-70)
ggcgaggacgggagcggcaagaccacccug

SEQ ID NO: 39270 - RNA, 33 nt, Artificial Sequence
  von Willebrand factor A domain-containing protein 5A (208-218)
ggcgaggacaagaccagcgcccaggugucccug

SEQ ID NO: 39271 - RNA, 27 nt, Artificial Sequence
  Protein Jade-2 (168-176)
ggcgaggaccuggagaaggugacccuc

SEQ ID NO: 39272 - RNA, 30 nt, Artificial Sequence
  Zinc finger protein 622 (359-368)
ggcgaggaccccaacaaggccgaggagcug

SEQ ID NO: 39273 - RNA, 33 nt, Artificial Sequence
  Eukaryotic translation initiation factor 3 subunit C-like protein (542-552)
ggcgaggacagcgccgugcugauggagcgccuc

SEQ ID NO: 39274 - RNA, 27 nt, Artificial Sequence
  Poly(U)-binding-splicing factor PUF60 (123-131)
ggcgaggacaccauccgccaggccuuc

SEQ ID NO: 39275 - RNA, 30 nt, Artificial Sequence
  Glutamine-tRNA ligase (351-360)
ggcgaggagcugaaggggcacaacacccuc

SEQ ID NO: 39276 - RNA, 27 nt, Artificial Sequence
  DNA damage-binding protein 1 (783-791)
ggcgaggagguggagguccacaaccug

SEQ ID NO: 39277 - RNA, 30 nt, Artificial Sequence
  RNA-binding protein 8A (81-90)
ggcgagaucaagaacauccaccugaaccuc

SEQ ID NO: 39278 - RNA, 33 nt, Artificial Sequence
  Supervillin (797-807)
ggcgagaucaagacccccaccggggagggccug

SEQ ID NO: 39279 - RNA, 27 nt, Artificial Sequence
  Hsc70-interacting protein (128-136)
ggcgagcugcagaaggccaucgaccuc

SEQ ID NO: 39280 - RNA, 27 nt, Artificial Sequence
  Antigen peptide transporter 2 (87-95)
ggcgagcugacccaggggagccuccug

SEQ ID NO: 39281 - RNA, 30 nt, Artificial Sequence
  Cytoplasmic dynein 1 heavy chain 1 (2173-2182)
ggcgagaugaccgcccugcgcgaggagcuc

SEQ ID NO: 39282 - RNA, 30 nt, Artificial Sequence
  Ras-related protein Rab-5A (27-36)
ggcgagagcgccguggggaaguccagccug

SEQ ID NO: 39283 - RNA, 33 nt, Artificial Sequence
  U4/U6 small nuclear ribonucleoprotein Prp4 (45-55)
ggcgagagcgggauccugggcaaggacgggcuc

SEQ ID NO: 39284 - RNA, 27 nt, Artificial Sequence
  tRNA wybutosine-synthesizing protein 2 homolog (54-62)
ggcgagacccugcccgagcagcaccuc

SEQ ID NO: 39285 - RNA, 27 nt, Artificial Sequence
  Nuclear protein localization protein 4 homolog (480-488)
ggcgagacccaggacuuccacagccug

SEQ ID NO: 39286 - RNA, 27 nt, Artificial Sequence
  Eukaryotic translation initiation factor 5A-1 (106-114)
ggcgaggugcgcgaggaccugcggcuc

SEQ ID NO: 39287 - RNA, 27 nt, Artificial Sequence
  Heterogeneous nuclear ribonucleoprotein H (422-430)
ggcggguacggcgggcagagcuccaug

SEQ ID NO: 39288 - RNA, 27 nt, Artificial Sequence
  Class E basic helix-loop-helix protein 41 (81-89)
ggccaccuggagaaggccgugguccuc

SEQ ID NO: 39289 - RNA, 27 nt, Artificial Sequence
  Guanine nucleotide-binding protein subunit beta-2-like 1 (13-21)
ggccacaacgggugggugacccagauc

SEQ ID NO: 39290 - RNA, 27 nt, Artificial Sequence
  Oxysterol-binding protein-related protein 9 (262-270)
ggccacagccccccguccagcucccug

SEQ ID NO: 39291 - RNA, 27 nt, Artificial Sequence
  DNA replication licensing factor MCM6 (508-516)
ggccacuacgaccgcagcaagucccug

SEQ ID NO: 39292 - RNA, 33 nt, Artificial Sequence
  40S ribosomal protein S15 (113-123)
ggccacuaccugggggaguucagcaucaccuac

SEQ ID NO: 39293 - RNA, 27 nt, Artificial Sequence
  Coatomer subunit alpha (731-739)
ggccacuaccagaacgcccuguaccuc

SEQ ID NO: 39294 - RNA, 27 nt, Artificial Sequence
  Poly(rC)-binding protein 1 (259-267)
ggcaucgacagcuccagccccgaggug

SEQ ID NO: 39295 - RNA, 27 nt, Artificial Sequence
  Mitogen-activated protein kinase kinase kinase 6 (197-205)
ggccuggccgacgggcucgugcaggcc

SEQ ID NO: 39296 - RNA, 27 nt, Artificial Sequence
  Multiple PDZ domain protein (814-822)
ggccuggccgacaagccccucuuccgc

SEQ ID NO: 39297 - RNA, 27 nt, Artificial Sequence
  Ras GTPase-activating-like protein IQGAP3 (153-161)
ggccuggccccccagauccacgaccuc

SEQ ID NO: 39298 - RNA, 27 nt, Artificial Sequence
  26S protease regulatory subunit 8 (27-35)
ggccuggacaagcagaucaaggagauc

SEQ ID NO: 39299 - RNA, 27 nt, Artificial Sequence
  Nuclear autoantigenic sperm protein (409-417)
ggccuggaggagaaggugcgcgccaag

SEQ ID NO: 39300 - RNA, 27 nt, Artificial Sequence
  Nuclear pore complex protein Nup98-Nup96 (50-58)
ggccuguucgggaacagccagaccaag

SEQ ID NO: 39301 - RNA, 27 nt, Artificial Sequence
  Box C/D snoRNA protein 1 (14-22)
ggccugcacagcguggccgaggggguc

SEQ ID NO: 39302 - RNA, 27 nt, Artificial Sequence
  60S ribosomal protein L11 (85-93)
ggccugaaggugcgcgaguacgagcuc

SEQ ID NO: 39303 - RNA, 27 nt, Artificial Sequence
  Kinesin-like protein KIF3A (576-584)
ggccugcucgagaacauccgccagcug

SEQ ID NO: 39304 - RNA, 33 nt, Artificial Sequence
  Mitochondrial import inner membrane translocase subunit TIM50 (78-88)
ggccugcucggggccggcgggaccgugagcguc

SEQ ID NO: 39305 - RNA, 27 nt, Artificial Sequence
  C-terminal-binding protein 1 (238-246)
ggccugaacgagcacaaccaccaccuc

SEQ ID NO: 39306 - RNA, 30 nt, Artificial Sequence
  Acyl-CoA synthetase family member 4 (721-730)
ggccugaacagccccgugcucaucgggaag

SEQ ID NO: 39307 - RNA, 27 nt, Artificial Sequence
  Fos-related antigen 2 (165-173)
ggccugcagaaggagaucgccgagcuc

SEQ ID NO: 39308 - RNA, 27 nt, Artificial Sequence
  Mitofusin-1 (547-555)
ggccugagcgagcccaucuuccagcuc

SEQ ID NO: 39309 - RNA, 27 nt, Artificial Sequence
  Serine/threonine-protein phosphatase 2B catalytic subunit beta isoform (228-236)
ggccugagccccgagauccacacccuc

SEQ ID NO: 39310 - RNA, 27 nt, Artificial Sequence
  Neurofibromin (37-45)
ggccugaccaccauccucaagaacgug

SEQ ID NO: 39311 - RNA, 27 nt, Artificial Sequence
  Retinoic acid receptor gamma (203-211)
ggccugugggacaaguucagcgagcuc

SEQ ID NO: 39312 - RNA, 27 nt, Artificial Sequence
  Uncharacterized protein C17orf85 (252-260)
ggccuguacgccgacacccgcgagaag

SEQ ID NO: 39313 - RNA, 24 nt, Artificial Sequence
  Very-long-chain (3R)-3-hydroxyacyl-CoA dehydratase 1 (106-113)
ggccuguacaagagcauccagaag

SEQ ID NO: 39314 - RNA, 27 nt, Artificial Sequence
  Tripartite motif-containing protein 65 (17-25)
ggccuguaccaggaccccgugacccuc

SEQ ID NO: 39315 - RNA, 30 nt, Artificial Sequence
  Thioredoxin reductase 1, cytoplasmic (282-291)
ggccaguucaucgggccccaccgcaucaag

SEQ ID NO: 39316 - RNA, 27 nt, Artificial Sequence
  Cdc42 effector protein 3 (76-84)
ggccaguuccccgggcacaacgaguuc

SEQ ID NO: 39317 - RNA, 27 nt, Artificial Sequence
  Regulator of chromosome condensation (439-447)
ggccagcacaccgugcugcucgucaag

SEQ ID NO: 39318 - RNA, 27 nt, Artificial Sequence
  Chromodomain-helicase-DNA-binding protein 4 (1164-1172)
ggccagaacaagaaggugaugaucuac

SEQ ID NO: 39319 - RNA, 39 nt, Artificial Sequence
  EH domain-containing protein 2 (65-77)
ggccaguacagcaccgggaagaccuccuucauccaguac

SEQ ID NO: 39320 - RNA, 33 nt, Artificial Sequence
  Heterogeneous nuclear ribonucleoprotein H (256-266)
ggcagcgaccgcuucgggcgggaccugaacuac

SEQ ID NO: 39321 - RNA, 27 nt, Artificial Sequence
  Mitochondrial import inner membrane translocase subunit TIM50 (62-70)
ggcagcgaggggcccuccuacgccaag

SEQ ID NO: 39322 - RNA, 33 nt, Artificial Sequence
  Ribonucleoside-diphosphate reductase subunit M2 (238-248)
ggcagcuucgccuccaucuucuggcugaagaag

SEQ ID NO: 39323 - RNA, 27 nt, Artificial Sequence
  HLA class I histocompatibility antigen, A-2 alpha chain (25-33)
ggcagccacuccaugcgcuacuucuuc

SEQ ID NO: 39324 - RNA, 30 nt, Artificial Sequence
  HLA class I histocompatibility antigen, A-1 alpha chain (25-34)
ggcagccacuccaugcgcuacuucuucacc

SEQ ID NO: 39325 - RNA, 27 nt, Artificial Sequence
  HLA class I histocompatibility antigen, Cw-4 alpha chain (25-33)
ggcagccacuccaugcgcuacuucagc

SEQ ID NO: 39326 - RNA, 27 nt, Artificial Sequence
  60S ribosomal protein L37 (23-31)
ggcagcaaggccuaccaccugcagaag

SEQ ID NO: 39327 - RNA, 33 nt, Artificial Sequence
  Protein PRR14L (865-875)
ggcagccugcccggggacaagauccgcaacaag

SEQ ID NO: 39328 - RNA, 30 nt, Artificial Sequence
  Smoothelin (449-458)
ggcaccgccgagcccgggggcagcaugaag

SEQ ID NO: 39329 - RNA, 33 nt, Artificial Sequence
  Embryonic stem cell-specific 5-hydroxymethylcytosine-binding protein (329-339)
ggcaccgccgggcugcucgagcaguggcugaag

SEQ ID NO: 39330 - RNA, 33 nt, Artificial Sequence
  Glutamine-rich protein 1 (209-219)
ggcaccgccagcgugcugcagcccgucaagaag

SEQ ID NO: 39331 - RNA, 30 nt, Artificial Sequence
  Sphingosine-1-phosphate phosphatase 1 (135-144)
ggcaccgagcuggggaacgagcucuucuac

SEQ ID NO: 39332 - RNA, 33 nt, Artificial Sequence
  WD repeat-containing protein 92 (479-489)
ggcaccuucggggccaccagccugcagcagcgc

SEQ ID NO: 39333 - RNA, 33 nt, Artificial Sequence
  Cactin isoform X2  (208-218)
ggcaccuucaucuggaacaaggcccuggagaag

SEQ ID NO: 39334 - RNA, 33 nt, Artificial Sequence
  Unconventional myosin-IXa (2491-2501)
ggcaccuucaaccccgagaaggggaagcagaag

SEQ ID NO: 39335 - RNA, 27 nt, Artificial Sequence
  Biogenesis of lysosome-related organelles complex 1 subunit 4 (164-172)
ggcaccuucccccgcgccuucaagaag

SEQ ID NO: 39336 - RNA, 30 nt, Artificial Sequence
  Actin-like protein 6A (362-371)
ggcaccuuccagcagauguggaucagcaag

SEQ ID NO: 39337 - RNA, 33 nt, Artificial Sequence
  Neurobeachin-like protein 1 (754-764)
ggcaccaucgagaagagcaagcugaucaccaag

SEQ ID NO: 39338 - RNA, 27 nt, Artificial Sequence
  Isoleucine-tRNA ligase, cytoplasmic (62-70)
ggcaccaucaaggacaucgugacccgc

SEQ ID NO: 39339 - RNA, 36 nt, Artificial Sequence
  Histone H2B type 1-K (115-126)
ggcaccaaggccgugaccaaguacacgagcgccaag

SEQ ID NO: 39340 - RNA, 30 nt, Artificial Sequence
  Integrator complex subunit 5 (378-387)
ggcacccugcagcccccguucaccgcccgc

SEQ ID NO: 39341 - RNA, 27 nt, Artificial Sequence
  Phosphomannomutase 1 (22-30)
ggcacccugacccccgcccgccagaag

SEQ ID NO: 39342 - RNA, 33 nt, Artificial Sequence
  Probable phospholipid-transporting ATPase IIA (238-248)
ggcacccugacccagaacgagaugaucuucaag

SEQ ID NO: 39343 - RNA, 27 nt, Artificial Sequence
  Thioredoxin domain-containing protein 9 (203-211)
ggcaccaacuucaccaagcuggagaag

SEQ ID NO: 39344 - RNA, 27 nt, Artificial Sequence
  Rho guanine nucleotide exchange factor 17 (1361-1369)
ggcacccaggggagccccaucaccaag

SEQ ID NO: 39345 - RNA, 30 nt, Artificial Sequence
  Inter-alpha-trypsin inhibitor heavy chain H5 (656-665)
ggcacccagcccgggccgcugcucaagaag

SEQ ID NO: 39346 - RNA, 36 nt, Artificial Sequence
  Sorting nexin-1 (275-286)
ggcacccagacccugagcggggccggccuccugaag

SEQ ID NO: 39347 - RNA, 39 nt, Artificial Sequence
  HCLS1-binding protein 3 (136-148)
ggcacccgcagccccggggccgccggccugaccucccgg

SEQ ID NO: 39348 - RNA, 27 nt, Artificial Sequence
  Bardet-Biedl syndrome 10 protein (375-383)
ggcaccagcucccuguucaucuacaag

SEQ ID NO: 39349 - RNA, 27 nt, Artificial Sequence
  Proteasome subunit beta type-7 (229-237)
ggcaccaccgccgugcugacggagaag

SEQ ID NO: 39350 - RNA, 30 nt, Artificial Sequence
  E3 ubiquitin-protein ligase CBL (49-58)
ggcaccguggacaagaagauggucgagaag

SEQ ID NO: 39351 - RNA, 27 nt, Artificial Sequence
  E3 SUMO-protein ligase PIAS1 (411-419)
ggcaccugggcccccaugcgcagcaag

SEQ ID NO: 39352 - RNA, 27 nt, Artificial Sequence
  Rho-associated protein kinase 2 (301-309)
ggcaccuacagcaagaucauggaccac

SEQ ID NO: 39353 - RNA, 27 nt, Artificial Sequence
  40S ribosomal protein S16 (64-72)
ggcguggacauccgcguccgggugaag

SEQ ID NO: 39354 - RNA, 30 nt, Artificial Sequence
  Phosphoribosyl pyrophosphate synthase-associated protein 1 (94-103)
ggcgugauccccuacuucccguacagcaag

SEQ ID NO: 39355 - RNA, 27 nt, Artificial Sequence
  Tenascin (23-31)
ggcgugcugaagaaggucauccgccac

SEQ ID NO: 39356 - RNA, 27 nt, Artificial Sequence
  Sterol regulatory element-binding protein 2 (852-860)
ggcgugaugagccccccgcugucccgc

SEQ ID NO: 39357 - RNA, 30 nt, Artificial Sequence
  NADH dehydrogenase (ubiquinone) iron-sulfur protein 6, mitochondrial (29-38)
ggcgugcgcgucagccccaccggggagaag

SEQ ID NO: 39358 - RNA, 27 nt, Artificial Sequence
  Double-strand-break repair protein rad21 homolog (62-70)
ggcgugguccgcaucuaccaccggaag

SEQ ID NO: 39359 - RNA, 24 nt, Artificial Sequence
  Melanoma-associated antigen B2 (231-238)
ggcguguacgacggggaggagcac

SEQ ID NO: 39360 - RNA, 27 nt, Artificial Sequence
  RNA-binding motif, single-stranded-interacting protein 2 (399-407)
ggcguguacagcuuccaguucaacaag

SEQ ID NO: 39361 - RNA, 27 nt, Artificial Sequence
  Glutathione synthetase (158-166)
ggcuacaugccccgccaguacagccug

SEQ ID NO: 39362 - RNA, 27 nt, Artificial Sequence
  Far upstream element-binding protein 3 (340-348)
cacgccgcccacaucaucagcgagcug

SEQ ID NO: 39363 - RNA, 27 nt, Artificial Sequence
  Ectonucleoside triphosphate diphosphohydrolase 4 (473-481)
cacgccgaccugcaccgccucaaguac

SEQ ID NO: 39364 - RNA, 27 nt, Artificial Sequence
  V-type proton ATPase subunit B, brain isoform (310-318)
cacgccgacgugagcaaccagcuguac

SEQ ID NO: 39365 - RNA, 27 nt, Artificial Sequence
  BRCA1-A complex subunit BRE (227-235)
cacgcccugggcgggagcuccgcccuc

SEQ ID NO: 39366 - RNA, 24 nt, Artificial Sequence
  Dolichyl-diphosphooligosaccharide-proteinosyltransferase 48 kDa subunit (235-242)
cacgccgugggcaagaacacccug

SEQ ID NO: 39367 - RNA, 27 nt, Artificial Sequence
  Perilipin-3 (249-257)
cacgccuacgagcacagccugggcaag

SEQ ID NO: 39368 - RNA, 27 nt, Artificial Sequence
  TBC1 domain family member 14 (206-214)
cacgaggccgaggagggcagcaagcug

SEQ ID NO: 39369 - RNA, 33 nt, Artificial Sequence
  DNA-directed RNA polymerases I and III subunit RPAC2 (45-55)
cacgaggaggaccacacccugggcaacagccuc

SEQ ID NO: 39370 - RNA, 30 nt, Artificial Sequence
  Exosome complex exonuclease RRP44 (679-688)
cacgaggaguucagcgagcacgcccugcuc

SEQ ID NO: 39371 - RNA, 27 nt, Artificial Sequence
  THO complex subunit 5 homolog (154-162)
cacgaggagaucgaccuggugagccuc

SEQ ID NO: 39372 - RNA, 27 nt, Artificial Sequence
  Tuftelin-interacting protein 11 (365-373)
cacgaggagcgcgugaucagcaaccug

SEQ ID NO: 39373 - RNA, 27 nt, Artificial Sequence
  X-linked retinitis pigmentosa GTPase regulator (637-645)
cacgaguucagcaagaccgaggagcug

SEQ ID NO: 39374 - RNA, 27 nt, Artificial Sequence
  GON-4-like protein (1051-1059)
cacgagggcgggcccgacagcaagcug

SEQ ID NO: 39375 - RNA, 27 nt, Artificial Sequence
  AP-3 complex subunit delta-1 (103-111)
cacgagggcaccgacgugaucaugcug

SEQ ID NO: 39376 - RNA, 27 nt, Artificial Sequence
  Gem-associated protein 5 (588-596)
cacgagcacggcagccagcccgagcug

SEQ ID NO: 39377 - RNA, 27 nt, Artificial Sequence
  Zinc finger protein 644 (930-938)
cacgagauccacgacccccagcaccug

SEQ ID NO: 39378 - RNA, 27 nt, Artificial Sequence
  Glycerol-3-phosphate dehydrogenase, mitochondrial (539-547)
cacgagauccugaacgagguggaccuc

SEQ ID NO: 39379 - RNA, 27 nt, Artificial Sequence
  Eukaryotic translation initiation factor 3 subunit I (165-173)
cacgagagcggcgagcugaaccaguac

SEQ ID NO: 39380 - RNA, 27 nt, Artificial Sequence
  Insulin-like growth factor 2 mRNA-binding protein 2 (301-309)
cacgagaccggcaccaagaucacgauc

SEQ ID NO: 39381 - RNA, 27 nt, Artificial Sequence
  Inositol-trisphosphate 3-kinase B (874-882)
cacgaggugaucggcagcucccugcuc

SEQ ID NO: 39382 - RNA, 27 nt, Artificial Sequence
  Trabeculin-alpha (2620-2628)
cacgaggugaaggaggcccagacccug

SEQ ID NO: 39383 - RNA, 30 nt, Artificial Sequence
  Translocation protein SEC62 (284-293)
cacgaguacaagggccccaaggccgaccug

SEQ ID NO: 39384 - RNA, 24 nt, Artificial Sequence
  Bifunctional glutamate/proline-tRNA ligase (272-279)
cacuucgagaccaucaugaaguac

SEQ ID NO: 39385 - RNA, 27 nt, Artificial Sequence
  PTB domain-containing engulfment adapter protein 1 (23-31)
cacuucauccccuacaacgccaaguuc

SEQ ID NO: 39386 - RNA, 27 nt, Artificial Sequence
  Squalene synthase (268-276)
caccacauccccgacgugaucaccuac

SEQ ID NO: 39387 - RNA, 27 nt, Artificial Sequence
  CD109 antigen (1425-1433)
caccacagcuccgugaucuucaucuuc

SEQ ID NO: 39388 - RNA, 27 nt, Artificial Sequence
  Protein Churchill (92-100)
caccacgugaucgcccgccacgaguac

SEQ ID NO: 39389 - RNA, 27 nt, Artificial Sequence
  SUN domain-containing protein 1 (591-599)
caccacgugagcgucaccaagcagcug

SEQ ID NO: 39390 - RNA, 27 nt, Artificial Sequence
  Huntingtin (895-903)
caccacuacaccggccugcucaagcug

SEQ ID NO: 39391 - RNA, 33 nt, Artificial Sequence
  DNA-directed RNA polymerase III subunit RPC1 (122-132)
cacaucgacgagcagagcggcaaggagaaguac

SEQ ID NO: 39392 - RNA, 36 nt, Artificial Sequence
  GPI transamidase component PIG-T (548-559)
cacaucgaggagccccgcaccggcgggcuggccaag

SEQ ID NO: 39393 - RNA, 27 nt, Artificial Sequence
  Peroxisomal acyl-coenzyme A oxidase 1 (21-29)
cacauccuggacggcagccccgagaag

SEQ ID NO: 39394 - RNA, 33 nt, Artificial Sequence
  Kinesin-like protein KIF20B (82-92)
cacauccuggacagccagaccgugguccucaag

SEQ ID NO: 39395 - RNA, 30 nt, Artificial Sequence
  Protein polybromo-1 (618-627)
cacauccuggagaagcuccugaaggagaag

SEQ ID NO: 39396 - RNA, 27 nt, Artificial Sequence
  ADNP homeobox protein 2 (899-907)
cacaucaugcccaccgugcacaccguc

SEQ ID NO: 39397 - RNA, 27 nt, Artificial Sequence
  Cytoskeleton-associated protein 5 (447-455)
cacaucaacgacagcgcccccgaggug

SEQ ID NO: 39398 - RNA, 30 nt, Artificial Sequence
  Tumor suppressor candidate 3 (250-259)
cacauccgcggccccccguacgcccacaag

SEQ ID NO: 39399 - RNA, 27 nt, Artificial Sequence
  E3 ubiquitin-protein ligase pellino homolog 3 (110-118)
cacaucagcaccccccugguguccaag

SEQ ID NO: 39400 - RNA, 27 nt, Artificial Sequence
  Death-associated protein kinase 3 (166-174)
cacaagaucgaggccggcaacgaguuc

SEQ ID NO: 39401 - RNA, 27 nt, Artificial Sequence
  Alpha-actinin-4 (413-421)
caccuggccgagaaguuccgccagaag

SEQ ID NO: 39402 - RNA, 27 nt, Artificial Sequence
  Synembryn-A (382-390)
caccuggacaccgacgugaagcgcguc

SEQ ID NO: 39403 - RNA, 27 nt, Artificial Sequence
  CAD protein (188-196)
caccuguucaacguggcccacacccuc

SEQ ID NO: 39404 - RNA, 30 nt, Artificial Sequence
  AP-5 complex subunit zeta-1 (1130-1139)
caccuguucagcggccaccucuccacccug

SEQ ID NO: 39405 - RNA, 30 nt, Artificial Sequence
  Proteasome inhibitor PI31 subunit (116-125)
caccugggcgacuuccaccgcaccuacaag

SEQ ID NO: 39406 - RNA, 27 nt, Artificial Sequence
  Cytoplasmic FMR1-interacting protein 1 (638-646)
caccugaucaacuucagcgagacccuc

SEQ ID NO: 39407 - RNA, 33 nt, Artificial Sequence
  Centromere protein H (132-142)
caccugcucgagcugaacaagcugaucaugaag

SEQ ID NO: 39408 - RNA, 27 nt, Artificial Sequence
  Solute carrier family 35 member C2 (289-297)
caccugcucggcgaccagaucagccug

SEQ ID NO: 39409 - RNA, 27 nt, Artificial Sequence
  Rotatin (987-995)
caccugcccgugcacgucaucggccac

SEQ ID NO: 39410 - RNA, 27 nt, Artificial Sequence
  SAP30-binding protein (125-133)
caccugcaggacaagauccagaagcuc

SEQ ID NO: 39411 - RNA, 33 nt, Artificial Sequence
  Collagen alpha-1(XV) chain (1257-1267)
caccugcaggaccucagcaccaucgugcgcaag

SEQ ID NO: 39412 - RNA, 27 nt, Artificial Sequence
  Small integral membrane protein 17 (92-100)
caccugaccaucaugguggccgucgug

SEQ ID NO: 39413 - RNA, 30 nt, Artificial Sequence
  Dysbindin (37-46)
caccugguggagaagcagcucaucagcaag

SEQ ID NO: 39414 - RNA, 27 nt, Artificial Sequence
  Zinc finger and BTB domain-containing protein 7B (252-260)
caccuggugcccgaggucccgaccgug

SEQ ID NO: 39415 - RNA, 30 nt, Artificial Sequence
  Ubinuclein-1 (86-95)
caccuguacgagcagggcgggcgccucaag

SEQ ID NO: 39416 - RNA, 30 nt, Artificial Sequence
  Fructosamine-3-kinase (111-120)
caccuguacaaccagaagcuccgcgagaag

SEQ ID NO: 39417 - RNA, 30 nt, Artificial Sequence
  Cysteine-tRNA ligase, cytoplasmic (30-39)
caccuguacaacagccucacccgcaacaag

SEQ ID NO: 39418 - RNA, 27 nt, Artificial Sequence
  Protein TANC1 (1825-1833)
caccuguaccaggagagcaucuccaag

SEQ ID NO: 39419 - RNA, 27 nt, Artificial Sequence
  Importin-7 (406-414)
cacaugaucggcagccuggccgagauc

SEQ ID NO: 39420 - RNA, 33 nt, Artificial Sequence
  ATP-dependent RNA helicase DDX18 (255-265)
cacaugcagaacacccccggcuucauguacaag

SEQ ID NO: 39421 - RNA, 27 nt, Artificial Sequence
  Proline-rich protein 11 (150-158)
cacaugagcggcaagcugaccaacgug

SEQ ID NO: 39422 - RNA, 27 nt, Artificial Sequence
  Protein CutA (98-106)
caccccuacgagguggccgaggucauc

SEQ ID NO: 39423 - RNA, 27 nt, Artificial Sequence
  Cyclic AMP-dependent transcription factor ATF-6 beta (691-699)
caccaggccagccaccagccccuguac

SEQ ID NO: 39424 - RNA, 27 nt, Artificial Sequence
  NUAK family SNF1-like kinase 2 (201-209)
caccagggcaaguuccugcagaccuuc

SEQ ID NO: 39425 - RNA, 27 nt, Artificial Sequence
  Golgi resident protein GCP60 (496-504)
caccaguaccccggccgcgggguguac

SEQ ID NO: 39426 - RNA, 27 nt, Artificial Sequence
  Major prion protein (148-156)
caccgcuaccccaaccagguguacuac

SEQ ID NO: 39427 - RNA, 27 nt, Artificial Sequence
  STAGA complex 65 subunit gamma (129-137)
cacagcgaccccgaguccgacuucuac

SEQ ID NO: 39428 - RNA, 27 nt, Artificial Sequence
  Histone-lysine N-methyltransferase NSD3 (877-885)
cacagcgaccccauguucuccagcuac

SEQ ID NO: 39429 - RNA, 30 nt, Artificial Sequence
  Protein FAM135A (1394-1403)
cacagcgacccccgccagaccuuccuguac

SEQ ID NO: 39430 - RNA, 27 nt, Artificial Sequence
  PERQ amino acid-rich with GYF domain-containing protein 1 (731-739)
cacagcgaccccuccauccugggcuac

SEQ ID NO: 39431 - RNA, 27 nt, Artificial Sequence
  NAD(P)H dehydrogenase (quinone) 1 (9-17)
cacagcgagcgcaccuccuucaacuac

SEQ ID NO: 39432 - RNA, 33 nt, Artificial Sequence
  Heterogeneous nuclear ribonucleoproteins A2/B1 (72-82)
cacagcaucgacggccgcguggucgagcccaag

SEQ ID NO: 39433 - RNA, 30 nt, Artificial Sequence
  Rho-related BTB domain-containing protein 3 (176-185)
cacagccuggacgacuucuacaucggcaag

SEQ ID NO: 39434 - RNA, 27 nt, Artificial Sequence
  Cytochrome c1, heme protein, mitochondrial (27-35)
cacagcauggacuucguggccuaccgc

SEQ ID NO: 39435 - RNA, 27 nt, Artificial Sequence
  FUN14 domain-containing protein 1 (39-47)
cacagcuccggccccaugguggagaag

SEQ ID NO: 39436 - RNA, 27 nt, Artificial Sequence
  Isocitrate dehydrogenase (NAD) subunit gamma, mitochondrial (342-350)
cacagcuacgccaccuccauccgcaag

SEQ ID NO: 39437 - RNA, 27 nt, Artificial Sequence
  KAT8 regulatory NSL complex subunit 1 (802-810)
cacaccgacaugagcuccagcuccuac

SEQ ID NO: 39438 - RNA, 30 nt, Artificial Sequence
  Histone-lysine N-methyltransferase SETD1A (230-239)
cacaccaucaccaaccugacgacccccaag

SEQ ID NO: 39439 - RNA, 33 nt, Artificial Sequence
  DNA damage-binding protein 2 (96-106)
cacacccuggacagcuaccgcauccuccagaag

SEQ ID NO: 39440 - RNA, 27 nt, Artificial Sequence
  Transmembraneoprotein NMB (178-186)
cacacccugggccaguacuuccagaag

SEQ ID NO: 39441 - RNA, 27 nt, Artificial Sequence
  Necdin (95-103)
cacaccauggaguucgcccuggugaag

SEQ ID NO: 39442 - RNA, 27 nt, Artificial Sequence
  Integrin beta-5 (781-789)
cacaccguggacuucaccuucaacaag

SEQ ID NO: 39443 - RNA, 27 nt, Artificial Sequence
  Histone-lysine N-methyltransferase 2A (25-33)
cacguggaccaggaccugaccaccuac

SEQ ID NO: 39444 - RNA, 27 nt, Artificial Sequence
  Adapter protein CIKS (72-80)
cacguguacagcuggcccaagaacaag

SEQ ID NO: 39445 - RNA, 27 nt, Artificial Sequence
  KN motif and ankyrin repeat domain-containing protein 1 (825-833)
cacuacaucgagcgcauccagaagcug

SEQ ID NO: 39446 - RNA, 27 nt, Artificial Sequence
  Astrotactin-2 (291-299)
cacuacaacagccacuacgagaaguuc

SEQ ID NO: 39447 - RNA, 27 nt, Artificial Sequence
  Tensin-1 (1660-1668)
cacuacccccugaacaccgugaccuuc

SEQ ID NO: 39448 - RNA, 27 nt, Artificial Sequence
  Kelch-like protein 15 (472-480)
cacuacagcgacuccauccugaccuuc

SEQ ID NO: 39449 - RNA, 27 nt, Artificial Sequence
  ATP-dependent RNA helicase DHX36 (726-734)
aucgccgacgcccgccggaaggagcug

SEQ ID NO: 39450 - RNA, 30 nt, Artificial Sequence
  Small ubiquitin-related modifier 1 (46-55)
aucgccgacaaccacacccccaaggagcug

SEQ ID NO: 39451 - RNA, 27 nt, Artificial Sequence
  Sarcoplasmic/endoplasmic reticulum calcium ATPase 1 (718-726)
aucgccaugggcagcgggaccgccgug

SEQ ID NO: 39452 - RNA, 30 nt, Artificial Sequence
  DNA-directed RNA polymerase I subunit RPA1 (1631-1640)
aucgccguggacccccgccaccugagccuc

SEQ ID NO: 39453 - RNA, 27 nt, Artificial Sequence
  Derlin-3 (176-184)
aucgccgugggccacaucuacuacuuc

SEQ ID NO: 39454 - RNA, 33 nt, Artificial Sequence
  CD99 antigen (129-139)
aucgccuaccagaagaagaagcugugcuucaag

SEQ ID NO: 39455 - RNA, 27 nt, Artificial Sequence
  Dolichyl-diphosphooligosaccharide-proteinosyltransferase subunit 1 (381-389)
aucgagaucgacagccccuacgagauc

SEQ ID NO: 39456 - RNA, 27 nt, Artificial Sequence
  NEDD8-activating enzyme E1 regulatory subunit (166-174)
aucgagagccaccccgacaacgcccug

SEQ ID NO: 39457 - RNA, 27 nt, Artificial Sequence
  Splicing factor 3A subunit 1 (762-770)
aucuucaucaaggacagcaacucccug

SEQ ID NO: 39458 - RNA, 27 nt, Artificial Sequence
  Retinoic acid receptor RXR-gamma (443-451)
aucggcgacacccccaucgacaccuuc

SEQ ID NO: 39459 - RNA, 27 nt, Artificial Sequence
  C-myc promoter-binding protein (1082-1090)
aucggcaagcccccgcugcgcagcaag

SEQ ID NO: 39460 - RNA, 27 nt, Artificial Sequence
  Serine/threonine-protein kinase tousled-like 2 (421-429)
auccacaacgaggacaacagccaguuc

SEQ ID NO: 39461 - RNA, 27 nt, Artificial Sequence
  Exportin-2 (769-777)
aucaucauccccgagauccagaaggug

SEQ ID NO: 39462 - RNA, 27 nt, Artificial Sequence
  Cytoplasmic dynein 1 heavy chain 1 (201-209)
aucaucaccaaggaccuguuccaggug

SEQ ID NO: 39463 - RNA, 27 nt, Artificial Sequence
  Renin receptor (326-334)
aucaucuaccgcaugaccaaccagaag

SEQ ID NO: 39464 - RNA, 39 nt, Artificial Sequence
  Putative heat shock 70 kDa protein 7 (30-42)
auccuggccaacgaccagggcaaccgcaccacccccagc

SEQ ID NO: 39465 - RNA, 27 nt, Artificial Sequence
  Very-long-chain enoyl-CoA reductase (8-16)
auccuggacgccaagacccgcgagaag

SEQ ID NO: 39466 - RNA, 33 nt, Artificial Sequence
  Ribosome-binding protein 1 (545-555)
auccuggaggacgagcagacccagcgccagaag

SEQ ID NO: 39467 - RNA, 30 nt, Artificial Sequence
  60S ribosomal protein L19 (118-127)
auccugauggagcacauccacaagcucaag

SEQ ID NO: 39468 - RNA, 27 nt, Artificial Sequence
  Chromobox protein homolog 6 (175-183)
auccugaaccucaaggugaucgacaag

SEQ ID NO: 39469 - RNA, 30 nt, Artificial Sequence
  A-kinase anchor protein 8-like (468-477)
auccugaacaacaagcucaucagcaagaag

SEQ ID NO: 39470 - RNA, 36 nt, Artificial Sequence
  Replication factor C subunit 3 (55-66)
auccugcgcgagcucuacggcgugggggucgagaag

SEQ ID NO: 39471 - RNA, 33 nt, Artificial Sequence
  Beta-crystallin B2 (110-120)
auccuguacgagaaccccaacuucaccggcaag

SEQ ID NO: 39472 - RNA, 36 nt, Artificial Sequence
  Discoidin, CUB and LCCL domain-containing protein 2 (337-348)
auccuguacagcgacgacggccagaaguggaccgug

SEQ ID NO: 39473 - RNA, 27 nt, Artificial Sequence
  Tight junction protein ZO-1 (1314-1322)
auccccgagccgcagaagccccagcug

SEQ ID NO: 39474 - RNA, 27 nt, Artificial Sequence
  Histone H2A.V (85-93)
aucccccacauccacaagagccugauc

SEQ ID NO: 39475 - RNA, 27 nt, Artificial Sequence
  Msx2-interacting protein (466-474)
auccccaucccgacccugcccagcgug

SEQ ID NO: 39476 - RNA, 27 nt, Artificial Sequence
  Histone-lysine N-methyltransferase 2E (370-378)
auccccaagggcaccgagaucaccauc

SEQ ID NO: 39477 - RNA, 27 nt, Artificial Sequence
  E3 ubiquitin-protein ligase UBR4 (92-100)
aucccccgcaaccagcugcagagcgug

SEQ ID NO: 39478 - RNA, 27 nt, Artificial Sequence
  Nucleoporin GLE1 (428-436)
auccccgugagccagaucuccaccauc

SEQ ID NO: 39479 - RNA, 27 nt, Artificial Sequence
  ER membrane protein complex subunit 1 (895-903)
auccccuacagcccggacgugcagauc

SEQ ID NO: 39480 - RNA, 33 nt, Artificial Sequence
  Elongator complex protein 6 (249-259)
auccaggacaagagcguguccuucuucgccaag

SEQ ID NO: 39481 - RNA, 27 nt, Artificial Sequence
  GPI transamidase component PIG-T (440-448)
auccaguucgagcgcgcccugcucaag

SEQ ID NO: 39482 - RNA, 30 nt, Artificial Sequence
  Kelch domain-containing protein 2 (308-317)
auccaguucaaccaccccuacaccgagaag

SEQ ID NO: 39483 - RNA, 27 nt, Artificial Sequence
  Helicase with zinc finger domain 2 (2172-2180)
auccagggccccccggggaccggcaag

SEQ ID NO: 39484 - RNA, 27 nt, Artificial Sequence
  Large proline-rich protein BAG6 (377-385)
auccagaucaacgugggcaccaccguc

SEQ ID NO: 39485 - RNA, 30 nt, Artificial Sequence
  Focadhesin (263-272)
auccagcugacccagaugagccuccagcug

SEQ ID NO: 39486 - RNA, 36 nt, Artificial Sequence
  Beta-2-microglobulin (21-32)
auccagcgcacccccaagauccagguguacagccgg

SEQ ID NO: 39487 - RNA, 30 nt, Artificial Sequence
  26S proteasome non-ATPase regulatory subunit 7 (266-275)
auccgcagcguggucgcccugcacaaccuc

SEQ ID NO: 39488 - RNA, 27 nt, Artificial Sequence
  Kinesin-like protein KIF20B (1684-1692)
aucagcgacgaccgcaacuccagcgug

SEQ ID NO: 39489 - RNA, 27 nt, Artificial Sequence
  Sperm-specific antigen 2 (226-234)
aucagcgacgaggccaacuccaacuuc

SEQ ID NO: 39490 - RNA, 27 nt, Artificial Sequence
  Lysosome-associated membraneoprotein 2 (66-74)
aucagcgaccacggcaccgugaccuac

SEQ ID NO: 39491 - RNA, 27 nt, Artificial Sequence
  Dolichyl-diphosphooligosaccharide-proteinosyltransferase 48 kDa subunit (164-172)
aucagcgaccugggccagcacacccuc

SEQ ID NO: 39492 - RNA, 27 nt, Artificial Sequence
  Dynamin-1-like protein (174-182)
aucagcaaccccaacuccaucauccug

SEQ ID NO: 39493 - RNA, 27 nt, Artificial Sequence
  HEAT repeat-containing protein 1 (915-923)
aucagcucccccguggucaccagccug

SEQ ID NO: 39494 - RNA, 33 nt, Artificial Sequence
  UBAP1-MVB12-associated (UMA)-domain containing protein 1 isoform b (69-79)
aucaccgaccugcccgaccaccuccugagcuac

SEQ ID NO: 39495 - RNA, 27 nt, Artificial Sequence
  U4/U6.U5 tri-snRNP-associated protein 2 (264-272)
aucaccgagaaggaguacaagaccuac

SEQ ID NO: 39496 - RNA, 30 nt, Artificial Sequence
  T-complex protein 1 subunit delta (70-79)
aucaccaacgacggcgccaccauccugaag

SEQ ID NO: 39497 - RNA, 33 nt, Artificial Sequence
  Cytoplasmic dynein 2 heavy chain 1 (74-84)
aucaccuacgagagccccccgggccugaagaag

SEQ ID NO: 39498 - RNA, 33 nt, Artificial Sequence
  Isocitrate dehydrogenase (NADP) cytoplasmic (55-65)
aucaccuacacccccagcgacggcacgcagaag

SEQ ID NO: 39499 - RNA, 27 nt, Artificial Sequence
  ATP-binding cassette sub-family F member 1 (656-664)
aucgugggccccaacggggucggcaag

SEQ ID NO: 39500 - RNA, 39 nt, Artificial Sequence
  Glia-derived nexin (119-131)
aucgugaccgucgccaacgccguguucgugaagaacgcg

SEQ ID NO: 39501 - RNA, 30 nt, Artificial Sequence
  Protein enabled homolog (37-46)
aucuaccaccacaccggcaacaacaccuuc

SEQ ID NO: 39502 - RNA, 27 nt, Artificial Sequence
  Vacuolar protein sorting-associated protein 13C (1267-1275)
aucuaccaccccgacauccagcugcuc

SEQ ID NO: 39503 - RNA, 27 nt, Artificial Sequence
  Calpain-5 (449-457)
aucuacaucaacagccgcuccguguuc

SEQ ID NO: 39504 - RNA, 27 nt, Artificial Sequence
  Cyclin E variant ex7del (19-27)
aucuaccccccgaagcugcaccaguuc

SEQ ID NO: 39505 - RNA, 27 nt, Artificial Sequence
  BTB/POZ domain-containing protein 10 (83-91)
aucuacagcaccaagcuguaccgcuuc

SEQ ID NO: 39506 - RNA, 30 nt, Artificial Sequence
  Beta-soluble NSF attachment protein (71-80)
aucuacaccgacaugggccgcuucaccauc

SEQ ID NO: 39507 - RNA, 27 nt, Artificial Sequence
  WD repeat-containing protein 1 (53-61)
aucuacaccgagcacgcccaccaggug

SEQ ID NO: 39508 - RNA, 27 nt, Artificial Sequence
  SMC5-SMC6 complex localization factor protein 2 (149-157)
aucuacgugcccagcuccuaccaccug

SEQ ID NO: 39509 - RNA, 33 nt, Artificial Sequence
  WW domain-binding protein 2 (229-239)
aaggccgccgaggcggccgccagcgccuacuac

SEQ ID NO: 39510 - RNA, 27 nt, Artificial Sequence
  40S ribosomal protein S17 (11-19)
aaggccgcccgcgugaucaucgagaag

SEQ ID NO: 39511 - RNA, 27 nt, Artificial Sequence
  F-box/WD repeat-containing protein 8 (325-333)
aaggccgaggacagcgcccgcacccug

SEQ ID NO: 39512 - RNA, 36 nt, Artificial Sequence
  Vacuolar fusion protein CCZ1 homolog (154-165)
aaggccauggaggacggcggggugaagcugcucaag

SEQ ID NO: 39513 - RNA, 27 nt, Artificial Sequence
  Ceramide synthase 2 (35-43)
aaggccagcgaccuguacaucacccuc

SEQ ID NO: 39514 - RNA, 27 nt, Artificial Sequence
  Vacuolar protein sorting-associated protein 11 homolog (811-819)
aaggccagccccaagaucuuccagaag

SEQ ID NO: 39515 - RNA, 27 nt, Artificial Sequence
  60S ribosomal protein L4 (175-183)
aaggccuggaacgacaucaagaaggug

SEQ ID NO: 39516 - RNA, 33 nt, Artificial Sequence
  Replication protein A 70 kDa DNA-binding subunit (157-167)
aaggccuacggcgccagcaagaccuucgggaag

SEQ ID NO: 39517 - RNA, 36 nt, Artificial Sequence
  NHP2-like protein 1 (9-20)
aaggccuacccccuggccgacgcgcaccucaccaag

SEQ ID NO: 39518 - RNA, 27 nt, Artificial Sequence
  WD repeat-containing protein WRAP73 (276-284)
aaggaggccgagaagagcccccagcug

SEQ ID NO: 39519 - RNA, 30 nt, Artificial Sequence
  Kinesin-like protein KIF20A (425-434)
aaggaggccggcaacaucaacaccagccug

SEQ ID NO: 39520 - RNA, 30 nt, Artificial Sequence
  Golgin subfamily B member 1 (533-542)
aaggaggcccaggaggagaucgccuuccug

SEQ ID NO: 39521 - RNA, 30 nt, Artificial Sequence
  Transmembrane protein 165 (82-91)
aaggaggaccccgccacccagaccaaccug

SEQ ID NO: 39522 - RNA, 27 nt, Artificial Sequence
  Zinc finger protein AEBP2 (439-447)
aaggaggacagcggcaagaucaagcug

SEQ ID NO: 39523 - RNA, 27 nt, Artificial Sequence
  Charged multivesicular body protein 4a (192-200)
aaggaggaggagcccagcgugaagcug

SEQ ID NO: 39524 - RNA, 27 nt, Artificial Sequence
  E3 ubiquitin-protein ligase makorin-1 (351-359)
aaggaggagaagcagaagcugauccuc

SEQ ID NO: 39525 - RNA, 27 nt, Artificial Sequence
  DNA topoisomerase I, mitochondrial (544-552)
aaggaggagaacaagcagguggcccug

SEQ ID NO: 39526 - RNA, 33 nt, Artificial Sequence
  DNA damage-binding protein 1 (287-297)
aaggaggagcagauggacggcaccgugacccug

SEQ ID NO: 39527 - RNA, 30 nt, Artificial Sequence
  TATA element modulatory factor (490-499)
aaggaggagagcuccagcaucuccagccug

SEQ ID NO: 39528 - RNA, 27 nt, Artificial Sequence
  Transcriptional adapter 3 (372-380)
aaggaggaggugagccgccaggagcug

SEQ ID NO: 39529 - RNA, 27 nt, Artificial Sequence
  Peptidyl-prolyl cis-trans isomerase-like 2 (4-12)
aaggaguucaagggcgacgagauccug

SEQ ID NO: 39530 - RNA, 30 nt, Artificial Sequence
  Protein transport protein Sec31A (436-445)
aaggaguuccugagccgcuccgaccagcuc

SEQ ID NO: 39531 - RNA, 27 nt, Artificial Sequence
  Heterogeneous nuclear ribonucleoprotein Q (66-74)
aaggaguucaacgaggacggcgcccug

SEQ ID NO: 39532 - RNA, 27 nt, Artificial Sequence
  CUGBP Elav-like family member 2 (417-425)
aaggagggccccgagggggccaaccug

SEQ ID NO: 39533 - RNA, 27 nt, Artificial Sequence
  Nuclear nucleic acid-binding protein C1D (79-87)
aaggagcaccccgugaagcaggagcug

SEQ ID NO: 39534 - RNA, 30 nt, Artificial Sequence
  Trafficking kinesin-binding protein 2 (299-308)
aaggagcacgugaucgagaaggaggagcug

SEQ ID NO: 39535 - RNA, 33 nt, Artificial Sequence
  HEAT repeat-containing protein 1 (449-459)
aaggagaucgccgaccugaagaagcaggagcuc

SEQ ID NO: 39536 - RNA, 30 nt, Artificial Sequence
  Serine palmitoyltransferase 2 (526-535)
aaggagaucgacgaggugggcgaccugcuc

SEQ ID NO: 39537 - RNA, 30 nt, Artificial Sequence
  (Pyruvate dehydrogenase (acetyl-transferring)) kinase isozyme 4, mitochondrial (34-43)
aaggagaucgacauccugcccacccagcuc

SEQ ID NO: 39538 - RNA, 33 nt, Artificial Sequence
  Cytochrome b-c1 complex subunit Rieske, mitochondrial (182-192)
aaggagaucgagcaggaggccgccguggagcug

SEQ ID NO: 39539 - RNA, 33 nt, Artificial Sequence
  40S ribosomal protein S7 (47-57)
aaggagaucgaggugggcgggggccgcaaggcc

SEQ ID NO: 39540 - RNA, 27 nt, Artificial Sequence
  RuvB-like 1 (172-180)
aaggagaucauccaggacgugacccug

SEQ ID NO: 39541 - RNA, 30 nt, Artificial Sequence
  Structural maintenance of chromosomes protein 4 (263-272)
aaggagaucaacgagaagagcaacauccug

SEQ ID NO: 39542 - RNA, 30 nt, Artificial Sequence
  Deoxynucleotidyltransferase terminal-interacting protein 2 (311-320)
aaggagaucaacgagaagagcucccagcug

SEQ ID NO: 39543 - RNA, 27 nt, Artificial Sequence
  Protein bicaudal D homolog 2 (150-158)
aaggagaucaaccagaacguggagauc

SEQ ID NO: 39544 - RNA, 27 nt, Artificial Sequence
  Nibrin (635-643)
aaggagaucagcaacaacgacaagcug

SEQ ID NO: 39545 - RNA, 33 nt, Artificial Sequence
  SNW domain-containing protein 1 (141-151)
aaggagaucaccgagaagacccgcguggcccug

SEQ ID NO: 39546 - RNA, 27 nt, Artificial Sequence
  Sperm-associated antigen 5 (893-901)
aaggagaagaccgagcaggagacccug

SEQ ID NO: 39547 - RNA, 30 nt, Artificial Sequence
  Microfibrillar-associated protein 1 (250-259)
aaggagcuggaggagaacaagcgcagccuc

SEQ ID NO: 39548 - RNA, 27 nt, Artificial Sequence
  LYR motif-containing protein 2 (77-85)
aaggagcuggagaagacccucgcccug

SEQ ID NO: 39549 - RNA, 30 nt, Artificial Sequence
  Prefoldin subunit 1 (92-101)
aaggagcuggagcagaagaagagcuaccuc

SEQ ID NO: 39550 - RNA, 30 nt, Artificial Sequence
  Developmentally-regulated GTP-binding protein 2 (161-170)
aaggagcuggagagcgugggcauccgccuc

SEQ ID NO: 39551 - RNA, 30 nt, Artificial Sequence
  Ancient ubiquitous protein 1 (250-259)
aaggagcugggccagaccgggacccgccuc

SEQ ID NO: 39552 - RNA, 30 nt, Artificial Sequence
  U2 small nuclear ribonucleoprotein B'' (57-66)
aaggagcugggcagcuccaccaacgcccuc

SEQ ID NO: 39553 - RNA, 30 nt, Artificial Sequence
  TSC22 domain family protein 1 (1011-1020)
aaggagcugaucgagaagaacagccagcuc

SEQ ID NO: 39554 - RNA, 30 nt, Artificial Sequence
  Bifunctional 3'-phosphoadenosine 5'-phosphosulfate synthase 1 (235-244)
aaggagcuguacgugcccgagaacaagcuc

SEQ ID NO: 39555 - RNA, 33 nt, Artificial Sequence
  Polymerase I and transcript release factor (170-180)
aaggagaaccuggagaagacccgccacacccuc

SEQ ID NO: 39556 - RNA, 27 nt, Artificial Sequence
  SCY1-like protein 2 (264-272)
aaggagcaggagcaggcccagaagcug

SEQ ID NO: 39557 - RNA, 30 nt, Artificial Sequence
  Corepressor interacting with RBPJ 1 (48-57)
aaggagcaggagagcuacgacaaccgccug

SEQ ID NO: 39558 - RNA, 27 nt, Artificial Sequence
  Kinesin-like protein (323-331)
aaggagcagaucaccaucagccagcug

SEQ ID NO: 39559 - RNA, 30 nt, Artificial Sequence
  Catenin alpha-1 (81-90)
aaggagagccaguuccugaaggaggagcuc

SEQ ID NO: 39560 - RNA, 27 nt, Artificial Sequence
  General transcription factor II-I repeat domain-containing protein 1 (343-351)
aaggagaccgaggacaucaacacccug

SEQ ID NO: 39561 - RNA, 27 nt, Artificial Sequence
  Endothelial PAS domain-containing protein 1 (29-37)
aaggagaccgagguguucuacgagcug

SEQ ID NO: 39562 - RNA, 33 nt, Artificial Sequence
  Activator of 90 kDa heat shock protein ATPase homolog 1 (136-146)
aaggagaccuuccugaccagccccgaggagcuc

SEQ ID NO: 39563 - RNA, 27 nt, Artificial Sequence
  Double-strand-break repair protein rad21 homolog (364-372)
aaggagaccggcgggguggagaagcug

SEQ ID NO: 39564 - RNA, 30 nt, Artificial Sequence
  Transcription factor BTF3 (46-55)
aaggagaccaucaugaaccaggagaagcug

SEQ ID NO: 39565 - RNA, 27 nt, Artificial Sequence
  RNA-binding protein PNO1 (122-130)
aaggagaccaaggacgugagcgcccug

SEQ ID NO: 39566 - RNA, 27 nt, Artificial Sequence
  Spectrin beta chain, non-erythrocytic 1 (832-840)
aaggagguggccgagcugacccgccuc

SEQ ID NO: 39567 - RNA, 30 nt, Artificial Sequence
  Sequestosome-1 (324-333)
aaggagguggaccccagcaccggcgagcug

SEQ ID NO: 39568 - RNA, 30 nt, Artificial Sequence
  Vacuolar protein sorting-associated protein 52 homolog (10-19)
aaggagguggagagcuuccagcagcugcuc

SEQ ID NO: 39569 - RNA, 30 nt, Artificial Sequence
  Sodium/potassium-transporting ATPase subunit alpha-1 (37-46)
aaggaggugagcauggacgaccacaagcug

SEQ ID NO: 39570 - RNA, 33 nt, Artificial Sequence
  Actin-related protein 5 (555-565)
aaggaguacgaggagaagggcggggaguaccug

SEQ ID NO: 39571 - RNA, 27 nt, Artificial Sequence
  Erythrocyte band 7 integral membrane protein (58-66)
aaggaguacgagcgcgccaucaucuuc

SEQ ID NO: 39572 - RNA, 27 nt, Artificial Sequence
  Son of sevenless homolog 1 (679-687)
aaggaguacauccagcccgugcagcug

SEQ ID NO: 39573 - RNA, 27 nt, Artificial Sequence
  Ran-binding protein 17 (349-357)
aaggaguaccccgaggugauccgccug

SEQ ID NO: 39574 - RNA, 36 nt, Artificial Sequence
  Intermediate filament family orphan 2 (103-114)
aaggaguaccaggagaccaucggccagaucgagcug

SEQ ID NO: 39575 - RNA, 27 nt, Artificial Sequence
  Mitochondrial ubiquitin ligase activator of NFKB 1 (158-166)
aaguuccaccccagcauccaguccuuc

SEQ ID NO: 39576 - RNA, 30 nt, Artificial Sequence
  Structural maintenance of chromosomes protein 4 (295-304)
aaguucaucgaggagaacaaggagaaguuc

SEQ ID NO: 39577 - RNA, 27 nt, Artificial Sequence
  NADH dehydrogenase (ubiquinone) 1 alpha subcomplex subunit 12 (107-115)
aaguucaucuggaccaaccacaaguuc

SEQ ID NO: 39578 - RNA, 27 nt, Artificial Sequence
  Kelch domain-containing protein 3 (136-144)
aaguucaaccccgugagcuucaccugg

SEQ ID NO: 39579 - RNA, 27 nt, Artificial Sequence
  Bromodomain and WD repeat-containing protein 1 (309-317)
aaguucagcccccgcccgcugaaguuc

SEQ ID NO: 39580 - RNA, 27 nt, Artificial Sequence
  Protein SHQ1 homolog (255-263)
aaguucgugaacaagagcuaccugcuc

SEQ ID NO: 39581 - RNA, 27 nt, Artificial Sequence
  Tyrosine-protein phosphatase non-receptor type 9 (176-184)
aagggcgccuuccccgcccgccugaag

SEQ ID NO: 39582 - RNA, 27 nt, Artificial Sequence
  Protein SCAF8 (528-536)
aagggccugcccccgauccgcagcaag

SEQ ID NO: 39583 - RNA, 27 nt, Artificial Sequence
  BTB/POZ domain-containing adapter for CUL3-mediated RhoA degradation protein 2 (78-86)
aagcacuucggcaccauccugaacuac

SEQ ID NO: 39584 - RNA, 27 nt, Artificial Sequence
  Hsp90 co-chaperone Cdc37 (147-155)
aagcacaagaccuucguggagaaguac

SEQ ID NO: 39585 - RNA, 27 nt, Artificial Sequence
  Transcription intermediary factor 1-beta (340-348)
aagcaccaggagcacauccugcgcuuc

SEQ ID NO: 39586 - RNA, 27 nt, Artificial Sequence
  Proliferating cell nuclear antigen (240-248)
aagaucgccgacaugggccaccugaag

SEQ ID NO: 39587 - RNA, 27 nt, Artificial Sequence
  Ubiquitin-conjugating enzyme E2 G2 (125-133)
aagaucgccaagcagaucgugcagaag

SEQ ID NO: 39588 - RNA, 27 nt, Artificial Sequence
  Signal peptidase complex subunit 2 (40-48)
aagaucgacgacaagcccgugaagauc

SEQ ID NO: 39589 - RNA, 27 nt, Artificial Sequence
  T-box transcription factor TBX3 (273-281)
aagaucgacaacaaccccuucgccaag

SEQ ID NO: 39590 - RNA, 27 nt, Artificial Sequence
  Myeloid leukemia factor 1 (90-98)
aagaucggcgacgagcccccgaaggug

SEQ ID NO: 39591 - RNA, 27 nt, Artificial Sequence
  Ras GTPase-activating-like protein IQGAP1 (916-924)
aagaucggccugcucgugaagaacaag

SEQ ID NO: 39592 - RNA, 33 nt, Artificial Sequence
  Replication factor C subunit 1 (468-478)
aagaucaucgacgaggacggccugcucaaccug

SEQ ID NO: 39593 - RNA, 27 nt, Artificial Sequence
  Nucleoprotein TPR (1420-1428)
aagaucaucgacauccaggagaaggug

SEQ ID NO: 39594 - RNA, 27 nt, Artificial Sequence
  Importin-8 (102-110)
aagauccuggaccaguaccgccagaag

SEQ ID NO: 39595 - RNA, 33 nt, Artificial Sequence
  Sorting nexin-14 (635-645)
aagauccugcccgacgugaaccucggcaagauc

SEQ ID NO: 39596 - RNA, 27 nt, Artificial Sequence
  V-type proton ATPase subunit E 2 (52-60)
aagaucauggaguacuacgagaagaag

SEQ ID NO: 39597 - RNA, 27 nt, Artificial Sequence
  Heat shock protein HSP 90-alpha (389-397)
aagaucaugaaggacauccuggagaag

SEQ ID NO: 39598 - RNA, 27 nt, Artificial Sequence
  Calcium-independent phospholipase A2-gamma (789-797)
aagaucaacgacuggaucaagcugaag

SEQ ID NO: 39599 - RNA, 27 nt, Artificial Sequence
  Heterogeneous nuclear ribonucleoprotein U-like protein 1 (262-270)
aagaucaacgaggagaucagcgugaag

SEQ ID NO: 39600 - RNA, 30 nt, Artificial Sequence
  UDP-glucose:glycoprotein glucosyltransferase 2 (148-157)
aagaucaacgagaucaagaagcugcucaag

SEQ ID NO: 39601 - RNA, 30 nt, Artificial Sequence
  Serine/threonine-protein phosphatase 4 regulatory subunit 3B (55-64)
aagaucaaccccaacaccgccuaccagaag

SEQ ID NO: 39602 - RNA, 30 nt, Artificial Sequence
  Oral-facial-digital syndrome 1 protein (116-125)
aagaucaaccccaccagcucccuguacaag

SEQ ID NO: 39603 - RNA, 27 nt, Artificial Sequence
  Poly(A) polymerase alpha (641-649)
aagauccccaccccgaucgugggcguc

SEQ ID NO: 39604 - RNA, 27 nt, Artificial Sequence
  Prefoldin subunit 5 (129-137)
aagauccagcccgcccugcaggagaag

SEQ ID NO: 39605 - RNA, 36 nt, Artificial Sequence
  Oxysterol-binding protein-related protein 9 (687-698)
aagauccgcgacaucgacgccgccaccgaggcgaag

SEQ ID NO: 39606 - RNA, 27 nt, Artificial Sequence
  Protein IMPACT (108-116)
aagauccgcgacgugcugauccagaag

SEQ ID NO: 39607 - RNA, 30 nt, Artificial Sequence
  Proto-oncogene tyrosine-protein kinase receptor Ret (156-165)
aagauccgcgaguacgagcagacccugaag

SEQ ID NO: 39608 - RNA, 30 nt, Artificial Sequence
  Heat shock factor protein 1 (131-140)
aagauccgccaggacagcgugaccaagcug

SEQ ID NO: 39609 - RNA, 36 nt, Artificial Sequence
  PDZ domain-containing RING finger protein 4 (443-454)
aagauccgcagcgacggcacccgguacaucaccaag

SEQ ID NO: 39610 - RNA, 33 nt, Artificial Sequence
  Insulin-like growth factor I (3-13)
aagaucagcucccugcccacccagcucuucaag

SEQ ID NO: 39611 - RNA, 27 nt, Artificial Sequence
  Importin-7 (419-427)
aagaucuacaaggaccagauggaguac

SEQ ID NO: 39612 - RNA, 27 nt, Artificial Sequence
  Mothers against decapentaplegic homolog 4 (428-436)
aagaucuaccccagcgccuacaucaag

SEQ ID NO: 39613 - RNA, 27 nt, Artificial Sequence
  RING finger protein 113A (151-159)
aagaucuaccgcggcaucaacaacuac

SEQ ID NO: 39614 - RNA, 30 nt, Artificial Sequence
  Prefoldin subunit 1 (28-37)
aagcuggccgacauccagaucgagcagcuc

SEQ ID NO: 39615 - RNA, 36 nt, Artificial Sequence
  DNA topoisomerase 2-alpha (976-987)
aagcuggccgaggccgagcgcgugggccuccacaag

SEQ ID NO: 39616 - RNA, 27 nt, Artificial Sequence
  Retinoblastoma-like protein 1 (329-337)
aagcuggccgagauccucuacuacaag

SEQ ID NO: 39617 - RNA, 27 nt, Artificial Sequence
  Neuron navigator 3 (940-948)
aagcuggccgaguacgugaucaccaag

SEQ ID NO: 39618 - RNA, 33 nt, Artificial Sequence
  Protein PRR14L (1625-1635)
aagcuggcccccgccaugaagacccagaagcuc

SEQ ID NO: 39619 - RNA, 27 nt, Artificial Sequence
  Ubiquitin-40S ribosomal protein S27a (95-103)
aagcuggccgugcucaaguacuacaag

SEQ ID NO: 39620 - RNA, 30 nt, Artificial Sequence
  Disco-interacting protein 2 homolog A (376-385)
aagcuggccuacacccuccugaacaagcug

SEQ ID NO: 39621 - RNA, 27 nt, Artificial Sequence
  Conserved oligomeric Golgi complex subunit 3 (394-402)
aagcuggacgagcuccuggagaagcug

SEQ ID NO: 39622 - RNA, 30 nt, Artificial Sequence
  REST corepressor 1 (145-154)
aagcuggacgaguacaucgccaucgccaag

SEQ ID NO: 39623 - RNA, 30 nt, Artificial Sequence
  40S ribosomal protein S7 (145-154)
aagcuggacggcagccgccucaucaaggug

SEQ ID NO: 39624 - RNA, 27 nt, Artificial Sequence
  CASP8-associated protein 2 (343-351)
aagcuggacaagaaccccaaccaggug

SEQ ID NO: 39625 - RNA, 27 nt, Artificial Sequence
  Cysteine and histidine-rich protein 1 (100-108)
aagcuggaggagcgccucuacagcgug

SEQ ID NO: 39626 - RNA, 27 nt, Artificial Sequence
  Glutathione S-transferase omega-1 (152-160)
aagcuggaggaggugcucaccaacaag

SEQ ID NO: 39627 - RNA, 33 nt, Artificial Sequence
  Thioredoxin domain-containing protein 5 (32-42)
aagcuguucaagcccggccaggaggccgugaag

SEQ ID NO: 39628 - RNA, 33 nt, Artificial Sequence
  Mitotic checkpoint serine/threonine-protein kinase BUB1 (954-964)
aagcuguuccccaagggcaccaucuucaccgcc

SEQ ID NO: 39629 - RNA, 27 nt, Artificial Sequence
  Vacuolar protein sorting-associated protein 11 homolog (687-695)
aagcuguuccagcagaucaugcacuac

SEQ ID NO: 39630 - RNA, 39 nt, Artificial Sequence
  YEATS domain-containing protein 4 (115-127)
aagcuguuccagagcgacaccaacgccaugcucggcaag

SEQ ID NO: 39631 - RNA, 27 nt, Artificial Sequence
  Peroxisomal acyl-coenzyme A oxidase 1 (537-545)
aagcuguucagcgagaagcuccugaag

SEQ ID NO: 39632 - RNA, 33 nt, Artificial Sequence
  28S ribosomal protein S33, mitochondrial (35-45)
aagcuguucagcgagcucccccuggccaagaag

SEQ ID NO: 39633 - RNA, 27 nt, Artificial Sequence
  BAH and coiled-coil domain-containing protein 1 (52-60)
aagcuguucuacaaggccaucgugcgc

SEQ ID NO: 39634 - RNA, 30 nt, Artificial Sequence
  Nucleolar protein 58 (93-102)
aagcugggcggggugaucaaggagaagcuc

SEQ ID NO: 39635 - RNA, 30 nt, Artificial Sequence
  Histone H1.2 (81-90)
aagcugggccucaagagccugguguccaag

SEQ ID NO: 39636 - RNA, 27 nt, Artificial Sequence
  Cytochrome c oxidase subunit NDUFA4 (39-47)
aagcugggccccaacgaccaguacaag

SEQ ID NO: 39637 - RNA, 27 nt, Artificial Sequence
  DCC-interacting protein 13-alpha (553-561)
aagcugaucgacccccagacccaggug

SEQ ID NO: 39638 - RNA, 27 nt, Artificial Sequence
  DNA topoisomerase 2-beta (209-217)
aagcugaucgagguggucaagaagaag

SEQ ID NO: 39639 - RNA, 27 nt, Artificial Sequence
  Dynactin subunit 4 (146-154)
aagcugaucgaguacuaccagcagcuc

SEQ ID NO: 39640 - RNA, 30 nt, Artificial Sequence
  Glycerol-3-phosphate dehydrogenase 1-like protein (55-64)
aagcugaucagcgacaucauccgcgagaag

SEQ ID NO: 39641 - RNA, 27 nt, Artificial Sequence
  Spectrin beta chain, non-erythrocytic 1 (387-395)
aagcugaucagcgacaucaacaaggcc

SEQ ID NO: 39642 - RNA, 39 nt, Artificial Sequence
  Transcription elongation factor B polypeptide 1 (4-16)
aagcugaucagcuccgacggccacgaguucaucgugaag

SEQ ID NO: 39643 - RNA, 27 nt, Artificial Sequence
  Vacuolar protein sorting-associated protein 4B (71-79)
aagcugaaggaguaccucaagaacaag

SEQ ID NO: 39644 - RNA, 36 nt, Artificial Sequence
  Heterogeneous nuclear ribonucleoproteins C1/C2 (187-198)
aagcugaagggcgacgaccuccaggccaucaagaag

SEQ ID NO: 39645 - RNA, 33 nt, Artificial Sequence
  Tight junction-associated protein 1 (150-160)
aagcugcucgacgccaagaacaccaucaacaag

SEQ ID NO: 39646 - RNA, 33 nt, Artificial Sequence
  26S proteasome non-ATPase regulatory subunit 7 (204-214)
aagcugcucgacauccgcagcuaccuggagaag

SEQ ID NO: 39647 - RNA, 33 nt, Artificial Sequence
  Methionine-tRNA ligase, cytoplasmic (453-463)
aagcugcucgaccugaagaagcagcuggccgug

SEQ ID NO: 39648 - RNA, 27 nt, Artificial Sequence
  Dihydrolipoyllysine-residue succinyltransferase component of 2-oxoglutarate dehydrogenase complex, mitochondrial (80-88)
aagcugcucgagacccagcugcagaag

SEQ ID NO: 39649 - RNA, 30 nt, Artificial Sequence
  Aspartate-tRNA ligase, cytoplasmic (373-382)
aagcugcucggccaccuggugaaggagaag

SEQ ID NO: 39650 - RNA, 27 nt, Artificial Sequence
  U3 small nucleolar ribonucleoprotein protein IMP3 (11-19)
aagcugcucaagcagguggacuuccug

SEQ ID NO: 39651 - RNA, 27 nt, Artificial Sequence
  Protein Smaug homolog 1 (103-111)
aagcugcuccccaagauccuggcccac

SEQ ID NO: 39652 - RNA, 27 nt, Artificial Sequence
  Box C/D snoRNA protein 1 (321-329)
aagcugcuccccaacggcuucaccaag

SEQ ID NO: 39653 - RNA, 27 nt, Artificial Sequence
  Anaphase-promoting complex subunit 5 (482-490)
aagcugcuccagaagcugcuggugcac

SEQ ID NO: 39654 - RNA, 33 nt, Artificial Sequence
  Nucleoprotein TPR (1356-1366)
aagcugcucagcgagaaggaggugcacaccaag

SEQ ID NO: 39655 - RNA, 30 nt, Artificial Sequence
  DNA replication ATP-dependent helicase/nuclease DNA2 (580-589)
aagcugauggagaacaccuucgugagcaag

SEQ ID NO: 39656 - RNA, 30 nt, Artificial Sequence
  Integrin alpha-9 (198-207)
aagcugaacgacgaggugaucaugaaccgc

SEQ ID NO: 39657 - RNA, 27 nt, Artificial Sequence
  Eukaryotic translation initiation factor 3 subunit C-like protein (333-341)
aagcugaacgagauccuccaggcccgc

SEQ ID NO: 39658 - RNA, 33 nt, Artificial Sequence
  Eukaryotic translation initiation factor 3 subunit C-like protein (333-343)
aagcugaacgagauccuccaggcccgcggcaag

SEQ ID NO: 39659 - RNA, 27 nt, Artificial Sequence
  PHD finger protein 14 (693-701)
aagcugaacauccccgccauccuccgc

SEQ ID NO: 39660 - RNA, 27 nt, Artificial Sequence
  EH domain-containing protein 4 (478-486)
aagcugcccaacagcgugcucggcaag

SEQ ID NO: 39661 - RNA, 30 nt, Artificial Sequence
  Sarcospan (62-71)
aagcugcccagcuccgagccgcucagccgc

SEQ ID NO: 39662 - RNA, 27 nt, Artificial Sequence
  40S ribosomal protein S18 (106-114)
aagcugcgcgaggaccucgagcggcug

SEQ ID NO: 39663 - RNA, 33 nt, Artificial Sequence
  Catenin delta-1 (688-698)
aagcugcgcgagacccagggcaucgagaagcuc

SEQ ID NO: 39664 - RNA, 33 nt, Artificial Sequence
  Ankycorbin (218-228)
aagcugagcgagaacgccggcauccagucccuc

SEQ ID NO: 39665 - RNA, 27 nt, Artificial Sequence
  Serine/threonine-protein kinase N1 (262-270)
aagcugaccgagagcaaccagaagcuc

SEQ ID NO: 39666 - RNA, 27 nt, Artificial Sequence
  Melanoma-associated antigen D1 (477-485)
aagcuggugaaguaccucaugcugaag

SEQ ID NO: 39667 - RNA, 27 nt, Artificial Sequence
  Cytochrome c oxidase subunit 5B, mitochondrial (121-129)
aagcuggugccccagcagcucgcccac

SEQ ID NO: 39668 - RNA, 30 nt, Artificial Sequence
  E3 ubiquitin-protein ligase TTC3 (1097-1106)
aagcugugggacaugaaccccaagcagaag

SEQ ID NO: 39669 - RNA, 30 nt, Artificial Sequence
  Fatty acid desaturase 2 (413-422)
aagcuguggcucgacgccuaccugcacaag

SEQ ID NO: 39670 - RNA, 27 nt, Artificial Sequence
  Serine/threonine-protein kinase ATR (289-297)
aagcuguacgaggagccccucagcaag

SEQ ID NO: 39671 - RNA, 27 nt, Artificial Sequence
  Retinoblastoma-like protein 2 (304-312)
aagcuguacgagaagaagcuccugaag

SEQ ID NO: 39672 - RNA, 30 nt, Artificial Sequence
  Lamina-associated polypeptide 2, isoforms beta/gamma (140-149)
aagcuguacgagaagaagcuccugaagcug

SEQ ID NO: 39673 - RNA, 27 nt, Artificial Sequence
  Dedicator of cytokinesis protein 7 (424-432)
aagcuguaccccgacagccgcgugcgg

SEQ ID NO: 39674 - RNA, 27 nt, Artificial Sequence
  Protein diaphanous homolog 3 (930-938)
aagcuguaccagagcaucaucggcuac

SEQ ID NO: 39675 - RNA, 30 nt, Artificial Sequence
  Nuclear pore complex protein Nup98-Nup96 (1480-1489)
aagcuguacagcgacuccauccgcgagaag

SEQ ID NO: 39676 - RNA, 27 nt, Artificial Sequence
  NADH dehydrogenase (ubiquinone) iron-sulfur protein 7, mitochondrial (74-82)
aagauggcccccgcccugcgcaaggug

SEQ ID NO: 39677 - RNA, 27 nt, Artificial Sequence
  TRPM8 channel-associated factor 1 (447-455)
aagauguucagccaccaggugcagaag

SEQ ID NO: 39678 - RNA, 36 nt, Artificial Sequence
  Heat shock cognate 71 kDa protein (82-93)
aagaugaaggagaucgccgaggccuaccugggcaag

SEQ ID NO: 39679 - RNA, 30 nt, Artificial Sequence
  Neuroblast differentiation-associated protein AHNAK (380-389)
aagaugcccaagaugaagaugccgaccuuc

SEQ ID NO: 39680 - RNA, 27 nt, Artificial Sequence
  DNA replication licensing factor MCM7 (236-244)
aagaugcaggagcacagcgaccaggug

SEQ ID NO: 39681 - RNA, 27 nt, Artificial Sequence
  Intraflagellar transport protein 74 homolog (462-470)
aagaugaccgaggagcagcacagccug

SEQ ID NO: 39682 - RNA, 27 nt, Artificial Sequence
  Nuclear receptor corepressor 1 (1336-1344)
aagcccuacgacggcaucaccaccauc

SEQ ID NO: 39683 - RNA, 30 nt, Artificial Sequence
  Hippocampus abundant transcript-like protein 1 (216-225)
aagcaggccgaccccuucgccagccugaag

SEQ ID NO: 39684 - RNA, 27 nt, Artificial Sequence
  T-complex protein 1 subunit zeta (39-47)
aagcaggacgagcccaucgaccuguuc

SEQ ID NO: 39685 - RNA, 27 nt, Artificial Sequence
  Catenin alpha-1 (865-873)
aagcaggacgagacccagaccaagauc

SEQ ID NO: 39686 - RNA, 27 nt, Artificial Sequence
  Cytoplasmic dynein 1 heavy chain 1 (1181-1189)
aagcaguucgagaagcagguggagcug

SEQ ID NO: 39687 - RNA, 27 nt, Artificial Sequence
  Probable E3 ubiquitin-protein ligase makorin-2 (226-234)
aagcaguucgagaaccccaucaucaag

SEQ ID NO: 39688 - RNA, 27 nt, Artificial Sequence
  Bromodomain adjacent to zinc finger domain protein 2A (588-596)
aagcaguuccccgaggugaucaaguac

SEQ ID NO: 39689 - RNA, 27 nt, Artificial Sequence
  60S ribosomal protein L22-like 1 (69-77)
aagcaguucagcaagcgcuaccugaag

SEQ ID NO: 39690 - RNA, 27 nt, Artificial Sequence
  Interleukin enhancer-binding factor 3 (519-527)
aagcagcagggccccauccugaccaag

SEQ ID NO: 39691 - RNA, 27 nt, Artificial Sequence
  Actin-related protein 8 (80-88)
aagcagcagggccagccccuguacaag

SEQ ID NO: 39692 - RNA, 27 nt, Artificial Sequence
  SAM and SH3 domain-containing protein 1 (898-906)
aagcgcuucagcgagccccagaagcug

SEQ ID NO: 39693 - RNA, 27 nt, Artificial Sequence
  AP-3 complex subunit mu-2 (240-248)
aagcgcugggagagcgagcggauccug

SEQ ID NO: 39694 - RNA, 27 nt, Artificial Sequence
  AP-3 complex subunit mu-1 (186-194)
aagcgcugggagagcgagcgggugcug

SEQ ID NO: 39695 - RNA, 27 nt, Artificial Sequence
  Rabankyrin-5 (851-859)
aagagcgccgaggccauccugaagcgc

SEQ ID NO: 39696 - RNA, 27 nt, Artificial Sequence
  Neuron-specific calcium-binding protein hippocalcin (174-182)
aagagcgaccccuccaucgugcgccug

SEQ ID NO: 39697 - RNA, 30 nt, Artificial Sequence
  Pre-mRNA-processing factor 40 homolog B (165-174)
aagagcgacaccggcaagcccuacuacuac

SEQ ID NO: 39698 - RNA, 30 nt, Artificial Sequence
  Supervillin (396-405)
aagagcuucgacgagcagaacgugcccaag

SEQ ID NO: 39699 - RNA, 33 nt, Artificial Sequence
  Tumor protein D54 (26-36)
aagagcuucgaggaccgcgugggcaccaucaag

SEQ ID NO: 39700 - RNA, 27 nt, Artificial Sequence
  Mitogen-activated protein kinase kinase kinase kinase 4 (1062-1070)
aagagcuucggcgagcuggugcacaag

SEQ ID NO: 39701 - RNA, 33 nt, Artificial Sequence
  Myristoylated alanine-rich C-kinase substrate (162-172)
aagagcuucaagcuguccggcuucagcuucaag

SEQ ID NO: 39702 - RNA, 27 nt, Artificial Sequence
  Kinetochore protein Spc25 (11-19)
aagagcaucaacgaguucuggaacaag

SEQ ID NO: 39703 - RNA, 27 nt, Artificial Sequence
  MICOS complex subunit MIC60 (102-110)
aagagcauccaguccggcccccugaag

SEQ ID NO: 39704 - RNA, 27 nt, Artificial Sequence
  DNA-dependent protein kinase catalytic subunit (2416-2424)
aagagcaaggacuucgugcaggucaug

SEQ ID NO: 39705 - RNA, 27 nt, Artificial Sequence
  Choline-phosphate cytidylyltransferase A (259-267)
aagagcaaggaguucgugcagaagguc

SEQ ID NO: 39706 - RNA, 27 nt, Artificial Sequence
  Phosphatidylinositol 4,5-bisphosphate 3-kinase catalytic subunit delta isoform (860-868)
aagagcaagaaccccggcgaggcccug

SEQ ID NO: 39707 - RNA, 30 nt, Artificial Sequence
  Arf-GAP with Rho-GAP domain, ANK repeat and PH domain-containing protein 3 (219-228)
aagagccuggaccagcccuuccucuccaag

SEQ ID NO: 39708 - RNA, 30 nt, Artificial Sequence
  Golgi-specific brefeldin A-resistance guanine nucleotide exchange factor 1 (944-953)
aagagccuggaggagaccaucauccagaag

SEQ ID NO: 39709 - RNA, 33 nt, Artificial Sequence
  Charged multivesicular body protein 2a (94-104)
aagagcaacaacuccauggcccaggccaugaag

SEQ ID NO: 39710 - RNA, 27 nt, Artificial Sequence
  B9 domain-containing protein 1 (56-64)
aagagccaggacgugcgccaggcccug

SEQ ID NO: 39711 - RNA, 36 nt, Artificial Sequence
  5-aminolevulinate synthase, nonspecific, mitochondrial (174-185)
aagaccgacggcggggaccccagcggccugcucaag

SEQ ID NO: 39712 - RNA, 27 nt, Artificial Sequence
  BRCA1-associated protein (26-34)
aagaccgacggcaagaucgugcaguac

SEQ ID NO: 39713 - RNA, 27 nt, Artificial Sequence
  Zinc finger homeobox protein 3 (90-98)
aagaccgacaagcacgugcagaaguac

SEQ ID NO: 39714 - RNA, 30 nt, Artificial Sequence
  Ubiquitin carboxyl-terminal hydrolase 7 (381-390)
aagaccgaccccaaggacccggccaacuac

SEQ ID NO: 39715 - RNA, 27 nt, Artificial Sequence
  Origin recognition complex subunit 3 (194-202)
aagaccgaccccaagaugcugagcaag

SEQ ID NO: 39716 - RNA, 27 nt, Artificial Sequence
  U2 small nuclear ribonucleoprotein B'' (85-93)
aagaccgacagcgacaucaucuccaag

SEQ ID NO: 39717 - RNA, 30 nt, Artificial Sequence
  Membrane metallo-endopeptidase-like 1 (728-737)
aagaccgacgugcacagcccccugaaguac

SEQ ID NO: 39718 - RNA, 27 nt, Artificial Sequence
  Phosphatidylinositol 4,5-bisphosphate 3-kinase catalytic subunit alpha isoform (1030-1038)
aagaccgagcaggaggcccuggaguac

SEQ ID NO: 39719 - RNA, 27 nt, Artificial Sequence
  Vesicle-associated membrane protein-associated protein B/C (147-155)
aagaccgagacccccaucgugagcaag

SEQ ID NO: 39720 - RNA, 33 nt, Artificial Sequence
  Leukotriene A-4 hydrolase (355-365)
aagaccuucggcgagacccaccccuucacgaag

SEQ ID NO: 39721 - RNA, 30 nt, Artificial Sequence
  Zinc finger CCCH domain-containing protein 11A (404-413)
aagaccuucagcgaggugcuggccgagaag

SEQ ID NO: 39722 - RNA, 33 nt, Artificial Sequence
  60S ribosomal protein L39-like (5-15)
aagaccuucaccaucaagcgcuuccuggccaag

SEQ ID NO: 39723 - RNA, 27 nt, Artificial Sequence
  Microtubule-actin cross-linking factor 1, isoforms 1/2/3/5 (99-107)
aagaccuucaccaagugggugaacaag

SEQ ID NO: 39724 - RNA, 30 nt, Artificial Sequence
  Transcription initiation factor TFIID subunit 7 (78-87)
aagaccaucgacaagaagaccuucuacaag

SEQ ID NO: 39725 - RNA, 33 nt, Artificial Sequence
  Transforming growth factor beta-1 (34-44)
aagaccaucgacauggagcuggugaagcgcaag

SEQ ID NO: 39726 - RNA, 27 nt, Artificial Sequence
  Max-like protein X (125-133)
aagaccaucgacuacauccaguuccug

SEQ ID NO: 39727 - RNA, 33 nt, Artificial Sequence
  Max-like protein X (125-135)
aagaccaucgacuacauccaguuccugcacaag

SEQ ID NO: 39728 - RNA, 39 nt, Artificial Sequence
  tRNA pseudouridine synthase A, mitochondrial (110-122)
aagaccaucgaggacgaccuggugagcgcccucguccgc

SEQ ID NO: 39729 - RNA, 27 nt, Artificial Sequence
  Polymerase delta-interacting protein 3 (147-155)
aagaccauccaggugccccagcagaag

SEQ ID NO: 39730 - RNA, 33 nt, Artificial Sequence
  Cyclin-dependent kinase 11A (11-21)
aagacccuggacgagauccuccaggagaagaag

SEQ ID NO: 39731 - RNA, 33 nt, Artificial Sequence
  Exportin-2 (17-27)
aagacccuggaccccgacccggccauccgccgg

SEQ ID NO: 39732 - RNA, 36 nt, Artificial Sequence
  Coatomer subunit gamma-1 (795-806)
aagacccuggaggaggccgugggcaacaucgucaag

SEQ ID NO: 39733 - RNA, 27 nt, Artificial Sequence
  Protein prune homolog 2 (118-126)
aagacccuggagagcgccguggucaag

SEQ ID NO: 39734 - RNA, 33 nt, Artificial Sequence
  Chromatin assembly factor 1 subunit B (467-477)
aagacccugcagcccagcucccagaacaccaag

SEQ ID NO: 39735 - RNA, 33 nt, Artificial Sequence
  RE1-silencing transcription factor (417-427)
aagaccauggacgugagcaaggucaagcugaag

SEQ ID NO: 39736 - RNA, 33 nt, Artificial Sequence
  Arfaptin-2 (216-226)
aagaccauggaggacacccugaugacggugaag

SEQ ID NO: 39737 - RNA, 27 nt, Artificial Sequence
  Asparagine synthetase domain-containing protein 1 (361-369)
aagaccaugcccaccacguucaaccgc

SEQ ID NO: 39738 - RNA, 27 nt, Artificial Sequence
  Uncharacterized protein C15orf41 (95-103)
aagacccccgacuucauccugcaggug

SEQ ID NO: 39739 - RNA, 27 nt, Artificial Sequence
  Neuroblast differentiation-associated protein AHNAK (489-497)
aagacccccgagaugaucauccagaag

SEQ ID NO: 39740 - RNA, 30 nt, Artificial Sequence
  LIM and SH3 domain protein 1 (112-121)
aagacccaggaccagaucagcaacaucaag

SEQ ID NO: 39741 - RNA, 27 nt, Artificial Sequence
  mRNA-capping enzyme (403-411)
aagacccaggagcccuucagcgugcgc

SEQ ID NO: 39742 - RNA, 33 nt, Artificial Sequence
  mRNA-capping enzyme (403-413)
aagacccaggagcccuucagcgugcgcaacaag

SEQ ID NO: 39743 - RNA, 27 nt, Artificial Sequence
  Actin-related protein 10 (403-411)
aagacccagcccccgcugaugaagcgc

SEQ ID NO: 39744 - RNA, 33 nt, Artificial Sequence
  Src substrate cortactin (299-309)
aagaccgugcccgucgaggccgugaccagcaag

SEQ ID NO: 39745 - RNA, 36 nt, Artificial Sequence
  X-ray repair cross-complementing protein 5 (274-285)
aagaccuggaccguggucgacgccaagacgcugaag

SEQ ID NO: 39746 - RNA, 30 nt, Artificial Sequence
  NADH dehydrogenase (ubiquinone) 1 subunit C2 (106-115)
aagaccuacggcgagaucuucgagaaguuc

SEQ ID NO: 39747 - RNA, 33 nt, Artificial Sequence
  Zinc finger protein SNAI2 (135-145)
aagaccuacagcaccuucuccggccuggccaag

SEQ ID NO: 39748 - RNA, 30 nt, Artificial Sequence
  ETS translocation variant 1 (301-310)
aagguggccggcgagcgcuacgucuacaag

SEQ ID NO: 39749 - RNA, 27 nt, Artificial Sequence
  5'-AMP-activated protein kinase catalytic subunit alpha-2 (41-49)
aagguggccgucaagauccugaaccgc

SEQ ID NO: 39750 - RNA, 27 nt, Artificial Sequence
  Heat shock cognate 71 kDa protein (601-609)
aaggugugcaaccccaucaucaccaag

SEQ ID NO: 39751 - RNA, 24 nt, Artificial Sequence
  Proteasome activator complex subunit 3 (6-13)
aagguggaccaggaggucaagcug

SEQ ID NO: 39752 - RNA, 27 nt, Artificial Sequence
  Proteasome activator complex subunit 3 (6-14)
aagguggaccaggaggucaagcugaag

SEQ ID NO: 39753 - RNA, 30 nt, Artificial Sequence
  Kinesin-like protein KIFC3 (522-531)
aagguguucgaguucggccacaccaaccgc

SEQ ID NO: 39754 - RNA, 33 nt, Artificial Sequence
  Nucleolin (370-380)
aagguguucggcaacgagaucaagcuggagaag

SEQ ID NO: 39755 - RNA, 36 nt, Artificial Sequence
  CUGBP Elav-like family member 2 (453-464)
aagguguucaucgacaagcagaccaaccugagcaag

SEQ ID NO: 39756 - RNA, 27 nt, Artificial Sequence
  Cathepsin L1 (104-112)
aagguguuccaggagccccuguucuac

SEQ ID NO: 39757 - RNA, 27 nt, Artificial Sequence
  Aspartyl/asparaginyl beta-hydroxylase (462-470)
aaggugcacuacggcuucauccugaag

SEQ ID NO: 39758 - RNA, 39 nt, Artificial Sequence
  Homeodomain-interacting protein kinase 2 (343-355)
aaggugaucgacuucggcagcgccucccacgucagcaag

SEQ ID NO: 39759 - RNA, 33 nt, Artificial Sequence
  Leucine-rich repeat-containing protein 61 (158-168)
aaggugaucgacggcgagcgcgucaucgggcgg

SEQ ID NO: 39760 - RNA, 27 nt, Artificial Sequence
  Prefoldin subunit 1 (19-27)
aaggugaucgacacccagcagaagguc

SEQ ID NO: 39761 - RNA, 27 nt, Artificial Sequence
  UPF0428 protein CXorf56 (42-50)
aaggugaucgagaagcagcuggagcgc

SEQ ID NO: 39762 - RNA, 33 nt, Artificial Sequence
  Liprin-alpha-1 (251-261)
aaggugaucgagcugcaggagaucaucagcaag

SEQ ID NO: 39763 - RNA, 33 nt, Artificial Sequence
  Signal-induced proliferation-associated 1-like protein 2 (559-569)
aaggugaucaacgccgagaacgccgcgcacaag

SEQ ID NO: 39764 - RNA, 27 nt, Artificial Sequence
  60S acidic ribosomal protein P2 (41-49)
aaggugaucagcgagcugaacggcaag

SEQ ID NO: 39765 - RNA, 33 nt, Artificial Sequence
  Protein PRRC2C (1140-1150)
aaggugaucagcaaggaccuggucaucgagcgc

SEQ ID NO: 39766 - RNA, 33 nt, Artificial Sequence
  Zinc finger protein 721 (156-166)
aaggugaucaccagcuccagcuccuucgccaag

SEQ ID NO: 39767 - RNA, 36 nt, Artificial Sequence
  Probable U3 small nucleolar RNA-associated protein 11 (109-120)
aaggugaagggcgucaccaaccagaccgggcugaag

SEQ ID NO: 39768 - RNA, 33 nt, Artificial Sequence
  Neuroblast differentiation-associated protein AHNAK (487-497)
aaggugaagacccccgagaugaucauccagaag

SEQ ID NO: 39769 - RNA, 30 nt, Artificial Sequence
  Gamma-interferon-inducible protein 16 (243-252)
aaggugcugaacaccagccucaaggagaag

SEQ ID NO: 39770 - RNA, 30 nt, Artificial Sequence
  E3 ubiquitin-protein ligase RNF216 (197-206)
aaggugcugccccagaccauccucuacaag

SEQ ID NO: 39771 - RNA, 30 nt, Artificial Sequence
  Serine/threonine-protein kinase Sgk1 (222-231)
aaggugcugcagaagaaggccauccucaag

SEQ ID NO: 39772 - RNA, 33 nt, Artificial Sequence
  Flavin reductaseADPH) (137-147)
aaggugcugcgcgagagcggccucaaguacguc

SEQ ID NO: 39773 - RNA, 30 nt, Artificial Sequence
  Polymerase I and transcript release factor (227-236)
aaggugcccccguucaccuuccacgucaag

SEQ ID NO: 39774 - RNA, 33 nt, Artificial Sequence
  Leucine-tRNA ligase, cytoplasmic (486-496)
aaggugcaggacgucaagaagaccauccagaag

SEQ ID NO: 39775 - RNA, 30 nt, Artificial Sequence
  28S ribosomal protein S29, mitochondrial (203-212)
aaggugcaggagaaguacgucuggaacaag

SEQ ID NO: 39776 - RNA, 27 nt, Artificial Sequence
  Prelamin-A/C (108-116)
aaggugcgcgaggaguucaaggagcug

SEQ ID NO: 39777 - RNA, 30 nt, Artificial Sequence
  ATP-dependent RNA helicase DHX8 (1091-1100)
aaggugagcgaccccaccaagcuguccaag

SEQ ID NO: 39778 - RNA, 27 nt, Artificial Sequence
  Protein O-GlcNAcase (850-858)
aaggugaccgaccccagcgucgccaag

SEQ ID NO: 39779 - RNA, 27 nt, Artificial Sequence
  Voltage-dependent anion-selective channel protein 1 (53-61)
aaggugaccggcagccuggagaccaag

SEQ ID NO: 39780 - RNA, 33 nt, Artificial Sequence
  Septin-9 (202-212)
aagguggucaacaucgugcccgugaucgccaag

SEQ ID NO: 39781 - RNA, 27 nt, Artificial Sequence
  Arf-GAP with Rho-GAP domain, ANK repeat and PH domain-containing protein 3 (53-61)
aagguguaccugggcauccgcaagaag

SEQ ID NO: 39782 - RNA, 27 nt, Artificial Sequence
  Ubiquitin carboxyl-terminal hydrolase 32 (278-286)
aaguacgccccccgcuucaacggcuuc

SEQ ID NO: 39783 - RNA, 27 nt, Artificial Sequence
  Methionine synthase (216-224)
aaguacgccccccgcccgaucuucauc

SEQ ID NO: 39784 - RNA, 27 nt, Artificial Sequence
  Metastasis-associated protein MTA2 (282-290)
aaguacggcaaggacuucaacgacauc

SEQ ID NO: 39785 - RNA, 27 nt, Artificial Sequence
  Glycerol-3-phosphate acyltransferase 4 (365-373)
aaguacggcauggugaccuaccugcuc

SEQ ID NO: 39786 - RNA, 24 nt, Artificial Sequence
  Splicing factor 3B subunit 6 (41-48)
aaguacggccccauccgccagauc

SEQ ID NO: 39787 - RNA, 27 nt, Artificial Sequence
  Inositol 1,4,5-trisphosphate receptor type 3 (117-125)
aaguacggcagcgugauccagcugcuc

SEQ ID NO: 39788 - RNA, 27 nt, Artificial Sequence
  KH domain-containing, RNA-binding, signal transduction-associated protein 3 (44-52)
aaguacaucgacguggucaucaacaag

SEQ ID NO: 39789 - RNA, 27 nt, Artificial Sequence
  Probable E3 ubiquitin-protein ligase HERC6 (822-830)
aaguacaucgacuacaucuucaacgug

SEQ ID NO: 39790 - RNA, 33 nt, Artificial Sequence
  Zinc finger FYVE domain-containing protein 16 (1129-1139)
aaguacaucgagaaccuggacaacaucaccuuc

SEQ ID NO: 39791 - RNA, 27 nt, Artificial Sequence
  Serine/threonine-protein kinase RIO3 (304-312)
aaguacaucaaggacgacuuccgcuuc

SEQ ID NO: 39792 - RNA, 27 nt, Artificial Sequence
  FERM domain-containing protein 6 (210-218)
aaguacaucaaggaggccgugcgccug

SEQ ID NO: 39793 - RNA, 27 nt, Artificial Sequence
  ER membrane protein complex subunit 3 (66-74)
aaguacauccccaagcagagcuuccug

SEQ ID NO: 39794 - RNA, 27 nt, Artificial Sequence
  Cleavage stimulation factor subunit 1 (212-220)
aaguacauccaggaggccgagaugcug

SEQ ID NO: 39795 - RNA, 27 nt, Artificial Sequence
  Poly(A)-specific ribonuclease PARN (21-29)
aaguacaucaccaagagcuucaacuuc

SEQ ID NO: 39796 - RNA, 27 nt, Artificial Sequence
  Tetratricopeptide repeat protein 14 (427-435)
aaguacaugcagaagagccuggagcuc

SEQ ID NO: 39797 - RNA, 27 nt, Artificial Sequence
  Heparan sulfate 2-sulfotransferase (241-249)
aaguacaaccugaucaacgaguacuuc

SEQ ID NO: 39798 - RNA, 27 nt, Artificial Sequence
  Homeobox protein Hox-B7 (13-21)
aaguaccccgccagcuccagcguguuc

SEQ ID NO: 39799 - RNA, 27 nt, Artificial Sequence
  Adenosylhomocysteinase 2 (210-218)
aaguaccccaacguguucaagaagauc

SEQ ID NO: 39800 - RNA, 27 nt, Artificial Sequence
  Zinc finger C2HC domain-containing protein 1A (306-314)
aaguaccccguggagugggccaaguuc

SEQ ID NO: 39801 - RNA, 27 nt, Artificial Sequence
  T-box transcription factor TBX15 (239-247)
aaguaccagccccgcgugcacgucauc

SEQ ID NO: 39802 - RNA, 30 nt, Artificial Sequence
  Intron-binding protein aquarius (90-99)
aaguacagcaacauggagcagucccuguuc

SEQ ID NO: 39803 - RNA, 27 nt, Artificial Sequence
  Putative zinc finger protein 724 (149-157)
aaguacgugaaggacuuccacaaguuc

SEQ ID NO: 39804 - RNA, 27 nt, Artificial Sequence
  Zinc finger protein 107 (80-88)
aaguacgugaaggucuucgacaaguuc

SEQ ID NO: 39805 - RNA, 27 nt, Artificial Sequence
  Zinc finger protein 486 (191-199)
aaguacgugaaggucuuccaccaguuc

SEQ ID NO: 39806 - RNA, 27 nt, Artificial Sequence
  Zinc finger protein 675 (148-156)
aaguacgugaaggucuucaacaaguuc

SEQ ID NO: 39807 - RNA, 27 nt, Artificial Sequence
  Nuclear pore membraneoprotein 210 (17-25)
cuggccgccggccccagcgcggccgcc

SEQ ID NO: 39808 - RNA, 27 nt, Artificial Sequence
  Lck-interacting transmembrane adapter 1 (150-158)
cuggccgcccuccccggcgugagccug

SEQ ID NO: 39809 - RNA, 27 nt, Artificial Sequence
  Prolyl endopeptidase-like (376-384)
cuggccgacgacagcgugcgcucccuc

SEQ ID NO: 39810 - RNA, 27 nt, Artificial Sequence
  Helicase ARIP4 (250-258)
cuggccaucgugcccgucaacacccuc

SEQ ID NO: 39811 - RNA, 27 nt, Artificial Sequence
  Receptor-interacting serine/threonine-protein kinase 4 (637-645)
cuggccaagcagcccggcgugagcguc

SEQ ID NO: 39812 - RNA, 27 nt, Artificial Sequence
  Importin-9 (625-633)
cuggcccaggacaucuucaaggagcuc

SEQ ID NO: 39813 - RNA, 27 nt, Artificial Sequence
  Exosome complex exonuclease RRP44 (767-775)
cuggccagccccaucuacacccacuuc

SEQ ID NO: 39814 - RNA, 27 nt, Artificial Sequence
  Serine/threonine-protein kinase 17B (265-273)
cuggccaccgacuucauccagagccuc

SEQ ID NO: 39815 - RNA, 27 nt, Artificial Sequence
  Junction plakoglobin (139-147)
cuggccacccgcgcccuccccgagcug

SEQ ID NO: 39816 - RNA, 27 nt, Artificial Sequence
  UBX domain-containing protein 8 (242-250)
cuggccguggagggcgggcagagccuc

SEQ ID NO: 39817 - RNA, 27 nt, Artificial Sequence
  F-box only protein 32 (100-108)
cuggaggaccagcagaacauccgccuc

SEQ ID NO: 39818 - RNA, 27 nt, Artificial Sequence
  Ubiquitin carboxyl-terminal hydrolase 22 (475-483)
cuggagagcggccacuacaccuccuuc

SEQ ID NO: 39819 - RNA, 27 nt, Artificial Sequence
  Gamma-aminobutyric acid receptor subunit pi (247-255)
cuggagaccuacgugcccagcaccuuc

SEQ ID NO: 39820 - RNA, 27 nt, Artificial Sequence
  Condensin-2 complex subunit H2 (434-442)
cuguucaucgccaccagccagaaguuc

SEQ ID NO: 39821 - RNA, 27 nt, Artificial Sequence
  ATP-dependent RNA helicase DDX54 (153-161)
cugauccucagccccacccgcgagcug

SEQ ID NO: 39822 - RNA, 27 nt, Artificial Sequence
  Lysine-specific demethylase 4B (245-253)
cugaucagccccaucauccucaagaag

SEQ ID NO: 39823 - RNA, 27 nt, Artificial Sequence
  Protocadherin-1 (27-35)
cugcucgcccccagcccgggccacgcc

SEQ ID NO: 39824 - RNA, 33 nt, Artificial Sequence
  ETS translocation variant 5 (377-387)
cugcucgacgaccccgccaacgcccacuucauc

SEQ ID NO: 39825 - RNA, 27 nt, Artificial Sequence
  ATP-binding cassette sub-family F member 3 (350-358)
cugcucgacgagcccaccaacaugcug

SEQ ID NO: 39826 - RNA, 30 nt, Artificial Sequence
  Zinc finger protein 490 (73-82)
cugcucgaccccggccagcgcaacaucuac

SEQ ID NO: 39827 - RNA, 27 nt, Artificial Sequence
  Probable global transcription activator SNF2L1 (721-729)
cugcucgagaaggagauccuguacuac

SEQ ID NO: 39828 - RNA, 39 nt, Artificial Sequence
  NKG2D ligand 3 (11-23)
cugcucuucgacuggagcggcaccgggcgcgccgacgcc

SEQ ID NO: 39829 - RNA, 27 nt, Artificial Sequence
  Sterol regulatory element-binding protein 2 (843-851)
cugcuccacagcuucguggacuccguc

SEQ ID NO: 39830 - RNA, 27 nt, Artificial Sequence
  Uncharacterized protein C18orf63 (124-132)
cugcucauccagggccgcgacuuccug

SEQ ID NO: 39831 - RNA, 27 nt, Artificial Sequence
  Transmembrane emp24 domain-containing protein 3 (78-86)
cugcucaagagcuucuucaccgagaag

SEQ ID NO: 39832 - RNA, 33 nt, Artificial Sequence
  Protein disulfide-isomerase A3 (14-24)
cugcuccuggccgccgcgcgccuggccgccgcc

SEQ ID NO: 39833 - RNA, 27 nt, Artificial Sequence
  Peptidyl-prolyl cis-trans isomerase B (16-24)
cugcuccugcccggcccgagcgccgcc

SEQ ID NO: 39834 - RNA, 30 nt, Artificial Sequence
  Plasma alpha-L-fucosidase (19-28)
cugcuccugcccccgccccccugccccgcc

SEQ ID NO: 39835 - RNA, 27 nt, Artificial Sequence
  PRKC apoptosis WT1 regulator protein (216-224)
cugcuccaggagcccccgcgcaccgug

SEQ ID NO: 39836 - RNA, 30 nt, Artificial Sequence
  Chromodomain-helicase-DNA-binding protein 7 (695-704)
cugcucgugaacagccuguucgccggcaug

SEQ ID NO: 39837 - RNA, 33 nt, Artificial Sequence
  Notchless protein homolog 1 (181-191)
cugcucugggaccccagcaccggcaagcaggug

SEQ ID NO: 39838 - RNA, 27 nt, Artificial Sequence
  Adenosine 3'-phospho 5'-phosphosulfate transporter 1 (251-259)
cugcucuacggccacaccgugaccguc

SEQ ID NO: 39839 - RNA, 27 nt, Artificial Sequence
  Activating signal cointegrator 1 complex subunit 1 (68-76)
cugcucuacaagcacaucgugggcaag

SEQ ID NO: 39840 - RNA, 27 nt, Artificial Sequence
  DNA-dependent protein kinase catalytic subunit (3482-3490)
cugaugaccaaggagaucagcuccgug

SEQ ID NO: 39841 - RNA, 27 nt, Artificial Sequence
  Nucleus accumbens-associated protein 1 (343-351)
cugcccgccgagcucaucaaccagauc

SEQ ID NO: 39842 - RNA, 24 nt, Artificial Sequence
  Mothers against decapentaplegic homolog 2 (5-12)
cugcccuucaccccgcccgugguc

SEQ ID NO: 39843 - RNA, 27 nt, Artificial Sequence
  Biorientation of chromosomes in cell division protein 1-like 1 (907-915)
cugcccaucagcuccgccaccaccauc

SEQ ID NO: 39844 - RNA, 27 nt, Artificial Sequence
  Catenin alpha-1 (553-561)
cugccccaggagcagaaggccaagauc

SEQ ID NO: 39845 - RNA, 27 nt, Artificial Sequence
  E3 ubiquitin-protein ligase RNF213 (5003-5011)
cugcccagcuccgugaucagcgccauc

SEQ ID NO: 39846 - RNA, 24 nt, Artificial Sequence
  Eukaryotic translation initiation factor 3 subunit C-like protein (816-823)
cugcccaccgugcacagcaucauc

SEQ ID NO: 39847 - RNA, 24 nt, Artificial Sequence
  Regulation of nuclear pre-mRNA domain-containing protein 1A (190-197)
cugcccguggagguccaggaggug

SEQ ID NO: 39848 - RNA, 27 nt, Artificial Sequence
  CDK5 and ABL1 enzyme substrate 2 (40-48)
cugcccuacggcgaggggcuccgcauc

SEQ ID NO: 39849 - RNA, 27 nt, Artificial Sequence
  Collagen alpha-1(XII) chain (105-113)
cugcccuacaagggcgggaacacccuc

SEQ ID NO: 39850 - RNA, 27 nt, Artificial Sequence
  A-kinase anchor protein 1, mitochondrial (646-654)
cugcccuacacccagagcgugcagauc

SEQ ID NO: 39851 - RNA, 27 nt, Artificial Sequence
  Putative tRNA (cytidine(32)/guanosine(34)-2'-O)-methyltransferase (30-38)
cugcagcucgacaaggaguuccagcug

SEQ ID NO: 39852 - RNA, 27 nt, Artificial Sequence
  Double-stranded RNA-binding protein Staufen homolog 1 (119-127)
cugcagaacgagccccucccggagcgc

SEQ ID NO: 39853 - RNA, 30 nt, Artificial Sequence
  CD44 antigen (331-340)
cugcagaacguggacaugaagaucggcguc

SEQ ID NO: 39854 - RNA, 27 nt, Artificial Sequence
  Vimentin (44-52)
cugcgccccagcaccucccggagccuc

SEQ ID NO: 39855 - RNA, 27 nt, Artificial Sequence
  Protein CASC5 (113-121)
cugagcgcccccauccacacccagaug

SEQ ID NO: 39856 - RNA, 30 nt, Artificial Sequence
  Fibronectin type III domain-containing protein 3B (320-329)
cugagcgacaagggccgcgacgggaaguac

SEQ ID NO: 39857 - RNA, 27 nt, Artificial Sequence
  Cytoplasmic dynein 1 heavy chain 1 (69-77)
cugagcgacccccaggugcacaccguc

SEQ ID NO: 39858 - RNA, 27 nt, Artificial Sequence
  Stress-induced-phosphoprotein 1 (194-202)
cugagcgaccccaccuaccgcgagcuc

SEQ ID NO: 39859 - RNA, 27 nt, Artificial Sequence
  Cytochrome c oxidase subunit 4 isoform 1, mitochondrial (131-139)
cugagcgaccccgugauccacucccuc

SEQ ID NO: 39860 - RNA, 33 nt, Artificial Sequence
  tRNA-splicing endonuclease subunit Sen54 (146-156)
cugaccgaccacaccgugacguuccuccaguac

SEQ ID NO: 39861 - RNA, 33 nt, Artificial Sequence
  Beta-galactosidase-1-like protein 2 (348-358)
cugaccgaggccggcgacuacaccgccaaguac

SEQ ID NO: 39862 - RNA, 24 nt, Artificial Sequence
  Serine/threonine-protein kinase 24 (284-291)
cugaccgagcucaucgaccgcuac

SEQ ID NO: 39863 - RNA, 27 nt, Artificial Sequence
  Endoplasmic reticulum-Golgi intermediate compartment protein 3 (39-47)
cugaccaccgaggugcaccccgagcuc

SEQ ID NO: 39864 - RNA, 24 nt, Artificial Sequence
  POTE ankyrin domain family member F (708-715)
cuggugaucgacaacggcagcggg

SEQ ID NO: 39865 - RNA, 36 nt, Artificial Sequence
  CD44 antigen (399-410)
cuggugaacaaggagagcuccgagacccccgaccag

SEQ ID NO: 39866 - RNA, 27 nt, Artificial Sequence
  Structural maintenance of chromosomes flexible hinge domain-containing protein 1 (857-865)
cuggugaccgacauccagcccguccuc

SEQ ID NO: 39867 - RNA, 27 nt, Artificial Sequence
  Cytoplasmic dynein 1 light intermediate chain 1 (179-187)
cugguguacaaguacaucguccagaag

SEQ ID NO: 39868 - RNA, 27 nt, Artificial Sequence
  Protein archease (109-117)
cuguacaaguucagcgccgacgaguuc

SEQ ID NO: 39869 - RNA, 27 nt, Artificial Sequence
  Tumor protein D54 (125-133)
cuguacaagaagacccaggagacccuc

SEQ ID NO: 39870 - RNA, 30 nt, Artificial Sequence
  CD109 antigen (139-148)
cuguacaagcccaagcaggaggugaaguuc

SEQ ID NO: 39871 - RNA, 27 nt, Artificial Sequence
  Ras-related GTP-binding protein C (292-300)
cuguaccucaaggaggugaccaaguuc

SEQ ID NO: 39872 - RNA, 27 nt, Artificial Sequence
  Exportin-5 (626-634)
cuguacaaccacgugaagcagcuccug

SEQ ID NO: 39873 - RNA, 27 nt, Artificial Sequence
  Interferon-induced GTP-binding protein Mx2 (422-430)
cuguacaacaagauccgcgaggacuuc

SEQ ID NO: 39874 - RNA, 27 nt, Artificial Sequence
  ATPase family AAA domain-containing protein 2 (447-455)
cuguaccccgagguguucgagaaguuc

SEQ ID NO: 39875 - RNA, 27 nt, Artificial Sequence
  TELO2-interacting protein 2 (300-308)
cuguacacccccgagcaccaccucauc

SEQ ID NO: 39876 - RNA, 27 nt, Artificial Sequence
  Formin-binding protein 1-like (181-189)
auggccgacgagaacaagaacgaguac

SEQ ID NO: 39877 - RNA, 30 nt, Artificial Sequence
  Condensin complex subunit 1 (1002-1011)
auggagcugcucgacggcaagcagacccug

SEQ ID NO: 39878 - RNA, 30 nt, Artificial Sequence
  Nucleoprotein TPR (1009-1018)
auggagguggagaaggagaagcaggagcug

SEQ ID NO: 39879 - RNA, 33 nt, Artificial Sequence
  Eukaryotic translation initiation factor 2 subunit 2 (6-16)
augaucuucgaccccaccaugagcaagaagaag

SEQ ID NO: 39880 - RNA, 27 nt, Artificial Sequence
  Melanoma-associated antigen D1 (497-505)
augcugcgcgacaucauccgggaguac

SEQ ID NO: 39881 - RNA, 30 nt, Artificial Sequence
  Cytochrome c oxidase subunit NDUFA4 (1-10)
augcugcgccagaucaucggccaggccaag

SEQ ID NO: 39882 - RNA, 27 nt, Artificial Sequence
  Tetratricopeptide repeat protein 17 (580-588)
augcccgacgaccacgcccgcaagauc

SEQ ID NO: 39883 - RNA, 24 nt, Artificial Sequence
  Protein polybromo-1 (426-433)
augcccaucagccugcagcagauc

SEQ ID NO: 39884 - RNA, 30 nt, Artificial Sequence
  Cell division cycle protein 27 homolog (515-524)
augcaggccgagcgcaucuucagcgaggug

SEQ ID NO: 39885 - RNA, 33 nt, Artificial Sequence
  CD44 antigen (412-422)
augaccgccgacgagacccgcaaccugcagaac

SEQ ID NO: 39886 - RNA, 33 nt, Artificial Sequence
  14-3-3 protein beta/alpha (1-11)
augaccauggacaagagcgagcuggugcagaag

SEQ ID NO: 39887 - RNA, 27 nt, Artificial Sequence
  Centromere/kinetochore protein zw10 homolog (415-423)
augaccagcgagauccacaacaccgug

SEQ ID NO: 39888 - RNA, 27 nt, Artificial Sequence
  Pyridoxal kinase (93-101)
augguggucgacaucgugcaggagcug

SEQ ID NO: 39889 - RNA, 27 nt, Artificial Sequence
  Nucleoside diphosphate kinase (76-84)
auggugugggagggccugaacgucgug

SEQ ID NO: 39890 - RNA, 27 nt, Artificial Sequence
  Tyrosine-protein phosphatase non-receptor type 14 (204-212)
auguacaucaacgagguggagcgccug

SEQ ID NO: 39891 - RNA, 27 nt, Artificial Sequence
  Phosphatidate cytidylyltransferase 2 (308-316)
auguaccccuuccagauccacagcauc

SEQ ID NO: 39892 - RNA, 27 nt, Artificial Sequence
  M-phase phosphoprotein 8 (351-359)
aacgccuuccuggagaagaagaccgug

SEQ ID NO: 39893 - RNA, 27 nt, Artificial Sequence
  E3 ubiquitin-protein ligase RNF213 (2663-2671)
aacgccuuccugagcaaguccagcgug

SEQ ID NO: 39894 - RNA, 27 nt, Artificial Sequence
  H/ACA ribonucleoprotein complex subunit 4 (161-169)
aacgccaucgagggcgggacccagcug

SEQ ID NO: 39895 - RNA, 27 nt, Artificial Sequence
  Protein transport protein Sec31A (866-874)
aacgccuaccccaacaccccguacauc

SEQ ID NO: 39896 - RNA, 27 nt, Artificial Sequence
  Ribonuclease P/MRP protein subunit POP5 (58-66)
aacgccuacaccggcaucgugcugcuc

SEQ ID NO: 39897 - RNA, 27 nt, Artificial Sequence
  Cytoplasmic dynein 1 heavy chain 1 (1442-1450)
aacgaggccaucgugaaggacguccug

SEQ ID NO: 39898 - RNA, 30 nt, Artificial Sequence
  Hsc70-interacting protein (314-323)
aacgagauccugagcgaccccgaggugcuc

SEQ ID NO: 39899 - RNA, 24 nt, Artificial Sequence
  DENN domain-containing protein 5A (694-701)
aacgagaucaccggccacaccuac

SEQ ID NO: 39900 - RNA, 27 nt, Artificial Sequence
  Nucleoprotein TPR (857-865)
aacgagguggagcagcgccacacccug

SEQ ID NO: 39901 - RNA, 27 nt, Artificial Sequence
  Serine/arginine repetitive matrix protein 2 (2175-2183)
aaccacgcccagagccgcaucgcccug

SEQ ID NO: 39902 - RNA, 27 nt, Artificial Sequence
  EH domain-containing protein 1 (209-217)
aaccacgaggacaagauccgcgugguc

SEQ ID NO: 39903 - RNA, 30 nt, Artificial Sequence
  Nuclear receptor coactivator 6 (844-853)
aaccacuucagcggccacgggauguccuuc

SEQ ID NO: 39904 - RNA, 27 nt, Artificial Sequence
  UDP-N-acetylhexosamine pyrophosphorylase (327-335)
aacaucgccaaccacuucuucaccgug

SEQ ID NO: 39905 - RNA, 27 nt, Artificial Sequence
  Mediator of RNA polymerase II transcription subunit 22 (67-75)
aacaucgugcgcgccggcgagagccug

SEQ ID NO: 39906 - RNA, 27 nt, Artificial Sequence
  Peroxisomal acyl-coenzyme A oxidase 1 (642-650)
aacaaggccgaggugcacgagagcuac

SEQ ID NO: 39907 - RNA, 30 nt, Artificial Sequence
  FERM domain-containing protein 6 (261-270)
aaccuggacgaggagaagcagcuccuguac

SEQ ID NO: 39908 - RNA, 24 nt, Artificial Sequence
  WD repeat-containing protein 43 (333-340)
aaccugaucaagaagaccgugcuc

SEQ ID NO: 39909 - RNA, 27 nt, Artificial Sequence
  C-terminal-binding protein 2 (784-792)
aaccugaacgagcacaaccaccaccuc

SEQ ID NO: 39910 - RNA, 33 nt, Artificial Sequence
  CD44 antigen (330-340)
aaccugcagaacguggacaugaagaucggcguc

SEQ ID NO: 39911 - RNA, 30 nt, Artificial Sequence
  E3 ubiquitin-protein ligase makorin-1 (292-301)
aaccccagcgagcgccgguucggcauccug

SEQ ID NO: 39912 - RNA, 33 nt, Artificial Sequence
  Transcription factor COE2 (207-217)
aaccagggcuacauccgcaacaccagcuccauc

SEQ ID NO: 39913 - RNA, 27 nt, Artificial Sequence
  Interferon-induced GTP-binding protein Mx2 (643-651)
aaccagauccccuucaucauccaguac

SEQ ID NO: 39914 - RNA, 27 nt, Artificial Sequence
  Transportin-1 (49-57)
aaccaguaccccgacuucaacaacuac

SEQ ID NO: 39915 - RNA, 27 nt, Artificial Sequence
  Dolichyl-diphosphooligosaccharide-proteinosyltransferase 48 kDa subunit (395-403)
aaccgccugggcuacacccaccucuac

SEQ ID NO: 39916 - RNA, 27 nt, Artificial Sequence
  TATA-binding protein-associated factor 2N (227-235)
aacagcgacaacaacaccaucuucgug

SEQ ID NO: 39917 - RNA, 27 nt, Artificial Sequence
  Niban-like protein 1 (154-162)
aacagcgaccccaaccugcaccuccug

SEQ ID NO: 39918 - RNA, 27 nt, Artificial Sequence
  Serine/threonine-protein kinase TBK1 (330-338)
aacaccgccaccaucuuccacgagcug

SEQ ID NO: 39919 - RNA, 30 nt, Artificial Sequence
  GREB1-like protein (1697-1706)
aacaccgaccugacccagaacgugcaguac

SEQ ID NO: 39920 - RNA, 30 nt, Artificial Sequence
  Eukaryotic translation initiation factor 3 subunit C-like protein (462-471)
aacaccgacccccacagccaggaguacgug

SEQ ID NO: 39921 - RNA, 30 nt, Artificial Sequence
  Guanine deaminase (328-337)
aacaccgaccgccccggcggguacagcuac

SEQ ID NO: 39922 - RNA, 30 nt, Artificial Sequence
  26S proteasome non-ATPase regulatory subunit 13 (227-236)
aacaccgaccgccaguggcugaucgacacc

SEQ ID NO: 39923 - RNA, 33 nt, Artificial Sequence
  Polypyrimidine tract-binding protein 1 (102-112)
aacaccgaggaggccgccaacaccauggugaac

SEQ ID NO: 39924 - RNA, 27 nt, Artificial Sequence
  MOB kinase activator 1A (60-68)
aacaccguggacuucuucaaccagauc

SEQ ID NO: 39925 - RNA, 27 nt, Artificial Sequence
  Vesicular integral-membrane protein VIP36 (305-313)
aacguggacgaccccaccggcaacuuc

SEQ ID NO: 39926 - RNA, 33 nt, Artificial Sequence
  Dynactin subunit 6 (105-115)
aacgugaucgagagcaaggccuacgucggccgc

SEQ ID NO: 39927 - RNA, 27 nt, Artificial Sequence
  Sperm-associated antigen 16 protein (89-97)
aacgugcccgacgucuacacccagauc

SEQ ID NO: 39928 - RNA, 27 nt, Artificial Sequence
  Activity-dependent neuroprotector homeobox protein (450-458)
aacuacaucaugaagauccacaacuuc

SEQ ID NO: 39929 - RNA, 27 nt, Artificial Sequence
  Abelson tyrosine-protein kinase 2 (124-132)
aacuacaucacccccgugaacagccug

SEQ ID NO: 39930 - RNA, 27 nt, Artificial Sequence
  Opioid growth factor receptor (195-203)
aacuaccagaagcgcuuccagaaccug

SEQ ID NO: 39931 - RNA, 27 nt, Artificial Sequence
  DNA-directed RNA polymerase II subunit RPB4 (66-74)
aacuacaccgcccgcuucagccgguuc

SEQ ID NO: 39932 - RNA, 30 nt, Artificial Sequence
  BTB/POZ domain-containing adapter for CUL3-mediated RhoA degradation protein 3 (245-254)
cccgaggcccgcaucuacgaggagacccug

SEQ ID NO: 39933 - RNA, 27 nt, Artificial Sequence
  Ubiquitin-like modifier-activating enzyme 7 (898-906)
cccuucgccccggccauccagaccuuc

SEQ ID NO: 39934 - RNA, 27 nt, Artificial Sequence
  Short-chain dehydrogenase/reductase 3 (219-227)
cccuuccacaccagcaccgagauguuc

SEQ ID NO: 39935 - RNA, 30 nt, Artificial Sequence
  Nodal modulator 2 (293-302)
cccuucuaccgcggcgagcggaucaccuuc

SEQ ID NO: 39936 - RNA, 30 nt, Artificial Sequence
  Beta-2-microglobulin (110-119)
cccaagaucgugaagugggaccgcgacaug

SEQ ID NO: 39937 - RNA, 27 nt, Artificial Sequence
  Proteasomal ubiquitin receptor ADRM1 (86-94)
ccccagugcccgagcggccgcguguac

SEQ ID NO: 39938 - RNA, 36 nt, Artificial Sequence
  NADH dehydrogenase (ubiquinone) 1 alpha subcomplex subunit 3 (73-84)
ccccagggcccgagccuggaguggcucaagaagcug

SEQ ID NO: 39939 - RNA, 27 nt, Artificial Sequence
  Signal recognition particle 9 kDa protein (2-10)
ccccaguaccagaccugggaggaguuc

SEQ ID NO: 39940 - RNA, 30 nt, Artificial Sequence
  Gamma-aminobutyric acid receptor-associated protein (52-61)
cccagcgaccugaccgugggccaguucuac

SEQ ID NO: 39941 - RNA, 33 nt, Artificial Sequence
  B-cell CLL/lymphoma 9-like protein (1331-1341)
cccagcgagaagccguccagcacccugcaguac

SEQ ID NO: 39942 - RNA, 27 nt, Artificial Sequence
  Retroviral-like aspartic protease 1 (314-322)
cccgugggcgggagccuggaggacgag

SEQ ID NO: 39943 - RNA, 27 nt, Artificial Sequence
  Procollagen-lysine,2-oxoglutarate 5-dioxygenase 3 (459-467)
cccuacaucagccaggccuacgugauc

SEQ ID NO: 39944 - RNA, 27 nt, Artificial Sequence
  Telomerase protein component 1 (1087-1095)
cccuacgugggcgggcuggaggaguuc

SEQ ID NO: 39945 - RNA, 27 nt, Artificial Sequence
  U5 small nuclear ribonucleoprotein 200 kDa helicase (643-651)
caggaggacgugcgccugaucggccuc

SEQ ID NO: 39946 - RNA, 27 nt, Artificial Sequence
  Ras GTPase-activating protein-binding protein 1 (211-219)
caggaggagaagcccgagccggugcug

SEQ ID NO: 39947 - RNA, 27 nt, Artificial Sequence
  Threonylcarbamoyladenosine tRNA methylthiotransferase (57-65)
caggaggagaacaagaagaucgugcug

SEQ ID NO: 39948 - RNA, 30 nt, Artificial Sequence
  Eukaryotic translation initiation factor 3 subunit K (94-103)
caggaggagcgccccauccggcagauccug

SEQ ID NO: 39949 - RNA, 36 nt, Artificial Sequence
  RNA polymerase II subunit A C-terminal domain phosphatase SSU72 (177-188)
caggaguucgaggagaagagcggccgcaccuuccug

SEQ ID NO: 39950 - RNA, 27 nt, Artificial Sequence
  Clathrin heavy chain 1 (10-18)
caggagcaccugcagcuccagaaccug

SEQ ID NO: 39951 - RNA, 27 nt, Artificial Sequence
  Bifunctional arginine demethylase and lysyl-hydroxylase JMJD6 (356-364)
caggagcaccccgagcuggccgugcuc

SEQ ID NO: 39952 - RNA, 30 nt, Artificial Sequence
  F-box only protein 11 (141-150)
caggagaagcugcccgacgaggugguccuc

SEQ ID NO: 39953 - RNA, 30 nt, Artificial Sequence
  protein PET100 homolog, mitochondrial (48-57)
caggagcuggaggaguucaaggagcgccuc

SEQ ID NO: 39954 - RNA, 30 nt, Artificial Sequence
  Protein SHQ1 homolog (236-245)
caggagaaccacgccacccuggugagcuuc

SEQ ID NO: 39955 - RNA, 30 nt, Artificial Sequence
  Histone-lysine N-methyltransferase SETD7 (253-262)
caggagguggacagccgcgacugggcccug

SEQ ID NO: 39956 - RNA, 27 nt, Artificial Sequence
  Neutral amino acid transporter B(0) (224-232)
caggagguggagggcaugaacauccug

SEQ ID NO: 39957 - RNA, 27 nt, Artificial Sequence
  Uridine-cytidine kinase 2 (143-151)
caggaggugcgcgaccuguuccagaug

SEQ ID NO: 39958 - RNA, 27 nt, Artificial Sequence
  WD repeat-containing protein 3 (640-648)
caguucgugcccaagagccaccuguuc

SEQ ID NO: 39959 - RNA, 27 nt, Artificial Sequence
  Niban-like protein 1 (79-87)
cagaucagcauccccuuccugcucaag

SEQ ID NO: 39960 - RNA, 27 nt, Artificial Sequence
  Rho-associated protein kinase 2 (563-571)
cagcuggacgagaccaacgcccuccug

SEQ ID NO: 39961 - RNA, 27 nt, Artificial Sequence
  Ras-associated and pleckstrin homology domains-containing protein 1 (496-504)
cagcuggaccacgugaacgucuacuac

SEQ ID NO: 39962 - RNA, 27 nt, Artificial Sequence
  Disco-interacting protein 2 homolog A (1561-1569)
cagcuggaccccaucuacguggccuac

SEQ ID NO: 39963 - RNA, 27 nt, Artificial Sequence
  Transcription elongation factor SPT5 (537-545)
cagcuggacccccagaccgugggcguc

SEQ ID NO: 39964 - RNA, 27 nt, Artificial Sequence
  Transcriptional repressor CTCF (65-73)
cagcuggaccccacccuccugcagaug

SEQ ID NO: 39965 - RNA, 27 nt, Artificial Sequence
  Ubiquitin-40S ribosomal protein S27a (69-77)
cagcuggaggacggccgcacccucagc

SEQ ID NO: 39966 - RNA, 27 nt, Artificial Sequence
  Mortality factor 4-like protein 2 (145-153)
cagcuguuccagcuccccgccaagaag

SEQ ID NO: 39967 - RNA, 30 nt, Artificial Sequence
  Transitional endoplasmic reticulum ATPase (50-59)
cagcuguuccgcggcgacaccgugcuccug

SEQ ID NO: 39968 - RNA, 33 nt, Artificial Sequence
  Transitional endoplasmic reticulum ATPase (50-60)
cagcuguuccgcggcgacaccgugcuccugaag

SEQ ID NO: 39969 - RNA, 30 nt, Artificial Sequence
  Mitofusin-2 (172-181)
cagcugcacgccggcagccucguguccguc

SEQ ID NO: 39970 - RNA, 27 nt, Artificial Sequence
  Kinesin-like protein KIF15 (1210-1218)
cagcugaucgagaagaacuggcuccug

SEQ ID NO: 39971 - RNA, 27 nt, Artificial Sequence
  Cleavage and polyadenylation specificity factor subunit 2 (95-103)
cagcugcucgaccagaucuggcgcacc

SEQ ID NO: 39972 - RNA, 27 nt, Artificial Sequence
  Eukaryotic translation initiation factor 4 gamma 1 (739-747)
cagcugaugaagcaggugacccagcuc

SEQ ID NO: 39973 - RNA, 27 nt, Artificial Sequence
  Lanosterol 14-alpha demethylase (218-226)
cagcugaacgagaagguggcccagcuc

SEQ ID NO: 39974 - RNA, 27 nt, Artificial Sequence
  Pleckstrin homology-like domain family B member 1 (775-783)
cagcugcaggagaagcucguggcccug

SEQ ID NO: 39975 - RNA, 27 nt, Artificial Sequence
  WD and tetratricopeptide repeats protein 1 (274-282)
cagcuguacagcaaggccgugcagcgc

SEQ ID NO: 39976 - RNA, 27 nt, Artificial Sequence
  Zinc finger protein ubi-d4 (70-78)
cagcuguacagcuaccccgcccgccgg

SEQ ID NO: 39977 - RNA, 27 nt, Artificial Sequence
  KxDL motif-containing protein 1 (65-73)
cagaugagcgagcgcuuccugcaccac

SEQ ID NO: 39978 - RNA, 27 nt, Artificial Sequence
  Helicase with zinc finger domain 2 (1555-1563)
cagcccgccccgcgcagccagcagcug

SEQ ID NO: 39979 - RNA, 27 nt, Artificial Sequence
  V-type proton ATPase subunit B, brain isoform (42-50)
cagccccgccugaccuacaagaccgug

SEQ ID NO: 39980 - RNA, 30 nt, Artificial Sequence
  Transmembrane protein 160 (91-100)
cagagcgacaugggccgcgaggccgccuac

SEQ ID NO: 39981 - RNA, 27 nt, Artificial Sequence
  Synaptotagmin-like protein 2 (379-387)
cagagcgaccccaagccgucccaguac

SEQ ID NO: 39982 - RNA, 30 nt, Artificial Sequence
  Very long-chain specific acyl-CoA dehydrogenase, mitochondrial (600-609)
cagagcgaccccuggcagcaggagcuguac

SEQ ID NO: 39983 - RNA, 27 nt, Artificial Sequence
  E3 ubiquitin-protein ligase TRAF7 (293-301)
cagaccgacgaccgcuuccacgagaug

SEQ ID NO: 39984 - RNA, 27 nt, Artificial Sequence
  WD repeat and FYVE domain-containing protein 3 (796-804)
cagaccgacgagcgccuggcccaguac

SEQ ID NO: 39985 - RNA, 30 nt, Artificial Sequence
  Tetratricopeptide repeat protein 19, mitochondrial (128-137)
cagaccgacaacaagaaggccaucaccuac

SEQ ID NO: 39986 - RNA, 33 nt, Artificial Sequence
  Nuclear pore complex protein Nup133 (878-888)
cagaccgacaaccagagccgccugcagcgguac

SEQ ID NO: 39987 - RNA, 27 nt, Artificial Sequence
  Signal recognition particle receptor subunit beta (32-40)
cagaccgaccccacccugcucagcgug

SEQ ID NO: 39988 - RNA, 27 nt, Artificial Sequence
  Helicase with zinc finger domain 2 (612-620)
cagaccgaccccgugacccugcaguac

SEQ ID NO: 39989 - RNA, 27 nt, Artificial Sequence
  Small G protein signaling modulator 3 (245-253)
cagaccgaccagcgcgugcugcggcac

SEQ ID NO: 39990 - RNA, 30 nt, Artificial Sequence
  SWI/SNF-related matrix-associated actin-dependent regulator of chromatin subfamily A member 5 (85-94)
cagaccgaccgcgccaaccgguucgaguac

SEQ ID NO: 39991 - RNA, 30 nt, Artificial Sequence
  Sodium-dependent lysophosphatidylcholine symporter 1 (104-113)
cagaccgagcgcgacagcgccaccgccuac

SEQ ID NO: 39992 - RNA, 27 nt, Artificial Sequence
  Ras GTPase-activating-like protein IQGAP1 (980-988)
cagaccaaccccaccuaccuggccaag

SEQ ID NO: 39993 - RNA, 27 nt, Artificial Sequence
  Mitochondrial-processing peptidase subunit alpha (144-152)
cagaccagccgcgacaccacgauguac

SEQ ID NO: 39994 - RNA, 27 nt, Artificial Sequence
  DNA-directed RNA polymerase III subunit RPC5 (106-114)
cagaccaccagcaacacgucccgcuac

SEQ ID NO: 39995 - RNA, 27 nt, Artificial Sequence
  Catenin beta-1 (78-86)
cagguggccgacaucgacggccaguac

SEQ ID NO: 39996 - RNA, 27 nt, Artificial Sequence
  Regulator of microtubule dynamics protein 1 (253-261)
cagguggaccccaacuucuacagcaag

SEQ ID NO: 39997 - RNA, 30 nt, Artificial Sequence
  Cell division cycle protein 27 homolog (594-603)
cagguggaccccaacuacgccuacgccuac

SEQ ID NO: 39998 - RNA, 42 nt, Artificial Sequence
  Protein Tob2 (303-316)
cagguguucggcgggggcgccaacagccuguuccucgagaag

SEQ ID NO: 39999 - RNA, 33 nt, Artificial Sequence
  UPF0488 protein C8orf33 (189-199)
caggugcagcccgucgacggcgccacccgcaag

SEQ ID NO: 40000 - RNA, 27 nt, Artificial Sequence
  Dynamin-like 120 kDa protein, mitochondrial (858-866)
cagguguaccgccggcacuuccugaag

SEQ ID NO: 40001 - RNA, 27 nt, Artificial Sequence
  Zinc finger MIZ domain-containing protein 2 (283-291)
caguacgcccccagcaccgcccaguuc

SEQ ID NO: 40002 - RNA, 27 nt, Artificial Sequence
  HEAT repeat-containing protein 6 (870-878)
caguacgcccgcaucuggaacgcccug

SEQ ID NO: 40003 - RNA, 27 nt, Artificial Sequence
  Ubiquitin carboxyl-terminal hydrolase 48 (677-685)
caguacuuccccaaggccccggaguuc

SEQ ID NO: 40004 - RNA, 27 nt, Artificial Sequence
  DNA-directed RNA polymerase III subunit RPC2 (60-68)
caguacaaggacgugcccaucaccuac

SEQ ID NO: 40005 - RNA, 33 nt, Artificial Sequence
  Negative elongation factor A (142-152)
caguaccugaacaagaacgcccucaccacccug

SEQ ID NO: 40006 - RNA, 27 nt, Artificial Sequence
  Laminin subunit alpha-4 (1299-1307)
caguacaacgacggccugagccacuuc

SEQ ID NO: 40007 - RNA, 27 nt, Artificial Sequence
  Protein spire homolog 1 (293-301)
caguacaacccccugccgaucgaguac

SEQ ID NO: 40008 - RNA, 27 nt, Artificial Sequence
  Protein transport protein Sec61 subunit alpha isoform 1 (275-283)
caguacaacaccuaccccaucaagcug

SEQ ID NO: 40009 - RNA, 30 nt, Artificial Sequence
  Protein transport protein Sec61 subunit alpha isoform 1 (275-284)
caguacaacaccuaccccaucaagcuguuc

SEQ ID NO: 40010 - RNA, 27 nt, Artificial Sequence
  Gem-associated protein 5 (1174-1182)
caguaccaggaggccuuccagaagcug

SEQ ID NO: 40011 - RNA, 27 nt, Artificial Sequence
  E3 ubiquitin-protein ligase RNF213 (2046-2054)
caguaccagaaggugcccguccuguuc

SEQ ID NO: 40012 - RNA, 27 nt, Artificial Sequence
  Spectrin beta chain, non-erythrocytic 2 (18-26)
caguacagcgacaucaacaaccgcugg

SEQ ID NO: 40013 - RNA, 27 nt, Artificial Sequence
  Ubiquitin-like modifier-activating enzyme 1 (717-725)
caguacagcaacaacauccgccagcug

SEQ ID NO: 40014 - RNA, 27 nt, Artificial Sequence
  Phosphatidylinositol transfer protein beta isoform (56-64)
caguacacccacaagaucuaccaccug

SEQ ID NO: 40015 - RNA, 27 nt, Artificial Sequence
  Laminin subunit gamma-1 (6-14)
cgcgccgcccccgcgcugcggccgcgc

SEQ ID NO: 40016 - RNA, 27 nt, Artificial Sequence
  CCAAT/enhancer-binding protein beta (62-70)
cgcgccaucgacuucagccccuaccug

SEQ ID NO: 40017 - RNA, 33 nt, Artificial Sequence
  X-ray repair cross-complementing protein 6 (586-596)
cgcgccuacggccugaagagcgggcucaagaag

SEQ ID NO: 40018 - RNA, 27 nt, Artificial Sequence
  Filamin-B (649-657)
cgcgccuacggccccgggcuggagaag

SEQ ID NO: 40019 - RNA, 27 nt, Artificial Sequence
  Ras and Rab interactor 2 (179-187)
cgcgacgugcugcccuucacccucaag

SEQ ID NO: 40020 - RNA, 33 nt, Artificial Sequence
  Glutamine-tRNA ligase (34-44)
cgcgaggccgccacccaggcgcagcagacccug

SEQ ID NO: 40021 - RNA, 33 nt, Artificial Sequence
  Pre-mRNA-processing-splicing factor 8 (1275-1285)
cgcgaggccguggucaacacccaggagcugcuc

SEQ ID NO: 40022 - RNA, 27 nt, Artificial Sequence
  TFIIH basal transcription factor complex helicase XPB subunit (472-480)
cgcgaggacgacaagaucguggaccug

SEQ ID NO: 40023 - RNA, 33 nt, Artificial Sequence
  Nuclear pore complex protein Nup107 (142-152)
cgcgaggacgaccccggcgaggccgccagcaug

SEQ ID NO: 40024 - RNA, 30 nt, Artificial Sequence
  Translationally-controlled tumor protein (152-161)
cgcgaggacggcgugacccccuacaugauc

SEQ ID NO: 40025 - RNA, 27 nt, Artificial Sequence
  Catenin beta-1 (457-465)
cgcgaggacaucaccgagcccgccauc

SEQ ID NO: 40026 - RNA, 36 nt, Artificial Sequence
  Histone-lysine N-methyltransferase 2D (2065-2076)
cgcgaggaccccggcaccgggaugggcagcucccug

SEQ ID NO: 40027 - RNA, 33 nt, Artificial Sequence
  Protein ELYS (1949-1959)
cgcgaggacagcaaccuggaguccagccagcuc

SEQ ID NO: 40028 - RNA, 33 nt, Artificial Sequence
  DNA damage-inducible transcript 4 protein (39-49)
cgcgaggagggcuucgaccggagcaccucccug

SEQ ID NO: 40029 - RNA, 30 nt, Artificial Sequence
  Protein THEMIS2 (210-219)
cgcgaggagaaccccgaguucaccagccug

SEQ ID NO: 40030 - RNA, 30 nt, Artificial Sequence
  Serine/threonine-protein phosphatase 2B catalytic subunit beta isoform (441-450)
cgcgaggagagcgaguccgugcugacccuc

SEQ ID NO: 40031 - RNA, 30 nt, Artificial Sequence
  Poly(rC)-binding protein 2 (40-49)
cgcgaggagagcggcgcccggaucaacauc

SEQ ID NO: 40032 - RNA, 30 nt, Artificial Sequence
  Vigilin (608-617)
cgcgaggagagcaacaccaagaucgaccug

SEQ ID NO: 40033 - RNA, 27 nt, Artificial Sequence
  Double-strand-break repair protein rad21 homolog (146-154)
cgcgaggaggugggcaacaucagcauc

SEQ ID NO: 40034 - RNA, 27 nt, Artificial Sequence
  U3 small nucleolar RNA-associated protein 14 homolog A (370-378)
cgcgaguucgaggagcggcgcagccug

SEQ ID NO: 40035 - RNA, 33 nt, Artificial Sequence
  ADP-ribose pyrophosphatase, mitochondrial (229-239)
cgcgaguucggcgaggaggcccugaacagccuc

SEQ ID NO: 40036 - RNA, 27 nt, Artificial Sequence
  Procollagen-lysine,2-oxoglutarate 5-dioxygenase 2 (100-108)
cgcgaguucaucgcccccgugacccug

SEQ ID NO: 40037 - RNA, 30 nt, Artificial Sequence
  Peptidyl-prolyl cis-trans isomerase FKBP14 (202-211)
cgcgaguucaccuacaagcacgacgagcug

SEQ ID NO: 40038 - RNA, 27 nt, Artificial Sequence
  Splicing factor 3B subunit 1 (390-398)
cgcgagaucgacgagcggaaccgcccc

SEQ ID NO: 40039 - RNA, 30 nt, Artificial Sequence
  Nucleolin (546-555)
cgcgagaucgagggccgggccauccgccug

SEQ ID NO: 40040 - RNA, 27 nt, Artificial Sequence
  Cytoplasmic dynein 1 heavy chain 1 (254-262)
cgcgagauccagaaggugaccaagcug

SEQ ID NO: 40041 - RNA, 33 nt, Artificial Sequence
  Death-associated protein kinase 3 (69-79)
cgcgagauccggcaccccaacaucaucacccug

SEQ ID NO: 40042 - RNA, 30 nt, Artificial Sequence
  E3 ubiquitin-protein ligase BRE1B (440-449)
cgcgagaaggacgacgccaacuucaagcug

SEQ ID NO: 40043 - RNA, 27 nt, Artificial Sequence
  Transcription factor AP-2 alpha (Activating enhancer binding protein 2 alpha), isoform CRA_c (266-274)
cgcgagaagcuggacaagaucggccuc

SEQ ID NO: 40044 - RNA, 27 nt, Artificial Sequence
  Putative pituitary tumor-transforming gene 3 protein (153-161)
cgcgagcuggagaagcucuuccagcug

SEQ ID NO: 40045 - RNA, 30 nt, Artificial Sequence
  Guanine nucleotide-binding protein G(I)/G(S)/G(T) subunit beta-2 (137-146)
cgcgagcugcccggccacaccggguaccuc

SEQ ID NO: 40046 - RNA, 30 nt, Artificial Sequence
  Glycosylphosphatidylinositol anchor attachment 1 protein (565-574)
cgcgagcugcaggaggccccccucagccug

SEQ ID NO: 40047 - RNA, 30 nt, Artificial Sequence
  Ataxin-10 (119-128)
cgcgagcugcggguggagcaggagagccuc

SEQ ID NO: 40048 - RNA, 30 nt, Artificial Sequence
  TSC22 domain family protein 3 (77-86)
cgcgagcugguggagaagaacagccagcuc

SEQ ID NO: 40049 - RNA, 33 nt, Artificial Sequence
  Src substrate cortactin (59-69)
cgcgagaacguguuccaggagcaccagacccug

SEQ ID NO: 40050 - RNA, 33 nt, Artificial Sequence
  WW domain-containing transcription regulator protein 1 (308-318)
cgcgagcagagcaccgacuccggccuggggcuc

SEQ ID NO: 40051 - RNA, 27 nt, Artificial Sequence
  Endoplasmin (427-435)
cgcgagacccugcagcagcacaagcuc

SEQ ID NO: 40052 - RNA, 30 nt, Artificial Sequence
  Rho guanine nucleotide exchange factor 2 (633-642)
cgcgagguggagggccugaaggaccuccug

SEQ ID NO: 40053 - RNA, 27 nt, Artificial Sequence
  Bifunctional methylenetetrahydrofolate dehydrogenase/cyclohydrolase, mitochondrial (337-345)
cgcgaggugcugaagagcaaggagcuc

SEQ ID NO: 40054 - RNA, 27 nt, Artificial Sequence
  Phosphoserine aminotransferase (319-327)
cgcuuccuggacaaggcccucgagcug

SEQ ID NO: 40055 - RNA, 30 nt, Artificial Sequence
  AP-5 complex subunit sigma-1 (172-181)
cgcuuccugccccacggccagcuccuguuc

SEQ ID NO: 40056 - RNA, 27 nt, Artificial Sequence
  Arf-GAP with coiled-coil, ANK repeat and PH domain-containing protein 2 (770-778)
cgcuuccagcaggacagccagaaguuc

SEQ ID NO: 40057 - RNA, 27 nt, Artificial Sequence
  NADH dehydrogenase (ubiquinone) 1 beta subcomplex subunit 5, mitochondrial (61-69)
cgcuucuacgaccggcgcuuccugaag

SEQ ID NO: 40058 - RNA, 33 nt, Artificial Sequence
  Putative helicase MOV-10 (450-460)
cgcggccuggacgacaucaaggaccucaaggug

SEQ ID NO: 40059 - RNA, 33 nt, Artificial Sequence
  Protein EFR3 homolog A (165-175)
cgcaucgccggcauccgggggauccagggcgug

SEQ ID NO: 40060 - RNA, 33 nt, Artificial Sequence
  Nuclear cap-binding protein subunit 1 (194-204)
cgcaucuucgccaacaccgagagcuaccugaag

SEQ ID NO: 40061 - RNA, 27 nt, Artificial Sequence
  Transcription cofactor vestigial-like protein 4 (79-87)
cgcaucuucaacccccaccugaacaag

SEQ ID NO: 40062 - RNA, 27 nt, Artificial Sequence
  Tubulin polyglutamylase TTLL7 (765-773)
cgcaucuucaaccggguguucaaccgc

SEQ ID NO: 40063 - RNA, 30 nt, Artificial Sequence
  Centrosomal protein of 192 kDa (1349-1358)
cgcaucuuccccgacaaguucgugcugaag

SEQ ID NO: 40064 - RNA, 27 nt, Artificial Sequence
  V-type proton ATPase subunit B, brain isoform (380-388)
cgcaucuuccccaaggagaugcugaag

SEQ ID NO: 40065 - RNA, 27 nt, Artificial Sequence
  COUP transcription factor 2 (293-301)
cgcaucuuccaggagcagguggagaag

SEQ ID NO: 40066 - RNA, 27 nt, Artificial Sequence
  BolA-like protein 3 (99-107)
cgcaucuucaccagcgugcccaagcgg

SEQ ID NO: 40067 - RNA, 30 nt, Artificial Sequence
  Serine/threonine-protein kinase PLK2 (71-80)
cgcaucaucguggaccccaccaccggcaag

SEQ ID NO: 40068 - RNA, 27 nt, Artificial Sequence
  Exostosin-2 (166-174)
cgcaucaaggagaccgcccaggccaug

SEQ ID NO: 40069 - RNA, 33 nt, Artificial Sequence
  Calcium-independent phospholipase A2-gamma (131-141)
cgcaucaagagcacccugaacuccgugagcaag

SEQ ID NO: 40070 - RNA, 33 nt, Artificial Sequence
  Inactive tyrosine-protein kinase 7 (630-640)
cgcauccuggaccccaccaagcucggcccgcgg

SEQ ID NO: 40071 - RNA, 33 nt, Artificial Sequence
  MORC family CW-type zinc finger protein 3 (659-669)
cgcauccuggagaugaacgacaaguacgugaag

SEQ ID NO: 40072 - RNA, 27 nt, Artificial Sequence
  Eukaryotic translation initiation factor 3 subunit C-like protein (507-515)
cgcauccugcacaccuacuacaaguuc

SEQ ID NO: 40073 - RNA, 30 nt, Artificial Sequence
  DNA polymerase alpha subunit B (497-506)
cgcauccugaagcacauccucacccagcgg

SEQ ID NO: 40074 - RNA, 27 nt, Artificial Sequence
  Chromodomain-helicase-DNA-binding protein 4 (623-631)
cgcauccugaaccacagcguggacaag

SEQ ID NO: 40075 - RNA, 27 nt, Artificial Sequence
  Catechol O-methyltransferase (58-66)
cgcauccugaaccacgugcuccagcac

SEQ ID NO: 40076 - RNA, 30 nt, Artificial Sequence
  Cleavage stimulation factor subunit 2 tau variant (180-189)
cgcaucauggaccccgagaucgcccugaag

SEQ ID NO: 40077 - RNA, 27 nt, Artificial Sequence
  Rho GTPase-activating protein 7 (278-286)
cgcaucaacgugcccaugguccggaag

SEQ ID NO: 40078 - RNA, 33 nt, Artificial Sequence
  Pleckstrin homology domain-containing family A member 5 (177-187)
cgcauccaggacgugauggagggccugagcaag

SEQ ID NO: 40079 - RNA, 27 nt, Artificial Sequence
  ATP-dependent RNA helicase DDX19B (454-462)
cgcauccaggagcacuucaacaagaag

SEQ ID NO: 40080 - RNA, 27 nt, Artificial Sequence
  Dolichyl-diphosphooligosaccharide-proteinosyltransferase subunit DAD1 (74-82)
cgcauccagaucaacccccagaacaag

SEQ ID NO: 40081 - RNA, 27 nt, Artificial Sequence
  Dynamin-like 120 kDa protein, mitochondrial (500-508)
cgcauccagcagaucaucgagggcaag

SEQ ID NO: 40082 - RNA, 33 nt, Artificial Sequence
  Coronin-2B (108-118)
cgcaucugggagauccccgagggcgggcugaag

SEQ ID NO: 40083 - RNA, 36 nt, Artificial Sequence
  Coronin-2B (113-124)
cgcaucugggagauccccgagggcgggcugaagcgg

SEQ ID NO: 40084 - RNA, 27 nt, Artificial Sequence
  E3 ubiquitin-protein ligase HECTD1 (480-488)
cgcaucugggagcccaccuacaccauc

SEQ ID NO: 40085 - RNA, 30 nt, Artificial Sequence
  Protein kinase C iota type (269-278)
cgcaucuacgccaugaagguggucaagaag

SEQ ID NO: 40086 - RNA, 30 nt, Artificial Sequence
  DNA dC-dU-editing enzyme APOBEC-3B (119-128)
cgcaucuacgacuacgacccccuguacaag

SEQ ID NO: 40087 - RNA, 36 nt, Artificial Sequence
  Fragile X mental retardation syndrome-related protein 1 (263-274)
cgcaucuacggcgagagcgccgacgccgugaagaag

SEQ ID NO: 40088 - RNA, 33 nt, Artificial Sequence
  Arpin (3-13)
cgcaucuaccacgacggcgcccugcggaacaag

SEQ ID NO: 40089 - RNA, 27 nt, Artificial Sequence
  Long-chain-fatty-acid-CoA ligase 3 (389-397)
cgcaucuacaagaacgugaugaacaag

SEQ ID NO: 40090 - RNA, 36 nt, Artificial Sequence
  Reticulon-1 (565-576)
cgcaucuacaagagcgugcugcaggccguccagaag

SEQ ID NO: 40091 - RNA, 27 nt, Artificial Sequence
  Protein MMS22-like (284-292)
cgcaucuacagcaaguuccaccagaag

SEQ ID NO: 40092 - RNA, 33 nt, Artificial Sequence
  Cytoplasmic dynein 1 heavy chain 1 (1603-1613)
cgccuggccgaccuccugggcaagauccagaag

SEQ ID NO: 40093 - RNA, 27 nt, Artificial Sequence
  NADH dehydrogenase (ubiquinone) 1 beta subcomplex subunit 4 (36-44)
cgccuggccauccgggcccagcucaag

SEQ ID NO: 40094 - RNA, 27 nt, Artificial Sequence
  Vacuolar protein sorting-associated protein 51 homolog (159-167)
cgccuggcccagcagcuccggcagcgc

SEQ ID NO: 40095 - RNA, 27 nt, Artificial Sequence
  Replication initiator 1 (39-47)
cgccuggccagccuccaguccgaggug

SEQ ID NO: 40096 - RNA, 27 nt, Artificial Sequence
  HEAT repeat-containing protein 2 (751-759)
cgccuggacgacgugagcaacgacguc

SEQ ID NO: 40097 - RNA, 27 nt, Artificial Sequence
  Arf-GAP with Rho-GAP domain, ANK repeat and PH domain-containing protein 1 (106-114)
cgccuggacaccgaccaccuccgguac

SEQ ID NO: 40098 - RNA, 30 nt, Artificial Sequence
  Centrosomal protein of 41 kDa (29-38)
cgccuggacaccggcaacagcaugaccaag

SEQ ID NO: 40099 - RNA, 27 nt, Artificial Sequence
  Protein flightless-1 homolog (672-680)
cgccuguucgccgagaagaucaacaag

SEQ ID NO: 40100 - RNA, 27 nt, Artificial Sequence
  Elongator complex protein 2 (264-272)
cgccuguucgcccccuggaagcggaag

SEQ ID NO: 40101 - RNA, 27 nt, Artificial Sequence
  NEDD8-conjugating enzyme Ubc12 (158-166)
cgccuguucgagcagaacgugcagcgg

SEQ ID NO: 40102 - RNA, 27 nt, Artificial Sequence
  Synaptonemal complex protein SC65 (104-112)
cgccuguucggccgggugcucgagcgc

SEQ ID NO: 40103 - RNA, 27 nt, Artificial Sequence
  Plectin (177-185)
cgccuguucaacgccaucauccaccgg

SEQ ID NO: 40104 - RNA, 30 nt, Artificial Sequence
  Transformation/transcription domain-associated protein (1453-1462)
cgccuguuccccaacagcuucaacgacaag

SEQ ID NO: 40105 - RNA, 30 nt, Artificial Sequence
  Zinc finger protein ZXDC (460-469)
cgccuguucaccagcaagcacuccaugaag

SEQ ID NO: 40106 - RNA, 27 nt, Artificial Sequence
  Insulin-degrading enzyme (683-691)
cgccugcacaucgaggcccuccugcac

SEQ ID NO: 40107 - RNA, 33 nt, Artificial Sequence
  Proteasome subunit alpha type-4 (20-30)
cgccugaucgcccagcgguaccuccugcaguac

SEQ ID NO: 40108 - RNA, 30 nt, Artificial Sequence
  Probable ATP-dependent RNA helicase DDX17 (304-313)
cgccugaucgacuuccucgagagcggcaag

SEQ ID NO: 40109 - RNA, 33 nt, Artificial Sequence
  General transcription factor 3C polypeptide 1 (377-387)
cgccugaucgagagccucuucaccauccagaag

SEQ ID NO: 40110 - RNA, 36 nt, Artificial Sequence
  Protein S100-A13 (77-88)
cgccugaucggcgagcucgccaaggagauccggaag

SEQ ID NO: 40111 - RNA, 33 nt, Artificial Sequence
  ATP synthase subunit a (41-51)
cgccugaucaccacccagcaguggcucaucaag

SEQ ID NO: 40112 - RNA, 33 nt, Artificial Sequence
  Peroxisomal multifunctional enzyme type 2 (634-644)
cgccugaaggacaucggccccgagguggucaag

SEQ ID NO: 40113 - RNA, 27 nt, Artificial Sequence
  Cardiolipin synthase (CMP-forming) (235-243)
cgccugaagcccaccuucaucagcaag

SEQ ID NO: 40114 - RNA, 36 nt, Artificial Sequence
  Eukaryotic translation initiation factor 3 subunit A (340-351)
cgccugcucgacauggacggcaucaucguggagaag

SEQ ID NO: 40115 - RNA, 27 nt, Artificial Sequence
  Oxidation resistance protein 1 (21-37)
cgccugcucgacagcgagaucaagcug

SEQ ID NO: 40116 - RNA, 30 nt, Artificial Sequence
  Mucosa-associated lymphoid tissue lymphoma translocation protein 1 (834-843)
cgccugcucgaggacaagaagaucaccgug

SEQ ID NO: 40117 - RNA, 33 nt, Artificial Sequence
  Condensin-2 complex subunit D3 (225-235)
cgccugcuccccaaguucagccugaaggagaag

SEQ ID NO: 40118 - RNA, 30 nt, Artificial Sequence
  Uridine-cytidine kinase-like 1 (31-40)
cgccugcuccccccggugggcaccgggcgg

SEQ ID NO: 40119 - RNA, 30 nt, Artificial Sequence
  Lymphokine-activated killer T-cell-originated protein kinase (81-90)
cgccugauggacgaggccaagauccucaag

SEQ ID NO: 40120 - RNA, 27 nt, Artificial Sequence
  GCN1 general control of amino-acid synthesis 1-like 1 (961-969)
cgccugauggagaucuaccaggagaag

SEQ ID NO: 40121 - RNA, 27 nt, Artificial Sequence
  RILP-like protein 1 (200-208)
cgccugaugaagaucaaccacgaccuc

SEQ ID NO: 40122 - RNA, 27 nt, Artificial Sequence
  Sperm-specific antigen 2 (294-302)
cgccugaugaagacccucagcaagcug

SEQ ID NO: 40123 - RNA, 27 nt, Artificial Sequence
  Glyoxylate reductase/hydroxypyruvate reductase (5-13)
cgccugaugaagguguucgucacccgg

SEQ ID NO: 40124 - RNA, 27 nt, Artificial Sequence
  Bombesin receptor-activated protein C6orf89 (119-127)
cgccugaugagccuccccaucgccaag

SEQ ID NO: 40125 - RNA, 30 nt, Artificial Sequence
  Fibronectin type-III domain-containing protein 3A (948-957)
cgccugaacgagagcaccuccuacaaguuc

SEQ ID NO: 40126 - RNA, 27 nt, Artificial Sequence
  DNA damage-binding protein 1 (1057-1065)
cgccugaacaaggugaucaagagcguc

SEQ ID NO: 40127 - RNA, 30 nt, Artificial Sequence
  Serine/threonine-protein phosphatase 2A 56 kDa regulatory subunit delta isoform (408-417)
cgccugaacccccaguacccgauguuccgg

SEQ ID NO: 40128 - RNA, 27 nt, Artificial Sequence
  Tuberin (712-720)
cgccugcccgagagccuccgguacaag

SEQ ID NO: 40129 - RNA, 27 nt, Artificial Sequence
  Poly (ADP-ribose) polymerase 10 (221-229)
cgccugcccggcccgcucgggaccgug

SEQ ID NO: 40130 - RNA, 30 nt, Artificial Sequence
  Lipase maturation factor 1 (191-200)
cgccugccccagcacaccccgaccagccgg

SEQ ID NO: 40131 - RNA, 27 nt, Artificial Sequence
  ER membrane protein complex subunit 7 (133-141)
cgccugcccuacccgcuccagaugaag

SEQ ID NO: 40132 - RNA, 30 nt, Artificial Sequence
  Guanine nucleotide-binding protein G(s) subunit alpha isoforms short (255-264)
cgccugcaggaggcccucaaccuguucaag

SEQ ID NO: 40133 - RNA, 27 nt, Artificial Sequence
  Syntaxin-18 (265-273)
cgccugcaggagaucuucaccgagaag

SEQ ID NO: 40134 - RNA, 27 nt, Artificial Sequence
  Pyridoxal-dependent decarboxylase domain-containing protein 1 (365-373)
cgccugcaggagagccucaagaaggug

SEQ ID NO: 40135 - RNA, 30 nt, Artificial Sequence
  Serine/threonine-protein kinase SIK2 (468-477)
cgccugcagaagcccagccuccuguccaag

SEQ ID NO: 40136 - RNA, 27 nt, Artificial Sequence
  ELAV-like protein 1 (85-93)
cgccugcagagcaagaccaucaaggug

SEQ ID NO: 40137 - RNA, 27 nt, Artificial Sequence
  E3 ubiquitin-protein ligase UBR5 (21-29)
cgccugcgggaggugagcgagaagcuc

SEQ ID NO: 40138 - RNA, 27 nt, Artificial Sequence
  Pituitary tumor-transforming gene 1 protein-interacting protein (14-22)
cgccugcggcucggcggggccgcccug

SEQ ID NO: 40139 - RNA, 27 nt, Artificial Sequence
  Serine/arginine-rich splicing factor 6 (8-16)
cgccugagcuacaacgugcgggagaag

SEQ ID NO: 40140 - RNA, 30 nt, Artificial Sequence
  DNA mismatch repair protein Mlh1 (265-274)
cgccugguggagagcaccucccuccggaag

SEQ ID NO: 40141 - RNA, 30 nt, Artificial Sequence
  E3 SUMO-protein ligase RanBP2 (170-179)
cgccugguggaggucuaccggagcaccaag

SEQ ID NO: 40142 - RNA, 27 nt, Artificial Sequence
  V-type proton ATPase subunit E 2 (44-52)
cgccuggugcagacccagcggcucaag

SEQ ID NO: 40143 - RNA, 27 nt, Artificial Sequence
  Sterol regulatory element-binding protein 2 (632-640)
cgccuggugcgguggcuccugaagaag

SEQ ID NO: 40144 - RNA, 27 nt, Artificial Sequence
  Protein disulfide-isomerase A3 (115-123)
cgccuguggcacauccagagcaagaag

SEQ ID NO: 40145 - RNA, 27 nt, Artificial Sequence
  Transducin beta-like protein 3 (102-110)
cgccuguggaaggccauccacaccgcc

SEQ ID NO: 40146 - RNA, 30 nt, Artificial Sequence
  GRAM domain-containing protein 1B (198-207)
cgccuguggcagaacgcccuccuggagaag

SEQ ID NO: 40147 - RNA, 30 nt, Artificial Sequence
  Inositol 1,4,5-trisphosphate receptor type 3 (801-810)
cgccuguggaccgagauccccaccgccauc

SEQ ID NO: 40148 - RNA, 27 nt, Artificial Sequence
  Annexin A5 (89-97)
cgccuguacgacgccuacgagcucaag

SEQ ID NO: 40149 - RNA, 30 nt, Artificial Sequence
  DNA damage-binding protein 1 (134-143)
cgccuguacgacggccucuucaaggugauc

SEQ ID NO: 40150 - RNA, 27 nt, Artificial Sequence
  Nesprin-1 (318-326)
cgccuguacgaccuccccgccaagcgg

SEQ ID NO: 40151 - RNA, 27 nt, Artificial Sequence
  Annexin A2 (273-281)
cgccuguacgacagcaugaagggcaag

SEQ ID NO: 40152 - RNA, 27 nt, Artificial Sequence
  DNA topoisomerase 3-alpha (407-415)
cgccuguacgaguucaucgugcggcac

SEQ ID NO: 40153 - RNA, 27 nt, Artificial Sequence
  Glutamine-tRNA ligase (679-687)
cgccuguacgagcggcucuuccagcac

SEQ ID NO: 40154 - RNA, 36 nt, Artificial Sequence
  Eukaryotic translation initiation factor 3 subunit A (172-183)
cgccuguaccacgacaucgcccagcaggccuucaag

SEQ ID NO: 40155 - RNA, 27 nt, Artificial Sequence
  GPI transamidase component PIG-T (503-511)
cgccuguacaccgagccccuccuggug

SEQ ID NO: 40156 - RNA, 27 nt, Artificial Sequence
  2-hydroxyacyl-CoA lyase 1 (135-143)
cgccuguacaccaaguucagcgcccgg

SEQ ID NO: 40157 - RNA, 24 nt, Artificial Sequence
  Uncharacterized protein (677-684)
cgccuguacgugggccgggagaag

SEQ ID NO: 40158 - RNA, 27 nt, Artificial Sequence
  Protein sel-1 homolog 3 (282-290)
cgcauggacuaccccguguucaccguc

SEQ ID NO: 40159 - RNA, 33 nt, Artificial Sequence
  Vimentin (13-23)
cgcauguucggcgggcccggcaccgccagccgg

SEQ ID NO: 40160 - RNA, 27 nt, Artificial Sequence
  Dynamin-1 (271-279)
cgcaugggcacccccuaccugcagaag

SEQ ID NO: 40161 - RNA, 27 nt, Artificial Sequence
  Eukaryotic translation initiation factor 3 subunit C-like protein (709-717)
cgcaugaucagcaagcaguuccaccac

SEQ ID NO: 40162 - RNA, 30 nt, Artificial Sequence
  Protein FAM208B (229-238)
cgcaugaaggaccccaccuuccugggcaag

SEQ ID NO: 40163 - RNA, 30 nt, Artificial Sequence
  UPF0585 protein C16orf13 (168-177)
cgcaugguggacaugcccgccaacaacaag

SEQ ID NO: 40164 - RNA, 27 nt, Artificial Sequence
  60S ribosomal protein L13a (117-125)
cgcauggugguccccgccgcccugaag

SEQ ID NO: 40165 - RNA, 27 nt, Artificial Sequence
  Cytoplasmic FMR1-interacting protein 1 (286-294)
cgcauguaccugacccccagcgagaag

SEQ ID NO: 40166 - RNA, 30 nt, Artificial Sequence
  Phosphatidate cytidylyltransferase 2 (307-316)
cgcauguaccccuuccagauccacagcauc

SEQ ID NO: 40167 - RNA, 27 nt, Artificial Sequence
  RNA cytidine acetyltransferase (629-637)
cgccccgccgagcggcuggacuaccuc

SEQ ID NO: 40168 - RNA, 27 nt, Artificial Sequence
  Cell division cycle protein 23 homolog (423-431)
cgccccaacgacagccggaugcuggug

SEQ ID NO: 40169 - RNA, 27 nt, Artificial Sequence
  Transgelin-2 (44-52)
cgcccccagccgggccgggagaacuuc

SEQ ID NO: 40170 - RNA, 30 nt, Artificial Sequence
  Myosin regulatory light polypeptide 9 (14-23)
cgcccccagcgggccaccagcaacguguuc

SEQ ID NO: 40171 - RNA, 27 nt, Artificial Sequence
  Pre-mRNA-splicing factor SYF1 (370-378)
cgcccccgggagaucaucaacaccuac

SEQ ID NO: 40172 - RNA, 30 nt, Artificial Sequence
  Trafficking protein particle complex subunit 4 (100-109)
cgcccccggcugaccagcaacgagaagcuc

SEQ ID NO: 40173 - RNA, 30 nt, Artificial Sequence
  Cytochrome c oxidase assembly factor 3 homolog, mitochondrial (39-48)
cgccaggccgagcuggcccaguggcagaag

SEQ ID NO: 40174 - RNA, 27 nt, Artificial Sequence
  Focal adhesion kinase 1 (476-484)
cgccaguucgaccacccccacaucgug

SEQ ID NO: 40175 - RNA, 33 nt, Artificial Sequence
  Acidic fibroblast growth factor intracellular-binding protein (136-146)
cgccaguucgacaacuucaagcggguguucaag

SEQ ID NO: 40176 - RNA, 33 nt, Artificial Sequence
  MICOS complex subunit MIC19 (130-140)
cgccagcuggaggagaaggaccgggugcucaag

SEQ ID NO: 40177 - RNA, 33 nt, Artificial Sequence
  40S ribosomal protein S29 (44-54)
cgccaguacgccaaggacaucggcuucaucaag

SEQ ID NO: 40178 - RNA, 30 nt, Artificial Sequence
  F-box only protein 33 (21-30)
cgccaguacgacaaguuccugacccacuuc

SEQ ID NO: 40179 - RNA, 27 nt, Artificial Sequence
  SH2B adapter protein 1 (560-568)
cgccggggcgaguacgugcugaccuuc

SEQ ID NO: 40180 - RNA, 27 nt, Artificial Sequence
  Multivesicular body subunit 12A (198-206)
cgccggaacgacagcaucuacgaggcc

SEQ ID NO: 40181 - RNA, 27 nt, Artificial Sequence
  Chloride intracellular channel protein 1 (50-58)
cgccggaccgagaccgugcagaagcug

SEQ ID NO: 40182 - RNA, 27 nt, Artificial Sequence
  Eukaryotic translation initiation factor 3 subunit L (327-335)
cgccgguaccaggacgccauccgcgug

SEQ ID NO: 40183 - RNA, 27 nt, Artificial Sequence
  Breast cancer metastasis-suppressor 1-like protein (255-263)
cgcagcgaggagggccggcuguacuac

SEQ ID NO: 40184 - RNA, 33 nt, Artificial Sequence
  Putative protein N-methyltransferase FAM86B1 (27-37)
cgcagcuuccccuggcagucccuggaggccaag

SEQ ID NO: 40185 - RNA, 33 nt, Artificial Sequence
  Dual specificity protein kinase CLK1 (60-70)
cgcagcaucaacgagaaggacuaccacucccgg

SEQ ID NO: 40186 - RNA, 33 nt, Artificial Sequence
  Transmembrane protein 209 (277-287)
cgcagcaugggcgacuacgcccagacccugaag

SEQ ID NO: 40187 - RNA, 27 nt, Artificial Sequence
  Annexin A11 (302-310)
cgcagcaacgagcacauccgggagcug

SEQ ID NO: 40188 - RNA, 27 nt, Artificial Sequence
  Cullin-associated NEDD8-dissociated protein 1 (758-766)
cgcagcaccgacuccauccggcugcuc

SEQ ID NO: 40189 - RNA, 27 nt, Artificial Sequence
  Non-structural maintenance of chromosomes element 4 homolog A (203-211)
cgcaccgccgagaacaccuucaacaag

SEQ ID NO: 40190 - RNA, 33 nt, Artificial Sequence
  Nephrocystin-1 (181-191)
cgcaccgacccccacuggagcgccgugcagaag

SEQ ID NO: 40191 - RNA, 30 nt, Artificial Sequence
  Arginine-glutamic acid dipeptide repeats protein (74-83)
cgcaccgacaccggcgagaucacgagcuac

SEQ ID NO: 40192 - RNA, 33 nt, Artificial Sequence
  Ectonucleoside triphosphate diphosphohydrolase 6 (319-329)
cgcaccgaggaggugaagcacgucgacuucuac

SEQ ID NO: 40193 - RNA, 36 nt, Artificial Sequence
  Protein LSM12 homolog (95-106)
cgcaccgagaaggaggagaagcugagccaggccuac

SEQ ID NO: 40194 - RNA, 30 nt, Artificial Sequence
  Tubulin-tyrosine ligase-like protein 12 (394-403)
cgcaccgagcugccccaguucgugagcuac

SEQ ID NO: 40195 - RNA, 27 nt, Artificial Sequence
  A-kinase anchor protein 13 (994-1002)
cgcaccuucagcuacaucaagaacaag

SEQ ID NO: 40196 - RNA, 36 nt, Artificial Sequence
  Biogenesis of lysosome-related organelles complex 1 subunit 1 (106-117)
cgcaccaucgccaccgcccuggaguacguguacaag

SEQ ID NO: 40197 - RNA, 27 nt, Artificial Sequence
  WASH complex subunit 7 (330-338)
cgcaccaucgacaagaaguucuacaag

SEQ ID NO: 40198 - RNA, 27 nt, Artificial Sequence
  Leucine-rich repeat-containing protein 57 (41-49)
cgcaccaucgaccugagcaacaacaag

SEQ ID NO: 40199 - RNA, 36 nt, Artificial Sequence
  DNA damage-binding protein 2 (181-192)
cgcaccaucgacguguucgacggcaacagcgggaag

SEQ ID NO: 40200 - RNA, 33 nt, Artificial Sequence
  F-box only protein 25 (19-29)
cgcaccauccuggagaugacccagauccucaag

SEQ ID NO: 40201 - RNA, 33 nt, Artificial Sequence
  DDB1- and CUL4-associated factor 4 (390-400)
cgcaccauccccagcccguaccccgccuccaag

SEQ ID NO: 40202 - RNA, 27 nt, Artificial Sequence
  Protein CEBPZOS (3-11)
cgcacccuggagccccucgccaagaag

SEQ ID NO: 40203 - RNA, 36 nt, Artificial Sequence
  Solute carrier family 22 member 18 (377-388)
cgcacccugggccccaccguggggggccuccuguac

SEQ ID NO: 40204 - RNA, 27 nt, Artificial Sequence
  Coatomer subunit gamma-2 (309-317)
cgcacccugaacaagguggccaugaag

SEQ ID NO: 40205 - RNA, 36 nt, Artificial Sequence
  Nuclear factor 1 C-type (82-93)
cgcacccugcccagcaccuccagcuccggcagcaag

SEQ ID NO: 40206 - RNA, 27 nt, Artificial Sequence
  Pinin (6-14)
cgcacccugcaggagcagcucgagaag

SEQ ID NO: 40207 - RNA, 33 nt, Artificial Sequence
  Ornithine decarboxylase antizyme 1 (32-42)
cgcaccaugccccugcucagccugcacucccgg

SEQ ID NO: 40208 - RNA, 27 nt, Artificial Sequence
  2,4-dienoyl-CoA reductase, mitochondrial (33-41)
cgcaccaacuucuucagcaacuggaag

SEQ ID NO: 40209 - RNA, 27 nt, Artificial Sequence
  Endoplasmic reticulum-Golgi intermediate compartment protein 3 (297-305)
cgcaccaaccaguucagcgugacccgg

SEQ ID NO: 40210 - RNA, 27 nt, Artificial Sequence
  RNA-binding protein 26 (515-523)
cgcaccaacagccccggcuuccagaag

SEQ ID NO: 40211 - RNA, 30 nt, Artificial Sequence
  Breast cancer type 2 susceptibility protein (2034-2043)
cgcacccccgagcaccugaucagccagaag

SEQ ID NO: 40212 - RNA, 27 nt, Artificial Sequence
  Short transient receptor potential channel 4-associated protein (364-372)
cgcacccagcugccccagagcaugaag

SEQ ID NO: 40213 - RNA, 33 nt, Artificial Sequence
  Signal recognition particle 14 kDa protein (21-31)
cgcaccagcggcuccguguacaucacccugaag

SEQ ID NO: 40214 - RNA, 27 nt, Artificial Sequence
  Histone-lysine N-methyltransferase 2A (1655-1663)
cgcaccaccagccaccugcuccgguac

SEQ ID NO: 40215 - RNA, 30 nt, Artificial Sequence
  Diphosphoinositol polyphosphate phosphohydrolase 3-alpha (9-18)
cgcaccuacgaccccgagggcuucaagaag

SEQ ID NO: 40216 - RNA, 33 nt, Artificial Sequence
  Transcription factor p65 (287-297)
cgcaccuacgagaccuucaagagcaucaugaag

SEQ ID NO: 40217 - RNA, 30 nt, Artificial Sequence
  Ras and Rab interactor 1 (442-451)
cgcaccuacagccccuccgcccaggugaag

SEQ ID NO: 40218 - RNA, 33 nt, Artificial Sequence
  Ras and Rab interactor 1 (442-452)
cgcaccuacagccccuccgcccaggugaagcgg

SEQ ID NO: 40219 - RNA, 33 nt, Artificial Sequence
  Acyl-CoA dehydrogenase family member 10 (557-567)
cgcguggccgccauccugcagggcgucuacaag

SEQ ID NO: 40220 - RNA, 33 nt, Artificial Sequence
  Cytochrome c oxidase subunit 7A-related protein, mitochondrial (26-36)
cgcguggcccccggccagcuggggcacgagaag

SEQ ID NO: 40221 - RNA, 27 nt, Artificial Sequence
  E3 ubiquitin-protein ligase TRIP12 (1581-1589)
cgcguggccccccggcuggaccgcaag

SEQ ID NO: 40222 - RNA, 33 nt, Artificial Sequence
  Coiled-coil domain-containing protein 115 (34-44)
cgcguggaggagggcuggcugagccucgccaag

SEQ ID NO: 40223 - RNA, 27 nt, Artificial Sequence
  Serine/threonine-protein kinase B-raf (158-166)
cgcguguuccugcccaacaagcagcgg

SEQ ID NO: 40224 - RNA, 33 nt, Artificial Sequence
  Coatomer subunit gamma-1 (32-42)
cgcguguucaacgagacccccaucaacccgcgg

SEQ ID NO: 40225 - RNA, 27 nt, Artificial Sequence
  Arf-GAP with GTPase, ANK repeat and PH domain-containing protein 3 (240-248)
cgcguguuccaggacgucgcccagaag

SEQ ID NO: 40226 - RNA, 30 nt, Artificial Sequence
  28S ribosomal protein S15, mitochondrial (238-247)
cgcguguuccaggagacccagaagcugaag

SEQ ID NO: 40227 - RNA, 33 nt, Artificial Sequence
  28S ribosomal protein S15, mitochondrial (238-248)
cgcguguuccaggagacccagaagcugaagaag

SEQ ID NO: 40228 - RNA, 27 nt, Artificial Sequence
  EH domain-containing protein 2 (305-313)
cgcgugcacgccuacaucaucagcuac

SEQ ID NO: 40229 - RNA, 30 nt, Artificial Sequence
  L-lactate dehydrogenase A chain (269-278)
cgcgugcaccccgucagcaccaugaucaag

SEQ ID NO: 40230 - RNA, 30 nt, Artificial Sequence
  E3 ubiquitin-protein ligase NEDD4 (24-33)
cgcgugaucgccggcaucgggcuggccaag

SEQ ID NO: 40231 - RNA, 27 nt, Artificial Sequence
  60S ribosomal protein L3 (156-164)
cgcgugaucgcccacacccagaugcgg

SEQ ID NO: 40232 - RNA, 27 nt, Artificial Sequence
  Lon protease homolog 2, peroxisomal (241-249)
cgcgugaucgccauccggcccauccgc

SEQ ID NO: 40233 - RNA, 27 nt, Artificial Sequence
  Ran GTPase-activating protein 1 (67-75)
cgcgugaucgccaaggcccuggagaag

SEQ ID NO: 40234 - RNA, 30 nt, Artificial Sequence
  SAFB-like transcription modulator (26-35)
cgcgugaucgaccugaagagcgagcucaag

SEQ ID NO: 40235 - RNA, 33 nt, Artificial Sequence
  Histone-binding protein RBBP7 (58-68)
cgcgugaucaacgaggaguacaagaucuggaag

SEQ ID NO: 40236 - RNA, 27 nt, Artificial Sequence
  Pumilio homolog 2 (311-319)
cgcgugauccagcggauccuggagcac

SEQ ID NO: 40237 - RNA, 33 nt, Artificial Sequence
  60S ribosomal protein L13 (167-177)
cgcgugaucaccgaggaggagaagaacuucaag

SEQ ID NO: 40238 - RNA, 36 nt, Artificial Sequence
  Cullin-4A (273-284)
cgcgugaucaccuaccuggaccacagcacccagaag

SEQ ID NO: 40239 - RNA, 30 nt, Artificial Sequence
  COX assembly mitochondrial protein 2 homolog (63-72)
cgcgugaucgucacccacggcagccugaag

SEQ ID NO: 40240 - RNA, 36 nt, Artificial Sequence
  Guanine nucleotide-binding protein G(I)/G(S)/G(O) subunit gamma-5 (25-36)
cgcgugaaggucagccaggccgccgcggaccugaag

SEQ ID NO: 40241 - RNA, 33 nt, Artificial Sequence
  Monofunctional C1-tetrahydrofolate synthase, mitochondrial (497-507)
cgcgugcuggacaccaacgaccgguuccuccgc

SEQ ID NO: 40242 - RNA, 27 nt, Artificial Sequence
  3-hydroxybutyrate dehydrogenase type 2 (55-63)
cgcgugcuggacgucaccaagaagaag

SEQ ID NO: 40243 - RNA, 30 nt, Artificial Sequence
  Cysteine-rich with EGF-like domain protein 1 (411-420)
cgcgugcuggagggcuucaucaaggggcgg

SEQ ID NO: 40244 - RNA, 36 nt, Artificial Sequence
  Serine hydroxymethyltransferase, mitochondrial (374-385)
cgcgugcuggagcucgucagcaucaccgccaacaag

SEQ ID NO: 40245 - RNA, 36 nt, Artificial Sequence
  Lon protease homolog 2, peroxisomal (308-319)
cgcgugcuggaguaccucgccguccggcagcugaag

SEQ ID NO: 40246 - RNA, 27 nt, Artificial Sequence
  Focadhesin (1784-1792)
cgcgugcugcccgaguucaagaagaag

SEQ ID NO: 40247 - RNA, 33 nt, Artificial Sequence
  Zinc finger MYM-type protein 1 (867-877)
cgcgugcugagcgucaccggcauccucuccaag

SEQ ID NO: 40248 - RNA, 27 nt, Artificial Sequence
  Exostosin-like 2 (12-20)
cgcgugaugggcauccggguccugcgc

SEQ ID NO: 40249 - RNA, 33 nt, Artificial Sequence
  Inner centromere protein (907-917)
cgcgugcccagcucccuggccuacagccucaag

SEQ ID NO: 40250 - RNA, 30 nt, Artificial Sequence
  DNA topoisomerase I, mitochondrial (376-385)
cgcgugcccgucgagaagccgguguacaag

SEQ ID NO: 40251 - RNA, 27 nt, Artificial Sequence
  6-phosphofructo-2-kinase/fructose-2,6-bisphosphatase 3 (43-51)
cgcgugcaggaccacauccagagccgg

SEQ ID NO: 40252 - RNA, 30 nt, Artificial Sequence
  Melanoma inhibitory activity protein 3 (1184-1193)
cgcgugcaggaggagaacgcccggcugaag

SEQ ID NO: 40253 - RNA, 27 nt, Artificial Sequence
  DNA replication licensing factor MCM3 (234-242)
cgcgugcaggucgugggcaccuaccgg

SEQ ID NO: 40254 - RNA, 42 nt, Artificial Sequence
  LysM and putative peptidoglycan-binding domain-containing protein 2 (74-87)
cgcgugcgggccggcgacacccugcaggggaucgcccucaag

SEQ ID NO: 40255 - RNA, 33 nt, Artificial Sequence
  Galectin-1 (11-21)
cgcgugcggggcgaggucgcccccgacgccaag

SEQ ID NO: 40256 - RNA, 27 nt, Artificial Sequence
  Protein phosphatase methylesterase 1 (228-236)
cgcgugagcauggucggccaggugaag

SEQ ID NO: 40257 - RNA, 30 nt, Artificial Sequence
  SLAIN motif-containing protein 2 (375-384)
cgcgugagcccccagccgaugaucucccgg

SEQ ID NO: 40258 - RNA, 27 nt, Artificial Sequence
  RNA-binding protein Raly (133-141)
cgcgugaccgucccccuggugcggcgc

SEQ ID NO: 40259 - RNA, 27 nt, Artificial Sequence
  5'-AMP-activated protein kinase subunit gamma-1 (236-244)
cgcguggucgacaucuacagcaaguuc

SEQ ID NO: 40260 - RNA, 27 nt, Artificial Sequence
  Clathrin heavy chain 1 (903-911)
cgcguggucggcaaguacugcgagaag

SEQ ID NO: 40261 - RNA, 30 nt, Artificial Sequence
  Coatomer subunit alpha (160-169)
cgcgugugggacaucagcggccugcggaag

SEQ ID NO: 40262 - RNA, 27 nt, Artificial Sequence
  SWI/SNF complex subunit SMARCC1 (56-64)
cgcguguggcugggcaagcacuacaag

SEQ ID NO: 40263 - RNA, 33 nt, Artificial Sequence
  Charged multivesicular body protein 1a (46-56)
cgcguguacgccgagaacgccauccggaagaag

SEQ ID NO: 40264 - RNA, 30 nt, Artificial Sequence
  WD repeat-containing protein 74 (208-217)
cgcguguacgaccccgccagcccgcagcgg

SEQ ID NO: 40265 - RNA, 30 nt, Artificial Sequence
  Protein Churchill (86-95)
cgcguguaccacgccgucagcgugaugcgg

SEQ ID NO: 40266 - RNA, 27 nt, Artificial Sequence
  Cytochrome c oxidase assembly protein COX14 (33-41)
cgcguguaccacuacuuccaguggcgg

SEQ ID NO: 40267 - RNA, 33 nt, Artificial Sequence
  Uncharacterized protein KIAA1522 (239-249)
cgcguguaccgggacgacaccuucgucggccgc

SEQ ID NO: 40268 - RNA, 27 nt, Artificial Sequence
  Poly(U)-binding-splicing factor PUF60 (112-120)
cgcguguacgucggcagcaucuacuac

SEQ ID NO: 40269 - RNA, 27 nt, Artificial Sequence
  Adipocyte plasma membrane-associated protein (296-304)
cgcguguacgucagcggccugaugaag

SEQ ID NO: 40270 - RNA, 33 nt, Artificial Sequence
  Histone-lysine N-methyltransferase 2A (2053-2063)
cgcguguacuggagcaccaccgacgcccggaag

SEQ ID NO: 40271 - RNA, 33 nt, Artificial Sequence
  60S ribosome subunit biogenesis protein NIP7 homolog (43-53)
cgcguguacuacgucagcgagaagaucaugaag

SEQ ID NO: 40272 - RNA, 27 nt, Artificial Sequence
  Kinesin-like protein KIF2C (467-475)
cgcuacgccgaccgggugaaggagcug

SEQ ID NO: 40273 - RNA, 30 nt, Artificial Sequence
  Protein-cysteine N-palmitoyltransferase HHAT (337-346)
cgcuacuucgacgugggccugcacaacuuc

SEQ ID NO: 40274 - RNA, 27 nt, Artificial Sequence
  von Willebrand factor A domain-containing protein 8 (1836-1844)
cgcuacggcauccaccccgccaaguuc

SEQ ID NO: 40275 - RNA, 27 nt, Artificial Sequence
  Serine/threonine-protein kinase PLK2 (271-279)
cgcuacaucgacacccacaaccgggug

SEQ ID NO: 40276 - RNA, 27 nt, Artificial Sequence
  Deoxyguanosine kinase, mitochondrial (148-156)
cgcuacaucuucgccaagaaccuguuc

SEQ ID NO: 40277 - RNA, 27 nt, Artificial Sequence
  Rho GTPase-activating protein 35 (208-216)
cgcuacauccgggacgcccacaccuuc

SEQ ID NO: 40278 - RNA, 27 nt, Artificial Sequence
  Structural maintenance of chromosomes protein 5 (245-253)
cgcuacaagcaggacguggagcgguuc

SEQ ID NO: 40279 - RNA, 33 nt, Artificial Sequence
  Tumor suppressor candidate 3 (18-28)
cgcuaccugcccaccggcagcuucccguuccuc

SEQ ID NO: 40280 - RNA, 27 nt, Artificial Sequence
  Potassium voltage-gated channel subfamily G member 1 (168-176)
cgcuaccugcagaagaucgaggaguuc

SEQ ID NO: 40281 - RNA, 27 nt, Artificial Sequence
  Cell division cycle protein 16 homolog (320-328)
cgcuaccugagcaaggccaccacccuc

SEQ ID NO: 40282 - RNA, 27 nt, Artificial Sequence
  Histone-binding protein RBBP7 (130-138)
cgcuacaugccccagaacccgcacauc

SEQ ID NO: 40283 - RNA, 27 nt, Artificial Sequence
  Kelch-like protein 24 (592-600)
cgcuacaacgagaagugcuucaagcug

SEQ ID NO: 40284 - RNA, 27 nt, Artificial Sequence
  Kelch-like protein 20 (478-486)
cgcuacaacccccggaccaaccagugg

SEQ ID NO: 40285 - RNA, 27 nt, Artificial Sequence
  Thyroid transcription factor 1-associated protein 26 (88-96)
cgcuaccccgacaaccugaagcaccuc

SEQ ID NO: 40286 - RNA, 30 nt, Artificial Sequence
  Thyroid transcription factor 1-associated protein 26 (88-97)
cgcuaccccgacaaccugaagcaccucuac

SEQ ID NO: 40287 - RNA, 27 nt, Artificial Sequence
  Serine/threonine-protein phosphatase 4 catalytic subunit (103-111)
cgcuaccccgaccggaucacccugauc

SEQ ID NO: 40288 - RNA, 27 nt, Artificial Sequence
  Lysophosphatidylcholine acyltransferase 1 (98-106)
cgcuaccccaacaagcuggacaccauc

SEQ ID NO: 40289 - RNA, 30 nt, Artificial Sequence
  CCR4-NOT transcription complex subunit 1 (438-447)
cgcuaccccaacagccacacccacuacuuc

SEQ ID NO: 40290 - RNA, 27 nt, Artificial Sequence
  Uncharacterized protein C1orf43 (178-186)
cgcuaccaggaggcccugagcgagcuc

SEQ ID NO: 40291 - RNA, 27 nt, Artificial Sequence
  YTH domain-containing protein 1 (550-558)
cgcuaccaggagguggaccggcgcuuc

SEQ ID NO: 40292 - RNA, 27 nt, Artificial Sequence
  High affinity cationic amino acid transporter 1 (419-427)
cgcuaccagcccgagcagccgaaccug

SEQ ID NO: 40293 - RNA, 27 nt, Artificial Sequence
  Centrosomal protein of 89 kDa (331-339)
cgcuaccagaccaaguuccggcaccug

SEQ ID NO: 40294 - RNA, 27 nt, Artificial Sequence
  Leucine zipper putative tumor suppressor 1 (36-44)
cgcuacagcgacggccugcuccgguuc

SEQ ID NO: 40295 - RNA, 27 nt, Artificial Sequence
  Myotubularin related protein 6 (594-602)
cgcuacagcgaguacgccgaggaguuc

SEQ ID NO: 40296 - RNA, 27 nt, Artificial Sequence
  Rap guanine nucleotide exchange factor 6 (57-65)
cgcuacagcggcaaccaggugcuguuc

SEQ ID NO: 40297 - RNA, 27 nt, Artificial Sequence
  Cation-independent mannose-6-phosphate receptor (1582-1590)
cgcuacguggaccagguccugcagcuc

SEQ ID NO: 40298 - RNA, 27 nt, Artificial Sequence
  Calpain-5 (466-474)
cgcuacgugaucauccccaccaccuuc

SEQ ID NO: 40299 - RNA, 27 nt, Artificial Sequence
  Histone-lysine N-methyltransferase EHMT2 (935-943)
cgcuacuacggcaacaucagccgguuc

SEQ ID NO: 40300 - RNA, 30 nt, Artificial Sequence
  Myosin-9 (104-113)
cgcuacuacagcggccugaucuacaccuac

SEQ ID NO: 40301 - RNA, 27 nt, Artificial Sequence
  Fanconi anemia group C protein (413-421)
agcgccgccgagcccccgaccgcgcug

SEQ ID NO: 40302 - RNA, 27 nt, Artificial Sequence
  V-type proton ATPase 16 kDa proteolipid subunit (20-28)
agcgccgccaugguguucuccgcgcug

SEQ ID NO: 40303 - RNA, 27 nt, Artificial Sequence
  Factor VIII intron 22 protein (251-259)
agcgccgcccccuccccggcggcccug

SEQ ID NO: 40304 - RNA, 27 nt, Artificial Sequence
  Phosphoacetylglucosamine mutase (515-523)
agcgccgaccaccuggcccacgaggug

SEQ ID NO: 40305 - RNA, 27 nt, Artificial Sequence
  Melanoma-associated antigen 1 (62-70)
agcgccuuccccaccaccaucaacuuc

SEQ ID NO: 40306 - RNA, 27 nt, Artificial Sequence
  Multiple epidermal growth factor-like domains protein 8 (745-753)
agcgccggccccgggcacuccgagcug

SEQ ID NO: 40307 - RNA, 27 nt, Artificial Sequence
  AT-rich interactive domain-containing protein 2 (319-327)
agcgcccacucccacuucaucagccug

SEQ ID NO: 40308 - RNA, 27 nt, Artificial Sequence
  ADP-ribosylation factor GTPase-activating protein 3 (167-175)
agcgccaucgccgagcccuccagccug

SEQ ID NO: 40309 - RNA, 27 nt, Artificial Sequence
  Catenin alpha-1 (366-374)
agcgccaucgacaagaugaccaagaag

SEQ ID NO: 40310 - RNA, 27 nt, Artificial Sequence
  COBW domain-containing protein 5 (82-90)
agcgcccuggagaagucccucgccgug

SEQ ID NO: 40311 - RNA, 36 nt, Artificial Sequence
  Vimentin (42-53)
agcgcccugcgccccuccaccagccggucccucuac

SEQ ID NO: 40312 - RNA, 30 nt, Artificial Sequence
  Putative annexin A2-like protein (89-98)
agcgcccuguccggccaccucgagaccgug

SEQ ID NO: 40313 - RNA, 27 nt, Artificial Sequence
  Ran GTPase-activating protein 1 (174-182)
agcgcccagggcaagccccuggcccuc

SEQ ID NO: 40314 - RNA, 27 nt, Artificial Sequence
  Protein virilizer homolog (804-812)
agcgccgugggccacgucuucucccug

SEQ ID NO: 40315 - RNA, 27 nt, Artificial Sequence
  MICAL-like protein 2 (424-432)
agcgccgugcccccgggcaccucccug

SEQ ID NO: 40316 - RNA, 30 nt, Artificial Sequence
  Eukaryotic peptide chain release factor GTP-binding subunit ERF3A (27-36)
agcgaggccgagcccggcgggggcucccug

SEQ ID NO: 40317 - RNA, 27 nt, Artificial Sequence
  Neuron navigator 2 (1899-1907)
agcgaggccgagaccgugaugcagcug

SEQ ID NO: 40318 - RNA, 27 nt, Artificial Sequence
  Transportin-1 (59-67)
agcgaggacgagcccacccgcucccug

SEQ ID NO: 40319 - RNA, 27 nt, Artificial Sequence
  Zinc finger protein 217 (77-85)
agcgaggaccugaacaagcacgugcuc

SEQ ID NO: 40320 - RNA, 27 nt, Artificial Sequence
  Vacuolar protein sorting-associated protein 35 (500-508)
agcgaggaccccgaccagcaguaccug

SEQ ID NO: 40321 - RNA, 30 nt, Artificial Sequence
  Protein CASC3 (106-115)
agcgaggaggagaacuccaagguggagcug

SEQ ID NO: 40322 - RNA, 27 nt, Artificial Sequence
  Ribosome biogenesis protein BOP1 (459-467)
agcgaggaggagcgccaggugggccug

SEQ ID NO: 40323 - RNA, 27 nt, Artificial Sequence
  GPI-anchor transamidase (176-184)
agcgaggagaucaccaacaucgagcug

SEQ ID NO: 40324 - RNA, 30 nt, Artificial Sequence
  Tyrosine-protein kinase JAK1 (600-609)
agcgaggagaagaagaucaaggugauccug

SEQ ID NO: 40325 - RNA, 27 nt, Artificial Sequence
  DNA mismatch repair protein Msh2 (900-908)
agcgaggagaacaucaccaucaagcug

SEQ ID NO: 40326 - RNA, 27 nt, Artificial Sequence
  Selenocysteine insertion sequence-binding protein 2 (597-605)
agcgaggagcccccgggcaccgagcug

SEQ ID NO: 40327 - RNA, 33 nt, Artificial Sequence
  Rac GTPase-activating protein 1 (44-54)
agcgaggagcagaaguccgcccuggccuuccuc

SEQ ID NO: 40328 - RNA, 30 nt, Artificial Sequence
  X-ray repair cross-complementing protein 5 (546-555)
agcgaggagcagcgcuucaacaacuuccug

SEQ ID NO: 40329 - RNA, 27 nt, Artificial Sequence
  Caspase-8 (168-176)
agcgaggaggugucccgcagcgagcug

SEQ ID NO: 40330 - RNA, 27 nt, Artificial Sequence
  E3 ubiquitin-protein ligase UBR5 (2161-2169)
agcgagggccccccgcugaccuccuuc

SEQ ID NO: 40331 - RNA, 36 nt, Artificial Sequence
  Basigin (49-60)
agcgagcacaucaacgagggcgagaccgccaugcug

SEQ ID NO: 40332 - RNA, 33 nt, Artificial Sequence
  Kinesin-like protein KIF20A (608-618)
agcgagcaccuggacacccagaaggagcuccug

SEQ ID NO: 40333 - RNA, 33 nt, Artificial Sequence
  La-related protein 4 (384-394)
agcgagcacuccaccgagggcagcgugucccug

SEQ ID NO: 40334 - RNA, 39 nt, Artificial Sequence
  AP-1 complex subunit beta-1 (185-197)
agcgagaucgccgagucccaccccagcuccaaccugcuc

SEQ ID NO: 40335 - RNA, 30 nt, Artificial Sequence
  Endothelial PAS domain-containing protein 1 (345-354)
agcgagaucgagaagaacgacguggucuuc

SEQ ID NO: 40336 - RNA, 33 nt, Artificial Sequence
  Centrosomal protein of 170 kDa (569-579)
agcgagaucggcgagaagcaggacaccgagcug

SEQ ID NO: 40337 - RNA, 30 nt, Artificial Sequence
  Protein OS-9 (136-145)
agcgagaucaagggcgaggugcuguaccuc

SEQ ID NO: 40338 - RNA, 33 nt, Artificial Sequence
  BCL-6 corepressor (765-775)
agcgagauccuggagaccuccagcaccaagcuc

SEQ ID NO: 40339 - RNA, 39 nt, Artificial Sequence
  AP-2 complex subunit beta (185-197)
agcgagaucuccgagagccaccccaacuccaaccugcuc

SEQ ID NO: 40340 - RNA, 30 nt, Artificial Sequence
  E3 ubiquitin-protein ligase UBR4 (365-374)
agcgagaucaccgaccccgaguccuuccug

SEQ ID NO: 40341 - RNA, 30 nt, Artificial Sequence
  Centrin-1 (98-107)
agcgagaaggacaccaaggaggagauccug

SEQ ID NO: 40342 - RNA, 30 nt, Artificial Sequence
  Ubiquitin carboxyl-terminal hydrolase 43 (210-219)
agcgagaagcugcccccggaggccaccaag

SEQ ID NO: 40343 - RNA, 27 nt, Artificial Sequence
  Spatacsin (742-750)
agcgagcugcucaagaacaugggcuuc

SEQ ID NO: 40344 - RNA, 27 nt, Artificial Sequence
  Nuclear pore complex protein Nup155 (1180-1188)
agcgagcugauggacaucaccaagcuc

SEQ ID NO: 40345 - RNA, 30 nt, Artificial Sequence
  WD repeat-containing protein 43 (123-132)
agcgagaacaaggaggagcccgugaagcug

SEQ ID NO: 40346 - RNA, 30 nt, Artificial Sequence
  Caspase recruitment domain-containing protein 19 (24-33)
agcgagcagcagguggaccgcaucauccug

SEQ ID NO: 40347 - RNA, 30 nt, Artificial Sequence
  Protein deglycase DJ-1 (83-92)
agcgaguccgccgccgugaaggagauccug

SEQ ID NO: 40348 - RNA, 33 nt, Artificial Sequence
  Coatomer subunit gamma-1 (429-439)
agcgaguccaaggagaccggccugagccaccuc

SEQ ID NO: 40349 - RNA, 27 nt, Artificial Sequence
  Probable ubiquitin carboxyl-terminal hydrolase FAF-X (1855-1863)
agcgagaccgccggcuccaccaaguac

SEQ ID NO: 40350 - RNA, 30 nt, Artificial Sequence
  Homocysteine-responsive endoplasmic reticulum-resident ubiquitin-like domain member 1 protein (3-12)
agcgagaccgagcccgagccggugacccug

SEQ ID NO: 40351 - RNA, 27 nt, Artificial Sequence
  DNA-dependent protein kinase catalytic subunit (1564-1572)
agcgagaccaucaacaccgagcugcuc

SEQ ID NO: 40352 - RNA, 30 nt, Artificial Sequence
  Adipocyte plasma membrane-associated protein (402-411)
agcgaggugcacgagcacgacggccaccug

SEQ ID NO: 40353 - RNA, 27 nt, Artificial Sequence
  Ubiquitin-like modifier-activating enzyme 1 (251-259)
agcgaggugcagggcauggucgagcug

SEQ ID NO: 40354 - RNA, 33 nt, Artificial Sequence
  Zinc finger and BTB domain-containing protein 2 (491-501)
agcgaggugaccgagcccgaccacccgguccug

SEQ ID NO: 40355 - RNA, 30 nt, Artificial Sequence
  60S ribosomal protein L28 (37-46)
agcuuccgcuacaacggccugauccaccgg

SEQ ID NO: 40356 - RNA, 27 nt, Artificial Sequence
  Prelamin-A/C (424-432)
agcggcgaccccgccgaguacaaccug

SEQ ID NO: 40357 - RNA, 27 nt, Artificial Sequence
  Replication protein A 70 kDa DNA-binding subunit (149-157)
agcggcaugggguccaccgugagcaag

SEQ ID NO: 40358 - RNA, 27 nt, Artificial Sequence
  Exocyst complex component 4 (448-456)
agccacgccaucuccaugagcgccuac

SEQ ID NO: 40359 - RNA, 27 nt, Artificial Sequence
  Unconventional myosin-Ib (546-554)
agccacgcccugaucaagucccucuuc

SEQ ID NO: 40360 - RNA, 27 nt, Artificial Sequence
  Transcription factor 4 (246-254)
agccacaucccccaguccagcuccuac

SEQ ID NO: 40361 - RNA, 27 nt, Artificial Sequence
  Dual specificity mitogen-activated protein kinase kinase 1 (86-94)
agccacaagcccuccggccuggugaug

SEQ ID NO: 40362 - RNA, 27 nt, Artificial Sequence
  Rho-related GTP-binding protein RhoE (218-226)
agccacaugcccucccgcccggagcug

SEQ ID NO: 40363 - RNA, 27 nt, Artificial Sequence
  Reticulon-3 (10-18)
agccacuccaucagcuccagcuccuuc

SEQ ID NO: 40364 - RNA, 27 nt, Artificial Sequence
  Aminoacylase-1 (79-87)
agccacaccgacgugguccccguguuc

SEQ ID NO: 40365 - RNA, 27 nt, Artificial Sequence
  Sialin (259-267)
agccacuacgagaaggaguacauccug

SEQ ID NO: 40366 - RNA, 27 nt, Artificial Sequence
  Solute carrier family 35 member C2 (273-281)
agcaucgccggcaucuucaaggaggug

SEQ ID NO: 40367 - RNA, 27 nt, Artificial Sequence
  40S ribosomal protein S4, X isoform (72-80)
agcaucgacaagaccggcgagaacuuc

SEQ ID NO: 40368 - RNA, 33 nt, Artificial Sequence
  YTH domain-containing family protein 1 (434-444)
agcaucuucgacgacuucgcccacuacgagaag

SEQ ID NO: 40369 - RNA, 33 nt, Artificial Sequence
  YTH domain-containing family protein 2 (707-717)
agcaucuucgacgacuucucccacuacgagaag

SEQ ID NO: 40370 - RNA, 27 nt, Artificial Sequence
  Transmembrane emp24 domain-containing protein 7 (192-200)
agcaucggccagguguuccugcucaag

SEQ ID NO: 40371 - RNA, 27 nt, Artificial Sequence
  Kit ligand (99-107)
agcaucaucgacaagcuggugaacauc

SEQ ID NO: 40372 - RNA, 27 nt, Artificial Sequence
  Heat shock protein HSP 90-alpha (763-771)
agcaucaucgagacccugcgccagaag

SEQ ID NO: 40373 - RNA, 36 nt, Artificial Sequence
  Poly(rC)-binding protein 2 (27-38)
agcaucaucggcaagaagggggaguccgugaagaag

SEQ ID NO: 40374 - RNA, 27 nt, Artificial Sequence
  NADH dehydrogenase (ubiquinone) 1 alpha subcomplex subunit 13 (40-48)
agcaucaugaaguggaaccgcgagcgg

SEQ ID NO: 40375 - RNA, 27 nt, Artificial Sequence
  Sterol regulatory element-binding protein 1 (338-346)
agcaucaacgacaagaucaucgagcug

SEQ ID NO: 40376 - RNA, 30 nt, Artificial Sequence
  Ubiquitin-associated protein 2-like (325-334)
agcaucccccagaagccgcagaccaacaag

SEQ ID NO: 40377 - RNA, 33 nt, Artificial Sequence
  Alkyldihydroxyacetonephosphate synthase, peroxisomal (630-640)
agcaucuccgacgugggcuucgggaugcugaag

SEQ ID NO: 40378 - RNA, 27 nt, Artificial Sequence
  Progressive ankylosis protein homolog (165-173)
agcaucuccgacgugaucgcccagguc

SEQ ID NO: 40379 - RNA, 36 nt, Artificial Sequence
  Insulin-like growth factor 2 mRNA-binding protein 2 (181-192)
agcaucuacaaccccgagcgcaccaucaccgugaag

SEQ ID NO: 40380 - RNA, 33 nt, Artificial Sequence
  Fibronectin type III domain-containing protein 3B (555-565)
agcaucuaccgcggccccucccacaccuacaag

SEQ ID NO: 40381 - RNA, 30 nt, Artificial Sequence
  Nuclear receptor coactivator 3 (336-345)
agccuggccgacggcaccaucgugaccgcc

SEQ ID NO: 40382 - RNA, 27 nt, Artificial Sequence
  Calmodulin-regulated spectrin-associated protein 2 (271-279)
agccuggccgacucccucuacaaccug

SEQ ID NO: 40383 - RNA, 30 nt, Artificial Sequence
  ATPase family AAA domain-containing protein 2 (410-419)
agccuggccgacguggaccccaugcagcuc

SEQ ID NO: 40384 - RNA, 27 nt, Artificial Sequence
  Wiskott-Aldrich syndrome protein family member 2 (67-75)
agccuggccgagcgcguggaccggcuc

SEQ ID NO: 40385 - RNA, 27 nt, Artificial Sequence
  Histone H1x (66-74)
agccuggccaagaucuacaccgaggcc

SEQ ID NO: 40386 - RNA, 27 nt, Artificial Sequence
  Discoidin, CUB and LCCL domain-containing protein 2 (222-230)
agccuggccaacaacgugaccuccguc

SEQ ID NO: 40387 - RNA, 36 nt, Artificial Sequence
  Prohibitin (227-238)
agccuggccaccgccggcgacgggcucaucgagcug

SEQ ID NO: 40388 - RNA, 27 nt, Artificial Sequence
  Arf-GAP with Rho-GAP domain, ANK repeat and PH domain-containing protein 3 (220-228)
agccuggaccagcccuuccucuccaag

SEQ ID NO: 40389 - RNA, 27 nt, Artificial Sequence
  Transcription intermediary factor 1-beta (265-273)
agccuggaccagcccggcgggacccuc

SEQ ID NO: 40390 - RNA, 27 nt, Artificial Sequence
  Dolichyl-diphosphooligosaccharide-proteinosyltransferase subunit 2 (40-48)
agccuggaccgccccuucaccaaccuc

SEQ ID NO: 40391 - RNA, 30 nt, Artificial Sequence
  Spatacsin (1958-1967)
agccuggacucccagaaguucgugaccguc

SEQ ID NO: 40392 - RNA, 27 nt, Artificial Sequence
  Mothers against decapentaplegic homolog 6 (187-195)
agccuggacacccuccuggaggccgug

SEQ ID NO: 40393 - RNA, 30 nt, Artificial Sequence
  Activating transcription factor 7-interacting protein 2 (272-281)
agccuggacaccaacaacaacucccacuac

SEQ ID NO: 40394 - RNA, 27 nt, Artificial Sequence
  Transcription factor E2-alpha (165-173)
agccuggacacccagcccaagaaggug

SEQ ID NO: 40395 - RNA, 30 nt, Artificial Sequence
  Transformation/transcription domain-associated protein (976-985)
agccuggaggacaacaagcacgcccucuac

SEQ ID NO: 40396 - RNA, 30 nt, Artificial Sequence
  Probable E3 ubiquitin-protein ligase HERC6 (177-186)
agccuggagggcaucccccucgcccaggug

SEQ ID NO: 40397 - RNA, 27 nt, Artificial Sequence
  Uncharacterized protein C17orf112 (97-105)
agccuggagcucgaccccccgucccug

SEQ ID NO: 40398 - RNA, 27 nt, Artificial Sequence
  Transmembrane emp24 domain-containing protein 9 (130-138)
agccuguucgccggcgggaugcuccgc

SEQ ID NO: 40399 - RNA, 30 nt, Artificial Sequence
  Splicing factor 3A subunit 3 (299-308)
agccuguucgccaagaaccccaaguccaag

SEQ ID NO: 40400 - RNA, 27 nt, Artificial Sequence
  Probable E3 ubiquitin-protein ligase HECTD4 (550-558)
agccuguucggcgggaccuccggccuc

SEQ ID NO: 40401 - RNA, 27 nt, Artificial Sequence
  ADP-ribosylation factor 4 (7-15)
agccuguucucccgccucuucggcaag

SEQ ID NO: 40402 - RNA, 30 nt, Artificial Sequence
  Leukocyte tyrosine kinase receptor (149-158)
agccugggccucggggagucccuguacauc

SEQ ID NO: 40403 - RNA, 30 nt, Artificial Sequence
  PRELI domain containing protein 3A (115-124)
agccugggcuccuaccucgagagccugaug

SEQ ID NO: 40404 - RNA, 33 nt, Artificial Sequence
  Epidermal growth factor receptor kinase substrate 8 (115-125)
agccugaucgaccucgaguccaagaacgagcug

SEQ ID NO: 40405 - RNA, 30 nt, Artificial Sequence
  Sugar phosphate exchanger 3 (370-379)
agccugaucggcuacucccucuucagcgug

SEQ ID NO: 40406 - RNA, 27 nt, Artificial Sequence
  Type I inositol 3,4-bisphosphate 4-phosphatase (107-115)
agccugaucaaccagaugacccaggug

SEQ ID NO: 40407 - RNA, 27 nt, Artificial Sequence
  Kinectin (369-377)
agccugaaggcccacgugcaggagguc

SEQ ID NO: 40408 - RNA, 27 nt, Artificial Sequence
  Dolichyl-diphosphooligosaccharide-proteinosyltransferase 48 kDa subunit (66-74)
agccugaaggaccgcggcuucgagcuc

SEQ ID NO: 40409 - RNA, 27 nt, Artificial Sequence
  Gamma-interferon-inducible protein 16 (248-256)
agccugaaggagaaguucaacggcaag

SEQ ID NO: 40410 - RNA, 27 nt, Artificial Sequence
  KN motif and ankyrin repeat domain-containing protein 1 (464-472)
agccugaaggagaagaucuaccgccuc

SEQ ID NO: 40411 - RNA, 30 nt, Artificial Sequence
  Histone-lysine N-methyltransferase NSD2 (177-186)
agccugcucgagcagggccugguggaggcc

SEQ ID NO: 40412 - RNA, 36 nt, Artificial Sequence
  TSC22 domain family protein 1 (28-39)
agccugcucggcaccgagaacgccuccgugcgccug

SEQ ID NO: 40413 - RNA, 36 nt, Artificial Sequence
  Homocysteine-responsive endoplasmic reticulum-resident ubiquitin-like domain member 1 protein (221-232)
agccugcuccccgagggcccgcccgccaucgccaac

SEQ ID NO: 40414 - RNA, 27 nt, Artificial Sequence
  Ankyrin repeat and KH domain-containing protein 1 (2544-2552)
agccugcuccccuccgugccggcccug

SEQ ID NO: 40415 - RNA, 27 nt, Artificial Sequence
  E3 ubiquitin-protein ligase TRIM38 (21-29)
agccugaugaccaaccccguguccauc

SEQ ID NO: 40416 - RNA, 27 nt, Artificial Sequence
  Coiled-coil domain-containing protein 93 (321-329)
agccugaacaagcagaucgcccagaag

SEQ ID NO: 40417 - RNA, 27 nt, Artificial Sequence
  Deubiquitinating protein VCIP135 (181-189)
agccugaacuccaacguguacgacguc

SEQ ID NO: 40418 - RNA, 27 nt, Artificial Sequence
  Disintegrin and metalloproteinase domain-containing protein 10 (100-108)
agccugaacaccggcaucaucaccgug

SEQ ID NO: 40419 - RNA, 27 nt, Artificial Sequence
  E3 ubiquitin-protein ligase BRE1B (149-157)
agccugcagaaccacaaccaccagcuc

SEQ ID NO: 40420 - RNA, 27 nt, Artificial Sequence
  DNA primase small subunit (265-273)
agccugcagcgcugggagcaccucaag

SEQ ID NO: 40421 - RNA, 27 nt, Artificial Sequence
  Integrin alpha-3 (452-460)
agccuguccgaccacaucgugcuccug

SEQ ID NO: 40422 - RNA, 27 nt, Artificial Sequence
  Pleckstrin homology-like domain family B member 2 (117-125)
agccuguccggcuacccccucgggcgc

SEQ ID NO: 40423 - RNA, 27 nt, Artificial Sequence
  GDH/6PGL endoplasmic bifunctional protein (741-749)
agccugucccucccccugaucaaccgc

SEQ ID NO: 40424 - RNA, 36 nt, Artificial Sequence
  26S proteasome non-ATPase regulatory subunit 3 (262-273)
agccuguacgaccaggccgagaagcucguguccaag

SEQ ID NO: 40425 - RNA, 27 nt, Artificial Sequence
  Delta(24)-sterol reductase (399-407)
agccuguaccacaagcuccgcgagaag

SEQ ID NO: 40426 - RNA, 39 nt, Artificial Sequence
  D-beta-hydroxybutyrate dehydrogenase, mitochondrial (246-258)
agccuguacucccccgagagcauccaggccaucgccaag

SEQ ID NO: 40427 - RNA, 27 nt, Artificial Sequence
  TATA box-binding protein-associated factor RNA polymerase I subunit B (255-263)
agccuguacuggcucuccacccagaag

SEQ ID NO: 40428 - RNA, 27 nt, Artificial Sequence
  Bifunctional 3'-phosphoadenosine 5'-phosphosulfate synthase 2 (537-545)
agcauggcccccggccugaccuccgug

SEQ ID NO: 40429 - RNA, 27 nt, Artificial Sequence
  Protein SON (1023-1031)
agcaugaugucccccauggccgagcgc

SEQ ID NO: 40430 - RNA, 27 nt, Artificial Sequence
  Small nuclear ribonucleoprotein Sm D1 (35-43)
agcaugaacacccaccugaaggccgug

SEQ ID NO: 40431 - RNA, 27 nt, Artificial Sequence
  Ubiquitin carboxyl-terminal hydrolase isozyme L5 (131-139)
agcaacuccgacgugauccgccagguc

SEQ ID NO: 40432 - RNA, 27 nt, Artificial Sequence
  Chloride channel CLIC-like protein 1 (324-332)
agccccgccgccgagaaggcgcagcug

SEQ ID NO: 40433 - RNA, 27 nt, Artificial Sequence
  Eukaryotic translation initiation factor 2A (347-355)
agcccccacggccacauccuggugcuc

SEQ ID NO: 40434 - RNA, 33 nt, Artificial Sequence
  Zinc finger SWIM domain-containing protein 7 (59-69)
agccccuccggccgccggguguaccagguccug

SEQ ID NO: 40435 - RNA, 27 nt, Artificial Sequence
  Spermatogenesis-associated protein 20 (30-38)
agccccaccucccgccugaacagccuc

SEQ ID NO: 40436 - RNA, 27 nt, Artificial Sequence
  mRNA-decapping enzyme 1A (62-70)
agccccuaccacggcuucaccaucgug

SEQ ID NO: 40437 - RNA, 27 nt, Artificial Sequence
  Complex I assembly factor TIMMDC1, mitochondrial (108-116)
agccaggccgagaucuaccacaaccgc

SEQ ID NO: 40438 - RNA, 33 nt, Artificial Sequence
  Centromere protein J (1081-1091)
agccagaucuccagcggcacccagguggagaag

SEQ ID NO: 40439 - RNA, 27 nt, Artificial Sequence
  G protein pathway suppressor 2 (319-327)
agccagaacccccgcuucuaccacaag

SEQ ID NO: 40440 - RNA, 27 nt, Artificial Sequence
  T-complex protein 1 subunit eta (157-165)
agccagcagaaggccuucuucgccaag

SEQ ID NO: 40441 - RNA, 30 nt, Artificial Sequence
  3-hydroxy-3-methylglutaryl-coenzyme A reductase (226-235)
agccgcgagggccggcccaucuggcagcug

SEQ ID NO: 40442 - RNA, 27 nt, Artificial Sequence
  Protein CYR61 (3-11)
agccgcaucgcccgggcccuggcgcuc

SEQ ID NO: 40443 - RNA, 27 nt, Artificial Sequence
  Polyadenylate-binding protein 4 (289-297)
agccgcuaccagggcgugaaccuguac

SEQ ID NO: 40444 - RNA, 30 nt, Artificial Sequence
  NUMB protein (52-61)
agcuccgccaccaccagccccuucuucaag

SEQ ID NO: 40445 - RNA, 27 nt, Artificial Sequence
  Nucleoporin GLE1 (16-24)
agcuccgacaagggccgccugugcuac

SEQ ID NO: 40446 - RNA, 30 nt, Artificial Sequence
  Rho guanine nucleotide exchange factor 35 (173-182)
agcuccgacaacagcggccagacccgcuac

SEQ ID NO: 40447 - RNA, 27 nt, Artificial Sequence
  Integrin alpha-7 (233-241)
agcuccgaccccgaccagcugguguac

SEQ ID NO: 40448 - RNA, 33 nt, Artificial Sequence
  Transcriptional coactivator YAP1 (331-341)
agcuccgaccccuuccugaacagcggcaccuac

SEQ ID NO: 40449 - RNA, 27 nt, Artificial Sequence
  Plastin-3 (113-121)
agcuccgagggcacccagcacagcuac

SEQ ID NO: 40450 - RNA, 30 nt, Artificial Sequence
  Spermatogenesis-associated serine-rich protein 2 (123-132)
agcuccgagaagggcgggaugaacggcuac

SEQ ID NO: 40451 - RNA, 33 nt, Artificial Sequence
  Myotubularin-related protein 14 (229-239)
agcuccgagaagguggacaaggcccagcgcuac

SEQ ID NO: 40452 - RNA, 27 nt, Artificial Sequence
  Liprin-beta-1 (506-514)
agcuccuucggccgcggguucuucaag

SEQ ID NO: 40453 - RNA, 27 nt, Artificial Sequence
  Breast cancer type 2 susceptibility protein (661-669)
agcuccuucggcaccauccugcgcaag

SEQ ID NO: 40454 - RNA, 27 nt, Artificial Sequence
  60S ribosomal protein L28 (14-22)
agcuccuuccugaucaagcgcaacaag

SEQ ID NO: 40455 - RNA, 27 nt, Artificial Sequence
  AP-3 complex subunit mu-2 (10-18)
agcuccggcgacaucuuccuggagaag

SEQ ID NO: 40456 - RNA, 27 nt, Artificial Sequence
  Deoxynucleotidyltransferase terminal-interacting protein 2 (562-570)
agcuccaucgaccccggccugagcauc

SEQ ID NO: 40457 - RNA, 27 nt, Artificial Sequence
  60S ribosomal protein L28 (91-99)
agcuccauccgccacaugauccggaag

SEQ ID NO: 40458 - RNA, 36 nt, Artificial Sequence
  Dermcidin (63-74)
agcucccugcucgagaagggccuggacggggccaag

SEQ ID NO: 40459 - RNA, 27 nt, Artificial Sequence
  Integrator complex subunit 3 (459-467)
agcucccugaaccacaucguggagaag

SEQ ID NO: 40460 - RNA, 27 nt, Artificial Sequence
  Retinoblastoma-like protein 2 (834-842)
agcucccugagccucuucuuccgcaag

SEQ ID NO: 40461 - RNA, 30 nt, Artificial Sequence
  GATS-like protein 2 (89-98)
agcuccagccagcccaucggcgugaccaag

SEQ ID NO: 40462 - RNA, 33 nt, Artificial Sequence
  Synaptotagmin-like protein 2 (280-290)
agcuccagcaccgacuccgagacccugcgcuac

SEQ ID NO: 40463 - RNA, 33 nt, Artificial Sequence
  WD repeat-containing protein 62 (49-59)
agcaccgccuccgaggagaccgugcagaaccgc

SEQ ID NO: 40464 - RNA, 27 nt, Artificial Sequence
  Cyclic AMP-responsive element-binding protein 3-like protein 2 (116-124)
agcaccgacuuccccuccaccagcauc

SEQ ID NO: 40465 - RNA, 36 nt, Artificial Sequence
  ETS-related transcription factor Elf-1 (430-441)
agcaccgaccccuccgccggcaccgggagccagaag

SEQ ID NO: 40466 - RNA, 30 nt, Artificial Sequence
  Epidermal growth factor receptor kinase substrate 8 (476-485)
agcaccgagcacuccagcguguccgaguac

SEQ ID NO: 40467 - RNA, 27 nt, Artificial Sequence
  Nuclear receptor subfamily 2 group C member 2 (226-234)
agcaccgagaagaucuacauccgcaag

SEQ ID NO: 40468 - RNA, 30 nt, Artificial Sequence
  V-type proton ATPase subunit H (296-305)
agcaccgagcgcgagacccggcaggaguac

SEQ ID NO: 40469 - RNA, 30 nt, Artificial Sequence
  Nucleolar protein 56 (354-363)
agcaccuucaucggccgcgccgccgcgaag

SEQ ID NO: 40470 - RNA, 33 nt, Artificial Sequence
  Ankyrin repeat and KH domain-containing protein 1 (1842-1852)
agcaccuuccagcccgccaacaagcugaacaag

SEQ ID NO: 40471 - RNA, 33 nt, Artificial Sequence
  5-aminolevulinate synthase, nonspecific, mitochondrial (212-222)
agcaccuuccaguacgaccgcuucuucgagaag

SEQ ID NO: 40472 - RNA, 27 nt, Artificial Sequence
  Nuclear autoantigen Sp-100 (389-397)
agcaccuuccgcgaguccuucaagaag

SEQ ID NO: 40473 - RNA, 30 nt, Artificial Sequence
  Zinc finger protein SNAI2 (138-147)
agcaccuucuccggccuggccaagcacaag

SEQ ID NO: 40474 - RNA, 36 nt, Artificial Sequence
  Oxidative stress-responsive serine-rich protein 1 (96-107)
agcaccaucgccuccagcuccagcucccagcugaag

SEQ ID NO: 40475 - RNA, 27 nt, Artificial Sequence
  Clathrin interactor 1 (210-218)
agcaccaucgacgacaccaucuccaag

SEQ ID NO: 40476 - RNA, 33 nt, Artificial Sequence
  Ligand-dependent nuclear receptor-interacting factor 1 (338-348)
agcaccaucgaccccuccggcacccgcagcaag

SEQ ID NO: 40477 - RNA, 30 nt, Artificial Sequence
  Regulation of nuclear pre-mRNA domain-containing protein 2 (942-951)
agcaccaucgaguucaagaacaugcugaag

SEQ ID NO: 40478 - RNA, 27 nt, Artificial Sequence
  Probable RNA-binding protein 23 (53-61)
agcaccaucggcgagaccuccaaccgc

SEQ ID NO: 40479 - RNA, 36 nt, Artificial Sequence
  Hexokinase-2 (408-419)
agcaccaucggcguggacggguccgucuacaagaag

SEQ ID NO: 40480 - RNA, 33 nt, Artificial Sequence
  Transcription intermediary factor 1-alpha (597-607)
agcaccaucaugcuggacaacaucgugcgcaag

SEQ ID NO: 40481 - RNA, 27 nt, Artificial Sequence
  Tigger transposable element-derived protein 2 (379-387)
agcaccaucaccaaggccuggaagaag

SEQ ID NO: 40482 - RNA, 33 nt, Artificial Sequence
  Mediator of RNA polymerase II transcription subunit 20 (51-61)
agcacccugggcucccaggggcagaccggcaag

SEQ ID NO: 40483 - RNA, 27 nt, Artificial Sequence
  KN motif and ankyrin repeat domain-containing protein 1 (972-980)
agcacccugaaguccaucaugaagaag

SEQ ID NO: 40484 - RNA, 33 nt, Artificial Sequence
  Alanine-tRNA ligase, cytoplasmic (3-13)
agcacccugaccgccuccgagauccgccagcgg

SEQ ID NO: 40485 - RNA, 27 nt, Artificial Sequence
  Guanine nucleotide-binding protein G(I)/G(S)/G(O) subunit gamma-12 (7-15)
agcaccaacaacaucgcccaggcccgc

SEQ ID NO: 40486 - RNA, 27 nt, Artificial Sequence
  AP-3 complex subunit delta-1 (232-240)
agcaccaacaacugggugcugaucaag

SEQ ID NO: 40487 - RNA, 27 nt, Artificial Sequence
  Guanine nucleotide-binding protein G(I)/G(S)/G(O) subunit gamma-5 (55-63)
agcaccaaccccuuccgcccgcagaag

SEQ ID NO: 40488 - RNA, 33 nt, Artificial Sequence
  ATP synthase F(0) complex subunit B1, mitochondrial (228-238)
agcacccagcaggagaaggagaccaucgccaag

SEQ ID NO: 40489 - RNA, 30 nt, Artificial Sequence
  Band 4.1-like protein 2 (78-87)
agcaccaccacgaccacccacaucaccaag

SEQ ID NO: 40490 - RNA, 27 nt, Artificial Sequence
  Mediator of RNA polymerase II transcription subunit 25 (129-137)
agcaccguggcccccggcuccgggcug

SEQ ID NO: 40491 - RNA, 27 nt, Artificial Sequence
  SEC14-like protein 1 (142-150)
agcaccguggagaagaucgccaugaag

SEQ ID NO: 40492 - RNA, 33 nt, Artificial Sequence
  Signal recognition particle 14 kDa protein (68-78)
agcaccguggucuccagcaaggaggugaacaag

SEQ ID NO: 40493 - RNA, 30 nt, Artificial Sequence
  Cleavage and polyadenylation specificity factor subunit 3 (66-75)
agcaccuacggcacccacauccacgagaag

SEQ ID NO: 40494 - RNA, 30 nt, Artificial Sequence
  DmX-like protein 2 (1766-1775)
agcaccuacaucuccauccugaaccagaag

SEQ ID NO: 40495 - RNA, 33 nt, Artificial Sequence
  Lysosomal protective protein (339-349)
agcaccuaccugaacaaccccuacgugcgcaag

SEQ ID NO: 40496 - RNA, 30 nt, Artificial Sequence
  E3 ubiquitin-protein ligase HECTD1 (546-555)
agcaccuacaaccugcagauccucacccgc

SEQ ID NO: 40497 - RNA, 33 nt, Artificial Sequence
  Protein FAM84B (105-115)
agcaccuacacccccgagaaccugcucaacaag

SEQ ID NO: 40498 - RNA, 30 nt, Artificial Sequence
  Lysine-specific demethylase 5B (847-856)
agcguggcccagcagcugcucaacggcaag

SEQ ID NO: 40499 - RNA, 27 nt, Artificial Sequence
  Perilipin-2 (129-137)
agcguggccuccaccaucaccggcguc

SEQ ID NO: 40500 - RNA, 33 nt, Artificial Sequence
  Oral-facial-digital syndrome 1 protein (92-102)
agcguguucuuccccgaguccggccuggccaag

SEQ ID NO: 40501 - RNA, 33 nt, Artificial Sequence
  Short coiled-coil protein (42-52)
agcguguuccagaccaccgacacgaaguccaag

SEQ ID NO: 40502 - RNA, 27 nt, Artificial Sequence
  Centromere protein F (215-223)
agcguguucuccuggcagcaggagaag

SEQ ID NO: 40503 - RNA, 33 nt, Artificial Sequence
  Probable 18S rRNA (guanine-N(7))-methyltransferase (228-238)
agcguguucaccaacgagcgcuucccccugcgg

SEQ ID NO: 40504 - RNA, 36 nt, Artificial Sequence
  Protein FAN (644-655)
agcguguucaccaccucccaggacagcacgcugaag

SEQ ID NO: 40505 - RNA, 27 nt, Artificial Sequence
  Acyl-CoA desaturase (245-253)
agcguguucgucgccaccuuccugcgc

SEQ ID NO: 40506 - RNA, 27 nt, Artificial Sequence
  Nitric oxide synthase-interacting protein (147-155)
agcgugggccccccguccaaggacaag

SEQ ID NO: 40507 - RNA, 30 nt, Artificial Sequence
  V-type proton ATPase subunit d 1 (68-77)
agcgugaucgacgaccgccugaaggagaag

SEQ ID NO: 40508 - RNA, 33 nt, Artificial Sequence
  Striatin (234-244)
agcgugaucgacaccuccaccaucguccgcaag

SEQ ID NO: 40509 - RNA, 33 nt, Artificial Sequence
  Phosducin-like protein (220-230)
agcgugaucggcgccuccagccaguucacccgc

SEQ ID NO: 40510 - RNA, 27 nt, Artificial Sequence
  Protein fuzzy homolog (41-49)
agcgugaucggcucccugaacgggguc

SEQ ID NO: 40511 - RNA, 27 nt, Artificial Sequence
  MAP kinase-activating death domain protein (1140-1148)
agcgugaucggcgucucccccgccgug

SEQ ID NO: 40512 - RNA, 27 nt, Artificial Sequence
  Tubby-related protein 3 (322-330)
agcgugaucauccccggcaugacccug

SEQ ID NO: 40513 - RNA, 27 nt, Artificial Sequence
  ETS-related transcription factor Elf-1 (531-539)
agcgugaucaagacccaggagaccaag

SEQ ID NO: 40514 - RNA, 27 nt, Artificial Sequence
  SEC14 domain and spectrin repeat-containing protein 1 (4-12)
agcgugauccugcccauccucaagaag

SEQ ID NO: 40515 - RNA, 27 nt, Artificial Sequence
  Serine/threonine-protein kinase RIO1 (130-138)
agcgugaucaacaaggucaccgagaag

SEQ ID NO: 40516 - RNA, 27 nt, Artificial Sequence
  NHS-like protein 1 (635-643)
agcgugaucaacgucuucgugggccgc

SEQ ID NO: 40517 - RNA, 33 nt, Artificial Sequence
  E3 ubiquitin-protein ligase Topors (307-317)
agcgugcugggcaaggacgagcagaucaacaag

SEQ ID NO: 40518 - RNA, 27 nt, Artificial Sequence
  Nuclear pore complex protein Nup50 (280-288)
agcgugcugggcucccucagcuccguc

SEQ ID NO: 40519 - RNA, 27 nt, Artificial Sequence
  Superkiller viralicidic activity 2-like 2 (759-767)
agcgugcugaaguccauccaggagguc

SEQ ID NO: 40520 - RNA, 27 nt, Artificial Sequence
  Nuclear pore membraneoprotein 210 (659-667)
agcgugcugaacuucgccaccaaccgc

SEQ ID NO: 40521 - RNA, 36 nt, Artificial Sequence
  Little elongation complex subunit 1 (852-863)
agcgugcugcccaaccaggucuccgugaucaccaag

SEQ ID NO: 40522 - RNA, 33 nt, Artificial Sequence
  Lysine-specific demethylase 3A (512-522)
agcgugcugaccgaccccgccaagcucaagaag

SEQ ID NO: 40523 - RNA, 27 nt, Artificial Sequence
  Enhancer of mRNA-decapping protein 4 (927-935)
agcgugauggcccagguccgccagaag

SEQ ID NO: 40524 - RNA, 30 nt, Artificial Sequence
  Poly(U)-binding-splicing factor PUF60 (174-183)
agcgugaugcugggcgggcgcaacaucaag

SEQ ID NO: 40525 - RNA, 27 nt, Artificial Sequence
  TGF-beta-activated kinase 1 and MAP3K7-binding protein 2 (354-362)
agcgugaacucccagacccugaaccgc

SEQ ID NO: 40526 - RNA, 30 nt, Artificial Sequence
  Rho GDP-dissociation inhibitor 1 (24-33)
agcgugaacuacaagcccccggcccagaag

SEQ ID NO: 40527 - RNA, 30 nt, Artificial Sequence
  LON peptidase N-terminal domain and RING finger protein 1 (418-427)
agcgugcaggagaagggcguccugcucaag

SEQ ID NO: 40528 - RNA, 27 nt, Artificial Sequence
  Kinesin-like protein KIF11 (750-758)
agcgugcaggagaacauccagcagaag

SEQ ID NO: 40529 - RNA, 27 nt, Artificial Sequence
  DNA topoisomerase 2-binding protein 1 (587-595)
agcgugcaggaguacuucguccgcaag

SEQ ID NO: 40530 - RNA, 27 nt, Artificial Sequence
  Zinc-binding alcohol dehydrogenase domain-containing protein 2 (299-307)
agcgugcagggcuucuuccugaaccac

SEQ ID NO: 40531 - RNA, 33 nt, Artificial Sequence
  E3 ubiquitin-protein ligase MARCH7 (13-23)
agcgugcagcccuccagcucccugagcgcccgc

SEQ ID NO: 40532 - RNA, 33 nt, Artificial Sequence
  MAP7 domain-containing protein 3 (532-542)
agcgugcaguccgccagcuccaccgucaagaag

SEQ ID NO: 40533 - RNA, 30 nt, Artificial Sequence
  BRCA1-associated RING domain protein 1 (162-171)
agcgugcagacccagcccgccaucaagaag

SEQ ID NO: 40534 - RNA, 27 nt, Artificial Sequence
  DNA-directed RNA polymerase, mitochondrial (77-85)
agcguguccgaggucguggugaaccgc

SEQ ID NO: 40535 - RNA, 30 nt, Artificial Sequence
  GAS2-like protein 3 (568-577)
agcgugucccccgucaaggccacccagaag

SEQ ID NO: 40536 - RNA, 27 nt, Artificial Sequence
  Lipoma-preferred partner (35-43)
agcguguccacccagcagcccccgaag

SEQ ID NO: 40537 - RNA, 27 nt, Artificial Sequence
  Probable 8-oxo-dGTP diphosphatase NUDT15 (78-86)
agcguggucaacuccuucaucgagaag

SEQ ID NO: 40538 - RNA, 27 nt, Artificial Sequence
  Transmembrane and TPR repeat-containing protein 2 (627-635)
agcguguacaaggaggccauccagaag

SEQ ID NO: 40539 - RNA, 27 nt, Artificial Sequence
  Cytoplasmic dynein 1 heavy chain 1 (2957-2965)
agcguguaccagaucaagguccaccgc

SEQ ID NO: 40540 - RNA, 27 nt, Artificial Sequence
  Tetratricopeptide repeat protein 28 (60-68)
agcuaccacaacuacgugcuggagcuc

SEQ ID NO: 40541 - RNA, 27 nt, Artificial Sequence
  Long-chain-fatty-acid-CoA ligase 3 (616-624)
agcuaccacuccuacgugaucggcuuc

SEQ ID NO: 40542 - RNA, 27 nt, Artificial Sequence
  14-3-3 protein beta/alpha (212-220)
agcuacaaggacuccacccugaucaug

SEQ ID NO: 40543 - RNA, 27 nt, Artificial Sequence
  Serine/threonine-protein kinase 24 (88-96)
agcuaccugaaggacaccaagcucugg

SEQ ID NO: 40544 - RNA, 27 nt, Artificial Sequence
  Selenoprotein N (310-318)
agcuaccugcccuucaccgaggccuuc

SEQ ID NO: 40545 - RNA, 27 nt, Artificial Sequence
  Zinc finger protein 383 (239-247)
agcuaccugucccagcaccagcgcauc

SEQ ID NO: 40546 - RNA, 27 nt, Artificial Sequence
  Tumor necrosis factor receptor superfamily member 3 (87-95)
agcuacaacgagcacuggaacuaccug

SEQ ID NO: 40547 - RNA, 27 nt, Artificial Sequence
  Transmembrane protein 39A (477-485)
agcuacccccugaacuccuacgagcuc

SEQ ID NO: 40548 - RNA, 27 nt, Artificial Sequence
  Tetraspanin-10 (217-225)
agcuaccaggacuggcagcagaaccug

SEQ ID NO: 40549 - RNA, 27 nt, Artificial Sequence
  Calcyclin-binding protein (124-132)
agcuacuccaugaucgugaacaaccug

SEQ ID NO: 40550 - RNA, 27 nt, Artificial Sequence
  Transmembrane protein 39A (363-371)
agcuacuccaacgccccccagcacauc

SEQ ID NO: 40551 - RNA, 27 nt, Artificial Sequence
  Serine/threonine-protein kinase LATS2 (554-562)
agcuacucccccuacgccuucaaguuc

SEQ ID NO: 40552 - RNA, 27 nt, Artificial Sequence
  AF4/FMR2 family member 4 (1095-1103)
agcuacgugcaggucaccuccaacuuc

SEQ ID NO: 40553 - RNA, 33 nt, Artificial Sequence
  Basement membrane-specific heparan sulfate proteoglycan core protein (176-186)
agcuacgugaccuccccccagggcuuccaguuc

SEQ ID NO: 40554 - RNA, 27 nt, Artificial Sequence
  Transcription factor BTF3 (82-90)
accgccgacgacaagaagcugcaguuc

SEQ ID NO: 40555 - RNA, 27 nt, Artificial Sequence
  Dolichyl-diphosphooligosaccharide-proteinosyltransferase 48 kDa subunit (78-86)
accgccgacgaccccagccugucccuc

SEQ ID NO: 40556 - RNA, 30 nt, Artificial Sequence
  Transducin beta-like protein 3 (197-206)
accgccgaccacaaccugcuccuguacgag

SEQ ID NO: 40557 - RNA, 27 nt, Artificial Sequence
  Lymphocyte cytosolic protein 2 (227-235)
accgccaagcugcccgccccgagcauc

SEQ ID NO: 40558 - RNA, 27 nt, Artificial Sequence
  Pyridine nucleotide-disulfide oxidoreductase domain-containing protein 1 (42-50)
accgccagccccgugaucaaggccguc

SEQ ID NO: 40559 - RNA, 27 nt, Artificial Sequence
  Programmed cell death 6-interacting protein (658-666)
accgccuacgacaacuucguggagcug

SEQ ID NO: 40560 - RNA, 42 nt, Artificial Sequence
  Cullin-4B (24-37)
accgacggcaacaccagcacgacccccccgaccuccgccaag

SEQ ID NO: 40561 - RNA, 27 nt, Artificial Sequence
  Putative sodium-coupled neutral amino acid transporter 10 (253-261)
accgaggccaccgccggcaacgugcug

SEQ ID NO: 40562 - RNA, 33 nt, Artificial Sequence
  Optineurin (373-383)
accgaggacgagaagagcaagcugaccgugcuc

SEQ ID NO: 40563 - RNA, 36 nt, Artificial Sequence
  Nuclear factor erythroid 2-related factor 2 (160-171)
accgaggaccccaaccagcugaccgugaacagccuc

SEQ ID NO: 40564 - RNA, 33 nt, Artificial Sequence
  Actin-related protein 2/3 complex subunit 1A (312-322)
accgaggaccgcaacaccgcccuggagacgcuc

SEQ ID NO: 40565 - RNA, 27 nt, Artificial Sequence
  Dynactin subunit 2 (131-139)
accgaggagaagcugacccccgugcuc

SEQ ID NO: 40566 - RNA, 30 nt, Artificial Sequence
  Dynactin subunit 2 (131-140)
accgaggagaagcugacccccgugcuccug

SEQ ID NO: 40567 - RNA, 30 nt, Artificial Sequence
  Protein fuzzy homolog (371-380)
accgaggagcccggcaccggggugcgccug

SEQ ID NO: 40568 - RNA, 33 nt, Artificial Sequence
  BRF1 protein (61-71)
accgaguucgaggacacccccacgagccagcug

SEQ ID NO: 40569 - RNA, 30 nt, Artificial Sequence
  Dystonin (2514-2523)
accgagaucgacagcaaguggcaggagcug

SEQ ID NO: 40570 - RNA, 27 nt, Artificial Sequence
  Protein TBRG4 (216-224)
accgagaucgaggacagccacacccug

SEQ ID NO: 40571 - RNA, 27 nt, Artificial Sequence
  RuvB-like 1 (44-52)
accgagaucaagaagaccgaggugcug

SEQ ID NO: 40572 - RNA, 27 nt, Artificial Sequence
  MIF2 suppressor (12-20)
accgagaacaacgaccacaucaaccug

SEQ ID NO: 40573 - RNA, 27 nt, Artificial Sequence
  Sodium/potassium-transporting ATPase subunit alpha-1 (206-214)
accgagaaccagagcggcguguccuuc

SEQ ID NO: 40574 - RNA, 27 nt, Artificial Sequence
  Eukaryotic translation initiation factor 3 subunit L (482-490)
accgagcaggaguuccgcauccagcug

SEQ ID NO: 40575 - RNA, 30 nt, Artificial Sequence
  Golgi-associated PDZ and coiled-coil motif-containing protein (106-115)
accgagacccaggccgagaaggugguccug

SEQ ID NO: 40576 - RNA, 30 nt, Artificial Sequence
  Dolichyl-diphosphooligosaccharide-proteinosyltransferase subunit 2 (371-380)
accgaggugggcaucaccaacgucgaccug

SEQ ID NO: 40577 - RNA, 30 nt, Artificial Sequence
  Apoptosis-inducing factor 2 (163-172)
accgaguaccccgagaaggaggugacccug

SEQ ID NO: 40578 - RNA, 27 nt, Artificial Sequence
  Fibronectin type III domain-containing protein 3B (635-643)
acccaccugaagcccggcacccucuac

SEQ ID NO: 40579 - RNA, 27 nt, Artificial Sequence
  Transcription factor 12 (468-476)
acccaccgcgaggacagcgugucccug

SEQ ID NO: 40580 - RNA, 27 nt, Artificial Sequence
  N-alpha-acetyltransferase 25, NatB auxiliary subunit (500-508)
acccacagccccuccaacgcccaguuc

SEQ ID NO: 40581 - RNA, 27 nt, Artificial Sequence
  Minor histocompatibility antigen H13 (287-295)
acccacaccuacuucuacacgagcuuc

SEQ ID NO: 40582 - RNA, 27 nt, Artificial Sequence
  GLTSCR1-like protein (169-177)
acccacgugcccgucggcgccagcuuc

SEQ ID NO: 40583 - RNA, 27 nt, Artificial Sequence
  Asparagine synthetase (glutamine-hydrolyzing) (553-561)
acccacuacaagagcgccgugaaggcc

SEQ ID NO: 40584 - RNA, 33 nt, Artificial Sequence
  Sorting nexin-18 (279-289)
accaucgacgaccccaccaagcagacgaaguuc

SEQ ID NO: 40585 - RNA, 27 nt, Artificial Sequence
  Clathrin interactor 1 (211-219)
accaucgacgacaccaucagcaaguuc

SEQ ID NO: 40586 - RNA, 27 nt, Artificial Sequence
  Nucleolar GTP-binding protein 1 (163-171)
accaucgaccccaacacccgcacgcug

SEQ ID NO: 40587 - RNA, 39 nt, Artificial Sequence
  Signal transducer and activator of transcription 5B (372-384)
accaucaucagcgagcagcaggccaagucccugcucaag

SEQ ID NO: 40588 - RNA, 27 nt, Artificial Sequence
  Sorting nexin-14 (74-82)
accaucaaguacaagcccaagcagcug

SEQ ID NO: 40589 - RNA, 33 nt, Artificial Sequence
  Heterogeneous nuclear ribonucleoproteins A2/B1 (164-174)
accaucaacggccacaacgccgaggugcgcaag

SEQ ID NO: 40590 - RNA, 30 nt, Artificial Sequence
  Similar to calcium-independent phospholipase A2 (165-174)
accaucgugaaccgcggcaucacccccaag

SEQ ID NO: 40591 - RNA, 33 nt, Artificial Sequence
  Cytoplasmic dynein 1 heavy chain 1 (1281-1291)
accaucuacgagggcaaguucgggcgccugaag

SEQ ID NO: 40592 - RNA, 27 nt, Artificial Sequence
  Melanoma-associated antigen D1 (153-161)
accaaggugggccccaacgccaccuac

SEQ ID NO: 40593 - RNA, 27 nt, Artificial Sequence
  Calmodulin-binding transcription activator 1 (1179-1187)
acccuggccgagcacaucaucgaggcc

SEQ ID NO: 40594 - RNA, 36 nt, Artificial Sequence
  Syndecan-3 (348-359)
acccuggaggagcccaagcaggccagcgugaccuac

SEQ ID NO: 40595 - RNA, 36 nt, Artificial Sequence
  Septin-7 (426-437)
acccuggagaagaacaagaagaagggcaagaucuuc

SEQ ID NO: 40596 - RNA, 33 nt, Artificial Sequence
  Histone-lysine N-methyltransferase ASH1L (2959-2969)
acccuguucauccccgagaacagcuuccgcaag

SEQ ID NO: 40597 - RNA, 33 nt, Artificial Sequence
  Uncharacterized protein C1orf198 (300-310)
acccuguucagcgagcccaaguucgcccaggug

SEQ ID NO: 40598 - RNA, 33 nt, Artificial Sequence
  Signal recognition particle receptor subunit beta (114-124)
acccugaucgaccuccccggccacgagagccug

SEQ ID NO: 40599 - RNA, 27 nt, Artificial Sequence
  Conserved oligomeric Golgi complex subunit 5 (271-279)
acccugaaggacaccaucacgagcgug

SEQ ID NO: 40600 - RNA, 27 nt, Artificial Sequence
  Transcription intermediary factor 1-beta (187-195)
acccugcagaagagcaccaaggaggug

SEQ ID NO: 40601 - RNA, 27 nt, Artificial Sequence
  Cell division cycle protein 20 homolog (304-312)
acccugagcggccacucccaggaggug

SEQ ID NO: 40602 - RNA, 27 nt, Artificial Sequence
  Zinc finger BED domain-containing protein 4 (953-961)
acccugagccaggugauccccaugguc

SEQ ID NO: 40603 - RNA, 27 nt, Artificial Sequence
  Ubiquitin-60S ribosomal protein L40 (12-20)
acccugaccggcaagacgaucacccuc

SEQ ID NO: 40604 - RNA, 27 nt, Artificial Sequence
  Sodium/potassium-transporting ATPase subunit alpha-3 (782-790)
acccugaccagcaacauccccgagauc

SEQ ID NO: 40605 - RNA, 33 nt, Artificial Sequence
  Putative heat shock protein HSP 90-beta 2 (85-95)
acccugguggacaccggcaucgggaugacgaag

SEQ ID NO: 40606 - RNA, 33 nt, Artificial Sequence
  Lathosterol oxidase (245-255)
acccugugggaccgcaucggcgggagcuucaag

SEQ ID NO: 40607 - RNA, 27 nt, Artificial Sequence
  Nicotinamide phosphoribosyltransferase (435-443)
acccccgccggcaacuucgugacccug

SEQ ID NO: 40608 - RNA, 27 nt, Artificial Sequence
  SH3 domain-containing protein 19 (137-145)
acccccgccccgcgcccccugcuccug

SEQ ID NO: 40609 - RNA, 27 nt, Artificial Sequence
  Ephrin-A5 (207-215)
accccccgcaucccgagccggcugcuc

SEQ ID NO: 40610 - RNA, 27 nt, Artificial Sequence
  40S ribosomal protein S2 (285-293)
acccaggcccccgccguggcgaccacg

SEQ ID NO: 40611 - RNA, 27 nt, Artificial Sequence
  RNA-binding protein EWS (33-41)
acccaggccuacggccagcagagcuac

SEQ ID NO: 40612 - RNA, 27 nt, Artificial Sequence
  28S ribosomal protein S12, mitochondrial (115-123)
acccaggaccugcccggcgugaagcuc

SEQ ID NO: 40613 - RNA, 33 nt, Artificial Sequence
  Synphilin-1 (60-70)
acccagaagcccaccggcaucgccgacguguac

SEQ ID NO: 40614 - RNA, 27 nt, Artificial Sequence
  U5 small nuclear ribonucleoprotein 200 kDa helicase (1765-1773)
acccagaaccccaacuacuacaaccug

SEQ ID NO: 40615 - RNA, 27 nt, Artificial Sequence
  SWI/SNF-related matrix-associated actin-dependent regulator of chromatin subfamily D member 1 (436-444)
acccagcgcgaguucaugcugagcuuc

SEQ ID NO: 40616 - RNA, 27 nt, Artificial Sequence
  Protein FAM204A (125-133)
acccaguggaaggagcugacccaguac

SEQ ID NO: 40617 - RNA, 27 nt, Artificial Sequence
  Cytoskeleton-associated protein 2 (274-282)
accagcgccaacgugaccauccgcaag

SEQ ID NO: 40618 - RNA, 27 nt, Artificial Sequence
  Uncharacterized protein KIAA2013 (598-606)
accagcgcccccaccggccacacguuc

SEQ ID NO: 40619 - RNA, 27 nt, Artificial Sequence
  Long-chain-fatty-acid-CoA ligase 4 (10-18)
accagcgacaagcccggcuccccguac

SEQ ID NO: 40620 - RNA, 27 nt, Artificial Sequence
  Zinc finger MYM-type protein 1 (293-301)
accagcgaccugggcaagaccgagcuc

SEQ ID NO: 40621 - RNA, 27 nt, Artificial Sequence
  Importin subunit alpha-4 (81-89)
accagcgacaaccccgugguccagcug

SEQ ID NO: 40622 - RNA, 27 nt, Artificial Sequence
  Dual specificity mitogen-activated protein kinase kinase 3 (150-158)
accagccuggacaaguucuaccgcaag

SEQ ID NO: 40623 - RNA, 33 nt, Artificial Sequence
  Prothymosin alpha (8-18)
accagcuccgagaucaccacgaaggaccugaag

SEQ ID NO: 40624 - RNA, 27 nt, Artificial Sequence
  Histone-lysine N-methyltransferase SETD2 (1436-1444)
accagcgugcccccgggcuccgcccug

SEQ ID NO: 40625 - RNA, 27 nt, Artificial Sequence
  Metastasis-associated protein MTA2 (312-320)
accaccgaccgcuacauccagcagaag

SEQ ID NO: 40626 - RNA, 27 nt, Artificial Sequence
  Cyclin-dependent kinase 1 (25-33)
accaccggccagguggucgccaugaag

SEQ ID NO: 40627 - RNA, 33 nt, Artificial Sequence
  ATP-dependent RNA helicase DHX8 (1166-1176)
accaccaucgacccccgcuggcugguggaguuc

SEQ ID NO: 40628 - RNA, 27 nt, Artificial Sequence
  Splicing factor 3A subunit 1 (123-131)
accacccagcagcagcugccccagaag

SEQ ID NO: 40629 - RNA, 27 nt, Artificial Sequence
  Germinal-center associated nuclear protein (203-211)
accaccagcaacuucacguucuccaag

SEQ ID NO: 40630 - RNA, 27 nt, Artificial Sequence
  Vacuolar protein sorting-associated protein 35 (375-383)
accaccguggagaucuucaacaagcug

SEQ ID NO: 40631 - RNA, 30 nt, Artificial Sequence
  Eukaryotic translation initiation factor 3 subunit L (353-362)
accaccuacaaguacgagaugaucaacaag

SEQ ID NO: 40632 - RNA, 27 nt, Artificial Sequence
  Cofilin-1 (12-20)
accguggacgaccccuacgccaccuuc

SEQ ID NO: 40633 - RNA, 27 nt, Artificial Sequence
  CCAAT/enhancer-binding protein beta (266-274)
accguggacaagcacagcgacgaguac

SEQ ID NO: 40634 - RNA, 33 nt, Artificial Sequence
  WD repeat-containing protein 48 (379-389)
accguggacaagaacaugcccaaguucaacaag

SEQ ID NO: 40635 - RNA, 27 nt, Artificial Sequence
  TRAF2 and NCK-interacting protein kinase (352-360)
accguggaggagggccagcgccugaag

SEQ ID NO: 40636 - RNA, 30 nt, Artificial Sequence
  Nicotinamide phosphoribosyltransferase (460-469)
accguguucaagaacggcaaggucaccaag

SEQ ID NO: 40637 - RNA, 27 nt, Artificial Sequence
  E3 ubiquitin-protein ligase RNF213 (4830-4838)
accguguuccugagcaccuggaacaag

SEQ ID NO: 40638 - RNA, 27 nt, Artificial Sequence
  Chromatin assembly factor 1 subunit B (444-452)
accgugauccgcgaccccccgagcauc

SEQ ID NO: 40639 - RNA, 27 nt, Artificial Sequence
  Glycine-tRNA ligase (350-358)
accgugcugggcuacuucaucgggcgc

SEQ ID NO: 40640 - RNA, 33 nt, Artificial Sequence
  Beta-lactamase-like protein 2 (237-247)
accgugauggagcuggucaagaucaucuacaag

SEQ ID NO: 40641 - RNA, 27 nt, Artificial Sequence
  Probable U3 small nucleolar RNA-associated protein 11 (238-246)
accgugaacagccccgccaucuacaag

SEQ ID NO: 40642 - RNA, 30 nt, Artificial Sequence
  Complex I assembly factor TIMMDC1, mitochondrial (151-160)
accgugaacaccagccugaacgucuaccgc

SEQ ID NO: 40643 - RNA, 27 nt, Artificial Sequence
  Coiled-coil domain-containing protein 66 (124-132)
accgugaacaccagccuggucggcaag

SEQ ID NO: 40644 - RNA, 27 nt, Artificial Sequence
  Exportin-1 (648-656)
accgugcaggagcaccugaucgagaag

SEQ ID NO: 40645 - RNA, 27 nt, Artificial Sequence
  SWI/SNF-related matrix-associated actin-dependent regulator of chromatin subfamily A containing DEAD/H box 1 (109-117)
accgugcaggagaagaccuucaacaag

SEQ ID NO: 40646 - RNA, 27 nt, Artificial Sequence
  Collagen alpha-3(VI) chain (2723-2731)
accgugcgccccccggucgccgugaag

SEQ ID NO: 40647 - RNA, 27 nt, Artificial Sequence
  Cleavage and polyadenylation specificity factor subunit 3 (440-448)
accgugaccacggucauccuggaggug

SEQ ID NO: 40648 - RNA, 33 nt, Artificial Sequence
  Transformation/transcription domain-associated protein (10-20)
accguggucgaccagaccacgcugaugaagaag

SEQ ID NO: 40649 - RNA, 36 nt, Artificial Sequence
  Endoplasmic reticulum-Golgi intermediate compartment protein 1 (103-114)
accguguacgaggacaagagcggcaagcagcgcuac

SEQ ID NO: 40650 - RNA, 36 nt, Artificial Sequence
  HIG1 domain family member 2A, mitochondrial (27-38)
accguguaccgcaaccccgagagcuucaaggagaag

SEQ ID NO: 40651 - RNA, 27 nt, Artificial Sequence
  Neuroblastoma-amplified sequence (1950-1958)
accuacgccgacacccugaaccaccuc

SEQ ID NO: 40652 - RNA, 27 nt, Artificial Sequence
  Dystonin (672-680)
accuacgccgagaagcugcaccgccuc

SEQ ID NO: 40653 - RNA, 27 nt, Artificial Sequence
  Unconventional myosin-Va (386-394)
accuacaucaagcccaucagcaagcug

SEQ ID NO: 40654 - RNA, 27 nt, Artificial Sequence
  Protein transport protein Sec24B (640-648)
accuacaucaaccccuucgugagcuuc

SEQ ID NO: 40655 - RNA, 33 nt, Artificial Sequence
  MORN repeat-containing protein 1 (177-187)
accuacaagggccaguggcacagcgacguguuc

SEQ ID NO: 40656 - RNA, 27 nt, Artificial Sequence
  Nesprin-2 (2589-2597)
accuaccuggacaagaucaagaaguuc

SEQ ID NO: 40657 - RNA, 27 nt, Artificial Sequence
  Interferon-induced protein with tetratricopeptide repeats 1 (116-124)
accuaccuggacaagguggagaacauc

SEQ ID NO: 40658 - RNA, 27 nt, Artificial Sequence
  Putative UDP-GlcNAc:betaGal beta-1,3-N-acetylglucosaminyltransferase LOC100288842 (347-355)
accuaccuggacagcuucaagcgcuuc

SEQ ID NO: 40659 - RNA, 33 nt, Artificial Sequence
  Tenascin (710-720)
accuaccugcccgccccggagggccucaaguuc

SEQ ID NO: 40660 - RNA, 27 nt, Artificial Sequence
  Mid1-interacting protein 1 (6-14)
accuacaaccagaagcacagccuguuc

SEQ ID NO: 40661 - RNA, 27 nt, Artificial Sequence
  Glycogenin-2 (121-129)
accuacagccccgccuucaagcaguuc

SEQ ID NO: 40662 - RNA, 27 nt, Artificial Sequence
  60S ribosomal protein L28 (24-32)
accuacagcaccgagcccaacaaccug

SEQ ID NO: 40663 - RNA, 33 nt, Artificial Sequence
  Vacuolar protein sorting-associated protein 13B (523-533)
accuacaccgagaucgccggcaugcagcgcuuc

SEQ ID NO: 40664 - RNA, 27 nt, Artificial Sequence
  5'-3' exoribonuclease 1 (313-321)
accuacgugaccauccugcccgagcuc

SEQ ID NO: 40665 - RNA, 27 nt, Artificial Sequence
  EF-hand calcium-binding domain-containing protein 11 (105-113)
accuacuaccgcggcuuccugacccuc

SEQ ID NO: 40666 - RNA, 27 nt, Artificial Sequence
  Exocyst complex component 4 (15-23)
guggccgccgcgcacagcgucgugcug

SEQ ID NO: 40667 - RNA, 27 nt, Artificial Sequence
  Pre-mRNA-splicing factor RBM22 (282-290)
guggccgccgagaagagcuucaacaag

SEQ ID NO: 40668 - RNA, 27 nt, Artificial Sequence
  Protein disulfide-isomerase A4 (76-84)
guggccgacaaggacaccguccugcuc

SEQ ID NO: 40669 - RNA, 30 nt, Artificial Sequence
  Dolichyl-diphosphooligosaccharide-proteinosyltransferase 48 kDa subunit (203-212)
guggccgaccccgacaacccgcugguccuc

SEQ ID NO: 40670 - RNA, 33 nt, Artificial Sequence
  KN motif and ankyrin repeat domain-containing protein 2 (489-499)
guggccgaccccaccgcccaccgccggagccug

SEQ ID NO: 40671 - RNA, 27 nt, Artificial Sequence
  40S ribosomal protein S5 (11-19)
guggccgagacccccgacaucaagcug

SEQ ID NO: 40672 - RNA, 27 nt, Artificial Sequence
  ATP-dependent 6-phosphofructokinase, liver type (717-725)
guggccuucagccccgucaccgagcug

SEQ ID NO: 40673 - RNA, 27 nt, Artificial Sequence
  Inosine-5'-monophosphate dehydrogenase 2 (219-227)
guggccaucaucgcccgcaccgaccug

SEQ ID NO: 40674 - RNA, 27 nt, Artificial Sequence
  Transmembrane protein 41B (243-251)
guggccaucaaggccggcaccacccug

SEQ ID NO: 40675 - RNA, 33 nt, Artificial Sequence
  Importin-9 (102-112)
guggccaugagccccgagcugauccagcaguuc

SEQ ID NO: 40676 - RNA, 27 nt, Artificial Sequence
  Cytochrome c oxidase subunit 7A2, mitochondrial (75-83)
guggccagcuuccccaagaagcaggag

SEQ ID NO: 40677 - RNA, 27 nt, Artificial Sequence
  Transketolase (365-373)
guggccaccgagaaggccgucgagcug

SEQ ID NO: 40678 - RNA, 27 nt, Artificial Sequence
  Hydroxyacylglutathione hydrolase-like protein (26-34)
guggccgucgacguggccgugcccaag

SEQ ID NO: 40679 - RNA, 42 nt, Artificial Sequence
  Myosin-9 (1950-1963)
guggacggcaaggccgacggggccgaggcgaagcccgccgag

SEQ ID NO: 40680 - RNA, 27 nt, Artificial Sequence
  StAR-related lipid transfer protein 13 (841-849)
guggaggcccccccgagcgucgugcug

SEQ ID NO: 40681 - RNA, 30 nt, Artificial Sequence
  Cytoplasmic dynein 1 heavy chain 1 (236-245)
guggaggaccccaccuuccugaaccagcuc

SEQ ID NO: 40682 - RNA, 30 nt, Artificial Sequence
  Protein strawberry notch homolog 1 (1087-1096)
guggaggaccgcagcggcauccugacccuc

SEQ ID NO: 40683 - RNA, 33 nt, Artificial Sequence
  Condensin complex subunit 3 (683-693)
guggaggagaccgccaccgccaagaacguccug

SEQ ID NO: 40684 - RNA, 30 nt, Artificial Sequence
  Serine/threonine-protein phosphatase 2A 55 kDa regulatory subunit B alpha isoform (34-43)
guggaguucaaccacagcggcgagcugcuc

SEQ ID NO: 40685 - RNA, 33 nt, Artificial Sequence
  Dynactin subunit 3 (113-123)
guggagaucaccgaggagagcaaggcccugcuc

SEQ ID NO: 40686 - RNA, 33 nt, Artificial Sequence
  Coatomer subunit delta (229-239)
guggagaacgaggacaagaagggcguccagcug

SEQ ID NO: 40687 - RNA, 36 nt, Artificial Sequence
  Transmembrane emp24 domain-containing protein 4 (79-90)
guggaggucaaggaccccgacggcaagguggugcug

SEQ ID NO: 40688 - RNA, 30 nt, Artificial Sequence
  Neuroblast differentiation-associated protein AHNAK (866-875)
guggagguccagggccccgacuggcaccug

SEQ ID NO: 40689 - RNA, 27 nt, Artificial Sequence
  Coatomer subunit alpha (256-264)
guguuccacccccgccaggagcugauc

SEQ ID NO: 40690 - RNA, 27 nt, Artificial Sequence
  Alpha-internexin (107-115)
guguucaucgagaagguccaccagcug

SEQ ID NO: 40691 - RNA, 27 nt, Artificial Sequence
  Protein unc-119 homolog B (162-170)
gugggcgacaagcccgucagcaacuuc

SEQ ID NO: 40692 - RNA, 27 nt, Artificial Sequence
  Dehydrogenase/reductase SDR family member on chromosome X (20-28)
gugauccuggcccagcuccugcgccgg

SEQ ID NO: 40693 - RNA, 30 nt, Artificial Sequence
  Transcription initiation factor IIA subunit 1 (21-30)
gugaucaacgacguccgcgacaucuuccug

SEQ ID NO: 40694 - RNA, 27 nt, Artificial Sequence
  Protein FAM208B (1046-1054)
gugaucaaccccgagccgaucacccug

SEQ ID NO: 40695 - RNA, 27 nt, Artificial Sequence
  Copine-2 (523-531)
gugcuggccgagcucccccagcagguc

SEQ ID NO: 40696 - RNA, 33 nt, Artificial Sequence
  High affinity cationic amino acid transporter 1 (147-157)
gugcuggccgagaaccccgacaucuucgccguc

SEQ ID NO: 40697 - RNA, 39 nt, Artificial Sequence
  Neudesin (19-31)
gugcuggcccucgcccccggccugccgaccgcgcgcgcc

SEQ ID NO: 40698 - RNA, 39 nt, Artificial Sequence
  Activating signal cointegrator 1 complex subunit 2 (166-178)
gugcuguucggcaaggggaacagcccccuccugcagaag

SEQ ID NO: 40699 - RNA, 33 nt, Artificial Sequence
  Acyl-CoA:lysophosphatidylglycerol acyltransferase 1 (180-190)
gugcuguuccccgagggcggguuccuccgcaag

SEQ ID NO: 40700 - RNA, 27 nt, Artificial Sequence
  Importin-7 (169-177)
gugcugauccagaagcagaucuucaag

SEQ ID NO: 40701 - RNA, 27 nt, Artificial Sequence
  Tight junction protein ZO-1 (1634-1642)
gugcugagcuccaucgagaccggcguc

SEQ ID NO: 40702 - RNA, 27 nt, Artificial Sequence
  Interleukin-4 receptor subunit alpha (335-343)
gugcuguggcccgagagcaucuccguc

SEQ ID NO: 40703 - RNA, 36 nt, Artificial Sequence
  Dolichyl-diphosphooligosaccharide-proteinosyltransferase subunit 4 (23-34)
gugcuguaccacuacgucgccgugaacaaccccaag

SEQ ID NO: 40704 - RNA, 33 nt, Artificial Sequence
  Clathrin heavy chain 1 (788-798)
gugcuguaccucuaccgcaacaaccugcagaag

SEQ ID NO: 40705 - RNA, 27 nt, Artificial Sequence
  ADNP homeobox protein 2 (968-976)
gugaugcacgacagcuccuucagcguc

SEQ ID NO: 40706 - RNA, 30 nt, Artificial Sequence
  Myosin-10 (1967-1976)
gugaacgagacccagcccccgcagagcgag

SEQ ID NO: 40707 - RNA, 27 nt, Artificial Sequence
  Fas-activated serine/threonine kinase (383-391)
gugcccaucuucccgcagccccugauc

SEQ ID NO: 40708 - RNA, 33 nt, Artificial Sequence
  DNA-(apurinic or apyrimidinic site) lyase (172-182)
gugcccaacgccggccgcgggcugguccggcuc

SEQ ID NO: 40709 - RNA, 27 nt, Artificial Sequence
  Eukaryotic translation initiation factor 3 subunit A (428-436)
gugccccagcugcagaacaacaccauc

SEQ ID NO: 40710 - RNA, 27 nt, Artificial Sequence
  Zinc finger CCCH domain-containing protein 7A (237-245)
gugcccgucaugccgcugaccagcauc

SEQ ID NO: 40711 - RNA, 24 nt, Artificial Sequence
  Cellular tumor antigen p53 (218-225)
gugcccuacgagccgcccgagguc

SEQ ID NO: 40712 - RNA, 27 nt, Artificial Sequence
  40S ribosomal protein S11 (120-128)
gugcagaucggcgacaucgucaccgug

SEQ ID NO: 40713 - RNA, 27 nt, Artificial Sequence
  Golgin-45 (153-161)
gugcagaccgaggucaaccgcgagcug

SEQ ID NO: 40714 - RNA, 27 nt, Artificial Sequence
  Centrosomal protein of 192 kDa (314-322)
gugcgcaacccccggaucaccagccug

SEQ ID NO: 40715 - RNA, 27 nt, Artificial Sequence
  Oxidoreductase HTATIP2 (105-113)
gugcgcgucgaccgggacuacgugcug

SEQ ID NO: 40716 - RNA, 27 nt, Artificial Sequence
  Serine/threonine-protein phosphatase 4 catalytic subunit (102-110)
gugcgcuaccccgaccggaucacccug

SEQ ID NO: 40717 - RNA, 27 nt, Artificial Sequence
  Phosphorylated CTD-interacting factor 1 (411-419)
gugagcgcccccccgaugcccuccguc

SEQ ID NO: 40718 - RNA, 27 nt, Artificial Sequence
  Protein prenyltransferase alpha subunit repeat-containing protein 1 (214-222)
gugagcgaccacuccggcuuccacuac

SEQ ID NO: 40719 - RNA, 36 nt, Artificial Sequence
  Nuclear protein localization protein 4 homolog (316-327)
gugagcgaggacacccgcaagggcaccguccgguac

SEQ ID NO: 40720 - RNA, 27 nt, Artificial Sequence
  Neuronal regeneration-related protein (79-87)
gugagccaggagcccuucccgaacaag

SEQ ID NO: 40721 - RNA, 27 nt, Artificial Sequence
  Mannosyl-oligosaccharide glucosidase (210-218)
gugaccgacggcaaggagguccugcuc

SEQ ID NO: 40722 - RNA, 27 nt, Artificial Sequence
  Attractin (8-16)
gugaccgacggccccgggaacuacaag

SEQ ID NO: 40723 - RNA, 27 nt, Artificial Sequence
  U3 small nucleolar ribonucleoprotein protein IMP3 (23-31)
gugaccgaccacaaccugcacgagcuc

SEQ ID NO: 40724 - RNA, 27 nt, Artificial Sequence
  Protocadherin Fat 1 (1217-1225)
gugaccgacaacggcagccccccgaag

SEQ ID NO: 40725 - RNA, 30 nt, Artificial Sequence
  Death-inducer obliterator 1 (716-725)
gugaccgacaaccgcuacaagagcaaguac

SEQ ID NO: 40726 - RNA, 33 nt, Artificial Sequence
  Fructose-bisphosphate aldolase A (87-97)
gugaccgagaagguccuggccgccguguacaag

SEQ ID NO: 40727 - RNA, 33 nt, Artificial Sequence
  Prefoldin subunit 4 (11-21)
gugaccuucgaggaccagcagaagaucaacaag

SEQ ID NO: 40728 - RNA, 33 nt, Artificial Sequence
  Phosphoserine aminotransferase (349-359)
gugaccaucgaggacguccagaagcuggccgcc

SEQ ID NO: 40729 - RNA, 39 nt, Artificial Sequence
  Phosphate carrier protein, mitochondrial (107-119)
gugacccugaaggaggacggcguccgcgggcucgccaag

SEQ ID NO: 40730 - RNA, 30 nt, Artificial Sequence
  Apoptosis inhibitor 5 (368-377)
gugacccugagcuggaagcccguccagaag

SEQ ID NO: 40731 - RNA, 30 nt, Artificial Sequence
  Small subunit processome component 20 homolog (830-839)
gugaccaaccccgacaucgccgccaagaag

SEQ ID NO: 40732 - RNA, 27 nt, Artificial Sequence
  Putative PIP5K1A and PSMD4-like protein (656-664)
gugaccguccccccgggccccagccug

SEQ ID NO: 40733 - RNA, 30 nt, Artificial Sequence
  Something about silencing protein 10 (302-311)
gugaccuaccgcaaccugaucaacaagcuc

SEQ ID NO: 40734 - RNA, 27 nt, Artificial Sequence
  116 kDa U5 small nuclear ribonucleoprotein component (795-803)
guggucgcccaggagccccugcaccgc

SEQ ID NO: 40735 - RNA, 27 nt, Artificial Sequence
  E3 ubiquitin-protein ligase TRIM23 (309-317)
guggucgacgcccacgugcgcgagaag

SEQ ID NO: 40736 - RNA, 27 nt, Artificial Sequence
  X-ray repair cross-complementing protein 5 (174-182)
guggucgacgccaagacccugaagaag

SEQ ID NO: 40737 - RNA, 36 nt, Artificial Sequence
  DNA damage-binding protein 1 (364-375)
guggucgaccuggagcgccagggccaggggcagcuc

SEQ ID NO: 40738 - RNA, 33 nt, Artificial Sequence
  Vacuolar protein sorting-associated protein 45 (3-13)
guggucuucgccgugaagcaguacaucagcaag

SEQ ID NO: 40739 - RNA, 33 nt, Artificial Sequence
  60S ribosomal protein L8 (15-25)
guggucuuccgcgaccccuaccgguucaagaag

SEQ ID NO: 40740 - RNA, 30 nt, Artificial Sequence
  Rho-related BTB domain-containing protein 3 (256-265)
guggucuucuacaaccccaaccugaagaag

SEQ ID NO: 40741 - RNA, 33 nt, Artificial Sequence
  Protein FAM171B (18-28)
gugguccugcucaaggcccgccuggugcccgcc

SEQ ID NO: 40742 - RNA, 33 nt, Artificial Sequence
  Clathrin interactor 1 (17-27)
guggucaugaacuacagcgagaucgaguccaag

SEQ ID NO: 40743 - RNA, 33 nt, Artificial Sequence
  Protein disulfide-isomerase A4 (356-366)
guggucaugcagcccgagaaguuccagagcaag

SEQ ID NO: 40744 - RNA, 30 nt, Artificial Sequence
  Sulfate anion transporter 1 (417-426)
guggucagcgccaccguggugcugcucguc

SEQ ID NO: 40745 - RNA, 27 nt, Artificial Sequence
  26S proteasome non-ATPase regulatory subunit 14 (143-151)
guggucguggaccccauccagagcgug

SEQ ID NO: 40746 - RNA, 27 nt, Artificial Sequence
  Sodium/potassium-transporting ATPase subunit alpha-1 (185-193)
guggucgugggcgaccugguggagguc

SEQ ID NO: 40747 - RNA, 27 nt, Artificial Sequence
  Receptor tyrosine-protein kinase erbB-3 (147-155)
guguacaucgagaagaacgacaagcug

SEQ ID NO: 40748 - RNA, 27 nt, Artificial Sequence
  Uncharacterized protein C5orf42 (702-710)
guguacauccugcagcccgaggucauc

SEQ ID NO: 40749 - RNA, 30 nt, Artificial Sequence
  Small nuclear ribonucleoprotein Sm D3 (61-70)
guguacauccgcggcagcaagauccgguuc

SEQ ID NO: 40750 - RNA, 27 nt, Artificial Sequence
  Selenoprotein K (56-64)
guguacaucagcaacggccagguccug

SEQ ID NO: 40751 - RNA, 27 nt, Artificial Sequence
  Fibronectin type III domain-containing protein 3B (651-659)
guguacaagggcgaggaggccaccuuc

SEQ ID NO: 40752 - RNA, 24 nt, Artificial Sequence
  Transmembrane protein 41B (71-78)
guguacaagaacuucccccagcug

SEQ ID NO: 40753 - RNA, 27 nt, Artificial Sequence
  Surfeit locus protein 4 (220-228)
guguacaagcccaugcacgacuuccug

SEQ ID NO: 40754 - RNA, 30 nt, Artificial Sequence
  Mitogen-activated protein kinase-binding protein 1 (356-365)
guguacaacgaccacagcaucuacgucugg

SEQ ID NO: 40755 - RNA, 27 nt, Artificial Sequence
  CMP-N-acetylneuraminate-beta-galactosamide-alpha-2,3-sialyltransf erase 1 (190-198)
guguaccccgagagcuuccgcgagcug

SEQ ID NO: 40756 - RNA, 27 nt, Artificial Sequence
  Inactive tyrosine-protein kinase 7 (603-611)
guguaccagggccacaccgcccugcuc

SEQ ID NO: 40757 - RNA, 27 nt, Artificial Sequence
  Bcl-2 homologous antagonist/killer (142-150)
guguaccagcacggccugaccggguuc

SEQ ID NO: 40758 - RNA, 27 nt, Artificial Sequence
  Rho GTPase-activating protein 5 (413-421)
guguaccagaaccacguccagcaccug

SEQ ID NO: 40759 - RNA, 27 nt, Artificial Sequence
  Mitochondrial peptide methionine sulfoxide reductase (82-90)
guguaccagcccgagcacaugagcuuc

SEQ ID NO: 40760 - RNA, 33 nt, Artificial Sequence
  Complex I assembly factor TIMMDC1, mitochondrial (158-168)
guguaccgcaacaaggacgcccugagccacuuc

SEQ ID NO: 40761 - RNA, 30 nt, Artificial Sequence
  Unconventional myosin-XVIIIa (453-462)
guguacagcgagaaggucaugcacauguuc

SEQ ID NO: 40762 - RNA, 30 nt, Artificial Sequence
  Latent-transforming growth factor beta-binding protein 3 (448-457)
guguacagcuccgccgaguuccacagccug

SEQ ID NO: 40763 - RNA, 27 nt, Artificial Sequence
  Uncharacterized protein C11orf80 (292-300)
guguacacccugcucaccacgcaccug

SEQ ID NO: 40764 - RNA, 27 nt, Artificial Sequence
  Integrin alpha-11 (440-448)
guguacgucgccggcgccccccgcuuc

SEQ ID NO: 40765 - RNA, 27 nt, Artificial Sequence
  Angiomotin (598-606)
guguacgucgacaagguggagaagaug

SEQ ID NO: 40766 - RNA, 27 nt, Artificial Sequence
  Early endosome antigen 1 (285-293)
guguacguccaggagcugcagaagcuc

SEQ ID NO: 40767 - RNA, 27 nt, Artificial Sequence
  Transformation/transcription domain-associated protein (1973-1981)
guguacuaccccguccgccaccaccug

SEQ ID NO: 40768 - RNA, 27 nt, Artificial Sequence
  Actin-binding protein anillin (212-220)
ugggaggacgacgugaaccacagcuuc

SEQ ID NO: 40769 - RNA, 27 nt, Artificial Sequence
  AP-5 complex subunit zeta-1 (1307-1315)
uacgccgccggcgugcacagcguccug

SEQ ID NO: 40770 - RNA, 30 nt, Artificial Sequence
  Proline-rich protein 12 (50-59)
uacgccgccccccacccgcugcagagcuac

SEQ ID NO: 40771 - RNA, 27 nt, Artificial Sequence
  A-kinase anchor protein 12 (1228-1236)
uacgccgacgagaagaccaaggacgug

SEQ ID NO: 40772 - RNA, 27 nt, Artificial Sequence
  Maturin (34-42)
uacgccgaccccggcgugagcuucuac

SEQ ID NO: 40773 - RNA, 27 nt, Artificial Sequence
  Integrin alpha-V (110-118)
uacgccaaggacgacccccuggaguuc

SEQ ID NO: 40774 - RNA, 27 nt, Artificial Sequence
  Ras-related protein Rab-1B (43-51)
uacgccagcgagaacgugaacaagcug

SEQ ID NO: 40775 - RNA, 27 nt, Artificial Sequence
  Acetyl-CoA carboxylase 2 (1068-1076)
uacgccagcaacaucaccuccgugcug

SEQ ID NO: 40776 - RNA, 30 nt, Artificial Sequence
  Translocon-associated protein subunit beta (33-42)
uacgccguggagggccgcgaccugacccuc

SEQ ID NO: 40777 - RNA, 24 nt, Artificial Sequence
  Melanoma-associated antigen B2 (233-240)
uacgacggcgaggagcacagcgug

SEQ ID NO: 40778 - RNA, 33 nt, Artificial Sequence
  Protein phosphatase 1A (59-69)
uacgacggccacgccgggagccagguggccaag

SEQ ID NO: 40779 - RNA, 27 nt, Artificial Sequence
  NAD(P)H dehydrogenase (quinone) 1 (130-138)
uacgacaagggccccuuccgcagcaag

SEQ ID NO: 40780 - RNA, 30 nt, Artificial Sequence
  Proteasome subunit beta type-4 (177-186)
uacgaggcccccagccuggccaccggcuac

SEQ ID NO: 40781 - RNA, 27 nt, Artificial Sequence
  RNA-binding motif protein, X-linked 2 (84-92)
uacgaggaccagcgcagcaccauccug

SEQ ID NO: 40782 - RNA, 27 nt, Artificial Sequence
  SAP30-binding protein (41-49)
uacggcgaggacgacuucagccgccug

SEQ ID NO: 40783 - RNA, 27 nt, Artificial Sequence
  Tubulin-specific chaperone C (219-227)
uacggcaaccccaacacccugcgccuc

SEQ ID NO: 40784 - RNA, 27 nt, Artificial Sequence
  Regulator of microtubule dynamics protein 1 (188-196)
uacaucaucaaggagcacuucgagaag

SEQ ID NO: 40785 - RNA, 27 nt, Artificial Sequence
  Tensin-3 (11-19)
uacaucaccgagcgcaucaucgccgug

SEQ ID NO: 40786 - RNA, 27 nt, Artificial Sequence
  Uncharacterized protein CXorf57 (109-117)
uaccuggaccccagccucaacucccug

SEQ ID NO: 40787 - RNA, 27 nt, Artificial Sequence
  Ragulator complex protein LAMTOR2 (114-122)
uaccuggaggagccccucacccaggug

SEQ ID NO: 40788 - RNA, 27 nt, Artificial Sequence
  HLA class I histocompatibility antigen, B-15 alpha chain (195-203)
uaccuggagaacggcaaggagacccuc

SEQ ID NO: 40789 - RNA, 27 nt, Artificial Sequence
  Proteasome activator complex subunit 4 (1375-1383)
uaccuggagcccaagcucacccaggug

SEQ ID NO: 40790 - RNA, 27 nt, Artificial Sequence
  Inhibitor of nuclear factor kappa-B kinase subunit alpha (354-362)
uaccuguucgacaagagcaagaccgug

SEQ ID NO: 40791 - RNA, 27 nt, Artificial Sequence
  Unconventional myosin-X (243-251)
uaccugcucgagaagaaccgcgugguc

SEQ ID NO: 40792 - RNA, 33 nt, Artificial Sequence
  Protein-lysine N-methyltransferase EEF2KMT (112-122)
uaccugcuccccagcggcggguccgugacccug

SEQ ID NO: 40793 - RNA, 27 nt, Artificial Sequence
  ER lumen protein-retaining receptor 3 (196-204)
uaccuguacgugaccaagguccucaag

SEQ ID NO: 40794 - RNA, 30 nt, Artificial Sequence
  Zinc-binding alcohol dehydrogenase domain-containing protein 2 (355-364)
uacauguacaugggcaagaacaccgggaag

SEQ ID NO: 40795 - RNA, 27 nt, Artificial Sequence
  Ubiquitin-60S ribosomal protein L40 (64-72)
uacaacauccagaaggagagcacccug

SEQ ID NO: 40796 - RNA, 30 nt, Artificial Sequence
  Disabled homolog 2-interacting protein (418-427)
uaccccgacgaccgcaccgcccggacccug

SEQ ID NO: 40797 - RNA, 33 nt, Artificial Sequence
  7-methylguanosine phosphate-specific 5'-nucleotidase (85-95)
uaccccaucgagaucgacccgcaccgcaccgug

SEQ ID NO: 40798 - RNA, 27 nt, Artificial Sequence
  RNA polymerase II-associated protein 3 (96-104)
uaccccaaggaggccgacaucgugauc

SEQ ID NO: 40799 - RNA, 27 nt, Artificial Sequence
  Rabankyrin-5 (262-270)
uacccccugcacaaggccaucaaggug

SEQ ID NO: 40800 - RNA, 27 nt, Artificial Sequence
  AP-1 complex subunit beta-1 (421-429)
uaccccaacaaguacgagagcgugauc

SEQ ID NO: 40801 - RNA, 27 nt, Artificial Sequence
  Ataxin-2 (759-767)
uaccccgugccggucagccccggcgug

SEQ ID NO: 40802 - RNA, 27 nt, Artificial Sequence
  Ataxin-2-like protein (752-760)
uaccccuacccggugagcaacuccguc

SEQ ID NO: 40803 - RNA, 27 nt, Artificial Sequence
  Long-chain-fatty-acid-CoA ligase 3 (709-717)
uaccaggccgacaucgagcgcauguac

SEQ ID NO: 40804 - RNA, 27 nt, Artificial Sequence
  RNA-binding motif protein 22 (253-261)
uaccaguucggcgagauccgcaccauc

SEQ ID NO: 40805 - RNA, 27 nt, Artificial Sequence
  Copine-1 (66-74)
uaccgcuucgagaccgugcagaagcug

SEQ ID NO: 40806 - RNA, 24 nt, Artificial Sequence
  Fibronectin type III domain-containing protein 3B (557-564)
uaccgcggccccagccacaccuac

SEQ ID NO: 40807 - RNA, 27 nt, Artificial Sequence
  Myosin-9 (40-48)
uaccgcaucggccagagcaagguguuc

SEQ ID NO: 40808 - RNA, 27 nt, Artificial Sequence
  Fatty acid desaturase 2 (166-174)
uaccgcaagcccaaguggaaccaccug

SEQ ID NO: 40809 - RNA, 27 nt, Artificial Sequence
  Breast cancer anti-estrogen resistance protein 3 (757-765)
uaccgcaugaacgccgagcggauccug

SEQ ID NO: 40810 - RNA, 27 nt, Artificial Sequence
  Unconventional myosin-Ib (72-80)
uaccgcaaccggaacuucuacgagcug

SEQ ID NO: 40811 - RNA, 27 nt, Artificial Sequence
  Constitutive coactivator of PPAR-gamma-like protein 1 (602-610)
uaccgccccgugcggcaguacgucuac

SEQ ID NO: 40812 - RNA, 27 nt, Artificial Sequence
  E3 ubiquitin-protein ligase MARCH6 (469-477)
uacagcgacgcccccguguccgagcug

SEQ ID NO: 40813 - RNA, 33 nt, Artificial Sequence
  Discoidin, CUB and LCCL domain-containing protein 2 (339-349)
uacagcgacgacggccagaaguggaccguguac

SEQ ID NO: 40814 - RNA, 27 nt, Artificial Sequence
  TM2 domain-containing protein 2 (68-76)
uacagcgacguggagcacaccuccguc

SEQ ID NO: 40815 - RNA, 27 nt, Artificial Sequence
  Caveolin-2 (19-27)
uacagccaccacuccggccuggaguac

SEQ ID NO: 40816 - RNA, 33 nt, Artificial Sequence
  Calcium-responsive transactivator (198-208)
uacagcuccgcccagggcgggagccagcacuac

SEQ ID NO: 40817 - RNA, 30 nt, Artificial Sequence
  Paxillin (31-40)
uacagcuaccccaccggcaaccacaccuac

SEQ ID NO: 40818 - RNA, 27 nt, Artificial Sequence
  Uridine phosphorylase 1 (20-28)
uacaccgagaaggacaagcaggccuac

SEQ ID NO: 40819 - RNA, 33 nt, Artificial Sequence
  Nucleolin (463-473)
uacaccggcgagaaggggcagaaccaggacuac

SEQ ID NO: 40820 - RNA, 27 nt, Artificial Sequence
  Melanophilin (121-129)
uacuacgagcacgugaaggcccgcuuc

SEQ ID NO: 40821 - RNA, 27 nt, Artificial Sequence
  26S proteasome non-ATPase regulatory subunit 3 (212-220)
uacuaccacgcccgcguguacgaguuc

SEQ ID NO: 40822 - RNA, 27 nt, Artificial Sequence
  Neuroepithelial cell-transforming gene 1 protein (222-230)
uacuacaucgacaagcuggaguaccuc

SEQ ID NO: 40823 - RNA, 27 nt, Artificial Sequence
  Disheveled-associated activator of morphogenesis 2 (101-109)
uacuacaucgaccgcaucaacagcaug

SEQ ID NO: 40824 - RNA, 30 nt, Artificial Sequence
  DNA-dependent protein kinase catalytic subunit (3101-3110)
uacuacauccagaacggcauccagagcuuc

SEQ ID NO: 40825 - RNA, 27 nt, Artificial Sequence
  Coiled-coil domain-containing protein 130 (79-87)
uacuacaccacccccaucuaccgcuuc

SEQ ID NO: 40826 - RNA, 27 nt, Artificial Sequence
  RING finger protein 145 (469-477)
uacuacgugaacggcaccuaccgccug

SEQ ID NO: 40827 - RNA, 27 nt, Artificial Sequence
  EH domain-containing protein 4 (505-513)
gcccuggccaagcaccucaucaagauc

SEQ ID NO: 40828 - RNA, 24 nt, Artificial Sequence
  Ubiquitin carboxyl-terminal hydrolase 10 (606-613)
uucggcgggcacauccgcagcgug

SEQ ID NO: 40829 - RNA, 21 nt, Artificial Sequence
  Guanine nucleotide-binding protein subunit beta-5 (322-328)
uucggccacgagaaccgcgug

SEQ ID NO: 40830 - RNA, 30 nt, Artificial Sequence
  Alpha-actinin-3 (113-122)
uucaucgccagcaagggcgugaagcugguc

SEQ ID NO: 40831 - RNA, 27 nt, Artificial Sequence
  Transcriptional regulator Kaiso (564-572)
uucaugagcucccacaucaagagcgug

SEQ ID NO: 40832 - RNA, 33 nt, Artificial Sequence
  DNA fragmentation factor subunit alpha (139-149)
auccugcucagcgaggaggaccugcagaugcug

SEQ ID NO: 40833 - RNA, 27 nt, Artificial Sequence
  Serine/threonine-protein kinase ULK3 (108-116)
auccugcccgagaagguggcccgcguc

SEQ ID NO: 40834 - RNA, 27 nt, Artificial Sequence
  Protein-lysine N-methyltransferase EEF2KMT (154-162)
aagcuggacagcccccgcgugaccguc

SEQ ID NO: 40835 - RNA, 27 nt, Artificial Sequence
  WASH complex subunit 7 (85-93)
aaggugcugaacaaggucaucaccgug

SEQ ID NO: 40836 - RNA, 24 nt, Artificial Sequence
  Myelin expression factor 2 (298-305)
cuguucgaccgccccaugcacgug

SEQ ID NO: 40837 - RNA, 27 nt, Artificial Sequence
  cAMP-specific 3',5'-cyclic phosphodiesterase 4B (450-458)
cugcucgccgaccugaagaccauggug

SEQ ID NO: 40838 - RNA, 27 nt, Artificial Sequence
  Multifunctional methyltransferase subunit TRM112-like protein (8-16)
cugcucagcucccacgugcgcggcguc

SEQ ID NO: 40839 - RNA, 21 nt, Artificial Sequence
  60S ribosomal protein L19 (120-126)
auggagcacauccacaagcug

SEQ ID NO: 40840 - RNA, 27 nt, Artificial Sequence
  Melanoma antigen preferentially expressed in tumors (394-402)
cagcugcucgcccugcugcccagccuc

SEQ ID NO: 40841 - RNA, 27 nt, Artificial Sequence
  Proteasome activator complex subunit 4 (564-572)
cagcugcucagcgagaucacccgcgug

SEQ ID NO: 40842 - RNA, 27 nt, Artificial Sequence
  Eukaryotic translation initiation factor 3 subunit C (478-486)
caggugugcgccaucaucgagcgcguc

SEQ ID NO: 40843 - RNA, 27 nt, Artificial Sequence
  Methylsterol monooxygenase 1 (33-41)
cgcaucuacaaguacauccacaaggug

SEQ ID NO: 40844 - RNA, 27 nt, Artificial Sequence
  Spectrin beta chain, erythrocytic (86-94)
cgcaugcugaucaagcuccuggaggug

SEQ ID NO: 40845 - RNA, 33 nt, Artificial Sequence
  NHP2-like protein 1 (118-128)
agcauccagcaguccaucgagcgccugcucgug

SEQ ID NO: 40846 - RNA, 27 nt, Artificial Sequence
  Erlin-2 (41-49)
agccuguucuccgccgugcacaagauc

SEQ ID NO: 40847 - RNA, 27 nt, Artificial Sequence
  Protein FAM214A (403-411)
agccugcacuccaagcucuuccgcgug

SEQ ID NO: 40848 - RNA, 27 nt, Artificial Sequence
  Vacuole membrane protein 1 (82-90)
agccugugguccaucaucagcaaggug

SEQ ID NO: 40849 - RNA, 27 nt, Artificial Sequence
  Potassium voltage-gated channel subfamily KQT member 5 (530-538)
agcaugcugggccgcguggucaaggug

SEQ ID NO: 40850 - RNA, 27 nt, Artificial Sequence
  Sialate O-acetylesterase (32-40)
accaucaugaagaaggugaccagcguc

SEQ ID NO: 40851 - RNA, 33 nt, Artificial Sequence
  Protein ELFN1 (17-27)
acccugcuccacgccggcgggcuggcccgcgcg

SEQ ID NO: 40852 - RNA, 27 nt, Artificial Sequence
  Reticulocalbin-1 (21-29)
gugcuggccccccgcguccuccgggcc

SEQ ID NO: 40853 - RNA, 27 nt, Artificial Sequence
  Eukaryotic translation initiation factor 3 subunit A (379-387)
gugcugcaguacgucgugcccgaggug

SEQ ID NO: 40854 - RNA, 27 nt, Artificial Sequence
  Intraflagellar transport protein 81 homolog (117-125)
uaccuggcccgcuuccucaucaagcug

SEQ ID NO: 40855 - RNA, 27 nt, Artificial Sequence
  Small subunit processome component 20 homolog (154-162)
uaccuguacaaguaccucuggcgccug

SEQ ID NO: 40856 - RNA, 45 nt, Artificial Sequence
  Serum albumin (438-452)
aaggugccccaggucagcaccccgacccugguggaggugucccgc

SEQ ID NO: 40857 - RNA, 27 nt, Artificial Sequence
  Beta-secretase 2 (5-13)
gcccgcgcccugcuccugccccugcuc

SEQ ID NO: 40858 - RNA, 27 nt, Artificial Sequence
  Proteasome subunit beta type-4 (79-87)
gcccgcuuccggaacaucagccgcauc

SEQ ID NO: 40859 - RNA, 30 nt, Artificial Sequence
  Protein sel-1 homolog 1 (629-638)
gcccgcaucaagcugggcgacuaccacuuc

SEQ ID NO: 40860 - RNA, 30 nt, Artificial Sequence
  Lon protease homolog 2, peroxisomal (291-300)
gcccgcauccugcucgacaacgaccacuac

SEQ ID NO: 40861 - RNA, 33 nt, Artificial Sequence
  NAD(P)H dehydrogenase (quinone) 1 (128-138)
gcccgcauccagauccuggagggcuggaagaag

SEQ ID NO: 40862 - RNA, 27 nt, Artificial Sequence
  Zinc finger protein 721 (73-81)
gcccgcgugaaggucuucagcaaguuc

SEQ ID NO: 40863 - RNA, 27 nt, Artificial Sequence
  TATA-box-binding protein (218-226)
gcccgcgugguccagaagcugggcuuc

SEQ ID NO: 40864 - RNA, 66 nt, Artificial Sequence
  Plectin (3368-3389)
gccaccaccgccgcgcugcuccuggaggcccaggccgccacgggcuuccugguggaccccguccgc

SEQ ID NO: 40865 - RNA, 27 nt, Artificial Sequence
  Coatomer subunit alpha (338-346)
gaccgcuuccugcggcagcucgacuuc

SEQ ID NO: 40866 - RNA, 27 nt, Artificial Sequence
  Mannosyl-oligosaccharide glucosidase (370-378)
gagcgcuucgagaagaccuuccagcug

SEQ ID NO: 40867 - RNA, 27 nt, Artificial Sequence
  General transcription factor II-I (386-394)
gagcgcauccgguucgugaucaagaag

SEQ ID NO: 40868 - RNA, 27 nt, Artificial Sequence
  NADH dehydrogenase (ubiquinone) 1 beta subcomplex subunit 4 (35-43)
gagcgccuggccauccgggcccagcuc

SEQ ID NO: 40869 - RNA, 27 nt, Artificial Sequence
  Cytoplasmic dynein 1 heavy chain 1 (2441-2449)
uuccagcuggagcacaucauggaccuc

SEQ ID NO: 40870 - RNA, 27 nt, Artificial Sequence
  AP-2 complex subunit sigma (52-60)
uuccgcaacuucaagaucaucuaccgg

SEQ ID NO: 40871 - RNA, 30 nt, Artificial Sequence
  Protein scribble homolog (1146-1155)
ggccgcgacgggcggcugcgcgugggccuc

SEQ ID NO: 40872 - RNA, 30 nt, Artificial Sequence
  Disintegrin and metalloproteinase domain-containing protein 10 (14-23)
ggccgcuucgagggguucauccagacccgg

SEQ ID NO: 40873 - RNA, 33 nt, Artificial Sequence
  Mitogen-activated protein kinase kinase kinase 12 (175-185)
ggccgcuuccacggggaggagguggccgucaag

SEQ ID NO: 40874 - RNA, 30 nt, Artificial Sequence
  Rho guanine nucleotide exchange factor 2 (459-468)
ggccgcuucaaggacgugcugguccuccug

SEQ ID NO: 40875 - RNA, 27 nt, Artificial Sequence
  Dolichyl-diphosphooligosaccharide-proteinosyltransferase subunit STT3A (230-238)
ggccgcuucagccaccggaucuacgug

SEQ ID NO: 40876 - RNA, 27 nt, Artificial Sequence
  Small nuclear ribonucleoprotein-associated proteins B and B' (17-25)
ggccgcaucuucaucgggaccuucaag

SEQ ID NO: 40877 - RNA, 27 nt, Artificial Sequence
  Sorbitol dehydrogenase (55-63)
ggccgcaucgggaacuucaucgugaag

SEQ ID NO: 40878 - RNA, 30 nt, Artificial Sequence
  Sorbitol dehydrogenase (55-64)
ggccgcaucgggaacuucaucgugaagaag

SEQ ID NO: 40879 - RNA, 27 nt, Artificial Sequence
  Dystonin (345-353)
ggccgcaucaagcugcuccagggguac

SEQ ID NO: 40880 - RNA, 27 nt, Artificial Sequence
  26S protease regulatory subunit 6B (325-333)
ggccgccuggaccggaagaucgaguuc

SEQ ID NO: 40881 - RNA, 27 nt, Artificial Sequence
  Serine/threonine-protein phosphatase 6 regulatory subunit 3 (311-319)
ggccgccuggggagcuuccacgagcuc

SEQ ID NO: 40882 - RNA, 30 nt, Artificial Sequence
  H(+)/Cl(-) exchange transporter 3 (772-781)
ggccgccugcucgggaucaucaccaagaag

SEQ ID NO: 40883 - RNA, 27 nt, Artificial Sequence
  Thioredoxin reductase 1, cytoplasmic (45-53)
ggccgccugcagaagcuccugaagaug

SEQ ID NO: 40884 - RNA, 27 nt, Artificial Sequence
  Aurora kinase A-interacting protein (40-48)
ggccgccugaccagccagcuccugcgg

SEQ ID NO: 40885 - RNA, 30 nt, Artificial Sequence
  Lon protease homolog 2, peroxisomal (714-723)
ggccgccuggugcggagcgacgucgccaug

SEQ ID NO: 40886 - RNA, 30 nt, Artificial Sequence
  Up-regulated during skeletal muscle growth protein 5 (26-35)
ggccgcaugaacugcgugcuggccaccuac

SEQ ID NO: 40887 - RNA, 27 nt, Artificial Sequence
  Tetratricopeptide repeat protein 12 (373-381)
ggccgcagccugaucaucaaccaccuc

SEQ ID NO: 40888 - RNA, 30 nt, Artificial Sequence
  Plectin (2680-2689)
ggccgcagcuccaucgccgggcugcuccug

SEQ ID NO: 40889 - RNA, 27 nt, Artificial Sequence
  Nucleolar protein 11 (40-48)
ggccgcaccgugauccuguacaagguc

SEQ ID NO: 40890 - RNA, 48 nt, Artificial Sequence
  HLA class I histocompatibility antigen, A-1 alpha chain (25-40)
ggcagccacuccaugcgcuacuucuucaccagcgugucccggcccggg

SEQ ID NO: 40891 - RNA, 27 nt, Artificial Sequence
  Transcription factor E2F4 (157-165)
auccgcgcccccagcggcaccucccug

SEQ ID NO: 40892 - RNA, 27 nt, Artificial Sequence
  CAP-Gly domain-containing linker protein 4 (454-462)
auccgcuucuucggcaccaccaacuuc

SEQ ID NO: 40893 - RNA, 33 nt, Artificial Sequence
  Glutamine synthetase (323-333)
auccgcaucccccggaccgugggccaggagaag

SEQ ID NO: 40894 - RNA, 33 nt, Artificial Sequence
  NADH dehydrogenase (ubiquinone) iron-sulfur protein 5 (8-18)
aagcgcuucggccugaacaucgaccgguggcuc

SEQ ID NO: 40895 - RNA, 30 nt, Artificial Sequence
  Cytoplasmic dynein 2 heavy chain 1 (804-813)
aagcgcuucaucggcauccccaaccaguuc

SEQ ID NO: 40896 - RNA, 27 nt, Artificial Sequence
  DNA-dependent protein kinase catalytic subunit (1074-1082)
aagcgccugggcgccagccucgccuuc

SEQ ID NO: 40897 - RNA, 27 nt, Artificial Sequence
  Fatty acyl-CoA reductase 1 (327-335)
aagcgcaacccccuggagcaggccuuc

SEQ ID NO: 40898 - RNA, 27 nt, Artificial Sequence
  ATP-dependent RNA helicase DDX18 (403-411)
aagcgcaccaccacguucuuccaguuc

SEQ ID NO: 40899 - RNA, 30 nt, Artificial Sequence
  Talin-1 (357-366)
aagcgcugggccgccagccccaaguccuuc

SEQ ID NO: 40900 - RNA, 27 nt, Artificial Sequence
  ATP-dependent RNA helicase DHX8 (289-297)
aagcgcugggagggccuggugcacauc

SEQ ID NO: 40901 - RNA, 27 nt, Artificial Sequence
  Eukaryotic translation initiation factor 4 gamma 1 (570-578)
aagcgcuacgaccgggaguuccugcuc

SEQ ID NO: 40902 - RNA, 27 nt, Artificial Sequence
  E3 ubiquitin-protein ligase RNF213 (1227-1235)
cugcgcgacagccacaucuuccagcuc

SEQ ID NO: 40903 - RNA, 27 nt, Artificial Sequence
  Eukaryotic initiation factor 4A-II (229-237)
augcgcgaccccauccggauccuggug

SEQ ID NO: 40904 - RNA, 27 nt, Artificial Sequence
  Abhydrolase domain-containing protein 2 (327-335)
augcgcuaccugcaccggaucuacgug

SEQ ID NO: 40905 - RNA, 27 nt, Artificial Sequence
  Uncharacterized protein C15orf41 (140-148)
aaccgcuucggccccgggcuggugauc

SEQ ID NO: 40906 - RNA, 27 nt, Artificial Sequence
  Heat shock protein HSP 90-alpha (808-816)
aaccgcaucuaccggaugaucaagcug

SEQ ID NO: 40907 - RNA, 27 nt, Artificial Sequence
  Guanine nucleotide-binding protein G(s) subunit alpha isoforms short (265-273)
aaccgcuggcugcggaccaucagcgug

SEQ ID NO: 40908 - RNA, 42 nt, Artificial Sequence
  Zinc finger protein 608 (42-55)
cccgccagcccgggcgccgggaacccccccggcacccccaag

SEQ ID NO: 40909 - RNA, 27 nt, Artificial Sequence
  Eukaryotic translation initiation factor 3 subunit L (152-160)
cagcgcuucgagagcuacuacaacuac

SEQ ID NO: 40910 - RNA, 27 nt, Artificial Sequence
  Eukaryotic translation initiation factor 3 subunit A (316-324)
cagcgcaugagcacccgggugcugcuc

SEQ ID NO: 40911 - RNA, 27 nt, Artificial Sequence
  Transmembrane protein 141 (54-62)
cgcaaguuccccuacccgcugcagugg

SEQ ID NO: 40912 - RNA, 33 nt, Artificial Sequence
  Nuclear envelope integral membrane protein 1 (157-167)
cgccgguucgaccccaagcuguuccucguguuc

SEQ ID NO: 40913 - RNA, 33 nt, Artificial Sequence
  Unconventional myosin-Id (770-780)
cgccgguucgaggaggcccugcagaccaucuuc

SEQ ID NO: 40914 - RNA, 39 nt, Artificial Sequence
  Pre-mRNA-processing-splicing factor 8 (820-832)
cgccgguucagccccaucccguuccccccccuguccuac

SEQ ID NO: 40915 - RNA, 27 nt, Artificial Sequence
  Exportin-1 (596-604)
cgccggcacuucgugcagguccaggug

SEQ ID NO: 40916 - RNA, 30 nt, Artificial Sequence
  Negative elongation factor C/D (83-92)
cgccggaucgcccaggaggugcagcgcuuc

SEQ ID NO: 40917 - RNA, 30 nt, Artificial Sequence
  cAMP-dependent protein kinase type I-beta regulatory subunit (232-241)
cgccggauccugaugggcagcacccuccgc

SEQ ID NO: 40918 - RNA, 30 nt, Artificial Sequence
  Cytoplasmic FMR1-interacting protein 2 (148-157)
cgccggaaggacuucgugagcgaggccuac

SEQ ID NO: 40919 - RNA, 27 nt, Artificial Sequence
  Nuclear pore complex protein Nup98-Nup96 (778-786)
cgccggaaggagguggucguguaccug

SEQ ID NO: 40920 - RNA, 30 nt, Artificial Sequence
  NADH dehydrogenase (ubiquinone) 1 alpha subcomplex subunit 13 (49-58)
cgccggcugcagaucgaggacuucgaggcc

SEQ ID NO: 40921 - RNA, 30 nt, Artificial Sequence
  Signal peptide peptidase-like 2A (5-14)
cgccggcugagccccgccggcgccgcgcuc

SEQ ID NO: 40922 - RNA, 39 nt, Artificial Sequence
  Splicing factor, proline- and glutamine-rich (547-559)
cgccggauggaggagcugcacaaccaggagaugcagaag

SEQ ID NO: 40923 - RNA, 27 nt, Artificial Sequence
  Probable ATP-dependent RNA helicase DDX10 (353-361)
cgccggauggagguguacaacgaguuc

SEQ ID NO: 40924 - RNA, 36 nt, Artificial Sequence
  40S ribosomal protein S21 (60-71)
cgccggaugggcgagagcgacgacuccauccugcgc

SEQ ID NO: 40925 - RNA, 27 nt, Artificial Sequence
  HLA class II histocompatibility antigen, DQ beta 1 chain (88-96)
cgccggguggagcccaccgucaccauc

SEQ ID NO: 40926 - RNA, 36 nt, Artificial Sequence
  HLA class I histocompatibility antigen, B-15 alpha chain (193-204)
cgccgguaccuggagaacggcaaggagacccuccag

SEQ ID NO: 40927 - RNA, 27 nt, Artificial Sequence
  Glucoside xylosyltransferase 1 (2-10)
cgccgguaccugcgcguggucgugcuc

SEQ ID NO: 40928 - RNA, 33 nt, Artificial Sequence
  Eukaryotic initiation factor 4A-I (168-178)
cgccgguaccugagccccaaguacaucaagaug

SEQ ID NO: 40929 - RNA, 45 nt, Artificial Sequence
  HLA class II histocompatibility antigen, DR alpha chain (48-62)
agcuucgaggcccagggcgcccuggcgaacaucgccguggacaag

SEQ ID NO: 40930 - RNA, 30 nt, Artificial Sequence
  EH domain-containing protein 4 (129-138)
agccgcuucggcaacgccuuccugaaccgg

SEQ ID NO: 40931 - RNA, 30 nt, Artificial Sequence
  Cohesin subunit SA-2 (369-378)
agccgcuucaaggaccggaucguguccaug

SEQ ID NO: 40932 - RNA, 27 nt, Artificial Sequence
  Nucleolar pre-ribosomal-associated protein 1 (628-636)
agccgcuucaaccgguacuacucccug

SEQ ID NO: 40933 - RNA, 27 nt, Artificial Sequence
  26S proteasome non-ATPase regulatory subunit 13 (153-161)
agccgcuucuacgaccuguccagcaag

SEQ ID NO: 40934 - RNA, 27 nt, Artificial Sequence
  Lysine-specific demethylase 3A (1085-1093)
agccgccugcccaacuacuucgugcgg

SEQ ID NO: 40935 - RNA, 27 nt, Artificial Sequence
  RRP12-like protein (519-527)
acccgccugggcuucuucaccacguac

SEQ ID NO: 40936 - RNA, 27 nt, Artificial Sequence
  Voltage-dependent anion-selective channel protein 2 (165-173)
acccgcaacaacuucgccgugggcuac

SEQ ID NO: 40937 - RNA, 33 nt, Artificial Sequence
  Dolichyl-diphosphooligosaccharide-proteinosyltransferase 48 kDa subunit (358-368)
gugcgcaucgaccccuucguccggaccuuccug

SEQ ID NO: 40938 - RNA, 27 nt, Artificial Sequence
  Phosphatidylinositol 4-phosphate 5-kinase type-1 alpha (54-62)
uaccgcuucgugaagaagcuggagcac

SEQ ID NO: 40939 - RNA, 27 nt, Artificial Sequence
  PERQ amino acid-rich with GYF domain-containing protein 2 (41-49)
uaccgcuacggccgggaggagaugcug

SEQ ID NO: 40940 - RNA, 27 nt, Artificial Sequence
  Alpha-actinin-1 (567-575)
gccauccugggcauccacaacgaggug

SEQ ID NO: 40941 - RNA, 27 nt, Artificial Sequence
  CCR4-NOT transcription complex subunit 1 (2294-2302)
gccauccaggagcagaucacccgcgug

SEQ ID NO: 40942 - RNA, 30 nt, Artificial Sequence
  GEM-interacting protein (553-562)
gcccuggacgugcagggcaucuaccgcguc

SEQ ID NO: 40943 - RNA, 30 nt, Artificial Sequence
  Glycogen phosphorylase, brain form (417-426)
gcccuguuccccggcgacguggaccgccuc

SEQ ID NO: 40944 - RNA, 39 nt, Artificial Sequence
  T-complex protein 1 subunit gamma (186-198)
gaggagaacggccgcaaggagaucgacaucaagaaguac

SEQ ID NO: 40945 - RNA, 27 nt, Artificial Sequence
  Glycerol-3-phosphate dehydrogenase, mitochondrial (467-475)
gagaccgcccgcaaguuccuguacuac

SEQ ID NO: 40946 - RNA, 27 nt, Artificial Sequence
  Hexokinase-2 (850-858)
ggccuggacgcccucaaggugaccguc

SEQ ID NO: 40947 - RNA, 27 nt, Artificial Sequence
  NF-kappa-B-repressing factor (193-201)
ggcagcgacaagaucaacuacaccuac

SEQ ID NO: 40948 - RNA, 27 nt, Artificial Sequence
  Galectin-3 (217-225)
caccugcuccaguacaaccaccgcgug

SEQ ID NO: 40949 - RNA, 27 nt, Artificial Sequence
  Serine-protein kinase ATM (2898-2906)
aagauccugcccaccccggagaccgug

SEQ ID NO: 40950 - RNA, 27 nt, Artificial Sequence
  F-box only protein 7 (226-234)
aagaucaacaacgagauccgcagcgug

SEQ ID NO: 40951 - RNA, 27 nt, Artificial Sequence
  DNA topoisomerase 2-beta (151-159)
aagcuggacgagaccggcguggcccuc

SEQ ID NO: 40952 - RNA, 30 nt, Artificial Sequence
  Coatomer subunit gamma-1 (75-84)
aagcuguuccagagcaacgaccccacccuc

SEQ ID NO: 40953 - RNA, 30 nt, Artificial Sequence
  Protein S100-A6 (47-56)
aagcugcaggacgccgagaucgcccgccuc

SEQ ID NO: 40954 - RNA, 27 nt, Artificial Sequence
  Nucleoprotein TPR (699-707)
aagcugcaggagcaggugaccgaccuc

SEQ ID NO: 40955 - RNA, 27 nt, Artificial Sequence
  Unconventional myosin-Ic (409-417)
aagcugcagcagcucuucaucgagcug

SEQ ID NO: 40956 - RNA, 27 nt, Artificial Sequence
  26S proteasome non-ATPase regulatory subunit 11 (159-167)
aagauggacgacaaggcccugcucgug

SEQ ID NO: 40957 - RNA, 27 nt, Artificial Sequence
  Serine/threonine-protein kinase/endoribonuclease IRE1 (690-698)
aagccccacaacauccugaucagcaug

SEQ ID NO: 40958 - RNA, 27 nt, Artificial Sequence
  Zinc finger protein 277 (158-166)
aagagcgagcugggccucaacuucuac

SEQ ID NO: 40959 - RNA, 27 nt, Artificial Sequence
  Profilin-1 (105-113)
aagaccgacaagacccuggugcuccug

SEQ ID NO: 40960 - RNA, 27 nt, Artificial Sequence
  RHO/RAC effector protein (462-470)
aagaccgagcgcagcgaccuggaguac

SEQ ID NO: 40961 - RNA, 27 nt, Artificial Sequence
  Replication protein A 70 kDa DNA-binding subunit (489-497)
aaggugaucgaccagcagaacggccug

SEQ ID NO: 40962 - RNA, 27 nt, Artificial Sequence
  Plectin (2572-2580)
cugcucgccgaggagaaccagcgccug

SEQ ID NO: 40963 - RNA, 27 nt, Artificial Sequence
  Clathrin heavy chain 1 (333-341)
aacaucauccccuacaucaccaacgug

SEQ ID NO: 40964 - RNA, 27 nt, Artificial Sequence
  Cell division cycle protein 27 homolog (216-224)
aaccuggagagcuccaacagcaaguac

SEQ ID NO: 40965 - RNA, 30 nt, Artificial Sequence
  Band 4.1-like protein 2 (252-261)
aaccugcucgagaaggacuacuucggccug

SEQ ID NO: 40966 - RNA, 27 nt, Artificial Sequence
  Keratin, type I cytoskeletal 18 (100-108)
cgccuggccgccgacgacuuccgggug

SEQ ID NO: 40967 - RNA, 30 nt, Artificial Sequence
  Vacuolar protein sorting-associated protein 35 (226-235)
cgccugagccagcucgagggcgugaacguc

SEQ ID NO: 40968 - RNA, 27 nt, Artificial Sequence
  DNA topoisomerase 2-alpha (230-238)
agccuggacaaggacaucguggcccuc

SEQ ID NO: 40969 - RNA, 27 nt, Artificial Sequence
  Ubiquitin carboxyl-terminal hydrolase 14 (241-249)
agccugaucgaccaguucuucggcgug

SEQ ID NO: 40970 - RNA, 27 nt, Artificial Sequence
  Calcium-binding mitochondrial carrier protein Aralar1 (25-33)
agcaccgagguggacggcgagcgcuac

SEQ ID NO: 40971 - RNA, 27 nt, Artificial Sequence
  Thymosin beta-10 (26-34)
accgagacccaggagaagaacacgcug

SEQ ID NO: 40972 - RNA, 27 nt, Artificial Sequence
  L-lactate dehydrogenase B chain (323-331)
acccugugggacauccagaaggaccuc

SEQ ID NO: 40973 - RNA, 27 nt, Artificial Sequence
  SAM and SH3 domain-containing protein 1 (299-307)
gugcuggacgagcgcagcgcccucuac

SEQ ID NO: 40974 - RNA, 27 nt, Artificial Sequence
  Centromere protein F (684-692)
gugcuggacagcaaguccgucgaggug

SEQ ID NO: 40975 - RNA, 30 nt, Artificial Sequence
  N(G),N(G)-dimethylarginine dimethylaminohydrolase 1 (92-101)
gugcuguucaccggccgcgaguucuucguc

SEQ ID NO: 40976 - RNA, 60 nt, Artificial Sequence
  Cytochrome c oxidase subunit 7C, mitochondrial (44-63)
uacuucggcagcgccuucgccacccccuuccuggugguccgccaccagcuccugaagacc

SEQ ID NO: 40977 - RNA, 27 nt, Artificial Sequence
  GTP-binding protein Rit1 (134-142)
uacaucgacgacguguuccacgcccug

SEQ ID NO: 40978 - RNA, 27 nt, Artificial Sequence
  WASH complex subunit 7 (733-741)
uaccuggacaagaccuucuacaaccuc

SEQ ID NO: 40979 - RNA, 30 nt, Artificial Sequence
  Coatomer subunit alpha (707-716)
uaccugaucaccggcaaccucgagaagcug

SEQ ID NO: 40980 - RNA, 27 nt, Artificial Sequence
  cAMP-dependent protein kinase type I-alpha regulatory subunit (126-134)
gccgcccuggcgaaggccaucgagaag

SEQ ID NO: 40981 - RNA, 24 nt, Artificial Sequence
  Fatty acid synthase (1645-1652)
gccgccagcgugcccgucguguac

SEQ ID NO: 40982 - RNA, 27 nt, Artificial Sequence
  Matrix Gla protein (90-98)
gccgccuacaaccgcuacuuccggaag

SEQ ID NO: 40983 - RNA, 24 nt, Artificial Sequence
  60S ribosomal protein L10 (29-36)
gccaagauccgcaucuucgaccug

SEQ ID NO: 40984 - RNA, 27 nt, Artificial Sequence
  Sushi repeat-containing protein SRPX isoform 4 (328-336)
gcccugcucgaccaguucuacgagaag

SEQ ID NO: 40985 - RNA, 30 nt, Artificial Sequence
  Zinc finger MYM-type protein 4 (757-766)
gccagcgccggccccccgucccugcgcaag

SEQ ID NO: 40986 - RNA, 30 nt, Artificial Sequence
  Thymosin beta-10 (16-25)
gccagcuucgacaaggccaagcugaagaag

SEQ ID NO: 40987 - RNA, 27 nt, Artificial Sequence
  Glycogen phosphorylase, muscle form (303-311)
gccacccugcaggacaucauccgccgg

SEQ ID NO: 40988 - RNA, 27 nt, Artificial Sequence
  Cell surfaceoprotein MUC18 (577-585)
gccgugcuguacuuccucuacaagaag

SEQ ID NO: 40989 - RNA, 24 nt, Artificial Sequence
  Torsin-1A-interacting protein 1 (433-440)
gccuacagcuccuuccgcagcgug

SEQ ID NO: 40990 - RNA, 24 nt, Artificial Sequence
  Nucleolin (415-422)
gacgccgccgagauccgccuggug

SEQ ID NO: 40991 - RNA, 24 nt, Artificial Sequence
  Prohibitin (233-240)
gacggccugaucgagcuccgcaag

SEQ ID NO: 40992 - RNA, 21 nt, Artificial Sequence
  Lysine-specific demethylase 5B (46-52)
uucgccuucauccacaagauc

SEQ ID NO: 40993 - RNA, 27 nt, Artificial Sequence
  Polypeptide N-acetylgalactosaminyltransferase 5 (282-290)
uuccccaaggugcgcauccugcggcuc

SEQ ID NO: 40994 - RNA, 30 nt, Artificial Sequence
  Dual specificity protein phosphatase 6 (130-139)
uucuaccuggagggcggguucagcaaguuc

SEQ ID NO: 40995 - RNA, 27 nt, Artificial Sequence
  Multiple PDZ domain protein (777-785)
ggcaccgugcgcaucggggucgccaag

SEQ ID NO: 40996 - RNA, 30 nt, Artificial Sequence
  Calcyphosin (120-129)
ggcguguacagcgggcgcgcccaccccaag

SEQ ID NO: 40997 - RNA, 30 nt, Artificial Sequence
  PEST proteolytic signal-containing nuclear protein (144-153)
caccugggcaacgugcacgaccaggacaac

SEQ ID NO: 40998 - RNA, 30 nt, Artificial Sequence
  DAZ-associated protein 1 (397-406)
cacaacgugcagggcuuccaccccuaccgc

SEQ ID NO: 40999 - RNA, 45 nt, Artificial Sequence
  Ribonucleoprotein PTB-binding 1 (737-751)
cacagccagggccuggggggccacuacgccgacuccuaccucaag

SEQ ID NO: 41000 - RNA, 27 nt, Artificial Sequence
  Melanocyte protein PMEL (189-197)
cacaccauggaggugaccgucuaccac

SEQ ID NO: 41001 - RNA, 33 nt, Artificial Sequence
  Neurosecretory protein VGF (2-12)
aaggcccugcgccucagcgccuccgcgcuguuc

SEQ ID NO: 41002 - RNA, 27 nt, Artificial Sequence
  Serine/threonine-protein kinase Nek7 (81-89)
aaggagaucgaccugcucaagcagcug

SEQ ID NO: 41003 - RNA, 27 nt, Artificial Sequence
  Calpain-3 (10-18)
aaggugcugaacaccgucgugaacaag

SEQ ID NO: 41004 - RNA, 27 nt, Artificial Sequence
  (Pyruvate dehydrogenase (acetyl-transferring))-phosphatase 1, mitochondrial (542-550)
cugcccgaggagcucgcccgcauguac

SEQ ID NO: 41005 - RNA, 21 nt, Artificial Sequence
  Vimentin (116-122)
aacuacaucgacaaggugcgc

SEQ ID NO: 41006 - RNA, 24 nt, Artificial Sequence
  Vimentin (116-123)
aacuacaucgacaaggugcgcuuc

SEQ ID NO: 41007 - RNA, 24 nt, Artificial Sequence
  Lysine-specific demethylase 5B (45-52)
cccuucgccuucauccacaagauc

SEQ ID NO: 41008 - RNA, 24 nt, Artificial Sequence
  Isoleucine-tRNA ligase, cytoplasmic (611-618)
cccgugagcaucauccagaaguac

SEQ ID NO: 41009 - RNA, 27 nt, Artificial Sequence
  Ankyrin-2 (1316-1324)
cccuacauggccaaguucguggucuuc

SEQ ID NO: 41010 - RNA, 21 nt, Artificial Sequence
  Plectin (3425-3431)
cccuacagcggcuccaccauc

SEQ ID NO: 41011 - RNA, 27 nt, Artificial Sequence
  Crooked neck-like protein 1 (372-380)
cgcuucgaggagaagcacgccuacuuc

SEQ ID NO: 41012 - RNA, 27 nt, Artificial Sequence
  Vimentin (122-130)
cgcuuccuggagcagcagaacaagauc

SEQ ID NO: 41013 - RNA, 27 nt, Artificial Sequence
  Membrane-associated transporter protein (209-217)
cgccugcucggcaccgaguuccaggug

SEQ ID NO: 41014 - RNA, 24 nt, Artificial Sequence
  V-type proton ATPase subunit B, kidney isoform (40-47)
cgcagcggccaggugcuggagguc

SEQ ID NO: 41015 - RNA, 27 nt, Artificial Sequence
  Sialidase-4 (192-200)
cgcaccagcccccacuccuucgccuuc

SEQ ID NO: 41016 - RNA, 27 nt, Artificial Sequence
  Tubulin beta-6 chain (244-252)
cgcuaccugaccguggccaccgucuuc

SEQ ID NO: 41017 - RNA, 27 nt, Artificial Sequence
  Transcription elongation factor SPT5 (361-369)
cgcuacagccggaagggcuuccuguuc

SEQ ID NO: 41018 - RNA, 27 nt, Artificial Sequence
  Zinc finger MYM-type protein 4 (758-766)
agcgccggccccccgucccugcgcaag

SEQ ID NO: 41019 - RNA, 27 nt, Artificial Sequence
  Melanoma-associated antigen 1 (230-238)
agcgccuacggcgagccccgcaagcug

SEQ ID NO: 41020 - RNA, 39 nt, Artificial Sequence
  Heterogeneous nuclear ribonucleoproteins A2/B1 (289-301)
agcggcggguccggcggguacggcgggcgcagccgguac

SEQ ID NO: 41021 - RNA, 39 nt, Artificial Sequence
  Elongation factor 1-alpha 1 (18-30)
agcggcaaguccaccaccacggggcaccugaucuacaag

SEQ ID NO: 41022 - RNA, 27 nt, Artificial Sequence
  G protein pathway suppressor 2 (319-327)
agccagaacccccgcuucuaccacaag

SEQ ID NO: 41023 - RNA, 27 nt, Artificial Sequence
  Nuclear pore complex protein Nup205 (214-222)
agcucccuguacaucauccucaagaag

SEQ ID NO: 41024 - RNA, 27 nt, Artificial Sequence
  RNA binding motif protein, X-linked-like-1 (142-150)
agcucccgcggcccccugccggugaag

SEQ ID NO: 41025 - RNA, 30 nt, Artificial Sequence
  Mitochondrial fission factor (79-88)
agcacccccuucaagccgcuggcccucaag

SEQ ID NO: 41026 - RNA, 51 nt, Artificial Sequence
  Prelamin-A/C (479-495)
agcgugggcggguccggcgggggcagcuucggggacaaccuggucacccgc

SEQ ID NO: 41027 - RNA, 27 nt, Artificial Sequence
  Zinc finger MIZ domain-containing protein 1 (594-602)
agcgugcugcagggccuccugaagaag

SEQ ID NO: 41028 - RNA, 27 nt, Artificial Sequence
  Anaphase-promoting complex subunit 5 (50-58)
agcguggucggccuguuccuccgccac

SEQ ID NO: 41029 - RNA, 33 nt, Artificial Sequence
  Prohibitin (230-240)
accgccggcgacgggcugaucgagcuccgcaag

SEQ ID NO: 41030 - RNA, 45 nt, Artificial Sequence
  RNA polymerase II-associated factor 1 homolog (4-18)
accauccagacccaggcccagcgcgaggacggccaccggcccaac

SEQ ID NO: 41031 - RNA, 45 nt, Artificial Sequence
  Thymosin beta-10 (33-47)
acccugcccaccaaggagacgaucgagcaggagaagcgcagcgag

SEQ ID NO: 41032 - RNA, 51 nt, Artificial Sequence
  Thymosin beta-10 (33-49)
acccugcccaccaaggagacgaucgagcaggagaagcgcagcgagaucucc

SEQ ID NO: 41033 - RNA, 42 nt, Artificial Sequence
  Golgi-specific brefeldin A-resistance guanine nucleotide exchange factor 1 (535-548)
accccccgcccgaccgaccccauccccacgagcgaggugaac

SEQ ID NO: 41034 - RNA, 33 nt, Artificial Sequence
  KH domain-containing, RNA-binding, signal transduction-associated protein 1 (33-43)
acccccagccgccagccgccccugccccaccgg

SEQ ID NO: 41035 - RNA, 45 nt, Artificial Sequence
  Probable ATP-dependent RNA helicase DDX5 (556-570)
accagcuuccgcaccggcaaccccacggggaccuaccagaacggc

SEQ ID NO: 41036 - RNA, 24 nt, Artificial Sequence
  Elongation factor 1-alpha 1 (23-30)
accaccggccaccugaucuacaag

SEQ ID NO: 41037 - RNA, 45 nt, Artificial Sequence
  Vimentin (446-460)
accguggagacccgcgacggccaggucaucaacgagacgagccag

SEQ ID NO: 41038 - RNA, 42 nt, Artificial Sequence
  Serum albumin (439-452)
gugccccaggucagcaccccgacccugguggaggugucccgc

SEQ ID NO: 41039 - RNA, 27 nt, Artificial Sequence
  Melanoma-associated antigen F1 (199-207)
gugcagcccagcaaguaccacuuccug

SEQ ID NO: 41040 - RNA, 24 nt, Artificial Sequence
  Vimentin (117-124)
uacaucgacaaggugcgcuuccug

SEQ ID NO: 41041 - RNA, 27 nt, Artificial Sequence
  Fatty acid synthase (2288-2296)
uacuacaucgacugcauccgccaggug

SEQ ID NO: 41042 - RNA, 27 nt, Artificial Sequence
  Zinc finger protein 552 (2-10)
gccgccgcggcccugcgcuuccccgug

SEQ ID NO: 41043 - RNA, 30 nt, Artificial Sequence
  Colipase-like protein 2 (3-12)
gccgcccuggcgcucguggccggcguccug

SEQ ID NO: 41044 - RNA, 27 nt, Artificial Sequence
  ATP-binding cassette sub-family G member 1 (538-546)
gccgcccugggcaccaugaccagccuc

SEQ ID NO: 41045 - RNA, 27 nt, Artificial Sequence
  Integrin beta-7 (351-359)
gccgcccugcccguguaccaggagcuc

SEQ ID NO: 41046 - RNA, 27 nt, Artificial Sequence
  Translocon-associated protein subunit delta (2-10)
gccgccauggcgagccugggcgcccuc

SEQ ID NO: 41047 - RNA, 27 nt, Artificial Sequence
  Fumarate hydratase, mitochondrial (264-272)
gccgccaugccccgcaucuacgagcug

SEQ ID NO: 41048 - RNA, 24 nt, Artificial Sequence
  Interferon-induced GTP-binding protein Mx1 (15-22)
gccgccagccacccccugcuccug

SEQ ID NO: 41049 - RNA, 27 nt, Artificial Sequence
  Basement membrane-specific heparan sulfate proteoglycan core protein (1503-1511)
gccgccagcaucuccgcggugagccug

SEQ ID NO: 41050 - RNA, 27 nt, Artificial Sequence
  Zinc finger and BTB domain-containing protein 7B (478-486)
gccgccagccccgcgggccuggaccuc

SEQ ID NO: 41051 - RNA, 27 nt, Artificial Sequence
  Poly(rC)-binding protein 2 (92-100)
gccgccagccgccccccggugacccug

SEQ ID NO: 41052 - RNA, 33 nt, Artificial Sequence
  Protein phosphatase inhibitor 2 (2-12)
gccgccagcaccgcgucccaccgccccaucaag

SEQ ID NO: 41053 - RNA, 27 nt, Artificial Sequence
  Transcription factor jun-B (200-208)
gccgccgugggcaccgggagcuccuac

SEQ ID NO: 41054 - RNA, 27 nt, Artificial Sequence
  Carnitine O-palmitoyltransferase 1, liver isoform (476-484)
gccgacgcccccaucguggcgcaccug

SEQ ID NO: 41055 - RNA, 30 nt, Artificial Sequence
  Protein CDV3 homolog (2-11)
gccgagaccgaggagcgcagccuggacaac

SEQ ID NO: 41056 - RNA, 27 nt, Artificial Sequence
  Cirhin (640-648)
gccuucaagaucagcaagaucuacaag

SEQ ID NO: 41057 - RNA, 27 nt, Artificial Sequence
  Tyrosine-protein kinase HCK (301-309)
gccuuccuggccgaggcgaacgugaug

SEQ ID NO: 41058 - RNA, 27 nt, Artificial Sequence
  2-oxoglutarate dehydrogenase, mitochondrial (85-93)
gccggcgcccccccggggaccgcguac

SEQ ID NO: 41059 - RNA, 24 nt, Artificial Sequence
  Fc receptor-like A (58-65)
gccggcuuccaggugaaggccuac

SEQ ID NO: 41060 - RNA, 27 nt, Artificial Sequence
  Piezo-type mechanosensitive ion channel component 1 (211-219)
gccggcaucgcccaccccagcgcgcug

SEQ ID NO: 41061 - RNA, 30 nt, Artificial Sequence
  Uncharacterized protein ENSP00000382042 (147-156)
gccggcaccgggggcagccccgcccugcuc

SEQ ID NO: 41062 - RNA, 27 nt, Artificial Sequence
  Glycogen debranching enzyme (1193-1201)
gccggcacccuggaccagccccucuuc

SEQ ID NO: 41063 - RNA, 30 nt, Artificial Sequence
  Abelson tyrosine-protein kinase 2 (1157-1166)
gccggcgugcccgggaccaacccgguccug

SEQ ID NO: 41064 - RNA, 27 nt, Artificial Sequence
  Heterogeneous nuclear ribonucleoprotein F (403-411)
gccggcuacagcgggcagaacuccaug

SEQ ID NO: 41065 - RNA, 27 nt, Artificial Sequence
  Spectrin alpha chain, non-erythrocytic 1 (2132-2140)
gcccacgacgccuuccgcagcucccug

SEQ ID NO: 41066 - RNA, 27 nt, Artificial Sequence
  ER degradation-enhancing alpha-mannosidase-like protein 1 (264-272)
gcccacgaccuggccgugcgccuccug

SEQ ID NO: 41067 - RNA, 27 nt, Artificial Sequence
  DmX-like protein 2 (2940-2948)
gcccacgacagcgccaucaaggcgcug

SEQ ID NO: 41068 - RNA, 27 nt, Artificial Sequence
  Testicular acid phosphatase (287-295)
gcccacgacagcacccugcucgcccug

SEQ ID NO: 41069 - RNA, 27 nt, Artificial Sequence
  Lysosomal acid phosphatase (285-293)
gcccacgacaccacccugguggcccuc

SEQ ID NO: 41070 - RNA, 33 nt, Artificial Sequence
  U4/U6 small nuclear ribonucleoprotein Prp3 (510-520)
gcccacgaggaggccaacgcggcccgcaagcug

SEQ ID NO: 41071 - RNA, 27 nt, Artificial Sequence
  Protein FAM195A (93-101)
gcccacgaggagaacgugcgcuucguc

SEQ ID NO: 41072 - RNA, 27 nt, Artificial Sequence
  Synemin (147-155)
gcccacgagcgcgacgugcgggagcug

SEQ ID NO: 41073 - RNA, 27 nt, Artificial Sequence
  NADH dehydrogenase (ubiquinone) 1 alpha subcomplex subunit 1 (39-47)
gcccacuucggcuaccacuggagccug

SEQ ID NO: 41074 - RNA, 27 nt, Artificial Sequence
  GDP-mannose 4,6 dehydratase (74-82)
gcccacaucgagggcaacaugaagcug

SEQ ID NO: 41075 - RNA, 27 nt, Artificial Sequence
  Striatin-3 (531-539)
gcccacaucggccccgugcugagccuc

SEQ ID NO: 41076 - RNA, 27 nt, Artificial Sequence
  Nuclear factor erythroid 2-related factor 2 (106-114)
gcccacauccccaagagcgacgcccug

SEQ ID NO: 41077 - RNA, 27 nt, Artificial Sequence
  Nucleolar RNA helicase 2 (616-624)
gcccacaucagcggcgccaccuccgug

SEQ ID NO: 41078 - RNA, 27 nt, Artificial Sequence
  Coatomer subunit beta' (555-563)
gcccaccuggaccgcaccauguaccuc

SEQ ID NO: 41079 - RNA, 27 nt, Artificial Sequence
  Nuclear inhibitor of protein phosphatase 1 (172-180)
gcccacaacaagcgcaucagcacccug

SEQ ID NO: 41080 - RNA, 24 nt, Artificial Sequence
  Suppressor of SWI4 1 homolog (136-143)
gcccaccccccgcugcucgugcug

SEQ ID NO: 41081 - RNA, 27 nt, Artificial Sequence
  Exosome complex component CSL4 (156-164)
gcccacagcgaguccggcauccagaug

SEQ ID NO: 41082 - RNA, 30 nt, Artificial Sequence
  DNA mismatch repair protein Msh6 (457-466)
gcccacagcggcuuccccgagaucgccuuc

SEQ ID NO: 41083 - RNA, 27 nt, Artificial Sequence
  60S ribosomal protein L18a (121-129)
gcccacagcauccagaucaugaaggug

SEQ ID NO: 41084 - RNA, 27 nt, Artificial Sequence
  Sodium-coupled neutral amino acid transporter 5 (74-82)
gcccacaccggcgugaucuucuuccug

SEQ ID NO: 41085 - RNA, 27 nt, Artificial Sequence
  AP-2 complex subunit mu (194-202)
gcccacgugagcggccgcgucgugaug

SEQ ID NO: 41086 - RNA, 27 nt, Artificial Sequence
  Trafficking protein particle complex subunit 5 (162-170)
gcccacuggcacaagggcaccacccug

SEQ ID NO: 41087 - RNA, 27 nt, Artificial Sequence
  LIM and SH3 domain protein 1 (55-63)
gcccacuaccccaagcagagcuucacc

SEQ ID NO: 41088 - RNA, 27 nt, Artificial Sequence
  Endoplasmic reticulum-Golgi intermediate compartment protein 3 (313-321)
gccaucaucggcgggauguucaccgug

SEQ ID NO: 41089 - RNA, 27 nt, Artificial Sequence
  Parafibromin (184-192)
gccaucaaggccaagaucauggcgaag

SEQ ID NO: 41090 - RNA, 27 nt, Artificial Sequence
  Exportin-4 (825-833)
gccauccuguucaacuuccucauggac

SEQ ID NO: 41091 - RNA, 27 nt, Artificial Sequence
  Protein arginine N-methyltransferase 5 (168-176)
gccauccugcccaccagcaucuuccuc

SEQ ID NO: 41092 - RNA, 30 nt, Artificial Sequence
  Bifunctional glutamate/proline-tRNA ligase (215-224)
gccaaggccgcgcugcucaaccagcacuac

SEQ ID NO: 41093 - RNA, 30 nt, Artificial Sequence
  Exportin-5 (744-753)
gccaaggccggcggguucguggucggcuac

SEQ ID NO: 41094 - RNA, 27 nt, Artificial Sequence
  DNA replication licensing factor MCM7 (470-478)
gccaaggccggcauccugaccacccuc

SEQ ID NO: 41095 - RNA, 27 nt, Artificial Sequence
  DNA replication licensing factor MCM5 (470-478)
gccaaggccggcaucaccaccacgcug

SEQ ID NO: 41096 - RNA, 27 nt, Artificial Sequence
  Peptidase M20 domain-containing protein 2 (398-406)
gccaaggcccuggcgaugaccgcccuc

SEQ ID NO: 41097 - RNA, 30 nt, Artificial Sequence
  Proteasome subunit beta type-2 (125-134)
gccaaggcccccuucgcggcccacggcuac

SEQ ID NO: 41098 - RNA, 27 nt, Artificial Sequence
  Drebrin (614-622)
gccaaggcccccccgcccguguucuac

SEQ ID NO: 41099 - RNA, 27 nt, Artificial Sequence
  CCAAT/enhancer-binding protein beta (241-249)
gccaaggcccccccgaccgcgugcuac

SEQ ID NO: 41100 - RNA, 27 nt, Artificial Sequence
  Ragulator complex protein LAMTOR2 (106-114)
gccaaggcccaggcgcuggugcaguac

SEQ ID NO: 41101 - RNA, 27 nt, Artificial Sequence
  Protein PRRC2C (2502-2510)
gccaaggcccagagcggccuggcguuc

SEQ ID NO: 41102 - RNA, 27 nt, Artificial Sequence
  ATP-dependent RNA helicase A (181-189)
gccaaggcccgccugaaccaguacuuc

SEQ ID NO: 41103 - RNA, 33 nt, Artificial Sequence
  Heterogeneous nuclear ribonucleoprotein L (247-257)
gccaaggccagccugaacggcgcggacaucuac

SEQ ID NO: 41104 - RNA, 27 nt, Artificial Sequence
  NAD(P)H-hydrate epimerase (96-104)
gccaaggccuaccccccgaccagcaug

SEQ ID NO: 41105 - RNA, 27 nt, Artificial Sequence
  1-phosphatidylinositol 4,5-bisphosphate phosphodiesterase beta-1 (127-135)
gccaaggaguggaccaacgagguguuc

SEQ ID NO: 41106 - RNA, 30 nt, Artificial Sequence
  Cell division cycle-associated 7-like protein (291-300)
gccaaguucgccgaggaguucuacagcuuc

SEQ ID NO: 41107 - RNA, 27 nt, Artificial Sequence
  Cathepsin D (193-201)
gccaaguucgacggcauccuggggaug

SEQ ID NO: 41108 - RNA, 30 nt, Artificial Sequence
  Crooked neck-like protein 1 (420-429)
gccaaguucgaggagaaccagaaggaguuc

SEQ ID NO: 41109 - RNA, 27 nt, Artificial Sequence
  Staphylococcal nuclease domain-containing protein 1 (248-256)
gccaaguucuucaccgagagccgccug

SEQ ID NO: 41110 - RNA, 27 nt, Artificial Sequence
  Pre-mRNA-processing factor 19 (487-495)
gccaaguucaucgccagcaccggcaug

SEQ ID NO: 41111 - RNA, 27 nt, Artificial Sequence
  Squalene monooxygenase (243-251)
gccaaguucaucgagggcgugguccug

SEQ ID NO: 41112 - RNA, 27 nt, Artificial Sequence
  DCN1-like protein 2 (152-160)
gccaaguucaaggacuucuaccaguuc

SEQ ID NO: 41113 - RNA, 30 nt, Artificial Sequence
  DnaJ homolog subfamily B member 9 (65-74)
gccaaguuccgcgagaucgccgaggcguac

SEQ ID NO: 41114 - RNA, 27 nt, Artificial Sequence
  Nitrogen permease regulator 3-like protein (366-374)
gccaaguucagccugcccgugucccuc

SEQ ID NO: 41115 - RNA, 33 nt, Artificial Sequence
  DNA-directed RNA polymerases I and III subunit RPAC1 (223-233)
gccaaguucagccccguggccaccgcguccuac

SEQ ID NO: 41116 - RNA, 27 nt, Artificial Sequence
  Ubiquitin-like modifier-activating enzyme 1 (321-329)
gccaaguucagccgccccgcccagcug

SEQ ID NO: 41117 - RNA, 27 nt, Artificial Sequence
  Staphylococcal nuclease domain-containing protein 1 (738-746)
gccaaguucguggacggcgagugguac

SEQ ID NO: 41118 - RNA, 27 nt, Artificial Sequence
  60S ribosomal protein L31 (74-82)
gccaagggcauccgcaacgugcccuac

SEQ ID NO: 41119 - RNA, 27 nt, Artificial Sequence
  Cullin-1 (220-228)
gccaagggccccacccugaccguguac

SEQ ID NO: 41120 - RNA, 27 nt, Artificial Sequence
  NACHT, LRR and PYD domains-containing protein 7 (625-633)
gccaagggcguguuccuggagaacuac

SEQ ID NO: 41121 - RNA, 27 nt, Artificial Sequence
  Cystatin-B (90-98)
gccaagcacgacgagcugaccuacuuc

SEQ ID NO: 41122 - RNA, 36 nt, Artificial Sequence
  T-complex protein 1 subunit theta (19-30)
gccaagcacuucagcggccuggaggaggccguguac

SEQ ID NO: 41123 - RNA, 27 nt, Artificial Sequence
  Unconventional myosin-Va (1821-1829)
gccaagcacaucuuccccgugaccuuc

SEQ ID NO: 41124 - RNA, 27 nt, Artificial Sequence
  Fatty aldehyde dehydrogenase (198-206)
gccaagcaccugacccccgugacccuc

SEQ ID NO: 41125 - RNA, 27 nt, Artificial Sequence
  AP-2 complex subunit sigma (44-52)
gccaagcacaccaacuucguggaguuc

SEQ ID NO: 41126 - RNA, 27 nt, Artificial Sequence
  F-box DNA helicase 1 (835-843)
gccaagaucgccguggucgagaaguac

SEQ ID NO: 41127 - RNA, 33 nt, Artificial Sequence
  Carnitine O-palmitoyltransferase 1, liver isoform (75-85)
gccaagaucgaccccagccugggcaucaucgcc

SEQ ID NO: 41128 - RNA, 27 nt, Artificial Sequence
  D(2) dopamine receptor (338-346)
gccaagaucuucgagauccagaccaug

SEQ ID NO: 41129 - RNA, 27 nt, Artificial Sequence
  Poly(rC)-binding protein 2 (308-316)
gccaagaucaacgagauccgccagaug

SEQ ID NO: 41130 - RNA, 27 nt, Artificial Sequence
  Reticulon-2 (522-530)
gccaagauccccggcaccggggcccug

SEQ ID NO: 41131 - RNA, 33 nt, Artificial Sequence
  Protein SET (89-99)
gccaagauccccaacuucugggugaccaccuuc

SEQ ID NO: 41132 - RNA, 33 nt, Artificial Sequence
  COBW domain-containing protein 6 (40-50)
gccaagauccccgugaccaucaucaccggcuac

SEQ ID NO: 41133 - RNA, 33 nt, Artificial Sequence
  Dolichyl-diphosphooligosaccharide-proteinosyltransferase subunit 1 (125-135)
gccaagaucagcgugaucgucgagaccguguac

SEQ ID NO: 41134 - RNA, 27 nt, Artificial Sequence
  Nuclear fragile X mental retardation-interacting protein 2 (350-358)
gccaagaucgugcccaagaucagcuac

SEQ ID NO: 41135 - RNA, 27 nt, Artificial Sequence
  Poly (ADP-ribose) polymerase 3 (121-129)
gccaagaaggacuucgagaagaaguuc

SEQ ID NO: 41136 - RNA, 27 nt, Artificial Sequence
  DnaJ homolog subfamily C member 7 (40-48)
gccaagaaggacuacaacgaggccuac

SEQ ID NO: 41137 - RNA, 27 nt, Artificial Sequence
  Double-stranded RNA-binding protein Staufen homolog 1 (297-305)
gccaagaaggagaaggagcccgaguac

SEQ ID NO: 41138 - RNA, 27 nt, Artificial Sequence
  Translocation protein SEC62 (64-72)
gccaagaagggcgaggaggcccuguuc

SEQ ID NO: 41139 - RNA, 27 nt, Artificial Sequence
  SWI/SNF complex subunit SMARCC2 (316-324)
gccaagaagggccccagcaccccguac

SEQ ID NO: 41140 - RNA, 27 nt, Artificial Sequence
  Myosin light chain 1/3, skeletal muscle isoform (105-113)
gccaagaagaucgaguucgagcaguuc

SEQ ID NO: 41141 - RNA, 27 nt, Artificial Sequence
  Probable ATP-dependent RNA helicase DDX6 (351-359)
gccaagaagaucagccagcugggcuac

SEQ ID NO: 41142 - RNA, 27 nt, Artificial Sequence
  Poly (ADP-ribose) polymerase 8 (686-694)
gccaagaagcuguucggcagcaccuuc

SEQ ID NO: 41143 - RNA, 27 nt, Artificial Sequence
  Serine/threonine-protein phosphatase 2A 56 kDa regulatory subunit delta isoform (231-239)
gccaagaaguacaucgaccagaaguuc

SEQ ID NO: 41144 - RNA, 27 nt, Artificial Sequence
  Nucleolar RNA helicase 2 (386-394)
gccaagaaguacaugaagagcaccuac

SEQ ID NO: 41145 - RNA, 33 nt, Artificial Sequence
  Interferon-induced, double-stranded RNA-activated protein kinase (313-323)
gccaagcuggaccacgugaacaucguccacuac

SEQ ID NO: 41146 - RNA, 27 nt, Artificial Sequence
  Golgin subfamily A member 4 (798-806)
gccaagcuggacguguuccagagcuac

SEQ ID NO: 41147 - RNA, 27 nt, Artificial Sequence
  Zinc finger Ran-binding domain-containing protein 2 (94-102)
gccaagcuggaggagcgcaccggcuac

SEQ ID NO: 41148 - RNA, 27 nt, Artificial Sequence
  Pre-mRNA-splicing factor ATP-dependent RNA helicase PRP16 (1082-1090)
gccaagcugaagggcaucggggaguac

SEQ ID NO: 41149 - RNA, 27 nt, Artificial Sequence
  DNA replication licensing factor MCM5 (557-565)
gccaagcugaagaaguucaucgccuac

SEQ ID NO: 41150 - RNA, 30 nt, Artificial Sequence
  Transmembrane and coiled-coil domain-containing protein 1 (115-124)
gccaagcugcccuucaccccgcucagcuac

SEQ ID NO: 41151 - RNA, 27 nt, Artificial Sequence
  ATP-dependent RNA helicase A (856-864)
gccaagcugcccaucgagccgcgcuuc

SEQ ID NO: 41152 - RNA, 27 nt, Artificial Sequence
  Peptidyl-prolyl cis-trans isomerase FKBP1A (73-81)
gccaagcugaccaucagccccgacuac

SEQ ID NO: 41153 - RNA, 33 nt, Artificial Sequence
  Heterogeneous nuclear ribonucleoprotein U (422-432)
gccaagaacggccaggaccuggggguggccuuc

SEQ ID NO: 41154 - RNA, 27 nt, Artificial Sequence
  Pre-mRNA-processing-splicing factor 8 (1011-1019)
gccaagaacaacguggucaucaacuac

SEQ ID NO: 41155 - RNA, 27 nt, Artificial Sequence
  Immunoglobulin superfamily member 10 (2607-2615)
gccaagaacccccugggcagcgacuac

SEQ ID NO: 41156 - RNA, 33 nt, Artificial Sequence
  ADP-ribosylation factor GTPase-activating protein 3 (30-40)
gccaagaaccccagcugggccuccaucaccuac

SEQ ID NO: 41157 - RNA, 30 nt, Artificial Sequence
  Transmembrane protein 214 (356-365)
gccaagcccgacagcacccugcacaccuac

SEQ ID NO: 41158 - RNA, 30 nt, Artificial Sequence
  Nucleolar GTP-binding protein 2 (401-410)
gccaagcccgaguacaucagcaagaccuac

SEQ ID NO: 41159 - RNA, 27 nt, Artificial Sequence
  Vacuolar protein sorting-associated protein 41 homolog (804-812)
gccaagcccuucagcguggucguguuc

SEQ ID NO: 41160 - RNA, 27 nt, Artificial Sequence
  116 kDa U5 small nuclear ribonucleoprotein component (445-453)
gccaagcccaagaucgagcacaccuac

SEQ ID NO: 41161 - RNA, 27 nt, Artificial Sequence
  Olfactomedin-like protein 2B (2-10)
gccaagccccgccugcucgugcuguac

SEQ ID NO: 41162 - RNA, 30 nt, Artificial Sequence
  RNA-binding protein 38 (113-122)
gccaagccccgcagccugcagaccggcuuc

SEQ ID NO: 41163 - RNA, 27 nt, Artificial Sequence
  116 kDa U5 small nuclear ribonucleoprotein component (962-970)
gccaagcaggacgugguccugaacuac

SEQ ID NO: 41164 - RNA, 27 nt, Artificial Sequence
  Nuclear pore complex protein Nup153 (293-301)
gccaagcagcugagcgcccaguccuac

SEQ ID NO: 41165 - RNA, 27 nt, Artificial Sequence
  Proteasome activator complex subunit 1 (189-197)
gccaagcagccccacgugggcgacuac

SEQ ID NO: 41166 - RNA, 27 nt, Artificial Sequence
  Mitochondrial import receptor subunit TOM7 homolog (8-16)
gccaagcagcgccugcagcagcucuuc

SEQ ID NO: 41167 - RNA, 27 nt, Artificial Sequence
  Protein disulfide-isomerase A4 (244-252)
gccaagcgcuucgacgugagcggcuac

SEQ ID NO: 41168 - RNA, 27 nt, Artificial Sequence
  Serine/threonine-protein phosphatase PP1-beta catalytic subunit (258-266)
gccaagcgccagcuggugacccucuuc

SEQ ID NO: 41169 - RNA, 24 nt, Artificial Sequence
  Putative uncharacterized protein C10orf113 (2-9)
gccaagagcgagcgccggaucuac

SEQ ID NO: 41170 - RNA, 27 nt, Artificial Sequence
  Serine/threonine-protein kinase/endoribonuclease IRE1 (276-284)
gccaagagcaagcugacccccacccuc

SEQ ID NO: 41171 - RNA, 30 nt, Artificial Sequence
  Gamma-taxilin (369-378)
gccaagagcaacgagcuguucaccaccuuc

SEQ ID NO: 41172 - RNA, 27 nt, Artificial Sequence
  Cullin-1 (38-46)
gccaagagccgcuacauggagcuguac

SEQ ID NO: 41173 - RNA, 27 nt, Artificial Sequence
  Protein disulfide-isomerase TMX3 (363-371)
gccaagagcaccaucguguccaucuuc

SEQ ID NO: 41174 - RNA, 27 nt, Artificial Sequence
  Coiled-coil domain-containing protein 115 (51-59)
gccaagagcgugggcccccugcaguac

SEQ ID NO: 41175 - RNA, 27 nt, Artificial Sequence
  Cyclin-dependent kinase 14 (280-288)
gccaagagcgugcccucccacaccuac

SEQ ID NO: 41176 - RNA, 27 nt, Artificial Sequence
  Nuclear nucleic acid-binding protein C1D (53-61)
gccaagguggaccuggucagcgccuac

SEQ ID NO: 41177 - RNA, 30 nt, Artificial Sequence
  Plastin-2 (19-28)
gccaagguggacaccgacggcaacggguac

SEQ ID NO: 41178 - RNA, 27 nt, Artificial Sequence
  Transmembrane protein 14D (103-111)
gccaaggugggcguccgcaugcugaug

SEQ ID NO: 41179 - RNA, 27 nt, Artificial Sequence
  60S ribosomal protein L27 (114-122)
gccaaggugaaguucgaggagcgcuac

SEQ ID NO: 41180 - RNA, 24 nt, Artificial Sequence
  Neuroblast differentiation-associated protein AHNAK (5180-5187)
gccaaggugaagacccccagcuuc

SEQ ID NO: 41181 - RNA, 27 nt, Artificial Sequence
  Nck-associated protein 1-like (512-520)
gccaaggugaugaaccugaucgucuuc

SEQ ID NO: 41182 - RNA, 27 nt, Artificial Sequence
  Dolichyl-diphosphooligosaccharide-proteinosyltransferase subunit STT3A (520-528)
gccaaggugaugagcuggugggacuac

SEQ ID NO: 41183 - RNA, 27 nt, Artificial Sequence
  Eukaryotic translation initiation factor 3 subunit L (142-150)
gccaaggugagcggcgggcccucccug

SEQ ID NO: 41184 - RNA, 27 nt, Artificial Sequence
  Condensin-2 complex subunit D3 (362-370)
gccaagguggucgacaagagcgaguac

SEQ ID NO: 41185 - RNA, 27 nt, Artificial Sequence
  Cytoskeleton-associated protein 5 (1205-1213)
gccaaguggcugcaggacgagauguuc

SEQ ID NO: 41186 - RNA, 33 nt, Artificial Sequence
  DNA-directed RNA polymerase II subunit RPB3 (174-184)
gccaaguggaaccccaccgccggcguggcguuc

SEQ ID NO: 41187 - RNA, 27 nt, Artificial Sequence
  Enhancer of mRNA-decapping protein 4 (124-132)
gccaaguacgacugggagcagaaguac

SEQ ID NO: 41188 - RNA, 27 nt, Artificial Sequence
  Myotubularin-related protein 6 (102-110)
gccaaguacgaggaccuguacgccuuc

SEQ ID NO: 41189 - RNA, 27 nt, Artificial Sequence
  CXXC-type zinc finger protein 1 (507-515)
gccaaguacgagagccagaccuccuuc

SEQ ID NO: 41190 - RNA, 27 nt, Artificial Sequence
  Guanine nucleotide-binding protein G(s) subunit alpha isoforms XLas (980-988)
gccaaguacuucauccgcgacgaguuc

SEQ ID NO: 41191 - RNA, 27 nt, Artificial Sequence
  Integrator complex subunit 10 (304-312)
gccaaguacaagaaccagguggucuac

SEQ ID NO: 41192 - RNA, 33 nt, Artificial Sequence
  40S ribosomal protein S5 (46-56)
gccaaguaccugccccacagcgccggccgcuac

SEQ ID NO: 41193 - RNA, 33 nt, Artificial Sequence
  Nucleolar protein 56 (319-329)
gccaaguaccccgccagcaccgugcagauccug

SEQ ID NO: 41194 - RNA, 27 nt, Artificial Sequence
  Proteasome activator complex subunit 3 (194-202)
gccaaguacccccacguggaggacuac

SEQ ID NO: 41195 - RNA, 27 nt, Artificial Sequence
  V-type proton ATPase subunit C 1 (110-118)
gccaaguaccccaucaagcagagccug

SEQ ID NO: 41196 - RNA, 27 nt, Artificial Sequence
  Probable ATP-dependent RNA helicase DDX10 (280-288)
gccaaguacagcacccccgccacccug

SEQ ID NO: 41197 - RNA, 27 nt, Artificial Sequence
  26S proteasome non-ATPase regulatory subunit 12 (367-375)
gccaaguacuacacccgcaucaccaug

SEQ ID NO: 41198 - RNA, 30 nt, Artificial Sequence
  Serine/arginine repetitive matrix protein 2 (2360-2369)
gcccuggcccccgcgagccucaccuccgcc

SEQ ID NO: 41199 - RNA, 27 nt, Artificial Sequence
  Protein FAM217A (258-266)
gcccuggaccuccacaaccuggcccug

SEQ ID NO: 41200 - RNA, 27 nt, Artificial Sequence
  HAUS augmin-like complex subunit 8 (77-85)
gcccuggacaccacccgccacgagcuc

SEQ ID NO: 41201 - RNA, 30 nt, Artificial Sequence
  Mesoderm development candidate 1 (248-257)
gcccuguucagcggcccccucgugcaggcc

SEQ ID NO: 41202 - RNA, 27 nt, Artificial Sequence
  Zinc finger protein 827 (563-571)
gcccuguucagccaggacaucuccgug

SEQ ID NO: 41203 - RNA, 27 nt, Artificial Sequence
  DNA-directed RNA polymerase I subunit RPA49 (297-305)
gcccugggccccggggugccgcacauc

SEQ ID NO: 41204 - RNA, 30 nt, Artificial Sequence
  Fatty acid desaturase 2 (422-431)
gcccugcucgacaucauccgcagccugaag

SEQ ID NO: 41205 - RNA, 27 nt, Artificial Sequence
  Symplekin (780-788)
gcccugcucccccagaaccacaagcug

SEQ ID NO: 41206 - RNA, 27 nt, Artificial Sequence
  Transmembrane protein 147 (135-143)
gcccugagcacccucgcccuguacgug

SEQ ID NO: 41207 - RNA, 30 nt, Artificial Sequence
  Protein HIRA (789-798)
gcccugaccgccgcggccacccucagcgug

SEQ ID NO: 41208 - RNA, 27 nt, Artificial Sequence
  ATP-binding cassette sub-family B member 8, mitochondrial (142-150)
gcccuggugaacguccagaucccccuc

SEQ ID NO: 41209 - RNA, 27 nt, Artificial Sequence
  Serine/threonine-protein phosphatase 6 regulatory ankyrin repeat subunit A (155-163)
gcccuggugccccuccugagcaacguc

SEQ ID NO: 41210 - RNA, 27 nt, Artificial Sequence
  Protein transport protein Sec61 subunit alpha isoform 2 (274-282)
gcccuggugagcaaccucuacgucauc

SEQ ID NO: 41211 - RNA, 27 nt, Artificial Sequence
  E3 ubiquitin-protein ligase UBR4 (709-717)
gcccuguaccacuucaaccacagccuc

SEQ ID NO: 41212 - RNA, 27 nt, Artificial Sequence
  Tetratricopeptide repeat protein 13 (724-732)
gcccuguacaaggaccucaccgccaag

SEQ ID NO: 41213 - RNA, 27 nt, Artificial Sequence
  E3 ubiquitin-protein ligase UBR5 (376-384)
gcccuguacagcgagcuccuggccgug

SEQ ID NO: 41214 - RNA, 27 nt, Artificial Sequence
  Protein spinster homolog 3 (269-277)
gccauggccuucgugaccggcgcgcug

SEQ ID NO: 41215 - RNA, 27 nt, Artificial Sequence
  28S ribosomal protein S9, mitochondrial (347-355)
gccauggccaaggcgcugugcagcuuc

SEQ ID NO: 41216 - RNA, 33 nt, Artificial Sequence
  Probable ribosome biogenesis protein RLP24 (92-102)
gccaugaagcgcguggaggagaucaagcagaag

SEQ ID NO: 41217 - RNA, 27 nt, Artificial Sequence
  Melanocyte-stimulating hormone receptor (198-206)
gccaugcuggugcucauggccguccug

SEQ ID NO: 41218 - RNA, 27 nt, Artificial Sequence
  Enteropeptidase (878-886)
gccaugaugcaccuggaguucaaggug

SEQ ID NO: 41219 - RNA, 27 nt, Artificial Sequence
  60S ribosomal protein L11 (162-170)
gccaugcgcugguuccagcagaaguac

SEQ ID NO: 41220 - RNA, 27 nt, Artificial Sequence
  Multivesicular body subunit 12A (38-46)
gcccccgccagcuucggcaaguccuuc

SEQ ID NO: 41221 - RNA, 27 nt, Artificial Sequence
  Hypoxia-inducible factor 1-alpha (828-836)
gcccccauccagggcagccgcaaccug

SEQ ID NO: 41222 - RNA, 27 nt, Artificial Sequence
  Transcriptional activator Myb (224-232)
gcccaggcccccccgaccgcgcagcug

SEQ ID NO: 41223 - RNA, 27 nt, Artificial Sequence
  Serine/threonine-protein phosphatase 2B catalytic subunit beta isoform (292-300)
gcccaggacgccggcuaccgcauguac

SEQ ID NO: 41224 - RNA, 24 nt, Artificial Sequence
  Transcription intermediary factor 1-beta (762-769)
gcccaggacgugggccgcauguuc

SEQ ID NO: 41225 - RNA, 27 nt, Artificial Sequence
  Poly(A) polymerase gamma (579-587)
gcccagggccugagcauccccgugauc

SEQ ID NO: 41226 - RNA, 27 nt, Artificial Sequence
  Ribosomal RNA processing protein 1 homolog A (91-99)
gcccagcaccuguuccuccaggccuuc

SEQ ID NO: 41227 - RNA, 27 nt, Artificial Sequence
  Very-long-chain enoyl-CoA reductase (83-91)
gcccagaucagcugggugaccgucuuc

SEQ ID NO: 41228 - RNA, 27 nt, Artificial Sequence
  Disintegrin and metalloproteinase domain-containing protein 15 (301-309)
gcccagcuggugaccggcaccagcuuc

SEQ ID NO: 41229 - RNA, 30 nt, Artificial Sequence
  Protein YIF1B (52-61)
gcccagcgcgcccccggcgggcugagcuac

SEQ ID NO: 41230 - RNA, 27 nt, Artificial Sequence
  Activator of basal transcription 1 (212-220)
gcccagcgccccaccgagcaggagcug

SEQ ID NO: 41231 - RNA, 24 nt, Artificial Sequence
  UBX domain-containing protein 4 (350-357)
gcccagaccgugggcaacaccuac

SEQ ID NO: 41232 - RNA, 27 nt, Artificial Sequence
  Uncharacterized protein C11orf24 (193-201)
gcccaggugcccaagagcuccgcccug

SEQ ID NO: 41233 - RNA, 30 nt, Artificial Sequence
  Asparagine synthetase (glutamine-hydrolyzing) (277-286)
gcccaggugcaguacccccugcagaccuuc

SEQ ID NO: 41234 - RNA, 27 nt, Artificial Sequence
  Elongation factor 1-gamma (93-101)
gcccaggugguccagugggugagcuuc

SEQ ID NO: 41235 - RNA, 27 nt, Artificial Sequence
  Transmembrane protein 147 (151-159)
gcccagguguggaugaucacccgcuac

SEQ ID NO: 41236 - RNA, 27 nt, Artificial Sequence
  Replication initiator 1 (187-195)
gcccagugggaccagcugguggcccac

SEQ ID NO: 41237 - RNA, 27 nt, Artificial Sequence
  Probable helicase with zinc finger domain (470-478)
gcccaguacaaggagaucagcaaguuc

SEQ ID NO: 41238 - RNA, 27 nt, Artificial Sequence
  Ribonuclease K6 (120-128)
gcccaguacaaguucuucaucguggcc

SEQ ID NO: 41239 - RNA, 27 nt, Artificial Sequence
  Centromere protein N (267-275)
gcccaguacaagcuggagaccaaguuc

SEQ ID NO: 41240 - RNA, 30 nt, Artificial Sequence
  Periodic tryptophan protein 1 homolog (372-381)
gcccgcagcgacaagcccaucuucacccug

SEQ ID NO: 41241 - RNA, 27 nt, Artificial Sequence
  Olfactory receptor 5K3 (240-248)
gccagccacuuccuguccgugagcauc

SEQ ID NO: 41242 - RNA, 27 nt, Artificial Sequence
  N-acetyllactosaminide beta-1,6-N-acetylglucosaminyl-transferase, isoform A (153-161)
gccagcaagaaggaguccguggucuac

SEQ ID NO: 41243 - RNA, 27 nt, Artificial Sequence
  Cytoplasmic FMR1-interacting protein 1 (658-666)
gccagcaugauggaguacgugcuguac

SEQ ID NO: 41244 - RNA, 30 nt, Artificial Sequence
  Utrophin (3369-3378)
gccagcccccagcacuccgcccugagcuac

SEQ ID NO: 41245 - RNA, 27 nt, Artificial Sequence
  RNA-binding protein NOB1 (403-411)
gccagccgcaagaaguucgugaagaag

SEQ ID NO: 41246 - RNA, 27 nt, Artificial Sequence
  Nodal modulator 2 (823-831)
gccagcuccccccugaucaccguguuc

SEQ ID NO: 41247 - RNA, 27 nt, Artificial Sequence
  Asparagine synthetase (glutamine-hydrolyzing) (544-552)
gccaccgaccccagcgcccgcacccug

SEQ ID NO: 41248 - RNA, 27 nt, Artificial Sequence
  Ribosomal RNA processing protein 1 homolog B (664-672)
gccacccaccccccgggccccgccgug

SEQ ID NO: 41249 - RNA, 27 nt, Artificial Sequence
  Polyadenylate-binding protein 1 (359-367)
gccaccaagccccuguacguggcccuc

SEQ ID NO: 41250 - RNA, 27 nt, Artificial Sequence
  ATP-dependent 6-phosphofructokinase, muscle type (150-158)
gccaccaagagcuccuaccugaacauc

SEQ ID NO: 41251 - RNA, 27 nt, Artificial Sequence
  Transmembrane protein 9B (2-10)
gccacccuguggggcgggcuccugcgc

SEQ ID NO: 41252 - RNA, 27 nt, Artificial Sequence
  Serine/threonine-protein phosphatase 6 regulatory subunit 1 (821-829)
gccacccgcgaccccagcaccuccgug

SEQ ID NO: 41253 - RNA, 27 nt, Artificial Sequence
  Leukocyte-associated immunoglobulin-like receptor 1 (224-232)
gccaccgugaacggccugcccgagaag

SEQ ID NO: 41254 - RNA, 27 nt, Artificial Sequence
  40S ribosomal protein S5 (40-48)
gccgugaaggagaaguacgccaaguac

SEQ ID NO: 41255 - RNA, 27 nt, Artificial Sequence
  Oligoribonuclease, mitochondrial (109-117)
gccgugaaggagagcaccaucacccug

SEQ ID NO: 41256 - RNA, 27 nt, Artificial Sequence
  39S ribosomal protein L44, mitochondrial (114-122)
gccgugcugcucaaccugaagagcaac

SEQ ID NO: 41257 - RNA, 30 nt, Artificial Sequence
  Ig lambda-2 chain C regions (41-50)
gccuggaaggccgacagcucccccgugaag

SEQ ID NO: 41258 - RNA, 27 nt, Artificial Sequence
  Nucleolar transcription factor 1 (644-652)
gccuacaaggaguacaucagcaacaag

SEQ ID NO: 41259 - RNA, 30 nt, Artificial Sequence
  Translocon-associated protein subunit gamma (76-85)
gccuacaagaacgugaaguucguccugaag

SEQ ID NO: 41260 - RNA, 27 nt, Artificial Sequence
  Serine-protein kinase ATM (740-748)
gccuacaagagcgagcuguuccagaag

SEQ ID NO: 41261 - RNA, 27 nt, Artificial Sequence
  Poly (ADP-ribose) polymerase (365-373)
gccuaccccgaguaccugaucaccuuc

SEQ ID NO: 41262 - RNA, 36 nt, Artificial Sequence
  Sialoadhesin (1671-1682)
ugcaagcagagcaugggcgagaacuccguggagaug

SEQ ID NO: 41263 - RNA, 27 nt, Artificial Sequence
  Transmembrane inner ear expressed protein (21-29)
ugccuggccggcguggccgggcagcuc

SEQ ID NO: 41264 - RNA, 27 nt, Artificial Sequence
  Tetraspanin-18 (82-90)
ugccugcuccuguucuucuuccuguuc

SEQ ID NO: 41265 - RNA, 27 nt, Artificial Sequence
  Asparagine-tRNA ligase, cytoplasmic (537-545)
ugccuguacccccgcuucgugcagcgg

SEQ ID NO: 41266 - RNA, 33 nt, Artificial Sequence
  Protein-glutamine gamma-glutamyltransferase 4 (213-223)
ugccgcgccaugugcgccaugaugagcuucgag

SEQ ID NO: 41267 - RNA, 30 nt, Artificial Sequence
  Pentatricopeptide repeat domain-containing protein 3, mitochondrial (34-43)
ugccgcuucuacagcggcuccgccacccug

SEQ ID NO: 41268 - RNA, 27 nt, Artificial Sequence
  Endothelin-1 receptor (88-96)
ugcaccaucuucaucgugggcaugguc

SEQ ID NO: 41269 - RNA, 27 nt, Artificial Sequence
  cAMP-dependent protein kinase type I-alpha regulatory subunit (109-117)
gacgccgccagcuacgugcgcaagguc

SEQ ID NO: 41270 - RNA, 27 nt, Artificial Sequence
  DnaJ homolog subfamily B member 9 (12-20)
gacgccgaggccaaguuccgcgagauc

SEQ ID NO: 41271 - RNA, 27 nt, Artificial Sequence
  Catenin beta-1 (145-153)
gacgccgagcuggccacccgcgcgauc

SEQ ID NO: 41272 - RNA, 27 nt, Artificial Sequence
  Protein disulfide-isomerase A5 (441-449)
gacgccuucaaggacgaccgcaagauc

SEQ ID NO: 41273 - RNA, 24 nt, Artificial Sequence
  Asparagine synthetase (glutamine-hydrolyzing) (9-16)
gacgccuuccgcuucgagaacgug

SEQ ID NO: 41274 - RNA, 27 nt, Artificial Sequence
  Protein FAM127A (61-69)
gacgcccugaaggugaccuuccucauc

SEQ ID NO: 41275 - RNA, 27 nt, Artificial Sequence
  Importin subunit beta-1 (627-635)
gacgcccugauggccgugagcacccuc

SEQ ID NO: 41276 - RNA, 24 nt, Artificial Sequence
  Eukaryotic translation initiation factor 3 subunit A (504-511)
gacgcccccaucggcccgcaccug

SEQ ID NO: 41277 - RNA, 33 nt, Artificial Sequence
  Dermcidin (86-96)
gacgccguggaggaccuggagagcgucggcaag

SEQ ID NO: 41278 - RNA, 24 nt, Artificial Sequence
  DNA polymerase delta catalytic subunit (515-522)
gacgccuaccugccccuccgccug

SEQ ID NO: 41279 - RNA, 27 nt, Artificial Sequence
  Oral-facial-digital syndrome 1 protein (185-193)
gacgccuacccccagcgcaucaaguuc

SEQ ID NO: 41280 - RNA, 27 nt, Artificial Sequence
  Splicing factor, arginine/serine-rich 15 (540-548)
gacgccuaccgcgcccugcagaagcuc

SEQ ID NO: 41281 - RNA, 24 nt, Artificial Sequence
  Period circadian protein homolog 1 (771-778)
gacgccuaccgccccgugggccug

SEQ ID NO: 41282 - RNA, 27 nt, Artificial Sequence
  Torsin-1A-interacting protein 2 (317-325)
gacgccuacaccagcucccagaaggug

SEQ ID NO: 41283 - RNA, 36 nt, Artificial Sequence
  Autism susceptibility gene 2 protein (283-294)
gacugcugcaaggagcccaucuucgagccggugguc

SEQ ID NO: 41284 - RNA, 30 nt, Artificial Sequence
  Voltage-dependent T-type calcium channel subunit alpha-1G (1640-1649)
gacgaggcccugaagaucugcaacuacauc

SEQ ID NO: 41285 - RNA, 27 nt, Artificial Sequence
  Signal peptidase complex subunit 2 (82-90)
gacggccgccugaccaucugcaccauc

SEQ ID NO: 41286 - RNA, 30 nt, Artificial Sequence
  Alanine-tRNA ligase, cytoplasmic (300-309)
gaccacgcccgcaccaucaccguggcccug

SEQ ID NO: 41287 - RNA, 27 nt, Artificial Sequence
  SRSF protein kinase 2 (597-605)
gaccacaucgcccacaucaucgagcug

SEQ ID NO: 41288 - RNA, 24 nt, Artificial Sequence
  Laminin subunit beta-3 (1159-1166)
gaccacaucaacggccgcgugcug

SEQ ID NO: 41289 - RNA, 27 nt, Artificial Sequence
  Coatomer subunit gamma-1 (762-770)
gaccacauccagaaggugaugaagcug

SEQ ID NO: 41290 - RNA, 27 nt, Artificial Sequence
  Protein Hook homolog 2 (130-138)
gaccacauccagcgcaucaugacccug

SEQ ID NO: 41291 - RNA, 27 nt, Artificial Sequence
  V-type proton ATPase subunit S1 (458-466)
gaccacaagggccccaccaucagccug

SEQ ID NO: 41292 - RNA, 27 nt, Artificial Sequence
  Cyclin-Y-like protein 2 (84-92)
gaccaccccaaggccagcaccaucuuc

SEQ ID NO: 41293 - RNA, 27 nt, Artificial Sequence
  Calponin-2 (202-210)
gaccacagcaccaucucccugcagaug

SEQ ID NO: 41294 - RNA, 24 nt, Artificial Sequence
  Integrin beta-7 (722-729)
gaccacacccaggccaucgugcug

SEQ ID NO: 41295 - RNA, 24 nt, Artificial Sequence
  Lipopolysaccharide-responsive and beige-like anchor protein (1946-1953)
gaccacgugaccgccacccagcug

SEQ ID NO: 41296 - RNA, 27 nt, Artificial Sequence
  BPI fold-containing family A member 2 (98-106)
gacaucuucggccugaagaucagcaac

SEQ ID NO: 41297 - RNA, 33 nt, Artificial Sequence
  BPI fold-containing family A member 2 (98-108)
gacaucuucggccugaagaucagcaacucccuc

SEQ ID NO: 41298 - RNA, 30 nt, Artificial Sequence
  60S ribosomal protein L4 (35-44)
gacaucgugaacuucguccacaccaaccug

SEQ ID NO: 41299 - RNA, 27 nt, Artificial Sequence
  Solute carrier family 2, facilitated glucose transporter member 2 (4-12)
gacaaggugaccggcacccuggucuuc

SEQ ID NO: 41300 - RNA, 27 nt, Artificial Sequence
  1,2-dihydroxy-3-keto-5-methylthiopentene dioxygenase (44-52)
gacaaguacgagaacgaccccgagcug

SEQ ID NO: 41301 - RNA, 27 nt, Artificial Sequence
  Peroxidasin-like protein (813-821)
gaccuggaccacaccgugcccgcccuc

SEQ ID NO: 41302 - RNA, 27 nt, Artificial Sequence
  Mitochondrial import receptor subunit TOM6 homolog (66-74)
gaccugauggccccccagccgggcgug

SEQ ID NO: 41303 - RNA, 27 nt, Artificial Sequence
  Phosphorylase b kinase gamma catalytic chain, skeletal muscle/heart isoform (105-113)
gaccugaugaagcgcggcgagcucuuc

SEQ ID NO: 41304 - RNA, 27 nt, Artificial Sequence
  Inosine-5'-monophosphate dehydrogenase 1 (77-85)
gacauggccaucgccauggcgcugaug

SEQ ID NO: 41305 - RNA, 36 nt, Artificial Sequence
  Type II inositol 1,4,5-trisphosphate 5-phosphatase (2-13)
gaccagagcguggccauccaggagacccuggccgag

SEQ ID NO: 41306 - RNA, 27 nt, Artificial Sequence
  Proline and serine-rich protein 3 (2-10)
gaccgcagccugcccguguucuccauc

SEQ ID NO: 41307 - RNA, 27 nt, Artificial Sequence
  Nucleotide exchange factor SIL1 (410-418)
gaccgcuaccggcaggacccccagcug

SEQ ID NO: 41308 - RNA, 27 nt, Artificial Sequence
  Cyclin-Y-like protein 2 (130-138)
gacagcaucgccucccagccccaccug

SEQ ID NO: 41309 - RNA, 24 nt, Artificial Sequence
  Hexokinase-2 (815-822)
gacagcaucaucgugaaggagguc

SEQ ID NO: 41310 - RNA, 24 nt, Artificial Sequence
  60S ribosomal protein L6 (255-262)
gacagccagauccugcccaagauc

SEQ ID NO: 41311 - RNA, 27 nt, Artificial Sequence
  Small ubiquitin-related modifier 1 (30-38)
gacagcuccgagauccacuucaaggug

SEQ ID NO: 41312 - RNA, 27 nt, Artificial Sequence
  Integrin beta-7 (374-382)
gacagcuccaacgugguccagcugauc

SEQ ID NO: 41313 - RNA, 27 nt, Artificial Sequence
  Ig lambda-2 chain C regions (45-53)
gacagcucccccgugaaggccggcguc

SEQ ID NO: 41314 - RNA, 27 nt, Artificial Sequence
  Sterol O-acyltransferase 1 (310-318)
gacagcuacccccgcaacccgaccgug

SEQ ID NO: 41315 - RNA, 24 nt, Artificial Sequence
  Store-operated calcium entry-associated regulatory factor (74-81)
gacagcuacacccccaaggugauc

SEQ ID NO: 41316 - RNA, 27 nt, Artificial Sequence
  Disintegrin and metalloproteinase domain-containing protein 15 (247-255)
gacaccuucuuccgcccccugaacgug

SEQ ID NO: 41317 - RNA, 24 nt, Artificial Sequence
  Sialidase-1 (75-82)
gacaccuuccgcaucccccugauc

SEQ ID NO: 41318 - RNA, 27 nt, Artificial Sequence
  WD repeat-containing protein 54 (273-281)
gacaccuucgugcacaucuggaagcug

SEQ ID NO: 41319 - RNA, 27 nt, Artificial Sequence
  Protein FAM117A (93-101)
gacaccauccugagcuccuaccuccug

SEQ ID NO: 41320 - RNA, 30 nt, Artificial Sequence
  Ankyrin repeat and SOCS box protein 3 (420-429)
gacacccugaucuucacccucgaguucacg

SEQ ID NO: 41321 - RNA, 27 nt, Artificial Sequence
  WD repeat-containing protein 26 (376-384)
gacaccaccgugaucaucuggcagguc

SEQ ID NO: 41322 - RNA, 27 nt, Artificial Sequence
  Signal recognition particle receptor subunit beta (154-162)
gacguggccgaguuccuguaccagguc

SEQ ID NO: 41323 - RNA, 27 nt, Artificial Sequence
  60S ribosomal protein L23a (120-128)
gacguggccaaggucaacacccugauc

SEQ ID NO: 41324 - RNA, 27 nt, Artificial Sequence
  G2/M phase-specific E3 ubiquitin-protein ligase (493-501)
gacguggcccagaucaucauccgcauc

SEQ ID NO: 41325 - RNA, 27 nt, Artificial Sequence
  Inorganic pyrophosphatase (42-50)
gacguguuccacauggucguggaggug

SEQ ID NO: 41326 - RNA, 27 nt, Artificial Sequence
  Carboxylesterase 3 (415-423)
gacguguucaucaacguccccaccgug

SEQ ID NO: 41327 - RNA, 27 nt, Artificial Sequence
  Bardet-Biedl syndrome 7 protein (53-61)
gaggccgccgcgguguucaagacccug

SEQ ID NO: 41328 - RNA, 27 nt, Artificial Sequence
  Exocyst complex component 5 (158-166)
gaggccgccgacaucauccagaagcug

SEQ ID NO: 41329 - RNA, 27 nt, Artificial Sequence
  Lysine-specific histone demethylase 1A (710-718)
gaggccgccggcaucauggagaacauc

SEQ ID NO: 41330 - RNA, 33 nt, Artificial Sequence
  Probable phospholipid-transporting ATPase VA (700-710)
gaggccgcccugguguacgcggcccgcgccuac

SEQ ID NO: 41331 - RNA, 27 nt, Artificial Sequence
  Kelch-like protein 6 (450-458)
gaggccgccccccugcucgugcacguc

SEQ ID NO: 41332 - RNA, 27 nt, Artificial Sequence
  Coatomer subunit gamma-1 (269-277)
gaggccgccagcgcgaucgugaaccug

SEQ ID NO: 41333 - RNA, 27 nt, Artificial Sequence
  Nesprin-3 (176-184)
gaggccgccagccuguucaaccgcauc

SEQ ID NO: 41334 - RNA, 30 nt, Artificial Sequence
  snRNA-activating protein complex subunit 4 (237-246)
gaggccgagaaggagauccaggacaucaac

SEQ ID NO: 41335 - RNA, 27 nt, Artificial Sequence
  L-xylulose reductase (98-106)
gaggccuucgaccgcagcuucgaggug

SEQ ID NO: 41336 - RNA, 30 nt, Artificial Sequence
  Protein flightless-1 homolog (516-525)
gaggccuuccacggcaaguucuacgaggcc

SEQ ID NO: 41337 - RNA, 27 nt, Artificial Sequence
  Mortality factor 4-like protein 2 (113-121)
gaggccuucaagaaccgcauggaggug

SEQ ID NO: 41338 - RNA, 27 nt, Artificial Sequence
  Pre-B-cell leukemia transcription factor-interacting protein 1 (166-174)
gaggccggccccccgcagcccauggug

SEQ ID NO: 41339 - RNA, 27 nt, Artificial Sequence
  E3 ubiquitin-protein ligase UBR2 (256-264)
gaggccaucggcuucgccaccaccgug

SEQ ID NO: 41340 - RNA, 24 nt, Artificial Sequence
  60S ribosomal protein L10 (63-70)
gaggcccuggaggccgcgcgcauc

SEQ ID NO: 41341 - RNA, 24 nt, Artificial Sequence
  Steroid hormone receptor ERR1 (353-360)
gaggcccugcacgaggcccuccug

SEQ ID NO: 41342 - RNA, 27 nt, Artificial Sequence
  Very-long-chain (3R)-3-hydroxyacyl-CoA dehydratase 3 (293-301)
gaggccgugagcgucauccaguccauc

SEQ ID NO: 41343 - RNA, 27 nt, Artificial Sequence
  Paired amphipathic helix protein Sin3a (1166-1174)
gagugccgcuucaagcugaacagcuac

SEQ ID NO: 41344 - RNA, 36 nt, Artificial Sequence
  RNA polymerase I-specific transcription initiation factor RRN3 (604-615)
gaggacgacgacuuccugaagggcgaggugccccag

SEQ ID NO: 41345 - RNA, 27 nt, Artificial Sequence
  MICAL C-terminal-like protein (368-376)
gaggacgugcccacccugcucgagaag

SEQ ID NO: 41346 - RNA, 27 nt, Artificial Sequence
  Protein transport protein Sec24C (408-416)
gaggaggccagccccuacguggucgac

SEQ ID NO: 41347 - RNA, 33 nt, Artificial Sequence
  PHD finger protein 10 (446-456)
gaggagaugauguucugcgacaugugcgaccgc

SEQ ID NO: 41348 - RNA, 27 nt, Artificial Sequence
  FERM domain-containing protein 6 (338-346)
gaggagaacgaggagaagaagcaguac

SEQ ID NO: 41349 - RNA, 27 nt, Artificial Sequence
  Epiplakin (2700-2708)
gaggagcgccugagcaagguguccuuc

SEQ ID NO: 41350 - RNA, 36 nt, Artificial Sequence
  Salivary acidic proline-rich phosphoprotein 1/2 (44-55)
gaggagcgccagggccccccgcuggggggccagcag

SEQ ID NO: 41351 - RNA, 27 nt, Artificial Sequence
  Inactive ubiquitin carboxyl-terminal hydrolase 17-like protein 4 (449-457)
gaguucaacgugcgcaaggucgagggc

SEQ ID NO: 41352 - RNA, 27 nt, Artificial Sequence
  Kinesin heavy chain isoform 5A (583-591)
gaguucaccguggcccgccuguacauc

SEQ ID NO: 41353 - RNA, 27 nt, Artificial Sequence
  Hyaluronan and proteoglycan link protein 2 (201-209)
gagggcagcgugcgcuaccccguccug

SEQ ID NO: 41354 - RNA, 24 nt, Artificial Sequence
  Gem-associated protein 5 (589-596)
gagcacggcagccagcccgagcug

SEQ ID NO: 41355 - RNA, 27 nt, Artificial Sequence
  Filamin-B (2269-2277)
gagcacauccccgagagcccguaccug

SEQ ID NO: 41356 - RNA, 27 nt, Artificial Sequence
  Protein Hook homolog 1 (136-144)
gagcacauccagaacaucaugacccug

SEQ ID NO: 41357 - RNA, 27 nt, Artificial Sequence
  26S proteasome non-ATPase regulatory subunit 11 (348-356)
gagcacaucagcucccugaucaagcuc

SEQ ID NO: 41358 - RNA, 27 nt, Artificial Sequence
  Intraflagellar transport protein 46 homolog (70-78)
gagcaccugcccgugagcgccgagauc

SEQ ID NO: 41359 - RNA, 27 nt, Artificial Sequence
  Kinesin-like protein KIF21B (1412-1420)
gagcaccagaucaaccagaucgcccug

SEQ ID NO: 41360 - RNA, 27 nt, Artificial Sequence
  Zinc finger and BTB domain-containing protein 38 (220-228)
gagcacagcuacgccguguccagcguc

SEQ ID NO: 41361 - RNA, 27 nt, Artificial Sequence
  Fructose-bisphosphate aldolase A (156-164)
gagcacacccccagcgcccuggccauc

SEQ ID NO: 41362 - RNA, 27 nt, Artificial Sequence
  Ribosome-binding protein 1 (768-776)
gagcacgugaaggagguccagcagcug

SEQ ID NO: 41363 - RNA, 27 nt, Artificial Sequence
  OTU domain-containing protein 6B (276-284)
gagcacuacaacagcgugacccgccug

SEQ ID NO: 41364 - RNA, 27 nt, Artificial Sequence
  E3 ubiquitin-protein ligase UBR4 (401-409)
gagcacuaccagaacuuccagcugcuc

SEQ ID NO: 41365 - RNA, 27 nt, Artificial Sequence
  26S protease regulatory subunit 4 (130-138)
gagcacuacgugagcauccuguccuuc

SEQ ID NO: 41366 - RNA, 27 nt, Artificial Sequence
  Epsin-2 (42-50)
gagaucgccgaccugaccuacaacgug

SEQ ID NO: 41367 - RNA, 27 nt, Artificial Sequence
  Telomere-associated protein RIF1 (220-228)
gagaucgccagcaucaccgagcagcug

SEQ ID NO: 41368 - RNA, 30 nt, Artificial Sequence
  General transcription factor II-I (577-586)
gagaucuucaaccugaaguucgcccaggcc

SEQ ID NO: 41369 - RNA, 30 nt, Artificial Sequence
  Atlastin-3 (199-208)
gagaucuuccagaagcccuuccagacccug

SEQ ID NO: 41370 - RNA, 27 nt, Artificial Sequence
  DNA-directed RNA polymerase III subunit RPC5 (655-663)
gagaucuucagcaagaacuaccgcgug

SEQ ID NO: 41371 - RNA, 30 nt, Artificial Sequence
  C-X-C motif chemokine 9 (62-71)
gagaucaucgccacccugaagaacggcgug

SEQ ID NO: 41372 - RNA, 27 nt, Artificial Sequence
  Uncharacterized protein CXorf23 (474-482)
gagaucaucaccaucauccaccaggug

SEQ ID NO: 41373 - RNA, 27 nt, Artificial Sequence
  Serine/threonine-protein kinase TBK1 (497-505)
gagaucagcgacauccacaccaagcug

SEQ ID NO: 41374 - RNA, 27 nt, Artificial Sequence
  Constitutive coactivator of peroxisome proliferator-activated receptor gamma (111-119)
gagaucagccgcaucuuccacuacauc

SEQ ID NO: 41375 - RNA, 27 nt, Artificial Sequence
  Centrosomal protein of 170 kDa protein B (1491-1499)
gagaucagcuccauccugaaggagcuc

SEQ ID NO: 41376 - RNA, 27 nt, Artificial Sequence
  Testis-specific Y-encoded-like protein 2 (468-476)
gagaucaccgacaucaacgagaacauc

SEQ ID NO: 41377 - RNA, 27 nt, Artificial Sequence
  Oxysterols receptor LXR-beta (280-288)
gagaucguggacuucgccaagcagguc

SEQ ID NO: 41378 - RNA, 30 nt, Artificial Sequence
  Tubulin beta-4B chain (3-12)
gagaucgugcaccugcaggccggccagugc

SEQ ID NO: 41379 - RNA, 27 nt, Artificial Sequence
  Activating transcription factor 7-interacting protein 2 (101-109)
gagaucgugcacagcgagaccaagcug

SEQ ID NO: 41380 - RNA, 27 nt, Artificial Sequence
  Ras GTPase-activating-like protein IQGAP2 (753-761)
gagaucgugaagauccagagccugcuc

SEQ ID NO: 41381 - RNA, 27 nt, Artificial Sequence
  Williams-Beuren syndrome chromosomal region 16 protein (214-222)
gagaucuacagcgagucccaccgcgug

SEQ ID NO: 41382 - RNA, 30 nt, Artificial Sequence
  Protein S100-A8 (6-15)
gagaaggcccugaacagcaucaucgacgug

SEQ ID NO: 41383 - RNA, 30 nt, Artificial Sequence
  Zinc finger protein 559 (97-106)
gagaaggcccugagcgagcacuccugccuc

SEQ ID NO: 41384 - RNA, 27 nt, Artificial Sequence
  Replication protein A 32 kDa subunit (84-92)
gagaaggcccccaccaacaucguguac

SEQ ID NO: 41385 - RNA, 27 nt, Artificial Sequence
  Pre-mRNA-processing factor 40 homolog A (475-483)
gagaagaugaccagcaccacgcgcuac

SEQ ID NO: 41386 - RNA, 30 nt, Artificial Sequence
  Transcriptional repressor p66-beta (434-443)
gagaagaacggcaagauccugugcgagcag

SEQ ID NO: 41387 - RNA, 30 nt, Artificial Sequence
  Valine-tRNA ligase (271-280)
gagaagcgcgaccccggcgugaucaccuac

SEQ ID NO: 41388 - RNA, 27 nt, Artificial Sequence
  Transcriptional regulator Kaiso (528-536)
gagaagguguucccccuggccgaguac

SEQ ID NO: 41389 - RNA, 27 nt, Artificial Sequence
  Tyrosine-tRNA ligase, cytoplasmic (281-289)
gagaaguggggcgggaacaagaccuac

SEQ ID NO: 41390 - RNA, 27 nt, Artificial Sequence
  E3 ubiquitin-protein ligase synoviolin (216-224)
gagcuguucaccggcuucaucaaggug

SEQ ID NO: 41391 - RNA, 30 nt, Artificial Sequence
  Cohesin subunit SA-2 (1209-1218)
gagcugaagcccgacuucuucgacccggcc

SEQ ID NO: 41392 - RNA, 27 nt, Artificial Sequence
  Cytospin-A (413-421)
gagcugcaggccacccuccaggagcug

SEQ ID NO: 41393 - RNA, 27 nt, Artificial Sequence
  E3 ubiquitin-protein ligase UBR4 (3813-3821)
gagcugagcaagaucauccagaaggug

SEQ ID NO: 41394 - RNA, 27 nt, Artificial Sequence
  60S ribosomal protein L36 (89-97)
gagcugagcaacgugcucgccgccaug

SEQ ID NO: 41395 - RNA, 30 nt, Artificial Sequence
  Glutamate-rich protein 3 (1485-1494)
gagcugagccccgagucccuccaggccaug

SEQ ID NO: 41396 - RNA, 27 nt, Artificial Sequence
  Mini-chromosome maintenance complex-binding protein (343-351)
gagcugagccccgugcgcgccgagcuc

SEQ ID NO: 41397 - RNA, 36 nt, Artificial Sequence
  Dynamin-binding protein (804-815)
gagaugugcaucgagcgcaucauggugcccaugcag

SEQ ID NO: 41398 - RNA, 30 nt, Artificial Sequence
  GLIPR1-like protein 2 (312-321)
gagauggagauggagaucauggagauggag

SEQ ID NO: 41399 - RNA, 36 nt, Artificial Sequence
  Pleckstrin homology domain-containing family G member 3 (582-593)
gagaugggcggggccgcccaggagcccgagagccug

SEQ ID NO: 41400 - RNA, 27 nt, Artificial Sequence
  Contactin-1 (416-424)
gagaugaaccccaugaagaagaagauc

SEQ ID NO: 41401 - RNA, 24 nt, Artificial Sequence
  Putative vomeronasal receptor-like protein 4 (2-9)
gagaugaccaagcuguucagcuac

SEQ ID NO: 41402 - RNA, 30 nt, Artificial Sequence
  Putative vomeronasal receptor-like protein 4 (2-11)
gagaugaccaagcuguucagcuacaucgug

SEQ ID NO: 41403 - RNA, 27 nt, Artificial Sequence
  Cyclin-H (240-248)
gagaaccgcaccugccugagccagcuc

SEQ ID NO: 41404 - RNA, 27 nt, Artificial Sequence
  3-phosphoinositide-dependent protein kinase 1 (57-65)
gagccccgcccgggcgccgggagccug

SEQ ID NO: 41405 - RNA, 27 nt, Artificial Sequence
  Gamma-glutamyltransferase 6 (2-10)
gagcgcgccgaggagcccguggucuac

SEQ ID NO: 41406 - RNA, 27 nt, Artificial Sequence
  Integrin beta-7 (243-251)
gagcgcgaggugggccggcagagcguc

SEQ ID NO: 41407 - RNA, 27 nt, Artificial Sequence
  Serine/threonine-protein kinase pim-3 (34-42)
gagagcuucgagaaggccuaccaggug

SEQ ID NO: 41408 - RNA, 27 nt, Artificial Sequence
  Endoplasmin (550-558)
gagagcucccccuucguggagcgccug

SEQ ID NO: 41409 - RNA, 27 nt, Artificial Sequence
  Lamina-associated polypeptide 2, isoforms beta/gamma (277-285)
gagagcacccccaucgccgagaccauc

SEQ ID NO: 41410 - RNA, 36 nt, Artificial Sequence
  Dermcidin (92-103)
gagagcgugggcaagggggccguccacgacgugaag

SEQ ID NO: 41411 - RNA, 27 nt, Artificial Sequence
  Elongation factor 2 (311-319)
gagaccgccaagcugaucgagaagcuc

SEQ ID NO: 41412 - RNA, 30 nt, Artificial Sequence
  Dolichyl-diphosphooligosaccharide-proteinosyltransferase 48 kDa subunit (318-327)
gagaccgcccccccgaacgccuacaccgug

SEQ ID NO: 41413 - RNA, 27 nt, Artificial Sequence
  Heat shock protein HSP 90-beta (13-21)
gagaccuucgccuuccaggccgagauc

SEQ ID NO: 41414 - RNA, 27 nt, Artificial Sequence
  Cyclin-dependent kinase 6 (69-77)
gagaccuucgagcaccccaacgugguc

SEQ ID NO: 41415 - RNA, 27 nt, Artificial Sequence
  Serine/threonine-protein phosphatase 2A catalytic subunit beta isoform (226-234)
gagaccuucaaccacgccaacggccug

SEQ ID NO: 41416 - RNA, 36 nt, Artificial Sequence
  Protein diaphanous homolog 1 (1255-1266)
gagaccuuccccaccauccuggaggaggccaaggag

SEQ ID NO: 41417 - RNA, 27 nt, Artificial Sequence
  Serine/threonine-protein kinase 17B (257-265)
gagaccuucagcuccgugagccagcug

SEQ ID NO: 41418 - RNA, 27 nt, Artificial Sequence
  Transcription elongation factor SPT6 (1159-1167)
gagaccuucuacaucggcaagcugauc

SEQ ID NO: 41419 - RNA, 27 nt, Artificial Sequence
  SWI/SNF-related matrix-associated actin-dependent regulator of chromatin subfamily D member 2 (442-450)
gagaccaucgagagcaucaaccagcug

SEQ ID NO: 41420 - RNA, 30 nt, Artificial Sequence
  Ribonuclease H2 subunit C (135-144)
gagaccauccccggcccggacgccaaggug

SEQ ID NO: 41421 - RNA, 30 nt, Artificial Sequence
  MOB kinase activator 1A (129-138)
gagacccuguuccccagcaagaucggcgug

SEQ ID NO: 41422 - RNA, 27 nt, Artificial Sequence
  Cystatin-B (15-23)
gagacccagcacaucgccgaccaggug

SEQ ID NO: 41423 - RNA, 27 nt, Artificial Sequence
  Heat shock protein HSP 90-beta (478-486)
gagacccagaagagcaucuacuacauc

SEQ ID NO: 41424 - RNA, 30 nt, Artificial Sequence
  Wiskott-Aldrich syndrome protein (285-294)
gagaccagcaagcugaucuacgacuucauc

SEQ ID NO: 41425 - RNA, 27 nt, Artificial Sequence
  Elongation factor 1-alpha 1 (81-89)
gagaccagcaaguacuacgugaccauc

SEQ ID NO: 41426 - RNA, 27 nt, Artificial Sequence
  Protein virilizer homolog (61-69)
gagaccagcccccacaccuuccagcug

SEQ ID NO: 41427 - RNA, 27 nt, Artificial Sequence
  Splicing factor 3B subunit 1 (1221-1229)
gagaccagcccccacgugauccaggcc

SEQ ID NO: 41428 - RNA, 30 nt, Artificial Sequence
  G1/S-specific cyclin-D2 (114-123)
gagaccagcccccugaccgccgagaagcuc

SEQ ID NO: 41429 - RNA, 27 nt, Artificial Sequence
  Neurexin-3 (1375-1383)
gagaccaccaaggacagccuguccaug

SEQ ID NO: 41430 - RNA, 27 nt, Artificial Sequence
  Mucin-16 (2346-2354)
gagaccaccgugaagacgagcgacauc

SEQ ID NO: 41431 - RNA, 27 nt, Artificial Sequence
  Non-structural maintenance of chromosomes element 1 homolog (182-190)
gagaccuaccccgacgccgugaagauc

SEQ ID NO: 41432 - RNA, 27 nt, Artificial Sequence
  Alanine-tRNA ligase, cytoplasmic (688-696)
gagaccuaccccgacccggugcgcguc

SEQ ID NO: 41433 - RNA, 30 nt, Artificial Sequence
  Actin-related protein 2 (129-138)
gagaccuaccaguucagcggcguguacguc

SEQ ID NO: 41434 - RNA, 27 nt, Artificial Sequence
  Pre-mRNA-processing-splicing factor 8 (1844-1852)
gagguggccgcccugauccgcagccuc

SEQ ID NO: 41435 - RNA, 27 nt, Artificial Sequence
  Ankyrin repeat and KH domain-containing protein 1 (519-527)
gagguggccgacuuccugaucaaggcc

SEQ ID NO: 41436 - RNA, 27 nt, Artificial Sequence
  PRKCA-binding protein (85-93)
gagguggccaagaugauccaggagguc

SEQ ID NO: 41437 - RNA, 27 nt, Artificial Sequence
  A-kinase anchor protein 9 (1455-1463)
gagguggccaaggucaucgugagcaug

SEQ ID NO: 41438 - RNA, 27 nt, Artificial Sequence
  Histone acetyltransferase KAT8 (250-258)
gagguggacggcaaggaccacaagauc

SEQ ID NO: 41439 - RNA, 33 nt, Artificial Sequence
  Nucleolin (411-421)
gagguguucgaggacgccgccgagauccgccug

SEQ ID NO: 41440 - RNA, 27 nt, Artificial Sequence
  Nucleolin (504-512)
gagguguucgagaaggccaccuucauc

SEQ ID NO: 41441 - RNA, 27 nt, Artificial Sequence
  Desmoplakin (745-753)
gagguguucggccuguuccagaagcuc

SEQ ID NO: 41442 - RNA, 27 nt, Artificial Sequence
  Splicing factor 3B subunit 3 (57-65)
gagguguucggcgucauccgcagccug

SEQ ID NO: 41443 - RNA, 27 nt, Artificial Sequence
  E2F-associated phosphoprotein (273-281)
gagguguuccacuucuucaacguccug

SEQ ID NO: 41444 - RNA, 27 nt, Artificial Sequence
  Vacuolar protein sorting-associated protein 8 homolog (935-943)
gagguguucaacuacauccacaacauc

SEQ ID NO: 41445 - RNA, 27 nt, Artificial Sequence
  Actin-binding LIM protein 1 (747-755)
gagguguuccgcgagaucuucggcaug

SEQ ID NO: 41446 - RNA, 30 nt, Artificial Sequence
  Replication protein A 32 kDa subunit (62-71)
gagguguuccgcaucggcaacgucgagauc

SEQ ID NO: 41447 - RNA, 27 nt, Artificial Sequence
  Phenylalanine-tRNA ligase alpha subunit (418-426)
gagguguucagcuaccaccagggccug

SEQ ID NO: 41448 - RNA, 27 nt, Artificial Sequence
  Non-canonical poly(A) RNA polymerase PAPD7 (185-193)
gagguguucaccggcgggaucagcucc

SEQ ID NO: 41449 - RNA, 27 nt, Artificial Sequence
  Cytochrome b-245 heavy chain (203-211)
gagguguucugguacacccaccaccug

SEQ ID NO: 41450 - RNA, 30 nt, Artificial Sequence
  Sigma non-opioid intracellular receptor 1 (144-153)
gagguguucuaccccggcgagaccgucgug

SEQ ID NO: 41451 - RNA, 27 nt, Artificial Sequence
  Phosphomannomutase 1 (68-76)
gaggugaucgagaaguucgacuacguc

SEQ ID NO: 41452 - RNA, 27 nt, Artificial Sequence
  Centromere/kinetochore protein zw10 homolog (663-671)
gaggugaucggcaagaucaccgcccug

SEQ ID NO: 41453 - RNA, 27 nt, Artificial Sequence
  Protein phosphatase 1G (109-117)
gaggugaucaaggagcuggcccagauc

SEQ ID NO: 41454 - RNA, 27 nt, Artificial Sequence
  Importin-9 (267-275)
gaggugcugaaggccgucaccgcccuc

SEQ ID NO: 41455 - RNA, 27 nt, Artificial Sequence
  Nuclear receptor-binding factor 2 (2-10)
gaggugauggagggcccccugaaccuc

SEQ ID NO: 41456 - RNA, 27 nt, Artificial Sequence
  Uncharacterized protein KIAA1143 (71-79)
gaggugaugaagaucaaggccgagauc

SEQ ID NO: 41457 - RNA, 27 nt, Artificial Sequence
  C-1-tetrahydrofolate synthase, cytoplasmic (80-88)
gaggugaugaaguacaucaccagccug

SEQ ID NO: 41458 - RNA, 27 nt, Artificial Sequence
  Probable ubiquitin carboxyl-terminal hydrolase FAF-X (357-365)
gaggugaacaaggucaucagcuccgug

SEQ ID NO: 41459 - RNA, 27 nt, Artificial Sequence
  Programmed cell death protein 4 (355-363)
gaggugccccacuuccaccacgagcug

SEQ ID NO: 41460 - RNA, 27 nt, Artificial Sequence
  InaD-like protein (626-634)
gaggugcccccgcccuucacccugguc

SEQ ID NO: 41461 - RNA, 27 nt, Artificial Sequence
  Gypsy retrotransposon integrase-like protein 1 (184-192)
gaggugagcaaggccaucaucaacauc

SEQ ID NO: 41462 - RNA, 27 nt, Artificial Sequence
  DNA-directed RNA polymerase III subunit RPC3 (143-151)
gaggugagcaacaccuucguccgccug

SEQ ID NO: 41463 - RNA, 27 nt, Artificial Sequence
  CAP-Gly domain-containing linker protein 1 (841-849)
gaggugagccaggucaaggagacccug

SEQ ID NO: 41464 - RNA, 30 nt, Artificial Sequence
  Double-stranded RNA-specific adenosine deaminase (806-815)
gaggugacccccgucaccggcgccagccug

SEQ ID NO: 41465 - RNA, 27 nt, Artificial Sequence
  Multiple C2 and transmembrane domain-containing protein 1 (410-418)
gagguggucggcagcuacuucuccgug

SEQ ID NO: 41466 - RNA, 30 nt, Artificial Sequence
  Monocarboxylate transporter 4 (456-465)
gaggugguccacacccccgagaccagcgug

SEQ ID NO: 41467 - RNA, 27 nt, Artificial Sequence
  E3 ubiquitin-protein ligase RNF114 (34-42)
gagguguacgagaagcccguccaggug

SEQ ID NO: 41468 - RNA, 33 nt, Artificial Sequence
  Sorting nexin-17 (460-470)
uucgccuucgagggcaucggggacgaggaccug

SEQ ID NO: 41469 - RNA, 30 nt, Artificial Sequence
  Coiled-coil domain-containing protein 60 (70-79)
uucgccauccugcgcgaggagaccgccaag

SEQ ID NO: 41470 - RNA, 27 nt, Artificial Sequence
  Serpin B6 (11-19)
uucgcccugaaccuccugaagacccug

SEQ ID NO: 41471 - RNA, 27 nt, Artificial Sequence
  Inactive phospholipase D5 (72-80)
uucgcccuggugugcugcuucgccauc

SEQ ID NO: 41472 - RNA, 27 nt, Artificial Sequence
  Actin-like protein 6A (118-126)
uucgccaacggccgcagcaccgggcug

SEQ ID NO: 41473 - RNA, 27 nt, Artificial Sequence
  Fatty acid synthase (1720-1728)
uucgccaacagccgcgacaccuccuuc

SEQ ID NO: 41474 - RNA, 27 nt, Artificial Sequence
  DNA polymerase delta subunit 2 (24-32)
uucgcccgcgugcccgucgccaccuac

SEQ ID NO: 41475 - RNA, 30 nt, Artificial Sequence
  Microtubule cross-linking factor 1 (1586-1595)
uucgccagcccccugcacucccucgagaug

SEQ ID NO: 41476 - RNA, 27 nt, Artificial Sequence
  ATP synthase subunit delta, mitochondrial (42-50)
uucgccagccccacccagguguucuuc

SEQ ID NO: 41477 - RNA, 27 nt, Artificial Sequence
  Alanine-tRNA ligase, cytoplasmic (346-354)
uucgccacccugguggacgucguggug

SEQ ID NO: 41478 - RNA, 33 nt, Artificial Sequence
  G patch domain-containing protein 2 (148-158)
uucgccguggacaacgucggcaaccgcacccug

SEQ ID NO: 41479 - RNA, 27 nt, Artificial Sequence
  Protein disulfide-isomerase A2 (456-464)
uucgccgugcacggcuuccccacccug

SEQ ID NO: 41480 - RNA, 27 nt, Artificial Sequence
  Translocon-associated protein subunit gamma (75-83)
uucgccuacaagaacgugaaguucguc

SEQ ID NO: 41481 - RNA, 27 nt, Artificial Sequence
  Transmembrane protein 214 (326-334)
uucgccuacaugcccaacaacagccug

SEQ ID NO: 41482 - RNA, 27 nt, Artificial Sequence
  28S ribosomal protein S29, mitochondrial (117-125)
uucgccuaccccgccauccgcuaccug

SEQ ID NO: 41483 - RNA, 27 nt, Artificial Sequence
  Protein furry homolog-like (828-836)
uucgccuacacccgccugcagcuccug

SEQ ID NO: 41484 - RNA, 24 nt, Artificial Sequence
  Transmembrane and coiled-coil domain-containing protein 1 (109-116)
uucgacggccgcguggucgccaag

SEQ ID NO: 41485 - RNA, 27 nt, Artificial Sequence
  ATP-binding cassette sub-family A member 9 (420-428)
uucgacaagauccugcccgccgaguac

SEQ ID NO: 41486 - RNA, 24 nt, Artificial Sequence
  Peroxidasin-like protein (1168-1175)
uucgaggaccugcagaacgagauc

SEQ ID NO: 41487 - RNA, 30 nt, Artificial Sequence
  Unconventional myosin-Ih (75-84)
uucgagcugcccccgcacguguacgccauc

SEQ ID NO: 41488 - RNA, 27 nt, Artificial Sequence
  Band 4.1-like protein 1 (692-700)
uucgagcccgugaagaccgagaccaug

SEQ ID NO: 41489 - RNA, 36 nt, Artificial Sequence
  Gigaxonin (459-470)
uucggcgccguggccugcggggucgcgauggagcug

SEQ ID NO: 41490 - RNA, 30 nt, Artificial Sequence
  Cysteine andine-rich protein 1 (180-189)
uucggcuucgggcagggcgccggggcccug

SEQ ID NO: 41491 - RNA, 27 nt, Artificial Sequence
  Protein FAM60A (2-10)
uucggcuuccacaagcccaagauguac

SEQ ID NO: 41492 - RNA, 27 nt, Artificial Sequence
  Acyl-CoA-binding domain-containing protein 6 (141-149)
uucggcgggcccgugaucagcucccug

SEQ ID NO: 41493 - RNA, 27 nt, Artificial Sequence
  Hydroxyacyl-coenzyme A dehydrogenase, mitochondrial (302-310)
uucggcaagaagaccggggagggcuuc

SEQ ID NO: 41494 - RNA, 27 nt, Artificial Sequence
  EH domain-containing protein 1 (42-50)
uuccacgaguuccacagccccgcccug

SEQ ID NO: 41495 - RNA, 27 nt, Artificial Sequence
  Forkhead box protein N2 (278-286)
uuccaccaccccagcgccgugcgccug

SEQ ID NO: 41496 - RNA, 27 nt, Artificial Sequence
  B-lymphocyte antigen CD20 (62-70)
uuccacaucgcccugggcgggcuccug

SEQ ID NO: 41497 - RNA, 27 nt, Artificial Sequence
  Endoplasmic reticulum-Golgi intermediate compartment protein 2 (185-193)
uuccacaucaccgugggcaaggccauc

SEQ ID NO: 41498 - RNA, 27 nt, Artificial Sequence
  Complement receptor type 2 (1016-1024)
uuccaccuggaggcccgcgagguguac

SEQ ID NO: 41499 - RNA, 27 nt, Artificial Sequence
  Eukaryotic elongation factor 2 kinase (553-561)
uuccaccuggagcacgccgccaaccuc

SEQ ID NO: 41500 - RNA, 27 nt, Artificial Sequence
  Dolichyl-diphosphooligosaccharide-proteinosyltransferase subunit 2 (579-587)
uuccaccugggccacgccgccaugcuc

SEQ ID NO: 41501 - RNA, 27 nt, Artificial Sequence
  Brain-specific angiogenesis inhibitor 1-associated protein 2 (97-105)
uuccacaacgagcugcucacccagcug

SEQ ID NO: 41502 - RNA, 27 nt, Artificial Sequence
  Large subunit GTPase 1 homolog (597-605)
uuccaccaggagaacgugcgcgcccug

SEQ ID NO: 41503 - RNA, 27 nt, Artificial Sequence
  tRNA (uracil(54)-C(5))-methyltransferase homolog (396-404)
uuccacaccggccaggccgagaagauc

SEQ ID NO: 41504 - RNA, 30 nt, Artificial Sequence
  E3 ubiquitin-protein ligase UHRF1 (36-45)
uuccacguggagcccggccugcagcgccuc

SEQ ID NO: 41505 - RNA, 27 nt, Artificial Sequence
  Minor histocompatibility protein HA-1 (190-198)
uuccacuacgagagcaacaacgaccug

SEQ ID NO: 41506 - RNA, 27 nt, Artificial Sequence
  Gamma-adducin (307-315)
uuccacuacaucuucaacgugcagcug

SEQ ID NO: 41507 - RNA, 27 nt, Artificial Sequence
  Protein RER1 (79-87)
uucaucgccuuccugagccccaaggug

SEQ ID NO: 41508 - RNA, 27 nt, Artificial Sequence
  Mitochondrial import receptor subunit TOM5 homolog (43-51)
uucauccugaagaagcucgacagcauc

SEQ ID NO: 41509 - RNA, 27 nt, Artificial Sequence
  Neutral amino acid transporter B(0) (175-183)
uucauccugcccaucggcgccaccgug

SEQ ID NO: 41510 - RNA, 27 nt, Artificial Sequence
  Nectin-1 (509-517)
uucaucagcaagaaggagugguacgug

SEQ ID NO: 41511 - RNA, 27 nt, Artificial Sequence
  Desmoplakin (2300-2308)
uucaucguggaccccgucagcaaccug

SEQ ID NO: 41512 - RNA, 27 nt, Artificial Sequence
  Zinc finger protein 460 (554-562)
uucaucguggaggagacccugccccuc

SEQ ID NO: 41513 - RNA, 27 nt, Artificial Sequence
  Elongation factor 1-gamma (16-24)
uucaaggcccugaucgccgcgcaguac

SEQ ID NO: 41514 - RNA, 27 nt, Artificial Sequence
  Ubiquilin-1 (61-69)
uucaaggaggagaucagcaagcgcuuc

SEQ ID NO: 41515 - RNA, 27 nt, Artificial Sequence
  Nuclear pore complex protein Nup153 (924-932)
uucaaguucggcgaccaggggggcuuc

SEQ ID NO: 41516 - RNA, 27 nt, Artificial Sequence
  Thioredoxin-interacting protein (370-378)
uucaaguucaugcccccgcccaccuac

SEQ ID NO: 41517 - RNA, 27 nt, Artificial Sequence
  Protein SCAF11 (1115-1123)
uucaaguucguggagcagcagagcuac

SEQ ID NO: 41518 - RNA, 30 nt, Artificial Sequence
  Casein kinase II subunit alpha (197-206)
uucaagggccccgagcugcucguggacuac

SEQ ID NO: 41519 - RNA, 30 nt, Artificial Sequence
  Ras association domain-containing protein 2 (212-221)
uucaagaucgagaacagcgccgaggaguuc

SEQ ID NO: 41520 - RNA, 27 nt, Artificial Sequence
  Septin-6 (197-205)
uucaagaucaagaucaccagcgagcug

SEQ ID NO: 41521 - RNA, 27 nt, Artificial Sequence
  Ubiquitin carboxyl-terminal hydrolase 33 (150-158)
uucaagauccccagcaacaccacccug

SEQ ID NO: 41522 - RNA, 30 nt, Artificial Sequence
  SLIT-ROBO Rho GTPase-activating protein 3 (765-774)
uucaagaagggcgccagccugcuccuguac

SEQ ID NO: 41523 - RNA, 30 nt, Artificial Sequence
  ETS domain-containing protein Elk-4 (163-172)
uucaagcugaucaagaccgagaaccccgcc

SEQ ID NO: 41524 - RNA, 27 nt, Artificial Sequence
  Nucleoporin-like protein 2 (303-311)
uucaagagccccgccgccuccagcuuc

SEQ ID NO: 41525 - RNA, 30 nt, Artificial Sequence
  Mini-chromosome maintenance complex-binding protein (250-259)
uucaaggugaacgacauccuggagcucuac

SEQ ID NO: 41526 - RNA, 27 nt, Artificial Sequence
  U2 small nuclear ribonucleoprotein auxiliary factor 35 kDa subunit-related protein 2 (256-264)
uucaaggugagcugcaaccuggagccc

SEQ ID NO: 41527 - RNA, 27 nt, Artificial Sequence
  Ubiquitin-conjugating enzyme E2 T (132-140)
uucaaguacaacaagcccgccuuccug

SEQ ID NO: 41528 - RNA, 27 nt, Artificial Sequence
  Bestrophin-3 (595-603)
uuccugggcagcucccacaccagccuc

SEQ ID NO: 41529 - RNA, 30 nt, Artificial Sequence
  Heparan-alpha-glucosaminide N-acetyltransferase (512-521)
uuccugggcgugcaggccgggaagauccuc

SEQ ID NO: 41530 - RNA, 27 nt, Artificial Sequence
  Acetyl-CoA carboxylase 1 (2174-2182)
uuccugauccccaucuaccaccaggug

SEQ ID NO: 41531 - RNA, 27 nt, Artificial Sequence
  Rho-associated protein kinase 1 (316-324)
uuccugaccgaccgcgaggugcggcuc

SEQ ID NO: 41532 - RNA, 27 nt, Artificial Sequence
  AP-2 complex subunit alpha-1 (812-820)
uuccugacccccccgcuccugagcgug

SEQ ID NO: 41533 - RNA, 30 nt, Artificial Sequence
  Bardet-Biedl syndrome 1 protein (409-418)
uuccuguacaacgaggcccucuacagccug

SEQ ID NO: 41534 - RNA, 27 nt, Artificial Sequence
  Adiponectin receptor protein 1 (163-171)
uucauggccccccugcaggagaaggug

SEQ ID NO: 41535 - RNA, 27 nt, Artificial Sequence
  Protein SGT1 homolog (332-340)
uucauggagagcggcgggaccgugcug

SEQ ID NO: 41536 - RNA, 27 nt, Artificial Sequence
  Cyclin-dependent kinase 13 (131-139)
uuccccaucaccgccauccgcgagauc

SEQ ID NO: 41537 - RNA, 27 nt, Artificial Sequence
  Actin-like protein 6A (99-107)
uuccaggccauccuggaccacaccuac

SEQ ID NO: 41538 - RNA, 30 nt, Artificial Sequence
  Nuclear pore complex protein Nup153 (1395-1404)
uuccaguucggcagcuccaccaccaacuuc

SEQ ID NO: 41539 - RNA, 27 nt, Artificial Sequence
  Choline-phosphate cytidylyltransferase B (242-250)
uuccagaaccagguggacaagaugaag

SEQ ID NO: 41540 - RNA, 27 nt, Artificial Sequence
  Fibrillin-3 (594-602)
uuccgcugccagugccugggcgggcuc

SEQ ID NO: 41541 - RNA, 27 nt, Artificial Sequence
  Polycystin-1 (3465-3473)
uucagcgccuccgacgaggaccugauc

SEQ ID NO: 41542 - RNA, 27 nt, Artificial Sequence
  Chromodomain-helicase-DNA-binding protein 4 (167-175)
uucagcgaggaggacuaccgcacccug

SEQ ID NO: 41543 - RNA, 27 nt, Artificial Sequence
  Integrin beta-7 (227-235)
uucagcuuccaccacgugcugucccuc

SEQ ID NO: 41544 - RNA, 30 nt, Artificial Sequence
  GPALPP motifs-containing protein 1 (331-340)
uucagccacggcaaggggaacauguuccug

SEQ ID NO: 41545 - RNA, 27 nt, Artificial Sequence
  Transcription intermediary factor 1-beta (125-133)
uucagcaaggacaucguggagaacuac

SEQ ID NO: 41546 - RNA, 27 nt, Artificial Sequence
  Meiosis arrest female protein 1 (1734-1742)
uucagccuggcccccaucaccaagcuc

SEQ ID NO: 41547 - RNA, 24 nt, Artificial Sequence
  Chromosome transmission fidelity protein 8 homolog isoform 2 (371-378)
uucagccaguccagcggcacccug

SEQ ID NO: 41548 - RNA, 27 nt, Artificial Sequence
  Protein PRRC2A (165-173)
uucagccgcgaggaguuccccacccug

SEQ ID NO: 41549 - RNA, 27 nt, Artificial Sequence
  V-type proton ATPase subunit D (79-87)
uucagcaccaccgugauccagaacguc

SEQ ID NO: 41550 - RNA, 24 nt, Artificial Sequence
  Nodal modulator 2 (329-336)
uucagcgugaccggccgcguccug

SEQ ID NO: 41551 - RNA, 27 nt, Artificial Sequence
  ETS domain-containing protein Elk-3 (331-339)
uucaccgcccagacccccaacggccug

SEQ ID NO: 41552 - RNA, 30 nt, Artificial Sequence
  ATP synthase subunit delta, mitochondrial (40-49)
uucaccuucgccagccccacccagguguuc

SEQ ID NO: 41553 - RNA, 33 nt, Artificial Sequence
  E3 SUMO-protein ligase RanBP2 (1132-1142)
uucaccuuccacggccccgggaagagcguguuc

SEQ ID NO: 41554 - RNA, 27 nt, Artificial Sequence
  Embigin (129-137)
uucaccaucaucaacagcaagcagaug

SEQ ID NO: 41555 - RNA, 27 nt, Artificial Sequence
  Protein transport protein Sec23B (392-400)
uucaccaaggacuucaacggcgacuuc

SEQ ID NO: 41556 - RNA, 27 nt, Artificial Sequence
  Protein TFG (363-371)
uucaccagccugcccggcuccaccaug

SEQ ID NO: 41557 - RNA, 27 nt, Artificial Sequence
  Nuclear factor of activated T-cells, cytoplasmic 2 (454-462)
uucaccuaccaccccgugccggccauc

SEQ ID NO: 41558 - RNA, 27 nt, Artificial Sequence
  Phosphomannomutase 2 (157-165)
uucguggccgaccugcgcaaggaguuc

SEQ ID NO: 41559 - RNA, 27 nt, Artificial Sequence
  V-type proton ATPase subunit G 1 (102-110)
uucgugugcgacauccgccccgagauc

SEQ ID NO: 41560 - RNA, 27 nt, Artificial Sequence
  T-box transcription factor TBX20 (45-53)
uucguggagaagagcuccugcgcccag

SEQ ID NO: 41561 - RNA, 27 nt, Artificial Sequence
  Dual specificity protein phosphatase 4 (364-372)
uucguguucagcuuccccgucuccgug

SEQ ID NO: 41562 - RNA, 27 nt, Artificial Sequence
  RNA-binding protein PNO1 (136-144)
uucgugaaggccuucauccugggcuuc

SEQ ID NO: 41563 - RNA, 27 nt, Artificial Sequence
  Serine/threonine-protein kinase mTOR (725-733)
uucgugaugcccuuccugcgcaagaug

SEQ ID NO: 41564 - RNA, 27 nt, Artificial Sequence
  60S ribosomal protein L36 (39-47)
uucgugcgcgacaugauccgggagguc

SEQ ID NO: 41565 - RNA, 27 nt, Artificial Sequence
  Melanoma-associated antigen C2 (265-273)
uucguguacggcgagccccgcgagcug

SEQ ID NO: 41566 - RNA, 27 nt, Artificial Sequence
  Beta-1,3-galactosyltransferase 5 (36-44)
uucguguacaagaaggacggcaacuuc

SEQ ID NO: 41567 - RNA, 27 nt, Artificial Sequence
  Olfactory receptor 12D2 (250-258)
uucuacgcccccgugcuguucaccuac

SEQ ID NO: 41568 - RNA, 27 nt, Artificial Sequence
  Laminin subunit alpha-5 (1849-1857)
uucuaccgcgacgugaagggccuguuc

SEQ ID NO: 41569 - RNA, 27 nt, Artificial Sequence
  Erythrocyte band 7 integral membrane protein (75-83)
ggcgccaaggggcccggccuguucuuc

SEQ ID NO: 41570 - RNA, 27 nt, Artificial Sequence
  Forkhead box protein O3 (542-550)
ggcgcccuggggggcagccgcgcccuc

SEQ ID NO: 41571 - RNA, 27 nt, Artificial Sequence
  Tumor necrosis factor receptor superfamily member 18 (5-13)
ggcgccaugggggccuuccgcgcgcug

SEQ ID NO: 41572 - RNA, 27 nt, Artificial Sequence
  Leukocyte elastase inhibitor (309-317)
ggcgcccgcgacaucuucaucagcaag

SEQ ID NO: 41573 - RNA, 27 nt, Artificial Sequence
  Solute carrier family 22 member 9 (444-452)
ggcgccagcgcccuggcgaacacccuc

SEQ ID NO: 41574 - RNA, 27 nt, Artificial Sequence
  Alpha-enolase (122-130)
ggcgccguggagaagggggucccccug

SEQ ID NO: 41575 - RNA, 27 nt, Artificial Sequence
  Importin subunit alpha-5 (169-177)
ggcgccgugcccaucuucaucgagcug

SEQ ID NO: 41576 - RNA, 27 nt, Artificial Sequence
  60S ribosomal protein L15 (2-10)
ggcgccuacaaguacauccaggagcug

SEQ ID NO: 41577 - RNA, 30 nt, Artificial Sequence
  Nuclease EXOG, mitochondrial (105-114)
ggcgacgccgaccgcaagcacugcaaguuc

SEQ ID NO: 41578 - RNA, 27 nt, Artificial Sequence
  Lariat debranching enzyme (502-510)
ggcgaggaccugaccaaggugccccuc

SEQ ID NO: 41579 - RNA, 24 nt, Artificial Sequence
  Leucine-rich repeat LGI family member 4 (2-9)
ggcggggccggcauccugcuccug

SEQ ID NO: 41580 - RNA, 27 nt, Artificial Sequence
  Anosmin-1 (412-420)
ggcgggauccagacccagcugcccuuc

SEQ ID NO: 41581 - RNA, 27 nt, Artificial Sequence
  Cold-inducible RNA-binding protein (133-141)
ggcggguacggcgggagccgcgacuac

SEQ ID NO: 41582 - RNA, 27 nt, Artificial Sequence
  Acetyl-CoA carboxylase 2 (352-360)
ggccacgccagcgagaaccccaagcug

SEQ ID NO: 41583 - RNA, 27 nt, Artificial Sequence
  Guanine nucleotide-binding protein subunit beta-5 (365-373)
ggccacgagaaccgcgugagcacccug

SEQ ID NO: 41584 - RNA, 33 nt, Artificial Sequence
  Rho guanine nucleotide exchange factor 2 (157-167)
ggccacuucaacgacgagagcccccuggggcuc

SEQ ID NO: 41585 - RNA, 27 nt, Artificial Sequence
  DNA polymerase delta catalytic subunit (784-792)
ggccacuuccccagcccgauccgccug

SEQ ID NO: 41586 - RNA, 27 nt, Artificial Sequence
  Factor VIII intron 22 protein (163-171)
ggccacuuccagcgcgccgcccagcug

SEQ ID NO: 41587 - RNA, 27 nt, Artificial Sequence
  Centrosomal protein of 152 kDa (1140-1148)
ggccaccacgcccagccccuggcccuc

SEQ ID NO: 41588 - RNA, 27 nt, Artificial Sequence
  Inosine-5'-monophosphate dehydrogenase 2 (371-379)
ggccacaucgccaaggcccuggcgcuc

SEQ ID NO: 41589 - RNA, 30 nt, Artificial Sequence
  Selenocysteine-specific elongation factor (14-23)
ggccacaucgacagcgggaagaccgcccug

SEQ ID NO: 41590 - RNA, 27 nt, Artificial Sequence
  Hairy/enhancer-of-split related with YRPW motif protein 1 (176-184)
ggccacauccccugggggaccguguuc

SEQ ID NO: 41591 - RNA, 36 nt, Artificial Sequence
  Transcription factor AP-1 (86-97)
ggccacaucaccaccacgcccaccccgacccaguuc

SEQ ID NO: 41592 - RNA, 27 nt, Artificial Sequence
  U5 small nuclear ribonucleoprotein 40 kDa protein (107-115)
ggccacagcggggccgugauggagcug

SEQ ID NO: 41593 - RNA, 27 nt, Artificial Sequence
  Scaffold attachment factor B1 (858-866)
ggccacagcgggcccggccacaugaug

SEQ ID NO: 41594 - RNA, 27 nt, Artificial Sequence
  Proteasome subunit beta type-4 (125-133)
ggccacagcuacuccccccgcgccauc

SEQ ID NO: 41595 - RNA, 33 nt, Artificial Sequence
  Inactive tyrosine-protein kinase transmembrane receptor ROR1 (927-937)
ggccacaccgagagcaugaucuccgccgagcug

SEQ ID NO: 41596 - RNA, 27 nt, Artificial Sequence
  Cytochrome b-c1 complex subunit 2, mitochondrial (445-453)
ggccacacccccuucguggacgagcug

SEQ ID NO: 41597 - RNA, 27 nt, Artificial Sequence
  Tetratricopeptide repeat protein 8 (471-479)
ggccacguggagcaggcccgcgcccug

SEQ ID NO: 41598 - RNA, 27 nt, Artificial Sequence
  Centromere protein M (155-163)
ggccacgugcccggggucagcgcccug

SEQ ID NO: 41599 - RNA, 27 nt, Artificial Sequence
  Inosine-5'-monophosphate dehydrogenase 1 (371-379)
ggccacguggucaaggcccuggcccuc

SEQ ID NO: 41600 - RNA, 27 nt, Artificial Sequence
  Ubiquitin carboxyl-terminal hydrolase 1 (592-600)
ggccacuacaccgccagcgugaagguc

SEQ ID NO: 41601 - RNA, 27 nt, Artificial Sequence
  Tubulin beta-4B chain (104-112)
ggccacuacaccgagggggccgagcug

SEQ ID NO: 41602 - RNA, 27 nt, Artificial Sequence
  Ubiquitin-like-conjugating enzyme ATG3 (118-126)
ggcaucaccgaggccgugaaggagauc

SEQ ID NO: 41603 - RNA, 27 nt, Artificial Sequence
  Phospholipid phosphatase 5 (2-10)
ggcaaggccgccgcggccguggccuuc

SEQ ID NO: 41604 - RNA, 30 nt, Artificial Sequence
  Sterol regulatory element-binding protein 2 (933-942)
ggcaaggccgacgggcagcagagcuccuuc

SEQ ID NO: 41605 - RNA, 27 nt, Artificial Sequence
  Zinc finger protein 623 (381-389)
ggcaaggccuucuuccugagcuccuac

SEQ ID NO: 41606 - RNA, 27 nt, Artificial Sequence
  Zinc finger protein 791 (278-286)
ggcaaggccuucaucuuccccagcuuc

SEQ ID NO: 41607 - RNA, 27 nt, Artificial Sequence
  Zinc finger protein with KRAB and SCAN domains 1 (495-503)
ggcaaggccuucaaccgcaacagcuac

SEQ ID NO: 41608 - RNA, 27 nt, Artificial Sequence
  Zinc finger protein 397 (375-383)
ggcaaggccuucagccaguccagcuac

SEQ ID NO: 41609 - RNA, 27 nt, Artificial Sequence
  Zinc finger protein 791 (362-370)
ggcaaggccuucagccgcaucuccuac

SEQ ID NO: 41610 - RNA, 30 nt, Artificial Sequence
  Zinc finger protein 460 (370-379)
ggcaaggccuucacccacuacagcaccuac

SEQ ID NO: 41611 - RNA, 27 nt, Artificial Sequence
  Coatomer subunit delta (13-21)
ggcaaggccaucgugagccgccaguuc

SEQ ID NO: 41612 - RNA, 27 nt, Artificial Sequence
  O-acetyl-ADP-ribose deacetylase MACROD1 (208-216)
ggcaaggccaagaucaccgggggcuac

SEQ ID NO: 41613 - RNA, 27 nt, Artificial Sequence
  2',3'-cyclic-nucleotide 3'-phosphodiesterase (260-268)
ggcaaggcccccggggccgaggaguac

SEQ ID NO: 41614 - RNA, 27 nt, Artificial Sequence
  Ig lambda chain V-II region BOH (43-51)
ggcaaggcccccaagcugaucaucuac

SEQ ID NO: 41615 - RNA, 27 nt, Artificial Sequence
  Ig kappa chain V-I region Walker (63-71)
ggcaaggcccccaagcugcucaucuac

SEQ ID NO: 41616 - RNA, 27 nt, Artificial Sequence
  Filamin-B (876-884)
ggcaaggccccccugaacgugcaguuc

SEQ ID NO: 41617 - RNA, 27 nt, Artificial Sequence
  SH2 domain-containing protein 3C (476-484)
ggcaaggccagccccuccccgagccug

SEQ ID NO: 41618 - RNA, 27 nt, Artificial Sequence
  Parafibromin (46-54)
ggcaaggaggggcagccccgcgaguac

SEQ ID NO: 41619 - RNA, 27 nt, Artificial Sequence
  40S ribosomal protein S11 (29-37)
ggcaaggagaagcugccccgcuacuac

SEQ ID NO: 41620 - RNA, 30 nt, Artificial Sequence
  Transmembrane emp24 domain-containing protein 10 (93-102)
ggcaaguucgccuucaccaccgaggacuac

SEQ ID NO: 41621 - RNA, 27 nt, Artificial Sequence
  ER membrane protein complex subunit 1 (28-36)
ggcaaguucgacuggcgccagcaguac

SEQ ID NO: 41622 - RNA, 27 nt, Artificial Sequence
  Nucleolar protein 56 (40-48)
ggcaaguuccacagcaucgugcgccug

SEQ ID NO: 41623 - RNA, 30 nt, Artificial Sequence
  Putative ATP-dependent RNA helicase DHX30 (1039-1048)
ggcaaguucaagcccaacagcgugaccuac

SEQ ID NO: 41624 - RNA, 30 nt, Artificial Sequence
  Kinesin light chain 1 (395-404)
ggcaaguucaagcaggccgagacccuguac

SEQ ID NO: 41625 - RNA, 30 nt, Artificial Sequence
  Transcription activator BRG1 (851-860)
ggcaaguucaacgugcugcucaccaccuac

SEQ ID NO: 41626 - RNA, 27 nt, Artificial Sequence
  60S ribosomal protein L10a (132-140)
ggcaaguuccccagccugcucacccac

SEQ ID NO: 41627 - RNA, 27 nt, Artificial Sequence
  Microtubule-associated protein RP/EB family member 1 (99-107)
ggcaaguuccaggacaacuucgaguuc

SEQ ID NO: 41628 - RNA, 36 nt, Artificial Sequence
  Glycogen phosphorylase, brain form (810-821)
ggcaaguucagcuccgaccgcaccaucaccgaguac

SEQ ID NO: 41629 - RNA, 27 nt, Artificial Sequence
  60S ribosome subunit biogenesis protein NIP7 homolog (71-79)
ggcaaguucaccaagacccacaaguuc

SEQ ID NO: 41630 - RNA, 33 nt, Artificial Sequence
  ATP-dependent RNA helicase DDX19B (186-196)
ggcaaguucuaccccgagcugaagcucgccuac

SEQ ID NO: 41631 - RNA, 27 nt, Artificial Sequence
  Serine/threonine-protein kinase pim-2 (39-47)
ggcaaggggggcuucgggaccguguuc

SEQ ID NO: 41632 - RNA, 27 nt, Artificial Sequence
  Tyrosine-protein kinase Fer (570-578)
ggcaaggggaacuucggcgagguguac

SEQ ID NO: 41633 - RNA, 27 nt, Artificial Sequence
  YTH domain-containing family protein 2 (451-459)
ggcaaggggcccguguaccugcucuuc

SEQ ID NO: 41634 - RNA, 30 nt, Artificial Sequence
  MYCBP-associated protein (359-368)
ggcaagggguggcccuucagcgccgugacc

SEQ ID NO: 41635 - RNA, 33 nt, Artificial Sequence
  60S ribosomal protein L36a (16-26)
ggcaagcaccagccccacaaggugacccaguac

SEQ ID NO: 41636 - RNA, 27 nt, Artificial Sequence
  SWI/SNF complex subunit SMARCC1 (93-101)
ggcaagcacgugaccaaccccgccuuc

SEQ ID NO: 41637 - RNA, 27 nt, Artificial Sequence
  DNA damage-binding protein 1 (59-67)
ggcaagaucgccgugauggagcuguuc

SEQ ID NO: 41638 - RNA, 30 nt, Artificial Sequence
  Acidic leucine-rich nuclear phosphoprotein 32 family member B (32-41)
ggcaagaucgaggggcugaccgccgaguuc

SEQ ID NO: 41639 - RNA, 27 nt, Artificial Sequence
  Endothelial differentiation-related factor 1 (122-130)
ggcaagaucgagcgcgccaucgggcug

SEQ ID NO: 41640 - RNA, 27 nt, Artificial Sequence
  Heterogeneous nuclear ribonucleoprotein A3 (150-158)
ggcaagaucgagaccaucgaggugaug

SEQ ID NO: 41641 - RNA, 27 nt, Artificial Sequence
  Peptidyl-prolyl cis-trans isomerase B (203-211)
ggcaagaucgagguggagaagcccuuc

SEQ ID NO: 41642 - RNA, 33 nt, Artificial Sequence
  Macrophage migration inhibitory factor (66-76)
ggcaagaucgggggcgcccagaaccgcagcuac

SEQ ID NO: 41643 - RNA, 27 nt, Artificial Sequence
  Phospholipase ABHD3 (231-239)
ggcaagaucgggagcaagaccccccug

SEQ ID NO: 41644 - RNA, 27 nt, Artificial Sequence
  D-dopachrome decarboxylase (109-117)
ggcaagaucgggaccgugaugaccuuc

SEQ ID NO: 41645 - RNA, 27 nt, Artificial Sequence
  Protein YIF1B (244-252)
ggcaagaucggguacuaccuggugcuc

SEQ ID NO: 41646 - RNA, 27 nt, Artificial Sequence
  Nucleolar GTP-binding protein 2 (54-62)
ggcaagaucaucaagccccugcaguac

SEQ ID NO: 41647 - RNA, 30 nt, Artificial Sequence
  Nucleolar protein 58 (195-204)
ggcaagaucaucagcgacaaccugaccuac

SEQ ID NO: 41648 - RNA, 27 nt, Artificial Sequence
  Nucleolar GTP-binding protein 2 (534-542)
ggcaagaucaacguggucccccaguuc

SEQ ID NO: 41649 - RNA, 27 nt, Artificial Sequence
  Protein YIPF5 (145-153)
ggcaagauccaguucggguacguguac

SEQ ID NO: 41650 - RNA, 30 nt, Artificial Sequence
  TBC1 domain family member 9 (117-126)
ggcaagauccaggggaucaucgccgaguac

SEQ ID NO: 41651 - RNA, 27 nt, Artificial Sequence
  Nucleolysin TIAR (121-129)
ggcaagaucagcgacgcccgcgugguc

SEQ ID NO: 41652 - RNA, 27 nt, Artificial Sequence
  Ras GTPase-activating protein 1 (354-362)
ggcaagaucagcaagcaggaggccuac

SEQ ID NO: 41653 - RNA, 24 nt, Artificial Sequence
  Solute carrier family 35 member E2B (319-326)
ggcaagaucagccccgugaccuuc

SEQ ID NO: 41654 - RNA, 27 nt, Artificial Sequence
  40S ribosomal protein S4, X isoform (167-175)
ggcaagaucaccgacuucaucaaguuc

SEQ ID NO: 41655 - RNA, 27 nt, Artificial Sequence
  Calcium channel flower homolog (141-149)
ggcaagaagggggacgccaucagcuac

SEQ ID NO: 41656 - RNA, 27 nt, Artificial Sequence
  Signal recognition particle receptor subunit beta (226-234)
ggcaagaaggggaaggaguucgaguuc

SEQ ID NO: 41657 - RNA, 27 nt, Artificial Sequence
  Sodium-coupled neutral amino acid transporter 2 (58-66)
ggcaagaagaaguacgagaccgaguuc

SEQ ID NO: 41658 - RNA, 27 nt, Artificial Sequence
  Barrier-to-autointegration factor (31-39)
ggcaagaagcuggaggagcgcggguuc

SEQ ID NO: 41659 - RNA, 27 nt, Artificial Sequence
  Amyloid protein-binding protein 2 (502-510)
ggcaagaagcuguucggggagggcuac

SEQ ID NO: 41660 - RNA, 27 nt, Artificial Sequence
  C-1-tetrahydrofolate synthase, cytoplasmic (332-340)
ggcaagcuggcccgcgagaucgggcuc

SEQ ID NO: 41661 - RNA, 27 nt, Artificial Sequence
  Sterol regulatory element-binding protein 2 (730-738)
ggcaagcugggguuccucgccagcuac

SEQ ID NO: 41662 - RNA, 30 nt, Artificial Sequence
  T-cell-specific surfaceoprotein CD28 (88-97)
ggcaagcuggggaacgagagcgugaccuuc

SEQ ID NO: 41663 - RNA, 33 nt, Artificial Sequence
  T-cell-specific surfaceoprotein CD28 (88-98)
ggcaagcuggggaacgagagcgugaccuucuac

SEQ ID NO: 41664 - RNA, 27 nt, Artificial Sequence
  Guanine nucleotide-binding protein G(I)/G(S)/G(T) subunit beta-1 (77-85)
ggcaagcugaucaucugggacagcuac

SEQ ID NO: 41665 - RNA, 24 nt, Artificial Sequence
  Sterile alpha motif domain-containing protein 9-like (1531-1538)
ggcaagcugaucagcguggaguac

SEQ ID NO: 41666 - RNA, 27 nt, Artificial Sequence
  RNA-binding protein FUS (331-339)
ggcaagcugaagggggaggccaccgug

SEQ ID NO: 41667 - RNA, 27 nt, Artificial Sequence
  Hydroxysteroid dehydrogenase-like protein 2 (382-390)
ggcaagcugaagcccaccauggccuuc

SEQ ID NO: 41668 - RNA, 27 nt, Artificial Sequence
  Endoplasmic reticulum-Golgi intermediate compartment protein 3 (5-13)
ggcaagcugaagcaguucgacgccuac

SEQ ID NO: 41669 - RNA, 27 nt, Artificial Sequence
  Tripartite motif-containing protein 26 (302-310)
ggcaagcugcuccgcgaccuggaguac

SEQ ID NO: 41670 - RNA, 30 nt, Artificial Sequence
  Protein PRRC2A (1913-1922)
ggcaagcugcccgccgggggcgugcucuac

SEQ ID NO: 41671 - RNA, 27 nt, Artificial Sequence
  RRP12-like protein (5-13)
ggcaagcugcccagcgggguguccgcc

SEQ ID NO: 41672 - RNA, 24 nt, Artificial Sequence
  Proteasome subunit alpha type-2 (17-24)
ggcaagcuggugcagaucgaguac

SEQ ID NO: 41673 - RNA, 27 nt, Artificial Sequence
  Pre-mRNA-processing-splicing factor 8 (1462-1470)
ggcaagcuguggaaccucaacaacuac

SEQ ID NO: 41674 - RNA, 27 nt, Artificial Sequence
  Non-specific lipid-transfer protein (510-518)
ggcaagaugaacccccagagcgccuuc

SEQ ID NO: 41675 - RNA, 27 nt, Artificial Sequence
  Vitamin D 25-hydroxylase (287-295)
ggcaagaacgaccccagcuccaccuuc

SEQ ID NO: 41676 - RNA, 27 nt, Artificial Sequence
  FACT complex subunit SSRP1 (142-150)
ggcaagaacgaggugacccuggaguuc

SEQ ID NO: 41677 - RNA, 27 nt, Artificial Sequence
  Protein disulfide-isomerase A2 (395-403)
ggcaagaacuucgagcagguggccuuc

SEQ ID NO: 41678 - RNA, 27 nt, Artificial Sequence
  Embigin (163-171)
ggcaagaacaagccccugaucagcuac

SEQ ID NO: 41679 - RNA, 27 nt, Artificial Sequence
  Pre-mRNA-splicing factor SLU7 (301-309)
ggcaagaaccccgacgaggugagcuac

SEQ ID NO: 41680 - RNA, 30 nt, Artificial Sequence
  Cell cycle control protein 50A (320-329)
ggcaagaaccccuuccuggggaucgccuac

SEQ ID NO: 41681 - RNA, 27 nt, Artificial Sequence
  WD repeat-containing protein 75 (353-361)
ggcaagcccgggcaccugcaguucuac

SEQ ID NO: 41682 - RNA, 30 nt, Artificial Sequence
  Aurora kinase A (325-334)
ggcaagcccccguucgaggccaacaccuac

SEQ ID NO: 41683 - RNA, 27 nt, Artificial Sequence
  Filamin-B (863-871)
ggcaagcccacccacuucaccguguac

SEQ ID NO: 41684 - RNA, 27 nt, Artificial Sequence
  Dual specificity protein phosphatase 5 (162-170)
ggcaagcccguggucaacgugagcuac

SEQ ID NO: 41685 - RNA, 27 nt, Artificial Sequence
  Actin-like protein 6A (61-69)
ggcaagcaggggggccccaccuacuac

SEQ ID NO: 41686 - RNA, 30 nt, Artificial Sequence
  F-box only protein 21 (396-405)
ggcaagcgcgaggggaucgaccagagcuac

SEQ ID NO: 41687 - RNA, 27 nt, Artificial Sequence
  Probable ATP-dependent RNA helicase DDX5 (500-508)
ggcaagcgcgggggcuucaacaccuuc

SEQ ID NO: 41688 - RNA, 27 nt, Artificial Sequence
  Hydroxymethylglutaryl-CoA synthase, cytoplasmic (367-375)
ggcaagcgcaucgggguguucagcuac

SEQ ID NO: 41689 - RNA, 27 nt, Artificial Sequence
  Protein S100-A4 (47-55)
ggcaagcgcaccgacgaggccgccuuc

SEQ ID NO: 41690 - RNA, 27 nt, Artificial Sequence
  Cell cycle progression protein 1 (410-418)
ggcaagagcgacucccccaacguguac

SEQ ID NO: 41691 - RNA, 27 nt, Artificial Sequence
  C-myc promoter-binding protein (1422-1430)
ggcaagagcgaggugaccuccagcuuc

SEQ ID NO: 41692 - RNA, 27 nt, Artificial Sequence
  Zinc finger protein 213 (379-387)
ggcaagagcuucucccgcagcgccuac

SEQ ID NO: 41693 - RNA, 27 nt, Artificial Sequence
  Zinc finger protein 557 (403-411)
ggcaagagcuucaccuccaacagcuac

SEQ ID NO: 41694 - RNA, 27 nt, Artificial Sequence
  Nuclear receptor corepressor 1 (1214-1222)
ggcaagagcgggcacauccuguccuac

SEQ ID NO: 41695 - RNA, 33 nt, Artificial Sequence
  Polyadenylate-binding protein 1 (228-238)
ggcaagagcaagggguucggcuucguguccuuc

SEQ ID NO: 41696 - RNA, 27 nt, Artificial Sequence
  Constitutive coactivator of PPAR-gamma-like protein 1 (209-217)
ggcaagagccugaccaccucccaguac

SEQ ID NO: 41697 - RNA, 30 nt, Artificial Sequence
  Heterogeneous nuclear ribonucleoprotein U (185-194)
ggcaagagcuccgggcccaccagccuguuc

SEQ ID NO: 41698 - RNA, 33 nt, Artificial Sequence
  Elongation factor 1-alpha 1 (19-29)
ggcaagagcaccaccacggggcaccugaucuac

SEQ ID NO: 41699 - RNA, 27 nt, Artificial Sequence
  Zinc finger protein 845 (333-341)
ggcaagaccuucagccagaccuccuac

SEQ ID NO: 41700 - RNA, 30 nt, Artificial Sequence
  Sodium-coupled neutral amino acid transporter 5 (46-55)
ggcaagaccagcuucgggauguccguguuc

SEQ ID NO: 41701 - RNA, 27 nt, Artificial Sequence
  Ras-related protein Rab-6A (25-33)
ggcaagaccagccugaucacccgcuuc

SEQ ID NO: 41702 - RNA, 27 nt, Artificial Sequence
  ATP-dependent RNA helicase DHX8 (593-601)
ggcaagaccacccagaucacgcaguac

SEQ ID NO: 41703 - RNA, 27 nt, Artificial Sequence
  Pre-mRNA-splicing factor ATP-dependent RNA helicase PRP16 (560-568)
ggcaagaccacccagcugacgcaguac

SEQ ID NO: 41704 - RNA, 27 nt, Artificial Sequence
  ATP-dependent RNA helicase DHX36 (235-243)
ggcaagaccacccaggugacgcaguuc

SEQ ID NO: 41705 - RNA, 27 nt, Artificial Sequence
  Adenosylhomocysteinase (213-221)
ggcaagguggccgucguggccggguac

SEQ ID NO: 41706 - RNA, 27 nt, Artificial Sequence
  Major facilitator superfamily domain-containing protein 1 (287-295)
ggcaagguguucuucaccgagaaguuc

SEQ ID NO: 41707 - RNA, 27 nt, Artificial Sequence
  Zinc finger protein 264 (349-357)
ggcaagguguucaagcaccgcagcuac

SEQ ID NO: 41708 - RNA, 27 nt, Artificial Sequence
  DNA polymerase delta catalytic subunit (997-1005)
ggcaagguggggggccugcucgccuuc

SEQ ID NO: 41709 - RNA, 33 nt, Artificial Sequence
  Estradiol 17-beta-dehydrogenase 8 (159-169)
ggcaagguggggaacgucggccagaccaacuac

SEQ ID NO: 41710 - RNA, 30 nt, Artificial Sequence
  WD repeat domain phosphoinositide-interacting protein 4 (281-290)
ggcaagguggggcccaugaucggccaguac

SEQ ID NO: 41711 - RNA, 27 nt, Artificial Sequence
  Dual specificity protein phosphatase 16 (647-655)
ggcaagguggggagccaguccagcuuc

SEQ ID NO: 41712 - RNA, 27 nt, Artificial Sequence
  Protein lin-7 homolog C (165-173)
ggcaaggugaagcuggucgugcgcuac

SEQ ID NO: 41713 - RNA, 27 nt, Artificial Sequence
  Apoptosis-associated speck-like protein containing a CARD (138-146)
ggcaaggugcugaccgacgagcaguac

SEQ ID NO: 41714 - RNA, 27 nt, Artificial Sequence
  E3 ubiquitin-protein ligase synoviolin (58-66)
ggcaaggugauggggaaggucuucuuc

SEQ ID NO: 41715 - RNA, 27 nt, Artificial Sequence
  Poly (ADP-ribose) polymerase 1 (46-54)
ggcaaggugccccacugguaccacuuc

SEQ ID NO: 41716 - RNA, 27 nt, Artificial Sequence
  DNA-directed RNA polymerase II subunit RPB1 (572-580)
ggcaaggugccccagccggccauccug

SEQ ID NO: 41717 - RNA, 27 nt, Artificial Sequence
  Nucleolar complex protein 2 homolog (575-583)
ggcaaggugcaggagaacagcgccuac

SEQ ID NO: 41718 - RNA, 33 nt, Artificial Sequence
  Major vault protein (396-406)
ggcaaggugcgcgccgucaucgggagcaccuac

SEQ ID NO: 41719 - RNA, 27 nt, Artificial Sequence
  40S ribosomal protein S4, X isoform (74-82)
ggcaaggugcgcaccgacaucaccuac

SEQ ID NO: 41720 - RNA, 27 nt, Artificial Sequence
  40S ribosomal protein S4, Y isoform 1 (74-82)
ggcaaggugcgcgucgacgugaccuac

SEQ ID NO: 41721 - RNA, 27 nt, Artificial Sequence
  ATP-dependent RNA helicase DHX8 (270-278)
ggcaaggugaccagcaucaugcaguuc

SEQ ID NO: 41722 - RNA, 27 nt, Artificial Sequence
  G2/mitotic-specific cyclin-B2 (323-331)
ggcaaguggaaccugaagcagcaguac

SEQ ID NO: 41723 - RNA, 27 nt, Artificial Sequence
  Transcription initiation factor IIE subunit beta (135-143)
ggcaaguacgccuucaagcccaaguac

SEQ ID NO: 41724 - RNA, 27 nt, Artificial Sequence
  Interferon-induced protein 44 (72-80)
ggcaaguacgccagcaucauccuguuc

SEQ ID NO: 41725 - RNA, 27 nt, Artificial Sequence
  WD repeat-containing protein 44 (704-712)
ggcaaguacgccgugaucgggaccuac

SEQ ID NO: 41726 - RNA, 27 nt, Artificial Sequence
  Kinesin light chain 1 (353-361)
ggcaaguacgaggagguggaguacuac

SEQ ID NO: 41727 - RNA, 27 nt, Artificial Sequence
  Transketolase (139-147)
ggcaaguacuucgacaaggccagcuac

SEQ ID NO: 41728 - RNA, 27 nt, Artificial Sequence
  Golgi pH regulator A (283-291)
ggcaaguacuucaacuuccugggguac

SEQ ID NO: 41729 - RNA, 33 nt, Artificial Sequence
  Ethanolamine kinase 1 (257-267)
ggcaaguacuucagccugauccccaccggguuc

SEQ ID NO: 41730 - RNA, 36 nt, Artificial Sequence
  Solute carrier family 35 member B1 (38-49)
ggcaaguacggggagggcgccaagcaggagaccuuc

SEQ ID NO: 41731 - RNA, 33 nt, Artificial Sequence
  Phosphatidylinositol 3-kinase regulatory subunit alpha (388-398)
ggcaaguacggguucagcgacccccugaccuuc

SEQ ID NO: 41732 - RNA, 27 nt, Artificial Sequence
  DNA-directed RNA polymerase II subunit RPB7 (40-48)
ggcaaguacggguucgugaucgccguc

SEQ ID NO: 41733 - RNA, 27 nt, Artificial Sequence
  Neutral amino acid transporter A (295-303)
ggcaaguacaucuucgccagcauccug

SEQ ID NO: 41734 - RNA, 27 nt, Artificial Sequence
  ER membrane protein complex subunit 3 (65-73)
ggcaaguacauccccaagcagagcuuc

SEQ ID NO: 41735 - RNA, 30 nt, Artificial Sequence
  Protein phosphatase 1K, mitochondrial (350-359)
ggcaaguacaagaacagcgagaucaacuuc

SEQ ID NO: 41736 - RNA, 30 nt, Artificial Sequence
  Peptidyl-prolyl cis-trans isomerase FKBP4 (284-293)
ggcaaguacaagcaggcccugcuccaguac

SEQ ID NO: 41737 - RNA, 27 nt, Artificial Sequence
  Protein transport protein Sec31A (487-495)
ggcaaguaccuggagcuccugggguac

SEQ ID NO: 41738 - RNA, 27 nt, Artificial Sequence
  Catalase (272-280)
ggcaaguaccccagcuggaccuucuac

SEQ ID NO: 41739 - RNA, 27 nt, Artificial Sequence
  Transmembrane protein 222 (176-184)
ggcaaguacgugagcgucggggccuuc

SEQ ID NO: 41740 - RNA, 27 nt, Artificial Sequence
  5'-nucleotidase domain-containing protein 1 (122-130)
ggcaaguacuacuucuacgacaacuac

SEQ ID NO: 41741 - RNA, 24 nt, Artificial Sequence
  Plasmalemma vesicle-associated protein (2-9)
ggccuggccauggagcacgggggc

SEQ ID NO: 41742 - RNA, 27 nt, Artificial Sequence
  DC-STAMP domain-containing protein 2 (243-251)
ggccuggccagccucgugcaggucuuc

SEQ ID NO: 41743 - RNA, 24 nt, Artificial Sequence
  Protein sel-1 homolog 3 (550-557)
ggccugcaccagaucagcuccauc

SEQ ID NO: 41744 - RNA, 27 nt, Artificial Sequence
  40S ribosomal protein S3a (61-69)
ggccugaaggggcgcguguucgagguc

SEQ ID NO: 41745 - RNA, 27 nt, Artificial Sequence
  Integrin beta-7 (317-325)
ggccuguacagccgcuccaccgaguuc

SEQ ID NO: 41746 - RNA, 33 nt, Artificial Sequence
  Solute carrier family 25 member 46 (162-172)
ggcauggggagcaccuucaucgugcagggcguc

SEQ ID NO: 41747 - RNA, 27 nt, Artificial Sequence
  DNA damage-binding protein 1 (56-64)
ggcauguacgggaagaucgccgugaug

SEQ ID NO: 41748 - RNA, 27 nt, Artificial Sequence
  60S ribosomal protein L8 (131-139)
ggcaacuacgccaccgugaucagccac

SEQ ID NO: 41749 - RNA, 27 nt, Artificial Sequence
  Huntingtin (77-85)
ggccccgccguggccgaggagccgcug

SEQ ID NO: 41750 - RNA, 27 nt, Artificial Sequence
  Salivary acidic proline-rich phosphoprotein 1/2 (83-91)
ggccccccgcccccccaggggaagccc

SEQ ID NO: 41751 - RNA, 33 nt, Artificial Sequence
  Basic salivary proline-rich protein 2 (59-69)
ggccccccgccccaggggggcaaccagccccag

SEQ ID NO: 41752 - RNA, 33 nt, Artificial Sequence
  Basic salivary proline-rich protein 4 (248-258)
ggccccccgcagcaggaggggaacaagccccag

SEQ ID NO: 41753 - RNA, 33 nt, Artificial Sequence
  Basic salivary proline-rich protein 2 (368-378)
ggccccccgcagcaggaggggaacaacccccag

SEQ ID NO: 41754 - RNA, 27 nt, Artificial Sequence
  Ig kappa chain V-I region WAT (41-49)
ggccaggcccccaaggugcugaucuac

SEQ ID NO: 41755 - RNA, 30 nt, Artificial Sequence
  Thioredoxin domain-containing protein 5 (57-66)
ggccaggacccccacagcaagcaccuguac

SEQ ID NO: 41756 - RNA, 27 nt, Artificial Sequence
  Protein FAM179B (288-296)
ggccaggaccgcuuccagagcuacauc

SEQ ID NO: 41757 - RNA, 27 nt, Artificial Sequence
  Nucleosome-remodeling factor subunit BPTF (843-851)
ggccaggaggggaaguaccgcguguac

SEQ ID NO: 41758 - RNA, 27 nt, Artificial Sequence
  Rho GTPase-activating protein 1 (183-191)
ggccagaagaucuucuacgugaacuac

SEQ ID NO: 41759 - RNA, 27 nt, Artificial Sequence
  Endoplasmic reticulum lectin 1 (141-149)
ggccagaagaucaacauccacgaguac

SEQ ID NO: 41760 - RNA, 27 nt, Artificial Sequence
  Chromodomain-helicase-DNA-binding protein 2 (905-913)
ggccagaagaagcaggugaacaucuac

SEQ ID NO: 41761 - RNA, 27 nt, Artificial Sequence
  Immunoglobulin superfamily member 10 (2429-2437)
ggccagaagcccgugauccugaccuac

SEQ ID NO: 41762 - RNA, 27 nt, Artificial Sequence
  Fibronectin (679-687)
ggccagcugaucagcauccagcaguac

SEQ ID NO: 41763 - RNA, 27 nt, Artificial Sequence
  Lysine-specific demethylase 4B (78-86)
ggccagagcgggcuguucacccaguac

SEQ ID NO: 41764 - RNA, 27 nt, Artificial Sequence
  FERM domain-containing protein 3 (200-208)
ggccagagccccccgguggccgaguuc

SEQ ID NO: 41765 - RNA, 27 nt, Artificial Sequence
  RNA-binding protein EWS (62-70)
ggccagaccgccuacgccaccagcuac

SEQ ID NO: 41766 - RNA, 24 nt, Artificial Sequence
  Guanine nucleotide-binding protein subunit beta-2-like 1 (295-302)
ggccagacccuguucgccggguac

SEQ ID NO: 41767 - RNA, 27 nt, Artificial Sequence
  Protein ELYS (807-815)
ggccaggugaagcugauccagggguuc

SEQ ID NO: 41768 - RNA, 27 nt, Artificial Sequence
  Zinc finger protein 507 (577-585)
ggccaggugaagaccgggaucagcaug

SEQ ID NO: 41769 - RNA, 30 nt, Artificial Sequence
  Probable ATP-dependent RNA helicase DDX17 (631-640)
ggccaguacaccuacgggcagggcaccuac

SEQ ID NO: 41770 - RNA, 27 nt, Artificial Sequence
  LanC-like protein 1 (154-162)
ggccgcaucggguacaucuacgcccug

SEQ ID NO: 41771 - RNA, 27 nt, Artificial Sequence
  Gamma-interferon-inducible protein 16 (464-472)
ggcagccacuuccccgggccguucaug

SEQ ID NO: 41772 - RNA, 27 nt, Artificial Sequence
  NADH dehydrogenase (ubiquinone) 1 alpha subcomplex subunit 8 (164-172)
ggcagccgcuucuacuucuggaccaag

SEQ ID NO: 41773 - RNA, 27 nt, Artificial Sequence
  Proteasome subunit beta type-4 (73-81)
ggcagcuacgggucccuggcccgcuuc

SEQ ID NO: 41774 - RNA, 30 nt, Artificial Sequence
  Egl nine homolog 2 (272-281)
ggcagcuacgugaucaacgggcgcaccaag

SEQ ID NO: 41775 - RNA, 27 nt, Artificial Sequence
  Olfactory receptor 8I2 (193-201)
ggcaccgagauggugagcuucguccug

SEQ ID NO: 41776 - RNA, 27 nt, Artificial Sequence
  Dual adapter for phosphotyrosine and 3-phosphotyrosine and 3-phosphoinositide (165-173)
ggcaccaaggagggguaccugaccaag

SEQ ID NO: 41777 - RNA, 27 nt, Artificial Sequence
  Large proline-rich protein BAG6 (391-399)
ggcacccgccccccgcccacccccaac

SEQ ID NO: 41778 - RNA, 27 nt, Artificial Sequence
  Splicing factor 3A subunit 2 (300-308)
ggcgugcaccccccggcccccgggguc

SEQ ID NO: 41779 - RNA, 27 nt, Artificial Sequence
  Centrosomal protein of 76 kDa (224-232)
ggcgugaccagccugaccgucgagcuc

SEQ ID NO: 41780 - RNA, 27 nt, Artificial Sequence
  Programmed cell death 6-interacting protein (279-287)
cacgccgccgagcugaucaagaccgug

SEQ ID NO: 41781 - RNA, 27 nt, Artificial Sequence
  UDP-glucose:glycoprotein glucosyltransferase 1 (566-574)
cacgccuuccagacccugacccacauc

SEQ ID NO: 41782 - RNA, 27 nt, Artificial Sequence
  Methionine synthase (601-609)
cacgccaucaagagcggcauggacaug

SEQ ID NO: 41783 - RNA, 27 nt, Artificial Sequence
  KH domain-containing, RNA-binding, signal transduction-associated protein 1 (246-254)
cacgccauggaggaggugaagaaguuc

SEQ ID NO: 41784 - RNA, 27 nt, Artificial Sequence
  Dynein heavy chain 6, axonemal (1387-1395)
cacgcccgcgacaucgugaccgagcug

SEQ ID NO: 41785 - RNA, 24 nt, Artificial Sequence
  Putative sodium-coupled neutral amino acid transporter 10 (698-705)
cacgccgugcugcuccaggucauc

SEQ ID NO: 41786 - RNA, 33 nt, Artificial Sequence
  HLA class I histocompatibility antigen, A-30 alpha chain (140-150)
cacgccuacgacggcaaggacuacaucgcccug

SEQ ID NO: 41787 - RNA, 24 nt, Artificial Sequence
  Tryptophan 2,3-dioxygenase (67-74)
cacgacgagcaccuguucaucauc

SEQ ID NO: 41788 - RNA, 24 nt, Artificial Sequence
  G1/S-specific cyclin-D2 (157-164)
cacgacuucaucgagcacauccug

SEQ ID NO: 41789 - RNA, 27 nt, Artificial Sequence
  Splicing factor, proline- and glutamine-rich (29-37)
cacgacuuccgcagccccccgcccggc

SEQ ID NO: 41790 - RNA, 27 nt, Artificial Sequence
  MKL/myocardin-like protein 1 (831-839)
cacgacggccccgagccgcugagccuc

SEQ ID NO: 41791 - RNA, 27 nt, Artificial Sequence
  Rho guanine nucleotide exchange factor 5 (1170-1178)
cacgaggaccagaagcugcaggaggug

SEQ ID NO: 41792 - RNA, 33 nt, Artificial Sequence
  Dedicator of cytokinesis protein 9 (933-943)
cacgaggagcugaccaagagcaugaccacgauc

SEQ ID NO: 41793 - RNA, 27 nt, Artificial Sequence
  Protein phosphatase 2C-like domain-containing protein 1 (71-79)
cacgagaucgaccugaccggcaucuuc

SEQ ID NO: 41794 - RNA, 30 nt, Artificial Sequence
  Histatin-3 (34-43)
cacgagaagcaccacagccaccgcggcuac

SEQ ID NO: 41795 - RNA, 27 nt, Artificial Sequence
  Protocadherin-9 (1071-1079)
cacgagcccgugggcagcgggacccug

SEQ ID NO: 41796 - RNA, 27 nt, Artificial Sequence
  60S ribosomal protein L36a-like (90-98)
cacuucgagcugggcggggacaagaag

SEQ ID NO: 41797 - RNA, 33 nt, Artificial Sequence
  Cancer/testis antigen 47A (120-130)
cacuucgugcugcucgacaugguccacagccug

SEQ ID NO: 41798 - RNA, 30 nt, Artificial Sequence
  Neuroblast differentiation-associated protein AHNAK (5535-5544)
cacggcgccgcccccgacaucagcgugaag

SEQ ID NO: 41799 - RNA, 24 nt, Artificial Sequence
  Centrosomal protein of 97 kDa (154-161)
cacggcaacaucaucaccagccug

SEQ ID NO: 41800 - RNA, 27 nt, Artificial Sequence
  Ubiquitin carboxyl-terminal hydrolase 19 (562-570)
caccacgccuuccagcccagcaagcug

SEQ ID NO: 41801 - RNA, 24 nt, Artificial Sequence
  E3 SUMO-protein ligase CBX4 (399-406)
caccacgccgugggccugaaccuc

SEQ ID NO: 41802 - RNA, 30 nt, Artificial Sequence
  Thyroid hormone receptor-associated protein 3 (641-650)
caccacuucggcagcuccgggaugacccug

SEQ ID NO: 41803 - RNA, 27 nt, Artificial Sequence
  Beta-galactoside alpha-2,6-sialyltransferase 2 (354-362)
caccacuucaucgacagcucccuguac

SEQ ID NO: 41804 - RNA, 27 nt, Artificial Sequence
  Protein virilizer homolog (679-687)
caccacuuccuggagcucgugacccug

SEQ ID NO: 41805 - RNA, 24 nt, Artificial Sequence
  L-aminoadipate-semialdehyde dehydrogenase-phosphopantetheinyl transferase (238-245)
caccacuucguggccgucgcccug

SEQ ID NO: 41806 - RNA, 27 nt, Artificial Sequence
  PCNA-interacting partner (385-393)
caccacggcaccagcauccugacccuc

SEQ ID NO: 41807 - RNA, 27 nt, Artificial Sequence
  E3 SUMO-protein ligase CBX4 (398-406)
caccaccacgccgugggccugaaccuc

SEQ ID NO: 41808 - RNA, 27 nt, Artificial Sequence
  Transcriptional repressor protein YY1 (76-84)
caccaccaccaccaccccccgaugauc

SEQ ID NO: 41809 - RNA, 30 nt, Artificial Sequence
  Histone deacetylase complex subunit SAP130 (202-211)
caccacaucaugaccaccaacgugcagaug

SEQ ID NO: 41810 - RNA, 30 nt, Artificial Sequence
  Vacuolar protein sorting-associated protein 11 homolog (554-563)
caccacauccccgagcagaccacccagcug

SEQ ID NO: 41811 - RNA, 24 nt, Artificial Sequence
  Drebrin-like protein (362-369)
caccacauccagggccaggggcug

SEQ ID NO: 41812 - RNA, 27 nt, Artificial Sequence
  Protein PRRC2B (1834-1842)
caccacauccagcgcgccaucggccug

SEQ ID NO: 41813 - RNA, 27 nt, Artificial Sequence
  Fructose-bisphosphate aldolase A (220-228)
caccacaucuaccuggagggcacccuc

SEQ ID NO: 41814 - RNA, 27 nt, Artificial Sequence
  Queuine tRNA-ribosyltransferase subunit QTRTD1 (365-373)
caccaccugcucgugaccaacgagcug

SEQ ID NO: 41815 - RNA, 27 nt, Artificial Sequence
  MMS19 nucleotide excision repair protein homolog (102-110)
caccaccuggugauccccagcguccuc

SEQ ID NO: 41816 - RNA, 27 nt, Artificial Sequence
  Transcription factor ETV6 (170-178)
caccacaaccccccgaccaucgagcug

SEQ ID NO: 41817 - RNA, 27 nt, Artificial Sequence
  Eukaryotic translation initiation factor 2-alpha kinase 1 (119-127)
caccacaaccgcgccaucacccaccug

SEQ ID NO: 41818 - RNA, 27 nt, Artificial Sequence
  Fas apoptotic inhibitory molecule 3 (176-184)
caccacagcucccccaccacccagauc

SEQ ID NO: 41819 - RNA, 27 nt, Artificial Sequence
  Gamma-glutamyltranspeptidase 1 (532-540)
caccacacccagaucgccagcaccuuc

SEQ ID NO: 41820 - RNA, 27 nt, Artificial Sequence
  Zinc transporter 6 (356-364)
caccacgugauccccaugccgcugcuc

SEQ ID NO: 41821 - RNA, 33 nt, Artificial Sequence
  GLTSCR1-like protein (415-425)
caccacgugcagaccaucaacggccagcugcuc

SEQ ID NO: 41822 - RNA, 27 nt, Artificial Sequence
  Nucleolar RNA helicase 2 (218-226)
caccacguguacagcggcaaggaccug

SEQ ID NO: 41823 - RNA, 27 nt, Artificial Sequence
  GMP synthase (glutamine-hydrolyzing) (22-30)
caccacuacgagggcgccguggucauc

SEQ ID NO: 41824 - RNA, 30 nt, Artificial Sequence
  GMP synthase (glutamine-hydrolyzing) (22-31)
caccacuacgagggcgccguggucauccug

SEQ ID NO: 41825 - RNA, 27 nt, Artificial Sequence
  Membralin (447-455)
caccacuacgagcugcccgccauccuc

SEQ ID NO: 41826 - RNA, 30 nt, Artificial Sequence
  G/T mismatch-specific thymine DNAosylase (150-159)
caccacuaccccggcccggggaaccacuuc

SEQ ID NO: 41827 - RNA, 27 nt, Artificial Sequence
  Suppression of tumorigenicity 18 protein (571-579)
cacaucgccgccgcggccgccauccug

SEQ ID NO: 41828 - RNA, 27 nt, Artificial Sequence
  Cytochrome b-c1 complex subunit 9 (55-63)
cacaucaagcacaaguacgagaacaag

SEQ ID NO: 41829 - RNA, 27 nt, Artificial Sequence
  Phosphofurin acidic cluster sorting protein 1 (734-742)
cacaaguuccccgacgaggacagcuac

SEQ ID NO: 41830 - RNA, 27 nt, Artificial Sequence
  Heterogeneous nuclear ribonucleoproteins C1/C2 (49-57)
cacaagggcuucgccuucgugcaguac

SEQ ID NO: 41831 - RNA, 27 nt, Artificial Sequence
  60S ribosomal protein L31 (30-38)
cacaagcgcauccacggcgugggguuc

SEQ ID NO: 41832 - RNA, 27 nt, Artificial Sequence
  Mitotic checkpoint serine/threonine-protein kinase BUB1 (430-438)
cacaagguggccaacaccagcuccuuc

SEQ ID NO: 41833 - RNA, 30 nt, Artificial Sequence
  JmjC domain-containing protein 8 (176-185)
cacaagguggaccugcccuuccaggaguac

SEQ ID NO: 41834 - RNA, 30 nt, Artificial Sequence
  40S ribosomal protein S7 (168-177)
cacaagguggagaccuucagcggcgucuac

SEQ ID NO: 41835 - RNA, 30 nt, Artificial Sequence
  Histone-lysine N-methyltransferase SETD2 (1284-1293)
cacaaguaccagcagaacgccgagcaguac

SEQ ID NO: 41836 - RNA, 33 nt, Artificial Sequence
  Protein S100-A4 (17-27)
cacaaguacagcggcaaggagggggacaaguuc

SEQ ID NO: 41837 - RNA, 27 nt, Artificial Sequence
  Calpain-12 (697-705)
caccuggacggcggggagggcgugauc

SEQ ID NO: 41838 - RNA, 36 nt, Artificial Sequence
  Tyrosine-protein kinase BAZ1B (365-376)
caccuggaggagaugaugaagaugaugagccccaac

SEQ ID NO: 41839 - RNA, 33 nt, Artificial Sequence
  Catalase (466-476)
caccugaaggacgcccagaucuucauccagaag

SEQ ID NO: 41840 - RNA, 27 nt, Artificial Sequence
  Neuropeptide FF receptor 1 (270-278)
cacaugcuggugauggucgcccucuuc

SEQ ID NO: 41841 - RNA, 30 nt, Artificial Sequence
  AP-1 complex subunit gamma-like 2 (576-585)
cacaugcgcgccgccauccuggagaagaug

SEQ ID NO: 41842 - RNA, 27 nt, Artificial Sequence
  Uncharacterized protein C2orf16 (1260-1268)
cacaaccugcccgagagcgacuccgag

SEQ ID NO: 41843 - RNA, 27 nt, Artificial Sequence
  E3 ubiquitin-protein ligase CBL (213-221)
caccccaucagcuccggccuggaggcc

SEQ ID NO: 41844 - RNA, 27 nt, Artificial Sequence
  Ubiquitin-conjugating enzyme E2 variant 3 (119-127)
caccccaagagcgugaucgucggccug

SEQ ID NO: 41845 - RNA, 30 nt, Artificial Sequence
  Microtubule-associated protein 4 (1128-1137)
caccccacccugagcggcgggggcgaccag

SEQ ID NO: 41846 - RNA, 27 nt, Artificial Sequence
  Ataxin-2-like protein (896-904)
caccaggccggccaggccccccaccug

SEQ ID NO: 41847 - RNA, 27 nt, Artificial Sequence
  Programmed cell death protein 10 (162-170)
caccagaagaaggaguucgugaaguac

SEQ ID NO: 41848 - RNA, 30 nt, Artificial Sequence
  Transcription activator BRG1 (178-187)
caccagcugcgcgcccagaucauggccuac

SEQ ID NO: 41849 - RNA, 27 nt, Artificial Sequence
  RNA polymerase-associated protein CTR9 homolog (714-722)
caccagaacaccgaggugguccuguac

SEQ ID NO: 41850 - RNA, 30 nt, Artificial Sequence
  Ubiquitin-conjugating enzyme E2 J1 (238-247)
caccagcccacccagccgguggccaagaac

SEQ ID NO: 41851 - RNA, 33 nt, Artificial Sequence
  40S ribosomal protein S29 (3-13)
caccagcagcuguacuggagccacccccgcaag

SEQ ID NO: 41852 - RNA, 36 nt, Artificial Sequence
  MORC family CW-type zinc finger protein 3 (528-539)
caccaggugcccccgcagagcgagcccgaguccaac

SEQ ID NO: 41853 - RNA, 27 nt, Artificial Sequence
  TBC1 domain family member 2B (111-119)
cacagcgccggcgccgugaccguccug

SEQ ID NO: 41854 - RNA, 27 nt, Artificial Sequence
  Serine palmitoyltransferase 2 (403-411)
cacagcgccguguacgccaccucccug

SEQ ID NO: 41855 - RNA, 27 nt, Artificial Sequence
  Protein virilizer homolog (1566-1574)
cacagcgagcuggagcgcuccuuccuc

SEQ ID NO: 41856 - RNA, 24 nt, Artificial Sequence
  Hematopoietic SH2 domain-containing protein (62-69)
cacagccacgugggcuacacccug

SEQ ID NO: 41857 - RNA, 27 nt, Artificial Sequence
  Thrombospondin type-1 domain-containing protein 7B (289-297)
cacagcaaguccugggccaucgagauc

SEQ ID NO: 41858 - RNA, 27 nt, Artificial Sequence
  Paired box protein Pax-9 (196-204)
cacagcgugaccgacauccugggcauc

SEQ ID NO: 41859 - RNA, 27 nt, Artificial Sequence
  Proteasome subunit beta type-4 (134-142)
cacagcuggcugacccgcgccauguac

SEQ ID NO: 41860 - RNA, 27 nt, Artificial Sequence
  E3 SUMO-protein ligase RanBP2 (3152-3160)
cacaccggccccgggcugcucagcaug

SEQ ID NO: 41861 - RNA, 27 nt, Artificial Sequence
  Cytochrome b-245 heavy chain (115-123)
cacaccaucgcccaccuguucaacgug

SEQ ID NO: 41862 - RNA, 30 nt, Artificial Sequence
  Heterogeneous nuclear ribonucleoproteins A2/B1 (163-172)
cacaccaucaacggccacaacgccgaggug

SEQ ID NO: 41863 - RNA, 30 nt, Artificial Sequence
  Heterogeneous nuclear ribonucleoprotein A3 (189-198)
cacaccaucaacggccacaacugcgaggug

SEQ ID NO: 41864 - RNA, 27 nt, Artificial Sequence
  Mucin-3A (1830-1838)
cacacccugacccccagcacggcccuc

SEQ ID NO: 41865 - RNA, 27 nt, Artificial Sequence
  Eukaryotic translation initiation factor 4 gamma 1 (354-362)
cacaccguggagauccacgagcccaac

SEQ ID NO: 41866 - RNA, 27 nt, Artificial Sequence
  Nucleoporin NUP188 homolog (1451-1459)
cacaccgugggcuucauccugcagcuc

SEQ ID NO: 41867 - RNA, 27 nt, Artificial Sequence
  5-phosphohydroxy-L-lysine phospho-lyase (166-174)
cacguggccccccugccggacaccuac

SEQ ID NO: 41868 - RNA, 30 nt, Artificial Sequence
  Extracellular matrix protein FRAS1 (3372-3381)
cacgugugcagcaaccuggucaccaccuac

SEQ ID NO: 41869 - RNA, 30 nt, Artificial Sequence
  Cystatin-B (58-67)
cacgugggcgacgaggacuucguccaccug

SEQ ID NO: 41870 - RNA, 36 nt, Artificial Sequence
  Microtubule-associated protein 4 (1016-1027)
cacgugcccggcgggggcaacguccagauccagaac

SEQ ID NO: 41871 - RNA, 27 nt, Artificial Sequence
  Transmembrane protein 201 (96-104)
cacguggucagcuccgcccccagccug

SEQ ID NO: 41872 - RNA, 33 nt, Artificial Sequence
  Cholinesterase (154-164)
cacguguacgacggcaaguuccuggcccgcguc

SEQ ID NO: 41873 - RNA, 27 nt, Artificial Sequence
  60S ribosomal protein L26 (61-69)
cacuacaagggccagcagaucgggaag

SEQ ID NO: 41874 - RNA, 27 nt, Artificial Sequence
  HEAT repeat-containing protein 1 (578-586)
aucgccgccgacauccugaucaaggag

SEQ ID NO: 41875 - RNA, 30 nt, Artificial Sequence
  Protein PRRC2C (2676-2685)
aucgccggccgcagcaccacccccacgucc

SEQ ID NO: 41876 - RNA, 27 nt, Artificial Sequence
  Endoplasmic reticulum lectin 1 (311-319)
aucgccaucggcagccagcccgugcug

SEQ ID NO: 41877 - RNA, 27 nt, Artificial Sequence
  Monoacylglycerol lipase ABHD12 (84-92)
aucgccauccccuuccugaucaagcuc

SEQ ID NO: 41878 - RNA, 27 nt, Artificial Sequence
  Endoplasmin (166-174)
aucgccaagagcggcaccuccgaguuc

SEQ ID NO: 41879 - RNA, 27 nt, Artificial Sequence
  Msx2-interacting protein (613-621)
aucgcccccaagaucaccagcgugauc

SEQ ID NO: 41880 - RNA, 27 nt, Artificial Sequence
  Mitotic checkpoint serine/threonine-protein kinase BUB1 (382-390)
aucgcccccccggugccccugaaggcc

SEQ ID NO: 41881 - RNA, 27 nt, Artificial Sequence
  Large proline-rich protein BAG6 (504-512)
aucgcccgccccaccccgccccaggcc

SEQ ID NO: 41882 - RNA, 27 nt, Artificial Sequence
  Low-density lipoprotein receptor-related protein 1B (2001-2009)
aucgccgugcaccccgagaagggccug

SEQ ID NO: 41883 - RNA, 30 nt, Artificial Sequence
  Signal transducing adapter molecule 2 (292-301)
aucgacgaggacaagauggaccgcgcccug

SEQ ID NO: 41884 - RNA, 27 nt, Artificial Sequence
  Omega-amidase NIT2 (246-254)
aucgaccugaagaagcucgccgagauc

SEQ ID NO: 41885 - RNA, 27 nt, Artificial Sequence
  DENN domain-containing protein 1A (78-86)
aucgacagcaagcagcgcuucggcuuc

SEQ ID NO: 41886 - RNA, 27 nt, Artificial Sequence
  Histone-lysine N-methyltransferase EHMT1 (1232-1240)
aucgaggccggcgagcagcugggguuc

SEQ ID NO: 41887 - RNA, 24 nt, Artificial Sequence
  Basic helix-loop-helix domain-containing protein KIAA2018 (1140-1147)
aucuucgaccaggagaaccuggag

SEQ ID NO: 41888 - RNA, 27 nt, Artificial Sequence
  Neutral cholesterol ester hydrolase 1 (382-390)
aucuucaccagcuggcccaccaacuuc

SEQ ID NO: 41889 - RNA, 27 nt, Artificial Sequence
  Olfactory receptor 5H15 (106-114)
aucggcgugaccaccgagugcuuccug

SEQ ID NO: 41890 - RNA, 27 nt, Artificial Sequence
  Heterogeneous nuclear ribonucleoprotein U (749-757)
aucggcuaccccuacccgcgcgccccc

SEQ ID NO: 41891 - RNA, 27 nt, Artificial Sequence
  BolA-like protein 2 (67-75)
auccacgccuucgagcagaagacccug

SEQ ID NO: 41892 - RNA, 27 nt, Artificial Sequence
  Histone H3.1 (113-121)
auccacgccaagcgcgugaccaucaug

SEQ ID NO: 41893 - RNA, 27 nt, Artificial Sequence
  Two pore calcium channel protein 1 (44-52)
auccacgacagccaggcccccucccug

SEQ ID NO: 41894 - RNA, 27 nt, Artificial Sequence
  Probable ATP-dependent RNA helicase DDX41 (201-209)
auccaccaccccaccccgauccagauc

SEQ ID NO: 41895 - RNA, 27 nt, Artificial Sequence
  T-complex protein 1 subunit eta (281-289)
auccaccacagcggcgccaaggugguc

SEQ ID NO: 41896 - RNA, 30 nt, Artificial Sequence
  T-complex protein 1 subunit eta (281-290)
auccaccacagcggcgccaaggugguccug

SEQ ID NO: 41897 - RNA, 27 nt, Artificial Sequence
  Leucine-rich repeat-containing protein 16A (481-489)
auccacaacaucaccagccuggacauc

SEQ ID NO: 41898 - RNA, 27 nt, Artificial Sequence
  UDP-N-acetylglucosamine-peptide N-acetylglucosaminyltransferase 110 kDa subunit (628-636)
auccaccaggacggcauccacauccug

SEQ ID NO: 41899 - RNA, 27 nt, Artificial Sequence
  Calcium/calmodulin-dependent protein kinase type 1 (286-294)
auccaccagagcguguccgagcagauc

SEQ ID NO: 41900 - RNA, 30 nt, Artificial Sequence
  G-protein coupled receptor 98 (3507-3516)
auccacagcuucacccccgccuccggcauc

SEQ ID NO: 41901 - RNA, 27 nt, Artificial Sequence
  Wee1-like protein kinase (417-425)
auccacagcaugucccuggugcacaug

SEQ ID NO: 41902 - RNA, 27 nt, Artificial Sequence
  Toll-like receptor 9 (587-595)
auccacagccaggugucccagcagcug

SEQ ID NO: 41903 - RNA, 27 nt, Artificial Sequence
  Tumor suppressor candidate 2 (99-107)
auccacguggacuuccccgucauccug

SEQ ID NO: 41904 - RNA, 27 nt, Artificial Sequence
  DNA replication licensing factor MCM5 (694-702)
aucaucaaggacuucaccaagcagaag

SEQ ID NO: 41905 - RNA, 30 nt, Artificial Sequence
  Kelch-like protein 6 (114-123)
aucaucaagggcguggacgccgagaccaug

SEQ ID NO: 41906 - RNA, 30 nt, Artificial Sequence
  Transcription factor Sp2 (277-286)
aucauccaggccggcaacaaccugcucauc

SEQ ID NO: 41907 - RNA, 27 nt, Artificial Sequence
  Stress-associated endoplasmic reticulum protein 1 (58-66)
aucauccagagcauccgcaugggcaug

SEQ ID NO: 41908 - RNA, 27 nt, Artificial Sequence
  HEAT repeat-containing protein 5B (1006-1014)
aucaucaccaccgugggccccgagcug

SEQ ID NO: 41909 - RNA, 27 nt, Artificial Sequence
  Annexin A7 (223-231)
aucaaggccgccuucaagaccagcuac

SEQ ID NO: 41910 - RNA, 30 nt, Artificial Sequence
  Tetraspanin-8 (198-207)
aucaaggacuuccuggccaagaaccucauc

SEQ ID NO: 41911 - RNA, 27 nt, Artificial Sequence
  Copine-3 (135-143)
aucaaggacaaccgcgugguccuguuc

SEQ ID NO: 41912 - RNA, 27 nt, Artificial Sequence
  AP-3 complex subunit mu-1 (102-110)
aucaaggacaacguggucaucguguac

SEQ ID NO: 41913 - RNA, 27 nt, Artificial Sequence
  Geminin (90-98)
aucaaggagaaccccagcucccaguac

SEQ ID NO: 41914 - RNA, 27 nt, Artificial Sequence
  X-ray repair cross-complementing protein 5 (647-655)
aucaaguucagcgaggagcagcgcuuc

SEQ ID NO: 41915 - RNA, 27 nt, Artificial Sequence
  Serine/threonine-protein kinase TAO1 (83-91)
aucaagcaccccaacagcaucgaguac

SEQ ID NO: 41916 - RNA, 27 nt, Artificial Sequence
  60S ribosomal protein L12 (98-106)
aucaagcacagcggcaacaucaccuuc

SEQ ID NO: 41917 - RNA, 27 nt, Artificial Sequence
  Alkyldihydroxyacetonephosphate synthase, peroxisomal (379-387)
aucaagauccgccccgugccggaguac

SEQ ID NO: 41918 - RNA, 27 nt, Artificial Sequence
  Probable ATP-dependent RNA helicase DDX52 (255-263)
aucaagaucagcgagggcaccggguuc

SEQ ID NO: 41919 - RNA, 27 nt, Artificial Sequence
  Nucleolar and spindle-associated protein 1 (108-116)
aucaagaucagcaaccccaccgaguuc

SEQ ID NO: 41920 - RNA, 27 nt, Artificial Sequence
  Serine/threonine-protein kinase 17A (79-87)
aucaagaaggacagcggcaaggaguuc

SEQ ID NO: 41921 - RNA, 27 nt, Artificial Sequence
  Dynein light chain 1, cytoplasmic (42-50)
aucaagaaggaguucgacaagaaguac

SEQ ID NO: 41922 - RNA, 27 nt, Artificial Sequence
  Endoplasmin (472-480)
aucaagaagaucgccgacgacaaguac

SEQ ID NO: 41923 - RNA, 30 nt, Artificial Sequence
  Elongation factor 2 (570-579)
aucaagaagagcgaccccguggucuccuac

SEQ ID NO: 41924 - RNA, 27 nt, Artificial Sequence
  DNA ligase 1 (608-616)
aucaagcugcccagcgugaccuccuuc

SEQ ID NO: 41925 - RNA, 27 nt, Artificial Sequence
  Acetyl-coenzyme A transporter 1 (305-313)
aucaagaugcccgccgugcugaccuuc

SEQ ID NO: 41926 - RNA, 27 nt, Artificial Sequence
  Ribulose-phosphate 3-epimerase (119-127)
aucaagcccggcaccagcguggaguac

SEQ ID NO: 41927 - RNA, 24 nt, Artificial Sequence
  Serine/threonine-protein kinase tousled-like 1 (482-489)
aucaagcccccgaucauccacuac

SEQ ID NO: 41928 - RNA, 30 nt, Artificial Sequence
  Eukaryotic translation initiation factor 5B (366-375)
aucaagcgccuggaggagcucgaggccaag

SEQ ID NO: 41929 - RNA, 27 nt, Artificial Sequence
  F-box only protein 11 (714-722)
aucaagaccgacagcaaccccacccug

SEQ ID NO: 41930 - RNA, 30 nt, Artificial Sequence
  60S ribosomal protein L11 (117-126)
aucaaguacgaccccagcaucggcaucuac

SEQ ID NO: 41931 - RNA, 27 nt, Artificial Sequence
  Ubiquitin carboxyl-terminal hydrolase 40 (723-731)
auccugauccaggacagccacgacgac

SEQ ID NO: 41932 - RNA, 27 nt, Artificial Sequence
  E3 ubiquitin-protein ligase UBR4 (654-662)
auccugaacuucaucaccagcuccaug

SEQ ID NO: 41933 - RNA, 27 nt, Artificial Sequence
  ATP-dependent RNA helicase DDX18 (529-537)
auccugcgccccgaggagcucggcuuc

SEQ ID NO: 41934 - RNA, 33 nt, Artificial Sequence
  Trace amine-associated receptor 6 (212-222)
aucaugaucauccuguacggcaacaucuuccuc

SEQ ID NO: 41935 - RNA, 27 nt, Artificial Sequence
  DNA polymerase delta subunit 2 (258-266)
aucaacaaggccaaguaccugaccaag

SEQ ID NO: 41936 - RNA, 27 nt, Artificial Sequence
  40S ribosomal protein S18 (5-13)
auccccgagaaguuccagcacauccug

SEQ ID NO: 41937 - RNA, 27 nt, Artificial Sequence
  Nuclear factor of activated T-cells, cytoplasmic 2 (331-339)
auccccgagagcuccggccgcaucgug

SEQ ID NO: 41938 - RNA, 24 nt, Artificial Sequence
  Nuclear factor erythroid 2-related factor 2 (443-450)
auccccuucccgguggagaagauc

SEQ ID NO: 41939 - RNA, 27 nt, Artificial Sequence
  Tetra-peptide repeat homeobox protein 1 (109-117)
auccccggcccgcugcccgggagcauc

SEQ ID NO: 41940 - RNA, 27 nt, Artificial Sequence
  DNA replication licensing factor MCM6 (79-87)
auccaggaggaguucuaccgcguguac

SEQ ID NO: 41941 - RNA, 33 nt, Artificial Sequence
  Poly (ADP-ribose) polymerase 8 (10-20)
auccagaaggacaucgacguggucauccagaag

SEQ ID NO: 41942 - RNA, 27 nt, Artificial Sequence
  DNA-directed RNA polymerase II subunit RPB4 (134-142)
auccagaccaagcgcagcuuccaguac

SEQ ID NO: 41943 - RNA, 27 nt, Artificial Sequence
  Serine/threonine-protein phosphatase 4 regulatory subunit 2 (40-48)
auccaguggagccaguucaagggcuac

SEQ ID NO: 41944 - RNA, 27 nt, Artificial Sequence
  Maestro heat-like repeat-containing protein family member 1 (525-533)
auccaguacgacgcccacgccagccug

SEQ ID NO: 41945 - RNA, 27 nt, Artificial Sequence
  Protein capicua homolog (862-870)
auccgcuucacccugcccccgggcacc

SEQ ID NO: 41946 - RNA, 30 nt, Artificial Sequence
  Inactive serine/threonine-protein kinase VRK3 (422-431)
auccgccccagcgagacccugcagaaguac

SEQ ID NO: 41947 - RNA, 27 nt, Artificial Sequence
  Sphingomyelin phosphodiesterase 3 (179-187)
aucagcgccgccuccuucagcucccug

SEQ ID NO: 41948 - RNA, 27 nt, Artificial Sequence
  Sodium channel protein type 5 subunit alpha (1758-1766)
aucagcuuccugaucguggucaacaug

SEQ ID NO: 41949 - RNA, 27 nt, Artificial Sequence
  Calsyntenin-1 (783-791)
aucagcaacgaguucaagguggagguc

SEQ ID NO: 41950 - RNA, 30 nt, Artificial Sequence
  Calcineurin subunit B type 2 (107-116)
aucagcaacggcgagcuguuccaggugcuc

SEQ ID NO: 41951 - RNA, 27 nt, Artificial Sequence
  AT-rich interactive domain-containing protein 2 (1322-1330)
aucagcaacggccccucccuggagcuc

SEQ ID NO: 41952 - RNA, 27 nt, Artificial Sequence
  THUMP domain-containing protein 3 (77-85)
aucagcguggagucccuggcccagguc

SEQ ID NO: 41953 - RNA, 27 nt, Artificial Sequence
  Methylcrotonoyl-CoA carboxylase subunit alpha, mitochondrial (547-555)
aucagcuacacccgcaacaugacccug

SEQ ID NO: 41954 - RNA, 27 nt, Artificial Sequence
  Kelch repeat and BTB domain-containing protein 12 (77-85)
aucaccgccgagagcguguccguccug

SEQ ID NO: 41955 - RNA, 27 nt, Artificial Sequence
  Titin (15022-15030)
aucaccaagaacaccgccgaccugaag

SEQ ID NO: 41956 - RNA, 33 nt, Artificial Sequence
  Elongation factor 1-alpha 1 (170-180)
aucgugaaggaggucagcaccuacaucaagaag

SEQ ID NO: 41957 - RNA, 27 nt, Artificial Sequence
  Nucleolar protein 58 (41-49)
aucgugaagcugaagcacuucgagaag

SEQ ID NO: 41958 - RNA, 27 nt, Artificial Sequence
  NADH dehydrogenase (ubiquinone) 1 beta subcomplex subunit 1 (7-15)
aucgugcgcgaccacuggguccacgug

SEQ ID NO: 41959 - RNA, 27 nt, Artificial Sequence
  Serine/threonine-protein kinase RIO1 (209-217)
aucuacaagaccagcauccugguguuc

SEQ ID NO: 41960 - RNA, 27 nt, Artificial Sequence
  60S ribosomal protein L4 (269-277)
aaggccgccagccugaaguccaacuac

SEQ ID NO: 41961 - RNA, 27 nt, Artificial Sequence
  Pre-mRNA-splicing factor SYF2 (221-229)
aaggccgagcgcuucuacggcaaguac

SEQ ID NO: 41962 - RNA, 27 nt, Artificial Sequence
  Zinc finger protein 215 (386-394)
aaggccuucugccgcagcuccagccug

SEQ ID NO: 41963 - RNA, 27 nt, Artificial Sequence
  Integrin alpha-4 (236-244)
aaggccuuccuggacaagcagaaccag

SEQ ID NO: 41964 - RNA, 27 nt, Artificial Sequence
  Spermatid perinuclear RNA-binding protein (384-392)
aaggccaucgaccugaugaacgcccuc

SEQ ID NO: 41965 - RNA, 27 nt, Artificial Sequence
  Collagen alpha-6(VI) chain (501-509)
aaggccaucgagaacauccgccagaug

SEQ ID NO: 41966 - RNA, 27 nt, Artificial Sequence
  T-complex protein 1 subunit gamma (163-171)
aaggccaucagccgcugguccagccug

SEQ ID NO: 41967 - RNA, 27 nt, Artificial Sequence
  60S ribosomal protein L7 (53-61)
aaggccaagcacuaccacaaggaguac

SEQ ID NO: 41968 - RNA, 27 nt, Artificial Sequence
  N(G),N(G)-dimethylarginine dimethylaminohydrolase 1 (196-204)
aaggcccugaagaucaugcagcagaug

SEQ ID NO: 41969 - RNA, 27 nt, Artificial Sequence
  Zinc finger protein 491 (250-258)
aaggcccugagccgccucaucuccuuc

SEQ ID NO: 41970 - RNA, 27 nt, Artificial Sequence
  Inositol 1,4,5-trisphosphate receptor type 3 (2312-2320)
aaggccauggugauggacauggaguuc

SEQ ID NO: 41971 - RNA, 30 nt, Artificial Sequence
  Mid1-interacting protein 1 (164-173)
aaggccaacauccugaccaaccgcuacaag

SEQ ID NO: 41972 - RNA, 27 nt, Artificial Sequence
  Phosphoenolpyruvate carboxykinase, cytosolic (GTP) (547-555)
aaggccagcaccaagcugacccccauc

SEQ ID NO: 41973 - RNA, 27 nt, Artificial Sequence
  Zinc finger protein 726 (174-182)
aagugcaagaacugcgugaagagcuuc

SEQ ID NO: 41974 - RNA, 27 nt, Artificial Sequence
  PDZ domain-containing protein 8 (559-567)
aaggacggcaacaagcccccgccccug

SEQ ID NO: 41975 - RNA, 27 nt, Artificial Sequence
  Zinc finger protein 470 (79-87)
aaggaccccugggugaucaagggcggg

SEQ ID NO: 41976 - RNA, 27 nt, Artificial Sequence
  HIV Tat-specific factor 1 (234-242)
aaggacuacaagaagaagcugagcaug

SEQ ID NO: 41977 - RNA, 27 nt, Artificial Sequence
  Glucose-6-phosphate translocase (212-220)
aaggaggagagcacccugcaggagcuc

SEQ ID NO: 41978 - RNA, 27 nt, Artificial Sequence
  Protein bassoon (2970-2978)
aaggagaucgacgccaagcugaaguac

SEQ ID NO: 41979 - RNA, 27 nt, Artificial Sequence
  Nuclear fragile X mental retardation-interacting protein 2 (667-675)
aaggagauggagagcaucuggaaccug

SEQ ID NO: 41980 - RNA, 27 nt, Artificial Sequence
  Desmoplakin (423-431)
aaggagcgcgagaagauccuggaguac

SEQ ID NO: 41981 - RNA, 27 nt, Artificial Sequence
  Protein FAM91A1 (752-760)
aaggagagccugcagaaccuccugcac

SEQ ID NO: 41982 - RNA, 27 nt, Artificial Sequence
  Complement C4-A (189-197)
aaggagguguacaugcccagcuccauc

SEQ ID NO: 41983 - RNA, 30 nt, Artificial Sequence
  Heterogeneous nuclear ribonucleoprotein U (565-574)
aaguucaucgagaucgccgcccgcaagaag

SEQ ID NO: 41984 - RNA, 27 nt, Artificial Sequence
  Ciliogenesis-associated TTC17-interacting protein (302-310)
aaguuccuggaccgcaaggaggagcuc

SEQ ID NO: 41985 - RNA, 30 nt, Artificial Sequence
  Heparan-sulfate 6-O-sulfotransferase 2 (519-528)
aaguuccugaagggccgccuccugcagacc

SEQ ID NO: 41986 - RNA, 30 nt, Artificial Sequence
  78 kDa glucose-regulated protein (113-122)
aaguuccugcccuucaagguggucgagaag

SEQ ID NO: 41987 - RNA, 27 nt, Artificial Sequence
  Protein SON (16-24)
aaguuccgcgagauccagcaggagcug

SEQ ID NO: 41988 - RNA, 30 nt, Artificial Sequence
  Mothers against decapentaplegic homolog 9 (159-168)
aaguuccgcagcgccucccugcacagcgag

SEQ ID NO: 41989 - RNA, 33 nt, Artificial Sequence
  Stabilin-2 (1755-1765)
aaguucagcaaccugauccaggacuccggccuc

SEQ ID NO: 41990 - RNA, 27 nt, Artificial Sequence
  Desmoglein-2 (639-647)
aagggcgccaagggguucacccccauc

SEQ ID NO: 41991 - RNA, 27 nt, Artificial Sequence
  Tumor necrosis factor ligand superfamily member 11 (257-265)
aagggcgggagcaccaaguacuggucc

SEQ ID NO: 41992 - RNA, 33 nt, Artificial Sequence
  Arginase-1 (153-163)
aagggcaagauccccgacgugccgggguucagc

SEQ ID NO: 41993 - RNA, 30 nt, Artificial Sequence
  Casein kinase I isoform delta (242-251)
aagggcuaccccagcgaguucgccaccuac

SEQ ID NO: 41994 - RNA, 33 nt, Artificial Sequence
  40S ribosomal protein S17 (49-59)
aagaucgccggcuacgugacccaccugaugaag

SEQ ID NO: 41995 - RNA, 27 nt, Artificial Sequence
  Repetin (489-497)
aagaucgaccgccaggaccagagcuac

SEQ ID NO: 41996 - RNA, 27 nt, Artificial Sequence
  T-complex protein 1 subunit eta (135-143)
aagaucaaggagaucgccgugaccguc

SEQ ID NO: 41997 - RNA, 27 nt, Artificial Sequence
  V-type proton ATPase catalytic subunit A (596-604)
aagaucaagagcgacuacgcccagcug

SEQ ID NO: 41998 - RNA, 27 nt, Artificial Sequence
  Potassium-transporting ATPase alpha chain 1 (737-745)
aagaaggccgacaucggcguggccaug

SEQ ID NO: 41999 - RNA, 27 nt, Artificial Sequence
  Histone H1.4 (63-71)
aagaaggcccuggccgcggccggcuac

SEQ ID NO: 42000 - RNA, 27 nt, Artificial Sequence
  Ezrin (262-270)
aagaaggcccccgacuucguguucuac

SEQ ID NO: 42001 - RNA, 27 nt, Artificial Sequence
  C1GALT1-specific chaperone 1 (160-168)
aagaaggaccccagccagccguucuac

SEQ ID NO: 42002 - RNA, 27 nt, Artificial Sequence
  Cofilin-1 (95-103)
aagaaggaggaccugguguucaucuuc

SEQ ID NO: 42003 - RNA, 30 nt, Artificial Sequence
  116 kDa U5 small nuclear ribonucleoprotein component (421-430)
aagaaguucuucggcgaguucaccggguuc

SEQ ID NO: 42004 - RNA, 27 nt, Artificial Sequence
  Squalene monooxygenase (15-23)
aagaaguucggcgacuucaucacccug

SEQ ID NO: 42005 - RNA, 27 nt, Artificial Sequence
  UPF0729 protein C18orf32 (17-25)
aagaaguuccuggagcccuacaucuac

SEQ ID NO: 42006 - RNA, 27 nt, Artificial Sequence
  Cholesterol 24-hydroxylase (94-102)
aagaaguuccugaugagcaccaaguac

SEQ ID NO: 42007 - RNA, 33 nt, Artificial Sequence
  Spermidine synthase (134-144)
aagaaguuccugcccggcauggccaucggguac

SEQ ID NO: 42008 - RNA, 30 nt, Artificial Sequence
  Probable global transcription activator SNF2L2 (1110-1119)
aagaaguucaacgagcccggcagccaguac

SEQ ID NO: 42009 - RNA, 30 nt, Artificial Sequence
  TRAF-interacting protein with FHA domain-containing protein A (76-85)
aagaaguucaacagcuccgugcugagcuuc

SEQ ID NO: 42010 - RNA, 36 nt, Artificial Sequence
  Nicotinamide phosphoribosyltransferase (330-341)
aagaaguuccccgugaccgagaacagcaagggcuac

SEQ ID NO: 42011 - RNA, 33 nt, Artificial Sequence
  Cell cycle progression protein 1 (523-533)
aagaaguucagcgacuccgugaagagcaccuuc

SEQ ID NO: 42012 - RNA, 30 nt, Artificial Sequence
  40S ribosomal protein S7 (85-94)
aagaaguucagcggcaagcacguggucuuc

SEQ ID NO: 42013 - RNA, 33 nt, Artificial Sequence
  Lupus La protein (165-175)
aagaaguucguggagacccccggccagaaguac

SEQ ID NO: 42014 - RNA, 27 nt, Artificial Sequence
  Zinc finger protein 451 (219-227)
aagaaguucgugacccagcagcaguac

SEQ ID NO: 42015 - RNA, 27 nt, Artificial Sequence
  Melanoma inhibitory activity protein 3 (67-75)
aagaagggcgaccccguguacgucuac

SEQ ID NO: 42016 - RNA, 27 nt, Artificial Sequence
  Protein FAM173B (108-116)
aagaagggcuucaccgccgugggguac

SEQ ID NO: 42017 - RNA, 27 nt, Artificial Sequence
  SEC14-like protein 1 (157-165)
aagaagggcaaggagaucaucgaguac

SEQ ID NO: 42018 - RNA, 27 nt, Artificial Sequence
  Na(+)/H(+) exchange regulatory cofactor NHE-RF1 (158-166)
aagaagggccccagcggguacggcuuc

SEQ ID NO: 42019 - RNA, 27 nt, Artificial Sequence
  Serine/threonine-protein kinase RIO3 (353-361)
aagaagcacauccuggugaugagcuuc

SEQ ID NO: 42020 - RNA, 27 nt, Artificial Sequence
  Heat shock protein HSP 90-beta (203-211)
aagaagcacagccaguucaucggcuac

SEQ ID NO: 42021 - RNA, 27 nt, Artificial Sequence
  Dynactin subunit 3 (59-67)
aagaagaucgaggaccugaucaaguac

SEQ ID NO: 42022 - RNA, 27 nt, Artificial Sequence
  60S ribosomal protein L23a (88-96)
aagaagaucgaggacaacaacacccug

SEQ ID NO: 42023 - RNA, 30 nt, Artificial Sequence
  Nardilysin (992-1001)
aagaagaucgaggaguuccugagcuccuuc

SEQ ID NO: 42024 - RNA, 27 nt, Artificial Sequence
  Leydig cell tumor 10 kDa protein homolog (59-67)
aagaagaucgagcacgacguggucaug

SEQ ID NO: 42025 - RNA, 27 nt, Artificial Sequence
  Brain-specific angiogenesis inhibitor 1-associated protein 2-like protein 1 (106-114)
aagaagaucgagcuggacgugaaguac

SEQ ID NO: 42026 - RNA, 30 nt, Artificial Sequence
  General transcription factor 3C polypeptide 4 (563-572)
aagaagaucgagagcuccggcgugaccuac

SEQ ID NO: 42027 - RNA, 30 nt, Artificial Sequence
  T-complex protein 1 subunit gamma (353-362)
aagaagaucggcgacgaguacuucaccuuc

SEQ ID NO: 42028 - RNA, 27 nt, Artificial Sequence
  Gamma-interferon-inducible protein 16 (256-264)
aagaagaucaucaucaucagcgacuac

SEQ ID NO: 42029 - RNA, 27 nt, Artificial Sequence
  Synaptojanin-2 (121-129)
aagaagauccugagcuccggcguguuc

SEQ ID NO: 42030 - RNA, 27 nt, Artificial Sequence
  Golgin-45 (320-328)
aagaagauccccagcaccguggaguuc

SEQ ID NO: 42031 - RNA, 27 nt, Artificial Sequence
  RNA exonuclease 4 (342-350)
aagaagauccgcgacacccagaaguac

SEQ ID NO: 42032 - RNA, 27 nt, Artificial Sequence
  60S ribosomal protein L23a (38-46)
aagaagauccgcaccagccccaccuuc

SEQ ID NO: 42033 - RNA, 27 nt, Artificial Sequence
  Stress-induced-phosphoprotein 1 (237-245)
aagaagaaggacuucgacaccgcccug

SEQ ID NO: 42034 - RNA, 30 nt, Artificial Sequence
  Protein DEK (143-152)
aagaagaaggaggagaugcugaagaaguuc

SEQ ID NO: 42035 - RNA, 27 nt, Artificial Sequence
  Protein KIAA2022 (1378-1386)
aagaagaagaucaacagcggcucccag

SEQ ID NO: 42036 - RNA, 27 nt, Artificial Sequence
  Regulatory factor X-associated protein (175-183)
aagaagaagaagagcgaccaggcccug

SEQ ID NO: 42037 - RNA, 27 nt, Artificial Sequence
  UBX domain-containing protein 4 (377-385)
aagaagaagcugcucgaccuggagcug

SEQ ID NO: 42038 - RNA, 30 nt, Artificial Sequence
  Prefoldin subunit 3 (51-60)
aagaagcuggacgagcaguaccagaaguac

SEQ ID NO: 42039 - RNA, 30 nt, Artificial Sequence
  Non-specific lipid-transfer protein (442-451)
aagaagcuggaggaggagggcgagcaguuc

SEQ ID NO: 42040 - RNA, 30 nt, Artificial Sequence
  Alpha-taxilin (423-432)
aagaagcuggagaaggagaccaccauguac

SEQ ID NO: 42041 - RNA, 27 nt, Artificial Sequence
  Mitogen-activated protein kinase kinase kinase 1 (792-800)
aagaagcugcucagccugcugaccuuc

SEQ ID NO: 42042 - RNA, 30 nt, Artificial Sequence
  Cold shock domain-containing protein E1 (411-420)
aagaagcugcccaagggcaccgugagcuuc

SEQ ID NO: 42043 - RNA, 27 nt, Artificial Sequence
  Hexokinase-2 (146-154)
aagaagcugccccucggcuucaccuuc

SEQ ID NO: 42044 - RNA, 27 nt, Artificial Sequence
  14-3-3 protein theta (74-82)
aagaagcugcagcucaucaaggacuac

SEQ ID NO: 42045 - RNA, 27 nt, Artificial Sequence
  Nibrin (236-244)
aagaagcugagcuccgccguggucuuc

SEQ ID NO: 42046 - RNA, 30 nt, Artificial Sequence
  Clustered mitochondria protein homolog (294-303)
aagaagaacuucgccgugcugcagaagaag

SEQ ID NO: 42047 - RNA, 27 nt, Artificial Sequence
  General transcription factor II-I (644-652)
aagaagcccgagcuggugaucagcuac

SEQ ID NO: 42048 - RNA, 30 nt, Artificial Sequence
  SUMO-activating enzyme subunit 1 (117-126)
aagaagcccgagagcuucuucacccaguuc

SEQ ID NO: 42049 - RNA, 27 nt, Artificial Sequence
  Poly(ADP-ribose)ohydrolase (689-697)
aagaagcccaccggccuggugaccuuc

SEQ ID NO: 42050 - RNA, 27 nt, Artificial Sequence
  DnaJ homolog subfamily C member 3 (406-414)
aagaagcaggagaucaucaaggccuac

SEQ ID NO: 42051 - RNA, 30 nt, Artificial Sequence
  Ankyrin repeat domain-containing protein 17 (1650-1659)
aagaagcagcccagcgugcuggucaccuuc

SEQ ID NO: 42052 - RNA, 27 nt, Artificial Sequence
  Transmembrane emp24 domain-containing protein 3 (82-90)
aagaagcaguacgacagcuucaccuac

SEQ ID NO: 42053 - RNA, 30 nt, Artificial Sequence
  Heterogeneous nuclear ribonucleoproteins A2/B1 (151-160)
aagaagcgcggcuucggguucgugaccuuc

SEQ ID NO: 42054 - RNA, 27 nt, Artificial Sequence
  Heterogeneous nuclear ribonucleoproteins C1/C2 (29-37)
aagaagagcgacguggaggccaucuuc

SEQ ID NO: 42055 - RNA, 27 nt, Artificial Sequence
  RNA-binding protein Raly (34-42)
aagaagagcgacguggagaccaucuuc

SEQ ID NO: 42056 - RNA, 27 nt, Artificial Sequence
  Endoplasmin (404-412)
aagaagagcgacuacaucaagcuguac

SEQ ID NO: 42057 - RNA, 27 nt, Artificial Sequence
  Exocyst complex component 2 (196-204)
aagaagagcgagggcucccuggccuac

SEQ ID NO: 42058 - RNA, 24 nt, Artificial Sequence
  ATPase family AAA domain-containing protein 5 (1559-1566)
aagaagagccagaagaagaagcag

SEQ ID NO: 42059 - RNA, 27 nt, Artificial Sequence
  60S ribosomal protein L18a (55-63)
aagaagagcuccggcgagaucguguac

SEQ ID NO: 42060 - RNA, 27 nt, Artificial Sequence
  Copper transport protein ATOX1 (56-64)
aagaagaccggcaagaccgugagcuac

SEQ ID NO: 42061 - RNA, 27 nt, Artificial Sequence
  Melanoma-associated antigen 1 (104-112)
aagaagguggccgaccuggucggcuuc

SEQ ID NO: 42062 - RNA, 27 nt, Artificial Sequence
  ATP-dependent RNA helicase DDX18 (647-655)
aagaagguggagaagagcaagaucuuc

SEQ ID NO: 42063 - RNA, 27 nt, Artificial Sequence
  Polyadenylate-binding protein 1 (268-276)
aagaagguggagcgccagaccgagcug

SEQ ID NO: 42064 - RNA, 30 nt, Artificial Sequence
  Asparagine synthetase (glutamine-hydrolyzing) (131-140)
aagaagguguuccugggccgcgacaccuac

SEQ ID NO: 42065 - RNA, 27 nt, Artificial Sequence
  60S ribosomal protein L37a (6-14)
aagaaggugggcaucgucgggaaguac

SEQ ID NO: 42066 - RNA, 27 nt, Artificial Sequence
  60S ribosomal protein L23 (74-82)
aagaaggugcaccccgccgucgugauc

SEQ ID NO: 42067 - RNA, 27 nt, Artificial Sequence
  Acyl-CoA desaturase (337-345)
aagaaggugagcaaggccgccauccug

SEQ ID NO: 42068 - RNA, 27 nt, Artificial Sequence
  Condensin-2 complex subunit G2 (421-429)
aagaaggugaccggcgagcuggccuuc

SEQ ID NO: 42069 - RNA, 27 nt, Artificial Sequence
  Sorting nexin-29 (261-269)
aagaaggugaccaacaucaucagcuuc

SEQ ID NO: 42070 - RNA, 30 nt, Artificial Sequence
  3-hydroxyisobutyryl-CoA hydrolase, mitochondrial (73-82)
aagaagugggagcaggaccccgagaccuuc

SEQ ID NO: 42071 - RNA, 30 nt, Artificial Sequence
  Rho-related GTP-binding protein RhoE (115-124)
aagaaguggaagggcgagauccaggaguuc

SEQ ID NO: 42072 - RNA, 27 nt, Artificial Sequence
  Conserved oligomeric Golgi complex subunit 2 (378-386)
aagaaguggaaccugcccguguacuuc

SEQ ID NO: 42073 - RNA, 27 nt, Artificial Sequence
  Oxysterol-binding protein 1 (288-296)
aagaaguggcagaagagccugcaguac

SEQ ID NO: 42074 - RNA, 30 nt, Artificial Sequence
  Cytosolic phospholipase A2 (379-388)
aagaaguacgaggagaacccccugcacuuc

SEQ ID NO: 42075 - RNA, 27 nt, Artificial Sequence
  F-BAR and double SH3 domains protein 2 (153-161)
aagaaguacuucgagaccgagcagaug

SEQ ID NO: 42076 - RNA, 30 nt, Artificial Sequence
  Cysteine andine-rich protein 1 (64-73)
aagaaguacggccccaagggguacggcuac

SEQ ID NO: 42077 - RNA, 30 nt, Artificial Sequence
  WD repeat-containing protein 82 (62-71)
aagaaguacggcguggaccugauccgcuac

SEQ ID NO: 42078 - RNA, 27 nt, Artificial Sequence
  Gamma-interferon-inducible protein 16 (3-11)
aagaaguacaagaacaucgugcugcuc

SEQ ID NO: 42079 - RNA, 30 nt, Artificial Sequence
  AT-rich interactive domain-containing protein 4B (387-396)
aagaaguaccuguacggcuucgaggaguac

SEQ ID NO: 42080 - RNA, 33 nt, Artificial Sequence
  116 kDa U5 small nuclear ribonucleoprotein component (63-73)
aagaaguacuaccccaccgccgaggagguguac

SEQ ID NO: 42081 - RNA, 27 nt, Artificial Sequence
  Astrocytic phosphoprotein PEA-15 (122-130)
aagcuggcccccccgcccaagaaggcc

SEQ ID NO: 42082 - RNA, 27 nt, Artificial Sequence
  Remodeling and spacing factor 1 (587-595)
aagcuggagaagagcaagaagaccuuc

SEQ ID NO: 42083 - RNA, 36 nt, Artificial Sequence
  Zymogen granule protein 16 homolog B (100-111)
aagcugggcgcccucgggggcaacacccaggaggug

SEQ ID NO: 42084 - RNA, 24 nt, Artificial Sequence
  Ubiquitin carboxyl-terminal hydrolase 3 (107-114)
aagcugggccucgugcagaagguc

SEQ ID NO: 42085 - RNA, 27 nt, Artificial Sequence
  Sister chromatid cohesion protein PDS5 homolog A (112-120)
aagcugaaggacaucuuccucuucauc

SEQ ID NO: 42086 - RNA, 27 nt, Artificial Sequence
  DDB1- and CUL4-associated factor 13 (376-384)
aagcugaaggagaaguuccagcacuac

SEQ ID NO: 42087 - RNA, 33 nt, Artificial Sequence
  Heterogeneous nuclear ribonucleoproteins C1/C2 (187-197)
aagcugaagggcgacgaccuccaggccaucaag

SEQ ID NO: 42088 - RNA, 27 nt, Artificial Sequence
  Rap guanine nucleotide exchange factor 2 (828-836)
aagcugcccaacaaguacgagaagcuc

SEQ ID NO: 42089 - RNA, 27 nt, Artificial Sequence
  Dynein heavy chain 1, axonemal (2025-2033)
aagcugcccccgcuccugaagcccuac

SEQ ID NO: 42090 - RNA, 30 nt, Artificial Sequence
  Signal peptidase complex subunit 2 (173-182)
aagcugaccuucaucagcggccgcaccaag

SEQ ID NO: 42091 - RNA, 30 nt, Artificial Sequence
  Heterogeneous nuclear ribonucleoprotein U-like protein 2 (521-530)
aagcuggugcagaucgccagccgcaccaag

SEQ ID NO: 42092 - RNA, 30 nt, Artificial Sequence
  Dedicator of cytokinesis protein 3 (182-191)
aagaugcaccugagcucccgccagagcgug

SEQ ID NO: 42093 - RNA, 27 nt, Artificial Sequence
  Neuroblast differentiation-associated protein AHNAK (5087-5095)
aagauguacuuccccgacguggaguuc

SEQ ID NO: 42094 - RNA, 27 nt, Artificial Sequence
  A-kinase anchor protein 9 (1420-1428)
aagaacaucgacggcaccaucgaguuc

SEQ ID NO: 42095 - RNA, 24 nt, Artificial Sequence
  Nucleoporin p58/p45 (71-78)
aagcccgccaccggcuucacccug

SEQ ID NO: 42096 - RNA, 24 nt, Artificial Sequence
  MARCKS-related protein (96-103)
aagcccuucaagcugagcggccuc

SEQ ID NO: 42097 - RNA, 27 nt, Artificial Sequence
  Zinc finger and BTB domain-containing protein 38 (175-183)
aagcaguuccagagccccuccacccug

SEQ ID NO: 42098 - RNA, 30 nt, Artificial Sequence
  ADP-sugar pyrophosphatase (81-90)
aagcaguuccgccccccgaugggcggguac

SEQ ID NO: 42099 - RNA, 27 nt, Artificial Sequence
  26S protease regulatory subunit 8 (30-38)
aagcagaucaaggagaucaaggaggug

SEQ ID NO: 42100 - RNA, 27 nt, Artificial Sequence
  Ubiquitin-40S ribosomal protein S27a (48-56)
aagcagcuggaggacggccgcacccuc

SEQ ID NO: 42101 - RNA, 27 nt, Artificial Sequence
  tRNA selenocysteine 1-associated protein 1 (88-96)
aagcagcccgacaacagcccggaguac

SEQ ID NO: 42102 - RNA, 27 nt, Artificial Sequence
  MARVEL domain-containing protein 2 (540-548)
aagcagcgcauccaggaguacgacaag

SEQ ID NO: 42103 - RNA, 27 nt, Artificial Sequence
  Heat shock 70 kDa protein 1B (423-431)
aagcagacccagaucuucaccacguac

SEQ ID NO: 42104 - RNA, 27 nt, Artificial Sequence
  Mortality factor 4-like protein 1 (38-46)
aagcaggugaaguacuucauccacuac

SEQ ID NO: 42105 - RNA, 30 nt, Artificial Sequence
  ADP-ribosylation factor-binding protein GGA2 (311-320)
aagcaggugauggagggccgcgucaccuuc

SEQ ID NO: 42106 - RNA, 36 nt, Artificial Sequence
  60S ribosomal protein L17 (74-85)
aagcaguggggcuggacccaggggcgcuggcccaag

SEQ ID NO: 42107 - RNA, 27 nt, Artificial Sequence
  ATP-dependent RNA helicase DDX3X (264-272)
aagcaguaccccaucagccuggugcuc

SEQ ID NO: 42108 - RNA, 27 nt, Artificial Sequence
  Cancer-related nucleoside-triphosphatase (73-81)
aagcgcgagugccgggugggccaguac

SEQ ID NO: 42109 - RNA, 30 nt, Artificial Sequence
  Unconventional myosin-VIIb (624-633)
aagcgccccagcacccugggcucccaguuc

SEQ ID NO: 42110 - RNA, 33 nt, Artificial Sequence
  Vigilin (550-560)
aagagcgacaucgugcagcugcgcggccccaag

SEQ ID NO: 42111 - RNA, 30 nt, Artificial Sequence
  Cyclin-dependent kinase-like 5 (680-689)
aagagcgagggcgggguguaccacgacccc

SEQ ID NO: 42112 - RNA, 27 nt, Artificial Sequence
  Clathrin heavy chain 1 (706-714)
aagagcuucgagggccuguucuacuuc

SEQ ID NO: 42113 - RNA, 27 nt, Artificial Sequence
  General transcription factor 3C polypeptide 2 (146-154)
aagagcaaggccgagcugcuccugcug

SEQ ID NO: 42114 - RNA, 33 nt, Artificial Sequence
  Calcyclin-binding protein (33-43)
aagagcaagaucgagaccgagaucaagaacaag

SEQ ID NO: 42115 - RNA, 27 nt, Artificial Sequence
  Dol-P-Glc:Glc(2)Man(9)GlcNAc(2)-PP-Dol alpha-1,2-glucosyltransferase (389-397)
aagagcaaguccaucuucuggaaccug

SEQ ID NO: 42116 - RNA, 27 nt, Artificial Sequence
  Leucine-rich repeat-containing protein 40 (210-218)
aagagccugcccgccgagaucaaccgc

SEQ ID NO: 42117 - RNA, 27 nt, Artificial Sequence
  Solute carrier family 7 member 13 (416-424)
aagagccccaacgugcacuacgucuac

SEQ ID NO: 42118 - RNA, 27 nt, Artificial Sequence
  Aromatase (99-107)
aagagcuccagcauguuccacaucaug

SEQ ID NO: 42119 - RNA, 27 nt, Artificial Sequence
  Thromboxane-A synthase (118-126)
aagagcguggccgacuccguccuguuc

SEQ ID NO: 42120 - RNA, 33 nt, Artificial Sequence
  Hypoxia up-regulated protein 1 (249-259)
aagaccaaggaggccggcaugcagccccagcug

SEQ ID NO: 42121 - RNA, 30 nt, Artificial Sequence
  Translin (76-85)
aagaccaaguuccccgccgagcaguacuac

SEQ ID NO: 42122 - RNA, 27 nt, Artificial Sequence
  RNA-binding protein PNO1 (189-197)
aagaccaaguucaccaucgagaacgug

SEQ ID NO: 42123 - RNA, 27 nt, Artificial Sequence
  DNA damage-binding protein 1 (915-923)
aagaccaagggcgacuucauccuggug

SEQ ID NO: 42124 - RNA, 27 nt, Artificial Sequence
  N-acetylgalactosamine kinase (102-110)
aagaccaagccccuguggcacaacuac

SEQ ID NO: 42125 - RNA, 27 nt, Artificial Sequence
  Splicing factor 3B subunit 3 (294-302)
aagaccaagagcauguucuucuuccug

SEQ ID NO: 42126 - RNA, 36 nt, Artificial Sequence
  Heterogeneous nuclear ribonucleoproteins A2/B1 (3-14)
aagacccuggagaccgugccccucgagcgcaagaag

SEQ ID NO: 42127 - RNA, 27 nt, Artificial Sequence
  ADP-ribosylation factor-like protein 11 (25-33)
aagaccacccugcucuacaagcugaag

SEQ ID NO: 42128 - RNA, 27 nt, Artificial Sequence
  Catenin alpha-2 (794-802)
aaggugaaggccgagguccagaaccug

SEQ ID NO: 42129 - RNA, 27 nt, Artificial Sequence
  Serine/threonine-protein phosphatase 2A 65 kDa regulatory subunit A alpha isoform (305-313)
aaggugaaggaguucugcgagaaccug

SEQ ID NO: 42130 - RNA, 27 nt, Artificial Sequence
  Septin-7 (364-372)
aaggugaaggagaagguccagaagcug

SEQ ID NO: 42131 - RNA, 27 nt, Artificial Sequence
  Kelch-like protein 24 (128-136)
aaggugaagaucaccaccgagaacguc

SEQ ID NO: 42132 - RNA, 33 nt, Artificial Sequence
  Ubiquitin-40S ribosomal protein S27a (97-107)
aaggugaagcuggccguccucaaguacuacaag

SEQ ID NO: 42133 - RNA, 30 nt, Artificial Sequence
  Thioredoxin-like protein 4A (51-60)
aaggugaagaacuucgccgucaucuaccug

SEQ ID NO: 42134 - RNA, 27 nt, Artificial Sequence
  FACT complex subunit SPT16 (424-432)
aaggugaagaacgucggcaucuuccug

SEQ ID NO: 42135 - RNA, 30 nt, Artificial Sequence
  Peptidylprolyl isomerase domain and WD repeat-containing protein 1 (65-74)
aaggugcuggaguucgagcgcgucuaccuc

SEQ ID NO: 42136 - RNA, 30 nt, Artificial Sequence
  Exocyst complex component 4 (568-577)
aaggugcugggcguccagcgcccccuccug

SEQ ID NO: 42137 - RNA, 30 nt, Artificial Sequence
  60S ribosomal protein L15 (5-14)
aaguacauccaggagcuguggcgcaagaag

SEQ ID NO: 42138 - RNA, 27 nt, Artificial Sequence
  Proto-oncogene vav (272-280)
aaguacaaggagcgcuuccugguguac

SEQ ID NO: 42139 - RNA, 30 nt, Artificial Sequence
  60S ribosomal protein L35 (77-86)
aaguacaagccccuggaccuccgcccgaag

SEQ ID NO: 42140 - RNA, 36 nt, Artificial Sequence
  Protein mab-21-like 3 (2-13)
aaguaccugaccgugggcgaccucgaggacugccug

SEQ ID NO: 42141 - RNA, 27 nt, Artificial Sequence
  Protein archease (35-43)
aaguaccccccggugaaccgcaaguac

SEQ ID NO: 42142 - RNA, 27 nt, Artificial Sequence
  RNA-binding protein 42 (445-453)
aaguacgugggcagccgccccaucaag

SEQ ID NO: 42143 - RNA, 27 nt, Artificial Sequence
  Suppressor of tumorigenicity 7 protein-like (66-74)
cuggccgccgugaccgucuuccucaac

SEQ ID NO: 42144 - RNA, 27 nt, Artificial Sequence
  Cytochrome c oxidase assembly protein COX14 (7-15)
cuggccgacaucggcuacaagaccuuc

SEQ ID NO: 42145 - RNA, 30 nt, Artificial Sequence
  Serine/arginine repetitive matrix protein 2 (2256-2265)
cuggccgacagccgcacccccgccgcggcc

SEQ ID NO: 42146 - RNA, 27 nt, Artificial Sequence
  Neutral amino acid transporter A (75-83)
cuggccuuccccggcgagaugcuccug

SEQ ID NO: 42147 - RNA, 27 nt, Artificial Sequence
  Apolipoprotein B receptor (1069-1077)
cuggcccaccccggcaugaugcaggag

SEQ ID NO: 42148 - RNA, 30 nt, Artificial Sequence
  Dystrophin-related protein 2 (299-308)
cuggccaucagcgacgugcaccucuccaug

SEQ ID NO: 42149 - RNA, 27 nt, Artificial Sequence
  Microtubule-associated protein 4 (558-566)
cuggccaaggacggcgugcucacccug

SEQ ID NO: 42150 - RNA, 27 nt, Artificial Sequence
  Renin receptor (203-211)
cuggccaaggaccacagccccgaccuc

SEQ ID NO: 42151 - RNA, 27 nt, Artificial Sequence
  Minor histocompatibility antigen H13 (335-343)
cuggccaagggcgaggugaccgagaug

SEQ ID NO: 42152 - RNA, 27 nt, Artificial Sequence
  Nectin-1 (16-24)
cuggcccucggccugaccgccuucuuc

SEQ ID NO: 42153 - RNA, 33 nt, Artificial Sequence
  Heterogeneous nuclear ribonucleoprotein M (609-619)
cuggccaugggcgggggcgggggcgccagcuuc

SEQ ID NO: 42154 - RNA, 30 nt, Artificial Sequence
  Golgin subfamily A member 3 (204-213)
cuggccaugaccaaggaguacagcuuccuc

SEQ ID NO: 42155 - RNA, 27 nt, Artificial Sequence
  Thioredoxin-interacting protein (222-230)
cuggccaacggccagaccaaggugcuc

SEQ ID NO: 42156 - RNA, 33 nt, Artificial Sequence
  Orexin receptor type 1 (225-235)
cuggccccccucggccugauggccauggcguac

SEQ ID NO: 42157 - RNA, 27 nt, Artificial Sequence
  Dynein heavy chain 6, axonemal (1621-1629)
cuggcccgcaagaugacccagauguac

SEQ ID NO: 42158 - RNA, 27 nt, Artificial Sequence
  Nucleolar protein 16 (58-66)
cuggccguggaccccaaccgcgccguc

SEQ ID NO: 42159 - RNA, 27 nt, Artificial Sequence
  Ectonucleoside triphosphate diphosphohydrolase 1 (33-41)
cuggccgugggccucacccagaacaag

SEQ ID NO: 42160 - RNA, 27 nt, Artificial Sequence
  60S ribosomal protein L29 (96-104)
cuggccuacaucgcccaccccaagcuc

SEQ ID NO: 42161 - RNA, 27 nt, Artificial Sequence
  Potassium-transporting ATPase alpha chain 2 (598-606)
cugugcuucgugggccuccugagcaug

SEQ ID NO: 42162 - RNA, 30 nt, Artificial Sequence
  Eukaryotic translation initiation factor 3 subunit C-like protein (635-644)
cuggacauccagagcuccggccgcgccaag

SEQ ID NO: 42163 - RNA, 27 nt, Artificial Sequence
  Cullin-7 (163-171)
cuggaccuccugaugcacaugcugagc

SEQ ID NO: 42164 - RNA, 27 nt, Artificial Sequence
  Sodium-driven chloride bicarbonate exchanger (854-862)
cuggaccuccugaugguggccgucaug

SEQ ID NO: 42165 - RNA, 27 nt, Artificial Sequence
  Fibrillin-3 (2702-2710)
cuggacagcgaggcccuccugacccug

SEQ ID NO: 42166 - RNA, 27 nt, Artificial Sequence
  Uncharacterized protein C9orf171 (285-293)
cuggacaccuuccccaccgaggccgac

SEQ ID NO: 42167 - RNA, 30 nt, Artificial Sequence
  Ankyrin repeat and LEM domain-containing protein 1 (184-193)
cuggaggccgaccccggcccgcccagccuc

SEQ ID NO: 42168 - RNA, 24 nt, Artificial Sequence
  Core histone macro-H2A.1 (61-68)
cuggagcucgccggcaacgccgcg

SEQ ID NO: 42169 - RNA, 27 nt, Artificial Sequence
  Alpha-mannosidase 2x (1106-1114)
cuguuccacggccucgacguggucuuc

SEQ ID NO: 42170 - RNA, 27 nt, Artificial Sequence
  Vasohibin-2 (48-56)
cuguuccacgugaacaagagcggcuuc

SEQ ID NO: 42171 - RNA, 27 nt, Artificial Sequence
  Pre-mRNA-processing factor 17 (418-426)
cugggcgccgugaacaccaucgucuuc

SEQ ID NO: 42172 - RNA, 27 nt, Artificial Sequence
  Pumilio homolog 1 (673-681)
cugggcuucgggagcuccagcucccuc

SEQ ID NO: 42173 - RNA, 27 nt, Artificial Sequence
  Putative nuclease HARBI1 (77-85)
cugggcuucuacaccagcggguccuuc

SEQ ID NO: 42174 - RNA, 30 nt, Artificial Sequence
  Hyaluronidase-4 (205-214)
cugggcaucaagagccgccccaaggggcuc

SEQ ID NO: 42175 - RNA, 30 nt, Artificial Sequence
  NF-kappa-B-repressing factor (591-600)
cugggccucgacguggagcgcgucaacaag

SEQ ID NO: 42176 - RNA, 27 nt, Artificial Sequence
  G-protein coupled receptor family C group 6 member A (447-455)
cugggcgugcucaagaacgucaccuuc

SEQ ID NO: 42177 - RNA, 27 nt, Artificial Sequence
  L-xylulose reductase (27-35)
cugcacgccaccggcgcccgcgugguc

SEQ ID NO: 42178 - RNA, 27 nt, Artificial Sequence
  Sterol regulatory element-binding protein 1 (1037-1045)
cugcacgaggccaccgcccgccucaug

SEQ ID NO: 42179 - RNA, 27 nt, Artificial Sequence
  U3 small nucleolar ribonucleoprotein protein MPP10 (405-413)
cugcacuucgaccacgccgugcgcaug

SEQ ID NO: 42180 - RNA, 27 nt, Artificial Sequence
  Nucleoporin Nup43 (101-109)
cugcaccaccccaacaaccagacccuc

SEQ ID NO: 42181 - RNA, 27 nt, Artificial Sequence
  Delta(14)-sterol reductase (279-287)
cugcaccacccccagccgcucggccug

SEQ ID NO: 42182 - RNA, 27 nt, Artificial Sequence
  Phospholipid-transporting ATPase ID (589-597)
cugcaccacagcacccaggagcuccug

SEQ ID NO: 42183 - RNA, 30 nt, Artificial Sequence
  Neuron navigator 3 (2128-2137)
cugcaccacgugggcagccucuccgacauc

SEQ ID NO: 42184 - RNA, 27 nt, Artificial Sequence
  GTP-binding protein 1 (551-559)
cugcacaucgaccagcgccucguguuc

SEQ ID NO: 42185 - RNA, 27 nt, Artificial Sequence
  Cyclin-I (151-159)
cugcacaucuuccacgccaucgccgug

SEQ ID NO: 42186 - RNA, 27 nt, Artificial Sequence
  Thioredoxin domain-containing protein 9 (138-146)
cugcacaucaaggugauccccacccuc

SEQ ID NO: 42187 - RNA, 27 nt, Artificial Sequence
  Myb-binding protein 1A (438-446)
cugcacaugcccgagcgcgccguguuc

SEQ ID NO: 42188 - RNA, 27 nt, Artificial Sequence
  Probable ATP-dependent RNA helicase DDX56 (212-220)
cugcacaaccccgugacccucaagcug

SEQ ID NO: 42189 - RNA, 27 nt, Artificial Sequence
  Gem-associated protein 5 (107-115)
cugcaccagcacaccaucagcacccuc

SEQ ID NO: 42190 - RNA, 27 nt, Artificial Sequence
  G patch domain-containing protein 8 (828-836)
cugcaccagaagagccccucccaguac

SEQ ID NO: 42191 - RNA, 27 nt, Artificial Sequence
  Actin-binding LIM protein 1 (664-672)
cugcaccgccccgugagcaccgacuuc

SEQ ID NO: 42192 - RNA, 27 nt, Artificial Sequence
  Cytochrome c oxidase subunit 2 (160-168)
cugcacagcugggccgugcccacccuc

SEQ ID NO: 42193 - RNA, 27 nt, Artificial Sequence
  IQ motif and SEC7 domain-containing protein 1 (263-271)
cugcacaccgaggaggcccccgcccuc

SEQ ID NO: 42194 - RNA, 27 nt, Artificial Sequence
  Selenoprotein S (22-30)
cugcacaccaccgugggcagccuccug

SEQ ID NO: 42195 - RNA, 27 nt, Artificial Sequence
  Plectin (1023-1031)
cugcacguggacaugaagagccuccug

SEQ ID NO: 42196 - RNA, 27 nt, Artificial Sequence
  Unconventional myosin-Ih (186-194)
cugaucgagaagagccgcguggucuac

SEQ ID NO: 42197 - RNA, 33 nt, Artificial Sequence
  Heat shock 70 kDa protein 1-like (198-208)
cugaucuucgaccucggcgggggcaccuucgac

SEQ ID NO: 42198 - RNA, 27 nt, Artificial Sequence
  DnaJ homolog subfamily C member 13 (1046-1054)
cugauccucaacaugcugaucaccaug

SEQ ID NO: 42199 - RNA, 27 nt, Artificial Sequence
  Probable ATP-dependent RNA helicase DDX59 (275-283)
cugauccucacccccacccgcgagcug

SEQ ID NO: 42200 - RNA, 27 nt, Artificial Sequence
  Integrin beta-7 (381-389)
cugaucauggacgccuacaacagccuc

SEQ ID NO: 42201 - RNA, 27 nt, Artificial Sequence
  Leucine-rich repeat and fibronectin type-III domain-containing protein 4 (447-455)
cugaucuaccgcaucgugcccgccagc

SEQ ID NO: 42202 - RNA, 27 nt, Artificial Sequence
  Protein disulfide-isomerase A2 (328-336)
cugaaggccgaggccgcgcccacccuc

SEQ ID NO: 42203 - RNA, 27 nt, Artificial Sequence
  Mini-chromosome maintenance complex-binding protein (430-438)
cugaaguucaucccccacaaggacuac

SEQ ID NO: 42204 - RNA, 27 nt, Artificial Sequence
  RNA-binding protein 8A (113-121)
cugaagggcuacacccucguggaguac

SEQ ID NO: 42205 - RNA, 27 nt, Artificial Sequence
  Mannosyl-oligosaccharide glucosidase (326-334)
cugaagauccccaucagcaucgaguuc

SEQ ID NO: 42206 - RNA, 27 nt, Artificial Sequence
  ER membrane protein complex subunit 1 (411-419)
cugaagaaggacgacagcgugggcuac

SEQ ID NO: 42207 - RNA, 33 nt, Artificial Sequence
  DENN domain-containing protein 4C (704-714)
cugaagcucuucgaccgcccccaggagcugaag

SEQ ID NO: 42208 - RNA, 27 nt, Artificial Sequence
  Eukaryotic translation initiation factor 3 subunit D (447-455)
cugaagcucggcuacgugagccgcuac

SEQ ID NO: 42209 - RNA, 27 nt, Artificial Sequence
  Serine/threonine-protein kinase PAK 2 (301-309)
cugaagaaccccaacaucgugaacuuc

SEQ ID NO: 42210 - RNA, 27 nt, Artificial Sequence
  Elongation factor 1-alpha 1 (272-280)
cugaagcccggcaugguggucaccuuc

SEQ ID NO: 42211 - RNA, 27 nt, Artificial Sequence
  X-ray repair cross-complementing protein 6 (281-289)
cugaagcccccgcccaucaagcucuac

SEQ ID NO: 42212 - RNA, 27 nt, Artificial Sequence
  Choline/ethanolaminephosphotransferase 1 (48-56)
cugaagcgccucgaggagcaccgguac

SEQ ID NO: 42213 - RNA, 27 nt, Artificial Sequence
  Renin receptor (22-30)
cugaagagccccggcuccguggucuuc

SEQ ID NO: 42214 - RNA, 27 nt, Artificial Sequence
  Nucleolin (323-331)
cugaagaccggcaucagcgacguguuc

SEQ ID NO: 42215 - RNA, 27 nt, Artificial Sequence
  26S protease regulatory subunit 7 (33-41)
cugaagaccuacggccagagcaccuac

SEQ ID NO: 42216 - RNA, 24 nt, Artificial Sequence
  60S ribosomal protein L19 (125-132)
cugaaggugaagggcaacgucuuc

SEQ ID NO: 42217 - RNA, 27 nt, Artificial Sequence
  Forkhead box protein O3 (93-101)
cugcucgaggacagcgcccgcgugcug

SEQ ID NO: 42218 - RNA, 27 nt, Artificial Sequence
  Dynein heavy chain 9, axonemal (368-376)
cugcucauccagcaggccagcaacuac

SEQ ID NO: 42219 - RNA, 33 nt, Artificial Sequence
  Dynein heavy chain 10, axonemal (1334-1344)
cugcuccuggaccugaagaacgaggcccuccgc

SEQ ID NO: 42220 - RNA, 27 nt, Artificial Sequence
  ER membrane protein complex subunit 3 (6-14)
cugcuccuggacagcaacauccgccug

SEQ ID NO: 42221 - RNA, 27 nt, Artificial Sequence
  Echinoderm microtubule-associated protein-like 4 (278-286)
cugcuccccaccggcaagaucguguac

SEQ ID NO: 42222 - RNA, 27 nt, Artificial Sequence
  Chromodomain-helicase-DNA-binding protein 2 (628-636)
cugcucuacaagacccugaucgacuuc

SEQ ID NO: 42223 - RNA, 27 nt, Artificial Sequence
  Integrator complex subunit 10 (519-527)
cugaugugcuacauggugcuccccauc

SEQ ID NO: 42224 - RNA, 33 nt, Artificial Sequence
  Melatonin receptor type 1A (106-116)
cugaugggccucagcgugaucggguccaucuuc

SEQ ID NO: 42225 - RNA, 27 nt, Artificial Sequence
  DNA-dependent protein kinase catalytic subunit (2219-2227)
cugaugaagcacguguuccaccccaag

SEQ ID NO: 42226 - RNA, 33 nt, Artificial Sequence
  Eukaryotic translation initiation factor 3 subunit H (211-221)
cugaugugggagcucgagaagaagagcgccgug

SEQ ID NO: 42227 - RNA, 27 nt, Artificial Sequence
  CTP synthase 2 (334-342)
cugauguacaucgacagcaucgaccuc

SEQ ID NO: 42228 - RNA, 27 nt, Artificial Sequence
  Ubiquitin-like modifier-activating enzyme ATG7 (128-136)
cugaacaaguuccuccugcugaccuuc

SEQ ID NO: 42229 - RNA, 30 nt, Artificial Sequence
  Carboxy-terminal domain RNA polymerase II polypeptide A small phosphatase 1 (54-63)
cugcccgcccacagcggcgccccgcuccug

SEQ ID NO: 42230 - RNA, 27 nt, Artificial Sequence
  Neutrophil cytosol factor 4 (89-97)
cugcccgccaagguguacgucggcgug

SEQ ID NO: 42231 - RNA, 27 nt, Artificial Sequence
  GPI transamidase component PIG-T (430-438)
cugcccgccaacagcgugaccaagguc

SEQ ID NO: 42232 - RNA, 27 nt, Artificial Sequence
  Tyrosine-protein phosphatase non-receptor type 12 (677-685)
cugcccgagcgcaccccggagagcuuc

SEQ ID NO: 42233 - RNA, 27 nt, Artificial Sequence
  Collagen alpha-2(IV) chain (385-393)
cugcccggcccgcccgggcucagcauc

SEQ ID NO: 42234 - RNA, 27 nt, Artificial Sequence
  DDB1- and CUL4-associated factor 13 (548-556)
cugcccaagagcaucuacucccagauc

SEQ ID NO: 42235 - RNA, 27 nt, Artificial Sequence
  Interferon regulatory factor 2-binding protein-like (271-279)
cugcccccgccccccccccacgcccuc

SEQ ID NO: 42236 - RNA, 27 nt, Artificial Sequence
  Neutral amino acid transporter A (142-150)
cugcccacccacgaccucccgcugauc

SEQ ID NO: 42237 - RNA, 24 nt, Artificial Sequence
  General transcription factor 3C polypeptide 2 (665-672)
cugcccuacaacggcgugaccguc

SEQ ID NO: 42238 - RNA, 27 nt, Artificial Sequence
  Signal peptidase complex catalytic subunit SEC11C (158-166)
cugcccuacgugggcauggucaccauc

SEQ ID NO: 42239 - RNA, 27 nt, Artificial Sequence
  WD repeat-containing protein 34 (423-431)
cugcaggcccccccgcucaccagccug

SEQ ID NO: 42240 - RNA, 27 nt, Artificial Sequence
  Protein unc-13 homolog C (117-125)
cugcaggagcucagcuccaucgagagc

SEQ ID NO: 42241 - RNA, 27 nt, Artificial Sequence
  TBC1 domain family member 4 (1186-1194)
cugcaggagagcuccuacagcugcgag

SEQ ID NO: 42242 - RNA, 30 nt, Artificial Sequence
  WD repeat-containing protein 82 (288-297)
cugcaguucaaccccaaguucaugaccuuc

SEQ ID NO: 42243 - RNA, 33 nt, Artificial Sequence
  Serine/threonine-protein kinase RIO2 (521-531)
cugcagaagggcgaggccaacaucuucaccaag

SEQ ID NO: 42244 - RNA, 30 nt, Artificial Sequence
  WAS protein family homolog 1 (40-49)
cugcagaaggugagcggcgacaucuucucc

SEQ ID NO: 42245 - RNA, 27 nt, Artificial Sequence
  Tubulin beta chain (42-50)
cugcagcucgaccgcaucagcguguac

SEQ ID NO: 42246 - RNA, 27 nt, Artificial Sequence
  Tubulin beta-4B chain (42-50)
cugcagcucgagcgcaucaacguguac

SEQ ID NO: 42247 - RNA, 27 nt, Artificial Sequence
  Acyl-coenzyme A synthetase ACSM5, mitochondrial (112-120)
cugcagcccggcgaccgcaugaugcuc

SEQ ID NO: 42248 - RNA, 27 nt, Artificial Sequence
  GPI transamidase component PIG-T (58-66)
cugcagcgcgagggcgugagccacuac

SEQ ID NO: 42249 - RNA, 27 nt, Artificial Sequence
  Splicing factor 1 (254-262)
cugcgcgaggacgacaaccggauccuc

SEQ ID NO: 42250 - RNA, 27 nt, Artificial Sequence
  FH1/FH2 domain-containing protein 1 (1156-1164)
cugagcaagggccccgggcucgaggug

SEQ ID NO: 42251 - RNA, 30 nt, Artificial Sequence
  Phosphatidylethanolamine-binding protein 1 (5-14)
cugagcaagugguccggcccccucagccug

SEQ ID NO: 42252 - RNA, 24 nt, Artificial Sequence
  FYVE, RhoGEF and PH domain-containing protein 5 (524-531)
cugagccucgagggcaagccccug

SEQ ID NO: 42253 - RNA, 27 nt, Artificial Sequence
  Cilia- and flagella-associated protein 54 (689-697)
cugagcaugcucaaguccaugcugcug

SEQ ID NO: 42254 - RNA, 27 nt, Artificial Sequence
  Alpha-ketoglutarate-dependent dioxygenase alkB homolog 7, mitochondrial (104-112)
cugagcuccgugcacguccucgaccug

SEQ ID NO: 42255 - RNA, 27 nt, Artificial Sequence
  WD repeat-containing protein 7 (683-691)
cugaccgaccccgacauccacgugcuc

SEQ ID NO: 42256 - RNA, 27 nt, Artificial Sequence
  Transcription factor SOX-30 (235-243)
cuggugcacggcagcgccgaggucauc

SEQ ID NO: 42257 - RNA, 27 nt, Artificial Sequence
  60S ribosomal protein L32 (7-15)
cuggugaagcccaagaucgucaagaag

SEQ ID NO: 42258 - RNA, 27 nt, Artificial Sequence
  Probable ATP-dependent RNA helicase DDX41 (390-398)
cuggugaagcccgucaccaucaacgug

SEQ ID NO: 42259 - RNA, 27 nt, Artificial Sequence
  Cationic amino acid transporter 3 (165-173)
cuggugcucaucgucggcuucaccuuc

SEQ ID NO: 42260 - RNA, 27 nt, Artificial Sequence
  Mitogen-activated protein kinase kinase kinase 10 (901-909)
cuggugagcuucggccgcacccucacc

SEQ ID NO: 42261 - RNA, 27 nt, Artificial Sequence
  Glypican-4 (385-393)
cuggugaccgacgucaaggagaagcuc

SEQ ID NO: 42262 - RNA, 27 nt, Artificial Sequence
  Transmembrane protein with metallophosphoesterase domain (414-422)
cuguaccagguggcccaggccaccuuc

SEQ ID NO: 42263 - RNA, 27 nt, Artificial Sequence
  Transcription factor SOX-6 (312-320)
auggccgccgcggccgccagcggccug

SEQ ID NO: 42264 - RNA, 27 nt, Artificial Sequence
  28S ribosomal protein S14, mitochondrial (1-9)
auggccgccuucaugcugggcagccuc

SEQ ID NO: 42265 - RNA, 27 nt, Artificial Sequence
  Steroid 21-hydroxylase (283-291)
auggccgccguggaccugcucaucggc

SEQ ID NO: 42266 - RNA, 27 nt, Artificial Sequence
  XK-related protein 5 (595-603)
auggccgacaucagccccauccugggc

SEQ ID NO: 42267 - RNA, 24 nt, Artificial Sequence
  Histone-binding protein RBBP4 (1-8)
auggccgacaaggaggccgcguuc

SEQ ID NO: 42268 - RNA, 27 nt, Artificial Sequence
  N-acetylated-alpha-linked acidic dipeptidase 2 (1-9)
auggccgagagccgcggccggcuguac

SEQ ID NO: 42269 - RNA, 27 nt, Artificial Sequence
  Mucin-17 (161-169)
auggccuucgugagcaccgccccccug

SEQ ID NO: 42270 - RNA, 27 nt, Artificial Sequence
  Butyrophilin-like protein 8 (1-9)
auggcccugaugcucagccuggugcug

SEQ ID NO: 42271 - RNA, 30 nt, Artificial Sequence
  Zinc finger protein 28 (1-10)
auggcccugccccagggccuccugaccuuc

SEQ ID NO: 42272 - RNA, 30 nt, Artificial Sequence
  Major facilitator superfamily domain-containing protein 9 (295-304)
auggccauggccgugaugcuguacuacagc

SEQ ID NO: 42273 - RNA, 27 nt, Artificial Sequence
  Splicing factor 3A subunit 1 (775-783)
auggccaacggcgccgugauccaccug

SEQ ID NO: 42274 - RNA, 27 nt, Artificial Sequence
  Small nuclear ribonucleoprotein-associated protein N (189-197)
auggcccccccgcccggcaugcgcccc

SEQ ID NO: 42275 - RNA, 24 nt, Artificial Sequence
  HLA class I histocompatibility antigen, Cw-7 alpha chain (4-11)
auggccccccgcgcccugcuccug

SEQ ID NO: 42276 - RNA, 27 nt, Artificial Sequence
  Coiled-coil domain-containing protein 42A (261-269)
auggccacccugaaccucuuccagauc

SEQ ID NO: 42277 - RNA, 27 nt, Artificial Sequence
  Frizzled-4 (474-482)
auggccguggagaugcugaagaucuuc

SEQ ID NO: 42278 - RNA, 27 nt, Artificial Sequence
  Interferon alpha-inducible protein 6 (45-53)
auggccgugggcgggggccuggccguc

SEQ ID NO: 42279 - RNA, 33 nt, Artificial Sequence
  Thyroid adenoma-associated protein (70-80)
augugcgaccccaccauccagagcugccuggac

SEQ ID NO: 42280 - RNA, 27 nt, Artificial Sequence
  Putative tripartite motif-containing protein 49B (236-244)
augugccacaagcccgacguggagcug

SEQ ID NO: 42281 - RNA, 27 nt, Artificial Sequence
  C-C chemokine receptor type 9 (118-126)
augugcaagguggucaacagcauguac

SEQ ID NO: 42282 - RNA, 27 nt, Artificial Sequence
  Centrosomal protein of 72 kDa (190-198)
auggacgccgacgacgaggccgugcug

SEQ ID NO: 42283 - RNA, 30 nt, Artificial Sequence
  Rho guanine nucleotide exchange factor 12 (1356-1365)
auggaccacaugaucaugacccccgagaug

SEQ ID NO: 42284 - RNA, 27 nt, Artificial Sequence
  Adenosine receptor A2b (219-227)
auggaccacagccgcaccacccugcag

SEQ ID NO: 42285 - RNA, 27 nt, Artificial Sequence
  Protein CREG1 (164-172)
auggacaucgccaagcacagccuguuc

SEQ ID NO: 42286 - RNA, 27 nt, Artificial Sequence
  P2X purinoceptor 7 (140-148)
auggacccccagagcaagggcauccag

SEQ ID NO: 42287 - RNA, 30 nt, Artificial Sequence
  40S ribosomal protein S28 (1-10)
auggacaccagccgcgugcagcccaucaag

SEQ ID NO: 42288 - RNA, 27 nt, Artificial Sequence
  F-box only protein 44 (151-159)
auggacaccacccgccccgacaucgag

SEQ ID NO: 42289 - RNA, 36 nt, Artificial Sequence
  BEN domain-containing protein 7 (1-12)
auggaguucagcgagcgcaagcggucccgcaagagc

SEQ ID NO: 42290 - RNA, 30 nt, Artificial Sequence
  Rho guanine nucleotide exchange factor 11 (1442-1451)
auggagcuggcccaccgcgagcuccugaag

SEQ ID NO: 42291 - RNA, 36 nt, Artificial Sequence
  Nitric oxide synthase, endothelial (1137-1148)
auggagcuggacgaggccggcgacgugaucgggguc

SEQ ID NO: 42292 - RNA, 24 nt, Artificial Sequence
  Pseudouridylate synthase 7 homolog (1-8)
auggagaugaccgagaugaccggc

SEQ ID NO: 42293 - RNA, 27 nt, Artificial Sequence
  Lethal(3)malignant brain tumor-like protein 3 (52-60)
auggagaacgugaagaaggccaccgcc

SEQ ID NO: 42294 - RNA, 36 nt, Artificial Sequence
  Heme oxygenase 1 (1-12)
auggagcgcccccagccggacagcaugccccaggac

SEQ ID NO: 42295 - RNA, 27 nt, Artificial Sequence
  Metalloreductase STEAP2 (1-9)
auggagagcaucuccaugaugggcagc

SEQ ID NO: 42296 - RNA, 27 nt, Artificial Sequence
  CD97 antigen (1-9)
augggcgggcgcguguuccuggccuuc

SEQ ID NO: 42297 - RNA, 30 nt, Artificial Sequence
  Putative uncharacterized protein ENSP00000381562 (1-10)
augggcagcauccccuccaagccgugcaac

SEQ ID NO: 42298 - RNA, 27 nt, Artificial Sequence
  Ubiquitin carboxyl-terminal hydrolase isozyme L3 (111-119)
augcacuucgagagcggcuccacccug

SEQ ID NO: 42299 - RNA, 27 nt, Artificial Sequence
  Complex I assembly factor TMEM126B, mitochondrial (35-43)
augcacggccagcccagcccgucccug

SEQ ID NO: 42300 - RNA, 27 nt, Artificial Sequence
  Transmembrane protein 114 (102-110)
augcacggcaccuucgugauccugcuc

SEQ ID NO: 42301 - RNA, 30 nt, Artificial Sequence
  Leucine-twenty homeobox (1-10)
augcaccccagccuggccaccaugggcaag

SEQ ID NO: 42302 - RNA, 27 nt, Artificial Sequence
  Protein Tob1 (226-234)
augcacagccuguacggccucgggcug

SEQ ID NO: 42303 - RNA, 27 nt, Artificial Sequence
  Deoxyribonuclease-1-like 1 (1-9)
augcacuaccccaccgcccugcucuuc

SEQ ID NO: 42304 - RNA, 27 nt, Artificial Sequence
  Neuronal acetylcholine receptor subunit alpha-4 (314-322)
augaucuucgugacccugagcaucguc

SEQ ID NO: 42305 - RNA, 27 nt, Artificial Sequence
  Eukaryotic translation initiation factor 3 subunit L (359-367)
augaucaacaagcagaacgagcagaug

SEQ ID NO: 42306 - RNA, 30 nt, Artificial Sequence
  Lysosomal protective protein (1-10)
augauccgcgccgcccccccgccccuguuc

SEQ ID NO: 42307 - RNA, 30 nt, Artificial Sequence
  60S ribosomal protein L18a (1-10)
augaaggccagcggcacccugcgcgaguac

SEQ ID NO: 42308 - RNA, 27 nt, Artificial Sequence
  Lymphocyte antigen 86 (1-9)
augaagggcuucaccgccacccuguuc

SEQ ID NO: 42309 - RNA, 27 nt, Artificial Sequence
  Sodium-coupled neutral amino acid transporter 5 (188-196)
augaagcaccugggcuaccucggguac

SEQ ID NO: 42310 - RNA, 27 nt, Artificial Sequence
  Neurexin-3 (694-702)
augaagaucaucaugcccauggugaug

SEQ ID NO: 42311 - RNA, 27 nt, Artificial Sequence
  Dentin matrix acidic phosphoprotein 1 (1-9)
augaagaucagcauccugcucauguuc

SEQ ID NO: 42312 - RNA, 27 nt, Artificial Sequence
  Sarcoplasmic/endoplasmic reticulum calcium ATPase 2 (479-487)
augaagaaggaguucacccuggaguuc

SEQ ID NO: 42313 - RNA, 30 nt, Artificial Sequence
  60S ribosomal protein L18a (54-63)
augaagaagagcuccggcgagaucguguac

SEQ ID NO: 42314 - RNA, 27 nt, Artificial Sequence
  Lysine-tRNA ligase (406-414)
augaagcugcccgagaccaaccucuuc

SEQ ID NO: 42315 - RNA, 30 nt, Artificial Sequence
  Glucose-fructose oxidoreductase domain-containing protein 2 (1-10)
augaagaugcugcccggcgugggggucuuc

SEQ ID NO: 42316 - RNA, 27 nt, Artificial Sequence
  Striatin-interacting protein 1 (733-741)
augaagaccaugagcgccaucuaccag

SEQ ID NO: 42317 - RNA, 27 nt, Artificial Sequence
  Zinc finger protein 425 (38-46)
augaagaccaacuacgagacccuggac

SEQ ID NO: 42318 - RNA, 27 nt, Artificial Sequence
  Peptidyl-prolyl cis-trans isomerase B (9-17)
augaaggugcugcucgccgccgcgcug

SEQ ID NO: 42319 - RNA, 27 nt, Artificial Sequence
  Protein tyrosine phosphatase type IVA 1 (124-132)
augaaguacgaggacgccgugcaguuc

SEQ ID NO: 42320 - RNA, 33 nt, Artificial Sequence
  Transmembrane protein 50A (102-112)
augcuggccuucggcagccucaucgccuccaug

SEQ ID NO: 42321 - RNA, 33 nt, Artificial Sequence
  Inactive phospholipase C-like protein 1 (259-269)
augcuggaggacaccagcguggagcucaucaag

SEQ ID NO: 42322 - RNA, 30 nt, Artificial Sequence
  Tyrosine-protein phosphatase non-receptor type 2 (134-143)
augcuguucaaggagaccggcuucagcgug

SEQ ID NO: 42323 - RNA, 36 nt, Artificial Sequence
  SPARC-related modular calcium-binding protein 1 (1-12)
augcugcccgcccgcugcgcccggcuccugaccccg

SEQ ID NO: 42324 - RNA, 27 nt, Artificial Sequence
  E3 ubiquitin-protein ligase TRIM22 (248-256)
augcugcaggacgugaucgacgucaug

SEQ ID NO: 42325 - RNA, 27 nt, Artificial Sequence
  Condensin complex subunit 1 (56-64)
augcugcagcacuucgacaccaucuac

SEQ ID NO: 42326 - RNA, 27 nt, Artificial Sequence
  Fibronectin (1-9)
augcugcgcggccccgggccgggccuc

SEQ ID NO: 42327 - RNA, 27 nt, Artificial Sequence
  Protein S100-A8 (1-9)
augcugaccgagcucgagaaggcccug

SEQ ID NO: 42328 - RNA, 30 nt, Artificial Sequence
  NACHT, LRR and PYD domains-containing protein 4 (169-178)
augauggccuggagcgacaacaagaucuuc

SEQ ID NO: 42329 - RNA, 27 nt, Artificial Sequence
  Eukaryotic translation initiation factor 4 gamma 1 (88-96)
augaugauccccagccagaucuccuac

SEQ ID NO: 42330 - RNA, 27 nt, Artificial Sequence
  Olfactory receptor 4K1 (112-120)
augaugcugcucguggccauggccuac

SEQ ID NO: 42331 - RNA, 30 nt, Artificial Sequence
  BUB3-interacting and GLEBS motif-containing protein ZNF207 (185-194)
augaugcccaugggcgggaugaugccgccc

SEQ ID NO: 42332 - RNA, 24 nt, Artificial Sequence
  C-myc promoter-binding protein (618-625)
augaugaccaagacccagauguuc

SEQ ID NO: 42333 - RNA, 24 nt, Artificial Sequence
  Protein SSX4 (1-8)
augaacggcgacgacgccuucgcc

SEQ ID NO: 42334 - RNA, 24 nt, Artificial Sequence
  Putative uncharacterized protein ENSP00000383407 (1-8)
augaaccuguucugcaucagccuc

SEQ ID NO: 42335 - RNA, 33 nt, Artificial Sequence
  Coiled-coil domain-containing protein 127 (1-11)
augaacaaccugaacgaccccccgaacuggaac

SEQ ID NO: 42336 - RNA, 27 nt, Artificial Sequence
  General transcription factor IIF subunit 1 (417-425)
augcccgccgccaagcgccugcggcuc

SEQ ID NO: 42337 - RNA, 27 nt, Artificial Sequence
  Actin-related protein 2/3 complex subunit 3 (1-9)
augcccgccuaccacagcucccugaug

SEQ ID NO: 42338 - RNA, 27 nt, Artificial Sequence
  Kelch domain-containing protein 10 (360-368)
augcccgagccgguguacuuccacugc

SEQ ID NO: 42339 - RNA, 30 nt, Artificial Sequence
  von Willebrand factor A domain-containing protein 5B2 (1-10)
augcccggccuguacugcccgagcuccugg

SEQ ID NO: 42340 - RNA, 27 nt, Artificial Sequence
  Acid ceramidase (1-9)
augcccggccgcagcugcguggcccug

SEQ ID NO: 42341 - RNA, 24 nt, Artificial Sequence
  Eukaryotic translation initiation factor 2 subunit 1 (223-230)
augcccaucaagaucaaccugauc

SEQ ID NO: 42342 - RNA, 36 nt, Artificial Sequence
  Cytochrome c oxidase subunit 8C, mitochondrial (1-12)
augccccugcuccgcggccggugcccggcccgccgg

SEQ ID NO: 42343 - RNA, 36 nt, Artificial Sequence
  Retrotransposon gag domain-containing protein 1 (964-975)
augccccugaugagcgccauggccuccggcgagaug

SEQ ID NO: 42344 - RNA, 36 nt, Artificial Sequence
  BUB3-interacting and GLEBS motif-containing protein ZNF207 (181-192)
augcccccgggcaugaugcccauggggggcaugaug

SEQ ID NO: 42345 - RNA, 27 nt, Artificial Sequence
  Pre-mRNA-processing-splicing factor 8 (108-116)
augcccugggagcagauccgcgacgug

SEQ ID NO: 42346 - RNA, 27 nt, Artificial Sequence
  Protein diaphanous homolog 2 (733-741)
augcccuacgaggacauccgcaacgug

SEQ ID NO: 42347 - RNA, 27 nt, Artificial Sequence
  Nuclear receptor coactivator 2 (1151-1159)
augcaggaccccaacuuccacaccaug

SEQ ID NO: 42348 - RNA, 27 nt, Artificial Sequence
  Heterogeneous nuclear ribonucleoprotein H (352-360)
augcagcaccgcuacguggagcuguuc

SEQ ID NO: 42349 - RNA, 27 nt, Artificial Sequence
  Myosin-7 (77-85)
augcagcagaaccccccgaaguucgac

SEQ ID NO: 42350 - RNA, 27 nt, Artificial Sequence
  Laminin subunit alpha-2 (1349-1357)
augcgccagagccggaucuccgagauc

SEQ ID NO: 42351 - RNA, 30 nt, Artificial Sequence
  Toll-like receptor 3 (1-10)
augcgccagacccugcccugcaucuacuuc

SEQ ID NO: 42352 - RNA, 24 nt, Artificial Sequence
  Transmembrane channel-like protein 2 (170-177)
augcgcagcaagcccuggccgaug

SEQ ID NO: 42353 - RNA, 27 nt, Artificial Sequence
  Clathrin coat assembly protein AP180 (156-164)
augcgcaccauggcccccgagaagcug

SEQ ID NO: 42354 - RNA, 27 nt, Artificial Sequence
  Glucose-6-phosphate translocase (266-274)
augagcgcccuggaggugggcgggcuc

SEQ ID NO: 42355 - RNA, 24 nt, Artificial Sequence
  RING finger protein 148 (1-8)
augagcuuccugcgcaucaccccc

SEQ ID NO: 42356 - RNA, 27 nt, Artificial Sequence
  Nesprin-1 (4697-4705)
augagcaaggugcccaccgaccuggcc

SEQ ID NO: 42357 - RNA, 24 nt, Artificial Sequence
  Zinc finger protein ZFPM2 (1-8)
augagccgccggaagcaguccaag

SEQ ID NO: 42358 - RNA, 27 nt, Artificial Sequence
  Cerebral dopamine neurotrophic factor (103-111)
augagcgugcacaugcccgccaugaag

SEQ ID NO: 42359 - RNA, 27 nt, Artificial Sequence
  Heat shock protein 105 kDa (1-9)
augagcguggucggccuggacgugggg

SEQ ID NO: 42360 - RNA, 27 nt, Artificial Sequence
  Solute carrier family 35 member E2B (144-152)
augaccaugcuguucgugggccucaug

SEQ ID NO: 42361 - RNA, 27 nt, Artificial Sequence
  Integrin beta-7 (1-9)
augguggcccugcccaugguccucgug

SEQ ID NO: 42362 - RNA, 30 nt, Artificial Sequence
  Testis- and ovary-specific PAZ domain-containing protein 1 (583-592)
auggugaucaaggagcccaucaucaaggac

SEQ ID NO: 42363 - RNA, 24 nt, Artificial Sequence
  Transmembrane and coiled-coil domain-containing protein 1 (85-92)
auggugcgcaugaagagcauguuc

SEQ ID NO: 42364 - RNA, 24 nt, Artificial Sequence
  Vomeronasal type-1 receptor 3 (279-286)
auggugagccccuucguccugaug

SEQ ID NO: 42365 - RNA, 27 nt, Artificial Sequence
  Receptor expression-enhancing protein 2 (1-9)
auggugagcuggaucaucucccgccug

SEQ ID NO: 42366 - RNA, 27 nt, Artificial Sequence
  Secretogranin-1 (32-40)
auggugacccgcugcaucaucgagguc

SEQ ID NO: 42367 - RNA, 30 nt, Artificial Sequence
  Protocadherin-19 (125-134)
aacgcccccagcuucccggccgcgcagauc

SEQ ID NO: 42368 - RNA, 27 nt, Artificial Sequence
  Exportin-6 (750-758)
aaccacgccagccugaucuccgcccuc

SEQ ID NO: 42369 - RNA, 27 nt, Artificial Sequence
  Olfactomedin-like protein 2B (387-395)
aaccacgccagcgugggccccacccug

SEQ ID NO: 42370 - RNA, 27 nt, Artificial Sequence
  Serine-protein kinase ATM (1801-1809)
aaccacgacaucuggaucaagacccug

SEQ ID NO: 42371 - RNA, 36 nt, Artificial Sequence
  Histone-binding protein RBBP4 (122-133)
aaccacgagggcgaggugaaccgcgcccgguacaug

SEQ ID NO: 42372 - RNA, 27 nt, Artificial Sequence
  WD repeat-containing protein 6 (772-780)
aaccacaucagcuccgugcgcgccguc

SEQ ID NO: 42373 - RNA, 27 nt, Artificial Sequence
  Integrator complex subunit 3 (462-470)
aaccacaucguggagaagcgcguccug

SEQ ID NO: 42374 - RNA, 27 nt, Artificial Sequence
  Protein RMD5 homolog A (226-234)
aaccaccagaaggacauccaggugcug

SEQ ID NO: 42375 - RNA, 27 nt, Artificial Sequence
  Protein dopey-2 (223-231)
aaccaccagcugaccgugaagagccuc

SEQ ID NO: 42376 - RNA, 27 nt, Artificial Sequence
  Protein FAM193A (991-999)
aaccacagcgagccccgcccgggccug

SEQ ID NO: 42377 - RNA, 27 nt, Artificial Sequence
  Myb-binding protein 1A (554-562)
aaccacagccacaacgugaccaccguc

SEQ ID NO: 42378 - RNA, 27 nt, Artificial Sequence
  E3 ubiquitin-protein ligase RNF19A (822-830)
aaccacagccaccagaccauggagcug

SEQ ID NO: 42379 - RNA, 33 nt, Artificial Sequence
  Vesicle transport protein SFT2B (73-83)
aacaucgccagcaucggcuccaccaucuuccug

SEQ ID NO: 42380 - RNA, 27 nt, Artificial Sequence
  Bardet-Biedl syndrome 4 protein (82-90)
aacauccaggagagccuggagcucuuc

SEQ ID NO: 42381 - RNA, 27 nt, Artificial Sequence
  V-type proton ATPase 116 kDa subunit a isoform 3 (810-818)
aacaaguucuacagcggcaccggguac

SEQ ID NO: 42382 - RNA, 27 nt, Artificial Sequence
  WD repeat-containing protein 82 (83-91)
aacaagaucgacgacaccauccgcuac

SEQ ID NO: 42383 - RNA, 27 nt, Artificial Sequence
  C-X-C chemokine receptor type 4 (37-45)
aacaagaucuuccugcccaccaucuac

SEQ ID NO: 42384 - RNA, 36 nt, Artificial Sequence
  Sialic acid-binding Ig-like lectin 9 (225-236)
aacaagaccgugcaccugaacgucagcuaccccccg

SEQ ID NO: 42385 - RNA, 27 nt, Artificial Sequence
  Zinc finger and BTB domain-containing protein 38 (494-502)
aacaagguguucgcccuggccgaguac

SEQ ID NO: 42386 - RNA, 27 nt, Artificial Sequence
  Probable ubiquitin carboxyl-terminal hydrolase FAF-X (359-367)
aacaaggugaucagcuccgucagcuac

SEQ ID NO: 42387 - RNA, 27 nt, Artificial Sequence
  Monocarboxylate transporter 1 (81-89)
aacaaguacggcagccgcaucgugaug

SEQ ID NO: 42388 - RNA, 27 nt, Artificial Sequence
  Bifunctional glutamate/proline-tRNA ligase (369-377)
aacaaguacaacguguaccccaccuac

SEQ ID NO: 42389 - RNA, 33 nt, Artificial Sequence
  60S ribosomal protein L7 (146-156)
aaccugaagagcgugaacgagcucaucuacaag

SEQ ID NO: 42390 - RNA, 27 nt, Artificial Sequence
  Protein MMS22-like (862-870)
aaccugagcgaggugaaguccaucuuc

SEQ ID NO: 42391 - RNA, 30 nt, Artificial Sequence
  Leucine-rich repeat and calponin homology domain-containing protein 2 (140-149)
aaccuguaccacaacugcaucaagaccauc

SEQ ID NO: 42392 - RNA, 27 nt, Artificial Sequence
  Lysine-specific histone demethylase 1A (492-500)
aaccuguacaaggcccccauccuccug

SEQ ID NO: 42393 - RNA, 24 nt, Artificial Sequence
  Dynein regulatory complex protein 1 (2-9)
aaccccccgggcagccuggaggcc

SEQ ID NO: 42394 - RNA, 27 nt, Artificial Sequence
  F-box only protein 8 (11-19)
aaccagcagcugcagcaggagggcuac

SEQ ID NO: 42395 - RNA, 27 nt, Artificial Sequence
  Serine/arginine repetitive matrix protein 2 (1399-1407)
aaccagagcaucuccagccccgugcug

SEQ ID NO: 42396 - RNA, 27 nt, Artificial Sequence
  COP9 signalosome complex subunit 2 (34-42)
aaccaguacuacaacagcaaggcccug

SEQ ID NO: 42397 - RNA, 30 nt, Artificial Sequence
  Gamma-aminobutyric acid receptor subunit delta (246-255)
aaccgcggcguguacaucauccagagcuac

SEQ ID NO: 42398 - RNA, 33 nt, Artificial Sequence
  Anaphase-promoting complex subunit CDC26 (75-85)
aaccgcagcucccaguucggcagccuggaguuc

SEQ ID NO: 42399 - RNA, 27 nt, Artificial Sequence
  Ubiquitin-like modifier-activating enzyme 1 (449-457)
aaccgcuacgacggccagguggccguc

SEQ ID NO: 42400 - RNA, 27 nt, Artificial Sequence
  Small G protein signaling modulator 3 (329-337)
aacagcgccuccaucuucaacacccug

SEQ ID NO: 42401 - RNA, 24 nt, Artificial Sequence
  Nuclear transcription factor Y subunit alpha (232-239)
aacagcggcgggauggugaugaug

SEQ ID NO: 42402 - RNA, 27 nt, Artificial Sequence
  Unconventional myosin-XV (3472-3480)
aacagcuccuaccccuacguggagauc

SEQ ID NO: 42403 - RNA, 27 nt, Artificial Sequence
  Junction plakoglobin (584-592)
aacaccaucccccuguucgugcagcuc

SEQ ID NO: 42404 - RNA, 27 nt, Artificial Sequence
  Olfactory receptor 5D18 (7-15)
aacaccagcggcaccacguucacccug

SEQ ID NO: 42405 - RNA, 27 nt, Artificial Sequence
  Kinetochore protein Nuf2 (10-18)
aacguggccgagaucgucauccacauc

SEQ ID NO: 42406 - RNA, 30 nt, Artificial Sequence
  Sodium- and chloride-dependentine transporter 2 (288-297)
aacgugaucaucugcuacacccuguucuac

SEQ ID NO: 42407 - RNA, 36 nt, Artificial Sequence
  Alpha-enolase (118-129)
aacgugaucaacggcgggagccacgccggcaacaag

SEQ ID NO: 42408 - RNA, 27 nt, Artificial Sequence
  Clustered mitochondria protein homolog (96-104)
aacgugcuggaccacuucagcgagcuc

SEQ ID NO: 42409 - RNA, 30 nt, Artificial Sequence
  Myosin regulatory light chain 12B (155-164)
aacuacaucgaguucacccgcauccugaag

SEQ ID NO: 42410 - RNA, 24 nt, Artificial Sequence
  Protein LYRIC (498-505)
cccgccgaggugcuggucaagaac

SEQ ID NO: 42411 - RNA, 30 nt, Artificial Sequence
  Peroxiredoxin-4 (260-269)
cccgccggcaagcugaaguacuucgacaag

SEQ ID NO: 42412 - RNA, 27 nt, Artificial Sequence
  Leucine-rich repeat-containing protein 26 (63-71)
cccgccgugccgcccggccugagccuc

SEQ ID NO: 42413 - RNA, 27 nt, Artificial Sequence
  StAR-related lipid transfer protein 13 (243-251)
cccuuccacccgaagaacgagaagccc

SEQ ID NO: 42414 - RNA, 30 nt, Artificial Sequence
  Dystrophia myotonica WD repeat-containing protein (517-526)
cccuucagcaucggccgcuucgccacccug

SEQ ID NO: 42415 - RNA, 30 nt, Artificial Sequence
  B-lymphocyte antigen CD19 (99-108)
cccggcccgcccagcgagaaggccuggcag

SEQ ID NO: 42416 - RNA, 27 nt, Artificial Sequence
  Zinc finger protein 853 (438-446)
cccggcuacguggucgugcaggagcug

SEQ ID NO: 42417 - RNA, 36 nt, Artificial Sequence
  DNA replication licensing factor MCM6 (505-516)
cccaucagcggccacuacgaccgcuccaagagccug

SEQ ID NO: 42418 - RNA, 30 nt, Artificial Sequence
  UPF0428 protein CXorf56 (2-11)
cccaagguggucagccgcuccguggugugc

SEQ ID NO: 42419 - RNA, 27 nt, Artificial Sequence
  Integrin beta-6 (709-717)
cccaugaucaugcugggcgugagccuc

SEQ ID NO: 42420 - RNA, 30 nt, Artificial Sequence
  AF4/FMR2 family member 2 (271-280)
cccccgggccuguacugcaagaccagcaug

SEQ ID NO: 42421 - RNA, 27 nt, Artificial Sequence
  Basic salivary proline-rich protein 4 (50-58)
cccccgcccccccccggcaagccgcag

SEQ ID NO: 42422 - RNA, 27 nt, Artificial Sequence
  RAS guanyl-releasing protein 2 (400-408)
cccccgccccgcccccccgugcuggag

SEQ ID NO: 42423 - RNA, 27 nt, Artificial Sequence
  Coiled-coil domain-containing protein 8 (89-97)
cccccgcgccugguggucggcaccuac

SEQ ID NO: 42424 - RNA, 36 nt, Artificial Sequence
  RNA-binding protein FUS (344-355)
cccccgagcgccaaggccgcgaucgacugguucgac

SEQ ID NO: 42425 - RNA, 24 nt, Artificial Sequence
  Cornulin (2-9)
ccccagcugcuccagaacaucaac

SEQ ID NO: 42426 - RNA, 27 nt, Artificial Sequence
  Sialate O-acetylesterase (378-386)
ccccgcgacaagcagaccguggccuac

SEQ ID NO: 42427 - RNA, 27 nt, Artificial Sequence
  Metastasis-associated in colon cancer protein 1 (382-390)
cccagcuucaccgugguccugaccgug

SEQ ID NO: 42428 - RNA, 33 nt, Artificial Sequence
  ATP synthase F(0) complex subunit B1, mitochondrial (43-53)
cccgugccgccccugcccgaguacggcgggaag

SEQ ID NO: 42429 - RNA, 27 nt, Artificial Sequence
  MAP7 domain-containing protein 3 (645-653)
caggccgaggaccaccugaagcucaag

SEQ ID NO: 42430 - RNA, 27 nt, Artificial Sequence
  26S proteasome non-ATPase regulatory subunit 12 (265-273)
caggcccugaagagcgugguccucuac

SEQ ID NO: 42431 - RNA, 27 nt, Artificial Sequence
  Bromodomain-containing protein 8 (465-473)
caggagcgcgacaagcccgugccgcug

SEQ ID NO: 42432 - RNA, 30 nt, Artificial Sequence
  Prolyl endopeptidase (268-277)
caggagagcuccggcaucgccgggauccug

SEQ ID NO: 42433 - RNA, 27 nt, Artificial Sequence
  Mitochondrial import inner membrane translocase subunit Tim17-B (140-148)
caguuccgcaacgcccccccguuccug

SEQ ID NO: 42434 - RNA, 27 nt, Artificial Sequence
  60S acidic ribosomal protein P2 (57-65)
cagggcaucgggaagcuggccagcgug

SEQ ID NO: 42435 - RNA, 33 nt, Artificial Sequence
  Salivary acidic proline-rich phosphoprotein 1/2 (82-92)
cagggccccccgcccccccaggggaagccccag

SEQ ID NO: 42436 - RNA, 27 nt, Artificial Sequence
  Protocadherin Fat 4 (557-565)
cagggcgugcaccccaaggucagcuac

SEQ ID NO: 42437 - RNA, 27 nt, Artificial Sequence
  Transmembrane protein 205 (75-83)
cagcacgccugggcccagcugaccuuc

SEQ ID NO: 42438 - RNA, 27 nt, Artificial Sequence
  MICOS complex subunit MIC10 (59-67)
cagcacgacuuccaggcccccuaccug

SEQ ID NO: 42439 - RNA, 24 nt, Artificial Sequence
  CX3C chemokine receptor 1 (144-151)
cagcacggcgugaccaucagccug

SEQ ID NO: 42440 - RNA, 27 nt, Artificial Sequence
  60S ribosomal protein L8 (217-225)
cagcacaucggcaagcccagcaccauc

SEQ ID NO: 42441 - RNA, 27 nt, Artificial Sequence
  Inositol polyphosphate 5-phosphatase K (105-113)
cagcaccugcccuacauccagauccuc

SEQ ID NO: 42442 - RNA, 27 nt, Artificial Sequence
  Torsin-3A (137-145)
cagcaccuggugcagcagcucguccug

SEQ ID NO: 42443 - RNA, 33 nt, Artificial Sequence
  Forkhead box protein J3 (593-603)
cagcacaugaugcccagccaggccuuccagaug

SEQ ID NO: 42444 - RNA, 27 nt, Artificial Sequence
  PAX-interacting protein 1 (506-514)
cagcaccagcugcagcagcagcagcuc

SEQ ID NO: 42445 - RNA, 27 nt, Artificial Sequence
  Dual specificity tyrosine-phosphorylation-regulated kinase 1A (475-483)
cagcacagcuucuucaagaagaccgcc

SEQ ID NO: 42446 - RNA, 27 nt, Artificial Sequence
  G protein-regulated inducer of neurite outgrowth 3 (749-757)
cagcacagcguguuccaguccaugcug

SEQ ID NO: 42447 - RNA, 27 nt, Artificial Sequence
  Histone-lysine N-methyltransferase 2E (207-215)
cagcacacccccaccagcaucacgcug

SEQ ID NO: 42448 - RNA, 27 nt, Artificial Sequence
  Class A basic helix-loop-helix protein 15 (151-159)
cagcacuaccagcagcagcagcaggug

SEQ ID NO: 42449 - RNA, 27 nt, Artificial Sequence
  Glutathione peroxidase 7 (62-70)
cagcacuaccgcgcccugcagcagcuc

SEQ ID NO: 42450 - RNA, 27 nt, Artificial Sequence
  N-terminal EF-hand calcium-binding protein 2 (176-184)
cagauccagagccugcucuccagcgug

SEQ ID NO: 42451 - RNA, 30 nt, Artificial Sequence
  Ig heavy chain V-II region MCE (1-10)
cagaucacccugaaggagagcggccccacc

SEQ ID NO: 42452 - RNA, 27 nt, Artificial Sequence
  CDGSH iron-sulfur domain-containing protein 3, mitochondrial (119-127)
cagaaggccgaggugggcagcccccug

SEQ ID NO: 42453 - RNA, 27 nt, Artificial Sequence
  Splicing factor 3B subunit 3 (1087-1095)
cagaaggccgaggugaucaugaacuac

SEQ ID NO: 42454 - RNA, 27 nt, Artificial Sequence
  Apolipoprotein L6 (219-227)
cagaaggccuucgccggcaccacccug

SEQ ID NO: 42455 - RNA, 30 nt, Artificial Sequence
  Synapsin-2 (317-326)
cagaagaucggcaacaacuacaaggccuac

SEQ ID NO: 42456 - RNA, 27 nt, Artificial Sequence
  E3 ubiquitin-protein ligase DTX3L (683-691)
cagaagcugaucuucaccgugggcuac

SEQ ID NO: 42457 - RNA, 36 nt, Artificial Sequence
  Very-long-chain enoyl-CoA reductase (66-77)
cagaagcugcccgugggcaccaccgccacgcucuac

SEQ ID NO: 42458 - RNA, 27 nt, Artificial Sequence
  ATP-dependent DNA helicase Q1 (438-446)
cagaagcuguacgagauggugagcuac

SEQ ID NO: 42459 - RNA, 30 nt, Artificial Sequence
  Melanoma inhibitory activity protein 3 (1518-1527)
cagaagguggagauccugaacgagcucuac

SEQ ID NO: 42460 - RNA, 27 nt, Artificial Sequence
  Clathrin interactor 1 (130-138)
cagaaggugaaggagcuggucgaguuc

SEQ ID NO: 42461 - RNA, 27 nt, Artificial Sequence
  Cell growth-regulating nucleolar protein (56-64)
cagaaguacggcgggaagggcuacgag

SEQ ID NO: 42462 - RNA, 33 nt, Artificial Sequence
  Pre-mRNA-processing-splicing factor 8 (573-583)
cagcuggccgacggccuccaguacaucuucgcc

SEQ ID NO: 42463 - RNA, 27 nt, Artificial Sequence
  Chloride transport protein 6 (651-659)
cagcugaucagcaacaacaucaaguuc

SEQ ID NO: 42464 - RNA, 27 nt, Artificial Sequence
  Probable helicase senataxin (307-315)
cagcugauggaccccaucguggccuuc

SEQ ID NO: 42465 - RNA, 27 nt, Artificial Sequence
  BRCA1-associated protein (505-513)
cagaacaagcugaaggaggaggagcgc

SEQ ID NO: 42466 - RNA, 27 nt, Artificial Sequence
  dCTP pyrophosphatase 1 (52-60)
cagccccgcaaccugcuccuggcccug

SEQ ID NO: 42467 - RNA, 27 nt, Artificial Sequence
  E3 ubiquitin-protein ligase TRIM37 (638-646)
cagccccgcccgcccgccagccugcuc

SEQ ID NO: 42468 - RNA, 36 nt, Artificial Sequence
  Salivary acidic proline-rich phosphoprotein 1/2 (81-92)
cagcagggccccccgcccccccaggggaagccccag

SEQ ID NO: 42469 - RNA, 27 nt, Artificial Sequence
  GTP-binding protein 1 (587-595)
cagcagaucaagaugcagagcaccaag

SEQ ID NO: 42470 - RNA, 27 nt, Artificial Sequence
  Titin (1700-1708)
cagcagaagcccuucuucaagaagaag

SEQ ID NO: 42471 - RNA, 27 nt, Artificial Sequence
  Histamine H1 receptor (130-138)
cagcagccccugcgcuaccucaaguac

SEQ ID NO: 42472 - RNA, 27 nt, Artificial Sequence
  5-oxoprolinase (164-172)
cagcagcccguggaccugggcgcccuc

SEQ ID NO: 42473 - RNA, 27 nt, Artificial Sequence
  Protein sel-1 homolog 3 (692-700)
cagcagcgccuggcccagaugcucuuc

SEQ ID NO: 42474 - RNA, 27 nt, Artificial Sequence
  60S ribosomal protein L3 (203-211)
cagcaggugcccgucaaccagguguuc

SEQ ID NO: 42475 - RNA, 27 nt, Artificial Sequence
  Pyruvate dehydrogenase protein X component, mitochondrial (463-471)
cagcgccagcugaucaccgugaccaug

SEQ ID NO: 42476 - RNA, 27 nt, Artificial Sequence
  E3 ubiquitin-protein ligase RBBP6 (887-895)
cagagccaccgcucccggaacaucggc

SEQ ID NO: 42477 - RNA, 27 nt, Artificial Sequence
  Mismatch repair endonuclease PMS2 (237-245)
cagagccugauccccuucgugcagcuc

SEQ ID NO: 42478 - RNA, 27 nt, Artificial Sequence
  Myosin-7 (419-427)
caggugaucuacgccaccggcgcccug

SEQ ID NO: 42479 - RNA, 30 nt, Artificial Sequence
  CD160 antigen (101-110)
caggugaccccccugcacagcggcaccuac

SEQ ID NO: 42480 - RNA, 27 nt, Artificial Sequence
  tRNA (adenine(58)-N(1))-methyltransferase non-catalytic subunit TRM6 (198-206)
cgcgccggcaacaagaugaucgugaug

SEQ ID NO: 42481 - RNA, 27 nt, Artificial Sequence
  Nucleolar GTP-binding protein 2 (400-408)
cgcgccaagcccgaguacaucagcaag

SEQ ID NO: 42482 - RNA, 30 nt, Artificial Sequence
  Solute carrier family 15 member 3 (102-111)
cgcgccguggcccugagccuccugcuguac

SEQ ID NO: 42483 - RNA, 27 nt, Artificial Sequence
  tRNA dimethylallyltransferase, mitochondrial (8-16)
cgcgccgugcccgucggcagcgggcug

SEQ ID NO: 42484 - RNA, 30 nt, Artificial Sequence
  Translocating chain-associated membrane protein 1 (154-163)
cgcgccuacccccacaaccugaugaccuuc

SEQ ID NO: 42485 - RNA, 33 nt, Artificial Sequence
  Phosphoribosyl pyrophosphate synthase-associated protein 1 (68-78)
cgcgacgugaacaccgccgucauggagcugcuc

SEQ ID NO: 42486 - RNA, 27 nt, Artificial Sequence
  Voltage-dependent L-type calcium channel subunit alpha-1D (1825-1833)
cgcgaggaccccgagauccacggcuac

SEQ ID NO: 42487 - RNA, 30 nt, Artificial Sequence
  Inner nuclear membrane protein Man1 (459-468)
cgcgaggaggugagccccaccggcuccuuc

SEQ ID NO: 42488 - RNA, 27 nt, Artificial Sequence
  Gamma-glutamyltranspeptidase 1 (107-115)
cgcgagguggccccccggcuggccuuc

SEQ ID NO: 42489 - RNA, 27 nt, Artificial Sequence
  Ras-related protein Rab-30 (70-78)
cgcuuccggagcaucacccaguccuac

SEQ ID NO: 42490 - RNA, 27 nt, Artificial Sequence
  UHRF1-binding protein 1-like (15-23)
cgcuucaccaagaaccugagccccgac

SEQ ID NO: 42491 - RNA, 27 nt, Artificial Sequence
  DNA-directed RNA polymerase I subunit RPA2 (766-774)
cgcggcuucgcccacgggagcguguac

SEQ ID NO: 42492 - RNA, 33 nt, Artificial Sequence
  Endothelial differentiation-related factor 1 (133-143)
cgcggcaaggacaucgggaagcccaucgagaag

SEQ ID NO: 42493 - RNA, 27 nt, Artificial Sequence
  NADH dehydrogenase (ubiquinone) iron-sulfur protein 2, mitochondrial (118-126)
cgcggcaccgagaagcugaucgaguac

SEQ ID NO: 42494 - RNA, 27 nt, Artificial Sequence
  Membrane-associated tyrosine- and threonine-specific cdc2-inhibitory kinase (33-41)
cgccacgccgagcccggcuucagccug

SEQ ID NO: 42495 - RNA, 27 nt, Artificial Sequence
  Colorectal mutant cancer protein (800-808)
cgccacgagacccaggugcggaugcug

SEQ ID NO: 42496 - RNA, 30 nt, Artificial Sequence
  Beta-1,4-galactosyltransferase 6 (247-256)
cgccacuucgccgccaagcuggacaaguac

SEQ ID NO: 42497 - RNA, 27 nt, Artificial Sequence
  Exophilin-5 (1818-1826)
cgccacuucagcgaguccaccagcauc

SEQ ID NO: 42498 - RNA, 27 nt, Artificial Sequence
  PDZ domain-containing protein GIPC1 (190-198)
cgccacuacgagguggcccggcugcuc

SEQ ID NO: 42499 - RNA, 30 nt, Artificial Sequence
  26S proteasome non-ATPase regulatory subunit 14 (198-207)
cgccacuacuacagcaucaccaucaacuac

SEQ ID NO: 42500 - RNA, 27 nt, Artificial Sequence
  Ubiquitin carboxyl-terminal hydrolase 40 (780-788)
cgcaucaaggccaucaaggagcugaag

SEQ ID NO: 42501 - RNA, 30 nt, Artificial Sequence
  ADP-ribosylation factor-like protein 2-binding protein (84-93)
cgcauccccgaguucaacauggccgccuuc

SEQ ID NO: 42502 - RNA, 27 nt, Artificial Sequence
  U5 small nuclear ribonucleoprotein 200 kDa helicase (234-242)
cgcauccagagcaagcuguaccgggcc

SEQ ID NO: 42503 - RNA, 30 nt, Artificial Sequence
  60S ribosomal protein L4 (268-277)
cgcaaggccgccagccugaaguccaacuac

SEQ ID NO: 42504 - RNA, 27 nt, Artificial Sequence
  Selenoprotein H (8-16)
cgcaaggccgaggccgcgguggucgcc

SEQ ID NO: 42505 - RNA, 27 nt, Artificial Sequence
  Polyadenylate-binding protein 4 (374-382)
cgcaaggcccaccugaccaaccaguac

SEQ ID NO: 42506 - RNA, 27 nt, Artificial Sequence
  Sterol regulatory element-binding protein 2 (371-379)
cgcaaggccaucgacuacaucaaguac

SEQ ID NO: 42507 - RNA, 27 nt, Artificial Sequence
  DNA-directed RNA polymerase II subunit RPB1 (1375-1383)
cgcaaggcccuggagcgggagcucuac

SEQ ID NO: 42508 - RNA, 30 nt, Artificial Sequence
  Mid1-interacting protein 1 (163-172)
cgcaaggccaacauccugaccaaccgguac

SEQ ID NO: 42509 - RNA, 33 nt, Artificial Sequence
  26S proteasome non-ATPase regulatory subunit 3 (314-324)
cgcaaggccccccagcacaccgccgugggcuuc

SEQ ID NO: 42510 - RNA, 27 nt, Artificial Sequence
  60S ribosomal protein L23 (90-98)
cgcaaggacggcguguuccuguacuuc

SEQ ID NO: 42511 - RNA, 27 nt, Artificial Sequence
  Eukaryotic translation initiation factor 5B (376-384)
cgcaaggaggaggagcggcuggagcag

SEQ ID NO: 42512 - RNA, 27 nt, Artificial Sequence
  Uridine-cytidine kinase 2 (119-127)
cgcaaggaggagaccgugaccgucuac

SEQ ID NO: 42513 - RNA, 30 nt, Artificial Sequence
  Histone H2B type 1-K (34-43)
cgcaaggagagcuacuccguguacgucuac

SEQ ID NO: 42514 - RNA, 30 nt, Artificial Sequence
  MOB kinase activator 3A (20-29)
cgcaaguucgagcccggcacccagcgguuc

SEQ ID NO: 42515 - RNA, 27 nt, Artificial Sequence
  Group XV phospholipase A2 (296-304)
cgcaaguucuuccaggacaucggcuuc

SEQ ID NO: 42516 - RNA, 33 nt, Artificial Sequence
  General transcription factor II-I (878-888)
cgcaaguucggcgaggccaucgggaugggcuuc

SEQ ID NO: 42517 - RNA, 27 nt, Artificial Sequence
  Ribosome biogenesis protein TSR3 homolog (186-194)
cgcaaguucaaguggggcaagggguuc

SEQ ID NO: 42518 - RNA, 33 nt, Artificial Sequence
  Elongation factor 1-gamma (51-61)
cgcaaguuccccgccggcaaggugccggccuuc

SEQ ID NO: 42519 - RNA, 27 nt, Artificial Sequence
  Actin filament-associated protein 1-like 2 (481-489)
cgcaaguucagcgagcccaacaccuac

SEQ ID NO: 42520 - RNA, 27 nt, Artificial Sequence
  Casein kinase I isoform delta (98-106)
cgcaaguucagccugaagaccgugcuc

SEQ ID NO: 42521 - RNA, 27 nt, Artificial Sequence
  60S ribosomal protein L35 (70-78)
cgcaaguucuacaagggcaagaaguac

SEQ ID NO: 42522 - RNA, 27 nt, Artificial Sequence
  Eukaryotic peptide chain release factor GTP-binding subunit ERF3B (315-323)
cgcaagggcgaguucgagaccggguuc

SEQ ID NO: 42523 - RNA, 30 nt, Artificial Sequence
  Cytochrome c oxidase subunit 5A, mitochondrial (71-80)
cgcaagggcaucaacacccuggugaccuac

SEQ ID NO: 42524 - RNA, 27 nt, Artificial Sequence
  Heat shock protein HSP 90-alpha (512-520)
cgcaagcacggccuggaggugaucuac

SEQ ID NO: 42525 - RNA, 30 nt, Artificial Sequence
  Nardilysin (545-554)
cgcaagaucgaggacaacgaguuccacuac

SEQ ID NO: 42526 - RNA, 30 nt, Artificial Sequence
  Lamin-B1 (473-482)
cgcaagaucggcgacaccagcguguccuac

SEQ ID NO: 42527 - RNA, 27 nt, Artificial Sequence
  Mediator of RNA polymerase II transcription subunit 23 (123-131)
cgcaagaucaucggcgggguggacuac

SEQ ID NO: 42528 - RNA, 27 nt, Artificial Sequence
  Immunoglobulin superfamily member 10 (1201-1209)
cgcaagauccccuggcagcagaacuuc

SEQ ID NO: 42529 - RNA, 27 nt, Artificial Sequence
  Ubiquitin carboxyl-terminal hydrolase 22 (420-428)
cgcaagaucaccaccuacgugagcuuc

SEQ ID NO: 42530 - RNA, 27 nt, Artificial Sequence
  60S ribosomal protein L10 (38-46)
cgcaagaaggccaagguggacgaguuc

SEQ ID NO: 42531 - RNA, 27 nt, Artificial Sequence
  Cytochrome c oxidase subunit 6C (45-53)
cgcaagaaggccuacgccgacuucuac

SEQ ID NO: 42532 - RNA, 27 nt, Artificial Sequence
  Protein ENL (20-28)
cgcaagaagcccaccaccgagggcuuc

SEQ ID NO: 42533 - RNA, 30 nt, Artificial Sequence
  60S ribosomal protein L15 (12-21)
cgcaagaagcagagcgacgugaugcgguuc

SEQ ID NO: 42534 - RNA, 27 nt, Artificial Sequence
  Cytochrome c1, heme protein, mitochondrial (317-325)
cgcaagcuggccuaccggcccccgaag

SEQ ID NO: 42535 - RNA, 33 nt, Artificial Sequence
  CD2 antigen cytoplasmic tail-binding protein 2 (320-330)
cgcaagcuggaccccccgggcgggcaguucuac

SEQ ID NO: 42536 - RNA, 27 nt, Artificial Sequence
  Protein O-GlcNAcase (156-164)
cgcaagcuggaccaggugagccaguuc

SEQ ID NO: 42537 - RNA, 27 nt, Artificial Sequence
  Neurabin-2 (179-187)
cgcaagcuggacguggucgugcgguuc

SEQ ID NO: 42538 - RNA, 33 nt, Artificial Sequence
  Prohibitin (239-249)
cgcaagcuggaggccgccgaggacaucgcguac

SEQ ID NO: 42539 - RNA, 27 nt, Artificial Sequence
  Thyroid transcription factor 1-associated protein 26 (59-67)
cgcaagcugaagauccagcagagcuac

SEQ ID NO: 42540 - RNA, 27 nt, Artificial Sequence
  Pre-mRNA-processing factor 19 (422-430)
cgcaagcugaagaacuucaagacccuc

SEQ ID NO: 42541 - RNA, 27 nt, Artificial Sequence
  Toll-like receptor 9 (337-345)
cgcaagcugaaccucagcuucaacuac

SEQ ID NO: 42542 - RNA, 30 nt, Artificial Sequence
  von Willebrand factor A domain-containing protein 9 (424-433)
cgcaagcugcccgagaagacccagaccuuc

SEQ ID NO: 42543 - RNA, 27 nt, Artificial Sequence
  UAP56-interacting factor (165-173)
cgcaagaacaacauccccgccaacuuc

SEQ ID NO: 42544 - RNA, 30 nt, Artificial Sequence
  Activating signal cointegrator 1 complex subunit 1 (17-26)
cgcaagaaccccgugcaggagcagaccuac

SEQ ID NO: 42545 - RNA, 27 nt, Artificial Sequence
  5'-AMP-activated protein kinase catalytic subunit alpha-1 (447-455)
cgcaagaaccccgugaccagcaccuac

SEQ ID NO: 42546 - RNA, 30 nt, Artificial Sequence
  Nuclear pore complex protein Nup98-Nup96 (1206-1215)
cgcaagcccgacgaggacaugaagcuguac

SEQ ID NO: 42547 - RNA, 30 nt, Artificial Sequence
  Ubiquitin carboxyl-terminal hydrolase 47 (700-709)
cgcaagcccgaccagguguuccagagcuac

SEQ ID NO: 42548 - RNA, 27 nt, Artificial Sequence
  Transcriptional regulator ATRX (81-89)
cgcaagcccagcaucgugaccaaguac

SEQ ID NO: 42549 - RNA, 27 nt, Artificial Sequence
  Bifunctional polynucleotide phosphatase/kinase (483-491)
cgcaagcaguucgaggcccccacccug

SEQ ID NO: 42550 - RNA, 27 nt, Artificial Sequence
  DNA-dependent protein kinase catalytic subunit (70-78)
cgcaagagccugaacuccaucgaguuc

SEQ ID NO: 42551 - RNA, 27 nt, Artificial Sequence
  Serine/threonine-protein phosphatase 6 regulatory subunit 1 (134-142)
cgcaagaccgaccagcuggugagcuuc

SEQ ID NO: 42552 - RNA, 33 nt, Artificial Sequence
  Histone H4 (79-89)
cgcaagaccgugaccgccauggacgucguguac

SEQ ID NO: 42553 - RNA, 27 nt, Artificial Sequence
  Flap endonuclease 1 (29-37)
cgcaagguggccaucgacgccagcaug

SEQ ID NO: 42554 - RNA, 33 nt, Artificial Sequence
  60S ribosome subunit biogenesis protein NIP7 homolog (154-164)
cgcaagguggaccccauggccaucgucguguuc

SEQ ID NO: 42555 - RNA, 30 nt, Artificial Sequence
  E3 ubiquitin/ISG15 ligase TRIM25 (236-245)
cgcaagguggagcagcugcagcaggaguac

SEQ ID NO: 42556 - RNA, 27 nt, Artificial Sequence
  Mitochondrial carrier homolog 2 (287-295)
cgcaaggugcccuucggcaagaccuac

SEQ ID NO: 42557 - RNA, 27 nt, Artificial Sequence
  Fatty acid desaturase 1 (40-48)
cgcaagguguacaacaucagcgaguuc

SEQ ID NO: 42558 - RNA, 27 nt, Artificial Sequence
  Glucose-6-phosphate translocase (126-134)
cgcaagugguucgagcccagccaguuc

SEQ ID NO: 42559 - RNA, 36 nt, Artificial Sequence
  Heterogeneous nuclear ribonucleoprotein R (145-156)
cgcaaguacggcgggcccccgcccgacagcguguac

SEQ ID NO: 42560 - RNA, 27 nt, Artificial Sequence
  Serine/threonine-protein phosphatase 4 catalytic subunit (132-140)
cgcaaguacggcagcgugaccgucugg

SEQ ID NO: 42561 - RNA, 27 nt, Artificial Sequence
  Vigilin (87-95)
cgcaaguacaaggacaugaaccaguuc

SEQ ID NO: 42562 - RNA, 27 nt, Artificial Sequence
  Lysine-specific demethylase 5A (773-781)
cgcaaguaccccgagaacgaccuguuc

SEQ ID NO: 42563 - RNA, 27 nt, Artificial Sequence
  Pre-mRNA-processing-splicing factor 8 (217-225)
cgcaaguacgugaacggcagcaccuac

SEQ ID NO: 42564 - RNA, 27 nt, Artificial Sequence
  Max-binding protein MNT (295-303)
cgccuggccgagcucaagcacgagcug

SEQ ID NO: 42565 - RNA, 27 nt, Artificial Sequence
  Protein unc-93 homolog B1 (374-382)
cgccuggccuaccuccugguggccuac

SEQ ID NO: 42566 - RNA, 27 nt, Artificial Sequence
  Nuclear pore complex protein Nup85 (162-170)
cgccuggacgaggcccggcagaugcuc

SEQ ID NO: 42567 - RNA, 27 nt, Artificial Sequence
  Acetyl-CoA carboxylase 2 (765-773)
cgccugggcgggauccccgugggcguc

SEQ ID NO: 42568 - RNA, 27 nt, Artificial Sequence
  X-ray repair cross-complementing protein 6 (517-525)
cgccugggcagccucguggacgaguuc

SEQ ID NO: 42569 - RNA, 27 nt, Artificial Sequence
  N-alpha-acetyltransferase 35, NatC auxiliary subunit (331-339)
cgccugaucgaccggaucaagaccgug

SEQ ID NO: 42570 - RNA, 30 nt, Artificial Sequence
  Cyclic GMP-AMP synthase (353-362)
cgccugaagcccuucuaccucgugccgaag

SEQ ID NO: 42571 - RNA, 27 nt, Artificial Sequence
  Myosin light chain kinase 2, skeletal/cardiac muscle (553-561)
cgccugaagagccagauccuccugaag

SEQ ID NO: 42572 - RNA, 27 nt, Artificial Sequence
  tRNA wybutosine-synthesizing protein 4 (311-319)
cgccugagccccguguccccggcccuc

SEQ ID NO: 42573 - RNA, 27 nt, Artificial Sequence
  DnaJ homolog subfamily C member 8 (45-53)
cgccugacccggcccggcagcuccuac

SEQ ID NO: 42574 - RNA, 27 nt, Artificial Sequence
  C-type lectin domain family 4 member F (36-44)
cgccuggugcaggccacccccgccuuc

SEQ ID NO: 42575 - RNA, 27 nt, Artificial Sequence
  Proteasome assembly chaperone 4 (20-28)
cgccugugggagcagcucgugcacuuc

SEQ ID NO: 42576 - RNA, 30 nt, Artificial Sequence
  Laminin subunit beta-3 (1125-1134)
cgcaugaaggacauggagcuggagcuccug

SEQ ID NO: 42577 - RNA, 27 nt, Artificial Sequence
  Cytochrome c oxidase assembly protein COX15 homolog (153-161)
cgcauguggggccggcugguggggcuc

SEQ ID NO: 42578 - RNA, 27 nt, Artificial Sequence
  Histone deacetylase complex subunit SAP18 (117-125)
cgccccggcuaccgggugaaggagauc

SEQ ID NO: 42579 - RNA, 30 nt, Artificial Sequence
  R3H domain-containing protein 2 (2-11)
cgccccccggugaccaaggccagcuccuuc

SEQ ID NO: 42580 - RNA, 27 nt, Artificial Sequence
  Short transient receptor potential channel 4-associated protein (31-39)
cgcccccggccgggcaacauccugcuc

SEQ ID NO: 42581 - RNA, 27 nt, Artificial Sequence
  Glycogen synthase kinase-3 beta (306-314)
cgcccccggaccccgcccgaggccauc

SEQ ID NO: 42582 - RNA, 27 nt, Artificial Sequence
  Transcription initiation factor IIB (169-177)
cgccaggagggcgugccccggaccuuc

SEQ ID NO: 42583 - RNA, 30 nt, Artificial Sequence
  Protein FAM46A (224-233)
cgccaguucgaguucagcguggacuccuuc

SEQ ID NO: 42584 - RNA, 27 nt, Artificial Sequence
  Pre-rRNA-processing protein TSR1 homolog (574-582)
cgccagggcaccccccugaucgccuuc

SEQ ID NO: 42585 - RNA, 27 nt, Artificial Sequence
  NADH dehydrogenase (ubiquinone) 1 subunit C2 (59-67)
cgccagcugcucuacaucaccgccuuc

SEQ ID NO: 42586 - RNA, 27 nt, Artificial Sequence
  Cytochrome b-245 heavy chain (147-155)
cgccagaacgagagcuaccugaacuuc

SEQ ID NO: 42587 - RNA, 27 nt, Artificial Sequence
  Rho GTPase-activating protein 4 (492-500)
cgccagccccggccgagcucccaguac

SEQ ID NO: 42588 - RNA, 30 nt, Artificial Sequence
  Protein strawberry notch homolog 1 (79-88)
cgccagcagcccccgagcaccaccacguuc

SEQ ID NO: 42589 - RNA, 27 nt, Artificial Sequence
  Large proline-rich protein BAG6 (780-788)
cgcagcuucuuccaccagcacuaccug

SEQ ID NO: 42590 - RNA, 27 nt, Artificial Sequence
  DnaJ homolog subfamily C member 10 (220-228)
cgcagcaaggagucccuggugagcuuc

SEQ ID NO: 42591 - RNA, 27 nt, Artificial Sequence
  DNA-dependent protein kinase catalytic subunit (3046-3054)
cgcagcaagcugaagcuccugcugcag

SEQ ID NO: 42592 - RNA, 30 nt, Artificial Sequence
  Protein SON (1072-1081)
cgcagcaugaugucccccauggccgaccgg

SEQ ID NO: 42593 - RNA, 27 nt, Artificial Sequence
  Small nuclear ribonucleoprotein E (28-36)
cgcagccagauccagguguggcuguac

SEQ ID NO: 42594 - RNA, 30 nt, Artificial Sequence
  PHD finger protein 3 (815-824)
cgcaccaaguacaucgacgacaccgugaag

SEQ ID NO: 42595 - RNA, 27 nt, Artificial Sequence
  60S ribosomal protein L34 (24-32)
cgcacccccggcaaccggaucguguac

SEQ ID NO: 42596 - RNA, 27 nt, Artificial Sequence
  Androglobin (1138-1146)
cgcaccagcaagcccgacgccuucauc

SEQ ID NO: 42597 - RNA, 27 nt, Artificial Sequence
  Eukaryotic translation initiation factor 2 subunit 2 (182-190)
cgcguguucaacaucaugcgggagaag

SEQ ID NO: 42598 - RNA, 27 nt, Artificial Sequence
  Ankyrin repeat domain-containing protein 13C (353-361)
cgcgugggcaacuuccuggccgacuuc

SEQ ID NO: 42599 - RNA, 27 nt, Artificial Sequence
  Eyes absent homolog 1 (440-448)
cgcgugaaggagaucuacaacaccuac

SEQ ID NO: 42600 - RNA, 27 nt, Artificial Sequence
  NADH dehydrogenase (ubiquinone) 1 beta subcomplex subunit 5, mitochondrial (150-158)
cgcgugaaggagcuggagguccggaag

SEQ ID NO: 42601 - RNA, 27 nt, Artificial Sequence
  Histone-lysine N-methyltransferase EZH2 (18-26)
cgcgugaagagcgaguacaugcggcug

SEQ ID NO: 42602 - RNA, 27 nt, Artificial Sequence
  Bystin (257-265)
cgcgugcgggacgacgucgccgaguac

SEQ ID NO: 42603 - RNA, 27 nt, Artificial Sequence
  Ribonucleoside-diphosphate reductase subunit M2 (288-296)
cgcgugcgggagaucaucaucaacgcc

SEQ ID NO: 42604 - RNA, 27 nt, Artificial Sequence
  Leydig cell tumor 10 kDa protein homolog (42-50)
cgcgugguccagcagcagaagcugaag

SEQ ID NO: 42605 - RNA, 30 nt, Artificial Sequence
  Thioredoxin-related transmembrane protein 2 (198-207)
cgcuacaccgacgugagcacccgguacaag

SEQ ID NO: 42606 - RNA, 27 nt, Artificial Sequence
  Dipeptidyl peptidase 3 (692-700)
agcgccgccggccugauccgcuccuuc

SEQ ID NO: 42607 - RNA, 27 nt, Artificial Sequence
  Cyclin-dependent kinase 11B (785-793)
agcgccgccggccccggguucucccug

SEQ ID NO: 42608 - RNA, 27 nt, Artificial Sequence
  Fanconi anemia group M protein (1313-1321)
agcgccgccaagaacgaggagcugcuc

SEQ ID NO: 42609 - RNA, 27 nt, Artificial Sequence
  Integrin beta-7 (338-346)
agcgccgccaacauccagcccaucuuc

SEQ ID NO: 42610 - RNA, 27 nt, Artificial Sequence
  Deleted in malignant brain tumors 1 protein (202-210)
agcgccgcccagccccaguccacccug

SEQ ID NO: 42611 - RNA, 27 nt, Artificial Sequence
  Cell division cycle and apoptosis regulator protein 1 (253-261)
agcgccgccuccaucaccccccugcuc

SEQ ID NO: 42612 - RNA, 27 nt, Artificial Sequence
  Magnesium transporter protein 1 (108-116)
agcgccuucaccaaccgcaucuucuuc

SEQ ID NO: 42613 - RNA, 27 nt, Artificial Sequence
  Rho guanine nucleotide exchange factor 2 (122-130)
agcgccaucuaccccuccgacagcuuc

SEQ ID NO: 42614 - RNA, 27 nt, Artificial Sequence
  Pleckstrin homology domain-containing family B member 1 (11-19)
agcgcccuggagucccccuucgaggag

SEQ ID NO: 42615 - RNA, 27 nt, Artificial Sequence
  14-3-3 protein eta (25-33)
agcgccaugaaggccgugaccgagcug

SEQ ID NO: 42616 - RNA, 33 nt, Artificial Sequence
  Nuclease-sensitive element-binding protein 1 (314-324)
agcgcccccgaggccgagcagggcggggcggag

SEQ ID NO: 42617 - RNA, 27 nt, Artificial Sequence
  Peroxisomal multifunctional enzyme type 2 (151-159)
agcgccuccggcaucuacgggaacuuc

SEQ ID NO: 42618 - RNA, 27 nt, Artificial Sequence
  Multidrug resistance-associated protein 4 (326-334)
agcgccuccaagaucaucguguucguc

SEQ ID NO: 42619 - RNA, 27 nt, Artificial Sequence
  CapZ-interacting protein (15-23)
agcgccucccccagcguggcccagcug

SEQ ID NO: 42620 - RNA, 27 nt, Artificial Sequence
  Mucin-20 (558-566)
agcgccgugggcaagaccaccuccuuc

SEQ ID NO: 42621 - RNA, 27 nt, Artificial Sequence
  ADP-dependent glucokinase (7-15)
agcgccuacgccggcuuccuggcgcuc

SEQ ID NO: 42622 - RNA, 27 nt, Artificial Sequence
  AFG3-like protein 2 (656-664)
agcgccuacgcccagaucgugcaguuc

SEQ ID NO: 42623 - RNA, 33 nt, Artificial Sequence
  HLA class I histocompatibility antigen, Cw-7 alpha chain (115-125)
agcgccuacgacggcaaggacuacaucgcccug

SEQ ID NO: 42624 - RNA, 27 nt, Artificial Sequence
  Heterogeneous nuclear ribonucleoprotein D-like (363-371)
agcgccuacggcggggaccagaacuac

SEQ ID NO: 42625 - RNA, 27 nt, Artificial Sequence
  Cyclic AMP-responsive element-binding protein 1 (143-151)
agcgacgcccccggcgugccgcgcauc

SEQ ID NO: 42626 - RNA, 27 nt, Artificial Sequence
  Obscurin (2339-2347)
agcgacggccuguaccgcaagcucauc

SEQ ID NO: 42627 - RNA, 30 nt, Artificial Sequence
  Transgelin-2 (163-172)
agcgacaaccagcugcaggagggcaagaac

SEQ ID NO: 42628 - RNA, 33 nt, Artificial Sequence
  Histone H2B type 1-K (113-123)
agcgagggcaccaaggccgugaccaaguacacg

SEQ ID NO: 42629 - RNA, 30 nt, Artificial Sequence
  Tumor protein D54 (166-175)
agcuucgaggaccgcgugggcaccaucaag

SEQ ID NO: 42630 - RNA, 36 nt, Artificial Sequence
  Ubiquitin-conjugating enzyme E2 J1 (236-247)
agcuuccaccagcccacccagccgguggccaagaac

SEQ ID NO: 42631 - RNA, 27 nt, Artificial Sequence
  Lipase member J (205-213)
agcuucaagaaguucaucggcuccaag

SEQ ID NO: 42632 - RNA, 30 nt, Artificial Sequence
  DNA damage-binding protein 1 (1096-1105)
agcuuccuggacaucucccgccccaagaug

SEQ ID NO: 42633 - RNA, 30 nt, Artificial Sequence
  Dynein heavy chain 14, axonemal (3238-3247)
agcuuccugaacaugcgcgugcccacccuc

SEQ ID NO: 42634 - RNA, 27 nt, Artificial Sequence
  Actin-related protein 3 (170-178)
agcggcgacggggugacccacgucauc

SEQ ID NO: 42635 - RNA, 27 nt, Artificial Sequence
  Protein phosphatase 1 regulatory subunit 14B (21-29)
agcggcgggcccggcccgcgcguguac

SEQ ID NO: 42636 - RNA, 30 nt, Artificial Sequence
  Dolichyl-diphosphooligosaccharide-proteinosyltransferase subunit 1 (272-281)
agcggcaucuccagcauccgcuccuucaag

SEQ ID NO: 42637 - RNA, 27 nt, Artificial Sequence
  Kinesin-like protein KIFC2 (600-608)
agccacgcccuggugacccucacccug

SEQ ID NO: 42638 - RNA, 27 nt, Artificial Sequence
  Sorting nexin-19 (151-159)
agccacgccguggcccaguccguccug

SEQ ID NO: 42639 - RNA, 27 nt, Artificial Sequence
  Probable E3 ubiquitin-protein ligase HERC4 (280-288)
agccacgagaucaacccccgcaaggug

SEQ ID NO: 42640 - RNA, 36 nt, Artificial Sequence
  Mucin-7 (41-52)
agccacuucgagcugccccacuacccgggccuccug

SEQ ID NO: 42641 - RNA, 27 nt, Artificial Sequence
  Histone-lysine N-methyltransferase 2D (2564-2572)
agccacuucggccccgggccgacccug

SEQ ID NO: 42642 - RNA, 24 nt, Artificial Sequence
  Putative uncharacterized protein FLJ37218 (158-165)
agccacuucaccgaccaggagcug

SEQ ID NO: 42643 - RNA, 27 nt, Artificial Sequence
  Tapasin (318-326)
agccacuucuaccccuccggcgggcug

SEQ ID NO: 42644 - RNA, 27 nt, Artificial Sequence
  Translational activator GCN1 (674-682)
agccaccaccccucccugguggccguc

SEQ ID NO: 42645 - RNA, 27 nt, Artificial Sequence
  Transcriptional repressor p66-beta (322-330)
agccacauccagcccggcaccgugaac

SEQ ID NO: 42646 - RNA, 27 nt, Artificial Sequence
  Disintegrin and metalloproteinase domain-containing protein 10 (377-385)
agccacaucaccuucgcccacgaggug

SEQ ID NO: 42647 - RNA, 27 nt, Artificial Sequence
  Niemann-Pick C1 protein (1169-1177)
agccacaucacccgcgccuucaccgug

SEQ ID NO: 42648 - RNA, 27 nt, Artificial Sequence
  Endothelial PAS domain-containing protein 1 (49-57)
agccaccuggacaaggccuccaucaug

SEQ ID NO: 42649 - RNA, 27 nt, Artificial Sequence
  Retrotransposon-derived protein PEG10 (219-227)
agccaccuggagguggccaagucccuc

SEQ ID NO: 42650 - RNA, 27 nt, Artificial Sequence
  Dolichyl-diphosphooligosaccharide-proteinosyltransferase subunit 2 (169-177)
agccaccugucccagcaggccgaccuc

SEQ ID NO: 42651 - RNA, 27 nt, Artificial Sequence
  Protein FAM78A (95-103)
agccacauggaguucuacaaccaguac

SEQ ID NO: 42652 - RNA, 27 nt, Artificial Sequence
  THO complex subunit 5 homolog (470-478)
agccacauggagaccaccaugaagcug

SEQ ID NO: 42653 - RNA, 27 nt, Artificial Sequence
  Nicastrin (219-227)
agccacaugcacgccgugaucuccacc

SEQ ID NO: 42654 - RNA, 27 nt, Artificial Sequence
  Regulation of nuclear pre-mRNA domain-containing protein 2 (503-511)
agccacaacccccuggccaacauccuc

SEQ ID NO: 42655 - RNA, 27 nt, Artificial Sequence
  Myotubularin-related protein 6 (41-49)
agccaccagaaggagaccuggauccug

SEQ ID NO: 42656 - RNA, 36 nt, Artificial Sequence
  Cytochrome c oxidase subunit 7B, mitochondrial (25-36)
agccaccagaagcgcacccccgacuuccacgacaag

SEQ ID NO: 42657 - RNA, 27 nt, Artificial Sequence
  Transmembrane protein 201 (295-303)
agccaccagaccggcguggucgcccug

SEQ ID NO: 42658 - RNA, 27 nt, Artificial Sequence
  Squalene monooxygenase (461-469)
agccacuccuucguggucaacauccug

SEQ ID NO: 42659 - RNA, 27 nt, Artificial Sequence
  Zinc transporter ZIP6 (388-396)
agccacucccacgaggagcccgccaug

SEQ ID NO: 42660 - RNA, 27 nt, Artificial Sequence
  Transmembrane protein 214 (503-511)
agccacuccagcuuccaggccucccug

SEQ ID NO: 42661 - RNA, 27 nt, Artificial Sequence
  39S ribosomal protein L17, mitochondrial (167-175)
agccacaccgcccagacccccggcauc

SEQ ID NO: 42662 - RNA, 27 nt, Artificial Sequence
  CLOCK-interacting pacemaker (249-257)
agccacguggccaaggcccccucccug

SEQ ID NO: 42663 - RNA, 27 nt, Artificial Sequence
  Pre-mRNA-processing-splicing factor 8 (2254-2262)
agccacuacgagcgcgugcagaugcug

SEQ ID NO: 42664 - RNA, 27 nt, Artificial Sequence
  DNA-binding protein RFX7 (154-162)
agccacuacaucggcaccaaguccaug

SEQ ID NO: 42665 - RNA, 27 nt, Artificial Sequence
  Dual specificity protein kinase CLK1 (54-62)
agccacuaccuggagucccgcagcauc

SEQ ID NO: 42666 - RNA, 27 nt, Artificial Sequence
  Protein EVI2B (202-210)
agcaucgccgccauccugaucggcgug

SEQ ID NO: 42667 - RNA, 27 nt, Artificial Sequence
  DNA-directed RNA polymerase II subunit RPB2 (468-476)
agcaucgccccccgcaugauguccgug

SEQ ID NO: 42668 - RNA, 27 nt, Artificial Sequence
  E3 ubiquitin-protein ligase RNF19A (93-101)
agcaucgaguccauccacagcgagaug

SEQ ID NO: 42669 - RNA, 27 nt, Artificial Sequence
  Translocon-associated protein subunit delta (126-134)
agcaucauccccccgcuguucaccgug

SEQ ID NO: 42670 - RNA, 36 nt, Artificial Sequence
  Alpha-enolase (2-13)
agcauccugaagauccacgcccgcgagaucuucgac

SEQ ID NO: 42671 - RNA, 27 nt, Artificial Sequence
  Copper-transporting ATPase 2 (876-884)
agcaucaacgcccacggcuccgugcug

SEQ ID NO: 42672 - RNA, 27 nt, Artificial Sequence
  Protein Smaug homolog 2 (352-360)
agcauccagaagcugcgcgagcggcag

SEQ ID NO: 42673 - RNA, 27 nt, Artificial Sequence
  CCR4-NOT transcription complex subunit 1 (312-320)
agcaucuccgcccccggcagcgggauc

SEQ ID NO: 42674 - RNA, 27 nt, Artificial Sequence
  AP-5 complex subunit mu-1 (477-485)
agcaaggcccccgccccggugaccuac

SEQ ID NO: 42675 - RNA, 27 nt, Artificial Sequence
  Ubiquitin carboxyl-terminal hydrolase 19 (576-584)
agcaaggccucccaguucaccggcuac

SEQ ID NO: 42676 - RNA, 27 nt, Artificial Sequence
  Putative tRNA (cytidine(32)/guanosine(34)-2'-O)-methyltransferase (5-13)
agcaaggacaagcgcgacguguacuac

SEQ ID NO: 42677 - RNA, 27 nt, Artificial Sequence
  40S ribosomal protein S6 (148-156)
agcaaggaggacgacgugcgccaguac

SEQ ID NO: 42678 - RNA, 27 nt, Artificial Sequence
  60S ribosomal protein L11 (158-166)
agcaaggaggaggccaugcgcugguuc

SEQ ID NO: 42679 - RNA, 27 nt, Artificial Sequence
  Gamma-glutamyltranspeptidase 1 (30-38)
agcaaggagcccgacaaccacguguac

SEQ ID NO: 42680 - RNA, 27 nt, Artificial Sequence
  NADH dehydrogenase (ubiquinone) 1 beta subcomplex subunit 8, mitochondrial (175-183)
agcaaggagcccgagcgcgugguccac

SEQ ID NO: 42681 - RNA, 27 nt, Artificial Sequence
  Neuroblast differentiation-associated protein AHNAK (5611-5619)
agcaaguucgccggcgggcugcacuuc

SEQ ID NO: 42682 - RNA, 27 nt, Artificial Sequence
  Core-binding factor subunit beta (10-18)
agcaaguucgagaacgaggaguucuuc

SEQ ID NO: 42683 - RNA, 30 nt, Artificial Sequence
  Proteasomal ATPase-associated factor 1 (78-87)
agcaaguuccuggcccccuacaccaccuuc

SEQ ID NO: 42684 - RNA, 33 nt, Artificial Sequence
  CWF19-like protein 2 (623-633)
agcaaguucaugggcaagaccgacggggacuac

SEQ ID NO: 42685 - RNA, 27 nt, Artificial Sequence
  Transcription intermediary factor 1-alpha (457-465)
agcaaguuccccacccagaucucccug

SEQ ID NO: 42686 - RNA, 27 nt, Artificial Sequence
  40S ribosomal protein S25 (101-109)
agcaagcaccgcgcccaggugaucuac

SEQ ID NO: 42687 - RNA, 33 nt, Artificial Sequence
  Proteasome subunit beta type-7 (75-85)
agcaagauccacuucaucucccccaacaucuac

SEQ ID NO: 42688 - RNA, 27 nt, Artificial Sequence
  60S ribosomal protein L18a (148-156)
agcaagaucaaguucccccugccgcac

SEQ ID NO: 42689 - RNA, 27 nt, Artificial Sequence
  Serine/threonine-protein phosphatase 4 regulatory subunit 3B (54-62)
agcaagaucaaccccaacaccgccuac

SEQ ID NO: 42690 - RNA, 27 nt, Artificial Sequence
  Signal recognition particle receptor subunit alpha (128-136)
agcaagauccgcgcccccaccaccaug

SEQ ID NO: 42691 - RNA, 27 nt, Artificial Sequence
  NUAK family SNF1-like kinase 2 (123-131)
agcaagaucgugaucgucauggaguac

SEQ ID NO: 42692 - RNA, 30 nt, Artificial Sequence
  E3 ubiquitin-protein ligase RING1 (108-117)
agcaagaucuaccccucccgcgaggaguac

SEQ ID NO: 42693 - RNA, 27 nt, Artificial Sequence
  60S ribosomal protein L19 (112-120)
agcaagaagaucgaccgccacauguac

SEQ ID NO: 42694 - RNA, 27 nt, Artificial Sequence
  HAUS augmin-like complex subunit 8 (124-132)
agcaagaagcccgaguccaccagcuuc

SEQ ID NO: 42695 - RNA, 27 nt, Artificial Sequence
  60S ribosomal protein L10 (168-176)
agcaagaaguggggcuucaccaaguuc

SEQ ID NO: 42696 - RNA, 30 nt, Artificial Sequence
  Golgi-associated PDZ and coiled-coil motif-containing protein (448-457)
agcaagcuggacgaccuccacacccuguac

SEQ ID NO: 42697 - RNA, 27 nt, Artificial Sequence
  Protein yippee-like 5 (78-86)
agcaagcugggcuggaucuacgaguuc

SEQ ID NO: 42698 - RNA, 33 nt, Artificial Sequence
  Eukaryotic translation initiation factor 2A (459-469)
agcaagcugcacgaggaggagcccccgcagaac

SEQ ID NO: 42699 - RNA, 36 nt, Artificial Sequence
  T-complex protein 1 subunit eta (291-302)
agcaagcugcccaucggcgacguggccacccaguac

SEQ ID NO: 42700 - RNA, 27 nt, Artificial Sequence
  Ubiquitin-protein ligase E3C (217-225)
agcaagcugcccuccagcaucgaguac

SEQ ID NO: 42701 - RNA, 27 nt, Artificial Sequence
  Laminin subunit alpha-5 (3479-3487)
agcaagcugcccgugaccgucggcuuc

SEQ ID NO: 42702 - RNA, 27 nt, Artificial Sequence
  Anaphase-promoting complex subunit 5 (144-152)
agcaagcuguccuucagccagguguuc

SEQ ID NO: 42703 - RNA, 27 nt, Artificial Sequence
  Protein Red (280-288)
agcaagcugacccagauccucuccuac

SEQ ID NO: 42704 - RNA, 27 nt, Artificial Sequence
  GPN-loop GTPase 2 (178-186)
agcaagauggaccugaucgagcacuac

SEQ ID NO: 42705 - RNA, 30 nt, Artificial Sequence
  Hsp90 co-chaperone Cdc37 (322-331)
agcaagauggaccccaccgacgccaaguac

SEQ ID NO: 42706 - RNA, 27 nt, Artificial Sequence
  Ubiquitin-conjugating enzyme E2 A (74-82)
agcaagauguuccaccccaacguguac

SEQ ID NO: 42707 - RNA, 27 nt, Artificial Sequence
  Deoxyribonuclease-2-alpha (168-176)
agcaagaugggcaagcagcugaccuac

SEQ ID NO: 42708 - RNA, 27 nt, Artificial Sequence
  Small nuclear ribonucleoprotein-associated protein N (7-15)
agcaagaugcugcagcacaucgacuac

SEQ ID NO: 42709 - RNA, 27 nt, Artificial Sequence
  A-kinase anchor protein 9 (893-901)
agcaagaacaagcaggagcuggaguac

SEQ ID NO: 42710 - RNA, 27 nt, Artificial Sequence
  Intraflagellar transport protein 80 homolog (558-566)
agcaagaacccccacaucguguccuuc

SEQ ID NO: 42711 - RNA, 27 nt, Artificial Sequence
  E3 SUMO-protein ligase RanBP2 (1103-1111)
agcaagaacguguccggcaucagcuuc

SEQ ID NO: 42712 - RNA, 27 nt, Artificial Sequence
  Protein yippee-like 3 (5-13)
agcaagcccaagaccuuccaggccuac

SEQ ID NO: 42713 - RNA, 27 nt, Artificial Sequence
  Coatomer subunit alpha (279-287)
agcaagcgcaccggcgugcagaccuuc

SEQ ID NO: 42714 - RNA, 27 nt, Artificial Sequence
  Calcium-dependent secretion activator 1 (390-398)
agcaaguccgacgugguccugagcuuc

SEQ ID NO: 42715 - RNA, 27 nt, Artificial Sequence
  S-adenosylmethionine synthase isoform type-2 (180-188)
agcaagacccaggugaccguccaguac

SEQ ID NO: 42716 - RNA, 27 nt, Artificial Sequence
  Protein YIPF1 (188-196)
agcaaggugaugaacaucgucuccuac

SEQ ID NO: 42717 - RNA, 27 nt, Artificial Sequence
  Nucleolar complex protein 4 homolog (137-145)
agcaagugggagggcaacuaccuguuc

SEQ ID NO: 42718 - RNA, 27 nt, Artificial Sequence
  EBNA1-binding protein 2 (257-265)
agcaaguggaacacccgcgaguccuac

SEQ ID NO: 42719 - RNA, 30 nt, Artificial Sequence
  Nuclease-sensitive element-binding protein 1 (136-145)
agcaaguacgccgccgaccgcaaccacuac

SEQ ID NO: 42720 - RNA, 27 nt, Artificial Sequence
  Transcription factor MafG (109-117)
agcaaguacgaggcccugcagaccuuc

SEQ ID NO: 42721 - RNA, 30 nt, Artificial Sequence
  7-dehydrocholesterol reductase (453-462)
agcaaguacggccgcgacugggagcgguac

SEQ ID NO: 42722 - RNA, 27 nt, Artificial Sequence
  Gamma-tubulin complex component 6 (1622-1630)
agcaaguacuccggcguguucagcuuc

SEQ ID NO: 42723 - RNA, 33 nt, Artificial Sequence
  V-type proton ATPase catalytic subunit A (264-274)
agcaaguacuccaacagcgacgugaucaucuac

SEQ ID NO: 42724 - RNA, 27 nt, Artificial Sequence
  DNA polymerase delta catalytic subunit (737-745)
agcaaguacaccguggagaacggcuac

SEQ ID NO: 42725 - RNA, 33 nt, Artificial Sequence
  Fatty acid synthase (1747-1757)
agccuggccgaggagaagcuccaggccuccgug

SEQ ID NO: 42726 - RNA, 36 nt, Artificial Sequence
  Intraflagellar transport protein 140 homolog (561-572)
agccuggccgagcucgugcccggcgucgggggcauc

SEQ ID NO: 42727 - RNA, 27 nt, Artificial Sequence
  DNA topoisomerase 3-beta-1 (12-20)
agccuggcccaguccaucgccaagauc

SEQ ID NO: 42728 - RNA, 27 nt, Artificial Sequence
  PMS1 protein homolog 1 (605-613)
agccuguucaacggcucccacuaccuc

SEQ ID NO: 42729 - RNA, 27 nt, Artificial Sequence
  Nuclear pore membraneoprotein 210-like (625-633)
agccugggccacacccucgugaccguc

SEQ ID NO: 42730 - RNA, 27 nt, Artificial Sequence
  Bifunctional glutamate/proline-tRNA ligase (786-794)
agccugaaggccgaguacaaggagaag

SEQ ID NO: 42731 - RNA, 27 nt, Artificial Sequence
  Bifunctional glutamate/proline-tRNA ligase (859-867)
agccugaaggcccaguacaaggagaag

SEQ ID NO: 42732 - RNA, 27 nt, Artificial Sequence
  Heterogeneous nuclear ribonucleoprotein M (86-94)
agccugaaggaccucgugaaggagaag

SEQ ID NO: 42733 - RNA, 24 nt, Artificial Sequence
  Serine/threonine-protein phosphatase 2A 65 kDa regulatory subunit A alpha isoform (403-410)
agccugcuccccgccaucguggag

SEQ ID NO: 42734 - RNA, 30 nt, Artificial Sequence
  Protein transport protein Sec23B (156-165)
agccugcuccccccggacgcccuggugggc

SEQ ID NO: 42735 - RNA, 27 nt, Artificial Sequence
  Nesprin-1 (5397-5405)
agccugcagcucgccgagguggcccug

SEQ ID NO: 42736 - RNA, 27 nt, Artificial Sequence
  Tetratricopeptide repeat protein 28 (1301-1309)
agccuguggcccgugccggucgccgcc

SEQ ID NO: 42737 - RNA, 27 nt, Artificial Sequence
  Probable E3 ubiquitin-protein ligase HECTD4 (1660-1668)
agcauggccgccgaggugaucgcgcug

SEQ ID NO: 42738 - RNA, 27 nt, Artificial Sequence
  Ribonuclease 3 (661-669)
agcaugcaccagauccugcucuaccug

SEQ ID NO: 42739 - RNA, 36 nt, Artificial Sequence
  B-cell CLL/lymphoma 9-like protein (1201-1212)
agcaugaugauggcccccggcgggccggacucccug

SEQ ID NO: 42740 - RNA, 30 nt, Artificial Sequence
  Titin (34201-34210)
agcaugaccgagaugaaguucgccuccaug

SEQ ID NO: 42741 - RNA, 36 nt, Artificial Sequence
  Protein S100-A7 (2-13)
agcaacacccaggccgagcgcuccaucaucggcaug

SEQ ID NO: 42742 - RNA, 36 nt, Artificial Sequence
  Basic salivary proline-rich protein 4 (241-252)
agccccccgggcaagccccaggggcccccccagcag

SEQ ID NO: 42743 - RNA, 24 nt, Artificial Sequence
  Protein kinase C-binding protein 1 (698-705)
agccccaccgugcaccugggccuc

SEQ ID NO: 42744 - RNA, 27 nt, Artificial Sequence
  Protein AF-17 (915-923)
agccaggccggcggggcccccacccug

SEQ ID NO: 42745 - RNA, 27 nt, Artificial Sequence
  4F2 cell-surface antigen heavy chain (436-444)
agccaggcccgccugcucaccuccuuc

SEQ ID NO: 42746 - RNA, 27 nt, Artificial Sequence
  Dolichyl-diphosphooligosaccharide-proteinosyltransferase subunit 1 (210-218)
agccaggacaccuucaaggugcacuac

SEQ ID NO: 42747 - RNA, 27 nt, Artificial Sequence
  Arf-GAP with SH3 domain, ANK repeat and PH domain-containing protein 2 (285-293)
agccagauccgccaguccaccgccuac

SEQ ID NO: 42748 - RNA, 27 nt, Artificial Sequence
  DNA mismatch repair protein Msh2 (717-725)
agccagcugaagggcguguccaccuuc

SEQ ID NO: 42749 - RNA, 30 nt, Artificial Sequence
  Fanconi anemia group E protein (322-331)
agccagauggaccugcucugcgcccagcug

SEQ ID NO: 42750 - RNA, 27 nt, Artificial Sequence
  Multidrug resistance-associated protein 4 (661-669)
agccagcaguccagccgccccucccug

SEQ ID NO: 42751 - RNA, 27 nt, Artificial Sequence
  Heat shock protein 105 kDa (552-560)
agccagucccccccgagccccgagcug

SEQ ID NO: 42752 - RNA, 27 nt, Artificial Sequence
  Cystatin-B (45-53)
agccagguggucgccggcaccaacuac

SEQ ID NO: 42753 - RNA, 30 nt, Artificial Sequence
  NEDD8-activating enzyme E1 catalytic subunit (290-299)
agccaguacaacauccgcggcgugaccuac

SEQ ID NO: 42754 - RNA, 27 nt, Artificial Sequence
  WD repeat-containing protein 97 (311-319)
agccgcgacuccaccgugaaggucugg

SEQ ID NO: 42755 - RNA, 36 nt, Artificial Sequence
  Nuclease-sensitive element-binding protein 1 (309-320)
agcuccgcccccgaggccgagcagggcggggcggag

SEQ ID NO: 42756 - RNA, 30 nt, Artificial Sequence
  Hematological and neurological expressed 1 protein (91-100)
agcuccggcgacuuccuggaccucaagggg

SEQ ID NO: 42757 - RNA, 30 nt, Artificial Sequence
  Synaptotagmin-like protein 2 (602-611)
agcuccggcaugaccagccuguccagcgug

SEQ ID NO: 42758 - RNA, 27 nt, Artificial Sequence
  HLA class I histocompatibility antigen, alpha chain G (301-309)
agcucccugcccaccaucccgaucaug

SEQ ID NO: 42759 - RNA, 27 nt, Artificial Sequence
  Mucin-1 (130-138)
agcaccgcccccccggcccacggcgug

SEQ ID NO: 42760 - RNA, 27 nt, Artificial Sequence
  Sperm-associated antigen 5 (305-313)
agcaccugccugacccccaaccucgug

SEQ ID NO: 42761 - RNA, 27 nt, Artificial Sequence
  V-type proton ATPase catalytic subunit A (16-24)
agcaccuucggcuacgugcacgggguc

SEQ ID NO: 42762 - RNA, 27 nt, Artificial Sequence
  Uncharacterized protein C20orf195 (2-10)
agcacccacguggccggccuggggcuc

SEQ ID NO: 42763 - RNA, 30 nt, Artificial Sequence
  Ubiquitin carboxyl-terminal hydrolase 3 (394-403)
agcaccaagaaguucuggauccagaagcug

SEQ ID NO: 42764 - RNA, 27 nt, Artificial Sequence
  Heat shock cognate 71 kDa protein (340-348)
agcacccgcauccccaagauccagaag

SEQ ID NO: 42765 - RNA, 27 nt, Artificial Sequence
  Putativeosylation-dependent cell adhesion molecule 1 (14-22)
agcaccucccuggccauccucgacgug

SEQ ID NO: 42766 - RNA, 30 nt, Artificial Sequence
  Microtubule-actin cross-linking factor 1, isoforms 1/2/3/5 (844-853)
agcguggccucccuggucggccgcagcaag

SEQ ID NO: 42767 - RNA, 30 nt, Artificial Sequence
  Zinc finger protein 638 (1228-1237)
agcguguucgccgaggagcgcaaccugaag

SEQ ID NO: 42768 - RNA, 27 nt, Artificial Sequence
  Heat shock protein HSP 90-alpha (658-666)
agcgugaaggaccuggucauccuccug

SEQ ID NO: 42769 - RNA, 27 nt, Artificial Sequence
  Eukaryotic translation initiation factor 3 subunit E (27-35)
agcgugaaggagaucuacaacgagaag

SEQ ID NO: 42770 - RNA, 36 nt, Artificial Sequence
  Cytoskeleton-associated protein 2 (388-399)
agcguggucacccagcacgagcccgccggccagaac

SEQ ID NO: 42771 - RNA, 30 nt, Artificial Sequence
  Echinoderm microtubule-associated protein-like 4 (184-193)
agcugggagaacuccgacgacagccgcaac

SEQ ID NO: 42772 - RNA, 30 nt, Artificial Sequence
  Cold-inducible RNA-binding protein (163-172)
agcuacgacuccuacgccacccacaacgag

SEQ ID NO: 42773 - RNA, 33 nt, Artificial Sequence
  14-3-3 protein theta (210-220)
agcuacaaggacuccacccugaucaugcagcuc

SEQ ID NO: 42774 - RNA, 27 nt, Artificial Sequence
  Nucleolar and coiled-body phosphoprotein 1 (681-689)
agcuaccgcggcggguccaucagcgug

SEQ ID NO: 42775 - RNA, 24 nt, Artificial Sequence
  Asparagine synthetase (glutamine-hydrolyzing) (409-416)
accgccgcccacggccuggagcuc

SEQ ID NO: 42776 - RNA, 30 nt, Artificial Sequence
  Ribosome biogenesis protein BOP1 (10-19)
accgccgcccccagcgugcgcccggagaag

SEQ ID NO: 42777 - RNA, 30 nt, Artificial Sequence
  Poly(rC)-binding protein 2 (91-100)
accgccgccagccgccccccggugacccug

SEQ ID NO: 42778 - RNA, 27 nt, Artificial Sequence
  Elongation factor 2 (73-81)
accgccaucagccuguucuacgagcuc

SEQ ID NO: 42779 - RNA, 30 nt, Artificial Sequence
  Ubiquitin-associated protein 2-like (322-331)
accgccaucagccagcccgccuccggcaac

SEQ ID NO: 42780 - RNA, 36 nt, Artificial Sequence
  Intraflagellar transport protein 88 homolog (62-73)
accgccaagaucagcuccaccgccgugacgcgcccc

SEQ ID NO: 42781 - RNA, 24 nt, Artificial Sequence
  Max-like protein X (152-159)
accgcccugaagaucaugaaggug

SEQ ID NO: 42782 - RNA, 27 nt, Artificial Sequence
  Nuclear pore membraneoprotein 210 (1573-1581)
accgccagcaaggugaucgucgccgug

SEQ ID NO: 42783 - RNA, 36 nt, Artificial Sequence
  Syndecan-1 (220-231)
accgccguggucgccguggagcccgaccgccggaac

SEQ ID NO: 42784 - RNA, 27 nt, Artificial Sequence
  Probable C-mannosyltransferase DPY19L3 (463-471)
accgccuacaaccugauccacaccauc

SEQ ID NO: 42785 - RNA, 27 nt, Artificial Sequence
  XK-related protein 9 (255-263)
accugcaucagcauggaguuccuguac

SEQ ID NO: 42786 - RNA, 33 nt, Artificial Sequence
  Uncharacterized protein C9orf78 (274-284)
accgacgacuaccacuacgagaaguucaagaag

SEQ ID NO: 42787 - RNA, 24 nt, Artificial Sequence
  Bcl-2-associated transcription factor 1 (341-348)
accgacgaggagagccgcguguuc

SEQ ID NO: 42788 - RNA, 30 nt, Artificial Sequence
  Bcl-2-associated transcription factor 1 (341-350)
accgacgaggagagccgcguguuccugcuc

SEQ ID NO: 42789 - RNA, 36 nt, Artificial Sequence
  Pleiotropic regulator 1 (74-85)
accgacagcuacgugcacaagcaguaccccgccaac

SEQ ID NO: 42790 - RNA, 27 nt, Artificial Sequence
  PRA1 family protein 3 (180-188)
accgacuacaucagcaaggugaaggag

SEQ ID NO: 42791 - RNA, 27 nt, Artificial Sequence
  Testis-expressed sequence 10 protein (733-741)
accgaggccguguuccacagccugcuc

SEQ ID NO: 42792 - RNA, 33 nt, Artificial Sequence
  Pre-mRNA cleavage complex 2 protein Pcf11 (561-571)
accgaggaggagcgcccccaggagaccacgaac

SEQ ID NO: 42793 - RNA, 30 nt, Artificial Sequence
  cTAGE family member 5 (795-804)
accgagcaccccgagccgcagcaggagacc

SEQ ID NO: 42794 - RNA, 36 nt, Artificial Sequence
  Tumor protein D52 (213-224)
accgagccccugccggagaagacccaggagagccuc

SEQ ID NO: 42795 - RNA, 36 nt, Artificial Sequence
  BAG family molecular chaperone regulator 4 (167-178)
accgaggugcccagcaccuaccgcuccagcggcaac

SEQ ID NO: 42796 - RNA, 33 nt, Artificial Sequence
  Non-POU domain-containing octamer-binding protein (6-16)
accuucaaccuggagaagcagaaccacaccccc

SEQ ID NO: 42797 - RNA, 36 nt, Artificial Sequence
  Non-POU domain-containing octamer-binding protein (6-17)
accuucaaccuggagaagcagaaccacaccccccgc

SEQ ID NO: 42798 - RNA, 30 nt, Artificial Sequence
  U2 snRNP-associated SURP motif-containing protein (134-143)
accuucgugcgcggcggggucgugaacgcc

SEQ ID NO: 42799 - RNA, 36 nt, Artificial Sequence
  Ubiquitin-associated protein 2-like (225-236)
accggccacuucgagcccgacgacgggaccagcgcc

SEQ ID NO: 42800 - RNA, 36 nt, Artificial Sequence
  E3 ubiquitin-protein ligase HUWE1 (2557-2568)
accggccacaccauccacgugcacuaccccgggaac

SEQ ID NO: 42801 - RNA, 30 nt, Artificial Sequence
  Transcriptional repressor p66-beta (558-567)
accggcaucgggggccacaaggggcccagc

SEQ ID NO: 42802 - RNA, 36 nt, Artificial Sequence
  Peptidyl-prolyl cis-trans isomerase FKBP1A (28-39)
accggcaugcuggaggacgggaagaaguucgacagc

SEQ ID NO: 42803 - RNA, 33 nt, Artificial Sequence
  Probable ATP-dependent RNA helicase DDX5 (560-570)
accggcaaccccaccgggacguaccagaacggc

SEQ ID NO: 42804 - RNA, 24 nt, Artificial Sequence
  60S ribosomal protein L13 (151-158)
accggccccgugaugccgguccgc

SEQ ID NO: 42805 - RNA, 36 nt, Artificial Sequence
  AT-rich interactive domain-containing protein 1A (1514-1525)
accggcagcgccccccaggggccggccuaccacggc

SEQ ID NO: 42806 - RNA, 36 nt, Artificial Sequence
  Nuclear pore complex protein Nup153 (406-417)
accggcuacgagaagaacaugacccccgggcagaac

SEQ ID NO: 42807 - RNA, 27 nt, Artificial Sequence
  Pumilio homolog 3 (361-369)
acccacgacggcgcccgcguggccaug

SEQ ID NO: 42808 - RNA, 27 nt, Artificial Sequence
  Glutaryl-CoA dehydrogenase, mitochondrial (416-424)
acccacgacauccacgcccugauccuc

SEQ ID NO: 42809 - RNA, 27 nt, Artificial Sequence
  Nuclear pore complex protein Nup88 (408-416)
acccacgaggccggcgugcacagcguc

SEQ ID NO: 42810 - RNA, 27 nt, Artificial Sequence
  Endonuclease G, mitochondrial (227-235)
acccacuucuucaaggugcugauccuc

SEQ ID NO: 42811 - RNA, 27 nt, Artificial Sequence
  Bax inhibitor 1 (51-59)
acccacuucauccaggccggccugcuc

SEQ ID NO: 42812 - RNA, 27 nt, Artificial Sequence
  BMP/retinoic acid-inducible neural-specific protein 2 (144-152)
acccacuuccugcucagcgccacccug

SEQ ID NO: 42813 - RNA, 27 nt, Artificial Sequence
  HEAT repeat-containing protein 1 (721-729)
acccacuuccccuucgccauccgcgug

SEQ ID NO: 42814 - RNA, 27 nt, Artificial Sequence
  Transitional endoplasmic reticulum ATPase (403-411)
acccacggccacgugggggccgaccug

SEQ ID NO: 42815 - RNA, 27 nt, Artificial Sequence
  Zinc finger protein 638 (449-457)
acccacaucgagagcugccgccagcug

SEQ ID NO: 42816 - RNA, 24 nt, Artificial Sequence
  Leucine-rich PPR motif-containing protein, mitochondrial (1095-1102)
acccacaucaagggcuucacccug

SEQ ID NO: 42817 - RNA, 27 nt, Artificial Sequence
  Probable C-mannosyltransferase DPY19L1 (228-236)
acccacauccugcgcgccaccaagcuc

SEQ ID NO: 42818 - RNA, 30 nt, Artificial Sequence
  Guanine nucleotide-binding protein-like 3-like protein (251-260)
acccacauccgcgugggcgucguggggcug

SEQ ID NO: 42819 - RNA, 36 nt, Artificial Sequence
  Neuroblast differentiation-associated protein AHNAK (1576-1587)
acccacaagaucagcaugcccgacgugggccugaac

SEQ ID NO: 42820 - RNA, 27 nt, Artificial Sequence
  Homeodomain-interacting protein kinase 3 (1110-1118)
acccaccugggcgggcagcccacccuc

SEQ ID NO: 42821 - RNA, 27 nt, Artificial Sequence
  Nck-associated protein 1-like (1054-1062)
acccaccugaaggaguuccucgugguc

SEQ ID NO: 42822 - RNA, 24 nt, Artificial Sequence
  Bone marrow stromal antigen 2 (67-74)
acccaccugcuccagcaggagcug

SEQ ID NO: 42823 - RNA, 27 nt, Artificial Sequence
  Dol-P-Man:Man(5)GlcNAc(2)-PP-Dol alpha-1,3-mannosyltransferase (381-389)
acccaccugcuccgccugcuggugcuc

SEQ ID NO: 42824 - RNA, 27 nt, Artificial Sequence
  Myocyte-specific enhancer factor 2C (372-380)
acccaccugagccaguccagcaaccuc

SEQ ID NO: 42825 - RNA, 27 nt, Artificial Sequence
  Dolichyl-diphosphooligosaccharide-proteinosyltransferase 48 kDa subunit (400-408)
acccaccuguacagcuccacccaggug

SEQ ID NO: 42826 - RNA, 27 nt, Artificial Sequence
  Bifunctional glutamate/proline-tRNA ligase (1422-1430)
acccacaugguggucgccaacaccaug

SEQ ID NO: 42827 - RNA, 27 nt, Artificial Sequence
  C-myc promoter-binding protein (1300-1308)
acccacagcucccccagcuucaaccug

SEQ ID NO: 42828 - RNA, 27 nt, Artificial Sequence
  Heterogeneous nuclear ribonucleoprotein R (25-33)
acccacaccgagcacuacaagacgcug

SEQ ID NO: 42829 - RNA, 27 nt, Artificial Sequence
  Stromal cell-derived factor 2 (95-103)
acccacgugaacaccggccgcaaccug

SEQ ID NO: 42830 - RNA, 27 nt, Artificial Sequence
  Dolichyl-diphosphooligosaccharide-proteinosyltransferase subunit 2 (26-34)
acccacuaccugaccaagcacgacgug

SEQ ID NO: 42831 - RNA, 33 nt, Artificial Sequence
  Lymphoid-restricted membrane protein (375-385)
accaucgccagccugccccgcaacaucggcaac

SEQ ID NO: 42832 - RNA, 36 nt, Artificial Sequence
  Myosin-binding protein H-like (137-148)
accaucgacauccuggugaucgagcgccccggcccg

SEQ ID NO: 42833 - RNA, 27 nt, Artificial Sequence
  Glycerol-3-phosphate dehydrogenase 1-like protein (285-293)
accaucgaggagcuggagaaggagaug

SEQ ID NO: 42834 - RNA, 36 nt, Artificial Sequence
  BPI fold-containing family A member 2 (157-168)
accaucgagaccgacccccagacgcaccagccggug

SEQ ID NO: 42835 - RNA, 27 nt, Artificial Sequence
  MOB kinase activator 1A (192-200)
accauccugaagcgccucuuccgggug

SEQ ID NO: 42836 - RNA, 27 nt, Artificial Sequence
  Protein sel-1 homolog 1 (219-227)
accaaggcccuggagcgcgugagcuac

SEQ ID NO: 42837 - RNA, 27 nt, Artificial Sequence
  WD repeat-containing protein 5 (45-53)
accaaggccgugagcuccgucaaguuc

SEQ ID NO: 42838 - RNA, 27 nt, Artificial Sequence
  Transforming protein RhoA (163-171)
accaaggacggcgugcgcgaggucuuc

SEQ ID NO: 42839 - RNA, 27 nt, Artificial Sequence
  Disintegrin and metalloproteinase domain-containing protein 17 (159-167)
accaaggacaagcgcaugcugguguac

SEQ ID NO: 42840 - RNA, 27 nt, Artificial Sequence
  Ras GTPase-activating-like protein IQGAP2 (912-920)
accaaguucauggacaccgugaucuuc

SEQ ID NO: 42841 - RNA, 27 nt, Artificial Sequence
  Vigilin (613-621)
accaagaucgaccugcccgccgagaac

SEQ ID NO: 42842 - RNA, 33 nt, Artificial Sequence
  Vigilin (613-623)
accaagaucgaccugcccgccgagaacagcaac

SEQ ID NO: 42843 - RNA, 27 nt, Artificial Sequence
  Vesicular integral-membrane protein VIP36 (290-298)
accaagaucgagcccagcgugaacuuc

SEQ ID NO: 42844 - RNA, 27 nt, Artificial Sequence
  Ubiquitin carboxyl-terminal hydrolase 33 (627-635)
accaagaucagcacccacguguccuuc

SEQ ID NO: 42845 - RNA, 27 nt, Artificial Sequence
  Nucleoprotein TPR (712-720)
accaagaucagcacccagcuggacuuc

SEQ ID NO: 42846 - RNA, 36 nt, Artificial Sequence
  Eukaryotic translation initiation factor 4 gamma 1 (1070-1081)
accaagaucaccaagcccggcagcaucgacuccaac

SEQ ID NO: 42847 - RNA, 27 nt, Artificial Sequence
  Pre-mRNA-processing factor 19 (264-272)
accaagaaggugaccagcgucguguuc

SEQ ID NO: 42848 - RNA, 27 nt, Artificial Sequence
  Serine/threonine-protein kinase 24 (105-113)
accaagcuguggaucaucauggaguac

SEQ ID NO: 42849 - RNA, 27 nt, Artificial Sequence
  Parafibromin (282-290)
accaagcagcccaucccggccgccuac

SEQ ID NO: 42850 - RNA, 27 nt, Artificial Sequence
  Cerebral cavernous malformations 2 protein (253-261)
accaagguggacaucaaggagaccuac

SEQ ID NO: 42851 - RNA, 27 nt, Artificial Sequence
  S-adenosylmethionine synthase isoform type-2 (288-296)
accaagguggaccgcagcgccgccuac

SEQ ID NO: 42852 - RNA, 27 nt, Artificial Sequence
  ER membrane protein complex subunit 3 (138-146)
accaaggugcccuucccgcugacccuc

SEQ ID NO: 42853 - RNA, 30 nt, Artificial Sequence
  ATP-binding cassette sub-family F member 2 (592-601)
accaaguggcccggcgacauccuggccuac

SEQ ID NO: 42854 - RNA, 27 nt, Artificial Sequence
  60S ribosomal protein L17 (45-53)
accaaguaccugaaggacgugacccuc

SEQ ID NO: 42855 - RNA, 24 nt, Artificial Sequence
  DNA dC-dU-editing enzyme APOBEC-3C (84-91)
accaaguaccaggugaccugguac

SEQ ID NO: 42856 - RNA, 30 nt, Artificial Sequence
  Tetratricopeptide repeat protein 27 (205-214)
acccuggccgagaacugcaucgaccaggug

SEQ ID NO: 42857 - RNA, 27 nt, Artificial Sequence
  Proliferation-associated protein 2G4 (386-394)
acccuggaggagaacgaggccggcgac

SEQ ID NO: 42858 - RNA, 27 nt, Artificial Sequence
  Protein FAM185A (259-267)
acccugggcagcgugcacgggaacauc

SEQ ID NO: 42859 - RNA, 36 nt, Artificial Sequence
  60S ribosomal protein L23a (126-137)
acccugauccgccccgacggcgagaagaaggccuac

SEQ ID NO: 42860 - RNA, 27 nt, Artificial Sequence
  Transcription elongation factor SPT6 (835-843)
acccugaagaaguuccuccugaacaag

SEQ ID NO: 42861 - RNA, 27 nt, Artificial Sequence
  AP-5 complex subunit mu-1 (115-123)
acccugagcccccgcccgccccucauc

SEQ ID NO: 42862 - RNA, 27 nt, Artificial Sequence
  40S ribosomal protein S7 (121-129)
acccugaccgccgugcacgacgccauc

SEQ ID NO: 42863 - RNA, 33 nt, Artificial Sequence
  40S ribosomal protein S7 (121-131)
acccugaccgccgugcacgacgccauccucgag

SEQ ID NO: 42864 - RNA, 36 nt, Artificial Sequence
  Translocating chain-associated membrane protein 1 (357-368)
acccugaccagcaacguggccgacuccccccgcaac

SEQ ID NO: 42865 - RNA, 36 nt, Artificial Sequence
  Peptidyl-prolyl cis-trans isomerase FKBP1A (97-108)
acccugguguucgacgucgagcuccugaagcuggag

SEQ ID NO: 42866 - RNA, 27 nt, Artificial Sequence
  Serine/threonine-protein kinase RIO2 (243-251)
accaugaucgacuucccccagauggug

SEQ ID NO: 42867 - RNA, 30 nt, Artificial Sequence
  CDC42 small effector protein 1 (26-35)
accaugaucggcgagcccaugaacuucgug

SEQ ID NO: 42868 - RNA, 36 nt, Artificial Sequence
  Far upstream element-binding protein 2 (277-288)
accaacguggacaagccccugcgcaucaucggcgac

SEQ ID NO: 42869 - RNA, 36 nt, Artificial Sequence
  Cell division cycle 5-like protein (373-384)
accaacguggacaccccccugaagggcgggcucaac

SEQ ID NO: 42870 - RNA, 30 nt, Artificial Sequence
  Vacuolar protein sorting-associated protein VTA1 homolog (224-233)
acccccgccgaggugccgcacagcaccggc

SEQ ID NO: 42871 - RNA, 36 nt, Artificial Sequence
  Vacuolar protein sorting-associated protein VTA1 homolog (224-235)
acccccgccgaggugccgcacagcaccggcgucgcc

SEQ ID NO: 42872 - RNA, 30 nt, Artificial Sequence
  Polyadenylate-binding protein 1 (502-511)
acccccgccgugcgcaccgucccgcaguac

SEQ ID NO: 42873 - RNA, 24 nt, Artificial Sequence
  Ubiquitin-associated protein 2-like (952-959)
acccccuuccagcagccgagcggc

SEQ ID NO: 42874 - RNA, 27 nt, Artificial Sequence
  IST1 homolog (241-249)
acccccuucagcuacccgcugcccaag

SEQ ID NO: 42875 - RNA, 33 nt, Artificial Sequence
  IST1 homolog (241-251)
acccccuucagcuacccgcugcccaagggcccc

SEQ ID NO: 42876 - RNA, 36 nt, Artificial Sequence
  TBC1 domain family member 30 (869-880)
acccccaucuucagcccguuccccuccgugaagccc

SEQ ID NO: 42877 - RNA, 24 nt, Artificial Sequence
  Eukaryotic translation initiation factor 4 gamma 1 (647-654)
accccccugcgcccgcucgacccc

SEQ ID NO: 42878 - RNA, 27 nt, Artificial Sequence
  Eukaryotic translation initiation factor 4 gamma 1 (647-655)
accccccugcgcccgcucgaccccacc

SEQ ID NO: 42879 - RNA, 30 nt, Artificial Sequence
  Eukaryotic translation initiation factor 4 gamma 1 (647-656)
accccccugcgcccgcucgaccccacccgg

SEQ ID NO: 42880 - RNA, 33 nt, Artificial Sequence
  Eukaryotic translation initiation factor 4 gamma 1 (647-657)
accccccugcgcccgcucgaccccacccggcug

SEQ ID NO: 42881 - RNA, 36 nt, Artificial Sequence
  Intercellular adhesion molecule 1 (521-532)
acccccaugaagccgaacacccaggccacgcccccc

SEQ ID NO: 42882 - RNA, 36 nt, Artificial Sequence
  Vesicular, overexpressed in cancer, prosurvival protein 1 (160-171)
acccccccgccccccuacgagcagguggucaaggcc

SEQ ID NO: 42883 - RNA, 36 nt, Artificial Sequence
  GTPase-activating protein and VPS9 domain-containing protein 1 (462-473)
accccccagcugagcccggccaccacgcccgccaac

SEQ ID NO: 42884 - RNA, 27 nt, Artificial Sequence
  Translocating chain-associated membrane protein 2 (334-342)
accccccgccugccggcccggcucauc

SEQ ID NO: 42885 - RNA, 27 nt, Artificial Sequence
  Target of Nesh-SH3 (160-168)
accccccgcccgaccggcacgccccug

SEQ ID NO: 42886 - RNA, 36 nt, Artificial Sequence
  Acidic leucine-rich nuclear phosphoprotein 32 family member A (15-26)
acccccagcgacgugaaggagcugguccucgacaac

SEQ ID NO: 42887 - RNA, 33 nt, Artificial Sequence
  ATP-dependent RNA helicase A (18-28)
acccccagcuacgagauccgcgccgugggcaac

SEQ ID NO: 42888 - RNA, 27 nt, Artificial Sequence
  Protein DENND6A (343-351)
acccaggcccccccgagcgugauccug

SEQ ID NO: 42889 - RNA, 27 nt, Artificial Sequence
  Gamma-glutamyltranspeptidase 1 (475-483)
acccagaucaccacggccaccgcccug

SEQ ID NO: 42890 - RNA, 27 nt, Artificial Sequence
  Disks large homolog 5 (356-364)
acccagcagcgcgacaccgccauccag

SEQ ID NO: 42891 - RNA, 27 nt, Artificial Sequence
  U3 small nucleolar RNA-associated protein 14 homolog A (567-575)
acccagagccccuccgugaagagccug

SEQ ID NO: 42892 - RNA, 27 nt, Artificial Sequence
  Splicing factor 1 (362-370)
acccagagccgccccccguggaugaac

SEQ ID NO: 42893 - RNA, 33 nt, Artificial Sequence
  Serine/threonine-protein kinase VRK1 (378-388)
acccagaccgaggaggccauccagacgcgcagc

SEQ ID NO: 42894 - RNA, 24 nt, Artificial Sequence
  Elongation factor 1-gamma (409-416)
acccagacccuggugcgcgaguac

SEQ ID NO: 42895 - RNA, 27 nt, Artificial Sequence
  Nucleolar protein 58 (259-267)
acccaggugaucgagaucagcgaguac

SEQ ID NO: 42896 - RNA, 27 nt, Artificial Sequence
  Lon protease homolog 2, peroxisomal (556-564)
acccgcgaggccggcgugcggagccug

SEQ ID NO: 42897 - RNA, 33 nt, Artificial Sequence
  Fibronectin type III domain-containing protein 3B (182-192)
acccgcgaggaccaguacagcaagcccccgcac

SEQ ID NO: 42898 - RNA, 27 nt, Artificial Sequence
  Myotubularin-related protein 10 (495-503)
acccgcaucagccuguucggcaccuuc

SEQ ID NO: 42899 - RNA, 27 nt, Artificial Sequence
  Uncharacterized protein DKFZp434B061 (517-525)
acccgcagccccccgaccgccucccug

SEQ ID NO: 42900 - RNA, 27 nt, Artificial Sequence
  Putative coiled-coil-helix-coiled-coil-helix domain-containing protein CHCHD2P9, mitochondrial (9-17)
accagccgcauggcccccccggccucc

SEQ ID NO: 42901 - RNA, 30 nt, Artificial Sequence
  Splicing factor 1 (361-370)
accacccagagccgccccccguggaugaac

SEQ ID NO: 42902 - RNA, 27 nt, Artificial Sequence
  Ubiquitin carboxyl-terminal hydrolase 22 (424-432)
accuacgugagcuucccccuggagcuc

SEQ ID NO: 42903 - RNA, 27 nt, Artificial Sequence
  Ataxin-7 (448-456)
guggagaagcaccugaacgcccagcuc

SEQ ID NO: 42904 - RNA, 27 nt, Artificial Sequence
  X-ray repair cross-complementing protein 6 (231-239)
gugcacuucgaggagagcuccaagcug

SEQ ID NO: 42905 - RNA, 27 nt, Artificial Sequence
  Sorting nexin-19 (246-254)
gugauccugccccucaucagccgccug

SEQ ID NO: 42906 - RNA, 27 nt, Artificial Sequence
  Eukaryotic translation initiation factor 3 subunit G (59-67)
gugaucaacggcaacaucaagaccguc

SEQ ID NO: 42907 - RNA, 27 nt, Artificial Sequence
  Inositol-tetrakisphosphate 1-kinase (261-269)
gugauccgcgagcugagccgggcccuc

SEQ ID NO: 42908 - RNA, 27 nt, Artificial Sequence
  Serine/threonine-protein phosphatase 2A 65 kDa regulatory subunit A beta isoform (174-182)
gugaaggccgagauccgccagcaguuc

SEQ ID NO: 42909 - RNA, 27 nt, Artificial Sequence
  T-complex protein 1 subunit theta (234-242)
gugaaggacgccaagaucgccgucuac

SEQ ID NO: 42910 - RNA, 27 nt, Artificial Sequence
  Nodal modulator 2 (43-51)
gugaagagcgacgucgagaucaacuac

SEQ ID NO: 42911 - RNA, 27 nt, Artificial Sequence
  Elongation factor 2 (480-488)
gugaagaccggcaccaucacgaccuuc

SEQ ID NO: 42912 - RNA, 27 nt, Artificial Sequence
  Alpha/beta hydrolase domain-containing protein 14B (150-158)
gugaagacccccgcccugaucgucuac

SEQ ID NO: 42913 - RNA, 27 nt, Artificial Sequence
  Eukaryotic translation initiation factor 3 subunit E (278-286)
gugaaggucauccagcaggagagcuac

SEQ ID NO: 42914 - RNA, 27 nt, Artificial Sequence
  Exocyst complex component 3 (40-48)
gugcugcagcgcagccucgucaccgug

SEQ ID NO: 42915 - RNA, 27 nt, Artificial Sequence
  HLA class II histocompatibility antigen, DRB1-11 beta chain (21-29)
gugcugagcuccccccucgcccuggcc

SEQ ID NO: 42916 - RNA, 27 nt, Artificial Sequence
  Cytoplasmic dynein 1 heavy chain 1 (1684-1692)
gugauguucaagacccccgucagcauc

SEQ ID NO: 42917 - RNA, 27 nt, Artificial Sequence
  HEAT repeat-containing protein 1 (171-179)
gugccccuggccaagggcacccucauc

SEQ ID NO: 42918 - RNA, 27 nt, Artificial Sequence
  DNA-(apurinic or apyrimidinic site) lyase (172-180)
gugcccaacgccggccgcgggcugguc

SEQ ID NO: 42919 - RNA, 27 nt, Artificial Sequence
  DDB1- and CUL4-associated factor 13 (189-197)
gugccccgcgaguacauccgggcccug

SEQ ID NO: 42920 - RNA, 30 nt, Artificial Sequence
  Transketolase (505-514)
gugccccgcagcggcaagccggccgagcug

SEQ ID NO: 42921 - RNA, 27 nt, Artificial Sequence
  Calcineurin-binding protein cabin-1 (1016-1024)
gugccccgcaccgagcggccggcccug

SEQ ID NO: 42922 - RNA, 27 nt, Artificial Sequence
  ATP-dependent RNA helicase DDX24 (664-672)
gugccccgcaccagcgagaucuacguc

SEQ ID NO: 42923 - RNA, 27 nt, Artificial Sequence
  Transient receptor potential cation channel subfamily V member 2 (284-292)
gugcagcuggaggacauccgcaaccuc

SEQ ID NO: 42924 - RNA, 27 nt, Artificial Sequence
  Putative eukaryotic translation initiation factor 2 subunit 3-like protein (234-242)
guggucugcgaguacaucgugaagaag

SEQ ID NO: 42925 - RNA, 27 nt, Artificial Sequence
  ATP-citrate synthase (56-64)
guggucaagcccgaccagcugaucaag

SEQ ID NO: 42926 - RNA, 27 nt, Artificial Sequence
  U4/U6 small nuclear ribonucleoprotein Prp31 (433-441)
guggucuacggcgggaagagcaccauc

SEQ ID NO: 42927 - RNA, 27 nt, Artificial Sequence
  Integrin beta-7 (770-778)
uggaagcaggacagcaacccccuguac

SEQ ID NO: 42928 - RNA, 24 nt, Artificial Sequence
  Heterogeneous nuclear ribonucleoprotein U (421-428)
uacgccaagaacggccaggaccug

SEQ ID NO: 42929 - RNA, 27 nt, Artificial Sequence
  Eukaryotic translation initiation factor 2 subunit 3 (83-91)
uacgccaacgccaagaucuacaagcug

SEQ ID NO: 42930 - RNA, 27 nt, Artificial Sequence
  Pyruvate kinase PKM (83-91)
uaccacgccgagaccaucaagaacgug

SEQ ID NO: 42931 - RNA, 27 nt, Artificial Sequence
  Interferon-induced GTP-binding protein Mx1 (584-592)
uaccaccaggaggccagcaagcgcauc

SEQ ID NO: 42932 - RNA, 30 nt, Artificial Sequence
  60S ribosomal protein L15 (53-62)
uacaaggccaagcagggcuacgugaucuac

SEQ ID NO: 42933 - RNA, 27 nt, Artificial Sequence
  Bifunctional glutamate/proline-tRNA ligase (791-799)
uacaaggagaagaccggccaggaguac

SEQ ID NO: 42934 - RNA, 30 nt, Artificial Sequence
  Eukaryotic translation initiation factor 3 subunit G (70-79)
uacaagaucgacgaggacggcaagaaguuc

SEQ ID NO: 42935 - RNA, 27 nt, Artificial Sequence
  Elongation factor 1-alpha 1 (254-262)
uacaagaucggcgggaucggcaccgug

SEQ ID NO: 42936 - RNA, 24 nt, Artificial Sequence
  Coatomer subunit alpha (73-80)
uacaagaucaagguguggaacuac

SEQ ID NO: 42937 - RNA, 24 nt, Artificial Sequence
  60S ribosomal protein L5 (219-226)
uacaagaagcaguucagccaguac

SEQ ID NO: 42938 - RNA, 27 nt, Artificial Sequence
  Eukaryotic translation initiation factor 3 subunit B (253-261)
uacaagcuggacaagcagcacaccuuc

SEQ ID NO: 42939 - RNA, 27 nt, Artificial Sequence
  Cathepsin B (219-227)
uacaagcaggacaagcacuacggcuac

SEQ ID NO: 42940 - RNA, 36 nt, Artificial Sequence
  Peroxisomal carnitine O-octanoyltransferase (254-265)
uaccugaucggccucgaccccgagaaccuggcccug

SEQ ID NO: 42941 - RNA, 27 nt, Artificial Sequence
  Putative ATP-dependent RNA helicase DDX11-like protein 8 (448-456)
uaccugcucgagaaguucguggccguc

SEQ ID NO: 42942 - RNA, 30 nt, Artificial Sequence
  G1/S-specific cyclin-E1 (243-252)
uaccugaacgaccuccacgaggugcugcug

SEQ ID NO: 42943 - RNA, 27 nt, Artificial Sequence
  DNA replication complex GINS protein PSF1 (79-87)
uaccuguacgaccgccuccugcggauc

SEQ ID NO: 42944 - RNA, 27 nt, Artificial Sequence
  Adenomatous polyposis coli protein (899-907)
uaccccgccgaccuggcccacaagauc

SEQ ID NO: 42945 - RNA, 27 nt, Artificial Sequence
  Cathepsin D (203-211)
uacccccgcaucagcgugaacaacguc

SEQ ID NO: 42946 - RNA, 27 nt, Artificial Sequence
  Dolichyl-diphosphooligosaccharide-proteinosyltransferase subunit 2 (53-61)
uacagcaucgugggccuguccagccuc

SEQ ID NO: 42947 - RNA, 27 nt, Artificial Sequence
  Staphylococcal nuclease domain-containing protein 1 (178-186)
uacaccaucgagaacccccgccacuuc

SEQ ID NO: 42948 - RNA, 27 nt, Artificial Sequence
  Glycogen synthase kinase-3 beta (134-142)
uacgugcccgagaccgucuaccgcgug

SEQ ID NO: 42949 - RNA, 27 nt, Artificial Sequence
  Titin (24337-24345)
gagagcgaccccaucguggcccaguac

SEQ ID NO: 42950 - RNA, 24 nt, Artificial Sequence
  Thymidylate synthase (255-262)
gcccacaucuaccugaaccacauc

SEQ ID NO: 42951 - RNA, 24 nt, Artificial Sequence
  Store-operated calcium entry-associated regulatory factor (104-111)
gccuacaaguucggcaagaccgug

SEQ ID NO: 42952 - RNA, 27 nt, Artificial Sequence
  Junction plakoglobin (136-144)
gacgccgagcuggccacccgcgcgcuc

SEQ ID NO: 42953 - RNA, 24 nt, Artificial Sequence
  U1 small nuclear ribonucleoprotein 70 kDa (100-107)
gacgccuucaagacccuguucgug

SEQ ID NO: 42954 - RNA, 24 nt, Artificial Sequence
  Interferon-induced helicase C domain-containing protein 1 (514-521)
gacgccuucaccaucaagaccgug

SEQ ID NO: 42955 - RNA, 24 nt, Artificial Sequence
  Gamma-interferon-inducible protein 16 (59-66)
gacgccggccuggggaagcucauc

SEQ ID NO: 42956 - RNA, 27 nt, Artificial Sequence
  Ubiquitin carboxyl-terminal hydrolase 30 (44-52)
gacgcccacgagcuguuccacgugauc

SEQ ID NO: 42957 - RNA, 27 nt, Artificial Sequence
  Ubiquitin carboxyl-terminal hydrolase 51 (682-690)
gacgccaucaucaccaaggccaccauc

SEQ ID NO: 42958 - RNA, 27 nt, Artificial Sequence
  ATP-dependent RNA helicase DDX50 (215-223)
gacgccauccgcagccuggccuccgug

SEQ ID NO: 42959 - RNA, 27 nt, Artificial Sequence
  WD repeat-containing protein 11 (348-356)
gacgccauccgcgugaccaagaccguc

SEQ ID NO: 42960 - RNA, 27 nt, Artificial Sequence
  Protein disulfide-isomerase TMX3 (362-370)
gacgccaagagcaccaucguguccauc

SEQ ID NO: 42961 - RNA, 27 nt, Artificial Sequence
  Cell division cycle protein 16 homolog (426-434)
gacgcccuggagaagaucaaggccauc

SEQ ID NO: 42962 - RNA, 24 nt, Artificial Sequence
  Protein FAM127A (61-68)
gacgcccugaaggugaccuuccuc

SEQ ID NO: 42963 - RNA, 27 nt, Artificial Sequence
  Glucosamine-6-phosphate isomerase 2 (125-133)
gacgcccgcgaggugaugauccugauc

SEQ ID NO: 42964 - RNA, 27 nt, Artificial Sequence
  Little elongation complex subunit 2 (170-178)
gacgcccgccuguucaccgagaagauc

SEQ ID NO: 42965 - RNA, 30 nt, Artificial Sequence
  Myotubularin (299-308)
gacgccuaccacaacgccgagcuguucuuc

SEQ ID NO: 42966 - RNA, 27 nt, Artificial Sequence
  C-Jun-amino-terminal kinase-interacting protein 4 (932-940)
gacgccuacaaggaccagaucagcgug

SEQ ID NO: 42967 - RNA, 27 nt, Artificial Sequence
  Interleukin-1 receptor accessory protein-like 1 (406-414)
gacgccuaccugagcuacaccaaggug

SEQ ID NO: 42968 - RNA, 24 nt, Artificial Sequence
  T-complex protein 1 subunit eta (49-56)
gacggcgccaccauccugaagcuc

SEQ ID NO: 42969 - RNA, 24 nt, Artificial Sequence
  Non-specific lipid-transfer protein (348-355)
gacggcuucaaggccaaccuggug

SEQ ID NO: 42970 - RNA, 24 nt, Artificial Sequence
  Ankyrin-1 (176-183)
gacggcuucaccccccuggccgug

SEQ ID NO: 42971 - RNA, 24 nt, Artificial Sequence
  Transmembrane protein 106C (116-123)
gacggcaucaagguggucaaggug

SEQ ID NO: 42972 - RNA, 24 nt, Artificial Sequence
  Retrotransposon-derived protein PEG10 (644-651)
gacggccugaucacccccaccauc

SEQ ID NO: 42973 - RNA, 27 nt, Artificial Sequence
  Phosphatidate phosphatase LPIN1 (456-464)
gacggccugcgcgaccuccccagcauc

SEQ ID NO: 42974 - RNA, 24 nt, Artificial Sequence
  Phosphatidylinositol transfer protein alpha isoform (159-166)
gaccccgccaaguucaagagcauc

SEQ ID NO: 42975 - RNA, 27 nt, Artificial Sequence
  Structural maintenance of chromosomes protein 3 (21-29)
gaccccuucagcuccaagcacaacgug

SEQ ID NO: 42976 - RNA, 24 nt, Artificial Sequence
  Interferon regulatory factor 4 (120-127)
gaccccuacaagguguaccgcauc

SEQ ID NO: 42977 - RNA, 27 nt, Artificial Sequence
  Interferon regulatory factor 4 (120-128)
gaccccuacaagguguaccgcaucguc

SEQ ID NO: 42978 - RNA, 24 nt, Artificial Sequence
  Plectin (4002-4009)
gaccccuacagcggcaagcugauc

SEQ ID NO: 42979 - RNA, 27 nt, Artificial Sequence
  All-trans-retinol 13,14-reductase (23-31)
aucgccuuccacaccauccccgugauc

SEQ ID NO: 42980 - RNA, 27 nt, Artificial Sequence
  Putative pre-mRNA-splicing factor ATP-dependent RNA helicase DHX16 (412-420)
aucgccaaccaccaggugcugaucauc

SEQ ID NO: 42981 - RNA, 27 nt, Artificial Sequence
  RNA-binding protein 12 (28-36)
auccccgacggcggggugcacaucguc

SEQ ID NO: 42982 - RNA, 27 nt, Artificial Sequence
  Integrator complex subunit 4 (508-516)
auccccuucagcaagccggugaagguc

SEQ ID NO: 42983 - RNA, 33 nt, Artificial Sequence
  14-3-3 protein zeta/delta (126-136)
auccccaacgccagccaggccgaguccaaggug

SEQ ID NO: 42984 - RNA, 24 nt, Artificial Sequence
  U5 small nuclear ribonucleoprotein 200 kDa helicase (821-828)
cugcccgcccacaccgugaucauc

SEQ ID NO: 42985 - RNA, 24 nt, Artificial Sequence
  Transportin-2 (392-399)
cugccccaccuccugccgcugcuc

SEQ ID NO: 42986 - RNA, 27 nt, Artificial Sequence
  Histone-lysine N-methyltransferase SETD1A (1210-1218)
cugccccucgaccacgccagccuggug

SEQ ID NO: 42987 - RNA, 27 nt, Artificial Sequence
  Polyhomeotic-like protein 3 (456-464)
cugccccucccggccagccccgugguc

SEQ ID NO: 42988 - RNA, 24 nt, Artificial Sequence
  Microphthalmia-associated transcription factor (107-114)
cugcccccgcccggccucaccauc

SEQ ID NO: 42989 - RNA, 24 nt, Artificial Sequence
  Flotillin-2 (345-352)
cugccccagaucgccgccaagauc

SEQ ID NO: 42990 - RNA, 27 nt, Artificial Sequence
  G1/S-specific cyclin-D3 (98-106)
cugccccgcgaccggcaggcccucgug

SEQ ID NO: 42991 - RNA, 27 nt, Artificial Sequence
  Cyclic AMP-dependent transcription factor ATF-6 beta (296-304)
cugccccgcccggagcggaagagcauc

SEQ ID NO: 42992 - RNA, 33 nt, Artificial Sequence
  Charged multivesicular body protein 2b (147-157)
cugcccagcgccuccaccagcaaggccaccauc

SEQ ID NO: 42993 - RNA, 24 nt, Artificial Sequence
  Msx2-interacting protein (1295-1302)
cugcccuacagcaacaucaccgug

SEQ ID NO: 42994 - RNA, 24 nt, Artificial Sequence
  LIM domain kinase 2 (146-153)
cugcccuacagcgugacccucauc

SEQ ID NO: 42995 - RNA, 27 nt, Artificial Sequence
  Isoleucine-tRNA ligase, cytoplasmic (986-994)
auggcccgcgaggugaucaaccggauc

SEQ ID NO: 42996 - RNA, 24 nt, Artificial Sequence
  Probable ATP-dependent RNA helicase DHX37 (780-787)
aacgccuacaagaccccccugcuc

SEQ ID NO: 42997 - RNA, 27 nt, Artificial Sequence
  Ubiquitin D (25-33)
aaccccuacgacagcgugaagaagauc

SEQ ID NO: 42998 - RNA, 30 nt, Artificial Sequence
  Host cell factor 1 (1378-1387)
cccgacgccaccagcucccaccgcaccgug

SEQ ID NO: 42999 - RNA, 24 nt, Artificial Sequence
  Queuine tRNA-ribosyltransferase subunit QTRTD1 (121-128)
cccgaggacaagccgcgccugauc

SEQ ID NO: 43000 - RNA, 27 nt, Artificial Sequence
  Zinc finger and BTB domain-containing protein 7B (219-227)
ccccugccgcccccccccccgcccccc

SEQ ID NO: 43001 - RNA, 24 nt, Artificial Sequence
  E3 ubiquitin-protein ligase UBR5 (666-673)
cccgugggcaagguccugaaggug

SEQ ID NO: 43002 - RNA, 27 nt, Artificial Sequence
  Probable ATP-dependent RNA helicase DDX5 (308-316)
agcgccaaccacaacauccugcagauc

SEQ ID NO: 43003 - RNA, 24 nt, Artificial Sequence
  Lys-63-specific deubiquitinase BRCC36 (236-243)
agcgccguggagcugcccaagauc

SEQ ID NO: 43004 - RNA, 27 nt, Artificial Sequence
  A-kinase anchor protein 9 (740-748)
agcgacgccuaccagacccgcgagauc

SEQ ID NO: 43005 - RNA, 27 nt, Artificial Sequence
  WD repeat-containing protein 35 (500-508)
accgccagcgacaagauccugaucgug

SEQ ID NO: 43006 - RNA, 24 nt, Artificial Sequence
  Ubiquitin carboxyl-terminal hydrolase 36 (521-528)
acccccacccacaugccgacgauc

SEQ ID NO: 43007 - RNA, 27 nt, Artificial Sequence
  DNA damage-binding protein 1 (463-471)
guggcccaccagcagcugauccagauc

SEQ ID NO: 43008 - RNA, 27 nt, Artificial Sequence
  Something about silencing protein 10 (290-298)
gugcccgcccacggccacccggucauc

SEQ ID NO: 43009 - RNA, 27 nt, Artificial Sequence
  RING finger protein unkempt homolog (549-557)
gugccccacccgggcagcaucaccauc

SEQ ID NO: 43010 - RNA, 27 nt, Artificial Sequence
  Ecto-NOX disulfide-thiol exchanger 1 (100-108)
gugcccccgcccccccccaccgagguc

SEQ ID NO: 43011 - RNA, 27 nt, Artificial Sequence
  Epidermal growth factor receptor kinase substrate 8 (711-719)
gugccccgccagaacgucccggugauc

SEQ ID NO: 43012 - RNA, 24 nt, Artificial Sequence
  NEDD8-conjugating enzyme Ubc12 (86-93)
uacccccacgacccgcccaaggug

SEQ ID NO: 43013 - RNA, 24 nt, Artificial Sequence
  Protein SMG7 (359-366)
uacccccugccggccgugaagguc

SEQ ID NO: 43014 - RNA, 24 nt, Artificial Sequence
  Nicotinamide phosphoribosyltransferase (26-33)
uaccccccgaacaccagcaaggug

SEQ ID NO: 43015 - RNA, 27 nt, Artificial Sequence
  E3 ubiquitin-protein ligase RNF144A (27-35)
uaccccguggagcagaugaccaccauc

SEQ ID NO: 43016 - RNA, 24 nt, Artificial Sequence
  Elongation of very long chain fatty acids protein 1 (202-209)
uaccccgugaucauccaccugauc

SEQ ID NO: 43017 - RNA, 27 nt, Artificial Sequence
  Mediator of RNA polymerase II transcription subunit 15 (438-446)
gcccgcaccccccagaacuucagcgug

SEQ ID NO: 43018 - RNA, 30 nt, Artificial Sequence
  Tubulin beta chain (335-344)
gccguguuccgcggccggaugagcaugaag

SEQ ID NO: 43019 - RNA, 48 nt, Artificial Sequence
  Myosin regulatory light chain 12A (110-125)
gacgaggaggccaccggcaccauccaggaggacuaccugcgcgagcuc

SEQ ID NO: 43020 - RNA, 48 nt, Artificial Sequence
  MARCKS-related protein (153-168)
gagccccaggccaagggcgccgaggcgagcgccgccuccgaggaggag

SEQ ID NO: 43021 - RNA, 27 nt, Artificial Sequence
  Cytochrome c oxidase subunit 7C, mitochondrial (49-57)
uucgccacccccuuccuggugguccgc

SEQ ID NO: 43022 - RNA, 57 nt, Artificial Sequence
  Cytochrome c oxidase subunit 8A, mitochondrial (26-44)
uuccugcuccccgccggcuggauccugagccaccuggagaccuaccgccggccggag

SEQ ID NO: 43023 - RNA, 45 nt, Artificial Sequence
  Disintegrin and metalloproteinase domain-containing protein 10 (292-306)
uuccccaacaucggcguggagaaguuccuggagcucaacagcgag

SEQ ID NO: 43024 - RNA, 27 nt, Artificial Sequence
  Hermansky-Pudlak syndrome 5 protein (380-388)
uuccagaacagcgugaucgccucccgc

SEQ ID NO: 43025 - RNA, 30 nt, Artificial Sequence
  NADH dehydrogenase (ubiquinone) flavoprotein 3, mitochondrial (107-116)
uucaccgacgagggcgugcccaaguuccug

SEQ ID NO: 43026 - RNA, 48 nt, Artificial Sequence
  Myristoylated alanine-rich C-kinase substrate (191-206)
ggcgggaaggacgaggccgccggcggggcggccgccgccgccgcggag

SEQ ID NO: 43027 - RNA, 39 nt, Artificial Sequence
  Heat shock cognate 71 kDa protein (484-496)
ggcauccugaacgugagcgccgucgacaaguccaccggg

SEQ ID NO: 43028 - RNA, 48 nt, Artificial Sequence
  Heat shock cognate 71 kDa protein (484-499)
ggcauccugaacgugagcgccgucgacaaguccaccgggaaggagaac

SEQ ID NO: 43029 - RNA, 45 nt, Artificial Sequence
  Myristoylated alanine-rich C-kinase substrate (192-206)
ggcaaggacgaggccgccgggggcgcggccgccgccgccgcggag

SEQ ID NO: 43030 - RNA, 48 nt, Artificial Sequence
  Gamma-secretase C-terminal fragment 59 (185-200)
ggcagcgaggacaagguggucgagguggccgaggaggaggagguggcc

SEQ ID NO: 43031 - RNA, 24 nt, Artificial Sequence
  26S proteasome non-ATPase regulatory subunit 12 (115-122)
aucaccgaccugcccaucaagcuc

SEQ ID NO: 43032 - RNA, 42 nt, Artificial Sequence
  Myristoylated alanine-rich C-kinase substrate (193-206)
aaggacgaggccgccggcggggcggccgccgccgccgcggag

SEQ ID NO: 43033 - RNA, 51 nt, Artificial Sequence
  NEDD4 family-interacting protein 1 (63-79)
aagcccccgagcuacaacguggccaccacccugcccuccuacgacgaggcc

SEQ ID NO: 43034 - RNA, 42 nt, Artificial Sequence
  HLA class I histocompatibility antigen, A-24 alpha chain (143-156)
aagcgcaagugggaggccgcccacguggcggagcagcagcgg

SEQ ID NO: 43035 - RNA, 39 nt, Artificial Sequence
  Glyceraldehyde-3-phosphate dehydrogenase (27-39)
aagguggacaucgucgccaucaacgaccccuucaucgac

SEQ ID NO: 43036 - RNA, 54 nt, Artificial Sequence
  Cytochrome c oxidase subunit 8A, mitochondrial (27-44)
cugcuccccgccggcuggauccugagccaccuggagaccuaccgccggccggag

SEQ ID NO: 43037 - RNA, 42 nt, Artificial Sequence
  HLA class I histocompatibility antigen, Cw-7 alpha chain (154-167)
cugcgcagcuggaccgccgccgacaccgcggcccagaucacg

SEQ ID NO: 43038 - RNA, 48 nt, Artificial Sequence
  HLA class I histocompatibility antigen, B-15 alpha chain (239-254)
cugaccuggcagcgcgacggcgaggaccagacccaggacacggagcuc

SEQ ID NO: 43039 - RNA, 54 nt, Artificial Sequence
  HLA class I histocompatibility antigen, B-15 alpha chain (239-256)
cugaccuggcagcgcgacggcgaggaccagacccaggacacggagcucguggag

SEQ ID NO: 43040 - RNA, 69 nt, Artificial Sequence
  NADH dehydrogenase (ubiquinone) 1 alpha subcomplex subunit 8 (150-172)
cccagcccggagaucgagggcgaccugcagcccgccacccacgggucccgcuucuacuucuggaccaag

SEQ ID NO: 43041 - RNA, 27 nt, Artificial Sequence
  Probable ATP-dependent RNA helicase DDX47 (371-379)
cagcgcaucgagcaccugaucggcaag

SEQ ID NO: 43042 - RNA, 30 nt, Artificial Sequence
  Ras GTPase-activating-like protein IQGAP3 (482-491)
cagcgcuacuucgacgcccugcucaagcug

SEQ ID NO: 43043 - RNA, 27 nt, Artificial Sequence
  Prelamin-A/C (213-221)
cagagccgcauccggaucgacucccug

SEQ ID NO: 43044 - RNA, 27 nt, Artificial Sequence
  Proteasome subunit beta type-2 (170-178)
cgcuucauccugaaccuccccaccuuc

SEQ ID NO: 43045 - RNA, 30 nt, Artificial Sequence
  Unconventional myosin-IXa (1043-1052)
cgccaggccagcgugaucauccagcgguuc

SEQ ID NO: 43046 - RNA, 36 nt, Artificial Sequence
  DNA polymerase delta subunit 3 (416-427)
cgccaggugagcaucaccggcuucuuccagcggaag

SEQ ID NO: 43047 - RNA, 30 nt, Artificial Sequence
  Calcipressin-1 (161-170)
cgccggcccgaguacaccccgauccaccug

SEQ ID NO: 43048 - RNA, 45 nt, Artificial Sequence
  Glyceraldehyde-3-phosphate dehydrogenase (25-39)
agcggcaagguggacaucgucgccaucaacgaccccuucaucgac

SEQ ID NO: 43049 - RNA, 27 nt, Artificial Sequence
  Mitotic checkpoint serine/threonine-protein kinase BUB1 beta (486-494)
agccagaagauccccggcaugacccug

SEQ ID NO: 43050 - RNA, 45 nt, Artificial Sequence
  HLA class I histocompatibility antigen, B-15 alpha chain (155-169)
agcuccuggaccgccgccgacaccgcggcccagaucacgcagcgc

SEQ ID NO: 43051 - RNA, 33 nt, Artificial Sequence
  L-lactate dehydrogenase A chain (255-265)
agcguggccgaccuggccgaguccaucaugaag

SEQ ID NO: 43052 - RNA, 45 nt, Artificial Sequence
  IST1 homolog (278-292)
acccccccgagcuacgaguccguggacgacaucaacgccgacaag

SEQ ID NO: 43053 - RNA, 48 nt, Artificial Sequence
  IST1 homolog (278-293)
acccccccgagcuacgaguccguggacgacaucaacgccgacaagaac

SEQ ID NO: 43054 - RNA, 27 nt, Artificial Sequence
  Palladin (534-542)
guggccgacggcuaccccguccgccug

SEQ ID NO: 43055 - RNA, 30 nt, Artificial Sequence
  Interferon-induced transmembrane protein 2 (89-98)
gugggcgacgucaccggggcccaggccuac

SEQ ID NO: 43056 - RNA, 60 nt, Artificial Sequence
  78 kDa glucose-regulated protein (425-444)
gugcccaccaagaagagccagaucuucuccaccgccagcgacaaccagccgacggucacc

SEQ ID NO: 43057 - RNA, 63 nt, Artificial Sequence
  Cytochrome c oxidase subunit 8A, mitochondrial (24-44)
gugaccuuccugcuccccgccggcuggauccugagccaccuggagaccuaccgccggccggag

SEQ ID NO: 43058 - RNA, 42 nt, Artificial Sequence
  Alpha-enolase (70-83)
guggucaucggcauggacguggccgccagcgaguucuuccgc

SEQ ID NO: 43059 - RNA, 48 nt, Artificial Sequence
  HLA class I histocompatibility antigen, B-15 alpha chain (241-256)
uggcagcgcgacggcgaggaccagacccaggacaccgagcugguggag

SEQ ID NO: 43060 - RNA, 42 nt, Artificial Sequence
  Vesicle-fusing ATPase (118-131)
gccgccgaguucauccagcaguucaacaaccaggcguucagc

SEQ ID NO: 43061 - RNA, 45 nt, Artificial Sequence
  Moesin (14-28)
gccgagcuggaguucgccauccagcccaacaccaccggcaagcag

SEQ ID NO: 43062 - RNA, 48 nt, Artificial Sequence
  Moesin (13-28)
gacgccgagcuggaguucgccauccagcccaacaccaccggcaagcag

SEQ ID NO: 43063 - RNA, 45 nt, Artificial Sequence
  Dihydropyrimidinase-related protein 2 (340-354)
gacgagaaccaguucguggccgucaccagcaccaacgccgcgaag

SEQ ID NO: 43064 - RNA, 48 nt, Artificial Sequence
  Dihydropyrimidinase-related protein 2 (340-355)
gacgagaaccaguucguggccgucaccagcaccaacgccgcgaaggug

SEQ ID NO: 43065 - RNA, 33 nt, Artificial Sequence
  Putative ATP-dependent RNA helicase DHX33 (87-97)
gaggccaucagcgacucccugcuccgcaaguac

SEQ ID NO: 43066 - RNA, 27 nt, Artificial Sequence
  Ubiquitin-associated protein 2-like (88-96)
gagggcaaccccgacacccacagcugg

SEQ ID NO: 43067 - RNA, 42 nt, Artificial Sequence
  Moesin (15-28)
gagcuggaguucgccauccagcccaacaccaccggcaagcag

SEQ ID NO: 43068 - RNA, 48 nt, Artificial Sequence
  Acylamino-acid-releasing enzyme (440-455)
ggccaggacagcauccugucccuccccgggaacgugggccaccaggac

SEQ ID NO: 43069 - RNA, 45 nt, Artificial Sequence
  Serine/threonine-protein phosphatase 2A 65 kDa regulatory subunit A alpha isoform (202-216)
aagagcgagaucauccccauguucuccaaccuggccagcgacgag

SEQ ID NO: 43070 - RNA, 27 nt, Artificial Sequence
  60 kDa heat shock protein, mitochondrial (397-405)
cugagcgacggcguggccguccucaag

SEQ ID NO: 43071 - RNA, 42 nt, Artificial Sequence
  Disintegrin and metalloproteinase domain-containing protein 10 (83-96)
agcgacgaguucaagguggagaccuccaacaagguccuggac

SEQ ID NO: 43072 - RNA, 45 nt, Artificial Sequence
  Peptidyl-prolyl cis-trans isomerase A (77-91)
agcaucuacggcgagaaguucgaggacgagaacuucauccugaag

SEQ ID NO: 43073 - RNA, 48 nt, Artificial Sequence
  Serine/threonine-protein phosphatase 2A 65 kDa regulatory subunit A alpha isoform (201-216)
gugaagagcgagaucauccccauguucuccaaccuggccagcgacgag

SEQ ID NO: 43074 - RNA, 51 nt, Artificial Sequence
  Serine/threonine-protein phosphatase 2A 65 kDa regulatory subunit A alpha isoform (201-217)
gugaagagcgagaucauccccauguucuccaaccuggccagcgacgagcag

SEQ ID NO: 43075 - RNA, 42 nt, Artificial Sequence
  Solute carrier family 2, facilitated glucose transporter member 1 (140-153)
gugcccauguacgucggcgaggugagcccgaccgcccugcgc

SEQ ID NO: 43076 - RNA, 45 nt, Artificial Sequence
  Glyceraldehyde-3-phosphate dehydrogenase (116-130)
gccaagcgcgugaucaucagcgcccccuccgcggacgccccgaug

SEQ ID NO: 43077 - RNA, 45 nt, Artificial Sequence
  Glyceraldehyde-3-phosphate dehydrogenase (202-216)
gcccugcagaacaucauccccgccagcaccggcgcggccaaggcc

SEQ ID NO: 43078 - RNA, 45 nt, Artificial Sequence
  60 kDa heat shock protein, mitochondrial (35-49)
gacgcccgcgcccugaugcuccagggcguggaccugcuggcggac

SEQ ID NO: 43079 - RNA, 45 nt, Artificial Sequence
  Tubulin beta-4B chain (22-36)
gaggugaucagcgacgagcacggcaucgaccccaccgggaccuac

SEQ ID NO: 43080 - RNA, 45 nt, Artificial Sequence
  Glyceraldehyde-3-phosphate dehydrogenase (269-283)
aucagcugguacgacaacgaguucggcuacuccaaccgcgugguc

SEQ ID NO: 43081 - RNA, 24 nt, Artificial Sequence
  RNA cytidine acetyltransferase (478-485)
gacgcccccgcccaccaccuguuc
